United States Patent 6,812,339 (POLYMORPHISMS IN KNOWN GENES ASSOCIATED WITH HUMAN DISEASE, METHODS OF DETECTION AND USES THEREOF) - sequence listing, part 94

SEQ ID NO: 82639 - DNA, 601 bp, Human
aacaatatccagatcggtgagtgagggggcagcctggggagggactttctgggtctggccagggatttttttggggataggggttgtgtaccccctccccggtactgactgttttgcttggctccctaaagctgtgctgcggtaacagaagggagacttgggcttacagccagaggagggggcttctcctgatcggatgaggggcagaggggaagtgttcacacacgcacacataccctactcgcactccaggcaagagcatgtgaaatggaggaaccatcgctttggaggaaaaaaaaaatcaggctggaaagggtggtgggtgtttaaggagttaactctattgcttggtagatggtgcttgattccatttttaatgtaagtatgtatggtgtgtgtgttttcacgtgtgtgattatatattacatatgcacatatatatgtaattgaaggaggcagtgctttctctgctgggggacagaaaagagaccctcgagaagaaggagtgaggggtgctgggtatattgcagccactgaaataatgccagaaggcccccactccaaggcgggtaggctccctctcctgttctggactcctcca

SEQ ID NO: 82640 - DNA, 601 bp, Human
atttttaatgtaagtatgtatggtgtgtgtgttttcacgtgtgtgattatatattacatatgcacatatatatgtaattgaaggaggcagtgctttctctgctgggggacagaaaagagaccctcgagaagaaggagtgaggggtgctgggtatattgcagccactgaaataatgccagaaggcccccactccaaggcgggtaggctccctctcctgttctggactcctccagctgccttctctttgctgtctgccatgctgcgctggtggtctccactcccccgatcctggaacttcctmgcctgccttttctccgttccttccttgccccctcctcttagatttcctatccacagaggtctaccttttacacacacaaacacacacacgtacacatgctcctttctcctcctgttggctctccattatccttgttactgggctccatcctctcaacttggaggcaggtttcaacatgctgcatgctttttttgttccccatttccccttcttagttgttacacttctcaaaggccccgccaccctccctgtatttctgaggggactgacagatattgctactcctgataatcatgaggg

SEQ ID NO: 82641 - DNA, 601 bp, Human
ttctctttgctgtctgccatgctgcgctggtggtctccactcccccgatcctggaacttcctcgcctgccttttctccgttccttccttgccccctcctcttagatttcctatccacagaggtctaccttttacacacacaaacacacacacgtacacatgctcctttctcctcctgttggctctccattatccttgttactgggctccatcctctcaacttggaggcaggtttcaacatgctgcatgctttttttgttccccatttccccttcttagttgttacacttctcaaaggcccygccaccctccctgtatttctgaggggactgacagatattgctactcctgataatcatgagggaaagcaaaacaaacagaagcaataacaccaatcacaaagcatgtccacaagggcttggggcttccgtgtgaccagcatgtcagtgtcgtttgtgtcccggaatgaagcaagctgctgtgtttggaagcatcttcgttggtttggtttctagtctctctcccctggtagggagatagctccactagggaaagttcgcattgctgggagtttgtgctcttttgtgagtgtgtgtttgagg

SEQ ID NO: 82642 - DNA, 601 bp, Human
tctctttgctgtctgccatgctgcgctggtggtctccactcccccgatcctggaacttcctcgcctgccttttctccgttccttccttgccccctcctcttagatttcctatccacagaggtctaccttttacacacacaaacacacacacgtacacatgctcctttctcctcctgttggctctccattatccttgttactgggctccatcctctcaacttggaggcaggtttcaacatgctgcatgctttttttgttccccatttccccttcttagttgttacacttctcaaaggcccckccaccctccctgtatttctgaggggactgacagatattgctactcctgataatcatgagggaaagcaaaacaaacagaagcaataacaccaatcacaaagcatgtccacaagggcttggggcttccgtgtgaccagcatgtcagtgtcgtttgtgtcccggaatgaagcaagctgctgtgtttggaagcatcttcgttggtttggtttctagtctctctcccctggtagggagatagctccactagggaaagttcgcattgctgggagtttgtgctcttttgtgagtgtgtgtttgaggg

SEQ ID NO: 82643 - DNA, 601 bp, Human
catcataatcaagaattttttttgttttcattctttaaaatgggagcacttgtacatgtggaaatcactggctcttacatgtggcattgtttacatttgtgcttatatactacctatcctttgtggcttggaagtgtttgtctagtatatttgtgtatatagtaaatggtataaatgcatgaggatgtttcatgtatgtgctatgttttctcatgtatctctgcatatttttaaaattatatttagccctaacttggttgttcaactgataaagccattgctactgttttcaaaaaaaaaagagattgaagcattaaattgtagaacaaaatgctgaaaatatcactgccatcaggtagtacttgattctatttgtgtgatctgtaacaaaaggcttgcaatccatttattggttcttaaaaacagacacccactctacaagaagttagaagtgcattatgtttggactgtgattactgtcagatttgagataaacttctatgtaaacatcattatagttcagtctctagaaatggctgattttaattcacagaaatgtaattgatttacatgttgacagtaaatacaaaggtaagccatg

SEQ ID NO: 82644 - DNA, 601 bp, Human
catctgaattgaatgcattgtaaaatgtgggcaacaaacaccattctgagttttcctggcaactaggaatgaaaaggaagcctgtgctcacatgattggcttttcatgacagatgaaagcataaaaattaatcaggaaacatattttcccttcagggattaagctcaagtaaaaatttatggcagggaaatgtgagctgaattcacaagaacaatttgagaccccaaactggattgaattggcacgatagtcttggtgtgtcactattgacttggtgacttctgctgagctgtctctggtrgaagtcatggaccatatttcctttgtgtctttctcatagtcccactggtgagttctcaatgatttgaataggctatgctttgaagtctcaaaatgagaagtcagaattctttctatcccaaagaccactcctaaaataatgttgttacaaattccaagaactataattatagcagatttcatttattgagaacttactgtgcatcagaactatgataaatactttatagtcatttatagtcacattcattaccatgtattaagcactgactacagcccatgtaatgcactaattgctttt

SEQ ID NO: 82645 - DNA, 601 bp, Human
tagcagcaggggactaaaaatgaggagaggtggttatatggtagggaaggtggggaagatagaagaggactatggctactactactggccaaggtgagagtttggtgccttcttcgtgttcaatctttcttgcttccctggtctgccattgttaaagagtaaagccattgaatcagcaacccaatgccttgggatctcctttaagcacttttccaagcttacaggggtagagtttggggagattgtgcatagagaagatatttactgatcagctacccagcttattttggtgcctttgtgktaagtgtaaataaaggaataaatgaaatgctgattgagattattactattagaggtctgagtagcatagttgcagcttaattcttaccttttaatttattcacctatttattcattcattcattcagcaagtacatactgaatgcctacttcatgccaaacactgggccagacgctaggaatataggggccaggaaagaaggcacagcctctttccttgtggagctaacagtttagcccagaggttcacaaacttcagtgcacttaaaattcactcagggagcttgtttaaagcaagact

SEQ ID NO: 82646 - DNA, 601 bp, Human
tcaagagtaggccctggaggaattctatagcaattattatggggattacactttaagaatctctttaatctaaaaagtcttccatccctttagtaagcatttttgagccctcaaccaaacctaggcatgacataaagtgctacaaatgcagacaacagtaagttgcattccccaccctggagtactttatccatagtaagacattttctatcctgtaaagagaaaattaaaatgtaatgttgtaagtgctatagcagcaatttgtatggagtattgaagattccttgaagagtggagtttktctctaggaggtggtgattgaattgagcctcaacgataaatagggttatctatctgcagaaggggtcaccaaatatagccatccacaagccagttccagcacagagactgagttctgggcccatacactgtgtaagaaccatggaatttcacattagaacttggacatcttgtcttgactaatatttttaaatattaaaatatctggcaacactagggcccaggtctatgcagcctcaatttgctgagatgggacagagtaaaccccatctacatggcctctttcccaatcagcccattc

SEQ ID NO: 82647 - DNA, 601 bp, Human
cattaagcaaccctaggcccacattcctgcttaacttctattttctagagctgagaagtgctgccctttttaaatacataaactcccaagttaaccaaagtttccattacttcctgtttgattgctagagtaatcaaattatgttgtttgggcaggcctgtaagtaggccaatctactcatacctgatttatatcgtcagcattcatcattttattattttgttctaataatatctattacttaccctgtcaaaaataataaaagacacaaaagatgtataactcctactctcaaaaaaaktagtgtgtatacagtaatgaagagaatggtggctgatggtgggataaacaagaattattttgaagacctactatgtgccaaatactttgcagatgttgtcttaagttttataactatcttgaaaggtgattatccccatttcattgatgatggtactgagactgagagagattgtgtcttctttatattatgcaacaaataaaaacctaagctagtatttaaagccagtttggggggctccaaaactcaatgagcattctccttttaaagatctatgaatatggccaggggcagtggctc

SEQ ID NO: 82648 - DNA, 601 bp, Human
accaaagtttccattacttcctgtttgattgctagagtaatcaaattatgttgtttgggcaggcctgtaagtaggccaatctactcatacctgatttatatcgtcagcattcatcattttattattttgttctaataatatctattacttaccctgtcaaaaataataaaagacacaaaagatgtataactcctactctcaaaaaaattagtgtgtatacagtaatgaagagaatggtggctgatggtgggataaacaagaattattttgaagacctactatgtgccaaatactttgcagrtgttgtcttaagttttataactatcttgaaaggtgattatccccatttcattgatgatggtactgagactgagagagattgtgtcttctttatattatgcaacaaataaaaacctaagctagtatttaaagccagtttggggggctccaaaactcaatgagcattctccttttaaagatctatgaatatggccaggggcagtggctcacacttgtaatcccagcactttggaaggccgaggtgggcagatcatgaggtcaggagattgacaccatcctggctaatacagtgaaaccccat

SEQ ID NO: 82649 - DNA, 601 bp, Human
tttgattgctagagtaatcaaattatgttgtttgggcaggcctgtaagtaggccaatctactcatacctgatttatatcgtcagcattcatcattttattattttgttctaataatatctattacttaccctgtcaaaaataataaaagacacaaaagatgtataactcctactctcaaaaaaattagtgtgtatacagtaatgaagagaatggtggctgatggtgggataaacaagaattattttgaagacctactatgtgccaaatactttgcagatgttgtcttaagttttataactrtcttgaaaggtgattatccccatttcattgatgatggtactgagactgagagagattgtgtcttctttatattatgcaacaaataaaaacctaagctagtatttaaagccagtttggggggctccaaaactcaatgagcattctccttttaaagatctatgaatatggccaggggcagtggctcacacttgtaatcccagcactttggaaggccgaggtgggcagatcatgaggtcaggagattgacaccatcctggctaatacagtgaaaccccatctctactaaaaatacaaaaactt

SEQ ID NO: 82650 - DNA, 601 bp, Human
tggccaggggcagtggctcacacttgtaatcccagcactttggaaggccgaggtgggcagatcatgaggtcaggagattgacaccatcctggctaatacagtgaaaccccatctctactaaaaatacaaaaacttagctgggcgtggtggcacgcacctgtagtcccagctactcaggaggctgaggcaggagaattgcttgaactcaggaggcagaggttgcattgagccaagatcacgccactgcactccagcctggcaacagagcgagaatttgtctcaaaaaaaaaaaaaaaaaaamaaaaaaaactatgaatatatggacagagaaaagtaccatagcagtgaaatagcccaacggtagaagtgtcacagtggaatttatgattcaagcttaagagctaagtcttccaaggcagaagctatgactgtggatgatgaaaacttcttggggaaggtggaactttagcaggcattaaagggtggagcagattttggttgtggagtgggaggagggtattttgagtgggtaaagtcacaatattcctcctcgcctcccctcaaccactgctgcatatgcttgttaccatgtggtggagat

SEQ ID NO: 82651 - DNA, 601 bp, Human
aaacccttttattatcaccttctatggggatatgtactgtcactgccccactccatacctttgtagacagcattagttgattacagaattttttcccactgaatctacacgtggcctcaaattggtgacagctgatgcaagagatgaaatccatttttcattacaaggcattgcactagaaattgagaaaaataaaatgcattaggcattgattttcctcttaaggggctcaggttcttataaaggaaataggcataaaccaaatctgcctctctttctctctctctctctctctctctccccccctcttacatacacacacacacacacacacacacacacacacacacacacacacattcagaggaaggaaggaaaacctttagttggagggatttaggtttcataaaacaaggacatttgagttgaatttggaaagataggtaggatgtagatgggaaaatatatatgtatatatttgtatacacacacacacaccccacacaccttcctgtaatggcaggtttgatgcagtaaatagcatactgagttgagatttgaagacatggattcaaatgctggactaccttcttgaatcgtt

SEQ ID NO: 82652 - DNA, 601 bp, Human
cctcttacatacacacacacacacacacacacacacacacacacacacacacacattcagaggaaggaaggaaaacctttagttggagggatttaggtttcataaaacaaggacatttgagttgaatttggaaagataggtaggatgtagatgggaaaatatatatgtatatatttgtatacacacacacacaccccacacaccttcctgtaatggcaggtttgatgcagtaaatagcatactgagttgagatttgaagacatggattcaaatgctggactaccttcttgaatcgtttagrtataaccttggagaaacatcccctcccccaagcttatttataaaatgaagctcatggtctctgagagtccttctggggctgtatttctatgctggcagcatatggaaaacaccagagatatatgattaatagaagttctctacctttggctagcaagaggatccctaaacaagctaagtgtctaaggaaagctctagacttcccttccaccaacttgcacattcagggcgcattctgtatgcaaatgctgaagcattatgcctactttggggcctcagatgaattcattcaatatttaac

SEQ ID NO: 82653 - DNA, 601 bp, Human
ccgctggactattgtcatgaggggtcctaaataaggtataaggttccatcttctaaataaagaatttctgattcaagccctgggtttgccattgatgtatgagccttgtatgcatcttacgactttggtgtgtcccagcctgctgtccagaaagcacaggggagcccagggccatgggaggtccaggttgaggaggcaggcaaaactggggcaaatgaggcagttggaggctaatgaaattgataccctatggttaggcgtgtttccatgtgttcattgtttggaacctctaggatgaaartaaagtttgagaatagcctttagtttgtctacaaaagtaatatatacattacagaaagctataggaacagagacagcaaacacaataaaacttgtataattatagtactaaggatacattttccatccttttttgaacctaacaatttaaacattaatagatttatcttactgtcttataacatgattttttgcatattacaacctttaggctacttttattattgcacattcatttttaatggtttcataaaagcccactgtacatatgtaccctaatttatttaagctgtctcctttt

SEQ ID NO: 82654 - DNA, 601 bp, Human
cctaaataaggtataaggttccatcttctaaataaagaatttctgattcaagccctgggtttgccattgatgtatgagccttgtatgcatcttacgactttggtgtgtcccagcctgctgtccagaaagcacaggggagcccagggccatgggaggtccaggttgaggaggcaggcaaaactggggcaaatgaggcagttggaggctaatgaaattgataccctatggttaggcgtgtttccatgtgttcattgtttggaacctctaggatgaaaataaagtttgagaatagcctttagtytgtctacaaaagtaatatatacattacagaaagctataggaacagagacagcaaacacaataaaacttgtataattatagtactaaggatacattttccatccttttttgaacctaacaatttaaacattaatagatttatcttactgtcttataacatgattttttgcatattacaacctttaggctacttttattattgcacattcatttttaatggtttcataaaagcccactgtacatatgtaccctaatttatttaagctgtctccttttatgggatatctagtttatttccctt

SEQ ID NO: 82655 - DNA, 601 bp, Human
gatgtcattggataaaacttaggacacatgctcatttctgaatatgacacagtggccaggatattgtagtcttttgcttgacatgggcctagtgaaatcatcatttttagagcttggggtagtgagaagaaccaaaagattgtggatttaagccagcccaccaaaaccatacggacatgggggaggaataattccctcaaagggaatcaggatgctattaccaaaagaatggagattgaatgcttgagaggcaaaatagatatatatatatatttttgtctattaagcatatatatatattcactatctatatatagatgtaaatgtatttattgtctattttatgtatttattgtaaataaatacatttactctctctatatatatattctatctatatatagatgtcccccattgcacatcttttcagaaaagaaaattcagacaggctggagctgaaccaatgcagacaaaaagtcaacatgctaaagtcagaagagccaccaatgagacaagcacatacaagggattctggtgggtaagtcaagatcagaagtcaggacaggcaaaaggtctgaaattcaggcttctgagttaatca

SEQ ID NO: 82656 - DNA, 601 bp, Human
gacatgggcctagtgaaatcatcatttttagagcttggggtagtgagaagaaccaaaagattgtggatttaagccagcccaccaaaaccatacggacatgggggaggaataattccctcaaagggaatcaggatgctattaccaaaagaatggagattgaatgcttgagaggcaaaatagatatatatatatatttttgtctattaagcatatatatatatacactatctatatatagatgtaaatgtatttattgtctattttatgtatttattgtaaataaatacatttactctctctmtatatatattctatctatatatagatgtcccccattgcacatcttttcagaaaagaaaattcagacaggctggagctgaaccaatgcagacaaaaagtcaacatgctaaagtcagaagagccaccaatgagacaagcacatacaagggattctggtgggtaagtcaagatcagaagtcaggacaggcaaaaggtctgaaattcaggcttctgagttaatcaaagctgtaggggtctttggtaatccttgtccagccacgagcaaacctgtgttcacagaacagttagaaagtgctagcca

SEQ ID NO: 82657 - DNA, 601 bp, Human
agatatatatatatatttttgtctattaagcatatatatatatacactatctatatatagatgtaaatgtatttattgtctattttatgtatttattgtaaataaatacatttactctctctatatatatattctatctatatatagatgtcccccattgcacatcttttcagaaaagaaaattcagacaggctggagctgaaccaatgcagacaaaaagtcaacatgctaaagtcagaagagccaccaatgagacaagcacatacaagggattctggtgggtaagtcaagatcagaagtyaggacaggcaaaaggtctgaaattcaggcttctgagttaatcaaagctgtaggggtctttggtaatccttgtccagccacgagcaaacctgtgttcacagaacagttagaaagtgctagccattcacccacatagaagcgactgggaggtggtctctccaggccactctgataataagttgaggttgtcggctgtaaaatgtttggtgatcctgaggcaccaatactctgtcccagtgaccaggacatttcctgctctactcaaacactcaagctattgtgcacaaactctttaacagtc

SEQ ID NO: 82658 - DNA, 601 bp, Human
tgaaggaggctttaacctctgttaaacaagcagagatctcaagctggctcctgtccaaggcaaacagggcagtatggttcttttacataggtcatggatttacaggggactgatatcctaagactaacactgatgaggcacaagactgtaatgattgaaaagtggtttagctacaaaggtcaactgatttgggggaaggtgcacttgtttattcaataattgatatttgtggagcatcgtggtagatgagattattatttggcaattatttctctctccctcaaactccttgggaaaaaaatataacttcctgcttcattaatgtcacatttggtcatttgacatgctctggcaacttagatattagtagatatgtttgaagcagagattatgagaagaacatgccccagagagcctgctcgtctcataggaaaggtaaatacagtaagtagaagtgtcccagtcaacccacagcccacagactaaagtttgaagcagagctatcccagctgacctgaaaatctgtgagcattgtaggaaatgctcaatgttatataccactgaaattggaaatggtttgttttgcagcaatagctggcca

SEQ ID NO: 82659 - DNA, 601 bp, Human
acagtaagtagaagtgtcccagtcaacccacagcccacagactaaagtttgaagcagagctatcccagctgacctgaaaatctgtgagcattgtaggaaatgctcaatgttatataccactgaaattggaaatggtttgttttgcagcaatagctggccaatagaagcaaccagcgtgtgttccacactttgctaggcactgagggaacattggaaatgacagacatagtcctggtctccatggagcactattgtagctaggaagatagacaatgaatacatttacaaataaaatatatakagagagatcattactagggtcataaagaaaataggatgtagtgacatcaccactatggtagagaagaacacctttaaagtaagtggtcaaagaaggcatttcaaaggaggtgacttctgagctcagatataaaagttggaagagagccaaatgagagtaaattcccctgtggaatgtcgaaatccagccccatgggcaacttggattgagaatcttggtctaggcagaggagaatgaggtgccctggaaaaatctcctgcaaactaggtcactcacttgtcttagggcagatactagctt

SEQ ID NO: 82660 - DNA, 601 bp, Human
cctttaaagtaagtggtcaaagaaggcatttcaaaggaggtgacttctgagctcagatataaaagttggaagagagccaaatgagagtaaattcccctgtggaatgtcgaaatccagccccatgggcaacttggattgagaatcttggtctaggcagaggagaatgaggtgccctggaaaaatctcctgcaaactaggtcactcacttgtcttagggcagatactagcttctctctaccacatcacatgtgcaagtcaagggctggcagatcacttgctgccaagactagatggtctcagscattggaagccactgagcatagcaaggcagagagggggaggtatgctagggcattcctaaccatgaggtgatggaattggctatacttcttggcttggctccagaatactcaagagttgttgcttattaggatggcaagaagggtgtgtgtgtgtgtgtgtgtgtgtgtgtgtgtgtgtgtgtgtgttcatacatatattcattctttcacagaggaggaaaatgaactagatggcttctagatccctttccaagtgtgtgattataaaaaggatgctgagatttaaattatgtgtgaag

SEQ ID NO: 82661 - DNA, 601 bp, Human
atttattgaagactatttctgatcatcaagcttcttgtctcaaaaaaatatcagtggcttcccatcttattttaagttcaaactcagactaaaatatgagtctctccataatgggtctctgcctgccttccttttgagacttacctaaaccctacactctatgttccagccaaactagactacctagtgttgccacaaacatgcctctcagtctttcactgctttggtcatactactgattccatctgaaatagtctctaccacattgagcacccactctctactaaaccctggagatacygcagaaaacaaaaccagcaaactccctgtacccttggggtttacgtcctgggaaacaaatacatataatgatttcaaatactagttaaatgatacaaacatagccaaatagagtcatgggacagagagtgagctgtagtgctacattagatgggtggtcagggaggacaggcatcacctgaagagatgatattttaactgagccttgttgcaatccatagaactttctgcagtgttgggagacattctatatctgtgctgtctaatatgtaggcactagcaacatctgcccctattacac

SEQ ID NO: 82662 - DNA, 601 bp, Human
acatgcctctcagtctttcactgctttggtcatactactgattccatctgaaatagtctctaccacattgagcacccactctctactaaaccctggagataccgcagaaaacaaaaccagcaaactccctgtacccttggggtttacgtcctgggaaacaaatacatataatgatttcaaatactagttaaatgatacaaacatagccaaatagagtcatgggacagagagtgagctgtagtgctacattagatgggtggtcagggaggacaggcatcacctgaagagatgatattttaamtgagccttgttgcaatccatagaactttctgcagtgttgggagacattctatatctgtgctgtctaatatgtaggcactagcaacatctgcccctattacacattagaaatgtagtgagcatgactgaggaaccaaatctttcatgtaatttaatttttattaattgtaatttaaaaagtcacatgtggctagtgactgtcatattagacagtgctaatctagattctagaatatttcagacaagaaaaaaaaaacagtaagcataaaggctttaaatgagagtgagtgtatattcaaag

SEQ ID NO: 82663 - DNA, 601 bp, Human
gaacccagggcttttattgacctggttggctgaatcattgtatgtagaggtgaagtaaaggcagtgcaggtgcaggtgcagtcacagatcatgcttttatacttgtggcatgtataggaaatgttgaataagctcatctctggatggggattttagtacgttaataaagggagttcaccaaagttcatctccaactcaggcatctcaaccagtttttgttttttgggcttcttcctggaattttttttgaaacaagaactcaaggtgcaacagttacaagtgtgtaatttctcattgtgtrtacccaacaatctggggaccctgagttataactctttttgctgaatttgtgaataatgtcttgtgatgtttaatcctgttttacatatggtgaaactaaggctgagagcatacacagggatttatctgcagtcaggtagcagccaggtcacgatgctaacacagaacttttgaccgtcacccaaggcctcctactcttccaggctccctgtcaatttttggagccagtcctctaaacagttttacccagaacaaggaattgccggtgatttcagaaagaactggcagactcgggggaggc

SEQ ID NO: 82664 - DNA, 601 bp, Human
gtcttgtgatgtttaatcctgttttacatatggtgaaactaaggctgagagcatacacagggatttatctgcagtcaggtagcagccaggtcacgatgctaacacagaacttttgaccgtcacccaaggcctcctactcttccaggctccctgtcaatttttggagccagtcctctaaacagttttacccagaacaaggaattgccggtgatttcagaaagaactggcagactcgggggaggcacttgccaaattggctcaggctggccttgctgccatgcttcttttcctcgttcctgcraagccagttctaggtaacctacctgcagatgtctaccctgaaataacacccagcctctgttacactgctgttacacacaaacaaacaaagcaaatctgctgcaaaaagaggcaggttgaaataaattatttttagtgcaacatataacgtcaatgtcaaaaatacgaaagaggcaggttgcatagggaggctgaggaggagatgctgagattcagtgtggaaggtgacaagataagaggaggaaagtttgccctggccctgaggcagcaaaattaattttgccccaggcctttaactgag

SEQ ID NO: 82665 - DNA, 601 bp, Human
tatttggaaaggtactgcattttctatggcccaagaggccaaaacacagacaagtgagtacaacatttggtctggcagattttgactccacacgacagagcccattctaagtgtgtggactggctagcagtggcgagggttccctttctctagtctgcaaacctcccaatcaacatggctgttagaaacctggtccttttgcagaattgctttaccacttctaccttgatgacccagtgcctgtgataccaccgttagaaagtcatctaattgcgtttaaacttgttctctccagcatccrttgaatagcaaagacaaatccttctgaccatagttctaattctgtgggctggcactatggatttaattgtgccctcccaaaatccgtttgttaaagccctaacctccagcatgatggtagtgggtttagctgtcgtcatgaggatgtcatcctcataatggattaatactctataagagacaccagaatacttgctctttctctttttctgtgcacatgcaccaaagtaaggtcatgagaacacacagcaagatggcggccattggcaagtcaggaagagaacctcaccatagtggcacc

SEQ ID NO: 82666 - DNA, 601 bp, Human
tctttctctttttctgtgcacatgcaccaaagtaaggtcatgagaacacacagcaagatggcggccattggcaagtcaggaagagaacctcaccatagtggcaccatgatctcgcacttccagtttccagaactgtgaaaaaagaaatttttgttgtttaagtcaccattccatagtatttggttatggcatcctgagctgactaacaccactggtaattaaggtgtttcttccatgaaaaatgaaatgatggtcaataggaagcaaacagaagcttaagcagaagggcagaaaggagtgmatttgggaaccagagggagtcctatagagactagacctgggattttgacagttctgctgagggctggccctgtgcccagcctccttccacttctcttcatctcactagaccaagaaaatatgcacatctgttatccacaaatactctgaattcccccgccaacgcagatccccgggaaaacctaacacaagcagaacagtggaggagatgcacggggtatttggtgtttctcaggaaaaaggcttgattttttgacaccctctatcttggtctcttaatttgtcctgagtcagtgagcca

SEQ ID NO: 82667 - DNA, 601 bp, Human
gtcagtgagccacagtgaagtccagagaaaaaaatggaaataggagaatcgggcttaaacctcagttttgtcgctgattaacctgtgatcttgggcaacccactgatctgttctttgtttcagtttccctccatgaccctgagtactttaatagcctctattctcccatgtatctctgttgaacagatcataaagagtagtgattatgaatccagactttactgttactgtcaaatatcacattaatttcctcagccactttacacctgtgcaacctgaggcaaaattttgtaatatctcagtttcagtttttatagctgtcaaatggggttaataacaatccctatcacaagcagtctttacaggcatggaatgaaaaattgcttgtgaaatgctgagtgtaaggcctattatattcagtaactattacctctattttggttcaacaccattttgcagtctcccccaaacaccctgctgcaacacacctctaagccttggctatgctggcctaaaaaacttctagacacccttgatgacccaaatgaaaatcttctgaacccaaggaatgctttcctggctgtgtaggtggcaagcatca

SEQ ID NO: 82668 - DNA, 601 bp, Human
caacaaagtgactgtagttaataatatattatgtatttcaaaatttctaaaagactggattttaaatgttctcaccacaaagaaatgacaagtatgtgaggttatgaatacgttaattagcctgatttgttcatgccacaatgtatatgtctatcaaaagatcacactgtaacacagaaatagatattatttgtcaattaaaaacaaattttttaaaaaggctatttttcttgctgaatcccacatgtctctggggctagggtagatgtcttttttaaccagattgtgtccagcttagtcyggtgttcaataagcattaagtgtctgaagggtggtcaatggacaaacagatgaagggttgcatagattaatagaagtctaccatatctaggctgggagtggtggctcacacctgtaatcccagcactttgggaggccaaggtgggcggatcatgaggtcaggagattgagaccatcctggctaacacggtgaaaccctgtctctactaaaaatacaaaaaatcagcctgacgtggtggcgggcgcctgtaatcccagctgctcagaaggctaaggcaggagaatcacttgaacctgggag

SEQ ID NO: 82669 - DNA, 601 bp, Human
ttctcaccacaaagaaatgacaagtatgtgaggttatgaatacgttaattagcctgatttgttcatgccacaatgtatatgtctatcaaaagatcacactgtaacacagaaatagatattatttgtcaattaaaaacaaattttttaaaaaggctatttttcttgctgaatcccacatgtctctggggctagggtagatgtcttttttaaccagattgtgtccagcttagtccggtgttcaataagcattaagtgtctgaagggtggtcaatggacaaacagatgaagggttgcatagatkaatagaagtctaccatatctaggctgggagtggtggctcacacctgtaatcccagcactttgggaggccaaggtgggcggatcatgaggtcaggagattgagaccatcctggctaacacggtgaaaccctgtctctactaaaaatacaaaaaatcagcctgacgtggtggcgggcgcctgtaatcccagctgctcagaaggctaaggcaggagaatcacttgaacctgggaggcagagatttcagtgagccaagatcacaccactgcactccagcctgggcaaccgagtgagactctgtc

SEQ ID NO: 82670 - DNA, 601 bp, Human
ccacatgtctctggggctagggtagatgtcttttttaaccagattgtgtccagcttagtccggtgttcaataagcattaagtgtctgaagggtggtcaatggacaaacagatgaagggttgcatagattaatagaagtctaccatatctaggctgggagtggtggctcacacctgtaatcccagcactttgggaggccaaggtgggcggatcatgaggtcaggagattgagaccatcctggctaacacggtgaaaccctgtctctactaaaaatacaaaaaatcagcctgacgtggtggcrggcgcctgtaatcccagctgctcagaaggctaaggcaggagaatcacttgaacctgggaggcagagatttcagtgagccaagatcacaccactgcactccagcctgggcaaccgagtgagactctgtctcaaaaaaataaaaataagaaatctaccatatctacttctcaggcataaatatgataactatttcctttaatttcccattggataaataactgtttataaacatctagttgccagacccatgcttggagtctcagggctaaaagaaatgctccccatttgctctatgtgcta

SEQ ID NO: 82671 - DNA, 601 bp, Human
acctgtaatcccagcactttgggaggccaaggtgggcggatcatgaggtcaggagattgagaccatcctggctaacacggtgaaaccctgtctctactaaaaatacaaaaaatcagcctgacgtggtggcgggcgcctgtaatcccagctgctcagaaggctaaggcaggagaatcacttgaacctgggaggcagagatttcagtgagccaagatcacaccactgcactccagcctgggcaaccgagtgagactctgtctcaaaaaaataaaaataagaaatctaccatatctacttctcwggcataaatatgataactatttcctttaatttcccattggataaataactgtttataaacatctagttgccagacccatgcttggagtctcagggctaaaagaaatgctccccatttgctctatgtgctagtcacatcaatcccacttgatccccacagcaccctttgggggaaagagagtagttgataatctgattttaccaatgaacaaaggctcagaaaagactagttgatcctaaaaacaccacacagcattctaatgttgtaaaaatacctggatttgagtcccctgtacactga

SEQ ID NO: 82672 - DNA, 601 bp, Human
aagtagctgtggcagctccttataaagagatcacagctggagatgcgttcactaatcccacagaataatcctctgtttctctttcctgaacccccacatctagttcatcagcaagtctgtcagtgctagttacaaaatatattttgaatccacacacttttttcaaaaaaaatctctaccataaccccgtatccctcacactgtgatctttttcccatatcactacattaacctcctaacctgtcttcttgcctccttccagacaatgttccacctggaggctaaagtgactttttaaacstattgagctgaacattccattcctctgcttaagtaaatgtagactcccttccttggcctacaaggccctccatgaacctgtccctccctaaccttacctcttgcccctctctcatgtaactggatttcagccttccaggccttccttcagttccttaaacaggccaagctgccagggcctttgcactggctgttccctttgcctgggatgccgttaaatctcatcatggctggctctagttcactattcaggtcccaattcccacgttactttctcagagagtgttccctgaacacttaa

SEQ ID NO: 82673 - DNA, 601 bp, Human
acttatgagttagtattatcacatttaaactacataaaaatgcatttggcagatgcagaaatggagatactgcgaggttcaaataactgggccatggggacagttagtaagtggctgagtgaattcagcctggcatcgtgctccatgtcagagccagtgctctgaagcactagatcagtgattctcaaaagatgaccgtcctggactggtagagtcagcatcacatggcagcctgttagaaatgccagttcaaggccaggcacggtggcttacgcctgtaatcccagcactttgggaggcygaggtgggcagatcacaaggtcaggagatcgagaccatcctggctaacaccgtgaaaccccgtctctaccaaaaatacaaaaaattagccgggcatgatggcacgcacctgtagtccagctcctcaggaggctgaggcaggagaatcgctggaatcgggaggtggcagctgcagtgagccaagatcacgccactgcactccagcctggacgacagagcgagactccatctcaaaaaaaaaggaaagaaaagaaatgccaattcgagggtctcaggccggacctcctgaatcagaaacttt

SEQ ID NO: 82674 - DNA, 601 bp, Human
tatcacatttaaactacataaaaatgcatttggcagatgcagaaatggagatactgcgaggttcaaataactgggccatggggacagttagtaagtggctgagtgaattcagcctggcatcgtgctccatgtcagagccagtgctctgaagcactagatcagtgattctcaaaagatgaccgtcctggactggtagagtcagcatcacatggcagcctgttagaaatgccagttcaaggccaggcacggtggcttacgcctgtaatcccagcactttgggaggccgaggtgggcagatcayaaggtcaggagatcgagaccatcctggctaacaccgtgaaaccccgtctctaccaaaaatacaaaaaattagccgggcatgatggcacgcacctgtagtccagctcctcaggaggctgaggcaggagaatcgctggaatcgggaggtggcagctgcagtgagccaagatcacgccactgcactccagcctggacgacagagcgagactccatctcaaaaaaaaaggaaagaaaagaaatgccaattcgagggtctcaggccggacctcctgaatcagaaactttggagttggggctcagc

SEQ ID NO: 82675 - DNA, 601 bp, Human
tggcagcctgttagaaatgccagttcaaggccaggcacggtggcttacgcctgtaatcccagcactttgggaggccgaggtgggcagatcacaaggtcaggagatcgagaccatcctggctaacaccgtgaaaccccgtctctaccaaaaatacaaaaaattagccgggcatgatggcacgcacctgtagtccagctcctcaggaggctgaggcaggagaatcgctggaatcgggaggtggcagctgcagtgagccaagatcacgccactgcactccagcctggacgacagagcgagactycatctcaaaaaaaaaggaaagaaaagaaatgccaattcgagggtctcaggccggacctcctgaatcagaaactttggagttggggctcagcactctgttttaacaggccccgcagatgattctgaagatgctcaccaaagtttgacaaccactacctattgaatgacttaattttatgggatactagatcagactagatcagagtctgaagtttttctgtaactcagttctcatcttaacgctgtgagtgtagattgctctcaatccacggctgaagaagccagattgtgactgaataaa

SEQ ID NO: 82676 - DNA, 601 bp, Human
accttgagaagcatgcttcaaccagcaaaggaaagacagtcctagacaaggaaacatcatcaagtctctctgtaggaatacttcatatcagaccatattgccatgtgttgaagattattatataatgataataattagtacaatagtaataccatacattttgattacatttttgacattttcaaggcatgtttatattctaataatctattttccctcttgataattttattttctcccttaaaaatctctccagttacacaaagtagagtaggagtgaaaggattgttaatctgttaawctgcctgtccaggggagaggcaaagtaaagagatgtatctgtgatttcatggcctgttaggttcgtagtaacaatagctaatgtgtgttagggagcttaagtgggccaggctctttgctagatatgtcagtgcttattaatttaataaaacctctagacccaaggcttccagactcccaactggtctccttcagcaagcagcgtttcttttctttcacctcactctgaattcttcagactctctagtcattcatttattttattcattcaacttttatttagcttatacatcctacagag

SEQ ID NO: 82677 - DNA, 601 bp, Human
tttgattacatttttgacattttcaaggcatgtttatattctaataatctattttccctcttgataattttattttctcccttaaaaatctctccagttacacaaagtagagtaggagtgaaaggattgttaatctgttaatctgcctgtccaggggagaggcaaagtaaagagatgtatctgtgatttcatggcctgttaggttcgtagtaacaatagctaatgtgtgttagggagcttaagtgggccaggctctttgctagatatgtcagtgcttattaatttaataaaacctctagayccaaggcttccagactcccaactggtctccttcagcaagcagcgtttcttttctttcacctcactctgaattcttcagactctctagtcattcatttattttattcattcaacttttatttagcttatacatcctacagagaaggtgaagggcacagaggtgaatgtgctggcccacaaattgctagctctctcaggggaatccagaacaatgcagtgccacccacagtggagccttgaaggacaaaggcaaattatttaccaaatcaaaagttgccagattcaagattctctgcagttc

SEQ ID NO: 82678 - DNA, 601 bp, Human
ctcagtcttgctgccttcccttgagtctggacagaaccatcctcggtggtgagcttcccagagccttttgggagtggctcaggggaccaatttgcttccttgaagaattttgaatagcttcagatgtagctctggtggttgaagctaaggacaataatgaaaataatatgatagctgacattcattgaactctaatcaggggcttgttttaaggcatattttaggctctatgcactgttgtgtgtcttgctgctctcattacaccaaagatattatagcacacccacatctcacattgaayctgatttatgtgtgagttgagtggcattgctgcacactagttggtgcaatgacatgttttatagatatttaaatatttattaatttgattttacagtttgcttttaatatttcagagtcaatatatttatttttctggtcagacatactttttaggcccacccttcaaaagactgtaggacccagacactgagttttctcatgccacctggagaaagtgatcctgtaattattgtgttgggagctgagtgctcccacacattgcctgtggataagtgtaagactctggaattaaactgcc

SEQ ID NO: 82679 - DNA, 601 bp, Human
atgagtttatttcttggtcatgctgcaagtccaacacaaaatggtgggggagtggggagaggcattgctcctcatgcttccttagggacccaagctgaaagagggaccatcctaacatgatcacagtgtcaaaggaacttatgtaataagccacaccctggctctaaagccttattcccaaggtcacggacatcatttccacacacagttcattggatcaagcaagttgatggccaggcttaactttaaaggaggtagaaaagtgaaatcttaccatgtaactgcaaaattgggaatagcyaaatgttatctcagaggaaggttttgaggatcaaattaattaatctatgaaattatcaaaaatagggcctagaacatagaaaaatcttctttaatgttaggtatgaattcttattaattaatgaattgcctcttgtagcagctctcctgtataaatatcttccacctgattctcttgttcctgatatctctctctctctctctctctctctctctctcaatgatccatcttgcagacctgatccattttattattagacctctctcttatcatgtcatctctcttgttctcccttgtctg

SEQ ID NO: 82680 - DNA, 601 bp, Human
gctgcgaggatagaattgaaaacaagttatagtgacctacatataggagatgactgtcctcatcatagctgtgtccctagtatcaagaacagtacctggcaaataatagtcagctcaatgactatttgttgactgaatgaattattagtaatcaccagccactcttactgcatgctagttttctccaaaagctgtaagttccttgaagacagctttgaaaagtaaagttctttggagtcttaggcaacggttctcaagcttaattatacaggagaagcaaggaatgttattgaaatgctartagttggaatctggatgtactgaatcagaattcctggcacagggccaggcgcagtggctcacgcctgtaatcccagcactttgggacgctgaggcaggcagatcacaaggtcaagacatagagatcagcctgaccaacatggtgaaatccctgtctccactaaaaatacaaaaattagctgggcgtggtggggctcacctgtagtcccagctactcaggaggctgaggcaggagaattgcttgaaccttggaggcggaggttgcagtgagccaaggtcacgccactgcactccagcctgg

SEQ ID NO: 82681 - DNA, 601 bp, Human
agtgaacctgtaatatagtaagatcctacaggtctctgtaggaaatattgctactgaaagtcaaagatcactcattaagtccatctcatagttgattgtagtccagtggaaatatttgctatatttggcagaactgtctttgtataaatagtgaacagatacattccatcttagcactgccagcttaggatctcttaaggattcgactatttacttaactgaggtacagcccatgggacacacatcacctattgaattccaggtcttagcagtttattagaagtgtaaacaatgcttccaytcaaaaaagtcaactcatccaattgttaagacgatttatcttttttctttcatttcagcctagtgcagtgattctcagctgggagtgattttgcccctttcccttcctgggggacatgtggcaatgtctggagacacttttaagtgtcacaactcaggactggagaactactattgacatttaggtaaaagcaatggatgtgctaaccatcctgtaatgcacagaacaaacccctacaacaaataattatctgggctaaaatgtcaataatgctgaggttaagaaacctcattctatttt

SEQ ID NO: 82682 - DNA, 601 bp, Human
gttaagacgatttatcttttttctttcatttcagcctagtgcagtgattctcagctgggagtgattttgcccctttcccttcctgggggacatgtggcaatgtctggagacacttttaagtgtcacaactcaggactggagaactactattgacatttaggtaaaagcaatggatgtgctaaccatcctgtaatgcacagaacaaacccctacaacaaataattatctgggctaaaatgtcaataatgctgaggttaagaaacctcattctattttttgtactcattaactatccccctcraaacatctcatgtaccccataaatatatatacctactatgtaccacaaaattaaaaataaaaaagagtataaaattaaaaaaaaaaaccacctagtctagttctttttttggccaagtgctgggcactggttccctctgctatttcattgtgtggaacctggatgggctactcagagtgttccttgttcagaatcaacttcagctggcttactcttagtgggaaggcaaaacttgggagataagggtcatctcaatttctcctttctttaagcactagtggttagccctgtagctggaat

SEQ ID NO: 82683 - DNA, 601 bp, Human
caaataattatctgggctaaaatgtcaataatgctgaggttaagaaacctcattctattttttgtactcattaactatccccctcaaaacatctcatgtaccccataaatatatatacctactatgtaccacaaaattaaaaataaaaaagagtataaaattaaaaaaaaaaaccacctagtctagttctttttttggccaagtgctgggcactggttccctctgctatttcattgtgtggaacctggatgggctactcagagtgttccttgttcagaatcaacttcagctggcttactcytagtgggaaggcaaaacttgggagataagggtcatctcaatttctcctttctttaagcactagtggttagccctgtagctggaatacaaaccacaaccctctctcctgattcactataagaacctggcttggacttctcaagatagttttccctcctcatttccctggcttggttggaacacactccactcagtaagttggagagtctctgtgggtatacaactggcactttgattgccgcaactttgttatctgtgatcatggtatataataatcaggatgaaagtcaagtttcctatt

SEQ ID NO: 82684 - DNA, 601 bp, Human
actcaacactgtaaaagaaaactactcctgtggaaattaaacagagtcattttcttgtggtgaaaaggtcctgggtttgcctcagtgggtctagatttcagccttggctactaaacttgctcatgggcctctgtttctttatctgtatgatgggaataataatttctgccctgattacattaatgatggagaggatctataagatggctcctaagttctgtaaaatgtaccgcagttgctccccaaaagtgaaacttgggattgggaaaacttctacacaatcccagtctatgaattaacrcttaggaatcactgcattattatttgaagaagtatatttataactgcagcatatcagcaaaatgaggccaatatagtaaagcaaaatgtatattttaaaggactcatattctaagcttatactctttttttgttcaaataccttttctattatgcaatgttatggtgatagattgcagaatgtttggttgtgttttaaaacaacttacatgaaaatatcaaacattaacaacctgtatcagtcccagaaatgtctttaaatatttttctgatctttgaaactgaatccaaaggaactctg

SEQ ID NO: 82685 - DNA, 601 bp, Human
ctaaattttaagagcctcagtttcttcatctgcaaaaatggaaatagtaatactaccccacagggttgtttgtgtgactaagtgagccaatatagggaagaggctagatagagagactagcacttggtgggtgctcagggttgtttgtttcattcatttaaattatttccagtatcccctagtgtgtaaatagtgaatctgtgacatggaggctcttccaaatttaatccagtgccatatgccttcgtgatgctgatcataatcttgagaacacaatcctgaactccgcaatcttgaataytgaaatcgcaaaaattcaaaatccctaaagtctaaaatttccaatagctaaattcctgaaaaacacaattttgaaagattaaaattgcaaatcttgaaatcttgcaaatcaaatcctggggaagggattagtgtatttttggttgtacacaggataggtgcatcgtgttagttacatcatattaggcagaactcttatcctgttattgtcttcatttggaaattaattatggtttaaggagatgcatattggagctgacaaggggcagacatgtgggcttaattttaggtgtacacttga

SEQ ID NO: 82686 - DNA, 601 bp, Human
taagagcctcagtttcttcatctgcaaaaatggaaatagtaatactaccccacagggttgtttgtgtgactaagtgagccaatatagggaagaggctagatagagagactagcacttggtgggtgctcagggttgtttgtttcattcatttaaattatttccagtatcccctagtgtgtaaatagtgaatctgtgacatggaggctcttccaaatttaatccagtgccatatgccttcgtgatgctgatcataatcttgagaacacaatcctgaactccgcaatcttgaatactgaaatcscaaaaattcaaaatccctaaagtctaaaatttccaatagctaaattcctgaaaaacacaattttgaaagattaaaattgcaaatcttgaaatcttgcaaatcaaatcctggggaagggattagtgtatttttggttgtacacaggataggtgcatcgtgttagttacatcatattaggcagaactcttatcctgttattgtcttcatttggaaattaattatggtttaaggagatgcatattggagctgacaaggggcagacatgtgggcttaattttaggtgtacacttgactggatta

SEQ ID NO: 82687 - DNA, 601 bp, Human
agtaatactaccccacagggttgtttgtgtgactaagtgagccaatatagggaagaggctagatagagagactagcacttggtgggtgctcagggttgtttgtttcattcatttaaattatttccagtatcccctagtgtgtaaatagtgaatctgtgacatggaggctcttccaaatttaatccagtgccatatgccttcgtgatgctgatcataatcttgagaacacaatcctgaactccgcaatcttgaatactgaaatcgcaaaaattcaaaatccctaaagtctaaaatttccaakagctaaattcctgaaaaacacaattttgaaagattaaaattgcaaatcttgaaatcttgcaaatcaaatcctggggaagggattagtgtatttttggttgtacacaggataggtgcatcgtgttagttacatcatattaggcagaactcttatcctgttattgtcttcatttggaaattaattatggtttaaggagatgcatattggagctgacaaggggcagacatgtgggcttaattttaggtgtacacttgactggattaaggaatatctaaaacctggtaaaacattacttttggt

SEQ ID NO: 82688 - DNA, 601 bp, Human
agagagactagcacttggtgggtgctcagggttgtttgtttcattcatttaaattatttccagtatcccctagtgtgtaaatagtgaatctgtgacatggaggctcttccaaatttaatccagtgccatatgccttcgtgatgctgatcataatcttgagaacacaatcctgaactccgcaatcttgaatactgaaatcgcaaaaattcaaaatccctaaagtctaaaatttccaatagctaaattcctgaaaaacacaattttgaaagattaaaattgcaaatcttgaaatcttgcaaaycaaatcctggggaagggattagtgtatttttggttgtacacaggataggtgcatcgtgttagttacatcatattaggcagaactcttatcctgttattgtcttcatttggaaattaattatggtttaaggagatgcatattggagctgacaaggggcagacatgtgggcttaattttaggtgtacacttgactggattaaggaatatctaaaacctggtaaaacattacttttggtgtgtctgtgagtgtgtttccagaggagtgtgtgacctaagtggattaggcggggaagatctgcc

SEQ ID NO: 82689 - DNA, 601 bp, Human
aattatttccagtatcccctagtgtgtaaatagtgaatctgtgacatggaggctcttccaaatttaatccagtgccatatgccttcgtgatgctgatcataatcttgagaacacaatcctgaactccgcaatcttgaatactgaaatcgcaaaaattcaaaatccctaaagtctaaaatttccaatagctaaattcctgaaaaacacaattttgaaagattaaaattgcaaatcttgaaatcttgcaaatcaaatcctggggaagggattagtgtatttttggttgtacacaggataggtrcatcgtgttagttacatcatattaggcagaactcttatcctgttattgtcttcatttggaaattaattatggtttaaggagatgcatattggagctgacaaggggcagacatgtgggcttaattttaggtgtacacttgactggattaaggaatatctaaaacctggtaaaacattacttttggtgtgtctgtgagtgtgtttccagaggagtgtgtgacctaagtggattaggcggggaagatctgccctcagtggtggcaggcacccttcaatcagcagagggcacaggaagaacaaa

SEQ ID NO: 82690 - DNA, 601 bp, Human
tttccaatagctaaattcctgaaaaacacaattttgaaagattaaaattgcaaatcttgaaatcttgcaaatcaaatcctggggaagggattagtgtatttttggttgtacacaggataggtgcatcgtgttagttacatcatattaggcagaactcttatcctgttattgtcttcatttggaaattaattatggtttaaggagatgcatattggagctgacaaggggcagacatgtgggcttaattttaggtgtacacttgactggattaaggaatatctaaaacctggtaaaacattayttttggtgtgtctgtgagtgtgtttccagaggagtgtgtgacctaagtggattaggcggggaagatctgccctcagtggtggcaggcacccttcaatcagcagagggcacaggaagaacaaatacagaagtcaaattggtctctctggcagctggctggcttttcttctactgcactggacatcagaaatattccaaaaagtgtagtttcacaatgttcactttctccataagcatcatgtgtgtacatgaaaacatggaaacttccttaataaatgtagagatgtctttttgtatatct

SEQ ID NO: 82691 - DNA, 601 bp, Human
attaaaattgcaaatcttgaaatcttgcaaatcaaatcctggggaagggattagtgtatttttggttgtacacaggataggtgcatcgtgttagttacatcatattaggcagaactcttatcctgttattgtcttcatttggaaattaattatggtttaaggagatgcatattggagctgacaaggggcagacatgtgggcttaattttaggtgtacacttgactggattaaggaatatctaaaacctggtaaaacattacttttggtgtgtctgtgagtgtgtttccagaggagtgtgtracctaagtggattaggcggggaagatctgccctcagtggtggcaggcacccttcaatcagcagagggcacaggaagaacaaatacagaagtcaaattggtctctctggcagctggctggcttttcttctactgcactggacatcagaaatattccaaaaagtgtagtttcacaatgttcactttctccataagcatcatgtgtgtacatgaaaacatggaaacttccttaataaatgtagagatgtctttttgtatatcttcgttggtgaaatggaacatttcttgagatctcagttctg

SEQ ID NO: 82692 - DNA, 601 bp, Human
gcagacatgtgggcttaattttaggtgtacacttgactggattaaggaatatctaaaacctggtaaaacattacttttggtgtgtctgtgagtgtgtttccagaggagtgtgtgacctaagtggattaggcggggaagatctgccctcagtggtggcaggcacccttcaatcagcagagggcacaggaagaacaaatacagaagtcaaattggtctctctggcagctggctggcttttcttctactgcactggacatcagaaatattccaaaaagtgtagtttcacaatgttcactttctscataagcatcatgtgtgtacatgaaaacatggaaacttccttaataaatgtagagatgtctttttgtatatcttcgttggtgaaatggaacatttcttgagatctcagttctgtgagcaattgcaagtgtggtgatgacccattgcagttcttgatcaatttcgtcaaaagatttaggttgtccatcatgtatttcagatgattgcagtagtaaagcttagtgcacacaattaccaaccatagttatatacatttgtaaattttactttttgacttattactttatgagtacagttcatt

SEQ ID NO: 82693 - DNA, 601 bp, Human
ggcttaattttaggtgtacacttgactggattaaggaatatctaaaacctggtaaaacattacttttggtgtgtctgtgagtgtgtttccagaggagtgtgtgacctaagtggattaggcggggaagatctgccctcagtggtggcaggcacccttcaatcagcagagggcacaggaagaacaaatacagaagtcaaattggtctctctggcagctggctggcttttcttctactgcactggacatcagaaatattccaaaaagtgtagtttcacaatgttcactttctccataagcatcrtgtgtgtacatgaaaacatggaaacttccttaataaatgtagagatgtctttttgtatatcttcgttggtgaaatggaacatttcttgagatctcagttctgtgagcaattgcaagtgtggtgatgacccattgcagttcttgatcaatttcgtcaaaagatttaggttgtccatcatgtatttcagatgattgcagtagtaaagcttagtgcacacaattaccaaccatagttatatacatttgtaaattttactttttgacttattactttatgagtacagttcatttgcacatcttt

SEQ ID NO: 82694 - DNA, 601 bp, Human
tggtggcaggcacccttcaatcagcagagggcacaggaagaacaaatacagaagtcaaattggtctctctggcagctggctggcttttcttctactgcactggacatcagaaatattccaaaaagtgtagtttcacaatgttcactttctccataagcatcatgtgtgtacatgaaaacatggaaacttccttaataaatgtagagatgtctttttgtatatcttcgttggtgaaatggaacatttcttgagatctcagttctgtgagcaattgcaagtgtggtgatgacccattgcagtycttgatcaatttcgtcaaaagatttaggttgtccatcatgtatttcagatgattgcagtagtaaagcttagtgcacacaattaccaaccatagttatatacatttgtaaattttactttttgacttattactttatgagtacagttcatttgcacatctttgttgtaaccatgaaactgccattagtacacctgagtgtttatgcttgcgaaaatgtgtatgttattattgaatattttattgtatagagtggactatgtgtgttctttgcatttttatttttctcaaaacatatagaca

SEQ ID NO: 82695 - DNA, 601 bp, Human
tcttgagatctcagttctgtgagcaattgcaagtgtggtgatgacccattgcagttcttgatcaatttcgtcaaaagatttaggttgtccatcatgtatttcagatgattgcagtagtaaagcttagtgcacacaattaccaaccatagttatatacatttgtaaattttactttttgacttattactttatgagtacagttcatttgcacatctttgttgtaaccatgaaactgccattagtacacctgagtgtttatgcttgcgaaaatgtgtatgttattattgaatattttattgtrtagagtggactatgtgtgttctttgcatttttatttttctcaaaacatatagacattattttatgtttctcaaataaaagaaacattgcccttttaaaatgtgaataaatgtcttttaaattttctttttattattttttccagaatatgtttttgggtttttgatcttttgagatttcaacatttgggattatggtgtttgggattgtgtctttcaggattatagccaaacccatttcttctctgcctctgaacatctgcaaacccactattctagtcctcacttttaagggtacaggc

SEQ ID NO: 82696 - DNA, 601 bp, Human
tggtgatgacccattgcagttcttgatcaatttcgtcaaaagatttaggttgtccatcatgtatttcagatgattgcagtagtaaagcttagtgcacacaattaccaaccatagttatatacatttgtaaattttactttttgacttattactttatgagtacagttcatttgcacatctttgttgtaaccatgaaactgccattagtacacctgagtgtttatgcttgcgaaaatgtgtatgttattattgaatattttattgtatagagtggactatgtgtgttctttgcatttttatktttctcaaaacatatagacattattttatgtttctcaaataaaagaaacattgcccttttaaaatgtgaataaatgtcttttaaattttctttttattattttttccagaatatgtttttgggtttttgatcttttgagatttcaacatttgggattatggtgtttgggattgtgtctttcaggattatagccaaacccatttcttctctgcctctgaacatctgcaaacccactattctagtcctcacttttaagggtacaggctcagaggactaaactgaggttctcaagcttttatg

SEQ ID NO: 82697 - DNA, 601 bp, Human
tgttggcagttttcccacaattttccaaaactggtcttcatccagtgtctcctctcatagtagacatcacattcatccagaaaataaggcattctcctatatgccttcttctctcttcctccacgttccttctgtcttcaggcattgtctcactggtccctggcccagtctgtcaatcagctgacatcactgcccccacttgctttgaatcatgcctcctcccttaatgtctatgtgtccttgcataggttggttaccagagtagatatacaaagaatgaatgagtctccccatctttccracctcaagaacttgattagtggtatcctgactggaacaatggaatatggccttttgtctgcaaacagaaacaattatagcaggttttctcactagggtcatgtttgcctattttatgttaataagagctgttgtattgacttagctgtctttattctagtcacttctgcttcacaataagaggctatctgtgcttgcgttccagggggtgagttactgtcttatattgtctgacagggctgtcccttgaggaatatctttccccaatgccagttcttgtagaggggccaggaggtcagaa

SEQ ID NO: 82698 - DNA, 601 bp, Human
tctcactagggtcatgtttgcctattttatgttaataagagctgttgtattgacttagctgtctttattctagtcacttctgcttcacaataagaggctatctgtgcttgcgttccagggggtgagttactgtcttatattgtctgacagggctgtcccttgaggaatatctttccccaatgccagttcttgtagaggggccaggaggtcagaacttaagctaacaaatgattatctttctcagcagaattaccagaggacctcagactcctgggttcctccttaagggactcaggttcasatctttggcccagaacacactgtaacctctgagttcaggctttagatgaggcacctgtcaattcctatgggacctcaacccagtctcaaatacttggtcaaaaggtgagttgaaacttaaaacagtaccagcccctggacagtataagttggtctcatcacatcgaagtattcatgatgagcatcataaaatcttctgagagttggttttgatgaacagataaggaagaataccaacaccctaaaagttgagggcaattcaagtccagatgagaagaaacgtgcaggattgcagacttgg

SEQ ID NO: 82699 - DNA, 601 bp, Human
gctgtctttattctagtcacttctgcttcacaataagaggctatctgtgcttgcgttccagggggtgagttactgtcttatattgtctgacagggctgtcccttgaggaatatctttccccaatgccagttcttgtagaggggccaggaggtcagaacttaagctaacaaatgattatctttctcagcagaattaccagaggacctcagactcctgggttcctccttaagggactcaggttcagatctttggcccagaacacactgtaacctctgagttcaggctttagatgaggcacctstcaattcctatgggacctcaacccagtctcaaatacttggtcaaaaggtgagttgaaacttaaaacagtaccagcccctggacagtataagttggtctcatcacatcgaagtattcatgatgagcatcataaaatcttctgagagttggttttgatgaacagataaggaagaataccaacaccctaaaagttgagggcaattcaagtccagatgagaagaaacgtgcaggattgcagacttggaatcccaaagaggcacttagtaatggttataaactctgagggttattcgtaactgat

SEQ ID NO: 82700 - DNA, 601 bp, Human
gacttggaatcccaaagaggcacttagtaatggttataaactctgagggttattcgtaactgatgcctggccttggggtaaatggatatcctgaggctttgggcagaacagttgcaaactccccaaccttctgcttttcttggaggtgatgtttgtatgaaaagagcagttttctggaattcacacaataaaatgagccctctcatttcaggccctctgctgggtaatcttgggcaatatgcttcccctctctgagccttattaccctgttccctcattttcgaagcagattctaacctcygatctgcttctgtggtggcctcactgggatattctgaagctcaagtgctgctgctgctaataataataataccaattactatagcaacagcaacaactctaactgtgagcacttgtgctgtgcccagctctgcggatggtctcatgtgttccatcagcccgttcttacagaagttctggtaggtagttactatcattatacccatcccataggcaaaaaaactcagccacagaaaggttaaatagcttgtctcaggtcacatagctaatagtggtagagtctgtactggaacccagcact

SEQ ID NO: 82701 - DNA, 601 bp, Human
aagagcagttttctggaattcacacaataaaatgagccctctcatttcaggccctctgctgggtaatcttgggcaatatgcttcccctctctgagccttattaccctgttccctcattttcgaagcagattctaacctccgatctgcttctgtggtggcctcactgggatattctgaagctcaagtgctgctgctgctaataataataataccaattactatagcaacagcaacaactctaactgtgagcacttgtgctgtgcccagctctgcggatggtctcatgtgttccatcagcccrttcttacagaagttctggtaggtagttactatcattatacccatcccataggcaaaaaaactcagccacagaaaggttaaatagcttgtctcaggtcacatagctaatagtggtagagtctgtactggaacccagcactgtcctgcatttaactgctatggtacactgctctgtagatgttaaaattacttttggtgaactttaagtaactatcaatggaagatgatttctttgccatgcgacagtttgctctccaagctttaagcggatcaccaaggagtctaactcctctggccctga

SEQ ID NO: 82702 - DNA, 601 bp, Human
acagggacagagagggatggttgaagaagagatacatgagctaagatgagaatggtaagtgagagttggctgtgggataatagtggggaaaaatattctaggcagagggaacttcaagtacaaaagtttttaggtgggtacaagttgagatggttcaagtaatagaaaggaagcccacatgggggttgggaggtggtgagccctagaggtagagtgctaggagaggtggttgtagggtcagtcagggacaaatgatgcagggccttctagaccatgggccttcctggggatcttctctttsagccctctacgggcccagccaaccaaggcaggaactgccttctgtgtattcatcatatctctgaagtccaaccccaaacctctccaaggccaagtctgtgtctttttctttctaaatatcctcacccaaatcttacacagttcttgacacatagcagattctcaggatagcctgatgacttcaaggtataagttaaggaagatattgcagaccacagatatattttatttataaccaaggaagagcttatatttagcaaaagtctgcacttcctcagtaggtactaagctccctgttact

SEQ ID NO: 82703 - DNA, 601 bp, Human
agagggatggttgaagaagagatacatgagctaagatgagaatggtaagtgagagttggctgtgggataatagtggggaaaaatattctaggcagagggaacttcaagtacaaaagtttttaggtgggtacaagttgagatggttcaagtaatagaaaggaagcccacatgggggttgggaggtggtgagccctagaggtagagtgctaggagaggtggttgtagggtcagtcagggacaaatgatgcagggccttctagaccatgggccttcctggggatcttctctttcagccctctasgggcccagccaaccaaggcaggaactgccttctgtgtattcatcatatctctgaagtccaaccccaaacctctccaaggccaagtctgtgtctttttctttctaaatatcctcacccaaatcttacacagttcttgacacatagcagattctcaggatagcctgatgacttcaaggtataagttaaggaagatattgcagaccacagatatattttatttataaccaaggaagagcttatatttagcaaaagtctgcacttcctcagtaggtactaagctccctgttactagaggtacat

SEQ ID NO: 82704 - DNA, 601 bp, Human
attgaatagaggtagtagtcatggtgttttgcaatagagatagcagtagtggtcacaatgataaaaatagtaatattcctatgtattaaacagtcaatatatgccagaccctagatgtatattatctcatttaagcttcctaaaacaacctcataaggaaataccattattatttccacttccagtcacagagactgaaacctctcacatttaaggactgtgcacctggggtcaggtagtgagtaagtggtagggtccacttgaaaacccatacttccagtccatacttgaaaaccctctytagggaaacttaatgattggagtccatattttgacttcatgtatcttggctttttatttctatccagagctttattgcagggtgtagggggtgtcactcttttacagcctttacagcccttttacatatattaggtaataatatagaattgaattctaaaatagctgaaagtatgttttttcctccagcaaaatcattccccaaagatcatccccaaactgatgagtatcttgttcctgtgagcattactgtactgatctttctcccgtcatgtagtactttgttatttgagtcatttca

SEQ ID NO: 82705 - DNA, 601 bp, Human
cttaatgattggagtccatattttgacttcatgtatcttggctttttatttctatccagagctttattgcagggtgtagggggtgtcactcttttacagcctttacagcccttttacatatattaggtaataatatagaattgaattctaaaatagctgaaagtatgttttttcctccagcaaaatcattccccaaagatcatccccaaactgatgagtatcttgttcctgtgagcattactgtactgatctttctcccgtcatgtagtactttgttatttgagtcatttcagctcttcarggtactcaagagtaggtgctgttgccttacactgtttaagcattctcatagacctctgaatttcttcagacctcacactcactccttgttgtgatttaatatctgtcttcccaacagggactcaagctatatccccagtacctagcaaatggcaagtggcagacacccaatagacaggctgaatgaatgaatgctaagttctgtctatcatcttcataccatggctgctcccatttagttggaacgtgtgctcttcagtttccacaaaccccacagcagtgtcttggactcctcaacatt

SEQ ID NO: 82706 - DNA, 601 bp, Human
gttagtaacatcatcaaatttttaaaatattatcacactgactttttgtgaatctagacttgctagctctggtgtgcatccaatgatacaaacccccatattcaacattcctctttgaaaggtttcacagaatgttgtctgagctgaccttaaagataccttgcagctccaaagttctgtgactttcaccaggagtctcaaggcaaatgcacagaagggtcaggcaagtatcgtgaatggaggctggaccagggagcccatgcattcttccaaaggcatttcaattcagtcttgttaaagyactgagttgcacaaaagaaacgtcactgttggccagcctcggttcttcggctagctccttcaacccaagtgtatcatctaggatggaggaggcttctgagggactgagggaggacaaatcttggaaagagaggtacaaggaagagatgggatttggataaggcaaggaagagccaggaggctttggatgaactgacctctagatacattcatttttatgccaaaagtccatttcccactctttaaaccccttcacctcttctcaagaaacttgtgtctcagcttcagagagccatggcct

SEQ ID NO: 82707 - DNA, 601 bp, Human
accaggagtctcaaggcaaatgcacagaagggtcaggcaagtatcgtgaatggaggctggaccagggagcccatgcattcttccaaaggcatttcaattcagtcttgttaaagcactgagttgcacaaaagaaacgtcactgttggccagcctcggttcttcggctagctccttcaacccaagtgtatcatctaggatggaggaggcttctgagggactgagggaggacaaatcttggaaagagaggtacaaggaagagatgggatttggataaggcaaggaagagccaggaggctttggrtgaactgacctctagatacattcatttttatgccaaaagtccatttcccactctttaaaccccttcacctcttctcaagaaacttgtgtctcagcttcagagagccatggcctcatttaaaatgttgtgaaagaaggtgatggaagcatcaggttcctaggctggtgaatttttatttttatttctccattgacacagtttaacctttgcttttggcagctagcatattgctcaaataaagtgaagagaagggtgtgggggagaaggcaagagatatttggctagaaggttatgagaatc

SEQ ID NO: 82708 - DNA, 601 bp, Human
ataactcacccatggtcacctatgtgaaaaaagtgcagagctaagaatggaattgaaatctgtcaaactccagagtgtagagactgaccaagtagaccccccacttccaggccaatgcatttcggcacttgatttgtggcaaggagtcctctcagggttttggggctatgctggtgcttgctatgctgcctcggaaatgtcacctaacctagaaatagtgtttattctgttacaaagcaagttggaagaaaagaaaacactccttttttcttttttctgtgcctcctctccttactttccyctgaaacttaagttccaaggagtgcaattagcaggtcagcttgtcttgctgaacagtcaggttactttccctcagtatttgatgccaagtgaatgttgagctgaaaggctggctgataaatgcccctctggggagaaggaactgtgaaatagcctggatctattggcagatactagggccaaaaagtccttagaaactcaacctgaaaaaaatgtctagggaaagcaaaacggccaactaaggtagtaaacacttcagaaaaccttgataatagcaatttggaaaatcttgcatgtacag

SEQ ID NO: 82709 - DNA, 601 bp, Human
gtaaatttagaatgtcaaacacgtacagactaatgctatttacccaccatccaccaccattgtttatccagttgtttattcaattgcaaatggcttcttagcctgttggagaaatgatctgaggtggtcagaggtatggcccatatctgtcaaataaagcaacctcctggcacatatgataggccaaaaccctatcacttgggatttgtgaacaacattctccagtcagctgaacaagcaggtgctagaaaagagtgtaaataattcaacttgtttcaggacatgtgtttaggtgagtaaygtgaatgtgaacagtttttatcttttatttcttggtctcaagttggcactattaggcatccattcctaacataaaatagtgtctatgaatggcagctggtcattagatgtacatatccaaatccaagatcagtacaattttcacctccaccttgtcttacctcttgcactccctaactcagtggcagtgccacaatccacctaatcacccagaaagagaccaagagacttttgattctttttcccttatccatgtctttgatctgccaccaagttctggagctgttacctctactgtctc

SEQ ID NO: 82710 - DNA, 601 bp, Human
gtgttctaaacaatagccagatttccctcatttccctcctgtttctgccctctgaccaaactcaatttgccagcaatgctctccggtttttttctttcttcatccctgtctcctctcaagacttttaatcgtccctcagggccaagtttagatctaatccctaccaataagctttcctcaatctcccacccctacctccacaagaattagccttcccccattatatcccttatcattctgccgtacattagcaagatttgtatgcatgactgttagactgacagctcctttgggggaaagkgccttcttgtgctcatctgtccatctcctttctctcttcttcctcttgcctcctccctcctaacctcctccagcccagcatctaagtgcagtacatttcacataagagacaccccagcaaagtgtgttgaatagaatccattaatttgcattccatttctttggaaatagcttttggaatccattgggcagatagtgaaaatttcaactaacatgatggtggagaaaaaccttaacttttgtgctcatgttaaatttagaaacattttgtttcattctatcacctctgctaacctcttaa

SEQ ID NO: 82711 - DNA, 601 bp, Human
tctttcttcatccctgtctcctctcaagacttttaatcgtccctcagggccaagtttagatctaatccctaccaataagctttcctcaatctcccacccctacctccacaagaattagccttcccccattatatcccttatcattctgccgtacattagcaagatttgtatgcatgactgttagactgacagctcctttgggggaaagggccttcttgtgctcatctgtccatctcctttctctcttcttcctcttgcctcctccctcctaacctcctccagcccagcatctaagtgcagkacatttcacataagagacaccccagcaaagtgtgttgaatagaatccattaatttgcattccatttctttggaaatagcttttggaatccattgggcagatagtgaaaatttcaactaacatgatggtggagaaaaaccttaacttttgtgctcatgttaaatttagaaacattttgtttcattctatcacctctgctaacctcttaactaacttgaggttatggagaaagggcagaagacttatttttctacttctttaatatttccggtcaattctctcttctccatcagtattgcca

SEQ ID NO: 82712 - DNA, 601 bp, Human
ttttaatcgtccctcagggccaagtttagatctaatccctaccaataagctttcctcaatctcccacccctacctccacaagaattagccttcccccattatatcccttatcattctgccgtacattagcaagatttgtatgcatgactgttagactgacagctcctttgggggaaagggccttcttgtgctcatctgtccatctcctttctctcttcttcctcttgcctcctccctcctaacctcctccagcccagcatctaagtgcagtacatttcacataagagacaccccagcaaastgtgttgaatagaatccattaatttgcattccatttctttggaaatagcttttggaatccattgggcagatagtgaaaatttcaactaacatgatggtggagaaaaaccttaacttttgtgctcatgttaaatttagaaacattttgtttcattctatcacctctgctaacctcttaactaacttgaggttatggagaaagggcagaagacttatttttctacttctttaatatttccggtcaattctctcttctccatcagtattgccagtgccttcgttgagacaggtcatctttgtg

SEQ ID NO: 82713 - DNA, 601 bp, Human
caatctcccacccctacctccacaagaattagccttcccccattatatcccttatcattctgccgtacattagcaagatttgtatgcatgactgttagactgacagctcctttgggggaaagggccttcttgtgctcatctgtccatctcctttctctcttcttcctcttgcctcctccctcctaacctcctccagcccagcatctaagtgcagtacatttcacataagagacaccccagcaaagtgtgttgaatagaatccattaatttgcattccatttctttggaaatagcttttggratccattgggcagatagtgaaaatttcaactaacatgatggtggagaaaaaccttaacttttgtgctcatgttaaatttagaaacattttgtttcattctatcacctctgctaacctcttaactaacttgaggttatggagaaagggcagaagacttatttttctacttctttaatatttccggtcaattctctcttctccatcagtattgccagtgccttcgttgagacaggtcatctttgtggttaaagtttgaagtccctgagataagactatctgggttttaatactagttatgct

SEQ ID NO: 82714 - DNA, 601 bp, Human
ttttgtttcattctatcacctctgctaacctcttaactaacttgaggttatggagaaagggcagaagacttatttttctacttctttaatatttccggtcaattctctcttctccatcagtattgccagtgccttcgttgagacaggtcatctttgtggttaaagtttgaagtccctgagataagactatctgggttttaatactagttatgctaacagacagaccttgggtgagttagttactctttctgggcctcagtttcctcaaccataaaatgaaaatattaatgctacccatttwgtagagagagattccacaggcctagttggtggccagggaaccctgggataataaaagcaatcggacatcttgggaaccaggtaatctcctaacattccaaagatacctgctgtcccctctcaacgccatacagtgtgtgccagtagattataaactgcataaggaaagagatgatgtctgctctcctccatatccctggctcctgacacataagaggatcataaacgcactttgcaaagcaaatgccagctctggaattctgcagcagcctggagaccagaccctgcacatcaaggccca

SEQ ID NO: 82715 - DNA, 601 bp, Human
gaagacttatttttctacttctttaatatttccggtcaattctctcttctccatcagtattgccagtgccttcgttgagacaggtcatctttgtggttaaagtttgaagtccctgagataagactatctgggttttaatactagttatgctaacagacagaccttgggtgagttagttactctttctgggcctcagtttcctcaaccataaaatgaaaatattaatgctacccattttgtagagagagattccacaggcctagttggtggccagggaaccctgggataataaaagcaatcrgacatcttgggaaccaggtaatctcctaacattccaaagatacctgctgtcccctctcaacgccatacagtgtgtgccagtagattataaactgcataaggaaagagatgatgtctgctctcctccatatccctggctcctgacacataagaggatcataaacgcactttgcaaagcaaatgccagctctggaattctgcagcagcctggagaccagaccctgcacatcaaggcccagtggaaaactaatgatttctcccccgcagacctgcctagcgaagggccccgtggagcttggct

SEQ ID NO: 82716 - DNA, 601 bp, Human
ccagtgccttcgttgagacaggtcatctttgtggttaaagtttgaagtccctgagataagactatctgggttttaatactagttatgctaacagacagaccttgggtgagttagttactctttctgggcctcagtttcctcaaccataaaatgaaaatattaatgctacccattttgtagagagagattccacaggcctagttggtggccagggaaccctgggataataaaagcaatcggacatcttgggaaccaggtaatctcctaacattccaaagatacctgctgtcccctctcaacrccatacagtgtgtgccagtagattataaactgcataaggaaagagatgatgtctgctctcctccatatccctggctcctgacacataagaggatcataaacgcactttgcaaagcaaatgccagctctggaattctgcagcagcctggagaccagaccctgcacatcaaggcccagtggaaaactaatgatttctcccccgcagacctgcctagcgaagggccccgtggagcttggctggtgagagcattcttcattctccgcatgtccctggctctccctctctctccccacctccgca

SEQ ID NO: 82717 - DNA, 601 bp, Human
cggacatcttgggaaccaggtaatctcctaacattccaaagatacctgctgtcccctctcaacgccatacagtgtgtgccagtagattataaactgcataaggaaagagatgatgtctgctctcctccatatccctggctcctgacacataagaggatcataaacgcactttgcaaagcaaatgccagctctggaattctgcagcagcctggagaccagaccctgcacatcaaggcccagtggaaaactaatgatttctcccccgcagacctgcctagcgaagggccccgtggagcttggytggtgagagcattcttcattctccgcatgtccctggctctccctctctctccccacctccgcagcctcccagtcaagctattgtgcatctcctgctctctgtgtctcgctgcctgggtccctttctgcgctgctgcctaagcattgtctgtgatgtctttagtgtgaaaggtgattcacagaaataaattgcattgtgttttaggtccatagcaatctacctctgtaatcatgtctgtaagggacttcataatagtgtgagggccttggtgtcagaaccagggtctccagtggcttcaag

SEQ ID NO: 82718 - DNA, 601 bp, Human
tgcctgggtccctttctgcgctgctgcctaagcattgtctgtgatgtctttagtgtgaaaggtgattcacagaaataaattgcattgtgttttaggtccatagcaatctacctctgtaatcatgtctgtaagggacttcataatagtgtgagggccttggtgtcagaaccagggtctccagtggcttcaagatagataagtgctgcaaccaaatgcacattcagccagtgaagttgcaagttagaggtgaagatggaggtgctgctgctatgaagcaaccatactctcagcccttttatcygcaggttgataaaaatcaatcaaaacatgagatgtggttttttgtttgtttttaataaccactggaaaactaagacttgtttaatagagtctcagccaacagcttgtgctcttaccagccctgtgattagacgaaagggaaagttcaaagtgtcacctagaagggggaggcaccaaagaagaagaggcagggaggtgatacagtgaaaggcaaggaggagctgggctggaatctgagaaacctgagactgatttgttctaatcatcatcctatgtgatggtggaagataagaaccacaga

SEQ ID NO: 82719 - DNA, 601 bp, Human
tggaatgacactggctgggtttgtgaactaatcaaacctcatgaaggggtaactagctggccagggctgagagaatgattaaattaggtcactgtttcctaaacacaacccttctcctatcttcatgtatttatcatatctgtgcatttacttatattttcctttaacaaacatattttaattaaagttatttaaaaaggaaacatatcaactattgcaaatagaaaaaccagtatcactattaataggtagaagctataaaattaaaacaaagcattgttattatattctagccatatgmcattgcattcatagcgttctgagcctgattcttgcctctttttgtttaaaataaaagggaaatggcaaggtatggagataaataatttaccaaacagattttctttttcacttaatagcaggaataaaaggaaatttaaaatgaatgtgcatacgcattgtgagtctgttgtttaatgccattctcacattgggaaattccactcaccatacctgggttctagtctttactgagcaattaaattgctatatggctagctcaccttcttgtacctcaatttgtacatatgtagaatgaggt

SEQ ID NO: 82720 - DNA, 601 bp, Human
attttcctttaacaaacatattttaattaaagttatttaaaaaggaaacatatcaactattgcaaatagaaaaaccagtatcactattaataggtagaagctataaaattaaaacaaagcattgttattatattctagccatatgccattgcattcatagcgttctgagcctgattcttgcctctttttgtttaaaataaaagggaaatggcaaggtatggagataaataatttaccaaacagattttctttttcacttaatagcaggaataaaaggaaatttaaaatgaatgtgcatacrcattgtgagtctgttgtttaatgccattctcacattgggaaattccactcaccatacctgggttctagtctttactgagcaattaaattgctatatggctagctcaccttcttgtacctcaatttgtacatatgtagaatgaggttggtgagttgaaatacagaattcctttaaacccaagtttctcaatgttgctcacgggcaagctgcacctgaattttctgtgtaggtatacttgttgaaaaatgttaatttctaagctccatccaagatattctgaaaaagaatttctggaaattt

SEQ ID NO: 82721 - DNA, 601 bp, Human
gtggcaatgttggaatggtgacaatgttgtaatcccagtggtaatattataatggtggcagttgtggtggtggtggtgatgatgatgatagtaacaaatgaggatgataagaatcaacagctaacatttgtagagagtttactattgtatatacaaggcatggtactaagtacttgcatatatctaatttcatccttttgacttcttttagatatggccagtactccacatctttcaagtgggtgaactgaggtttcagaagttgagtaatttcctgagagcctacatttagtaaactaasacaaagtcagaatttgatacaggccatatgatgtcatcatatatatgtaaagtgctcaactgttggttacttgaatgaggaaggaaagaaggaagaaagagaaggagtgagggagggaggaatttacttgttttctaatcttaagattccttttctgaaaatagagataattctagcatttatggaaatcaaatgagattaaaaaaagtcaaagctctttgaaaactgtcaagtcttctctatgtacgagggctaaaccatcagaggcagcttcataattactcattcattcattcaata

SEQ ID NO: 82722 - DNA, 601 bp, Human
agttgagtaatttcctgagagcctacatttagtaaactaagacaaagtcagaatttgatacaggccatatgatgtcatcatatatatgtaaagtgctcaactgttggttacttgaatgaggaaggaaagaaggaagaaagagaaggagtgagggagggaggaatttacttgttttctaatcttaagattccttttctgaaaatagagataattctagcatttatggaaatcaaatgagattaaaaaaagtcaaagctctttgaaaactgtcaagtcttctctatgtacgagggctaaaccrtcagaggcagcttcataattactcattcattcattcaatagatatttggttttctgttttaggcactagaatatagtgggcaaaacaaactaaagtgcctgccctcagtgagctttcagtcgagtctagtgacagacaagcaaatgccaggtgaaatatatagtcctgtgggaaaaaataaagcatggagggggtgagggaatatgtgtgtatgttgggggtggggtcactctttaaatagggtggtgagggaaggcctctgataaggtgatatctgagcagggcctgaaaaaggtaagc

SEQ ID NO: 82723 - DNA, 601 bp, Human
gaatgaggaaggaaagaaggaagaaagagaaggagtgagggagggaggaatttacttgttttctaatcttaagattccttttctgaaaatagagataattctagcatttatggaaatcaaatgagattaaaaaaagtcaaagctctttgaaaactgtcaagtcttctctatgtacgagggctaaaccatcagaggcagcttcataattactcattcattcattcaatagatatttggttttctgttttaggcactagaatatagtgggcaaaacaaactaaagtgcctgccctcagtgagytttcagtcgagtctagtgacagacaagcaaatgccaggtgaaatatatagtcctgtgggaaaaaataaagcatggagggggtgagggaatatgtgtgtatgttgggggtggggtcactctttaaatagggtggtgagggaaggcctctgataaggtgatatctgagcagggcctgaaaaaggtaagccagggagtcacacagaatctgggaaaaaagtgttttatatcccacaggggagtttaaaagtcaaatgaggaatgatatcactgtgataagaatgctaggaatgggattatgca

SEQ ID NO: 82724 - DNA, 601 bp, Human
tgcagtcaagtcagtcttttccttggtaacctcctctggtggggtctctgaaggctcagtcaaggtgtgatgtcccaggggagatactattatctgaaagcatggttcctctggcaacaggcaatgggtctgagggagatatcttctattctccattcaaccatccatgagcatgatgacactaggcaggtcatctgtgctcatggcatcaccccttccagctgggaaagacaaaggaaagtcagggaggttctccccacatcaaatggaaaagtcctgctccaccagggtctataatgaratggtttatttaagtctataatgacctaagataaagttaatttactttattcagatttacagacattaccaaattacataggattgcaaacacaggagaagataaaataaattaccaaccagattgaagagcttagagaaataggtaaatagtcatgggaagagatttaatttagataaaccaaaggcaggatatctggaaaatgccaaggtcagggaaaagccgagaggaaaagatagctagtaagatggaagagacatggaaaggattcagaaaatgacgttggtgatagtgagtgtg

SEQ ID NO: 82725 - DNA, 601 bp, Human
ccgagaggaaaagatagctagtaagatggaagagacatggaaaggattcagaaaatgacgttggtgatagtgagtgtggccagtattatgataaagatagaggaaatgggaaagatattactgaaaaatatggcttctccttagaatcccaaaataaatgaggtaatttgtggaaagcagtgccagactggattctgtggtcttagttccaagtctgctaggaactgcctctgcaacttgggaaagctttttgatttttttctaacctttagcttcctcttctgttatgacatacaatacrgttctaagtctaaatgtttctagttctcttgtgtttaaggaaggcgccatgtgctctgaggagaccctgaatccatccctggtcctcctggctgaccttaatagaaacattgaaagatggagattcatgacaagtagtcaaacggaaaggcattcattttggagatggatcaagggtccaggctcatcggagacactgaaaaagttgaaaggttgcaaaattgagggagaacgacagttatgatagttcagtataactgggttttgccagaggttgtagaaaaaagttaaagattgattt

SEQ ID NO: 82726 - DNA, 601 bp, Human
caacttgggaaagctttttgatttttttctaacctttagcttcctcttctgttatgacatacaatacggttctaagtctaaatgtttctagttctcttgtgtttaaggaaggcgccatgtgctctgaggagaccctgaatccatccctggtcctcctggctgaccttaatagaaacattgaaagatggagattcatgacaagtagtcaaacggaaaggcattcattttggagatggatcaagggtccaggctcatcggagacactgaaaaagttgaaaggttgcaaaattgagggagaacracagttatgatagttcagtataactgggttttgccagaggttgtagaaaaaagttaaagattgatttgaaatggttgaggggtatgtacaatgcagaaggaggggtgagttaaataagacaatttataggctggatgtcttcagggactggggggaagtttgggtatctttaagatggcatggcagtctgacatacaggaatagttgtatccactgcaaatcataaccttctatgcatttcagggtcggcttaaggatatttgcaaagaacatactggagggagaacatcagacttgtcc

SEQ ID NO: 82727 - DNA, 601 bp, Human
ctgaccttaatagaaacattgaaagatggagattcatgacaagtagtcaaacggaaaggcattcattttggagatggatcaagggtccaggctcatcggagacactgaaaaagttgaaaggttgcaaaattgagggagaacgacagttatgatagttcagtataactgggttttgccagaggttgtagaaaaaagttaaagattgatttgaaatggttgaggggtatgtacaatgcagaaggaggggtgagttaaataagacaatttataggctggatgtcttcagggactggggggaagkttgggtatctttaagatggcatggcagtctgacatacaggaatagttgtatccactgcaaatcataaccttctatgcatttcagggtcggcttaaggatatttgcaaagaacatactggagggagaacatcagacttgtcctagttgcttgggtcccgggttagttcaccactacagcaatgtgggagctaactgcatgctaagcttggcatgcagggattggcaaaccttttctgtaaaaacccagatagtaaatgttttagattttgtgagccatacggtctctgtcacaattactca

SEQ ID NO: 82728 - DNA, 601 bp, Human
ccaaggaaacacagtttattataagtgccaaagtcaggcctcaaactcagctctgctcccacagctgacactcctaaccaacacattgtcctattgcacaactgcagcattctttcattagtgggtatgttaatgtgaagaaccagcacttggaccagtgccttataaggatcctttgaaaccaagattttattgtggttgaagggcagagagctaaatcaccaaaatgtgtaagtagagacagaccagaatgtaatctccatgaaagcaatgtccttctctgttttttaattttttcacyatgttatccctagcacttagttgtgtctgataaatatttgaataaatgcatcagtatgtgaacattatttggaattattttttctttttaatatcaaaaatctcataaccacctaggccaagcttaacccgtgggcctcaggccgcatgcagcccaacacggctttgaatgaggcccaatacaaatttgtaaagtttcttaaaacattttgagactttttgtgtgattttttttttagctcatcagctattgttagtgttagtgtatgtgatgtgtggtccaagacaatgcttcttcttt

SEQ ID NO: 82729 - DNA, 601 bp, Human
ctaacctgtctatcttaataggatgttgtaagaattaactgaaataatgtacagtctgcctcacaatcatctggacggcttgagaaagcacagattgccagatcccacccccagaggttctaattcagtaggtctggggttggacccaagaatttatattcttttttattatgatgatgattattatactttaagttttagggtacatgtgcacaatgtgcaggttagttacatatgtatacaatgaatttatattcttaacaagctctcaagtgatgctgatatagctggtctggggatyacagtaagaaaaccactgctttaggtcaatgcagttttttttaaaagctattattcataactggctcaagagtcatgtaagtgttgattatgttttattatgtgtctagacccttaatagactactcaggatatgcacaaatagaagatgtaatattttctgtagcattccctacaccaaatcggccttgctcggtcatgcatagttaatgtatgtgttgattttatttgtcttcgtgtggcttctagtctcactagaaagacatacatttatttgaatgttgtagaatgatattattca

SEQ ID NO: 82730 - DNA, 601 bp, Human
cagaggttctaattcagtaggtctggggttggacccaagaatttatattcttttttattatgatgatgattattatactttaagttttagggtacatgtgcacaatgtgcaggttagttacatatgtatacaatgaatttatattcttaacaagctctcaagtgatgctgatatagctggtctggggattacagtaagaaaaccactgctttaggtcaatgcagttttttttaaaagctattattcataactggctcaagagtcatgtaagtgttgattatgttttattatgtgtctagamccttaatagactactcaggatatgcacaaatagaagatgtaatattttctgtagcattccctacaccaaatcggccttgctcggtcatgcatagttaatgtatgtgttgattttatttgtcttcgtgtggcttctagtctcactagaaagacatacatttatttgaatgttgtagaatgatattattcattggaataaaatcggatctttttacagttttttttgtttgtttgtttcttaatgagcaggcctatgattcctaaaggactttttattttatttcatttgaacctttgatag

SEQ ID NO: 82731 - DNA, 601 bp, Human
gtatacaatgaatttatattcttaacaagctctcaagtgatgctgatatagctggtctggggattacagtaagaaaaccactgctttaggtcaatgcagttttttttaaaagctattattcataactggctcaagagtcatgtaagtgttgattatgttttattatgtgtctagacccttaatagactactcaggatatgcacaaatagaagatgtaatattttctgtagcattccctacaccaaatcggccttgctcggtcatgcatagttaatgtatgtgttgattttatttgtcttcrtgtggcttctagtctcactagaaagacatacatttatttgaatgttgtagaatgatattattcattggaataaaatcggatctttttacagttttttttgtttgtttgtttcttaatgagcaggcctatgattcctaaaggactttttattttatttcatttgaacctttgatagaaactgcatctttcatgtgaccactctccatttttctgctcatatgaccacatttcccagtagtctttaaaggctccagtttggatgggatttcgattaatggaagagaacagatagctctgtaa

SEQ ID NO: 82732 - DNA, 601 bp, Human
cttaatgagcaggcctatgattcctaaaggactttttattttatttcatttgaacctttgatagaaactgcatctttcatgtgaccactctccatttttctgctcatatgaccacatttcccagtagtctttaaaggctccagtttggatgggatttcgattaatggaagagaacagatagctctgtaaatagagccagatgtctcttgcaatatctgaaatgaactgtctcaaccatcagaactgtaaatcaccttcagaaggctccttctcccaggagtagtctttgcattattcatarcccttttgctgtagtacattcttgtctcatgaagattacagccaatcactatgctttcatagcccatcctcctccctgaacccctgctttcatgctgtgtcatagccttggcactctgttctttgaacttctttgaggagtagtgttttccaggacctagcttcagttatgccaagagtgtttcctttctgtgatcatgatacattgtaaagtatgtggttcctttttcaaagggaaaatactatagtcaccctaattccttcaagaaagaaggcagagaaagccccccctcatcctctc

SEQ ID NO: 82733 - DNA, 601 bp, Human
agaggtcccaaactggtgttctatggattgcatccagtgattttatgtgtagcataactttttaagaggaagagagaagaaaattgactttgcgatcaacattacaaaaaaacatcatgagactttgaatagaaatttggattttcagcaaaaaaaaagaaaaaaaaaaagaagaaggtttggcagtactggactcccatctttaagggtaacagccgaatgctggccacgtcctgtaagaacccacactctccagtttgctgctgtccataccagcttgtgtgactcctttacattaccygcttgactcctaaaggtatttcaattagtggcctgtttttgctctttttggcaagttcacagacttacagagtttgaaagctaaaggagtccctgagaacaaggattttctaatgttacttcacatcaaaatcacctataccctataaccaggctgcatccagtaccaattaaataagaatctctggggaggaccaagctgtcaggatttttttttttaattccccagatgattccagtatacagatcagttcatctaagaaccagtaccttggaagaatactactcagaatttattgtg

SEQ ID NO: 82734 - DNA, 601 bp, Human
cgaatgagaggcataagacagagtgaaagactgaggcaggtttcagagcaggagtgaatgtttattaaaaagctttagaacaggaatgaaagaaagtaaagtacacttggaagagggttaacggggagacttgagagaccaagtgcatggtttgacctctgacttggggttttatgtgctggtgtgcttcgggggtcttacattacttctccactgattcttccattgggatggactgtccatatgcacagtggcctgttagtgcttgtgaggagccgcatgcacagtgtgtttactgaarttgtatccatgctcacgtgaggcattcttcccttaccagtattcgtagaaccatatgccagttaaactccaccattttgcctcttagtgtgcatgcttgagctcattcacccagtttctgagatattgggaaaatgcgatcaccagtttcaggtttttctatccattgggaaactgcctttccctggcactggctgcaaccaattattattttagagagacagtttaataatcgcctatcatctgatggttgcctgacatttcttgtggtggcagcaggggggaccctctcctgtcctgc

SEQ ID NO: 82735 - DNA, 601 bp, Human
taagacagagtgaaagactgaggcaggtttcagagcaggagtgaatgtttattaaaaagctttagaacaggaatgaaagaaagtaaagtacacttggaagagggttaacggggagacttgagagaccaagtgcatggtttgacctctgacttggggttttatgtgctggtgtgcttcgggggtcttacattacttctccactgattcttccattgggatggactgtccatatgcacagtggcctgttagtgcttgtgaggagccgcatgcacagtgtgtttactgaagttgtatccatgcycacgtgaggcattcttcccttaccagtattcgtagaaccatatgccagttaaactccaccattttgcctcttagtgtgcatgcttgagctcattcacccagtttctgagatattgggaaaatgcgatcaccagtttcaggtttttctatccattgggaaactgcctttccctggcactggctgcaaccaattattattttagagagacagtttaataatcgcctatcatctgatggttgcctgacatttcttgtggtggcagcaggggggaccctctcctgtcctgctcgtgtctgacta

SEQ ID NO: 82736 - DNA, 601 bp, Human
gatggactgtccatatgcacagtggcctgttagtgcttgtgaggagccgcatgcacagtgtgtttactgaagttgtatccatgctcacgtgaggcattcttcccttaccagtattcgtagaaccatatgccagttaaactccaccattttgcctcttagtgtgcatgcttgagctcattcacccagtttctgagatattgggaaaatgcgatcaccagtttcaggtttttctatccattgggaaactgcctttccctggcactggctgcaaccaattattattttagagagacagtttaawaatcgcctatcatctgatggttgcctgacatttcttgtggtggcagcaggggggaccctctcctgtcctgctcgtgtctgactagctacctactgtaataaatggggtgcagattagaaaacaggtccttaccctcccccttccccacccagttattgctcaagatcacataattatgaaatagaagagctgatacatagagaaaaatagttccagttgtctttataagtggttcaaaactctgtgagcttctttgatgggttgagttgtaagttatgtggcagcctctcctttcaggtg

SEQ ID NO: 82737 - DNA, 601 bp, Human
gcatgcacagtgtgtttactgaagttgtatccatgctcacgtgaggcattcttcccttaccagtattcgtagaaccatatgccagttaaactccaccattttgcctcttagtgtgcatgcttgagctcattcacccagtttctgagatattgggaaaatgcgatcaccagtttcaggtttttctatccattgggaaactgcctttccctggcactggctgcaaccaattattattttagagagacagtttaataatcgcctatcatctgatggttgcctgacatttcttgtggtggcagcrggggggaccctctcctgtcctgctcgtgtctgactagctacctactgtaataaatggggtgcagattagaaaacaggtccttaccctcccccttccccacccagttattgctcaagatcacataattatgaaatagaagagctgatacatagagaaaaatagttccagttgtctttataagtggttcaaaactctgtgagcttctttgatgggttgagttgtaagttatgtggcagcctctcctttcaggtgagaatgaagcagtcagccaggtctaattgcctagttatatgagtgtac

SEQ ID NO: 82738 - DNA, 601 bp, Human
tataagtggttcaaaactctgtgagcttctttgatgggttgagttgtaagttatgtggcagcctctcctttcaggtgagaatgaagcagtcagccaggtctaattgcctagttatatgagtgtactgagtaggtaactctctcaatagtttaatttgaggtctgcaattggagagttgatgctgaaacatttctcaggaccagaaatttcctttcaggctagccacttctctgagctgaaaatgctgtcatggtgaattcattcttctagatccatgttttttaagtatattatcaaaggwctatgtgtatcggaatcccttgagactctagttaatgactgtccacgtcccactcccagagattccgagtcagtaaatctggggtggggctcaggaagtggttttttgttgttgttgctgctttgttttgtttttgagatggagttttactctgttgcccaggctggaatgcagtggcgtgatcttggctcactgcaacctctgcctcccaggttcaagcgattctcctgcctcagcctcccaagtagctgggattacaggtgcccaccagcatgccaggctaatttttatatttttagt

SEQ ID NO: 82739 - DNA, 601 bp, Human
taagttatgtggcagcctctcctttcaggtgagaatgaagcagtcagccaggtctaattgcctagttatatgagtgtactgagtaggtaactctctcaatagtttaatttgaggtctgcaattggagagttgatgctgaaacatttctcaggaccagaaatttcctttcaggctagccacttctctgagctgaaaatgctgtcatggtgaattcattcttctagatccatgttttttaagtatattatcaaaggactatgtgtatcggaatcccttgagactctagttaatgactgtccasgtcccactcccagagattccgagtcagtaaatctggggtggggctcaggaagtggttttttgttgttgttgctgctttgttttgtttttgagatggagttttactctgttgcccaggctggaatgcagtggcgtgatcttggctcactgcaacctctgcctcccaggttcaagcgattctcctgcctcagcctcccaagtagctgggattacaggtgcccaccagcatgccaggctaatttttatatttttagtagagacggggttcccccatgttggccaggctggtcacaaactgctg

SEQ ID NO: 82740 - DNA, 601 bp, Human
agtttaatttgaggtctgcaattggagagttgatgctgaaacatttctcaggaccagaaatttcctttcaggctagccacttctctgagctgaaaatgctgtcatggtgaattcattcttctagatccatgttttttaagtatattatcaaaggactatgtgtatcggaatcccttgagactctagttaatgactgtccacgtcccactcccagagattccgagtcagtaaatctggggtggggctcaggaagtggttttttgttgttgttgctgctttgttttgtttttgagatggagtyttactctgttgcccaggctggaatgcagtggcgtgatcttggctcactgcaacctctgcctcccaggttcaagcgattctcctgcctcagcctcccaagtagctgggattacaggtgcccaccagcatgccaggctaatttttatatttttagtagagacggggttcccccatgttggccaggctggtcacaaactgctgacctcacatgatctgcccacctcagcctcccaaagtgctggaattacaggcatgagccactgcacctggccaggaagtggcatttttcagaaaactcatc

SEQ ID NO: 82741 - DNA, 601 bp, Human
atgttttttaagtatattatcaaaggactatgtgtatcggaatcccttgagactctagttaatgactgtccacgtcccactcccagagattccgagtcagtaaatctggggtggggctcaggaagtggttttttgttgttgttgctgctttgttttgtttttgagatggagttttactctgttgcccaggctggaatgcagtggcgtgatcttggctcactgcaacctctgcctcccaggttcaagcgattctcctgcctcagcctcccaagtagctgggattacaggtgcccaccagcaygccaggctaatttttatatttttagtagagacggggttcccccatgttggccaggctggtcacaaactgctgacctcacatgatctgcccacctcagcctcccaaagtgctggaattacaggcatgagccactgcacctggccaggaagtggcatttttcagaaaactcatccaagtgattttgatgcaggtagtaggccagatgcagagaaatatgatataaaggtaaatgtcctttcttccctgtctactagtatagtgaccattttctcctgaatcaaatactgcagccttgaaact

SEQ ID NO: 82742 - DNA, 601 bp, Human
tgtgtatcggaatcccttgagactctagttaatgactgtccacgtcccactcccagagattccgagtcagtaaatctggggtggggctcaggaagtggttttttgttgttgttgctgctttgttttgtttttgagatggagttttactctgttgcccaggctggaatgcagtggcgtgatcttggctcactgcaacctctgcctcccaggttcaagcgattctcctgcctcagcctcccaagtagctgggattacaggtgcccaccagcatgccaggctaatttttatatttttagtagaracggggttcccccatgttggccaggctggtcacaaactgctgacctcacatgatctgcccacctcagcctcccaaagtgctggaattacaggcatgagccactgcacctggccaggaagtggcatttttcagaaaactcatccaagtgattttgatgcaggtagtaggccagatgcagagaaatatgatataaaggtaaatgtcctttcttccctgtctactagtatagtgaccattttctcctgaatcaaatactgcagccttgaaactagttaaaaccagggttgtgccatacttcta

SEQ ID NO: 82743 - DNA, 601 bp, Human
aatcccttgagactctagttaatgactgtccacgtcccactcccagagattccgagtcagtaaatctggggtggggctcaggaagtggttttttgttgttgttgctgctttgttttgtttttgagatggagttttactctgttgcccaggctggaatgcagtggcgtgatcttggctcactgcaacctctgcctcccaggttcaagcgattctcctgcctcagcctcccaagtagctgggattacaggtgcccaccagcatgccaggctaatttttatatttttagtagagacggggttcycccatgttggccaggctggtcacaaactgctgacctcacatgatctgcccacctcagcctcccaaagtgctggaattacaggcatgagccactgcacctggccaggaagtggcatttttcagaaaactcatccaagtgattttgatgcaggtagtaggccagatgcagagaaatatgatataaaggtaaatgtcctttcttccctgtctactagtatagtgaccattttctcctgaatcaaatactgcagccttgaaactagttaaaaccagggttgtgccatacttctactcagctcag

SEQ ID NO: 82744 - DNA, 601 bp, Human
ttgctgctttgttttgtttttgagatggagttttactctgttgcccaggctggaatgcagtggcgtgatcttggctcactgcaacctctgcctcccaggttcaagcgattctcctgcctcagcctcccaagtagctgggattacaggtgcccaccagcatgccaggctaatttttatatttttagtagagacggggttcccccatgttggccaggctggtcacaaactgctgacctcacatgatctgcccacctcagcctcccaaagtgctggaattacaggcatgagccactgcacctgkccaggaagtggcatttttcagaaaactcatccaagtgattttgatgcaggtagtaggccagatgcagagaaatatgatataaaggtaaatgtcctttcttccctgtctactagtatagtgaccattttctcctgaatcaaatactgcagccttgaaactagttaaaaccagggttgtgccatacttctactcagctcagaaggaggctctccatttgagaacacatgggttccttttgctaccaggacatgcagcttggaacctctgattctcagtgatgtaggcattttcttagcatac

SEQ ID NO: 82745 - DNA, 601 bp, Human
tctgcccacctcagcctcccaaagtgctggaattacaggcatgagccactgcacctggccaggaagtggcatttttcagaaaactcatccaagtgattttgatgcaggtagtaggccagatgcagagaaatatgatataaaggtaaatgtcctttcttccctgtctactagtatagtgaccattttctcctgaatcaaatactgcagccttgaaactagttaaaaccagggttgtgccatacttctactcagctcagaaggaggctctccatttgagaacacatgggttccttttgctacyaggacatgcagcttggaacctctgattctcagtgatgtaggcattttcttagcatacagcagcctggaatttatcataatgtacatgtcacaggaggatatgaaatagagtaaacaccttttttatagactttagattttgaggtctcactacagcagcgttttgcaactttttaaaaaagaaccaataatgatctctttggatgttcataaaagcctcacactctgctgtcccatactagattctgatatacctaactttgaaggatgtccaccattgagtgtcactacatacagggag

SEQ ID NO: 82746 - DNA, 601 bp, Human
gaattacaggcatgagccactgcacctggccaggaagtggcatttttcagaaaactcatccaagtgattttgatgcaggtagtaggccagatgcagagaaatatgatataaaggtaaatgtcctttcttccctgtctactagtatagtgaccattttctcctgaatcaaatactgcagccttgaaactagttaaaaccagggttgtgccatacttctactcagctcagaaggaggctctccatttgagaacacatgggttccttttgctaccaggacatgcagcttggaacctctgattckcagtgatgtaggcattttcttagcatacagcagcctggaatttatcataatgtacatgtcacaggaggatatgaaatagagtaaacaccttttttatagactttagattttgaggtctcactacagcagcgttttgcaactttttaaaaaagaaccaataatgatctctttggatgttcataaaagcctcacactctgctgtcccatactagattctgatatacctaactttgaaggatgtccaccattgagtgtcactacatacagggagcaaattccatttcatttttcgcgcattcc

SEQ ID NO: 82747 - DNA, 601 bp, Human
ctcctggcaggtattttcccccttccttattccactaagactcacttgcaacgcaaagaccagggcctcatggaagaaggcagctgggcacaagcctgttgccatggaaagcttagggcgggaagcgattgattggtctctgcatacagagactgatctagaaggcttcagtgtgtctgaatggacctgtctgggctggaatttcagtcagtctgacagactgctaaaggagactcaggtgtacacttcagcaacttgataactcttccccagctgaaagtcgaatcatttgatccaacgrgaaagaagctaaaattgtcctgacagctaaagagcgatctgacctttgtgatcaggaggagaatttcttgtgatacagaaagtgaaagtagaaactggaatgatggtattgatgatgaaggcatttagagcagcaggcactgccattcattaaaagattgcactgtgtcaggcacatgctttatcctattgaaccatcatgccaaacttgggacacttaggtatcattgtttttcattttccattaagaacttgaggattaaagctgttaatctatctgttcatggtgaaatgagtagta

SEQ ID NO: 82748 - DNA, 601 bp, Human
ccccttccttattccactaagactcacttgcaacgcaaagaccagggcctcatggaagaaggcagctgggcacaagcctgttgccatggaaagcttagggcgggaagcgattgattggtctctgcatacagagactgatctagaaggcttcagtgtgtctgaatggacctgtctgggctggaatttcagtcagtctgacagactgctaaaggagactcaggtgtacacttcagcaacttgataactcttccccagctgaaagtcgaatcatttgatccaacgggaaagaagctaaaattgycctgacagctaaagagcgatctgacctttgtgatcaggaggagaatttcttgtgatacagaaagtgaaagtagaaactggaatgatggtattgatgatgaaggcatttagagcagcaggcactgccattcattaaaagattgcactgtgtcaggcacatgctttatcctattgaaccatcatgccaaacttgggacacttaggtatcattgtttttcattttccattaagaacttgaggattaaagctgttaatctatctgttcatggtgaaatgagtagtatgtggcctgggtttgaac

SEQ ID NO: 82749 - DNA, 601 bp, Human
aagactcacttgcaacgcaaagaccagggcctcatggaagaaggcagctgggcacaagcctgttgccatggaaagcttagggcgggaagcgattgattggtctctgcatacagagactgatctagaaggcttcagtgtgtctgaatggacctgtctgggctggaatttcagtcagtctgacagactgctaaaggagactcaggtgtacacttcagcaacttgataactcttccccagctgaaagtcgaatcatttgatccaacgggaaagaagctaaaattgtcctgacagctaaagagcratctgacctttgtgatcaggaggagaatttcttgtgatacagaaagtgaaagtagaaactggaatgatggtattgatgatgaaggcatttagagcagcaggcactgccattcattaaaagattgcactgtgtcaggcacatgctttatcctattgaaccatcatgccaaacttgggacacttaggtatcattgtttttcattttccattaagaacttgaggattaaagctgttaatctatctgttcatggtgaaatgagtagtatgtggcctgggtttgaacctttgttatagctgcaat

SEQ ID NO: 82750 - DNA, 601 bp, Human
gatgatgaaggcatttagagcagcaggcactgccattcattaaaagattgcactgtgtcaggcacatgctttatcctattgaaccatcatgccaaacttgggacacttaggtatcattgtttttcattttccattaagaacttgaggattaaagctgttaatctatctgttcatggtgaaatgagtagtatgtggcctgggtttgaacctttgttatagctgcaattttttcagagcttttaattgttgaactacacggtgtttctggggctattcttgatctttgcacagtgtgggggckaaagttggtccttttaggaattcaactattctctcatttagttatggccaagaaaggagaggctcagagatcagttggtgcctcaaaaggtcgctcttccctgcagccgacttaatatgtctcctagctcccagtccagtgctccagcaagatccggaagctaaatattccctgaagcctttataatctattgagaatacacaacagagttgctgggagtttttccaaggcagtaagtctcatttttcttattagtttggatcccctgaacccttaaggtagtatctcaaatgcagttaa

SEQ ID NO: 82751 - DNA, 601 bp, Human
gctttatcctattgaaccatcatgccaaacttgggacacttaggtatcattgtttttcattttccattaagaacttgaggattaaagctgttaatctatctgttcatggtgaaatgagtagtatgtggcctgggtttgaacctttgttatagctgcaattttttcagagcttttaattgttgaactacacggtgtttctggggctattcttgatctttgcacagtgtgggggcgaaagttggtccttttaggaattcaactattctctcatttagttatggccaagaaaggagaggctcaragatcagttggtgcctcaaaaggtcgctcttccctgcagccgacttaatatgtctcctagctcccagtccagtgctccagcaagatccggaagctaaatattccctgaagcctttataatctattgagaatacacaacagagttgctgggagtttttccaaggcagtaagtctcatttttcttattagtttggatcccctgaacccttaaggtagtatctcaaatgcagttaagtgttcaaccaatatttgttgcaagaataaacattactagtaagaaatgtgatcttggagacaatat

SEQ ID NO: 82752 - DNA, 601 bp, Human
tccattaagaacttgaggattaaagctgttaatctatctgttcatggtgaaatgagtagtatgtggcctgggtttgaacctttgttatagctgcaattttttcagagcttttaattgttgaactacacggtgtttctggggctattcttgatctttgcacagtgtgggggcgaaagttggtccttttaggaattcaactattctctcatttagttatggccaagaaaggagaggctcagagatcagttggtgcctcaaaaggtcgctcttccctgcagccgacttaatatgtctcctagcycccagtccagtgctccagcaagatccggaagctaaatattccctgaagcctttataatctattgagaatacacaacagagttgctgggagtttttccaaggcagtaagtctcatttttcttattagtttggatcccctgaacccttaaggtagtatctcaaatgcagttaagtgttcaaccaatatttgttgcaagaataaacattactagtaagaaatgtgatcttggagacaatattttatgttcctagtctctagttttcctatttttgaaataagcaggtgtgttctagatatttc

SEQ ID NO: 82753 - DNA, 601 bp, Human
aattttttactgtacaaacttttaaatgttttaactttttgactcttttgtagtaacagcttaaaacacaaacacattgtacaactatacaacttttttttccttatatccctatgctataagcttttctttttctatttctaactttttgttactttttaaactttttggttagaaaatgtttaaagggtaaagacacaaactagagaatttatatctttaaactttaaatgtttaagaagtaaagatattaagacacaaacacatgcattagcctaggcctacactgggtcaggatcaycaacatcactgtctttcttccacctccacagcttgtccggctgaaaggtcttcagtggcaatagcacgcatggagctgtcatcacctataatactgccttcttctggaatacctcctgaaggacttgcctgaggctattttacagctacctttttttataagtagaaagagtgcactgtaaaataacaacatatatagtaaatgtataaaccagttacataactgcttattatcaagtattatgtactgtacatgactgtatgtgttatacttttatatacaaccacagcacagtaggtt

SEQ ID NO: 82754 - DNA, 601 bp, Human
gacattgccagccttctttccctttccgggaccttggaaaccctgtccattggtaaccagtttgatggctaagctccatttttccatcatgtttcctagacaacgccatgcaagcttctgctccagcccctttggagctctgattcagacactaatctcaggccctccaaggaagcatcattcagaccttccctgcttcctgcagaggcacatgtagtacagtacgtgaggctttctatggagctgctctcatttttgttcattaacttctctccctgggaggaggcatgccagggagggygtttatcaagatgaggcacatgacaataggagcaccagatttccagtccctgttttgttatcagaagttcgctttccagacttgggcaaatcactttaatgtctcttgcttaaaaccttgactagcttttcaatgtttttggggacaaggactcaaggccttagagatcttgtgatctctctacatgtgtaataaatatataaaccataatatagctgcttattatcaagtatcatgcactgtacatgactgtatgtgctatacttttatatgcaactggcagcacagtaggtttcttta

SEQ ID NO: 82755 - DNA, 601 bp, Human
ctttggagctctgattcagacactaatctcaggccctccaaggaagcatcattcagaccttccctgcttcctgcagaggcacatgtagtacagtacgtgaggctttctatggagctgctctcatttttgttcattaacttctctccctgggaggaggcatgccagggagggtgtttatcaagatgaggcacatgacaataggagcaccagatttccagtccctgttttgttatcagaagttcgctttccagacttgggcaaatcactttaatgtctcttgcttaaaaccttgactagcttytcaatgtttttggggacaaggactcaaggccttagagatcttgtgatctctctacatgtgtaataaatatataaaccataatatagctgcttattatcaagtatcatgcactgtacatgactgtatgtgctatacttttatatgcaactggcagcacagtaggtttctttaaaccagcatcaacacaaacacattagtaatgcattgtgttacaacattaccatggcagagatattactagacaataggaatttttcagctctattataatcttatgggaccaccatcatataagcaggt

SEQ ID NO: 82756 - DNA, 601 bp, Human
tgttacaacattaccatggcagagatattactagacaataggaatttttcagctctattataatcttatgggaccaccatcatataagcaggtcattgttaaccaaaacatcattacatggtacatgactatattttggtataattttatacaaaaaaaaattgcctgacttttgcctacctacccagctcctacttccttgagttcactcctttgtgcactccaaccccactcacctatctgttatccttctgacacaccctattgcctccttccatttggctttatcctacaaagtttrctgtttacaaagtttactctgaaatagaggtcatcattttgaagactagaaaaccaaggcacagagacttacatgccttgcccaagtttgcatagtttgtaaatggaaaagctggggaaaatccacggaaacttggctctggattccatgctattgaccaactcctgacttcctgccctgctagaccttagtgggtggtcatgaaataaaggatgtaggaacagtgtgccaagagttctgttggattattttagctgaaatctcataatggctttttatagaatattaatgacttacaga

SEQ ID NO: 82757 - DNA, 601 bp, Human
gactatattttggtataattttatacaaaaaaaaattgcctgacttttgcctacctacccagctcctacttccttgagttcactcctttgtgcactccaaccccactcacctatctgttatccttctgacacaccctattgcctccttccatttggctttatcctacaaagtttgctgtttacaaagtttactctgaaatagaggtcatcattttgaagactagaaaaccaaggcacagagacttacatgccttgcccaagtttgcatagtttgtaaatggaaaagctggggaaaatccamggaaacttggctctggattccatgctattgaccaactcctgacttcctgccctgctagaccttagtgggtggtcatgaaataaaggatgtaggaacagtgtgccaagagttctgttggattattttagctgaaatctcataatggctttttatagaatattaatgacttacagagctctttgctctgggttatggacttaggtttctaaattgtcatctccttctagataacttttcaggaacttatcagcacccacacaggactggatgtgcttttggaaggtaccatggaggctgata

SEQ ID NO: 82758 - DNA, 601 bp, Human
cccaagtttgcatagtttgtaaatggaaaagctggggaaaatccacggaaacttggctctggattccatgctattgaccaactcctgacttcctgccctgctagaccttagtgggtggtcatgaaataaaggatgtaggaacagtgtgccaagagttctgttggattattttagctgaaatctcataatggctttttatagaatattaatgacttacagagctctttgctctgggttatggacttaggtttctaaattgtcatctccttctagataacttttcaggaacttatcagcaccyacacaggactggatgtgcttttggaaggtaccatggaggctgatatggtgtggctatatcaaatctcatcttgaattgtagctcccataacccccacgtgtcaagggagggaccaggtgggaggtaattaaatcatgggtgtgtgtttttccgtgctgtcctcgtgacagtgaataagtctcatgagatctgatggttttataaagggcagttcccctgcacatgctttcttgcctgccaccatgtaagaagtgcctttgctcttctaccatgattgtgaggcctccctagctgtgtgca

SEQ ID NO: 82759 - DNA, 601 bp, Human
agcagcaaaacaatagactcctacctgtatggaaaggacagagtcacaagtcaaagcttcaggctgaacctttcttagcaaagtgagaagggtagatctgagacaaaggagcagggattttttttaggttgattcctgtatttatgtaacttctttctcctcaacagtacaggtttcttcatgatacatgtcttcaagacagcattggagtaaaggattctcagtggccttgttttattcaatggcatttagtaaacgtggggaagggatcaagagtccacatcagatcctggccctggarcagcttttctagtcgggggtcatgatagctacagtctctctagtatcttctctgtgccatttaaataaataaatcagagaattggactcagaatctgattctctgattccgctgagtcagttcttggccagggtcatgaaactggtaacttgtacagcctggacccgtactcaaggatgtgagacttggagtgggggttgagaggaggacagttcatgacaagcctgacccaacatagtgctgtgcccaattagctagctacacagataagcaaactgaggctaccactgggtcagttct

SEQ ID NO: 82760 - DNA, 601 bp, Human
aaataaataaatcagagaattggactcagaatctgattctctgattccgctgagtcagttcttggccagggtcatgaaactggtaacttgtacagcctggacccgtactcaaggatgtgagacttggagtgggggttgagaggaggacagttcatgacaagcctgacccaacatagtgctgtgcccaattagctagctacacagataagcaaactgaggctaccactgggtcagttcttggcaagggtcaggaagctgtaacttgtagagcctggacaagtgtctgtgatgtcaaaccccrtccatgtaactgctagttactatatgggaactcaagtttattacttaactgtattaagcttccattttctctaagaaatgggggaaaaaaagcttttaccttggcttaaagcagttgcaagaattaaaaagttaattcatgttgtttatttatcagaatgcctagcacattataagtctcagtataggagaattgtattattcttaccatcatcaccatcaccaccattatttgccaagagagaggtatatgcaaagtgctatagtggttcaaaggagggggcaatcgcttccaccagga

SEQ ID NO: 82761 - DNA, 601 bp, Human
aacttgtacagcctggacccgtactcaaggatgtgagacttggagtgggggttgagaggaggacagttcatgacaagcctgacccaacatagtgctgtgcccaattagctagctacacagataagcaaactgaggctaccactgggtcagttcttggcaagggtcaggaagctgtaacttgtagagcctggacaagtgtctgtgatgtcaaaccccgtccatgtaactgctagttactatatgggaactcaagtttattacttaactgtattaagcttccattttctctaagaaatgggggaaaaaaagcttttaccttggcttaaagcagttgcaagaattaaaaagttaattcatgttgtttatttatcagaatgcctagcacattataagtctcagtataggagaattgtattattcttaccatcatcaccatcaccaccattatttgccaagagagaggtatatgcaaagtgctatagtggttcaaaggagggggcaatcgcttccaccaggaagacagtggagggtagtgtgaggataaatgtaaaacctgaaaatttaaacttgaacttgaaaggagactgtgtatgtgggaatt

SEQ ID NO: 82762 - DNA, 601 bp, Human
tggttcaaaggagggggcaatcgcttccaccaggaagacagtggagggtagtgtgaggataaatgtaaaacctgaaaatttaaacttgaacttgaaaggagactgtgtatgtgggaattttggatcaaaaggggattccaatagaagaaacagctgagttaaagcaaagcgatagaacactgataacgactatgaatggtgaatagagcattttggctgattgctgtgtacctaaatggagatgagggtggaaagatgcattggggggtaagactttgagaaccaagttcatttgagaacsaagttcatttgagaacaactacgaatggtgaatagagcattttggctgattgctgtgtacctaaatggaggtgagggtggaaagatgcattgggggataactatgagaaccaagttaagggaagtgtcatgagcagagctatgctccaaaaagatttagcaggccatctatacccattatgtctggggtgcatatgagggagttacaggatgtgagacttggagtgggggtggagggagggcagttcatgacaagcctgacccaacacactgttgtgtccaattagcacgacctattttg

SEQ ID NO: 82763 - DNA, 601 bp, Human
cacactgttgtgtccaattagcacgacctattttggctttgaatggggaaggagaatctgtgacctctgagtcagcctttatggaatgctcaagacttaacaggtcttgcaagatgcattctctatcagtcatagtactttaataatggttccttactcagcttcattcattcattggaaattcatgcatgtctttgtagtccataggattctcagaataaccttgtgactagacgagagaaatattgactgtgcgattactgaaggcaaagactgtttgtgatgcttgattacttgattyttgcatatccaacaagtgaatgagtgagtaagtgagtgagtgagtgaatgattgaatctccacttgactcctgaggcaactgagatgaggagatattaaaatatctcaaggtgtcattattggacacacatatgactaggacttttgttactttcatacttctccatttacaatttcttaaaagagtactttccaaagtatatacaatttaatgatttgaaatcctgcttgcggccaggcacggtggctcatgcctgtaatcccagcactttgggaggctgaggcgtgtggatcacgaga

SEQ ID NO: 82764 - DNA, 601 bp, Human
agaataaccttgtgactagacgagagaaatattgactgtgcgattactgaaggcaaagactgtttgtgatgcttgattacttgatttttgcatatccaacaagtgaatgagtgagtaagtgagtgagtgagtgaatgattgaatctccacttgactcctgaggcaactgagatgaggagatattaaaatatctcaaggtgtcattattggacacacatatgactaggacttttgttactttcatacttctccatttacaatttcttaaaagagtactttccaaagtatatacaatttaatkatttgaaatcctgcttgcggccaggcacggtggctcatgcctgtaatcccagcactttgggaggctgaggcgtgtggatcacgagatcaagagattgagaccatcccggccaacatggtgaaaccccgtctctactaaaaatagaaaaattagctgggcatggtggcaggcgcctgtaatcccagctacttgggaggctgaggcagaagaatcacttgaacctgggaggcagaggttgtagtgagccaagactgtgccactgcaccccagattggcgacagagcgagactctgtctcaaa

SEQ ID NO: 82765 - DNA, 601 bp, Human
atgaggagatattaaaatatctcaaggtgtcattattggacacacatatgactaggacttttgttactttcatacttctccatttacaatttcttaaaagagtactttccaaagtatatacaatttaatgatttgaaatcctgcttgcggccaggcacggtggctcatgcctgtaatcccagcactttgggaggctgaggcgtgtggatcacgagatcaagagattgagaccatcccggccaacatggtgaaaccccgtctctactaaaaatagaaaaattagctgggcatggtggcaggygcctgtaatcccagctacttgggaggctgaggcagaagaatcacttgaacctgggaggcagaggttgtagtgagccaagactgtgccactgcaccccagattggcgacagagcgagactctgtctcaaaaaaaaaaaaaaaaaccttcttgcttttgttgctgttttcttcctaaaagtggagctttgccttttcccttttaagtcagtcactgagacagtatttggttttgtgccctctgagagttattttccagcccacgagccccacgttctgattctgatgtgagataatggagct

SEQ ID NO: 82766 - DNA, 601 bp, Human
ttgcggccaggcacggtggctcatgcctgtaatcccagcactttgggaggctgaggcgtgtggatcacgagatcaagagattgagaccatcccggccaacatggtgaaaccccgtctctactaaaaatagaaaaattagctgggcatggtggcaggcgcctgtaatcccagctacttgggaggctgaggcagaagaatcacttgaacctgggaggcagaggttgtagtgagccaagactgtgccactgcaccccagattggcgacagagcgagactctgtctcaaaaaaaaaaaaaaaaamcttcttgcttttgttgctgttttcttcctaaaagtggagctttgccttttcccttttaagtcagtcactgagacagtatttggttttgtgccctctgagagttattttccagcccacgagccccacgttctgattctgatgtgagataatggagcttagccctcagagatatggaagacaccaattgtttcgttctctaagtgttcagaaacaactgttcttttcttttcttccttttttacttccccttacaagactttcttttctttgcctcaaagagggtaaaggatggaagataga

SEQ ID NO: 82767 - DNA, 601 bp, Human
aagagattgagaccatcccggccaacatggtgaaaccccgtctctactaaaaatagaaaaattagctgggcatggtggcaggcgcctgtaatcccagctacttgggaggctgaggcagaagaatcacttgaacctgggaggcagaggttgtagtgagccaagactgtgccactgcaccccagattggcgacagagcgagactctgtctcaaaaaaaaaaaaaaaaaccttcttgcttttgttgctgttttcttcctaaaagtggagctttgccttttcccttttaagtcagtcactgagasagtatttggttttgtgccctctgagagttattttccagcccacgagccccacgttctgattctgatgtgagataatggagcttagccctcagagatatggaagacaccaattgtttcgttctctaagtgttcagaaacaactgttcttttcttttcttccttttttacttccccttacaagactttcttttctttgcctcaaagagggtaaaggatggaagatagaaggaggaactcaggttagtctatggctcagaggccttgaatagtttgggaaaaaaattaaacaacatgaaacta

SEQ ID NO: 82768 - DNA, 601 bp, Human
gaccatcccggccaacatggtgaaaccccgtctctactaaaaatagaaaaattagctgggcatggtggcaggcgcctgtaatcccagctacttgggaggctgaggcagaagaatcacttgaacctgggaggcagaggttgtagtgagccaagactgtgccactgcaccccagattggcgacagagcgagactctgtctcaaaaaaaaaaaaaaaaaccttcttgcttttgttgctgttttcttcctaaaagtggagctttgccttttcccttttaagtcagtcactgagacagtatttggytttgtgccctctgagagttattttccagcccacgagccccacgttctgattctgatgtgagataatggagcttagccctcagagatatggaagacaccaattgtttcgttctctaagtgttcagaaacaactgttcttttcttttcttccttttttacttccccttacaagactttcttttctttgcctcaaagagggtaaaggatggaagatagaaggaggaactcaggttagtctatggctcagaggccttgaatagtttgggaaaaaaattaaacaacatgaaactataacttctca

SEQ ID NO: 82769 - DNA, 601 bp, Human
ctactaaaaatagaaaaattagctgggcatggtggcaggcgcctgtaatcccagctacttgggaggctgaggcagaagaatcacttgaacctgggaggcagaggttgtagtgagccaagactgtgccactgcaccccagattggcgacagagcgagactctgtctcaaaaaaaaaaaaaaaaaccttcttgcttttgttgctgttttcttcctaaaagtggagctttgccttttcccttttaagtcagtcactgagacagtatttggttttgtgccctctgagagttattttccagcccaygagccccacgttctgattctgatgtgagataatggagcttagccctcagagatatggaagacaccaattgtttcgttctctaagtgttcagaaacaactgttcttttcttttcttccttttttacttccccttacaagactttcttttctttgcctcaaagagggtaaaggatggaagatagaaggaggaactcaggttagtctatggctcagaggccttgaatagtttgggaaaaaaattaaacaacatgaaactataacttctcattgttctctgctgcttccacctcccactgacag

SEQ ID NO: 82770 - DNA, 601 bp, Human
tgccaacatcaggccaactgaacccttgagagattgccctataaactgttattggagcagcatctgtttgccagggtaaatattcagtcatatggactgggccctggagtcttcagatggtgcagcccttcccagagggaagacttcatgggggtccaaatgctggtaagaagtttttgtttgtctgtgtctgccatcacagcatagagattaagaacctggtatttggaatcagacagatttttgtgtattatttacctgttgctgcataacaaattgcccccaaactcggtgactttcyacaacaatctttgtttattatctcttatggatccctgggccaagaattcacatggagcacaatggagaaggatggaagacctgaaaactaaactgaaatcatctaaagacttatttactcatgtgagctgtgttggagctgtcagctgcaacacttacacaaggcctctgcattgggcctgaacttcctcacaacatggtgactgggtcttaaggattggcctagataaagtcatggcagagaccactcatggaaagctatgtcaacaatggaagatgaatggccaggatgaagacagag

SEQ ID NO: 82771 - DNA, 601 bp, Human
ttttctatatatgaaatcatactatttgtggtcctttgtgactggcctctttcacttagcataatgttttcaaggttcattcatgtcttagcatgtatcagtgcttcatccctttatggtatatccataaaatgaaatattataggactatagtatttcattttatggatataccatattttgtttatccatttattagttgatagacatttgagttgtttttactttttgactactatgactaatgctgctatggaaattcttttacaagttgtcatgtggccatatgttttcatttttyttgagtgtgtacctagtggtgaaattgctgtgttatgtagtaactctatgtttagccttttgaggaactgccaaactgttttccaaagtgattgcaccagtttacattctcaccagcaatatatgagggtttcaatttctccacatccttaccaacacttgttattgtctgtctttttcattatagtcattctgtgggtatgaagtggtatctcattgtggttttgatttacattttgtaacgactgatgggtgttgaacatcttttttatttcctattggttattttgtatatcttctt

SEQ ID NO: 82772 - DNA, 601 bp, Human
tatatgaaatcatactatttgtggtcctttgtgactggcctctttcacttagcataatgttttcaaggttcattcatgtcttagcatgtatcagtgcttcatccctttatggtatatccataaaatgaaatattataggactatagtatttcattttatggatataccatattttgtttatccatttattagttgatagacatttgagttgtttttactttttgactactatgactaatgctgctatggaaattcttttacaagttgtcatgtggccatatgttttcatttttcttgagtrtgtacctagtggtgaaattgctgtgttatgtagtaactctatgtttagccttttgaggaactgccaaactgttttccaaagtgattgcaccagtttacattctcaccagcaatatatgagggtttcaatttctccacatccttaccaacacttgttattgtctgtctttttcattatagtcattctgtgggtatgaagtggtatctcattgtggttttgatttacattttgtaacgactgatgggtgttgaacatcttttttatttcctattggttattttgtatatcttctttggagaa

SEQ ID NO: 82773 - DNA, 601 bp, Human
ctgtgttatgtagtaactctatgtttagccttttgaggaactgccaaactgttttccaaagtgattgcaccagtttacattctcaccagcaatatatgagggtttcaatttctccacatccttaccaacacttgttattgtctgtctttttcattatagtcattctgtgggtatgaagtggtatctcattgtggttttgatttacattttgtaacgactgatgggtgttgaacatcttttttatttcctattggttattttgtatatcttctttggagaaatagctctccaattccctgccttttttttttttttttttttttttttttttttttttttccagagacagagtctcactcttgtcacccaggctgcagtggagtggtgcgatcttggctcactgcaacctccgcctcctgggttcaagcgattcccttgccttagactcccaagtagctgggattacaggcatccaccatgccaagctaatttttttgcatttttagtagagatggggtttcaccatgttggccaggttggtctcgaactcctgacctcaggtgatctgcctgcctcgacctcccaaagtgctgggattaca

SEQ ID NO: 82774 - DNA, 601 bp, Human
ttgtaacgactgatgggtgttgaacatcttttttatttcctattggttattttgtatatcttctttggagaaatagctctccaattccctgccttttttttttttttttttttttttttttttttttttttccagagacagagtctcactcttgtcacccaggctgcagtggagtggtgcgatcttggctcactgcaacctccgcctcctgggttcaagcgattcccttgccttagactcccaagtagctgggattacaggcatccaccatgccaagctaatttttttgcatttttagtaragatggggtttcaccatgttggccaggttggtctcgaactcctgacctcaggtgatctgcctgcctcgacctcccaaagtgctgggattacagatgtgaaccaccatgcccagcctcttgtccattttttaatttggttgtttgtcttatattattgaattgtaagaatgttttaacgtattctagttataagctgcttatcagatatacatttgcaaatattgtcttttttttttttttttttgagacggagttttgctcttgtcgcccaggttggagtgcaatggcacaatctcggct

SEQ ID NO: 82775 - DNA, 601 bp, Human
gtagctgggattacaggcatccaccatgccaagctaatttttttgcatttttagtagagatggggtttcaccatgttggccaggttggtctcgaactcctgacctcaggtgatctgcctgcctcgacctcccaaagtgctgggattacagatgtgaaccaccatgcccagcctcttgtccattttttaatttggttgtttgtcttatattattgaattgtaagaatgttttaacgtattctagttataagctgcttatcagatatacatttgcaaatattgtcttttttttttttttttttgagacggagttttgctcttgtcgcccaggttggagtgcaatggcacaatctcggctcactgcaacctccgcctcctgggttcaagcgattctcctgcctcagcctcctgagtagctgggattacaggtgtgcaccaccacgcccagctaatttttgtatttttgatagagacggggcttcaccatattggccaggctggtctcaaactcctgacctcgggtgatccacccgcctcggcctcccaaagtgctgggattacaggcatgagccaccgtgcctggccacaaatattgtctttta

SEQ ID NO: 82776 - DNA, 601 bp, Human
ttgtgtttgcttagtacttctttcttaaggttgttggcaagagcatctgctggtaacttggctcagtgtgttgtaggtttttgtatatggtttgggtttcctattcctgggcattgaactattaagattcctgcagataggcataactacttacagccttttctgtgtatatattagctcttacggacctcataaacctaaagaggtgcagaggaaaagtgccatcattctcattttacaactggggaagcagaggcccagaaaagtgatctaactttcccaagttcacaaatgtgttatyagagctgcaaccagagctaaggttgaggctttatgaaccttaggttactattcggttaataggctcagtgcagccttaccttactaattattaaaaatagacaacattaggatttaaaccagatggtcttttcctgttgttcacactcttacccactgtcagcaatggcccatcagataatccacactgattcatgaaaaggcaaatattttctgtttctgttctaagctaggcttgccaaaaccgagagcaatattctctatccccgagatgcattgcttcaagcacctatctactttc

SEQ ID NO: 82777 - DNA, 601 bp, Human
gcctgaatgagtaattccttctggattactaatatcaaaagtccatttgtatctgattgagatgaggaaagaaatgcaggatggagcagggaaccagtcctcacactacatggtttactccagcgattctcaacgttagcactacctatgttttgcacagggttagtctttgttttggggggctgtcctgcacaatggaggatgttcatcagtatccttggcctctatccattataagatgccagcagcaaaccaacctcctccaagttctgatgaccaaaactatatccagatatttgcygactgggggcacttgcccccagttgagagtcactaattacacagtacatttgtccatgatggggacatgtaggctcacggggtagccagtgacaggcaggcagacaggagtggggaattttttttctgtaaaggccccaagtagcaaatattttaggcactgtctgtcccaactactaaactctgccatgtagcttgaaagcagccaaagacaacacataaatgaacatgttccagcaaaactatttatgggccctgaaatttgaatttcatataattttcatgtgtcactaagtaatct

SEQ ID NO: 82778 - DNA, 601 bp, Human
ttttttttctgtaaaggccccaagtagcaaatattttaggcactgtctgtcccaactactaaactctgccatgtagcttgaaagcagccaaagacaacacataaatgaacatgttccagcaaaactatttatgggccctgaaatttgaatttcatataattttcatgtgtcactaagtaatctttttaaaatttttattcaaccacctaaaaatgttaaaactatacatgagtcgtacaaaatcaggtggtgggctagacttggcccatgagccatagttttctgacctttggactaagamatacatgaagccgtaacttcatatttatccctaagataaacatgggataaatatgatacttctcctaacaccatcaaatttacatataaattttagagaaagcatattattttattaaaatgagcattgctatattttggaataggacccaagccaaaatgaattttagagataaaacattatattccaaagttatatcttgcttcccatgggctgttgacccatgcctcaggtccccagaggccttcatttcctgccttcattttcccttgcttttaggctaccttggtaggaaaactt

SEQ ID NO: 82779 - DNA, 601 bp, Human
tagagctgtcagccgtggatgggagatcagggattggctggcaaaagtgccagggtgttgacaggcatagtctcagtcatctccacagttcttcctggctggaaatgcctctggctatattacccttattgcatgatttcatggtactgatcagatccaaagaaggaggatgattgtgagatgcaaagctcaggggacgactacgcggtgaaggtgagagaatgcccagagctttgaagaggctgcttcttcttcaaagctgtgttccagcagagcacattttgtgcatacttgaattttsgttggctctaggctgagcgcattctattgtggcgttggcatgggaagagggaggcatgcgagaaatattgcatctctgctattctcctgggcccttgtgaatgggaatgtcttcttaatgagcctatcccagagagtctggcctttcagataaacaaataagcatcagcaggagatgctcacaaaaggactgggcaaaatagggccacgttgagtgacaacccaaataaaggagtcctaagaggtctgaagctggtggctaatgagcacatctcctcatttgtgatttcttggccaggac

SEQ ID NO: 82780 - DNA, 601 bp, Human
gagttgtaggtgcactctgttctctggttctttgcagtgtaatggcagaactgaggttagaattctccttggatgtaaggatcaccagcccaccaggctggcagttagacaagggagtgatggatttgggatgctttgtgtgaccttgtatacaacaggttcttagacacaaccctaggacatggaaaagaattacattcatcctgagccccagctactgttaccaattcaaattaggacaacatattgattaagatacaggtagttatgctaccctaagaactggaatctgaatacctastttttatttctacttctaccgcttgttagtaacctattcttgatccaccatttaacttctgtgagcctcagtttctccatctttaagacagtgatgataatgacagtatctgtagaacagcttaacttgaactaaatgagaaaaactaaacaaaacacatagaattaagtatgaatttctgaggttagtttatacatgttttaagagcttagagaaaaggaaaaaacataagtatcctaaggagattaggaaatgtttccttggggaggttggaaagcagctaagccttgaagaatagga

SEQ ID NO: 82781 - DNA, 601 bp, Human
ctctggttctttgcagtgtaatggcagaactgaggttagaattctccttggatgtaaggatcaccagcccaccaggctggcagttagacaagggagtgatggatttgggatgctttgtgtgaccttgtatacaacaggttcttagacacaaccctaggacatggaaaagaattacattcatcctgagccccagctactgttaccaattcaaattaggacaacatattgattaagatacaggtagttatgctaccctaagaactggaatctgaatacctactttttatttctacttctaccrcttgttagtaacctattcttgatccaccatttaacttctgtgagcctcagtttctccatctttaagacagtgatgataatgacagtatctgtagaacagcttaacttgaactaaatgagaaaaactaaacaaaacacatagaattaagtatgaatttctgaggttagtttatacatgttttaagagcttagagaaaaggaaaaaacataagtatcctaaggagattaggaaatgtttccttggggaggttggaaagcagctaagccttgaagaataggatgtattttgaacactgggaga

SEQ ID NO: 82782 - DNA, 601 bp, Human
gaggttagaattctccttggatgtaaggatcaccagcccaccaggctggcagttagacaagggagtgatggatttgggatgctttgtgtgaccttgtatacaacaggttcttagacacaaccctaggacatggaaaagaattacattcatcctgagccccagctactgttaccaattcaaattaggacaacatattgattaagatacaggtagttatgctaccctaagaactggaatctgaatacctactttttatttctacttctaccgcttgttagtaacctattcttgatccaccatytaacttctgtgagcctcagtttctccatctttaagacagtgatgataatgacagtatctgtagaacagcttaacttgaactaaatgagaaaaactaaacaaaacacatagaattaagtatgaatttctgaggttagtttatacatgttttaagagcttagagaaaaggaaaaaacataagtatcctaaggagattaggaaatgtttccttggggaggttggaaagcagctaagccttgaagaataggatgtattttgaacactgggagaagagatgagaaggtagtgaagtggaggcaat

SEQ ID NO: 82783 - DNA, 601 bp, Human
tacaggtagttatgctaccctaagaactggaatctgaatacctactttttatttctacttctaccgcttgttagtaacctattcttgatccaccatttaacttctgtgagcctcagtttctccatctttaagacagtgatgataatgacagtatctgtagaacagcttaacttgaactaaatgagaaaaactaaacaaaacacatagaattaagtatgaatttctgaggttagtttatacatgttttaagagcttagagaaaaggaaaaaacataagtatcctaaggagattaggaaatgyttccttggggaggttggaaagcagctaagccttgaagaataggatgtattttgaacactgggagaagagatgagaaggtagtgaagtggaggcaatagcctgcactatccagagacagtttctgattgtcctaatgctatgggctctctacttcagtttaagaaatattccaatctttgataccttcattcaacagtcctttctatttttctaatttcatttcctgaattgtttccctgcggaggagtgggcctacttgttgaaataaatcacatcacagatacctcttttcttctcttt

SEQ ID NO: 82784 - DNA, 601 bp, Human
tatgctaccctaagaactggaatctgaatacctactttttatttctacttctaccgcttgttagtaacctattcttgatccaccatttaacttctgtgagcctcagtttctccatctttaagacagtgatgataatgacagtatctgtagaacagcttaacttgaactaaatgagaaaaactaaacaaaacacatagaattaagtatgaatttctgaggttagtttatacatgttttaagagcttagagaaaaggaaaaaacataagtatcctaaggagattaggaaatgtttccttgggraggttggaaagcagctaagccttgaagaataggatgtattttgaacactgggagaagagatgagaaggtagtgaagtggaggcaatagcctgcactatccagagacagtttctgattgtcctaatgctatgggctctctacttcagtttaagaaatattccaatctttgataccttcattcaacagtcctttctatttttctaatttcatttcctgaattgtttccctgcggaggagtgggcctacttgttgaaataaatcacatcacagatacctcttttcttctcttttgttaaaagt

SEQ ID NO: 82785 - DNA, 601 bp, Human
gtatctgtagaacagcttaacttgaactaaatgagaaaaactaaacaaaacacatagaattaagtatgaatttctgaggttagtttatacatgttttaagagcttagagaaaaggaaaaaacataagtatcctaaggagattaggaaatgtttccttggggaggttggaaagcagctaagccttgaagaataggatgtattttgaacactgggagaagagatgagaaggtagtgaagtggaggcaatagcctgcactatccagagacagtttctgattgtcctaatgctatgggctctctrcttcagtttaagaaatattccaatctttgataccttcattcaacagtcctttctatttttctaatttcatttcctgaattgtttccctgcggaggagtgggcctacttgttgaaataaatcacatcacagatacctcttttcttctcttttgttaaaagttctgttaaaatatatatattgttaaaaaattaaaggttatctccagataattccccaaatgagtaggcttaggctttaatcatattatgttcccttccttcttgctcttcacttgccaagttatactaatgatcataatc

SEQ ID NO: 82786 - DNA, 601 bp, Human
agaaaaactaaacaaaacacatagaattaagtatgaatttctgaggttagtttatacatgttttaagagcttagagaaaaggaaaaaacataagtatcctaaggagattaggaaatgtttccttggggaggttggaaagcagctaagccttgaagaataggatgtattttgaacactgggagaagagatgagaaggtagtgaagtggaggcaatagcctgcactatccagagacagtttctgattgtcctaatgctatgggctctctacttcagtttaagaaatattccaatctttgataycttcattcaacagtcctttctatttttctaatttcatttcctgaattgtttccctgcggaggagtgggcctacttgttgaaataaatcacatcacagatacctcttttcttctcttttgttaaaagttctgttaaaatatatatattgttaaaaaattaaaggttatctccagataattccccaaatgagtaggcttaggctttaatcatattatgttcccttccttcttgctcttcacttgccaagttatactaatgatcataatctcttctatgtgttttggactttacagtgtgtga

SEQ ID NO: 82787 - DNA, 601 bp, Human
aaacccagtctctactaaaaatacaacaaattagctgagcatcatggtgcgtgcctgtaattctagctactcgggaggctgaggacatgaaaatcgcttgaacctaggaggcagaggttgcagtgagccaagatcacaccattgcgccccagcctgagcagcagagagagactctgtcaaaaaaaaaaaaaaaaaaaaaaaaagaaagaaagaagaaagaaagaaaagaaaaggagaaagaaaacacgattctctgaagaaaaaagcaatacactgagagaaggaaacatgaaggtattcrtttaaatagtgggtcagtgaatgcccttactgagtaaaagtgacatttaagcctagatttcaatgctggatggtattcatgctacaaaacaatttggagaatattctagccaaaagggaataatttgtgcaatgatttgaaaaatggaaggacaaccagggtagctggaatgtttatggcaagggagagagtgatagaagattaaatcaggaaaacagagaaagtaacagatgaggcagtgcttgacaggccatgaaaagaagagtgacttttattttaagtgcatgagaagccactgga

SEQ ID NO: 82788 - DNA, 601 bp, Human
ccttactgagtaaaagtgacatttaagcctagatttcaatgctggatggtattcatgctacaaaacaatttggagaatattctagccaaaagggaataatttgtgcaatgatttgaaaaatggaaggacaaccagggtagctggaatgtttatggcaagggagagagtgatagaagattaaatcaggaaaacagagaaagtaacagatgaggcagtgcttgacaggccatgaaaagaagagtgacttttattttaagtgcatgagaagccactggaaggtcacaagtagaaagggatgtgrtctcatctgttttaagaatttggtccagtcggctggccgcggtggctcatgcctgtaatcccagcactttgggagcccaaggcgggtggatcacgaggtcaggaattcgagaccagcctggccagcatggtgaaaccccgtctttactaaaaatacaaaaaattagctgggcatggtggcgtgcacctgtagtcctagctacttgggaggctgaggcaggagaattgcttgaacccgccaggtggagattgcagtgagccgagatagcaccattgcactccagcctgggtgacagaggga

SEQ ID NO: 82789 - DNA, 601 bp, Human
agaagccactggaaggtcacaagtagaaagggatgtggtctcatctgttttaagaatttggtccagtcggctggccgcggtggctcatgcctgtaatcccagcactttgggagcccaaggcgggtggatcacgaggtcaggaattcgagaccagcctggccagcatggtgaaaccccgtctttactaaaaatacaaaaaattagctgggcatggtggcgtgcacctgtagtcctagctacttgggaggctgaggcaggagaattgcttgaacccgccaggtggagattgcagtgagccgaratagcaccattgcactccagcctgggtgacagagggagactccatctcaaaaataaataaataaataaataaaagaatttcgcccagtcactgaacttctttgtgactcccttttctctcctgaaaacaaggattaaactactgattgtccttccaagaggttgtctgagtgtcagatcatgttcattataatactttgctccaagttgtgcttgataaattttgaactgaattgtttcataacaatatgaaaatgctttataaactgtaaagggccatgcaagtataaagtattaccaa

SEQ ID NO: 82790 - DNA, 601 bp, Human
tcaagtgtctgccttagagctaagcttctctcttggtgaaatggtttaaaatacccatccagtacatgtcctaaaatggacatgaggttcctctgggataaaggatgagaagatactttgtattttgtaacattctactcagatgcaggatgttcatctcattaatattacactctggtgccagtttctggggggtcagctgcagagaagctagttcaggctgcaacatctcattagaagctgaaatttggattcaggaagaggagcatggagtgggtgagagccactgtctgctgctcargttcctgctgctatctgtattcagagaggcatcctggtaccttagcagtgctgctcagtgggacgtctctgactttgatgttgcacgtgtcaacattctaatagggcagcagccgagatggggtatgagtttggaaagacatcttatgacagctttttcctaaagatgtttcaagagataaccctttagaaataacgaaggtagtttatgcatttcataggaaacccagcggcttacgtagcagctcacttcgaagtctggcatgcggacggcttcctactgtcccgtttttgccctccc

SEQ ID NO: 82791 - DNA, 601 bp, Human
cagctgcagagaagctagttcaggctgcaacatctcattagaagctgaaatttggattcaggaagaggagcatggagtgggtgagagccactgtctgctgctcaagttcctgctgctatctgtattcagagaggcatcctggtaccttagcagtgctgctcagtgggacgtctctgactttgatgttgcacgtgtcaacattctaatagggcagcagccgagatggggtatgagtttggaaagacatcttatgacagctttttcctaaagatgtttcaagagataaccctttagaaataatgaaggtagtttatgcatttcataggaaacccagcggcttacgtagcagctcacttcgaagtctggcatgcggacggcttcctactgtcccgtttttgccctccctgcacatctgtgagaaatcatcacttgtcacagtaacacagtattgtatttagttacattgacagcaatggtgaaaggactataagcctatttccttctaaactgttcacatcaaatgaaccttaaacatttactcctctcttaaaatgtaaatcagatcacctcagcctactgtttaaacattctatcatggctt

SEQ ID NO: 82792 - DNA, 601 bp, Human
gccactgtctgctgctcaagttcctgctgctatctgtattcagagaggcatcctggtaccttagcagtgctgctcagtgggacgtctctgactttgatgttgcacgtgtcaacattctaatagggcagcagccgagatggggtatgagtttggaaagacatcttatgacagctttttcctaaagatgtttcaagagataaccctttagaaataacgaaggtagtttatgcatttcataggaaacccagcggcttacgtagcagctcacttcgaagtctggcatgcggacggcttcctactstcccgtttttgccctccctgcacatctgtgagaaatcatcacttgtcacagtaacacagtattgtatttagttacattgacagcaatggtgaaaggactataagcctatttccttctaaactgttcacatcaaatgaaccttaaacatttactcctctcttaaaatgtaaatcagatcacctcagcctactgtttaaacattctatcatggctttccatcatgaatagaatccaaatgcctaacacaagctggatggtagcctgatctgacctttgctgacctctctgacctcccctcac

SEQ ID NO: 82793 - DNA, 601 bp, Human
gatgactacaatgtggtattttatgtttgtttgagaatattagctgttagggctgtggtaacctctaccagattgggttaaacaaaagcagtctgcagtccatgataatacaatggaaaagcatagggaacacaagaaacctgggtgaactttttcacaaacaattcatttttctaatgaggcaactaaagctcagaaaaggaaagggtcttccttgtgatcatacattcattttatcattcaacaaaccttaactgaatacctcctattcaacagtgcacgagctgccaggaacaatgargtaagtattaacagaaatgcctaacatttactgagcacttcttaggtgctgggtacacactaagtccttcaagtagtctctcctgctgaaagtgctattccaagtgcaagttggaacagcaggtgccttggcaccaaagctctatgtgaccgacctttctgacctggcctcacttccttccccctcccctcatttctctctcttctctccctttatttttcttttctttctctctctcttttttttttttttttttttttttttgagacagactcttgctctgtcgcccaggctggagta

SEQ ID NO: 82794 - DNA, 601 bp, Human
acaaatatgtacgtaatatacactcagagacctcggtgagtgagaaccaggagagtggcatggtgattaagtaaggtaatatttgatggagtcttggaggatatcattggagtgctttttccaccatgccaaagttgcttcccacctggaaaaactgacattatgaaatctttcttggataaggaagagaaatcaggctttactcaaatgtaaagaaaagcacagaagcattattgagatggtttgagggtcagccggatatttcagtacacaagaaaactgatagtccacttgaggcacrtttccagacagggtcttaacttctcctcactgctgatcttgtgacatgttctctgatgaagggcttttttaagctctaggttgaattgctcacccatttctgcttctgattctttgcctcctgcatcaaaatttcaggtggctactcacctgggatggtagtgtgatatagtttggatgtttgctcccacccaaatctcatgttgaattgtaatccccaatgctgaaggtggggcctagtgggaggtgtgtgggtcatgggggcagatccctcagggcttggtgctgttcttccaatagg

SEQ ID NO: 82795 - DNA, 601 bp, Human
ctttctaaagcactgggtttgtgtgtatgtgtatgcacgcacttcccccaacccccatgcctccattactcctctactccaaaaaatgtcagttgtttttctagtgcctgcaatgtaaggcctaagcccactggcatcaaagacttctgtaatttagcatcaactaaactttcagctgtcacttcccactgttgggaaaccatataacatgatgttagaacatagtgacagaaggagctttggagtcaaatagctgatgtaaatcttgtttcttccattttctgcctttgtgacctaggayagattgcttaatcctgctgagcctatggttttatacttttaaattgaaattatagtgtaaagtttaaatcagataattaaataaagccttgagcataatccatgatgtactgaaagtaatgattaaataatagtctattagactatacagcctactcactatctctcattcttatctagtatttactagctagttaggcactatttctattgcttagaacaacttctttcgcatctatccaaaatgtataaccctttggtcaccagatcaatatcttcagctccttcctttcaggtacta

SEQ ID NO: 82796 - DNA, 601 bp, Human
ccactggcatcaaagacttctgtaatttagcatcaactaaactttcagctgtcacttcccactgttgggaaaccatataacatgatgttagaacatagtgacagaaggagctttggagtcaaatagctgatgtaaatcttgtttcttccattttctgcctttgtgacctaggatagattgcttaatcctgctgagcctatggttttatacttttaaattgaaattatagtgtaaagtttaaatcagataattaaataaagccttgagcataatccatgatgtactgaaagtaatgattaartaatagtctattagactatacagcctactcactatctctcattcttatctagtatttactagctagttaggcactatttctattgcttagaacaacttctttcgcatctatccaaaatgtataaccctttggtcaccagatcaatatcttcagctccttcctttcaggtactatatattgcatttgcttcataacacctaatacaatgcatgaagcatgcttttaataaacattccttggatggatgaataaataaatgaataaagaaatgaagtaaaagaaagtcaatttttatattat

SEQ ID NO: 82797 - DNA, 601 bp, Human
agggaaaaaagagaaacgaatcaaaatatcttggaaataaaattctgttcctctctgagcttttgatttgtttataagctggggagcatgttgcttaccatttatttagtctcacaagtatgttaacatcatcaacataaggtttatgaagtactttatactgcctggaggaaggatggtatagaaatttaaaatattatatatgatccttccaggaagaaaaaaagaagcaatatctattctgtgaggtgcatcaattttggatcactctaatggaagtgccccgagcagttggtttatytcttcaaatgtgaattaatttatacatttcaaagctcctgatggatacttttcattttaattaagtacatttttgccaaatttcaactttaaaaactcaacaaatttgttcccacacttgctttgtagaatttgcaatattagatataaatttattataaaagggtatgttagaaacttctcatactgaaatcggccacccagcaactttttcttaggattcaagtgctctaacatgtgcttgcttgtttgtctgtgtgattcggtggttttattttgattttcatagaaaataataaat

SEQ ID NO: 82798 - DNA, 601 bp, Human
gattgcacagtactatattgctgtcacaaatggtgttttggagtaaacaaataccattgtttctaacattaaattaatattggtgattcaaaatgtactgaaattataatttgtgtttgtctcatttgtaaatttcctttggttttatagttttaagatagctataaataaaggattgatctctgacttcatgtttgtacattttcaagtatcattatagtaaatataatttgtcaacattgtggattcagaagaacagtttccttcaaaaagcgttcataaattacatcagttcgaaaaattgcattagtagatgatagtaaaagcctccaagaaagtgttgcattatggccaagctttattataccaagttcacaaaacataaagggaggaatcagaaatgcagagaatggcagatatggaaacagcagctttgcaggtaagagtaaaatactgaagttctaagaggtttttagggttggataaaatggaaaaatcaagactgagagaccgccagagtcctgtgagtattgttgatgaactcttaaaatgtgcaaactcaacaagctattgaaatgtgtgtgtgtgtgtgtgtgtgtgt

SEQ ID NO: 82799 - DNA, 601 bp, Human
gaagaataccacctttttttcttacccttttaaagttgagaagattatttgtaagagtgtgaaatggtctaagcattgcccctttaaatgggggtattgtgttaattgtaagcactgcaaagtgggttgctatattgtggctgttgtactcagtgtcaaaagatttagttccttcttgacccagtcctagttattcaagagtcatcaaacagagatacacaattttaaattgtttttcagaatgaatctgaagagagcgaagagttgagtggagaagtcagctagatcatccttgtctatytatgcagactccttcccataatttttccccaatctagtttatgcctaattttataccaggaatttcttcctgaccttttaattgcctgtccttagggcatgaaaattatgagtgtaattttacagaccattcttaacttttcaaaaccattccaacgatattcatctaagaaatggccagtgtttgtggagcactaatttgtcacgcagcattgtgctagacattcaagatatcccattgagtatcgcacgaaaaccctgaccaacacatccctataccaactaggtcagatcctcattc

SEQ ID NO: 82800 - DNA, 601 bp, Human
ttgtggctgttgtactcagtgtcaaaagatttagttccttcttgacccagtcctagttattcaagagtcatcaaacagagatacacaattttaaattgtttttcagaatgaatctgaagagagcgaagagttgagtggagaagtcagctagatcatccttgtctatctatgcagactccttcccataatttttccccaatctagtttatgcctaattttataccaggaatttcttcctgaccttttaattgcctgtccttagggcatgaaaattatgagtgtaattttacagaccattctwaacttttcaaaaccattccaacgatattcatctaagaaatggccagtgtttgtggagcactaatttgtcacgcagcattgtgctagacattcaagatatcccattgagtatcgcacgaaaaccctgaccaacacatccctataccaactaggtcagatcctcattcacaggtattcataatacataaaattcccctgcatagcactaggtcacatgtaggcaataattatttatcttgtatatgccttttcactcaactgtgagctcctagaggacataggtaaaatctgttttgttcac

SEQ ID NO: 82801 - DNA, 601 bp, Human
tgagtggagaagtcagctagatcatccttgtctatctatgcagactccttcccataatttttccccaatctagtttatgcctaattttataccaggaatttcttcctgaccttttaattgcctgtccttagggcatgaaaattatgagtgtaattttacagaccattcttaacttttcaaaaccattccaacgatattcatctaagaaatggccagtgtttgtggagcactaatttgtcacgcagcattgtgctagacattcaagatatcccattgagtatcgcacgaaaaccctgaccarcacatccctataccaactaggtcagatcctcattcacaggtattcataatacataaaattcccctgcatagcactaggtcacatgtaggcaataattatttatcttgtatatgccttttcactcaactgtgagctcctagaggacataggtaaaatctgttttgttcactgctgaattcctagaacccaacatagtatctagcaccaagaagcactcaatagaagttggatgaactaaagaagaaatggttggtctaggaaggggttgggaccataagaagcatactgttatttaagaag

SEQ ID NO: 82802 - DNA, 601 bp, Human
gagagtgtccctgaaactagtagatggctctagattccattgaattcctgccaaggggcctgacagcatagatgaattctactacttccagcttcctctagagttagcagagtccaggtttgggagtcaggagacccagattctagtcctgtctgtgccgtggtctctttgtggttttgagcatatcactttatctcttgtatcctcagtttcctcttgtgtaaaaaggagatttttctcatcactagttggtaggacaaggacatttttaatttattttttctccctaaataatgcatgyataacttacaaaatcaaatgttacttcaagtcataagacaaaattcaacattctcttccctcctccctttctatcttggattccagctctcataggggatcactttaggctctcttagctgtttcttctgatattttacctttgtatctcttgtattgcctgttctggtttgggctgctataacaaatactatagactgggtggcttaaacaaaagatgtttatttctcagttctggaggctgggaagtacaagatcaatgtgaggccaatttgggtcttggcaaagacctgcttcctag

SEQ ID NO: 82803 - DNA, 601 bp, Human
tataatataatatatatataattaatatatataatataatgtaaatacggtctacatcttagaaatagttctttagtcctttactaactaacaaagtgctagacacagaatgctgggcaggcacataggattggaacactaaatacttctttggctaacttagtgcttttaaatatatattcagtcatttctaaattcccagtgtcatgttccatgagaggtcacatagatgcataaaagctccctcaaggactgtaaccttattagggaaatacacatatatagacaataaaaaaaaaaacaggtcaacactgtcactaagtagcaaattatgtcattttcatagtttaagagtgacagatttcatggcctgagtgatcaatttggatgcatccatcatggctggcatcccagaaaaggctgggaatgatttagacagagtgaaatgagagagtcttttaaccacacagggtataacaagtatgcatctattctttttggaatgtttaaaaattatcaaatcagaagcatcttaaaattcacttttctttgaaaaatgtatgcaagatccagccactttatttttgttcatatttggttt

SEQ ID NO: 82804 - DNA, 601 bp, Human
catgccattctcctgcctcagcctcccgagcagctggaactgcaggcgcccgccaccacgcctggctagtttttttgtatttttagtagagatggggtttcaccctgttagccaggatggtctcgatctcctgacctcatgatccacccacctcagcctgccaaagtgctgggattacaggcatgagccactgtacccggccagggctgttgattttatataatttccttcctttttggctgattgaagtccattgctaattctagtttgacactttttattacctcaactagattatttygtccagaaagtttactgagcatcttctaggctaagcactttagaaagtatgaaagaagtttaattcacaatacttatcctaaaagatcacaatcttgctgatggcacttagacagtacagcaatcccttgatatccacaggggtttggtaccaggactcctacagataccaacatctaggtatgtttaagtcctttatataacatggcgtggtgtttgcacataacctaggcacatcctctcacatactttaaatcatctctatattacttataatacctaatacaatgtaaatactatg

SEQ ID NO: 82805 - DNA, 601 bp, Human
ggtttcaccctgttagccaggatggtctcgatctcctgacctcatgatccacccacctcagcctgccaaagtgctgggattacaggcatgagccactgtacccggccagggctgttgattttatataatttccttcctttttggctgattgaagtccattgctaattctagtttgacactttttattacctcaactagattattttgtccagaaagtttactgagcatcttctaggctaagcactttagaaagtatgaaagaagtttaattcacaatacttatcctaaaagatcacaatcytgctgatggcacttagacagtacagcaatcccttgatatccacaggggtttggtaccaggactcctacagataccaacatctaggtatgtttaagtcctttatataacatggcgtggtgtttgcacataacctaggcacatcctctcacatactttaaatcatctctatattacttataatacctaatacaatgtaaatactatgtaaatagctgccacactttattattttgattgttatgttgttaattttatttttaatattttcaatctgcagttgtgaatctgcaaacgtagaac

SEQ ID NO: 82806 - DNA, 601 bp, Human
agcactttcggaggccgaggcgggtggatcgcgaggtcagaagattgagaccatcctggctaacatggtgaaacactgtctctactaaaaatacaaaaaaactagctgggcgtggtggcgggcgcctgtagtcccagatactcgggaggctgaggcagcagaatggcgtgaacccaggaggcggagtttgcagtgagccgagatcgcgccgctgcactccagcctgggcgacagagcgagactccatctcaaaaaaaaaaaaaaaaaaaaaaaaagtatggagtttgtaaggataggttttcaatcagtagaaaaagagaaatgccctcaaatccagaatttatttaggaaagaaatagcgcttttccacccaggtttttgactgtggaaagtcaaaggaggcacctgaaatttcagaccactatacccaaagcacctacatacatagaaaatggtgatctcaagcctcagagtgaaaaatgaacatcccagggagaccaaagaggagaagtgcctgtctgtttcttgccaggctggggggccaaagggaaactgggagaagaagcagagacacgtctaccaccatggaaccttgctgcta

SEQ ID NO: 82807 - DNA, 601 bp, Human
aggctgcatagtattccatggtgtatatgtgccacattttcttaatccagtctatcattgttggacatttgggttggttccaagtctttgctattgtgaatagtgccacaataaacataacgtgtgcatgtgtctttatagcagcatgatttatagccctttggctatatacccagtaatgggatggctgggtcaaatggtatttctagttctagatccctgaggaatcgccacatgtgccctaaaacttaaagtataataataattaaaaaaaaacagttaccagtatttattgagtgcytaaggtagtaaaggcttgagaagctggagcctattttcataccgaatatgtaaatatcgacatctctgctctagaagatctaggacactctggaaaagtgtctgtatatcttatattaggagtagtggcctcaccaatgtggtgtcatggttagtaaaggacaggctgagtgaacaagaagggactgatcatgtctttgccagttgccaccgcctagctacgttcttgggcatgggacctaatttgtccagcctcaactttcatctgtgtgacaggtccaataattccccataccacagg

SEQ ID NO: 82808 - DNA, 601 bp, Human
ctagatccctgaggaatcgccacatgtgccctaaaacttaaagtataataataattaaaaaaaaacagttaccagtatttattgagtgcctaaggtagtaaaggcttgagaagctggagcctattttcataccgaatatgtaaatatcgacatctctgctctagaagatctaggacactctggaaaagtgtctgtatatcttatattaggagtagtggcctcaccaatgtggtgtcatggttagtaaaggacaggctgagtgaacaagaagggactgatcatgtctttgccagttgccacygcctagctacgttcttgggcatgggacctaatttgtccagcctcaactttcatctgtgtgacaggtccaataattccccataccacagggatgttgtgatgattaaatgataagcagagattttagtacaggattggatatatagtaagctctccataaatggtaatactattactatacatatacatgtattttacatacctatatatatttacatacatttatgatctagtttataatctccaatatgccttggaagcttcagaatgagtcttatttcatttttgtaatgttactatc

SEQ ID NO: 82809 - DNA, 601 bp, Human
ccttggaagcttcagaatgagtcttatttcatttttgtaatgttactatcatacacagcaataacagaaacaagttctaaaatttctccctggagctttacttcaggagtttgctaccaattagaggggtggggggaagaggaagagatgggagaaagagaatttcacctgttttagtctctatatacaaataaagtgggtgacccctaactttgccaagctcttgcctcagaatgaaaccacacccagtgcctgtaacttcctaatcaaacacgtgagttaccttcaagggttacaaaaycatagttcatggatgaaatatgtgtggcccaaacagaattctaatttgttaaaaaaaacagttgctaacctttcaaaatacaagaatttcatttgaaaatctaggtttctgtcttctcacttacttttaactttcttaatctgacctacatactcaaggcaaaactatatagcacactgttttatcacaaaggtaacactcagccaagtcaagaattgtagcgttgtcagcccccaggaatgctcttgtgcccatccctagctctatacactgtctctccaaacagaacctctatcggga

SEQ ID NO: 82810 - DNA, 601 bp, Human
agtctctatatacaaataaagtgggtgacccctaactttgccaagctcttgcctcagaatgaaaccacacccagtgcctgtaacttcctaatcaaacacgtgagttaccttcaagggttacaaaatcatagttcatggatgaaatatgtgtggcccaaacagaattctaatttgttaaaaaaaacagttgctaacctttcaaaatacaagaatttcatttgaaaatctaggtttctgtcttctcacttacttttaactttcttaatctgacctacatactcaaggcaaaactatatagcamactgttttatcacaaaggtaacactcagccaagtcaagaattgtagcgttgtcagcccccaggaatgctcttgtgcccatccctagctctatacactgtctctccaaacagaacctctatcgggattcatcataacatccttgtttttctttagaactttaccacctaagcatgcatttctaaatgttagagtttaattttgtctacattttggaattcagaatatactcctgacctcacggtaggaaaaatcttcttaaacaaaatataaaaccatccataaggaagaaactgataaat

SEQ ID NO: 82811 - DNA, 601 bp, Human
ttcaaaatacaagaatttcatttgaaaatctaggtttctgtcttctcacttacttttaactttcttaatctgacctacatactcaaggcaaaactatatagcacactgttttatcacaaaggtaacactcagccaagtcaagaattgtagcgttgtcagcccccaggaatgctcttgtgcccatccctagctctatacactgtctctccaaacagaacctctatcgggattcatcataacatccttgtttttctttagaactttaccacctaagcatgcatttctaaatgttagagtttarttttgtctacattttggaattcagaatatactcctgacctcacggtaggaaaaatcttcttaaacaaaatataaaaccatccataaggaagaaactgataaattgaactgtattaaagttaacagtttctgtcctataaagcaggagataccattaagagagtgaaaatgcaagctacagaaaggaacactcacatttagaatacctaaaatcagtttaaaaagaggagagacaaccaagtagaaaaacaggcaaaaggtggccaggcgcagtggtcaggaatttgagaccagcctgacc

SEQ ID NO: 82812 - DNA, 601 bp, Human
agtattcgtccaaattacatagtctttcattaacacaagaggaagtcctgttcctgatcttgaaaaaaatgatagatatgtccacaataggctgaaacaaggcagtgatttctcccttcatatgaggaatacattctcccacaatgtccagctagcctccttctcattcaccttagcccagtgactttggcatttgggattcagactcttttctttttttttttttttttttttttttgagatggagtcttgctctgtcacccaggctggagtgcagtggagcaatcttggctcactgcargctccaccttccgggttcaggtcattctcctgcctcagccttccgagtagctgggattacatggcccaccaccacacccagctaatttttgtatttttagtagagacgaggtttcaccatgttagccaggatggtctcgatctcctgaccttgtgatctgccggcctcggcctcccaaagtgctgggattacaggcatgagccaccgagcccagcccagactcttttcttaaatattccaataaggtacaatttgatcatcctaggtttctttcctctaagtctggcatgatatggttgg

SEQ ID NO: 82813 - DNA, 601 bp, Human
acaaggcagtgatttctcccttcatatgaggaatacattctcccacaatgtccagctagcctccttctcattcaccttagcccagtgactttggcatttgggattcagactcttttctttttttttttttttttttttttttgagatggagtcttgctctgtcacccaggctggagtgcagtggagcaatcttggctcactgcaggctccaccttccgggttcaggtcattctcctgcctcagccttccgagtagctgggattacatggcccaccaccacacccagctaatttttgtattkttagtagagacgaggtttcaccatgttagccaggatggtctcgatctcctgaccttgtgatctgccggcctcggcctcccaaagtgctgggattacaggcatgagccaccgagcccagcccagactcttttcttaaatattccaataaggtacaatttgatcatcctaggtttctttcctctaagtctggcatgatatggttggtaaatggaggttaactattttattattttgctagagaagaactcctaaagcccctatggggttggcatcattctactgtctgcatgcctggaagat

SEQ ID NO: 82814 - DNA, 601 bp, Human
tatttccttatcagaaaagaactttgcataatccgtaagggacttcttctacttcccattccactgaagaacttcaatttagtattttacccagcatttgctgcaagcttcgtaggatacccagccacacatacccatatcagcagcaagttctgagagccagcggcagtattagcattataaagtgtttccagagttggaccagtgtgtgcttccccttcataaatccttaaatcttaggctcactcagctggaaaaaaaaaaaagaaatctgggtttgaagaacacttatttatttttkattttctctgccttgtgtgcttcttttgactgcgcatctgaatatcaaggcaagaagtgctcaagttcctctgggctctggaaggctggaaccaattggtattcttggagtcggtcctttttggactaaagctcctttttcttttcctccccccaataaaaatttctgttccagggagtactttctcagtcactcctttcctaatgtaattctgtttgatttccactgaacggctcctgaaaggagacactgaaccatgcctccacaagcatttcaattcctcaacaccagctttcaggc

SEQ ID NO: 82815 - DNA, 601 bp, Human
aagttcctctgggctctggaaggctggaaccaattggtattcttggagtcggtcctttttggactaaagctcctttttcttttcctccccccaataaaaatttctgttccagggagtactttctcagtcactcctttcctaatgtaattctgtttgatttccactgaacggctcctgaaaggagacactgaaccatgcctccacaagcatttcaattcctcaacaccagctttcaggcaggagcagttccagatgcatttttatatccagtaatcatgcatttaaccaaaatgattgatgyagcattttttcccctctctatcatttccagtccattagtcttatttgttttccatggtttgggttcctgccaaatcagtgaatatacaaatacttgcataagtcatgcacatctacacacacatacatgtaataggtactgggtctgtatctgagttgaatattcaacattttatttccaggcttcatgtctccactgaagttttagccgcttctttccttctttcttacttccctctctcccttctttttttccctctcttcctctcctttatagtctattaagttggtgcaaaagtaa

SEQ ID NO: 82816 - DNA, 601 bp, Human
agttcctctgggctctggaaggctggaaccaattggtattcttggagtcggtcctttttggactaaagctcctttttcttttcctccccccaataaaaatttctgttccagggagtactttctcagtcactcctttcctaatgtaattctgtttgatttccactgaacggctcctgaaaggagacactgaaccatgcctccacaagcatttcaattcctcaacaccagctttcaggcaggagcagttccagatgcatttttatatccagtaatcatgcatttaaccaaaatgattgatgcrgcattttttcccctctctatcatttccagtccattagtcttatttgttttccatggtttgggttcctgccaaatcagtgaatatacaaatacttgcataagtcatgcacatctacacacacatacatgtaataggtactgggtctgtatctgagttgaatattcaacattttatttccaggcttcatgtctccactgaagttttagccgcttctttccttctttcttacttccctctctcccttctttttttccctctcttcctctcctttatagtctattaagttggtgcaaaagtaat

SEQ ID NO: 82817 - DNA, 601 bp, Human
caattcacagcattgccaagaaagactgtagatattcagggatgagagtgagattcctatgagccagagaatcaaaagctctgtaaattagtgagttcgtgatatcatgctacgctcctgtttttaagagctagatatcaaaataaatggtccagtgtatgtgcctgatggctatgtcttttccactgtacacacaagtaagattctgcatggtgactatcattttgttttcaggaagtagatgaatcagccgtttggttccctgggaatgtgggctgctggcttttaattctttttgggraagatttctatgtcatcagccatcttgtttatctggaaacatgggacaaacgttggctctctttctacctatgtagtcctttgctagggttgtacagcttgagtagaattgggaaaagtgatttggatccttgtgactgggattagggagaattggtacatgagtatacagaatcttttcattgatctccttgcctctgaccttgatttagccacctactttcagtggataaggccctacagaacaaaccaactgaagcatactttaggataggccacacctctaatctcatatttatta

SEQ ID NO: 82818 - DNA, 601 bp, Human
taaggccctacagaacaaaccaactgaagcatactttaggataggccacacctctaatctcatatttattatgaccaactaaaaactgcttatccttctctttatgtctattatttaactttcccctcctctctaccttctttcccttaagtccttctgatacactacatgctcctgccattgtgactatgagtctaaaaagctggtggcattacccaccttcccctccaccttcaaaactcacatgtacaccatgctttgggcttctctgatttggctcactatttcttcaacttagaaygcccactttctattatgatcattaaaagatcctggatttatgtgtggggtggatgtagtaacaactgggaaatagcataaaattatttggtttcttgtatgctggttttcttcccagaggtaacctgtttggtttgacgtttggcttaatgttgttaatttgacgaaggtggaaatggatgggctagaaatctttgtgggactaggataaggcttgaatggtctaatctagggattcaaactttctagttaagaatgtacaacctgtgaggataatttgcattttattctacatatatcc

SEQ ID NO: 82819 - DNA, 601 bp, Human
aatagaaagaagtataaaatacagtgcctaggtctgcaagtatttattacctgtgacactactatgttggccaaggagaagttctgtatattatgctctttttataaaagcagaagcatgtatagaaactattaggatatttttcttcaaaatgtttaaaattctttagctgcttacaagagaaatttatttagtactactttctcaaagatcccatttcctgacaatgctaataatggaggcatttcaagataatgacctcataaaattcacacaactgtctgtctgtgcagacttagayagcacagtcatgacctcacttaggtcagggacagatcttagcttgatagggcaatggtcagaaatgcagtttggtttaaacagttttttcctcttctctgttgactcatttaatgaaagaaagtgtctcattcaacctgcatatttttttcaaagattccacaatgatggggccatgtctcctatgagttattatacaaaatggacactgagtcctgaggtacattaggaagccccaaacttatccttgtatttaattcatttgaacattttggatattttattttatcaagccagtcat

SEQ ID NO: 82820 - DNA, 601 bp, Human
cacttaaaggaacaccaaatcatttgagtgcacaggcaatgacaccatctgtagacttatctgatccagagaacctgaggtggagcctatagcctctggtcagttggaagcggtggggaaatctcaagaacacttgtcctgagagaaagaaaactttatctgcttgttacacatgagcctgagctgaggaaatagacctggatccagggaattcgtgtttactgggtgccacaacttgtgttagcacttgacatgatttcttctatttaaatattagactaaaaacactctatcagactasggttttaaaatactatttcatttttttggtacctatttataaaatggggaaactgagtcttgggggatattaaggtcttatagactgtaaatggtataatccaaggttgaaaggtttcctgactctaatgctggttctctttcacaatacctcattgccttctggaagttgtagttcctaccctagttctgcctttatttggctgtggtaatcaaaacaaatcacttaagttcttgaatctcattttgttcttctgttaaatatcacaaaaccaaccaaccaaccaaaacagtgagaata

SEQ ID NO: 82821 - DNA, 601 bp, Human
gcttccatgatttgtggatggtcttcacaggcaacaattaattcatgaggaatgatgcccactgctgtcatgcaacatagtggccctggattttaaggaatccatgtattaatacatgcaacctgaaatcacatatgtaaattgtattatatacttgcatatctatattgttttagagaagaggctaaagctttcttgagaggctttctgtggcatctatatccccaaattcctaaaaatcattaggttcttggcagctcattaagtgattagtaggtctccttatgatgtgttataactsaaaacatcagtaaccatctgaaagaaattaaggtttaggacaggcatggtggtacacacctgtaatcccagcatttggggaggtaaagatggcagtatcgcttgaggccaagagtttaagaacagcctgagcaacacagtgagaccctatctttacaaaaaatttaaaattgttattaaaagaaattaaagtttagtacatgaaagcagctgaaactcagaactgacccttacatcagaaaccatgtggtatcatggaaagaaatctggcaaagaatcaaagattctgggtcctacttta

SEQ ID NO: 82822 - DNA, 601 bp, Human
aaaagaatcaaatgtgataatatggatgaaggcactttggcaaaatatgaagtaccctgcaaaagtctgatattaaccatgagatattaaagtatcaagtcatttcactagttgtcaactgagaaaaagggaaaattgcaagttccatcagcaaaatttagaagccttgctttttcattccttcagcaaggtcctacagctgatatttatgcataaattttcttgactttaatgagaattggttgcaaatacaccttacaggattcaaatggagatcatcaccattctaggagctgctaawcagaacatgtggcttcttctctagccaagagttctcctcttttatcacctttattttatgatcagtggttctcaaggaatggtcaagcaccagcagcgtgagcatcttctgggaatatgttagaaatgaaaattctcgagccccatcccagacctactgaatcagaaatcctggaggtggagcccagcaggctgtgttttaacaaacccttaagaggattctgatgccctgcacacttaagtgtgagaaccactgccataagtgattatccttggagagacctactttggtcctgggtac

SEQ ID NO: 82823 - DNA, 601 bp, Human
agaagccttgctttttcattccttcagcaaggtcctacagctgatatttatgcataaattttcttgactttaatgagaattggttgcaaatacaccttacaggattcaaatggagatcatcaccattctaggagctgctaaacagaacatgtggcttcttctctagccaagagttctcctcttttatcacctttattttatgatcagtggttctcaaggaatggtcaagcaccagcagcgtgagcatcttctgggaatatgttagaaatgaaaattctcgagccccatcccagacctactraatcagaaatcctggaggtggagcccagcaggctgtgttttaacaaacccttaagaggattctgatgccctgcacacttaagtgtgagaaccactgccataagtgattatccttggagagacctactttggtcctgggtactttaaggaaaatcgtggggccccagtaatccaaacgagtacctcatctaagtctctgaagggctgatgttagagcaaaggttgggctagtgaatgtcaatgttagcaaacatggtgggtgtgacccaaaacataatcaaataggcctcttaggttaaag

SEQ ID NO: 82824 - DNA, 601 bp, Human
aaatggagatcatcaccattctaggagctgctaaacagaacatgtggcttcttctctagccaagagttctcctcttttatcacctttattttatgatcagtggttctcaaggaatggtcaagcaccagcagcgtgagcatcttctgggaatatgttagaaatgaaaattctcgagccccatcccagacctactgaatcagaaatcctggaggtggagcccagcaggctgtgttttaacaaacccttaagaggattctgatgccctgcacacttaagtgtgagaaccactgccataagtgaktatccttggagagacctactttggtcctgggtactttaaggaaaatcgtggggccccagtaatccaaacgagtacctcatctaagtctctgaagggctgatgttagagcaaaggttgggctagtgaatgtcaatgttagcaaacatggtgggtgtgacccaaaacataatcaaataggcctcttaggttaaagtcctgatgttaggtttgctggttgagaaggaatacaaatgtatctcaaggaatgcagttctctcaagattcagaaagtatggatacctttgccatgcctggcagctt

SEQ ID NO: 82825 - DNA, 601 bp, Human
tcctcttttatcacctttattttatgatcagtggttctcaaggaatggtcaagcaccagcagcgtgagcatcttctgggaatatgttagaaatgaaaattctcgagccccatcccagacctactgaatcagaaatcctggaggtggagcccagcaggctgtgttttaacaaacccttaagaggattctgatgccctgcacacttaagtgtgagaaccactgccataagtgattatccttggagagacctactttggtcctgggtactttaaggaaaatcgtggggccccagtaatccaaamgagtacctcatctaagtctctgaagggctgatgttagagcaaaggttgggctagtgaatgtcaatgttagcaaacatggtgggtgtgacccaaaacataatcaaataggcctcttaggttaaagtcctgatgttaggtttgctggttgagaaggaatacaaatgtatctcaaggaatgcagttctctcaagattcagaaagtatggatacctttgccatgcctggcagcttgaaagaaatagcaatgtaaagttaaaccacgcctatgtgaaagttagctccatagcaggctttcttctc

SEQ ID NO: 82826 - DNA, 601 bp, Human
aacaaacccttaagaggattctgatgccctgcacacttaagtgtgagaaccactgccataagtgattatccttggagagacctactttggtcctgggtactttaaggaaaatcgtggggccccagtaatccaaacgagtacctcatctaagtctctgaagggctgatgttagagcaaaggttgggctagtgaatgtcaatgttagcaaacatggtgggtgtgacccaaaacataatcaaataggcctcttaggttaaagtcctgatgttaggtttgctggttgagaaggaatacaaatgtrtctcaaggaatgcagttctctcaagattcagaaagtatggatacctttgccatgcctggcagcttgaaagaaatagcaatgtaaagttaaaccacgcctatgtgaaagttagctccatagcaggctttcttctctgagatttgaatttatggaacatgataacaaatatgaaaatagataatttttattgaatatcatatcactaccactattttaagtgatttgtatgtattaatggctaaccttttttcaggtagttactccaccaagctctttgctgggccctgaaaatgtaacagt

SEQ ID NO: 82827 - DNA, 601 bp, Human
ggtactttaaggaaaatcgtggggccccagtaatccaaacgagtacctcatctaagtctctgaagggctgatgttagagcaaaggttgggctagtgaatgtcaatgttagcaaacatggtgggtgtgacccaaaacataatcaaataggcctcttaggttaaagtcctgatgttaggtttgctggttgagaaggaatacaaatgtatctcaaggaatgcagttctctcaagattcagaaagtatggatacctttgccatgcctggcagcttgaaagaaatagcaatgtaaagttaaaccacgcctatgtgaaagttagctccatagcaggctttcttctctgagatttgaatttatggaacatgataacaaatatgaaaatagataatttttattgaatatcatatcactaccactattttaagtgatttgtatgtattaatggctaaccttttttcaggtagttactccaccaagctctttgctgggccctgaaaatgtaacagtgaacaagaaaaaaatctctttcctcaaggaactcacacttcaatgaagggaaattagaagaaattagcctattactgttcaagttcagggtgttt

SEQ ID NO: 82828 - DNA, 601 bp, Human
atgtattaatggctaaccttttttcaggtagttactccaccaagctctttgctgggccctgaaaatgtaacagtgaacaagaaaaaaatctctttcctcaaggaactcacacttcaatgaagggaaattagaagaaattagcctattactgttcaagttcagggtgtttgcagaggcctagatgcggcacctacactcagtcttatgtaaatagaggtttctcaaaggaagaaatgtataaatttagacctctgtagagtgagaggagttgatcactttagagtggagaaacagatttagrataactatactctagatcacacagcaagtaagtgatagtgttgggatttgaactcaggttggtttcatccaaagccattgctttcaaccattaaggcaagggcagaaaatgggttttatcaagcctgtcaattctgacaaattaataatggcttccaagaatgtggatggtgaatactcggtgagcactgggctcaattggaaaaaaaaatgccatgattaattaataatgtcttccctgggttcagagaggagggtgtatgtgtcatgcatttgcctaccctgcagtacagagtactgc

SEQ ID NO: 82829 - DNA, 601 bp, Human
gtttctcaaaggaagaaatgtataaatttagacctctgtagagtgagaggagttgatcactttagagtggagaaacagatttaggataactatactctagatcacacagcaagtaagtgatagtgttgggatttgaactcaggttggtttcatccaaagccattgctttcaaccattaaggcaagggcagaaaatgggttttatcaagcctgtcaattctgacaaattaataatggcttccaagaatgtggatggtgaatactcggtgagcactgggctcaattggaaaaaaaaatgccaygattaattaataatgtcttccctgggttcagagaggagggtgtatgtgtcatgcatttgcctaccctgcagtacagagtactgcctccaggacttagcacgagaggatgaaatctgcggttgtttcttattcatgtaagagtgtctatgacttcaaggaaccttagagctcaatggcatcagcaggggcttattatatgttagcaaaggtagcaagtgacagcccaggatggagcattcagtaaaaaagagaataaagtttcctgtcaaaagagaagacactaattaagtttaacagtga

SEQ ID NO: 82830 - DNA, 601 bp, Human
tgcttggaaatggcttctggatgaatttcctttgcaaaaagtctctttcactttccccagctcaccttcacatttaaccgtaataagcactctttactctagacatttaacagatgtttttaaataactcagttattgggtatataaaaagaagaagatgacctccccaaaagtcccaaggtcagagctatttgccatctgagcaattgtccccaggaagaatgttgtgaatgatcacttctctctaaccgtgactcagcacagcacaccaacctgcacccattttcagaggctcaccttkggttgagggtgactttgagtatatgggcctcagcagtcaccgcccaagggctgtgcctgcttgtcatgcttctctatcaccccacccacctgcagccatcagagaggaccagtttctcactgatcctcctcccctgatgcatttacatgagagatgggggaggagctttcccccttgagacttgttcaccttgttttactttggaagacaagattttacagtaccaggaatcaaaacatttctctgatcacgtcatgctgaccagtgctaaattatctctgattcattgtacattttaca

SEQ ID NO: 82831 - DNA, 601 bp, Human
atataagtccctagtacatctctattttttttttagcaatattgctgctgaagcttagctgtgtgctctcgtgtgtcccatcctgctctttctgcctcaggtgtgtggtctagttaatcctccattccatgggagaaacatagcccaggaatgctggttgtgaggagatttgatttctactcctacttctgccattaactgtatgactttgggcaaggctctttcctggtcccagcccagccccagctattcagcatccatttaggataggttggtctctaaggagcctttctagccccarcattcaaggacttagtggaaactagaattctgggttcagttgagttcagtgccaccggcatttgccgactgacttcctctttgtcatcaagcaccatacggggcactgcaggggatatgtttatatcagagctctctctgataccacggcactcacgggcaaagggagagtgggatgagaaaaacaagtgtattgatataccagtgcagagcagactatgttgtatgctggaagcaaagtacaaatgattatagggtccaaaggaagcagaaatttcatttatttatgaaaagtcagaat

SEQ ID NO: 82832 - DNA, 601 bp, Human
gcttagctgtgtgctctcgtgtgtcccatcctgctctttctgcctcaggtgtgtggtctagttaatcctccattccatgggagaaacatagcccaggaatgctggttgtgaggagatttgatttctactcctacttctgccattaactgtatgactttgggcaaggctctttcctggtcccagcccagccccagctattcagcatccatttaggataggttggtctctaaggagcctttctagccccagcattcaaggacttagtggaaactagaattctgggttcagttgagttcagtgmcaccggcatttgccgactgacttcctctttgtcatcaagcaccatacggggcactgcaggggatatgtttatatcagagctctctctgataccacggcactcacgggcaaagggagagtgggatgagaaaaacaagtgtattgatataccagtgcagagcagactatgttgtatgctggaagcaaagtacaaatgattatagggtccaaaggaagcagaaatttcatttatttatgaaaagtcagaataaaacttcatggcatttcagatcagccttgaaagagaaaattcaaacaggat

SEQ ID NO: 82833 - DNA, 601 bp, Human
ccccagtcagaatgaagtcactaactccagagtaaaagaatggggcaagcgatgctctctgtaaagtgaattctaatgaggtaaaagtgggcaggtctctactggaggagagaggacagcagcgaggagagtggcatgggaagtggagagagctgcatatgcccccacctccccagttctctgagagatattccacacaggaattcctgacccttgcccagcaattgttcaatgactctgaccatggaaagcatacgagaaaaagtacgccagaaaagttgtatcatggtcggtagaccasagacaacagagaaactggctgcaagtctcagcatcactcagaaagcctttgttcccaaggcactattaagtatcaggcagacagagagattcctgagacacagctcctgtcctcacaggaaggactcactggataagatgggaggcaaacccaggcaggctagcattgatgcaagatgctgagtgccataacaaacgtctaagcagcttgctttaggtgtagtgtgaagggaggatcagacatagttaattctaacacgaggtaggaagtgttaagtgtgctaatagcaatacaagccaa

SEQ ID NO: 82834 - DNA, 601 bp, Human
gttcaataaatgatagtttttattgtctgtgctatgactatttcagtgaacattatctcagtcttctgggtagcatctgaggctaattggccactgttaggcaattttaaaagttaacgaaatgcacctacaacttcatctgcatttgtcctctcttcagatccttgtatatgagcatctttgcctattcttggatcatagtcttgcttttttgtttttgatttgtttgtgggttttttttctatacaatagagcaaattattgattcctttttataatttcctcttcctgttctaaagtyctaccttggatggtccactctttgttgtgtgttcagatccagtagtgagtgcagaaggacagttaccatagtcagcctctcagttagaattctgtcgtgtctacagaccagctttgttcctctcctagtcaccactatgctgctgagaatcatcatagaatatgggaactgcaggcaactgcagccaaatcttttgttttaccaatgagaacctccagcccagggacaggaagaaaattgtcaagtttgtacagagagacaggcaggggtgggcctgtgtactagtcctcaagtgtgctg

SEQ ID NO: 82835 - DNA, 601 bp, Human
tagagcaaattattgattcctttttataatttcctcttcctgttctaaagtcctaccttggatggtccactctttgttgtgtgttcagatccagtagtgagtgcagaaggacagttaccatagtcagcctctcagttagaattctgtcgtgtctacagaccagctttgttcctctcctagtcaccactatgctgctgagaatcatcatagaatatgggaactgcaggcaactgcagccaaatcttttgttttaccaatgagaacctccagcccagggacaggaagaaaattgtcaagtttrtacagagagacaggcaggggtgggcctgtgtactagtcctcaagtgtgctgactcacaggccagtgccctggatggtttgcatgccctttctgcttttcttccgcagacttaggctgtgaggagggcaaaaatgcctttcctcctcctcatttcctcttccctcccccttcctccctgctttgggtaaagctgaaacatgcagctcgtgcttccacaaggcatcctcagcatgcttttcacagcaccctctgctgactccggggccttcacagcttgcagcccagttgacagccagtgaa

SEQ ID NO: 82836 - DNA, 601 bp, Human
cacgcatttatgcatttgcactatgtagtaggcatttctgccttggacttttaaaaacatgcttgccctttaggatcctcatcttggaaatctgccctcttctccctctttaagggattgcccttccctctgaatgtgcagaacatgctgttcttctactgcagaatttatttcattttctcatgcaatttttattagtggctcataagtgtgtctttcatcgcattggaatgaccctcttagaggcaagggtcttgactgttgttttccccatactataccacatacactatgttgaatygataaatttacttattcagtgaatgttttggtattataatagacatgttgcaaggtagtttagcaaagtgataaggactcatgtggaatcagacatacaggggtttgaattgtagctccactattatcagttctgtgacccctgcctacctatgttttagtccctcttttgttaaatggcaataataataaagtacaccctcttaagctgttacagagattaaaagaattgatgaaagtaaaatgtgtagtctattttctagcattaaagtgctcagtatatgcaagcacctattagtaa

SEQ ID NO: 82837 - DNA, 601 bp, Human
tggctcataagtgtgtctttcatcgcattggaatgaccctcttagaggcaagggtcttgactgttgttttccccatactataccacatacactatgttgaattgataaatttacttattcagtgaatgttttggtattataatagacatgttgcaaggtagtttagcaaagtgataaggactcatgtggaatcagacatacaggggtttgaattgtagctccactattatcagttctgtgacccctgcctacctatgttttagtccctcttttgttaaatggcaataataataaagtacamcctcttaagctgttacagagattaaaagaattgatgaaagtaaaatgtgtagtctattttctagcattaaagtgctcagtatatgcaagcacctattagtaattaatgttagaaataataatgataattatcatcatcatcatcatcatcatcatcatttgttgccactgtggctgtgccaggttctccagatcctcaatgatcccctttcttttcttagatatgtgagggagataagcaaaggaatatattgaagagaaaaagcccaatgtttattactgcgtggctgttgctatgctg

SEQ ID NO: 82838 - DNA, 601 bp, Human
tagtttagcaaagtgataaggactcatgtggaatcagacatacaggggtttgaattgtagctccactattatcagttctgtgacccctgcctacctatgttttagtccctcttttgttaaatggcaataataataaagtacaccctcttaagctgttacagagattaaaagaattgatgaaagtaaaatgtgtagtctattttctagcattaaagtgctcagtatatgcaagcacctattagtaattaatgttagaaataataatgataattatcatcatcatcatcatcatcatcatcacttgttgccactgtggctgtgccaggttctccagatcctcaatgatcccctttcttttcttagatatgtgagggagataagcaaaggaatatattgaagagaaaaagcccaatgtttattactgcgtggctgttgctatgctgtgggcttctatgagctggaggacccaagaaagctactttccctgtggccctcacctattcttggctgtctggatctcagcactatggggatcagaagaggccaccccaaaacaataggaaataaaaaggaatttttgcccaatgctttgaacaaggca

SEQ ID NO: 82839 - DNA, 601 bp, Human
tatattgaagagaaaaagcccaatgtttattactgcgtggctgttgctatgctgtgggcttctatgagctggaggacccaagaaagctactttccctgtggccctcacctattcttggctgtctggatctcagcactatggggatcagaagaggccaccccaaaacaataggaaataaaaaggaatttttgcccaatgctttgaacaaggcaggtccaagcttcccacctcagatcttcagagtgaagtcccctccctcccatgctcaaagcagctctagacctgcacagcaccctcaaakaagcaaatccagcagagattttatggctttagcaccatctggccttatctccttagctgtcttgaaggagacaatagagggtggaggagaagtaatcatcctaaaaccaacaggtggccccagttgtaggctatgtagcagcatggctgtggtggtggtggttgcttggtgtatgtgtggaagtgcaagggaagtctataatgcagtgttctgagtgtgtgcagaacctatggaggaaatcagaacttgagatagagaaacaagtcctgttaatggtaacgccatttggatctggaaata

SEQ ID NO: 82840 - DNA, 601 bp, Human
ttattactgcgtggctgttgctatgctgtgggcttctatgagctggaggacccaagaaagctactttccctgtggccctcacctattcttggctgtctggatctcagcactatggggatcagaagaggccaccccaaaacaataggaaataaaaaggaatttttgcccaatgctttgaacaaggcaggtccaagcttcccacctcagatcttcagagtgaagtcccctccctcccatgctcaaagcagctctagacctgcacagcaccctcaaagaagcaaatccagcagagattttatgrctttagcaccatctggccttatctccttagctgtcttgaaggagacaatagagggtggaggagaagtaatcatcctaaaaccaacaggtggccccagttgtaggctatgtagcagcatggctgtggtggtggtggttgcttggtgtatgtgtggaagtgcaagggaagtctataatgcagtgttctgagtgtgtgcagaacctatggaggaaatcagaacttgagatagagaaacaagtcctgttaatggtaacgccatttggatctggaaataactgtgtttgcatagtccatgtctgt

SEQ ID NO: 82841 - DNA, 601 bp, Human
gtggccccagttgtaggctatgtagcagcatggctgtggtggtggtggttgcttggtgtatgtgtggaagtgcaagggaagtctataatgcagtgttctgagtgtgtgcagaacctatggaggaaatcagaacttgagatagagaaacaagtcctgttaatggtaacgccatttggatctggaaataactgtgtttgcatagtccatgtctgttctcttacagatgaggaaacaaaagctcttcatttaaggagagaaatagtccactctcttgtttactcttttacttgacattgattgwacctctcaatggcaaagactgtgttgtgcattagatagatatgctgagaaatgagaaagaggctgtgccctcaaaaatttgtcctaaaaggggaacatctagataatcaatgagctaataaatgattagatacagtgttgtcccttcaaccatctctttggattcaccacattctccacactctctctaaagactcccactcatgcccctggtgagtcaaaagctcctggccagtagcctcttctctgatcaactcatatatttctgctcatatcacctttgctggtggcataccagaat

SEQ ID NO: 82842 - DNA, 601 bp, Human
ggctgtggtggtggtggttgcttggtgtatgtgtggaagtgcaagggaagtctataatgcagtgttctgagtgtgtgcagaacctatggaggaaatcagaacttgagatagagaaacaagtcctgttaatggtaacgccatttggatctggaaataactgtgtttgcatagtccatgtctgttctcttacagatgaggaaacaaaagctcttcatttaaggagagaaatagtccactctcttgtttactcttttacttgacattgattgaacctctcaatggcaaagactgtgttgtgcaytagatagatatgctgagaaatgagaaagaggctgtgccctcaaaaatttgtcctaaaaggggaacatctagataatcaatgagctaataaatgattagatacagtgttgtcccttcaaccatctctttggattcaccacattctccacactctctctaaagactcccactcatgcccctggtgagtcaaaagctcctggccagtagcctcttctctgatcaactcatatatttctgctcatatcacctttgctggtggcataccagaatcaagaatcaattctgtttgttttcaaacctg

SEQ ID NO: 82843 - DNA, 601 bp, Human
ggcagcatgtgctcttggttgtcatgcctccattcctccttctggaaaatagtaaagaagaaaatgtataagttagagaggtgaaagagtgttagagctaattaaatctcacttattttacttatgaggaaataactcccaaagaggagaaatgactaagttcatataaagaacctgcagctaacttggtcatttagtcatataaagaacctgcagcttacttggtcatttatgcatttattccattcagcagacatgtttcagtgcctcccatgtgccaggcactgtggtagatgctagracaatagtgataagtaaataaacatgattcttgccctaatcagggagatgaaattaaacaaataaaccaaaagttaaacaaaataattaaagatagagataaggtatgatggaaagaaacaaggtaccgcaatagagaataaagagtagggaccgggcacggtggctcactcctgtaatcccagcattttgggaggccgaggcgggtggatcacaaggtcaggacatcgagaccatcctggctaacacggtgaaaccccatctctactaaaaatacaaaaaaaattagccagtcgtgatg

SEQ ID NO: 82844 - DNA, 601 bp, Human
ctggaaaatagtaaagaagaaaatgtataagttagagaggtgaaagagtgttagagctaattaaatctcacttattttacttatgaggaaataactcccaaagaggagaaatgactaagttcatataaagaacctgcagctaacttggtcatttagtcatataaagaacctgcagcttacttggtcatttatgcatttattccattcagcagacatgtttcagtgcctcccatgtgccaggcactgtggtagatgctagaacaatagtgataagtaaataaacatgattcttgccctaatyagggagatgaaattaaacaaataaaccaaaagttaaacaaaataattaaagatagagataaggtatgatggaaagaaacaaggtaccgcaatagagaataaagagtagggaccgggcacggtggctcactcctgtaatcccagcattttgggaggccgaggcgggtggatcacaaggtcaggacatcgagaccatcctggctaacacggtgaaaccccatctctactaaaaatacaaaaaaaattagccagtcgtgatggcaggcacctgtagtcccagctactcgggaggctgaggcag

SEQ ID NO: 82845 - DNA, 601 bp, Human
gcacggtggctcactcctgtaatcccagcattttgggaggccgaggcgggtggatcacaaggtcaggacatcgagaccatcctggctaacacggtgaaaccccatctctactaaaaatacaaaaaaaattagccagtcgtgatggcaggcacctgtagtcccagctactcgggaggctgaggcaggagaatggcgtgaacccgggaggtggagcttgcagtgagccgagatcgcgccactgcaatccagtctgggcaacagagtgagactccatctcaaaaaaaaaaaagaaaaaaaaaaagagtaggatgagtattttagagaaggcctctatgaagagagaacattttaagctgagatctgaagaatgcgaaggggtcagccacttaaagagggttggaagagctttctaggagataacagcttgtgtaaaacctcaaggcaagaaagtcgggactgtcctgaaaggtaagagaaagaccagcatgaagcccaggcagaggtgtcatggcctggaagcagatgtggtgggagagataggcagggccagaactcagagcctcagagttcaaagtgcccttattggcagactcttgattga

SEQ ID NO: 82846 - DNA, 601 bp, Human
gatgaattttgctgatttagggcaccctcgggctgtcctctgtagctttcagtaaagctttgtcttgattgacagatgctgatcaagttcatgggtatgcattacagtgtacgtttgctggttggcctaggaaaacccatttgcacgtatgactttcataggaaaagaatggcaaataagaaacaaaagattttttttctgccactcacccaaggaacagaaattaagacagccaaaggaagagtctgccttcatttaacggatgatttacctggtgttccttgcggtagtggttcattcrtgaaccagcagaaggtattttgtgactatggggattgcggagatgactgggccaggaggggaagctgtaaagctaatctctcccacaacccacttctctttggctaatggctttgcttttgtttgttctgctttggctggttcatgtgctagttcccaaaggctgcacaaaggcagagctaggtagatgtactccctaccagggctctttagtgaatcccacctcctagccccagatgaggctgagtgaacactcactccagccttggactgtagcctttactgtggcccctgaacctaa

SEQ ID NO: 82847 - DNA, 601 bp, Human
tttgcttttgtttgttctgctttggctggttcatgtgctagttcccaaaggctgcacaaaggcagagctaggtagatgtactccctaccagggctctttagtgaatcccacctcctagccccagatgaggctgagtgaacactcactccagccttggactgtagcctttactgtggcccctgaacctaacccaagaatgagacttgttgacccaaggctcagaccccaagtctcagatcccttatttcaaagagagctcctcaccccagctccagactgagcccctggcccagcattcctsgctgagtccccacacgtggtagagccttggcctcaaagggtccatccacaatgttgtgagtcccttggtacatattcactttttgaatgaacctctgaggacccctgccctctcaagactggcgtctcctctgccatctcatcagagtggcttttagccatggagcagtgtcatagcctcctctagtccaaagctggccggtgctaagaagaggaagcctggaactcagaacctctgtccttgtgccaacatgttagttgcagtctatctgtgagcttcacagtcccattgactcttgta

SEQ ID NO: 82848 - DNA, 601 bp, Human
tgggctcagacgtgtgtccatccttgcatgacccttggctcctcatctgttcatgggtttaaaggtcatccttcctgccctgcctaccttattgagtattcacaacagaaaatgaatgtaggagattgaaaattgtataatgcactctaagttattattacctctcccaaattgtcagcatttcatccttgctatctagcagcagaatagtgtagggtaggagtttacaaactacagcccacaggccaaagccagcccaaggccagattttctaaataaagttttattgaaacacagcaaygtaaatatgtaaactcatttgtttacatattgtctttggctgccttcatgctataaaagtagcactgagtagtgcagcagagaccacatggcccgcaaaacctaagatatttactatttggctttttgcagaaaaagtttgcctatacctggcatagaggagcaaagtgaggactctgaagttggaatgcctgtgtttggattctgaatcttctacttaatggctatatgaccttgtgcaagttaattagcttcacttttctctctatgaaataaaaataaacattgtatccccaccctg

SEQ ID NO: 82849 - DNA, 601 bp, Human
aaatgctctcattttgaacccattcaacatcttcagggttgagttctgtaatgggatgtaaatcttctttcctggggagaaacggctgaggagactgggtgttgtaggtggaatacattaaggctggtggggtttgagtgccagcccaagagcacagctctcattctcagttggcctaagctaacagggagtgatcaagttcagtggactgaagcacaggggagtattacgtatcttccagacctgtggatgctagatgggcaacctaatttagaggaatatgaaacaagtaacagcaccrtgcaattttcgttattccctacctagctctttatgagttattgttcattatattagcagaaaaatgaggatttggagagcctcttccttcaagggagcttacatctcaattgcaggtgaaaaggcataaatacacaaaaagttacttgataatataaaataaaataatcaattcattcagtgcaagacatgtcatgaaagaaagatgggtcaacttagtatccagagattaaaataggtaaatgacttgcattcattcatttattctcatattcattcatgtccaaaaatattgtgtagt

SEQ ID NO: 82850 - DNA, 601 bp, Human
ctgggtgttgtaggtggaatacattaaggctggtggggtttgagtgccagcccaagagcacagctctcattctcagttggcctaagctaacagggagtgatcaagttcagtggactgaagcacaggggagtattacgtatcttccagacctgtggatgctagatgggcaacctaatttagaggaatatgaaacaagtaacagcaccgtgcaattttcgttattccctacctagctctttatgagttattgttcattatattagcagaaaaatgaggatttggagagcctcttccttcaagkgagcttacatctcaattgcaggtgaaaaggcataaatacacaaaaagttacttgataatataaaataaaataatcaattcattcagtgcaagacatgtcatgaaagaaagatgggtcaacttagtatccagagattaaaataggtaaatgacttgcattcattcatttattctcatattcattcatgtccaaaaatattgtgtagtcattatgggaacccttcaaagggatatgaataataatataagctttatgagggcaaaggcatcatctgtcttatttaccactctattccacagt

SEQ ID NO: 82851 - DNA, 601 bp, Human
gggtgttgtaggtggaatacattaaggctggtggggtttgagtgccagcccaagagcacagctctcattctcagttggcctaagctaacagggagtgatcaagttcagtggactgaagcacaggggagtattacgtatcttccagacctgtggatgctagatgggcaacctaatttagaggaatatgaaacaagtaacagcaccgtgcaattttcgttattccctacctagctctttatgagttattgttcattatattagcagaaaaatgaggatttggagagcctcttccttcaagggrgcttacatctcaattgcaggtgaaaaggcataaatacacaaaaagttacttgataatataaaataaaataatcaattcattcagtgcaagacatgtcatgaaagaaagatgggtcaacttagtatccagagattaaaataggtaaatgacttgcattcattcatttattctcatattcattcatgtccaaaaatattgtgtagtcattatgggaacccttcaaagggatatgaataataatataagctttatgagggcaaaggcatcatctgtcttatttaccactctattccacagtgt

SEQ ID NO: 82852 - DNA, 601 bp, Human
tgtaggtggaatacattaaggctggtggggtttgagtgccagcccaagagcacagctctcattctcagttggcctaagctaacagggagtgatcaagttcagtggactgaagcacaggggagtattacgtatcttccagacctgtggatgctagatgggcaacctaatttagaggaatatgaaacaagtaacagcaccgtgcaattttcgttattccctacctagctctttatgagttattgttcattatattagcagaaaaatgaggatttggagagcctcttccttcaagggagcttamatctcaattgcaggtgaaaaggcataaatacacaaaaagttacttgataatataaaataaaataatcaattcattcagtgcaagacatgtcatgaaagaaagatgggtcaacttagtatccagagattaaaataggtaaatgacttgcattcattcatttattctcatattcattcatgtccaaaaatattgtgtagtcattatgggaacccttcaaagggatatgaataataatataagctttatgagggcaaaggcatcatctgtcttatttaccactctattccacagtgtctagcc

SEQ ID NO: 82853 - DNA, 601 bp, Human
ctcagttttactcagagagctatgtgatctctttctcctcacctgcatctctactgctttcctcctttccccctatactgtgtccacatgggccttctgtttctcaagctcttcagtcttgttcctgagcctcattcagagcctctgttccattccttctgcctgagactgcttctttagcctttagcctggctggctccttcttagggttcatttctcagctccaatgctagtgacacagagaggtctccctgaccatcctgtctaaaatagtcctgccagtcactctcacatcatcccrttttattttctttgtaatattcgcagcatccaaaatggccttgtttattcacatgtcatctctctccctctctagagcctaagctccaagagagcagagacttatctttttatccagtgatgtatacccctagcaccagcttgctgcctagcatacactacacattcaggaaacttgttggatgggtgaatgattaggcagaagaaagatggagagaagaaacagaaaatttcaatctgtaggacctcacatccccagtgagtacaaaagttctattacaggtacttcaccaaaacaaaa

SEQ ID NO: 82854 - DNA, 601 bp, Human
tagcctcgtatgcagtaccacatctcattggctttcaatgcctagtaattaagacccatgcttaataataaatacacaaatatgacctgggaggatggcttttcttccacatctccttttgcagccatcttccaactgggcatcagggcctggatgaagaaagttcttgtgagtctcaaatgaatccaaaaccaaagtgaaatgctacattgacacatgacacaatgacctaacttctccagcccgggcaaggcccttggcaacctagtccccacccatctccaactctgtgccatacccygaccccagtcatactggtgtttctggagtttttctgttgtgcccttctcttttatcttggtgctttggataaagtggtccctctatctagacacaggaacaaggtgcttaacactgtgcccggcctctgctaaaggacccagttaacactgactataatagcagttatgatcatttatcctgtggctgatccctttattactctctcaaatcaccctttattttccttaatgtaaaactcactgaacacttgcttaagctctgtgaaggtagaaaacatgtctgtcttgtgtaattgtgg

SEQ ID NO: 82855 - DNA, 601 bp, Human
gtgaaggtagaaaacatgtctgtcttgtgtaattgtggtaccccaattttctggcaatattagtttctggtgccaataaatatctgttgaatttactaaataaatgataacattgtatctagtaaatgacagacaccctggatgtgtctcagaatcctaagtaaatgtgatattgtttaagggctttgggatgatttatatctattatggtaattctttgcatgtcagcattatatctacgatacaagagaatataaaaagggatggacaggcactcttattgtcctctgagtgatggaamtgaagcacatcctttgatgttacaacgttagagtaagatgatgaagaatgtgattcccaccaataaggatagaattattccaggaggggaatgagtgcctgaaagtccccccattcacacatacttttgatctccctcccctaaaatgaagctgtcctgtcacctcattatctgctatttacaatgaggctgccacattcccagggacaggagccaaggagaaatgtcggtgtgagaggccttaaatgaagtgacaataaaaaaggagttgttaatgccaggagttccctccctgggaga

SEQ ID NO: 82856 - DNA, 601 bp, Human
acatgtctgtcttgtgtaattgtggtaccccaattttctggcaatattagtttctggtgccaataaatatctgttgaatttactaaataaatgataacattgtatctagtaaatgacagacaccctggatgtgtctcagaatcctaagtaaatgtgatattgtttaagggctttgggatgatttatatctattatggtaattctttgcatgtcagcattatatctacgatacaagagaatataaaaagggatggacaggcactcttattgtcctctgagtgatggaactgaagcacatccyttgatgttacaacgttagagtaagatgatgaagaatgtgattcccaccaataaggatagaattattccaggaggggaatgagtgcctgaaagtccccccattcacacatacttttgatctccctcccctaaaatgaagctgtcctgtcacctcattatctgctatttacaatgaggctgccacattcccagggacaggagccaaggagaaatgtcggtgtgagaggccttaaatgaagtgacaataaaaaaggagttgttaatgccaggagttccctccctgggagacagctgtcagggc

SEQ ID NO: 82857 - DNA, 601 bp, Human
ttgcaaagaggtaagaaaagcaggctgcaggcaggagggggacagtgcaggatcccaggattttgttacaagggaatccaagaactcagagacttacctgcttactggatttgaaaaagtgcactgggggttgctagaatttgactaaataactaaaatattgtcgaatcagtaaacattttccaatcaattagactagactctagaatgtcagagtctgaaagggcattaagcattatagagatcaaacaatcatttcacagatgggaaagctgaggcctaggagagcgtgggatttacytaaagtcatacaagtactctgtaatgataaaaccaaaaagagaatcgtccaggtcttctgacagctagcctagtactttgtctacagaaccatgttatctcttctgattgaatattggttgtgacagattcaaagtagatataatacctcacaactactaattatatttatcaacatttaaccaatgactgccttctcccacaggccttgggcctatagggtctgtctgtctgtttctgtctctctctctttcttttacttcctctctctctgctgttgcttaggtttggctgaagtgta

SEQ ID NO: 82858 - DNA, 601 bp, Human
agagcgtgggatttacttaaagtcatacaagtactctgtaatgataaaaccaaaaagagaatcgtccaggtcttctgacagctagcctagtactttgtctacagaaccatgttatctcttctgattgaatattggttgtgacagattcaaagtagatataatacctcacaactactaattatatttatcaacatttaaccaatgactgccttctcccacaggccttgggcctatagggtctgtctgtctgtttctgtctctctctctttcttttacttcctctctctctgctgttgcttargtttggctgaagtgtagaaatggtctgacagtcaggcactgagcaactctgggagccagggttcactcaagtaaatccaggccaggctacctccaagccatgctcttttagggagtagtgcgtaaatgcaccctcttagccttagaggagaaagcactctgtttaaggtaagagatgtttgcagaaggggaaaatgaggagataatttgaaggggaaaatgtcctggcctcctgtgtgtctaaggatttgttgtgtctgcctgctcccatttcgtccacccccatctcaccctttcctac

SEQ ID NO: 82859 - DNA, 601 bp, Human
ggcttctgggtagagaagtgattttgtcactgaaaaccaaatgtcctaaagctcaaggccatgaacaccaccttcagataccaggagggctatagagtgggtcaagagcaagaattgtgtgaaaccagaatctcagtaactagaagtatgcaagcagatgttaatgatcacctgccaggtttcctgcagatggtatgctggttttcagtgggagtaggacagatgggttatatggttcagctgcaatctttaagagattatgacctttaaagcccattttctctagggactaacagaaaayggagactcacagtagacaattaggtaccactggttaattgcattctttattgcagcatgggccaaaagattttcaataacatttcaaaagtattcaccaaaaaaaggtcttggaggcaaatagatttgacaaaatctgggataaaaatgggtagaattcctcacaatcttttatgcagctaatgtgaagtatgaaactctaaaacagggacaaagtatgcaccatttcccaaatgtatttgaccaaagaagacttattttttaaggagcatcttgtggggctatagtttcatgaaacctt

SEQ ID NO: 82860 - DNA, 601 bp, Human
gcaaagattatgaactctcatcctatatcatatagtaaaacaaagtttaggagctgactgacttggagtttaatcccatgaccttggtcttattagcatcgtattttaattagaagtataatcaaccacaaaccaggattggcaactgcattgggattctacagaatcggtcctgtgggtatgttctcacagctaagctattactatggctgatacactggggggtctgaaaatcagctagcaagatgtacaagcacaaagtgaacattagcagacaaatgaacactgagagttaagggccagactgggaaaatcgacacttgttttcttaaacgtgtattagcagcaatagctggattcttcctgtagcacctttttatgctttgcctttaattgatagacaatgtgaggggaagatcgttagattaagagtcaagaatatctgcccaagtcatatgtcctagctgtgctaccttgaatatgttcattaaatttctgagccttggtttctcccctttaaaaaaatgacccagtcatccctttctagcctcaatagggtcattgtagagaccaagtaaggtaatagatgaaagtgtcttat

SEQ ID NO: 82861 - DNA, 601 bp, Human
gtgcctgcaacatagtaaaaactcaaaattctttctctgttttagatgttatcatcatcatcatcctcctcatcataatcttcatccttctctgggctttctaattcttcctcctttgaatttaacatcacattttccaaatgttttctatactttttcttctctatgtctttactcatgttattccagttttctggaatgcacttcccttctccaatttacatctgtaaatccttctcctcttttgcaggatgtccctattccccaattctgtggatgggagcactctctccaactcccrtgatgtttgtcttgtactgtcctaccttctcattgtatattaaatagtcttgtaataatttattcactactggtgtaaacaaataaatgggtcacgcaagacctgaaaggtgagacagaggagtacagtactgatgtggttgcctgcagggagtcttagaaaacttttgagttggagagaggtttgtgaaagtgatttttcaggcagttaggcaggcgtcgttcagatgggaaggagccaacagaagaaaccaggaacaccctattttctttgattttctcttcactgtccccactttga

SEQ ID NO: 82862 - DNA, 601 bp, Human
tttagatgttatcatcatcatcatcctcctcatcataatcttcatccttctctgggctttctaattcttcctcctttgaatttaacatcacattttccaaatgttttctatactttttcttctctatgtctttactcatgttattccagttttctggaatgcacttcccttctccaatttacatctgtaaatccttctcctcttttgcaggatgtccctattccccaattctgtggatgggagcactctctccaactcccatgatgtttgtcttgtactgtcctaccttctcattgtataytaaatagtcttgtaataatttattcactactggtgtaaacaaataaatgggtcacgcaagacctgaaaggtgagacagaggagtacagtactgatgtggttgcctgcagggagtcttagaaaacttttgagttggagagaggtttgtgaaagtgatttttcaggcagttaggcaggcgtcgttcagatgggaaggagccaacagaagaaaccaggaacaccctattttctttgattttctcttcactgtccccactttgatgacttcccttctcagactgcgactattgcaggggtcacc

SEQ ID NO: 82863 - DNA, 601 bp, Human
cctaccttctcattgtatattaaatagtcttgtaataatttattcactactggtgtaaacaaataaatgggtcacgcaagacctgaaaggtgagacagaggagtacagtactgatgtggttgcctgcagggagtcttagaaaacttttgagttggagagaggtttgtgaaagtgatttttcaggcagttaggcaggcgtcgttcagatgggaaggagccaacagaagaaaccaggaacaccctattttctttgattttctcttcactgtccccactttgatgacttcccttctcagactgygactattgcaggggtcacctggaagtctatttcaggacagctttgcagcataatgtagctggaggcctggaagtaataaagccagaaaaatgtacctttgcttgtgggagatcatctctggggtcagcagaagcacccacactctcaaaagagctccacctacctcagaactcagagctcagagccctgccgtttgtcagctgtgtgaccttggactaatgactaaatctctctaagcctcaatttccacactataaaatagggataataatagtatctaccttgaaagattaagtggat

SEQ ID NO: 82864 - DNA, 601 bp, Human
ctaccttctcattgtatattaaatagtcttgtaataatttattcactactggtgtaaacaaataaatgggtcacgcaagacctgaaaggtgagacagaggagtacagtactgatgtggttgcctgcagggagtcttagaaaacttttgagttggagagaggtttgtgaaagtgatttttcaggcagttaggcaggcgtcgttcagatgggaaggagccaacagaagaaaccaggaacaccctattttctttgattttctcttcactgtccccactttgatgacttcccttctcagactgcractattgcaggggtcacctggaagtctatttcaggacagctttgcagcataatgtagctggaggcctggaagtaataaagccagaaaaatgtacctttgcttgtgggagatcatctctggggtcagcagaagcacccacactctcaaaagagctccacctacctcagaactcagagctcagagccctgccgtttgtcagctgtgtgaccttggactaatgactaaatctctctaagcctcaatttccacactataaaatagggataataatagtatctaccttgaaagattaagtggatt

SEQ ID NO: 82865 - DNA, 601 bp, Human
aggcaagagagtggattcttccctagaacctttagacaccaacacagccctgctgacaccttgattttagcctgggacacctatctcatgcatcttacctcaagaactgtaagatagtacatttgtgttgttttaagccagtaagtgtgtgataacttgttacagcagcagtaggaaactaatacaccatctaattctccaagaagaaacaaagcagcattgagtaatggcctctctactcatttagctatagatcagaagagagtagtttaattcaggacacattttatttatttatttgtttagttagttagttagttagttgagacagagtttcactcttgtcacccaggctggagtgcaatggcacgatgtgggctcactgcaacctctgcctcccaggttcaagcaattctcctgcctcagcctaccaggtagctgggattacaggtacctgccaccatgcctggctaatttttgtaattttttttagtagagatggggtttcatcatgtttgccaggctggtctcaaactcctgacctcaggtgatccacccacctcgacctcccaaagtgctgggattacaggcgtgagccact

SEQ ID NO: 82866 - DNA, 601 bp, Human
ggcaagagagtggattcttccctagaacctttagacaccaacacagccctgctgacaccttgattttagcctgggacacctatctcatgcatcttacctcaagaactgtaagatagtacatttgtgttgttttaagccagtaagtgtgtgataacttgttacagcagcagtaggaaactaatacaccatctaattctccaagaagaaacaaagcagcattgagtaatggcctctctactcatttagctatagatcagaagagagtagtttaattcaggacacattttatttatttatttaattagttagttagttagttagttgagacagagtttcactcttgtcacccaggctggagtgcaatggcacgatgtgggctcactgcaacctctgcctcccaggttcaagcaattctcctgcctcagcctaccaggtagctgggattacaggtacctgccaccatgcctggctaatttttgtaattttttttagtagagatggggtttcatcatgtttgccaggctggtctcaaactcctgacctcaggtgatccacccacctcgacctcccaaagtgctgggattacaggcgtgagccactg

SEQ ID NO: 82867 - DNA, 601 bp, Human
agagagtggattcttccctagaacctttagacaccaacacagccctgctgacaccttgattttagcctgggacacctatctcatgcatcttacctcaagaactgtaagatagtacatttgtgttgttttaagccagtaagtgtgtgataacttgttacagcagcagtaggaaactaatacaccatctaattctccaagaagaaacaaagcagcattgagtaatggcctctctactcatttagctatagatcagaagagagtagtttaattcaggacacattttatttatttatttatttakttagttagttagttagttgagacagagtttcactcttgtcacccaggctggagtgcaatggcacgatgtgggctcactgcaacctctgcctcccaggttcaagcaattctcctgcctcagcctaccaggtagctgggattacaggtacctgccaccatgcctggctaatttttgtaattttttttagtagagatggggtttcatcatgtttgccaggctggtctcaaactcctgacctcaggtgatccacccacctcgacctcccaaagtgctgggattacaggcgtgagccactgggcc

SEQ ID NO: 82868 - DNA, 601 bp, Human
catgcctggctaatttttgtaattttttttagtagagatggggtttcatcatgtttgccaggctggtctcaaactcctgacctcaggtgatccacccacctcgacctcccaaagtgctgggattacaggcgtgagccactgggcctggcctgccaggacacatattaaacacctactgtgtgagagacaaagtattaggtattaaagatactatattgaacattcacaaatttgatcagcagttattaggtgaccatttagatgctaggttggcacatttaataagcagttactgagtgcygaataaaactaacagctaatatttataaaacccttgcaggtgtcaggctctgctatgtatcaaacattctcacttaatcctcataatgacattatgaggtgagcattatttacaccacactttacctttgaagaaactaaagtttgaagaggctaatgagcctgcacaaggccatttagccatatgttggatttgagcctcagattgttttttaatcactagttctaccatctatgttcagaaacacagtgtctgatctcacagagttcagagttttgcagccagagaaaactagaactg

SEQ ID NO: 82869 - DNA, 601 bp, Human
aatgacattatgaggtgagcattatttacaccacactttacctttgaagaaactaaagtttgaagaggctaatgagcctgcacaaggccatttagccatatgttggatttgagcctcagattgttttttaatcactagttctaccatctatgttcagaaacacagtgtctgatctcacagagttcagagttttgcagccagagaaaactagaactgagtttggcagaagagtgggtttgggggtagccaggggaggtaggtgcctgatgggagtgggtggtgcccacaaatcctgactgttatttctcttctactcatctgaactttaggcttatccgtcctgcagaaagtcctggatacagctgctgagaagaactggcaggtgacagcagtcaacatcttgacaaccacagaggagggataccggatgctctttcaggacctggagaagaaaaaggagcggctggtggtggtggactgtgaatcagaacgcctcaatgctatcttgggccaggtagtgaaagcagcaagggctcagggtgggtgcgggaggtgattcaggaatagccagacacacttttgccttgggtgttataaagag

SEQ ID NO: 82870 - DNA, 601 bp, Human
atgttggatttgagcctcagattgttttttaatcactagttctaccatctatgttcagaaacacagtgtctgatctcacagagttcagagttttgcagccagagaaaactagaactgagtttggcagaagagtgggtttgggggtagccaggggaggtaggtgcctgatgggagtgggtggtgcccacaaatcctgactgtcatttctcttctactcatctgaactttaggcttatccgtcctgcagaaagtcctggatacagctgctgagaagaactggcaggtgacagcagtcaacatyttgacaaccacagaggagggataccggatgctctttcaggacctggagaagaaaaaggagcggctggtggtggtggactgtgaatcagaacgcctcaatgctatcttgggccaggtagtgaaagcagcaagggctcagggtgggtgcgggaggtgattcaggaatagccagacacacttttgccttgggtgttataaagagggttataaagagggttcttgactaggtgagactaaaagacctctatctcattttctataattcacaaaatttaattctgaaatagcacaaacaatggga

SEQ ID NO: 82871 - DNA, 601 bp, Human
ccttgaacctgggaggtggaggttgcagtgagccaagattgtgctactgcactccagcctaggcaacagagcaagactccatctcgaaaaataataaaaaataataatgataaattacattccattttagagtttatgaaatgttatcatattaggaacacagcttatagggccaaatttctgggttcgactctggactctgtcactcatgatccagggtttggcatctcattcctttcaccttcttaactgttttgaaaggctaaggaagcagcagccacctttatttccattgtttccytgaacatgcccttccctttgagaaatcaattgacagtacattcttctataaacaggcattgtaacttcaacagtcttgagctagatctctctaaactgtgcttcccctggtctcaaaacaaaagcccatgcccaccacagaattaggattttttgtagattccttatctttttaaactacatttatgtattcagattcagagctagcaaggtagcagacgttgcaataacttttgaacaatgtcatacaataaaattgatagttttaggtacttgacaacatgacaaagtttgttaatgg

SEQ ID NO: 82872 - DNA, 601 bp, Human
ttagagtttatgaaatgttatcatattaggaacacagcttatagggccaaatttctgggttcgactctggactctgtcactcatgatccagggtttggcatctcattcctttcaccttcttaactgttttgaaaggctaaggaagcagcagccacctttatttccattgtttccttgaacatgcccttccctttgagaaatcaattgacagtacattcttctataaacaggcattgtaacttcaacagtcttgagctagatctctctaaactgtgcttcccctggtctcaaaacaaaagcmcatgcccaccacagaattaggattttttgtagattccttatctttttaaactacatttatgtattcagattcagagctagcaaggtagcagacgttgcaataacttttgaacaatgtcatacaataaaattgatagttttaggtacttgacaacatgacaaagtttgttaatggccttcaagacccctggggccctcacagagaatcttggtactaggacagctattactcagaggcctcagcaatagaacacagacagagtttgaatgttatggattctttaaggcactaactgttcta

SEQ ID NO: 82873 - DNA, 601 bp, Human
atcatattaggaacacagcttatagggccaaatttctgggttcgactctggactctgtcactcatgatccagggtttggcatctcattcctttcaccttcttaactgttttgaaaggctaaggaagcagcagccacctttatttccattgtttccttgaacatgcccttccctttgagaaatcaattgacagtacattcttctataaacaggcattgtaacttcaacagtcttgagctagatctctctaaactgtgcttcccctggtctcaaaacaaaagcccatgcccaccacagaattgggattttttgtagattccttatctttttaaactacatttatgtattcagattcagagctagcaaggtagcagacgttgcaataacttttgaacaatgtcatacaataaaattgatagttttaggtacttgacaacatgacaaagtttgttaatggccttcaagacccctggggccctcacagagaatcttggtactaggacagctattactcagaggcctcagcaatagaacacagacagagtttgaatgttatggattctttaaggcactaactgttctactttatgaagtacaaattt

SEQ ID NO: 82874 - DNA, 601 bp, Human
tattcagattcagagctagcaaggtagcagacgttgcaataacttttgaacaatgtcatacaataaaattgatagttttaggtacttgacaacatgacaaagtttgttaatggccttcaagacccctggggccctcacagagaatcttggtactaggacagctattactcagaggcctcagcaatagaacacagacagagtttgaatgttatggattctttaaggcactaactgttctactttatgaagtacaaatttggccttccctcttggaaagagaaacccagcaaaacttgttccwttgagatggaagttctctgggccggagtcagggatttgaattgcagttttcaattcaggcaggataagataatagttaagagcagagataaaaccagactggctagggttcaaatcccagctctagtatttactggctttgtgaccttgaccaggtttttaatctttctacatctcaagttcttgatctgtaaaatgggcatcatcatcataataatagccacttttagagggctcttgtgagaattaaaagaatcaatatatgtgaagcacttagaacagagtctgccccacagtaagt

SEQ ID NO: 82875 - DNA, 601 bp, Human
aagataatagttaagagcagagataaaaccagactggctagggttcaaatcccagctctagtatttactggctttgtgaccttgaccaggtttttaatctttctacatctcaagttcttgatctgtaaaatgggcatcatcatcataataatagccacttttagagggctcttgtgagaattaaaagaatcaatatatgtgaagcacttagaacagagtctgccccacagtaagtggtacaagcaagcatttgcctatttttgctattcctagtgcctactaggaccagcttcttgagtcmctttcttccttgggcataagtgaatccgtctgtaaaatgtgaatgaaggcctctgttctataaaactgataaaaaggcaagataacatagtcgatggaaaaagtgccaaatgataatgacatattaatagacagatgacctattgtatattgttctatggtacagacagtagctattactactatttttttagtgtgtatggtataccagatactatgccaagaccttcccatgcataatcctacttcattcccacatcaactttgtaaaacagcttttttcaattcccctattttatag

SEQ ID NO: 82876 - DNA, 601 bp, Human
ccagactggctagggttcaaatcccagctctagtatttactggctttgtgaccttgaccaggtttttaatctttctacatctcaagttcttgatctgtaaaatgggcatcatcatcataataatagccacttttagagggctcttgtgagaattaaaagaatcaatatatgtgaagcacttagaacagagtctgccccacagtaagtggtacaagcaagcatttgcctatttttgctattcctagtgcctactaggaccagcttcttgagtccctttcttccttgggcataagtgaatccrtctgtaaaatgtgaatgaaggcctctgttctataaaactgataaaaaggcaagataacatagtcgatggaaaaagtgccaaatgataatgacatattaatagacagatgacctattgtatattgttctatggtacagacagtagctattactactatttttttagtgtgtatggtataccagatactatgccaagaccttcccatgcataatcctacttcattcccacatcaactttgtaaaacagcttttttcaattcccctattttatagatgaagaaaagagagattatacttgccc

SEQ ID NO: 82877 - DNA, 601 bp, Human
ccccagcacatagcatagtgcttggcatataatttatgttaaataaatgtttgttgaatggattaattagttaatcatagagggttttacagaggagttgagattggagctcagccattaaggatacgaacaatcagagagaatgggagaggccattcagacacaaatattgtgaatgaaggcaatgcattgggaatgagctttgaagtaatgggggtcagtgaggtgatggaccccttgtgaaattgcttcttacatttataacacctttctcagtttgttaccctgtatatatttatcygttcacctatttattatggatctcctctcaatgaagtgtaacctccaagagggcaagcaccatgcttctttcacctttccactgtgttgccaatagtgcttcacccatagcaagctcttaatacatatttgtgaaaggaaggtattagaggagggaaggtcaatgtataggttggggaatagatagatgggaaggttggtatcaggttggatcatatgaaattgccagtttttataagtcaaaagtcatcagttatcagctgtttcctttgtttcaatttgtactttcatcttgtgggga

SEQ ID NO: 82878 - DNA, 601 bp, Human
aggagggaaggtcaatgtataggttggggaatagatagatgggaaggttggtatcaggttggatcatatgaaattgccagtttttataagtcaaaagtcatcagttatcagctgtttcctttgtttcaatttgtactttcatcttgtggggacaatatttctccattgcctgaatgtggttggttttaaaatatcatgtctttgctgttttgtgtttattagaagctgaataggttcttgataaaggtgtctcattgttgaaaaggcagcaaaccatttgacaagcagatgaaaaagtaaygaagaattattaataaaactatcatcccaatagtatttgagctccgtggtctggaatttcacaatctaaccactatttcaaagaattcattgtgtgtgcttgcatttaattattccccacataaaaaaacatgagtcactatgcacatacatccaattaagtagatgtctgaatgtggattttaataaccttgaaaatttattcagttagagaagaagcccaagtgcttatcatctgttatatgtctccttgcaacagtgcagggagagagacaccgagcagagtacactaaccccaatt

SEQ ID NO: 82879 - DNA, 601 bp, Human
aaaaatagggaattagatctagttaatctgcaggctgagctagatctaaaaccaaggtctgtagtcttaaccattcattattaggtgtgtctcctgcccaagcaaacttctgggcagttctttccacaaatattttttctacctgtgatgattagggatagtctgcattttgggataaaagggtattcattgacactggttcttaatgattaaccataatcaaacatcaaatggaaaagttcacaggagtcaggtccctgtcctgatactgccaccaggctactatcagatctgggcaaarcattttccctctgtgggtcttgacttcctatctgtacagtgagagtttggaccagatgatcctaactttcccttccagcttctaagttgggcaatccattaatgtctgagtacctaactgattcggggaggaaggcacaaaattcagaaaaagaaagaagagcatctatatatggttcatgcaaggaattgaaggtgaagtcatccacatacccatctgaccattcatccaccatccatctattaactcatctgtttttccaatcagcgaatattgtcatgacagatttcatgcaacata

SEQ ID NO: 82880 - DNA, 601 bp, Human
atgccaccatcattggatggttgggatattgtagttctagtacttagggtagggcacattgtaagcactcgatatcagctgccgttattactgttgttgtcgtggctttaactgttagtatgattaatgagtctccacctattatgttttgtagattataaagctagagaagaatggcatcggctaccactacattcttgcaaatctggtgagtagagcactgcaggctctcagctcaagtcctttccaggtttggggccctaccttgcttctgttgtccctggctgatgtgaactgagtrggtggaaggggcaattcagggctgtaataatgagtcttggcaatactacatttttatcttctccacatcccactcatcaaaccacaacacactattcatgaacctctaaccttccttggaagagagcatactggtgggcacggctttatcatcttcacaattccagctttaattggctctgccccttggcaatagggacaaaatcaccacatctttgaattaatgcaagatgtcttgatcttactggtttgggtcctccattttgaccccagtgatagttttacttcttataaatacatt

SEQ ID NO: 82881 - DNA, 601 bp, Human
gaataatgctgctataaaatattagtgtacaagattttcactttaatatatacctaggcatggaattactgggttatatgataactctatgtttaacattttgaggaactccaaaattattttccaaagtggctgcatcacccatcaaattttaatcaataacaaatttttccatgtgacagtttgaatgatggcaagtgtctcttaatgataactatttctacagtttattatcctgttctgtctttgcaattttccatgtttccattaagaagtggtttctagctttttatctataacraattttcaggttttaacttacttaactgaacatataactggcttcagttttaaccatgttattttgtgttgattatctctatgagcaatagtaattgaacaaaggattaatatttgttactcatttctggagtaaagtctgttagtagaaataaggcacagggtgcatgaatctaaaaatgtgaccaaagcatcctgcctaatccataaattctgtccttctttctgacctggtatccagccttagatagatccctgccttactcttctttccccttcttcaactaacttgtcttggcaa

SEQ ID NO: 82882 - DNA, 601 bp, Human
atgataactatttctacagtttattatcctgttctgtctttgcaattttccatgtttccattaagaagtggtttctagctttttatctataacgaattttcaggttttaacttacttaactgaacatataactggcttcagttttaaccatgttattttgtgttgattatctctatgagcaatagtaattgaacaaaggattaatatttgttactcatttctggagtaaagtctgttagtagaaataaggcacagggtgcatgaatctaaaaatgtgaccaaagcatcctgcctaatccakaaattctgtccttctttctgacctggtatccagccttagatagatccctgccttactcttctttccccttcttcaactaacttgtcttggcaatatttcggagtgaggacttgaaataagaagggcttagagaagtaggttaatttaggcccagctgttaatggctaaatatattacctttctcagaggtatttgcattttaaatgagggtggctctccagacacttttggggaaccaagagtctcaccctccaaagaccatttgcaaaaatggaatttttgacttcggagtgaggaaag

SEQ ID NO: 82883 - DNA, 601 bp, Human
agtagaaataaggcacagggtgcatgaatctaaaaatgtgaccaaagcatcctgcctaatccataaattctgtccttctttctgacctggtatccagccttagatagatccctgccttactcttctttccccttcttcaactaacttgtcttggcaatatttcggagtgaggacttgaaataagaagggcttagagaagtaggttaatttaggcccagctgttaatggctaaatatattacctttctcagaggtatttgcattttaaatgagggtggctctccagacacttttggggaacsaagagtctcaccctccaaagaccatttgcaaaaatggaatttttgacttcggagtgaggaaagcccttaacatcccttgactcccagatccttagtgctagagcggacttaggaagtcaactccacttaaacctcacttgtttatagggaaacaaccagcaaaggggtgtgacttggccaaggtcacacagtgaggcagcactagagctaggcctgtcaccaagggtagcaggcagtattcaggccttttctataactccaggtcatctctcagtgaaactttgtaggcaccctgctgct

SEQ ID NO: 82884 - DNA, 601 bp, Human
cagagtccttcagagttgtagttcttatctttgtgactcaccagaagcaaatcttagaccaaatgagtgtttctcaaaacagaggacctgtggacctctgtagtgtttctgtagagccagtttggaaaatgtggcaccaacaagcgaatgcttcagtgccactgcaattgccaatatgagtacctaaaccatggagtaaatggtcagattgttatattggtatttagaatttcactggaatgaaagcacatattttaaaattctcatagagaactagaagattgggagaatttacacaggkttcagcagactcctgtctgaaaaatattgaatttgttggacaacattgaccagtgtgaacaatatggtgccttctagaggagtagtaacaatagtaatatcaacaatctctctcatttttataccatattatagtttatgtgatatttctgtatgaatcatactaccgggttttggatgtcataatactcctatgaagtaaacaaggtggaattcatcatccccattttacagatgtgggaactgaggctgagacattacatgactgagctgcagaggagaaagacaggaacctaattaa

SEQ ID NO: 82885 - DNA, 601 bp, Human
acctgtggacctctgtagtgtttctgtagagccagtttggaaaatgtggcaccaacaagcgaatgcttcagtgccactgcaattgccaatatgagtacctaaaccatggagtaaatggtcagattgttatattggtatttagaatttcactggaatgaaagcacatattttaaaattctcatagagaactagaagattgggagaatttacacagggttcagcagactcctgtctgaaaaatattgaatttgttggacaacattgaccagtgtgaacaatatggtgccttctagaggagtartaacaatagtaatatcaacaatctctctcatttttataccatattatagtttatgtgatatttctgtatgaatcatactaccgggttttggatgtcataatactcctatgaagtaaacaaggtggaattcatcatccccattttacagatgtgggaactgaggctgagacattacatgactgagctgcagaggagaaagacaggaacctaattaatggagtttggctgtcaggaatatgacaaaaaccaagagatgtgggcataagaataagatgatcaggctaacctgatgctgagaca

SEQ ID NO: 82886 - DNA, 601 bp, Human
tcactgaattagaattccttaaacccctaataaattacaacaataataacaatggcaataacttccacaattgactgattgctacattctagacactatgataaacacttaaatgcatgtcaattaaaccttcccaatagcccttgaggttgatattatcctcagatgaagaaacagagcttcagaaaggttgacttttccacagtcacaaaacatataaagtgatggagctgcacttctcctcaagggccatggaatcccaaaatttgtgttcttattaccgtgccatgtgagtgctggrcagggagagttggggaaagagtcaggaaagagagggggttgtcctggacaagacagcttgagtttaaatcttgtctacagtagcagcaatagatctgacattccaacccaggctctcaaattcccattggacatctgtctcaccatttactccatggtttaggtactcatattggcaatcgcagtggcactgaagcattcacttgttagtgctgcattttccaaactggctctacagacacaccacagaggtccacaggtcctctgttttgagaaacactcatttggtctaagatttgct

SEQ ID NO: 82887 - DNA, 601 bp, Human
catataaagtgatggagctgcacttctcctcaagggccatggaatcccaaaatttgtgttcttattaccgtgccatgtgagtgctgggcagggagagttggggaaagagtcaggaaagagagggggttgtcctggacaagacagcttgagtttaaatcttgtctacagtagcagcaatagatctgacattccaacccaggctctcaaattcccattggacatctgtctcaccatttactccatggtttaggtactcatattggcaatcgcagtggcactgaagcattcacttgttagtgcygcattttccaaactggctctacagacacaccacagaggtccacaggtcctctgttttgagaaacactcatttggtctaagatttgcttctggtgagtcacaaaggtaagaactacaactacattgatggaattttattaaaattattatttctagtgtgacagaagctgaggaagagatgacggagttagcccattccaggtcttatcggggtacttgggaaccaggacagttggccatttctgccatgtgcttgcagattaactcctgtagaatgttagattggaagttttagtctatt

SEQ ID NO: 82888 - DNA, 601 bp, Human
aggaagagatgacggagttagcccattccaggtcttatcggggtacttgggaaccaggacagttggccatttctgccatgtgcttgcagattaactcctgtagaatgttagattggaagttttagtctatttggcagctattccaagcccccagccccatgctgctgctcctctgcgggatcagccctgagcagaaactgttctttagtctccttgctcccctgtggtgataaatctgtcagctccttctgcaaagctgagctcatccactttcttcagtgcctctcttcctgttggctcygtacctcacagttatgtttagtttctgcagcttctggttaggcaggtggtatagtagttgggaagggtggctttggagccagttctgggtttgaattctgacttttatacttattagctatgtaacattagtcaatttatctaccttttctgagtttttgttgccttatctttaaaaaagagaatgatattatgtacattcttatagggttttatgagaactaagtgagatccctcaacgctctcggaaatgaaatcacatctacctgttttatgctgccatagccccagatattttttc

SEQ ID NO: 82889 - DNA, 601 bp, Human
aagtaagattctggtcccattttataaggagaaaaatgaagttcaagttgttgaaaaaccttttgtaaagtcatttgactaaaactggaattcaaacttaaaacctttcccattctaaggattaggcttgttctccattgggccacactgcccaaactggggaaacctttgcaattcttaggactggtattataattgagcaaagccaagaaataaactcctttcttccttaaactgcctgggtttgaaatctggctcagctacttactagctgtttgtccattgcaagtcacttctcctstttgtacctcagctgtctcacctatgagtgggaatattaatgtggatctcataagataaagataaaatgagttaatgtatgtaaagttttagaacacagagtgcaacagaagcccagggtctcatcctaactctgtcacttactcatgaccatttatgcaaatcatatttttctgtaagatctcaatttgttctagaattggcataatgttttcaaaaggaaaaaaatcagcaaaacaatcttcctgcctgtgtgatttagggttctagttttcctgattgtcttcagttcagaggtatc

SEQ ID NO: 82890 - DNA, 601 bp, Human
tcagaggtatcaaaaaatatctctcatagccacactggctcccttaagcttaaggaagaggctgttctattaatctcaagcacttggtgtgtgtatctttcgatcttgcaaaccatgcacacctaggctgatttggaatggcctttttcatgctgggtcagcatcctttggaccatttcagatatgtaagacagtgactatgattgctctgacagagcatggaaactcactgtcaccagcagccttcaagcaagaggggccccttagcactaattttggcagatggttggtgagctatgtwactagaagagtctggtccttgtttccttacctatccctctttttaagacagaaaaatagagaatacaatgggagggaaatggagctccaggagacacaggattttaggtaaatacttactatgtgccaagcactgttctctaagaatctgacaggtaacatagttaatcctcacaacagctatgagaaataccataataatccttatgttgcagcaaaggttactgaggcactaaaaggttgagtagccctcctgaggttgcacagctaggaggtggtggagctaagatttgaatctagg

SEQ ID NO: 82891 - DNA, 601 bp, Human
ttttcatcaaaagatgggcatgctatgagtatttgcttggccttttctagataggaaggttttgatcatgtaaagggtagatgcaattggttttaagtccactgggaactgtagccataagggcccacctcataccaggaaatttgctcttgctctgaaatggccttggccaggtgtcattcctgaccacaacagttggggcagagtaaagatgaagggactctctggaagaccaactattcccaggccaggtagtacacccatgcagccttgcactcaatagcccaacctggagtccctraccttctgccagaaagtgccagcattttatcctaaatcccagggctgagagaaattagtttgtgagaccctgactgacatttacaatgctttgtcaatactggatacttgtatgaggtatgtctgttggtgtgtttgcagatatccaagtgtgcctccctggttccaaatgtaactggataagtcaacacgaatgcttttttcttctcaatatttatggtgttttcactgatttaagcacagctacaataccttgtttaattagaggaaaccagactaccctctgtgttaccagagatta

SEQ ID NO: 82892 - DNA, 601 bp, Human
tagataggaaggttttgatcatgtaaagggtagatgcaattggttttaagtccactgggaactgtagccataagggcccacctcataccaggaaatttgctcttgctctgaaatggccttggccaggtgtcattcctgaccacaacagttggggcagagtaaagatgaagggactctctggaagaccaactattcccaggccaggtagtacacccatgcagccttgcactcaatagcccaacctggagtccctgaccttctgccagaaagtgccagcattttatcctaaatcccagggctragagaaattagtttgtgagaccctgactgacatttacaatgctttgtcaatactggatacttgtatgaggtatgtctgttggtgtgtttgcagatatccaagtgtgcctccctggttccaaatgtaactggataagtcaacacgaatgcttttttcttctcaatatttatggtgttttcactgatttaagcacagctacaataccttgtttaattagaggaaaccagactaccctctgtgttaccagagattatatagggagaggacaccttaaaggtttggttggttaaagtggctaaa

SEQ ID NO: 82893 - DNA, 601 bp, Human
ccttgcactcaatagcccaacctggagtccctgaccttctgccagaaagtgccagcattttatcctaaatcccagggctgagagaaattagtttgtgagaccctgactgacatttacaatgctttgtcaatactggatacttgtatgaggtatgtctgttggtgtgtttgcagatatccaagtgtgcctccctggttccaaatgtaactggataagtcaacacgaatgcttttttcttctcaatatttatggtgttttcactgatttaagcacagctacaataccttgtttaattagaggraaccagactaccctctgtgttaccagagattatatagggagaggacaccttaaaggtttggttggttaaagtggctaaaataggaaaatgtgaagacttttatgcagagacatgggtatttgaggacacaattaagtcttcagcccaggagtattccacaaattcacacatatccatattcatgcgcacatacctgtgtgatcatagaattgtagatcaaagctggaagagcccttaagagagaaatcaagtggctcagaagtttccaaactttttagtttgaggctctattttcaaatg

SEQ ID NO: 82894 - DNA, 601 bp, Human
cttactttcttggtcttctatacttttttaggctgataattcccacttttaaaaaaatacttctaatataagacttttcaaaccacagtttcctataactactctctcaatggagctgtcatctaagattttatctgacaatttggggaaacttggcatgttcaacctgtgccattcagagtatacagtacaagttctttgatttttctctcaacttacctcctgtggatctcaaggggatgggatggaggaagtgctctttccagtgtcccaggatttgtttaataaaccttacttgccygtttccttgaacaatgttagatgctccttcttccttctgactggtgtggtgtcagcacaggcaggatgatgagggctgaacagctcgtatgtgaccccttgaaagaatcccagagcaaaggaaatccagctttgaagataaagcctttcatccttcgatagctatgttcctatacacctgcttcatgttctctcaggcttcttgcctgacccagtccctgtatttgaagcagttctaacacctaacctcttttgacccaatgataatgataatggtgaatgtgatgatcataataatagc

SEQ ID NO: 82895 - DNA, 601 bp, Human
attgcacgtgataattaatagtcataatgatggcccagagcctcttcaagattcttaaagcattctccaaatcttcacagcaagatgaaagcatgtccaatgtagttgtagtgttaaacacctctttaggatatcataattacttgaaatgccttttcattctaatcctttgaaaattataattggcatatgatagatggagtgactatattaactagtttacttaattgagcgcatttactccccatcattgtactcaaatgccttttcaacattgtgttacctcctacagtggatatasagaggagacagattctgttctcaactaatcctctcaccagccatataaccttaagccactattcccctctttgggcctcagtttccctatctgaacaatatgaggggtttgttttacctcctacagtggatatagagaggagacagattctattctcaaccaatcctctaactggccatataaccttaagccactattcccatctctgggcctcagtttccctatctgtacaatatgaagggtttggtcttctctccaaaatctttgctcctgtataggtcaaaagtcagcaaactatgg

SEQ ID NO: 82896 - DNA, 601 bp, Human
tgactatattaactagtttacttaattgagcgcatttactccccatcattgtactcaaatgccttttcaacattgtgttacctcctacagtggatatacagaggagacagattctgttctcaactaatcctctcaccagccatataaccttaagccactattcccctctttgggcctcagtttccctatctgaacaatatgaggggtttgttttacctcctacagtggatatagagaggagacagattctattctcaaccaatcctctaactggccatataaccttaagccactattcccrtctctgggcctcagtttccctatctgtacaatatgaagggtttggtcttctctccaaaatctttgctcctgtataggtcaaaagtcagcaaactatggtccctgtgtcaaatccagccatcacctgattttatatggctcatgagctaagaatgattttttacattttttaattgttgggaaaaaaatcaaaagaatgatattttataatatgtggaactatatgacattaaattaccatgcccaaaaatattgggacagccatgctcttccaattactatatgctaaatagtaatagta

SEQ ID NO: 82897 - DNA, 601 bp, Human
ctcagtttccctatctgaacaatatgaggggtttgttttacctcctacagtggatatagagaggagacagattctattctcaaccaatcctctaactggccatataaccttaagccactattcccatctctgggcctcagtttccctatctgtacaatatgaagggtttggtcttctctccaaaatctttgctcctgtataggtcaaaagtcagcaaactatggtccctgtgtcaaatccagccatcacctgattttatatggctcatgagctaagaatgattttttacattttttaattkttgggaaaaaaatcaaaagaatgatattttataatatgtggaactatatgacattaaattaccatgcccaaaaatattgggacagccatgctcttccaattactatatgctaaatagtaatagtaaattactattttctatatatggctactttcatgctgcaatggcagagctgactagttgtgacaagaaccatatggtttgcaaagcctaaaatatttataatctggccctttacataaaaagtttgctgaccccttgcatagatgtggaatagggggacactaataggcttcagat

SEQ ID NO: 82898 - DNA, 601 bp, Human
ccaatcctctaactggccatataaccttaagccactattcccatctctgggcctcagtttccctatctgtacaatatgaagggtttggtcttctctccaaaatctttgctcctgtataggtcaaaagtcagcaaactatggtccctgtgtcaaatccagccatcacctgattttatatggctcatgagctaagaatgattttttacattttttaattgttgggaaaaaaatcaaaagaatgatattttataatatgtggaactatatgacattaaattaccatgcccaaaaatattgggamagccatgctcttccaattactatatgctaaatagtaatagtaaattactattttctatatatggctactttcatgctgcaatggcagagctgactagttgtgacaagaaccatatggtttgcaaagcctaaaatatttataatctggccctttacataaaaagtttgctgaccccttgcatagatgtggaatagggggacactaataggcttcagataaactagacactttggaagcatctaaagacccttaggaggttagtgtcaaggagaggaacctagcgcagtcccacaaatattc

SEQ ID NO: 82899 - DNA, 601 bp, Human
gctactttcatgctgcaatggcagagctgactagttgtgacaagaaccatatggtttgcaaagcctaaaatatttataatctggccctttacataaaaagtttgctgaccccttgcatagatgtggaatagggggacactaataggcttcagataaactagacactttggaagcatctaaagacccttaggaggttagtgtcaaggagaggaacctagcgcagtcccacaaatattcgttcaagaaagacagctacatttgaaggcccctgctctggcagggtgacatattctggctattmactgtgccagccacagtctgaggttcattgtccctctttgtctggagcaatcttgacacaccatcctaaagctaaagtcatatgtttctccactggtggagcagtagaacacatttgtgaagaagacagattttatagttggaccacagtttgaattcttgcttgctgtgtgatctcagggaaatttccaaaggtctcttaaccatagctccttaacagaaaattaggatggatactcactcactcatttatgcaaataagtattgggtgtctactgtgcacatttacctcttggaattg

SEQ ID NO: 82900 - DNA, 601 bp, Human
cttgcatagatgtggaatagggggacactaataggcttcagataaactagacactttggaagcatctaaagacccttaggaggttagtgtcaaggagaggaacctagcgcagtcccacaaatattcgttcaagaaagacagctacatttgaaggcccctgctctggcagggtgacatattctggctattaactgtgccagccacagtctgaggttcattgtccctctttgtctggagcaatcttgacacaccatcctaaagctaaagtcatatgtttctccactggtggagcagtagaacrcatttgtgaagaagacagattttatagttggaccacagtttgaattcttgcttgctgtgtgatctcagggaaatttccaaaggtctcttaaccatagctccttaacagaaaattaggatggatactcactcactcatttatgcaaataagtattgggtgtctactgtgcacatttacctcttggaattgtttaagtaattaaaggattatgtatataaagcatttaacagaatgcctgactcaggaatagagcttggaaaatgtttaaaatacatctcaaacaattattattcttttgtt

SEQ ID NO: 82901 - DNA, 601 bp, Human
gttggaccacagtttgaattcttgcttgctgtgtgatctcagggaaatttccaaaggtctcttaaccatagctccttaacagaaaattaggatggatactcactcactcatttatgcaaataagtattgggtgtctactgtgcacatttacctcttggaattgtttaagtaattaaaggattatgtatataaagcatttaacagaatgcctgactcaggaatagagcttggaaaatgtttaaaatacatctcaaacaattattattcttttgtttttaaattacagtaacctcaaaactcytaaaaagctgtttgaataaagttatataatgcatacaaaggggcatttttagccattattgtcatttttgttcttataagcaatgcttctgaagccgttttcagtggagcacttaacagcaccagtgtgctttaatttcaggccaggagataaaaaattaagcagggctctcttaaaagaccataacaaagcttcaacaaatgcaacaacttctctcccctgtcttgccactgctactctgtcccccactttccagtgactaatggatgatatctaagatacattagagctatctgagga

SEQ ID NO: 82902 - DNA, 601 bp, Human
gcatttttagccattattgtcatttttgttcttataagcaatgcttctgaagccgttttcagtggagcacttaacagcaccagtgtgctttaatttcaggccaggagataaaaaattaagcagggctctcttaaaagaccataacaaagcttcaacaaatgcaacaacttctctcccctgtcttgccactgctactctgtcccccactttccagtgactaatggatgatatctaagatacattagagctatctgaggatcgatttttattttttaatagtattaaaaatacaatatattcrcatgataaaacagatattacagaagggtataaagtaaaagataaatgcccattctttccaattctatacttcatagaagtaactattttaaacccttttcctgcatttggttatttaatggtttcctttacacttctacatcatatatttatgtttctttttcttgctttatcaactttaactccatatctgacttcccattagaaagatgacaaatcagctcatattacacccccaacatccccttctcaatgtttgttagcctatatgctattatttggaattcttctgatgattacc

SEQ ID NO: 82903 - DNA, 601 bp, Human
ggtcaatttctttgcatttaataatgacagtagacacagcattctttctcaccgatttattagtcacacatggggcaatgtgaaatgctacataggtgcagaagaagcagacaagaacacagtgacctaatagccctaggaactcactcatcaccaagcttcactttaggtgagaaacagtcactcaaagagaagcatctggtaccagtgctgggaggtcagtggaaggagagtgggtttagacctgcattcttgtgctgaatagctggaaaaacacttgactaacctgaaaaacaagtaytctgtagattaatttcattttttttttgtcagtagtaacagtatatagagcaatggtcccagcatttgggaacatgttgtaaataggcaaagtggctcaaagagagtagtaatcaaacttcgtagttaaaatttttaatagaatataattagcaatgtagtatttttatataatactatataattaatagcacaaataaagcacataaagaaaaatgttctaattaccaaatattaccctctaaggttttttttaataaaatggcaaagaaaattagaaaattatttaattaaaccttat

SEQ ID NO: 82904 - DNA, 601 bp, Human
cagtagacacagcattctttctcaccgatttattagtcacacatggggcaatgtgaaatgctacataggtgcagaagaagcagacaagaacacagtgacctaatagccctaggaactcactcatcaccaagcttcactttaggtgagaaacagtcactcaaagagaagcatctggtaccagtgctgggaggtcagtggaaggagagtgggtttagacctgcattcttgtgctgaatagctggaaaaacacttgactaacctgaaaaacaagtactctgtagattaatttcattttttttttgtcagtagtaacagtatatagagcaatggtcccagcatttgggaacatgttgtaaataggcaaagtggctcaaagagagtagtaatcaaacttcgtagttaaaatttttaatagaatataattagcaatgtagtatttttatataatactatataattaatagcacaaataaagcacataaagaaaaatgttctaattaccaaatattaccctctaaggttttttttaataaaatggcaaagaaaattagaaaattatttaattaaaccttatttaatgagagttcccaggggaacagaa

SEQ ID NO: 82905 - DNA, 601 bp, Human
gcattgctctaggagcaggttctaggacacatcagtgaccaagacaaaaaaggttcctgctcttaggaaactgacatttcaataggaggaaagaggctatgggaacacatgagtaaacaagataatctcaaatggtgataaaaactctggagaagctctaacagggcactgagatagagcagactggatagggtgctgggggtaactctactatgttcttccagaagcagttccctgaaacaaggattcaagtacaaggggcttcttgggtgccaatcctaaaaaaccagggaagggaggyagagaagggaagtctgcctacaaagtttcataaacaagatgcctacactgcaggctactgaaggagaacagtccctgaggggatcccaacatgtcagtgtagaactcacctcagggtcatgccatgcaggggagaggattctggggcacttatctactgactcttcatctgtcattgattgaaagctgcttctgggcatattaactccttaacatgtctaacttagcctgcaggtaggcggagtagccaggtgtttgcagttggtacgtaaagtagaatacccatgtagaaaggggagtg

SEQ ID NO: 82906 - DNA, 601 bp, Human
tttcttcctgctgggcaggcccccaattatacctaaaagaaacccaagttaacacaaggctctatgtgaccagctttgggctgccaatttgacctcctttcccaccctttctcttcaaactcactgtgccacaatcacaccagcctccttactgtttcttgaatatgccaatcatcctctcacctctgggcctttgctcagaatgctcttctccaaatatccccatagctcagacacaggcatcacttcactcaggtccctaagccaagaccacctccttgcggaggctcatcctcatcaytccttccaaagcatgacactgcccctccccatcctcttacctcactttatccttcatggggctcattgctaccgcagagtatactatcccagattatactatactatgctgcatatttacttgttcatttattgtctgtcttccccactagaatataagctccataagggaagaaacttgctttattcactattagaatagtgcactatgacttttcaaaaatgtttgttgaaatgattaatcagtgaataagtgagtgagtgactgagtgaaccaatgcctaacagaggcccttagttc

SEQ ID NO: 82907 - DNA, 601 bp, Human
ggcctcatggagtggtgaaaatttaccctgttgtatggaaaagagcacagggtgaggatggagactgggatcagaactcggcctcttccacagacttgctggtgtccttgggtaactcataggagcttgcccagtgaaattcagattcctcttctctcaaaatggttgggtattgggatggtagacgagattattccctccttagaggtttctaccttgtactatatatctgcatcatcataataatcacagccactatttattgatcacttggtctgccccatgcacttgacatgtgtcrttgcattgtatgtttaccccaacaaccagacctccattattcagacaagaaaactgtcaagtaacttagttaatagtggtataactactggcttatgcatagcagcgccagcactccaaactaggcatactggctcctgagctgtgctaattttgtgcacaaactaagtaataatcaagttcaaaggaaaggaggcctaactgtctctccattgagtaggtttcatctggtggaactgaatggaaaatcctgtggttttggaacaggttaagttgatttatccaggcagcatgttctaac

SEQ ID NO: 82908 - DNA, 601 bp, Human
gggtattgggatggtagacgagattattccctccttagaggtttctaccttgtactatatatctgcatcatcataataatcacagccactatttattgatcacttggtctgccccatgcacttgacatgtgtcattgcattgtatgtttaccccaacaaccagacctccattattcagacaagaaaactgtcaagtaacttagttaatagtggtataactactggcttatgcatagcagcgccagcactccaaactaggcatactggctcctgagctgtgctaattttgtgcacaaactaagtaataatcaagttcaaaggaaaggaggcctaactgtctctccattgagtaggtttcatctggtggaactgaatggaaaatcctgtggttttggaacaggttaagttgatttatccaggcagcatgttctaacttctccctcctccccctctcacagggcttcatggacattgacttaaacaaattcaaggagagtggcgccaatgtgacaggtttccagctggtgaactacacagacactattccggccaagatcatgcagcagtggaagaatagtgatgctcgagaccacacacgggt

SEQ ID NO: 82909 - DNA, 601 bp, Human
ctgaagtcaaaccagatagcttgacagtggccatatggaaccctgtgttgagaaggatactaaggccaagtttgtttatctggacaaacagtgaatctttgacagactttctcttgccactcaatccatttctttttataaatggcaaaccgtataacggagatacttcttatcccactattcaaactgatttaactcttcaataatgaagacttatttcaatatgatcttaagcaaacaaaatcgcaaatatgctttcaagcaatgagaaaactacataggaattaattaagtaatgtgyaatgattgcactccaatttccaaaagactgagcagatgacaaaaataaccaaatgtaatttaattttttttttttttttgagatggagtctggctctgttgcccaggctggagtgcagtggcatgatctcggctcactgcaagctccacctcccgagttcacgccattctcctgcctcagcctcccaagtagctgggactacaggcacccgccaccacgtctggctaattttttgtattttttagtagagatggggtttcaccgtgttagccaggatggtcttgatctcctgaccttgtg

SEQ ID NO: 82910 - DNA, 601 bp, Human
aatatgatcttaagcaaacaaaatcgcaaatatgctttcaagcaatgagaaaactacataggaattaattaagtaatgtgcaatgattgcactccaatttccaaaagactgagcagatgacaaaaataaccaaatgtaatttaattttttttttttttttgagatggagtctggctctgttgcccaggctggagtgcagtggcatgatctcggctcactgcaagctccacctcccgagttcacgccattctcctgcctcagcctcccaagtagctgggactacaggcacccgccaccacgyctggctaattttttgtattttttagtagagatggggtttcaccgtgttagccaggatggtcttgatctcctgaccttgtgatccacccatctcagcctcccaaagtgctgggattacaggcgtgagccactgcgcccggcatgtaatttaactttttaaaaaagaagtgagagaattaaatttaaaaaattagaaaaatacccattcattcgttcttcaattctctattgtgaacttggagtgtgctaggcaacataataagtattaggaacaaattagtgaagaaaacagacataggtt

SEQ ID NO: 82911 - DNA, 601 bp, Human
ttttttttgagatggagtctggctctgttgcccaggctggagtgcagtggcatgatctcggctcactgcaagctccacctcccgagttcacgccattctcctgcctcagcctcccaagtagctgggactacaggcacccgccaccacgtctggctaattttttgtattttttagtagagatggggtttcaccgtgttagccaggatggtcttgatctcctgaccttgtgatccacccatctcagcctcccaaagtgctgggattacaggcgtgagccactgcgcccggcatgtaatttaaytttttaaaaaagaagtgagagaattaaatttaaaaaattagaaaaatacccattcattcgttcttcaattctctattgtgaacttggagtgtgctaggcaacataataagtattaggaacaaattagtgaagaaaacagacataggttccaaagccaggatatattttcctggactgctctcctgattttgtttcatccacatcctagtcccctttttgtcaggagagggtataattgatagttgttgtgagaaagaatgaggggaaagtttacaggatataaacttaccacttaggtaa

SEQ ID NO: 82912 - DNA, 601 bp, Human
agctcacccttctttcattttctttttgcttttacttttacaagagatgaaagagttaatcgttcctcttggtttccagctgatgactgtaatgccgggataaaccagctgatttttcatgaactgtatccagcctgcagatgtgttatatgtaatctatgcattttttcccaaatgaaccaacattttaaaaattgcaagattgcacacagaaacctagaatcctggcttctcttcaaaaattataactggcagtactgaactcacagttcaaggaggtcagcattgactagcatggtcragcagcagcacccatctgcttgaatatttatgcttctcagggacaccatccctgattcaccactgtctgccccacgtataccatgcatctggcccactgcacacccttctcatcaccagaaaacacattcccaaatacagcacccaaacctgccttcctgtcagctctctttgatacctaactgtctccattcctcccactagtacacctctgcgctcacctacgatggggtgaaggtgatggctgaggctttccagagcctgcggaggcagagaattgatatatctcgccgggggaatg

SEQ ID NO: 82913 - DNA, 601 bp, Human
actttcacaaccaggagaaagagatgctgaaggaacctcaccagctgttcctcagccctgatgagtgcctttctgtagagaagaatatgtaggtctgtcctttgaaatgaagctaagcaggatttctactagctacatgaggaacatgctaaggaggacctccagctgccatttctgccctcccctggtccctgtgcagggtggctcccaagtcactaggcagcaacaacagacaccaggcagcttgcaggggaaaattgccaaatggacagtgcctgcgcctccctttctacccccaccycagcttatttaaaatgctcttccagactccacagtcgagacagattctgtttgcaatgtgaggctggtttcaaaaggtcccagagatttgtcctcagcttcacaacccttccaactcccttgcctctcccatcttaatgacgtcctgaaaggatagtctgatgccaccatgacagtgatgaagcctgggaggcagttcagggtggcaggaaggactctgtactgggaggcaggagagctggactccacgtccagctgggcccctggctctctggatgaccttgaaacattcacttagctc

SEQ ID NO: 82914 - DNA, 601 bp, Human
tggatggggatgtcaatgatacccagcaagagacgaggtagggtgagggtacaagaaaggacttgcacatgtcacattggcctgttaaggaattagggatagaagagctgggttccaaccgtggctccacgcagaactatctgggggatcttggactaattgcttgccttttccagatctggatttttcctgtctgctaaacagacataatcctcctagtgctgcctccctgactggcttgtcacagggctcagaattttaagaaagcatcgtgcttgtgggccaagcatcgtggttcatrcctgtaatcccagcactttgggaggctgaggtgggcagatcacgaggtaaggagtttgagaccaacctggccaacatagtgaaaccctgtctctactaaaaatacaaaaagttagcgggatgtgtagcaggcacctgtaattccagctacctgggaggctgagacaggagaatcacttgaacgcaggaggcagaggttacagtgagccgaggttgtgccactgcataccacaccagcctgggtgacagtgtgagactatgtcaaaaaaaaaaaaagcatcatgcatgtgtttctttgaac

SEQ ID NO: 82915 - DNA, 601 bp, Human
ggttacagtgagccgaggttgtgccactgcataccacaccagcctgggtgacagtgtgagactatgtcaaaaaaaaaaaaagcatcatgcatgtgtttctttgaacttcagggaagctgcatgagacagtcagagccaagattattcttcccatgactcaggtaggaaagtgaagcttaggagggttctgagatttgctctggccagagtacctagaatgtgacccagcaaggacctagtctacaggcctcacagccagtgagcatccaggaggaaggatccacctgagggcaactgcaarggggatacaggagccctgcgtccagtttgactgctcggctgtctccttcaggactgcctttcaggatccaatgagggcaggggagagcagtcactgttgacacctgacaaagattctttgcttgaccaaactttagtcaggcttctgaaccttctcctaggcccatctgtgcaattcttgtgaaatccagttttggcaaagaacttgctaagtcggtttagcaagaaccctgtccaccacgtccaccctctttgccatgatcatcttcttcagcccccaccatcccccagattatgtcgg

SEQ ID NO: 82916 - DNA, 601 bp, Human
tgtgccactgcataccacaccagcctgggtgacagtgtgagactatgtcaaaaaaaaaaaaagcatcatgcatgtgtttctttgaacttcagggaagctgcatgagacagtcagagccaagattattcttcccatgactcaggtaggaaagtgaagcttaggagggttctgagatttgctctggccagagtacctagaatgtgacccagcaaggacctagtctacaggcctcacagccagtgagcatccaggaggaaggatccacctgagggcaactgcaagggggatacaggagccctgygtccagtttgactgctcggctgtctccttcaggactgcctttcaggatccaatgagggcaggggagagcagtcactgttgacacctgacaaagattctttgcttgaccaaactttagtcaggcttctgaaccttctcctaggcccatctgtgcaattcttgtgaaatccagttttggcaaagaacttgctaagtcggtttagcaagaaccctgtccaccacgtccaccctctttgccatgatcatcttcttcagcccccaccatcccccagattatgtcggatcatcctcgtccatcttc

SEQ ID NO: 82917 - DNA, 601 bp, Human
ctgctcggctgtctccttcaggactgcctttcaggatccaatgagggcaggggagagcagtcactgttgacacctgacaaagattctttgcttgaccaaactttagtcaggcttctgaaccttctcctaggcccatctgtgcaattcttgtgaaatccagttttggcaaagaacttgctaagtcggtttagcaagaaccctgtccaccacgtccaccctctttgccatgatcatcttcttcagcccccaccatcccccagattatgtcggatcatcctcgtccatcttcagcaagaatccycttaggccattttagccagaattcctcttaaccccgatgcttgctgttagcaatttcctatccactgacccccaccctgctccttggctatatattcccacgggcccatgctctattcagagttgagcccaatctctctccacctctgcaagacccattgcaggggtctctatacctattgctacgattctgaataaagtcttcttcactgtgctttaacaagtgtgctgattaattttttctttaacacagctgaagtaatagagacattaacccgcattctctcagcaccaagcagga

SEQ ID NO: 82918 - DNA, 601 bp, Human
cccatgctctattcagagttgagcccaatctctctccacctctgcaagacccattgcaggggtctctatacctattgctacgattctgaataaagtcttcttcactgtgctttaacaagtgtgctgattaattttttctttaacacagctgaagtaatagagacattaacccgcattctctcagcaccaagcaggaaaggaaatatatgcttcagcctcccatcagcagcagactctgagctggcacccagtaccctttacaggaagcccaaggttaattctccatctttcatggagggarttgagggcgccaggatggcgacagaagttccgggagcaggaaccaagaagaagtgcctgggctccatcaatctgacctcagacaccctgggatggggggagagagggataagtgcccagatcccagagctcagacctgatggatggggacagtggtttcaagatacacatttctgagaagcttcttcctctgtctctgagtcctgactctccttgataaatggtttggggctgagccattctcttgaactctccttgctctgccatcatggaatggtgtttctgggatgtctctttcgca

SEQ ID NO: 82919 - DNA, 601 bp, Human
tgtgaaacaggcaaaataacgtctgctctggctactcactgggtttctgtgaacatgaaataagcagcttcttgtgagatcaccgtgacagtgcaaggggtccttgggtcactagaactgtgcaggtaggacccttgaccttattggaaactgaggaaggcagtaaaagtgtcagtgacatgatccttctttcttctgaaagagtccccttgtcttagacaacctaccagccccaaggcctcaattttagattttatttttcataacttttacccactctacacagcacagtagtagtagycgtcattatcatcattattatcatctaaataatataaactatgcattgaaaacttatgtcccagacaatgtgctaagtacttcttggaggaggaaactaagaagcagatagtttgagcaaggaacctatggtcatacagttagaatgagcagagcacaacctgggaaatgcccagcagcaatagcagaaagcaggtagaaaacactacattgcacatttttgtgttgtcctcctgaagcctagcacaatagcactggcctgtgtttcggcgaacacttggtaccttaagtgaagatacca

SEQ ID NO: 82920 - DNA, 601 bp, Human
ttaagataaaaaaagggcagagatttttggaaactgaaggcttagagagctaaattgcctgagggcacttggctattaaggattaagctggggttaaatccaagtctttcaattgccaagtattttattccctggactcaggaataaagaagaaattcttaaaggaattaagaagccatctccaagcatagcttaaggcttcattcataaagctggcttcttgtcctgggtcttctgactcattagtgatggtgcaccattttctttcctttgcaggccccccatactttcttcatcttcrgatgtgtatctgagaagggcagtggtcatagtggttgtgtgatgggaggtgtttggttagggatggtgcagacatttcacattagtatgcactctgacccattgttagtatttgcctaaagaaataggtaaaaacaattgtcaggatgaatcccaatttagggaaaagagatctgtaatgcatcccttgcctgtggcaagggagtgaagagttttagcattcaggatactccaagacatcattccatggaacactcttgggttctgaatttctacttcagtggaaaaagcaaacacacat

SEQ ID NO: 82921 - DNA, 601 bp, Human
cgatttgaaggtttaacaggaaacgtgcagtttaatgagaaaggacgccggaccaactacacgctccacgtgattgaaatgaaacatgacggcatccgaaaggtaaggtccccctttacttctgttctgcagagagaagaggctgagcagggactctggccagagctgagggcctgtgagtccaccttttctggactggatctttgaagaaactcagacaacacagattctagacttggctctgccactaaccagctgggacattgggcaagtctcgttcttcctctgagaatccattcaytcatttgcaaaattaagtttaaaaaaatctctacatttgtcccaggatgcttgtgaaaatccaaggtagaggaaagcacttctaaaacataaagtaattgatgtgtataaaatgccactcccattcctgagggtttctaaactaagaacttgagaatgatgattattgatgaggttaactatctcttcctaatcgatagttggtcatatccactctattatttatacaaaagtaagggtgaaaatatatatgtttacatatatgtataatgtataatatgtttgcatatgaaaattctta

SEQ ID NO: 82922 - DNA, 601 bp, Human
ggaaacgtgcagtttaatgagaaaggacgccggaccaactacacgctccacgtgattgaaatgaaacatgacggcatccgaaaggtaaggtccccctttacttctgttctgcagagagaagaggctgagcagggactctggccagagctgagggcctgtgagtccaccttttctggactggatctttgaagaaactcagacaacacagattctagacttggctctgccactaaccagctgggacattgggcaagtctcgttcttcctctgagaatccattcattcatttgcaaaattaagwttaaaaaaatctctacatttgtcccaggatgcttgtgaaaatccaaggtagaggaaagcacttctaaaacataaagtaattgatgtgtataaaatgccactcccattcctgagggtttctaaactaagaacttgagaatgatgattattgatgaggttaactatctcttcctaatcgatagttggtcatatccactctattatttatacaaaagtaagggtgaaaatatatatgtttacatatatgtataatgtataatatgtttgcatatgaaaattcttagaatagcattcaaatcct

SEQ ID NO: 82923 - DNA, 601 bp, Human
tgttctgcagagagaagaggctgagcagggactctggccagagctgagggcctgtgagtccaccttttctggactggatctttgaagaaactcagacaacacagattctagacttggctctgccactaaccagctgggacattgggcaagtctcgttcttcctctgagaatccattcattcatttgcaaaattaagtttaaaaaaatctctacatttgtcccaggatgcttgtgaaaatccaaggtagaggaaagcacttctaaaacataaagtaattgatgtgtataaaatgccactccyattcctgagggtttctaaactaagaacttgagaatgatgattattgatgaggttaactatctcttcctaatcgatagttggtcatatccactctattatttatacaaaagtaagggtgaaaatatatatgtttacatatatgtataatgtataatatgtttgcatatgaaaattcttagaatagcattcaaatccttggaataacatttcgaattctaccagaacctatgtgcccgggcctctgccgatttcttcacccttaacccttgatacttccttcatctctccactccagtcatt

SEQ ID NO: 82924 - DNA, 601 bp, Human
ctaaactaagaacttgagaatgatgattattgatgaggttaactatctcttcctaatcgatagttggtcatatccactctattatttatacaaaagtaagggtgaaaatatatatgtttacatatatgtataatgtataatatgtttgcatatgaaaattcttagaatagcattcaaatccttggaataacatttcgaattctaccagaacctatgtgcccgggcctctgccgatttcttcacccttaacccttgatacttccttcatctctccactccagtcattctgtttgtctttcayctccctgaatacaccatgttctttctcatcattgagccttcatacatgtttcctctgcctgggacttcctccccccatctccctcctcttgcctgccaatccctcctcagccttccacactcaaagtaaatgtcattccccagcgaagccttctctggcctttcttattatgcttcatggaagcctctacttctctgctcatggccttcatcacattgctaattccatttggtggcgtagcataatgactgggaggcattgtacagcatggcgtagagctggtagggtgccatggatcag

SEQ ID NO: 82925 - DNA, 601 bp, Human
cctcaacactgaatcctggcttcaccacttactagtctggggttccggataatttatttgagctctttgttccttaattctcttatctagtaagtggggatcaccttaaccatgccaacctcatagggtcattgagaggattaaatgatctaagagtgtgcagaagttctaagtactggaactggcccattgaaagttgggtcttaatctctcagacttaatgctctctatgcctgtgctgtcagataaccttgccactagccgtatgtggctgtttaggttgaattttaaataaattccmatttaaaaatcagttcttcagttgcactatctacatgtcaagtgctcagtagccacatgtggctagtggctaccacatcaggcagcacagatgtagaacatttacatcactgcagaaagttctactttaaagttctctttgtccactctccgtcctcacctcccttaaacctgtcttctctgctcttatgtctagaaccgcatcttctacctcacagccaatcttatctcattcattaaggctatgtcagttgtctattgctgctgtacaaattaccacaaacagtgacttaaaacaaca

SEQ ID NO: 82926 - DNA, 601 bp, Human
cgtcctcacctcccttaaacctgtcttctctgctcttatgtctagaaccgcatcttctacctcacagccaatcttatctcattcattaaggctatgtcagttgtctattgctgctgtacaaattaccacaaacagtgacttaaaacaacacagatttatcatctcacaattctgtaggtcagaagtctgacttgagtttcactggactaaaatcaaagtgttggcaaggtcatgtttcttcctggaggctccagagttaagtttgtttctttgccttttccagtttcttaaaggccacctrtattccttggctcccatgttaccaagctttctccatattcaaaaccagcaatgttacctctctctgacccttcttctatcatcacatcttctcgctaaccacagccttccagagcccatctcccatctctgactgggagatctcctccttcaggaatcagctacagtaacctgccttgacttacagcaggtaccaaataagggcaccctatttggctatgaatgtagccactgggaacgtatccacttcttcagcaaacttttggcatgttgattgtacacagacactctttctgggctc

SEQ ID NO: 82927 - DNA, 601 bp, Human
tacctcacagccaatcttatctcattcattaaggctatgtcagttgtctattgctgctgtacaaattaccacaaacagtgacttaaaacaacacagatttatcatctcacaattctgtaggtcagaagtctgacttgagtttcactggactaaaatcaaagtgttggcaaggtcatgtttcttcctggaggctccagagttaagtttgtttctttgccttttccagtttcttaaaggccacctatattccttggctcccatgttaccaagctttctccatattcaaaaccagcaatgttasctctctctgacccttcttctatcatcacatcttctcgctaaccacagccttccagagcccatctcccatctctgactgggagatctcctccttcaggaatcagctacagtaacctgccttgacttacagcaggtaccaaataagggcaccctatttggctatgaatgtagccactgggaacgtatccacttcttcagcaaacttttggcatgttgattgtacacagacactctttctgggctcaaaaacccttgagaatgacatttatccagaaatagtccaagtctgagttcatttttg

SEQ ID NO: 82928 - DNA, 601 bp, Human
ccacttcttcagcaaacttttggcatgttgattgtacacagacactctttctgggctcaaaaacccttgagaatgacatttatccagaaatagtccaagtctgagttcatttttgttgtcccatggtcttctgatttttgctgctggagaagacatttgctaggtcacttagctcttataactttcaatttccacatctgtaaaacgggcacagatcatgtctgcattagcgcctgatcactgttcagtgaatgttacctgtgttagtggttattaatagctatagtaaatgttgaagagktagcacacggctgaaatctggaaaacactgaggtggcttgtttatttctttcaaagcatttagcagctactgttaagagtactgcctctggaagggacaccaaatatgtgaccatctccccaaggccatcttcctttcagattctttttttgtttttttggagacagagccttgctctgtcgctcagactggagtgcaatggcatggtctcggctcactgcaacctccacctcccggattcaagtgattctcctgcctcagcctcccgagtggttgggattataggtgcccatcaccaca

SEQ ID NO: 82929 - DNA, 601 bp, Human
tttagcagctactgttaagagtactgcctctggaagggacaccaaatatgtgaccatctccccaaggccatcttcctttcagattctttttttgtttttttggagacagagccttgctctgtcgctcagactggagtgcaatggcatggtctcggctcactgcaacctccacctcccggattcaagtgattctcctgcctcagcctcccgagtggttgggattataggtgcccatcaccacacctggctaatttttgtattttgggtagacacggggtttctcacgacgttggccagactrgtctcaaactcctgaccgtgtgatccattcacctccgcctcccaaagtgctgagattacaggtatgagccaccacccccaggcttttttttctttctttctttcttttttgaggcagggtctcgctctcttgcccaggctggagtgcagtggtactatcatagctcactataacctcaaactcctgggctcaagtgatccacccacctcggcctcccaaagtgctgggattacaagcatgagccactgtccccagcccctttctttcagattctgagaactgctggtatcacctcctgcc

SEQ ID NO: 82930 - DNA, 601 bp, Human
cctttcagattctttttttgtttttttggagacagagccttgctctgtcgctcagactggagtgcaatggcatggtctcggctcactgcaacctccacctcccggattcaagtgattctcctgcctcagcctcccgagtggttgggattataggtgcccatcaccacacctggctaatttttgtattttgggtagacacggggtttctcacgacgttggccagactagtctcaaactcctgaccgtgtgatccattcacctccgcctcccaaagtgctgagattacaggtatgagccaccrcccccaggcttttttttctttctttctttcttttttgaggcagggtctcgctctcttgcccaggctggagtgcagtggtactatcatagctcactataacctcaaactcctgggctcaagtgatccacccacctcggcctcccaaagtgctgggattacaagcatgagccactgtccccagcccctttctttcagattctgagaactgctggtatcacctcctgccttgacaatgaaaacatagatgcagcatttttgtgtaaggcccaagcaggcaagcctattgctcctagatagaaa

SEQ ID NO: 82931 - DNA, 601 bp, Human
tataatttataatataatttacaaaaaaagaaacactgacagggtggctaagagcttgggctttagaggcagacagaccaggattttaagtctgctttagtctttactaggcacatgaccttgaacacattatttagcctccctgcaagtcattacatcatctctaaaagggtggtaatactctttgcctcccaggatcactgtcaggattgaataagacaatgcctgttacaccactgcttgtagtaagggattcggaaaagtagctcctggcacgtagcggacattcagcccacatttstttacttgtttgtacttttaaactcccttctataggccacagggattttatatcagcattgcatttgggggagtcaggctgtgtaagcctgtggaatggataaatcagcaaagagaaataacagagtaccttaaaatccatgagcaaatggttgtgctttagttttcagatcccagggctgtttttaaacttaccttccaatggccaaatcctttcttagaatgtgggcttaaacgtcctttgtttatgggggatttgcctttcagaaaatcaattcctcacatctgtggcttcaggctt

SEQ ID NO: 82932 - DNA, 601 bp, Human
ggaaaagtagctcctggcacgtagcggacattcagcccacatttgtttacttgtttgtacttttaaactcccttctataggccacagggattttatatcagcattgcatttgggggagtcaggctgtgtaagcctgtggaatggataaatcagcaaagagaaataacagagtaccttaaaatccatgagcaaatggttgtgctttagttttcagatcccagggctgtttttaaacttaccttccaatggccaaatcctttcttagaatgtgggcttaaacgtcctttgtttatgggggatytgcctttcagaaaatcaattcctcacatctgtggcttcaggctttttactcaatcagcctcctaacaaagtaatttttctgattttcaagggtgacctagttgtactggtttcagtgagcattacatggccttacctgattgtgtatagtaaaaaggagctgtttcttccagatttggagcctcagagaaactctcctgatcttcaggcctatttcctgttcacccatgtgccaatataccctctaggtacctggatacaatttgacatcccactgaaatgtgggtgttctaagcatcca

SEQ ID NO: 82933 - DNA, 601 bp, Human
gtttttaaacttaccttccaatggccaaatcctttcttagaatgtgggcttaaacgtcctttgtttatgggggatttgcctttcagaaaatcaattcctcacatctgtggcttcaggctttttactcaatcagcctcctaacaaagtaatttttctgattttcaagggtgacctagttgtactggtttcagtgagcattacatggccttacctgattgtgtatagtaaaaaggagctgtttcttccagatttggagcctcagagaaactctcctgatcttcaggcctatttcctgttcacycatgtgccaatataccctctaggtacctggatacaatttgacatcccactgaaatgtgggtgttctaagcatccattcatcataaagtttaggggcttcagataccaggatgggtacttgctctactaaaatgggatccttaggaaatcccgttcaaggataccacttcactatggggtactgatttagggtctctctctgaataaaatatcttgtcaaaatctggtagaatcacaaattctgataaatggctgcccaatggagaagtttagggaaaattatcttacatttttcatcgaa

SEQ ID NO: 82934 - DNA, 601 bp, Human
tttgtttatgggggatttgcctttcagaaaatcaattcctcacatctgtggcttcaggctttttactcaatcagcctcctaacaaagtaatttttctgattttcaagggtgacctagttgtactggtttcagtgagcattacatggccttacctgattgtgtatagtaaaaaggagctgtttcttccagatttggagcctcagagaaactctcctgatcttcaggcctatttcctgttcacccatgtgccaatataccctctaggtacctggatacaatttgacatcccactgaaatgtgsgtgttctaagcatccattcatcataaagtttaggggcttcagataccaggatgggtacttgctctactaaaatgggatccttaggaaatcccgttcaaggataccacttcactatggggtactgatttagggtctctctctgaataaaatatcttgtcaaaatctggtagaatcacaaattctgataaatggctgcccaatggagaagtttagggaaaattatcttacatttttcatcgaagaactggtattgttgatttaaccgtcttttcccatcaccattgttcctatagcaatttt

SEQ ID NO: 82935 - DNA, 601 bp, Human
agggtgacctagttgtactggtttcagtgagcattacatggccttacctgattgtgtatagtaaaaaggagctgtttcttccagatttggagcctcagagaaactctcctgatcttcaggcctatttcctgttcacccatgtgccaatataccctctaggtacctggatacaatttgacatcccactgaaatgtgggtgttctaagcatccattcatcataaagtttaggggcttcagataccaggatgggtacttgctctactaaaatgggatccttaggaaatcccgttcaaggatacyacttcactatggggtactgatttagggtctctctctgaataaaatatcttgtcaaaatctggtagaatcacaaattctgataaatggctgcccaatggagaagtttagggaaaattatcttacatttttcatcgaagaactggtattgttgatttaaccgtcttttcccatcaccattgttcctatagcaatttttagactgggtggaggaatctacttctcatttcaattcgatttgagtggccctgccctgccccaagtttattatccccacttctgaccctgtgtataactagaatg

SEQ ID NO: 82936 - DNA, 601 bp, Human
cagagaaactctcctgatcttcaggcctatttcctgttcacccatgtgccaatataccctctaggtacctggatacaatttgacatcccactgaaatgtgggtgttctaagcatccattcatcataaagtttaggggcttcagataccaggatgggtacttgctctactaaaatgggatccttaggaaatcccgttcaaggataccacttcactatggggtactgatttagggtctctctctgaataaaatatcttgtcaaaatctggtagaatcacaaattctgataaatggctgcccartggagaagtttagggaaaattatcttacatttttcatcgaagaactggtattgttgatttaaccgtcttttcccatcaccattgttcctatagcaatttttagactgggtggaggaatctacttctcatttcaattcgatttgagtggccctgccctgccccaagtttattatccccacttctgaccctgtgtataactagaatgaaaagactgggcaggaaacaagactaaagggacacaaagtcctgctgatatcaaaagtaatcttctaaagtcccaaagaatttatagcttgccat

SEQ ID NO: 82937 - DNA, 601 bp, Human
attgttgatttaaccgtcttttcccatcaccattgttcctatagcaatttttagactgggtggaggaatctacttctcatttcaattcgatttgagtggccctgccctgccccaagtttattatccccacttctgaccctgtgtataactagaatgaaaagactgggcaggaaacaagactaaagggacacaaagtcctgctgatatcaaaagtaatcttctaaagtcccaaagaatttatagcttgccattccatatgctttttggaagttttgctttaaatccttgttacccaattttsaccatactgaatcatgttatagcatcagatatagacatagcatctcagatatagcctaaacctcaccacctctctccatttctactgctgagcccagagcccaggccatcttccacacaccacacagtagcctccttaccagtcacgagtcctgctatgttcttgcccctctacaaggctacttttccaccacaagacgaggacaataattttcaaatatatatcaggttatatggctcctttccttaaaacttttaccactttcctgttgccagtaaatatacaacatggccctcagag

SEQ ID NO: 82938 - DNA, 601 bp, Human
ttaaccgtcttttcccatcaccattgttcctatagcaatttttagactgggtggaggaatctacttctcatttcaattcgatttgagtggccctgccctgccccaagtttattatccccacttctgaccctgtgtataactagaatgaaaagactgggcaggaaacaagactaaagggacacaaagtcctgctgatatcaaaagtaatcttctaaagtcccaaagaatttatagcttgccattccatatgctttttggaagttttgctttaaatccttgttacccaattttgaccatactraatcatgttatagcatcagatatagacatagcatctcagatatagcctaaacctcaccacctctctccatttctactgctgagcccagagcccaggccatcttccacacaccacacagtagcctccttaccagtcacgagtcctgctatgttcttgcccctctacaaggctacttttccaccacaagacgaggacaataattttcaaatatatatcaggttatatggctcctttccttaaaacttttaccactttcctgttgccagtaaatatacaacatggccctcagagccctcaatg

SEQ ID NO: 82939 - DNA, 601 bp, Human
cttaaaacttttaccactttcctgttgccagtaaatatacaacatggccctcagagccctcaatgctgcttccctgtggcatcagctctcactcctctttctctagctcatttctctgcagttacactggcatctttgcattccttgagcacagcctcgcactttcctcaagtcacttgcatatgctattcctttacctggcattttctatcactagagtttcatgtgctgtgtgcctccttgtcattcaggtctcagtccaagtgaagccaccttggaaacgacatccttgaccaagcayttttaaagtcactcccactcacccagctcacagtcacaatttcctttttatttgtacttttcatggtgcttattccttctgatatatttttattggttgattgatctagattgaggttggcaaacttctgcctactggccaaattcatcccaccacctatttttgtacagcccatgagctaatggttacatgtacatttttaaatggttgtaataaatcaaaagaagaccattttgtgacatgtgaaaattatgagagattaaaatttcagtgcccataaagtttttctggaacatagct

SEQ ID NO: 82940 - DNA, 601 bp, Human
tagattgaggttggcaaacttctgcctactggccaaattcatcccaccacctatttttgtacagcccatgagctaatggttacatgtacatttttaaatggttgtaataaatcaaaagaagaccattttgtgacatgtgaaaattatgagagattaaaatttcagtgcccataaagtttttctggaacatagctatgctcatttgtttatatattatctatatctgcctctgcatgacaacaacagagataagtagtggcaacacagactatatgatccacaaagccaaagatatctaccrtctggccctttaggataaagcttgtcaacccctggtctggatatgtattttcttcatacttctctacctcctaaatgttctaaaacaccaactctttaaaagcaaggaccatatttgtatttttattatattcacagtgcctagaatatactgaaacagagtaagcacatacatataaaaggttgtttattacatcactgggaagtttatcaaatgtttctgtgcaatcagagagcacactatgctagcccatatttcaaaagatctgccaataagtaagggaaaaaaatgcctgcaaat

SEQ ID NO: 82941 - DNA, 601 bp, Human
ctgcctactggccaaattcatcccaccacctatttttgtacagcccatgagctaatggttacatgtacatttttaaatggttgtaataaatcaaaagaagaccattttgtgacatgtgaaaattatgagagattaaaatttcagtgcccataaagtttttctggaacatagctatgctcatttgtttatatattatctatatctgcctctgcatgacaacaacagagataagtagtggcaacacagactatatgatccacaaagccaaagatatctaccgtctggccctttaggataaagyttgtcaacccctggtctggatatgtattttcttcatacttctctacctcctaaatgttctaaaacaccaactctttaaaagcaaggaccatatttgtatttttattatattcacagtgcctagaatatactgaaacagagtaagcacatacatataaaaggttgtttattacatcactgggaagtttatcaaatgtttctgtgcaatcagagagcacactatgctagcccatatttcaaaagatctgccaataagtaagggaaaaaaatgcctgcaaatttaataaaataacacctcaag

SEQ ID NO: 82942 - DNA, 601 bp, Human
agtttttctggaacatagctatgctcatttgtttatatattatctatatctgcctctgcatgacaacaacagagataagtagtggcaacacagactatatgatccacaaagccaaagatatctaccgtctggccctttaggataaagcttgtcaacccctggtctggatatgtattttcttcatacttctctacctcctaaatgttctaaaacaccaactctttaaaagcaaggaccatatttgtatttttattatattcacagtgcctagaatatactgaaacagagtaagcacatacawataaaaggttgtttattacatcactgggaagtttatcaaatgtttctgtgcaatcagagagcacactatgctagcccatatttcaaaagatctgccaataagtaagggaaaaaaatgcctgcaaatttaataaaataacacctcaagcagaactcagataaagttacacataaacttattaacttcaaatcttttaagtgtgttaatttagataatcctaggtgctgtaacagataaactctgaaatctcagctgtttaatgcaaaagaagcttttttttgttcactcagtgaccacttt

SEQ ID NO: 82943 - DNA, 601 bp, Human
ctgcctctgcatgacaacaacagagataagtagtggcaacacagactatatgatccacaaagccaaagatatctaccgtctggccctttaggataaagcttgtcaacccctggtctggatatgtattttcttcatacttctctacctcctaaatgttctaaaacaccaactctttaaaagcaaggaccatatttgtatttttattatattcacagtgcctagaatatactgaaacagagtaagcacatacatataaaaggttgtttattacatcactgggaagtttatcaaatgtttctgkgcaatcagagagcacactatgctagcccatatttcaaaagatctgccaataagtaagggaaaaaaatgcctgcaaatttaataaaataacacctcaagcagaactcagataaagttacacataaacttattaacttcaaatcttttaagtgtgttaatttagataatcctaggtgctgtaacagataaactctgaaatctcagctgtttaatgcaaaagaagcttttttttgttcactcagtgaccacttttttggctgagggttctggctaagactcaggctcatggaccctccactgt

SEQ ID NO: 82944 - DNA, 601 bp, Human
gggcatcagcctagaagagatgcacatcacttctgttgtattccgttggccagaacccagttacttggctcaatcagaggtaaaacaagctgggaaatgtcattgctggccaggtagccactctccaccaacatctctacaccatggaaggaaaataagaatgcttgggagtcagctaattatcttggccacaatagacaacttagtctttaaaaattgatactaaaggatcttattttttgaggtaaggggctgtggtctcagaggcagcctggagataccaatttctgaatttgatttkatgactgtgcaatatagatcaattgaattttcagttctatgatcatctccttttaagactttctccacttaaaaaatctgatctgtcatctagattcattttctacattcaaagaatctttagaggtagatggaaaacacggagatcaaaaattataactggccccaggagaagacctctcactgtcagaattgtttaaatcctctcctgactggtaggccccaatctttaccaactactaactctgatttacttttagaaagaatcaaaattcctgcatatcctcagtagagaatcaaa

SEQ ID NO: 82945 - DNA, 601 bp, Human
accatggaaggaaaataagaatgcttgggagtcagctaattatcttggccacaatagacaacttagtctttaaaaattgatactaaaggatcttattttttgaggtaaggggctgtggtctcagaggcagcctggagataccaatttctgaatttgatttgatgactgtgcaatatagatcaattgaattttcagttctatgatcatctccttttaagactttctccacttaaaaaatctgatctgtcatctagattcattttctacattcaaagaatctttagaggtagatggaaaacamggagatcaaaaattataactggccccaggagaagacctctcactgtcagaattgtttaaatcctctcctgactggtaggccccaatctttaccaactactaactctgatttacttttagaaagaatcaaaattcctgcatatcctcagtagagaatcaaagtgctgtattataatccaaccatttcccaaagaaaggaaaatttgctctaatctccaaagtgcaatgtctgttcaaaaatctttgccagctttcttttcatcaaactgtggaaccagatttctcagtctactagtttaca

SEQ ID NO: 82946 - DNA, 601 bp, Human
tttaaatcctctcctgactggtaggccccaatctttaccaactactaactctgatttacttttagaaagaatcaaaattcctgcatatcctcagtagagaatcaaagtgctgtattataatccaaccatttcccaaagaaaggaaaatttgctctaatctccaaagtgcaatgtctgttcaaaaatctttgccagctttcttttcatcaaactgtggaaccagatttctcagtctactagtttacatgaggcataggcatgaggctgagtatcactcagcccactgaccctggcaatattwtgttttatctccctacaaaagagttagaaataaaataggtttgtttacaatttctaactattctactagcttttgatatgaaagtacctagcatataagccaagctataccacatttttttagagatcccaatttaacaatagtgctaaaattaataagtagtgctagctttgaaggacaactatccttaaaaattaaggtgtctttctaagccatatacatctggcttacacagattcatcttgcttttttttcctatcttgtatgaaaaccttgggattttacggcagttttataatt

SEQ ID NO: 82947 - DNA, 601 bp, Human
ttcatcaaactgtggaaccagatttctcagtctactagtttacatgaggcataggcatgaggctgagtatcactcagcccactgaccctggcaatattatgttttatctccctacaaaagagttagaaataaaataggtttgtttacaatttctaactattctactagcttttgatatgaaagtacctagcatataagccaagctataccacatttttttagagatcccaatttaacaatagtgctaaaattaataagtagtgctagctttgaaggacaactatccttaaaaattaaggtrtctttctaagccatatacatctggcttacacagattcatcttgcttttttttcctatcttgtatgaaaaccttgggattttacggcagttttataatttttaaaccacataccctgaacattctatacataaagaagggttatattgtcaagtgaatttcaaaatgctctataatgcatgcttcttttgcagataatgttcaacagcaaattgaaaacagaaatgtcttgtagtatagaaacctgttaaccttcaactaggcactaccctaatgaatatcattttttagcttactgacaa

SEQ ID NO: 82948 - DNA, 601 bp, Human
tacatctggcttacacagattcatcttgcttttttttcctatcttgtatgaaaaccttgggattttacggcagttttataatttttaaaccacataccctgaacattctatacataaagaagggttatattgtcaagtgaatttcaaaatgctctataatgcatgcttcttttgcagataatgttcaacagcaaattgaaaacagaaatgtcttgtagtatagaaacctgttaaccttcaactaggcactaccctaatgaatatcattttttagcttactgacaatatgaaccatacactrtgctaattgttttacatgcattaactaatgtagttctcatagcagcccatgaggcaggtaccattgttacatccactctacagatcagggactgaggaccacagaggtcaggtaacttgctcaagctgatagttggtaattaggaaagcctagcttttaaaccaggtctggcctgaggccagagaccaagatcttgaccactgggctccctcttttttaaaataatacatcttaatactcagtggcttttagaggaattggttgcatgtcaaaggaagcaacttcctttctactgatggt

SEQ ID NO: 82949 - DNA, 601 bp, Human
gtatgaaaaccttgggattttacggcagttttataatttttaaaccacataccctgaacattctatacataaagaagggttatattgtcaagtgaatttcaaaatgctctataatgcatgcttcttttgcagataatgttcaacagcaaattgaaaacagaaatgtcttgtagtatagaaacctgttaaccttcaactaggcactaccctaatgaatatcattttttagcttactgacaatatgaaccatacactgtgctaattgttttacatgcattaactaatgtagttctcatagcascccatgaggcaggtaccattgttacatccactctacagatcagggactgaggaccacagaggtcaggtaacttgctcaagctgatagttggtaattaggaaagcctagcttttaaaccaggtctggcctgaggccagagaccaagatcttgaccactgggctccctcttttttaaaataatacatcttaatactcagtggcttttagaggaattggttgcatgtcaaaggaagcaacttcctttctactgatggttgtgcagtttgagtaggaatatttaaacctgtggactaattgtga

SEQ ID NO: 82950 - DNA, 601 bp, Human
caggtctggcctgaggccagagaccaagatcttgaccactgggctccctcttttttaaaataatacatcttaatactcagtggcttttagaggaattggttgcatgtcaaaggaagcaacttcctttctactgatggttgtgcagtttgagtaggaatatttaaacctgtggactaattgtgaagaaggaagaagaaagacaggaaggaaaggaggaagaataggaggaaggaagggagaaaggatggatgacagggaagaaaatgaacaagaaggaggagaaagggaaaagaaaaaaaaaccttaggaccatctatgaggggataaatcatatttgacagatattttcccaggtttgtattgattttattaaataatcttacctttgaggtccacaagacctgggttctatgttctgccactaatctactatataacctattgttttgttagatcatttaatctccctaagcctaagttttcctatctgtaaagcagagaaaataatcctaagcctgcctgcactatctgcatagtgtaaagatgttataaaagtactgtggagatttaaaaaacaaaacaataccaaaggagaaaactt

SEQ ID NO: 82951 - DNA, 601 bp, Human
cttaggaccatctatgaggggataaatcatatttgacagatattttcccaggtttgtattgattttattaaataatcttacctttgaggtccacaagacctgggttctatgttctgccactaatctactatataacctattgttttgttagatcatttaatctccctaagcctaagttttcctatctgtaaagcagagaaaataatcctaagcctgcctgcactatctgcatagtgtaaagatgttataaaagtactgtggagatttaaaaaacaaaacaataccaaaggagaaaactttrcatcataatatactaccagagtgcttttaaacatctatttttcagctagaaggctccttgagaaaggcaactcttgcggggaatcccaataggtgaaatagataaaaagcagagctgaccattagagcaaggatgaggaagccagagctctctcctcttcactgcccctcaccaccttccatgagcggtgaaaggccccacaagtctcttagggttccctagaacacagtccttgcaaaagcgagggaactgagaccacactgtcttgagcaaattctgtggtctctgcgcctctgcttc

SEQ ID NO: 82952 - DNA, 601 bp, Human
gttataaaagtactgtggagatttaaaaaacaaaacaataccaaaggagaaaactttacatcataatatactaccagagtgcttttaaacatctatttttcagctagaaggctccttgagaaaggcaactcttgcggggaatcccaataggtgaaatagataaaaagcagagctgaccattagagcaaggatgaggaagccagagctctctcctcttcactgcccctcaccaccttccatgagcggtgaaaggccccacaagtctcttagggttccctagaacacagtccttgcaaaagcragggaactgagaccacactgtcttgagcaaattctgtggtctctgcgcctctgcttctccctgtgaaaaaggaaaaagttggacaaaatgattcttcagtccccttccagttctgacattctagaaacgtgagtttctggttcttctgtcattagaaagcaatgtctccttccaccttgactaacagcatccctcacagggaacatggtacacatgcctgcactgagggtaagcctccatgcagtatcctgagagacatgctccccgtcagacctccgagctgtctcagcatcgataggg

SEQ ID NO: 82953 - DNA, 601 bp, Human
ttcaattaatatttcttgaaagaccttggaaaatgaattagtataaataacctactcaaatttgaaaaattaatattgtcaaccataatttttaggcactcctatatattcaatattgtaatagtttatacttggagacagaagaaatttttaaaaataaaggataaacaaccatcataggaagttaaatctagatggaaaaatacagttaacctaaaaataaagtaaaagaatgtaatgtttaaatcatatgattccaactatagttcagaatgagttcactgaagtgcagggttagtasacatgggggaaagaggggtttgaccctgtgaacaactgcagggaattaaatcccatggtcctggcttgcattgtacaaaacagactggctgtgtaaacagttaagcccttatccctcagaggtggcaatttccaaactgaaccaattattgtggggattttccctgggagcaaaattgggggcacctgaaaagcactgtgcttcttattatttctgtttaccaatattttagagctcggtatgtccaattcttcatgagctccttacttgcctgtctctggtattgactgggtgacccag

SEQ ID NO: 82954 - DNA, 601 bp, Human
gagctggcggcagagattgccaagcacgtgggctactcctaccgtctggagattgtcagtgatggaaaatacggagcccgagaccctgacacgaaggcctggaatggcatggtgggagagctggtctatggagtaagttcactgcagggtgggaaattagagggcggaggcagagggtttgacaggaaatcatttggtggttgggtggccctgcccacagatgtctatgaaaccctgtaattgagtgttgttgctgctgaacagatgagtcatccaaaatccaatttcttcagacactctktgttcaggttactggtcccaggtccctcaatcccactcagagtcttgtgacgtcagttgattgtcgtccaacacaggtgacagcatagctccaagatcaattttcttgaggcagactgctgagttgtctatacaaagtcacttgtggctctctcagtatcagtttcttctctgatattaaatgcatctggagccaacctaactttctagttacttgcctctctagtttcatgctctctcatgaaatttccaattcagtcaaatgccccttaattactctgttccctagagtgctcccttc

SEQ ID NO: 82955 - DNA, 601 bp, Human
gaaataagtaaggtgtgagaggagaatgagaaaacgcatggtttttgttgaggacttgggttgaagagtagtcagggatacatatgagtaaaaaatagcaagaggaagagtgtggatgattcagtgggcattgggagatcacgaaggtatttgagtagagagacaacaaaaggcaatggaagaagcctccagctgccttgtgcagggaagggaccaccacggcttcactcatagaaactaaaacacatgccaagccccaggtcaatgttaagtgctcataaggacaagcagccactgaggragatgataaatcttgtttcatatcagggcaagaggagccatgatggccctgagagacatacaaagggaattcaaagaagaaaaagatggaataaaggaaatcttcctcagggaggtagcttttgagatgacatgtgaaggtggttattgagttggggaatgggatgtgcttctctcctttcttattccctttaccacctctcactttgggaagctccatggacaaaaggtagagacctggatagtacatgctgcatctggaggctggtttccatgggaactcccatcaagctcttaaggt

SEQ ID NO: 82956 - DNA, 601 bp, Human
tacatgctgcatctggaggctggtttccatgggaactcccatcaagctcttaaggtcatccccatggcaactgctgtgcacttttcaccttctctagcatttatcttcaccttcacctcatgtaatgtggtttgcttggttaaaagtctgcagtgtgggcagaacaatgccaggatcatccccagtagccaacacagctggtggtgagtcactggcacagcagggctcaggccagctggagttacctatgggtgcctcagcagccaggcctgcctcagtagcctcctccttatcaggcctrttcctctgcccagtaaaaactgttctgaccaggtgtggtggctcatgcctgtaatcccagcactttgggaggctgaggcgggtggatcacgaggtcaggagatctagaccatcctggctaacacagtgaaaccccatctctactaagaatacaaaaaattagccgggcatggtagtgggcgcctgtagtcctaggaattcgggagctgagtagttaaggcaggagaatggcgtgaacctgggaggcggagcttgcaatgagccaagatggtgccgctgtactccagcctgggcgacaaag

SEQ ID NO: 82957 - DNA, 575 bp, Human
tcccatcaagctcttaaggtcatccccatggcaactgctgtgcacttttcaccttctctagcatttatcttcaccttcacctcatgtaatgtggtttgcttggttaaaagtctgcagtgtgggcagaacaatgccaggatcatccccagtagccaacacagctggtggtgagtcactggcacagcagggctcaggccagctggagttacctatgggtgcctcagcagccaggcctgcctcagtagcctcctccttatcaggcctgttcctctgcccagtaaaaactgttctgaccaggtgyggtggctcatgcctgtaatcccagcactttgggaggctgaggcgggtggatcacgaggtcaggagatctagaccatcctggctaacacagtgaaaccccatctctactaagaatacaaaaaattagccgggcatggtagtgggcgcctgtagtcctaggaattcgggagctgagtagttaaggcaggagaatggcgtgaacctgggaggcggagcttgcaatgagccaagatggtgccgctgtactccagcctgggcgacaaagcgagacccgt

SEQ ID NO: 82958 - DNA, 601 bp, Human
cttacatacatgggtacctcttgatgcttaggaagatgaatgacccatggccaaatagttttggaaatgccacattctacttactcctcttggaaattctcagtgcattgtggtcatctaaaggttctgggaagttctgccccaagcatgtttatttttatgttattttcatgttattaaccatccttccagaaataatgttctattgaacaaatttttgaactacaaaatgaactaagctttaggacaatacggaacaggctgggtatggtggctcacacctgtaatcccagcactttgrgaggctaaggcaggcagatcacttgaggccaggagtttgagaccagcttggccaacatggcgaaacctctactaaaaatacaaaaattagctgggcattgtggcacatccctgtaatcccagctacttaggaggctgaggcatgagcattgcttgaacccaggagacagaggttgcagagccaagatcacaccactgcactccagcctggggaacagggcaagaccctgtctcaaaaaaagaaaaggcaatatggatcaatgatttccagtctatgatctcttattaaatcacattagga

SEQ ID NO: 82959 - DNA, 543 bp, Human
tgttgtcctcttcctggtcgccgcttcagtccctatgaatggcacagtgaagagtttgaggaaggacgggaccagacaaccagtgaccagtccaatgagtttgggatattcaacagtttgtggttctccctgggagccttcatgcagcaaggatgtgacatttctcccaggtcagtcagctcttctcaatccctttgcctaatgctatggttttgtttgtttgtttgtttgtttgtttgttttttttttaaatactgaaaagtaaagagatgaattatttcagaccactgtattcagtttttcaactattctttacaatcaactgtccattgcacgctgtggattatctggatcatcctgtagctgggccatctctgtctgctctctgggttgatgtgctctgtcaaggttaataggcataattatgactgatgcgttgtagctgaaaggtacagaggaaagaagggagcattgtgtggtacaactaacacttatggagcacctaccaaatgccaagcaaggttctgagtcctgtacatgcct

SEQ ID NO: 82960 - DNA, 601 bp, Human
gagccttcatgcagcaaggatgtgacatttctcccaggtcagtcagctcttctcaatccctttgcctaatgctatggttttgtttgtttgtttgtttgtttgtttgtttgttttttaaatactgaaaagtaaagagatgaattatttcagaccactgtattcagtttttcaactattctttacaatcaactgtccattgcacgctgtggattatctggatcatcctgtagctgggccatctctgtctgctctctgggttgatgtgctctgtcaaggttaataggcataattatgactgatgcgttgtagctgaaaggtacagaggaaagaagggagcattgtgtggtacaactaacacttatggagcacctaccaaatgccaagcaaggttctgagtcctgtacatgccttatctcattgagtccttacaggaacataaggtggtactcccatcatgtctctttttacaaatgaggaaccacagaaatgttgaatatcttgccaatgttacacagctagtaggcaagtgagttgagattcagaatgctgtcctttcctacttctgcatggtgggaagagcactggattatgagtaagttct

SEQ ID NO: 82961 - DNA, 601 bp, Human
ggttgatgtgctctgtcaaggttaataggcataattatgactgatgcgttgtagctgaaaggtacagaggaaagaagggagcattgtgtggtacaactaacacttatggagcacctaccaaatgccaagcaaggttctgagtcctgtacatgccttatctcattgagtccttacaggaacataaggtggtactcccatcatgtctctttttacaaatgaggaaccacagaaatgttgaatatcttgccaatgttacacagctagtaggcaagtgagttgagattcagaatgctgtcctttsctacttctgcatggtgggaagagcactggattatgagtaagttctagcactggttctagcacatgggccctttatgcggctctcagaaagtcacctcaccctagtagatgttggcgtcttcatcttaaagagaaaaaacttctccttttctttggttctgagaaagactctggaaataatctagttccagtgatgatggaaatttgtttcttgtaattaaaaagtggaatttcaggccaggcgtggtggctcacgcctgtaatcctagcactttgggaggccaaggcaggtggattactt

SEQ ID NO: 82962 - DNA, 601 bp, Human
aaagtgactgaagctaagaaaagagaaagggtggacaggagatgggggtgaggaaggtaggaaacctgccaatctagaccaagtccacatttactgacctcctgttcttctgactacattctggatgtgcatgccacaattccccaccaatttgcctgataaataagcactgactctatttccttttacagttgcttaatgtctatgaactctttttccagtaggcactctcttagattaccaaatttcaaaagcctacagggagtcatggctcagaatttggcctccatggacagatctrgaggcataagtgcataatatcaaggtctcatagacatgtgctggaggcatctttaccacctatctacgttttgcatttcattgtcaaggaggaccaatattcctaagcggcaatggagtaaattctttctaacaagcttccctcaggacttatttggcctgctgtataacttagaaagtctcatcgttcattataatcttgtttttctttaaataagaagacagtggggggtggggggcgcgtgggagaggaggtgtgagactggctgcttggccaatactggcaaacacatggtgaaga

SEQ ID NO: 82963 - DNA, 601 bp, Human
cagaatttggcaatggttatccaaaactgagtggtagcttccctcttgaacaggtccgcgcattcacggttcaccccagccccaacctgaccttctttgttcctgtgttactcagctggccccagagggtgtttgagtttgtgacctctggctgcaagaggattttcaaactatgctttccggacttctgagggttccactagggtatcataggagttgacattgaggtgaagaggagactggacaacatatccagcctccctcctccctgattttcataaaacaactctactctatgccwctttttcattaataaaatggaaataatagtttctacctcaaatcttgttggaaagtttagaagtatgtatagatcctataacacagtacccagccttcacacaggaagcgctataactggatgctttttttattatgttaattgattttttttaacttggattttgtctaaacttcactggaagaaacgatgccactgttcacactgatttgaaagcctaataccttcttctagagaagtccattaacaaagcagaaatagccagtggtttatgccagagaccagccacatctggattcc

SEQ ID NO: 82964 - DNA, 601 bp, Human
cctaaaatcaatgttttctgcactggcaccaggaatagatagaaataatccagaattagcacagtcaatggtgtatgccagcgaatgctactgaaatgctttaaagactcctccacccaccctttgaaatgtatattcaataaattggttttgtataacccattttaacagtgaaagttaaaaatcacttcagctatgatcacagattacaatttatttttttaattaggttgatggtgagattaaaaagggacccatgaatttacttttaagcctgcttcttgttcaaaaaaaaaaaaaacaacttttttttttaactcagtcaccccagctggagtgtagtggtgcaatctcagctcactgcagccttgaccttctgggctcaagccatcctcctacctcagcctcctgagtagctgggactacaggcacaagcctccacgcccagctaatttttgtattttttgtatagttgaggtttccctatgctgcccaagctggtcttgaacccctgaacccaagtgatctgcctaccttggcctcctgaagtgctgggattgcagacatgagccactgtgcccagcccaaagacctattttta

SEQ ID NO: 82965 - DNA, 601 bp, Human
aatgctttaaagactcctccacccaccctttgaaatgtatattcaataaattggttttgtataacccattttaacagtgaaagttaaaaatcacttcagctatgatcacagattacaatttatttttttaattaggttgatggtgagattaaaaagggacccatgaatttacttttaagcctgcttcttgttcaaaaaaaaaaaaaacaacttttttttttaactcagtcaccccagctggagtgtagtggtgcaatctcagctcactgcagccttgaccttctgggctcaagccatcctyctacctcagcctcctgagtagctgggactacaggcacaagcctccacgcccagctaatttttgtattttttgtatagttgaggtttccctatgctgcccaagctggtcttgaacccctgaacccaagtgatctgcctaccttggcctcctgaagtgctgggattgcagacatgagccactgtgcccagcccaaagacctatttttaatagatattttagattttgaggagtatgttaaagaaggaataaaaatcatcacagacaaaacttatctttagtaccttcaactttcatttctgg

SEQ ID NO: 82966 - DNA, 601 bp, Human
tgattggtgcccagtccaatgctaccctactgtgtagtctcagcccaaggctccattgccttcaaatgaactgagagtgagcttcttcagcttattacacccatggccccactttcccaatggcttctccatggcatcaatattttcctgggttcaggtgaccttagtaagagaatgagaggaggttagagggtgctaggagaatggaggaaaatgggaaattatgactttagctttcagaattctctcttttattcttgatcatagactgaattggaatgtgtaacaattgtctccaccyagtggagataattactctcaggagaagaagtctaaggcggggggagtgatggtgctttggaggtctcctggagcctgatatcataacctcctccctccactaatttatttatttatttattttttccaagaccgagtcttgctctgttgcccagagctggagtgcaatggcatgatctcggttcactgtaacctccacctcccgggttcaagcaattctcatgcctcagcctccccagtagctggcattacaggcgtgtgccaccatgcccagctaattgttgtatttttagtagagatg

SEQ ID NO: 82967 - DNA, 601 bp, Human
caggttctcagacttcatttcagctctctagaatttgaaactctgcagttggagagaaagttctacatgtttcacaagcctccccacccacttctgccccagggctgatgggattaaagtttggaagtcattgaactagggtgctgcccagagaagtcagcttaaaagtacagaaagcaaggcccatatggcagctagaaatgatgctgagtcaacattgagtttgatattgagtcaaaagccgtaaacatggagcccagggtccgccagctcactaccctatagtatgttacatgctggrtgagcgaggcccttggcacaggggtgttgactgtggccttcaaagcaggggcctggctgtcctgatgaccctgccttctgcaggccaagccagcaagaggaacttaccaagggtttcaccagcatatttcaccttgacagttttttcctctccattagcaagcaacaccaacacaaagggactggcccaggtgaggtgattctgcagtcatggcaggtgtgaagtgtgcatggactgtgtgggggtggcccccatcatgggagatagggtgtggaactccagatcagtggctcctacttt

SEQ ID NO: 82968 - DNA, 601 bp, Human
tactttgaacattttaattgacggagagattttttttctccaaaattacaataggaaaattttcagaaagtttttcacagagctgaaagggatattgaggaccaattattcatttatttattcattaagtgtttctttagcaactgttatttaacaaacattgttcaaggtactgtgagagacatcacagaacatagcagacaaaagctcctactctcctggagcttgcattccagagagaagaggcaggcaataaataaaataaaaatgtgattaacatggccatcccaattcgataggygaggattctgggtgacagggagaggaagggacatagccaaaatcacacagataattagtgtaggttcaatagcataggagtggaagtcagccgggggctgtggtgaacggcacatgcatgtgtcagctagagaggatagctccccctcggctctggatagtcattgccatgggaactccatgcagaccaaacaaaagcatgcctagattcagcttgtacgccaccagtttgagagccctaaaagaatggtgaggaataaaacagccaccgtatgtacttactgcatttagacacacttgg

SEQ ID NO: 82969 - DNA, 601 bp, Human
agctgaaagggatattgaggaccaattattcatttatttattcattaagtgtttctttagcaactgttatttaacaaacattgttcaaggtactgtgagagacatcacagaacatagcagacaaaagctcctactctcctggagcttgcattccagagagaagaggcaggcaataaataaaataaaaatgtgattaacatggccatcccaattcgataggtgaggattctgggtgacagggagaggaagggacatagccaaaatcacacagataattagtgtaggttcaatagcataggastggaagtcagccgggggctgtggtgaacggcacatgcatgtgtcagctagagaggatagctccccctcggctctggatagtcattgccatgggaactccatgcagaccaaacaaaagcatgcctagattcagcttgtacgccaccagtttgagagccctaaaagaatggtgaggaataaaacagccaccgtatgtacttactgcatttagacacacttggaatatcgtatttatatatacatttttaagggaatttttctccttttcccctccatttttgattccaagcatgaaatctga

SEQ ID NO: 82970 - DNA, 601 bp, Human
gacagggagaggaagggacatagccaaaatcacacagataattagtgtaggttcaatagcataggagtggaagtcagccgggggctgtggtgaacggcacatgcatgtgtcagctagagaggatagctccccctcggctctggatagtcattgccatgggaactccatgcagaccaaacaaaagcatgcctagattcagcttgtacgccaccagtttgagagccctaaaagaatggtgaggaataaaacagccaccgtatgtacttactgcatttagacacacttggaatatcgtatttayatatacatttttaagggaatttttctccttttcccctccatttttgattccaagcatgaaatctgattgctgtatttttctttcctttcatatactttggaaaatccagaccataaatggtggctgcactaaaagaaagatggtccctaaattcctgtatccagagaaacctatttatggctagctacatcttcgtaggttctgcattttcccagagacgacctcttgtttttcttttaaaccctcactggatatatggcatctgtgaccaagaaacccagttgttcacctgcaaagaag

SEQ ID NO: 82971 - DNA, 601 bp, Human
gcaaaatggaagtaagatggtctctagtatgtccctagctccccacctaaggctcacctccttatgattcccagcttagccaaggctccaaccaagccaagttgtgcttcattctgtctcccagctccatgctcccattatgcctttattgttccctctgcttggagtgacttttcccacctttcctgctcaactccttccccatttgcaaatgttgccttctcactctcccccaaccaactccaattactcctctgaatctgtgatttatagtcatagttataagcttgaactctgcagyagggccggctgggattgaattctgactctactacctactagctgtgtgagctttagaaaataactttcctacatccagtttccacttctggaaaacaggaaaaataataagacctacctcaaatgagatattttgaggattaaatgatgagattcatggaaaacatttgccttgcacggggggtgacacactgtaaatgctgttgttattgctgctgttgccattgttgctgtcacctacacctctctgagggcatcttaaatcttcaaccctgcactatagttaccatgtctgtttctt

SEQ ID NO: 82972 - DNA, 601 bp, Human
ccccactattcaggaaagctctgatctctttgctggaaaaatagtagcaaaaatttctttctttcatgtgttgtacctactatgtgtcaggcactctgacaagtgttagatcatgttactgctaatcttcttgaaaactctgcctggtatatcaacaccattttgtgatgagaaaactggggctcagagaaattaattcacttgcatgtgggtacccagcagggctgagattataacctgtgtcagtctgattctaatacccatgatttatccttgacacacagctgtcttccaagaccarcaatcttctgaaggtcccttagggctccccagggattgttataattttttaaaaagtgggagacatcctttttcctttataggattccctaactctggtttttttaatgggccttgctttgaatttttattcaatttttattattcctaagagtatctttgtctttaagagccatctcctgagggagcagaggcgagcacccaggagaacattttgcccccaccaagatcaggtgcagcctgctcagctggagtgagggagatggtgagacagaaatatgagcaaaaatgtaactggtgc

SEQ ID NO: 82973 - DNA, 601 bp, Human
tgggattcaaagggtcctggctgggcacttgggggaacccactggccaccgctgctgccaggttattatttatctttatctcctgagcagcaggtagaagaggctgttagaaaaatgtcttcctggctggggacccccctgagattcattttctctttcacgtctcattttgggaatggaaaaaaaatcaatagagagggagtttgctttattttggttctggctattgcagacatgtatttctacagatacaagaaaggagtcatcactccgatgttttaaattgagcaccacctgggayctaaaccttgcattaggcacaaggctaactaagcattatggcagatttaaagaagcaagaagtgagttcagacctctaagtttgcgacacagtagaagaaccaaggtattcaaggagaaaaatagataataaagcagaacatgcttttgaataattcccaaaagtggggttaatagtcaataggtaaagaagagagaaagatcactgaggactaaaatgatctgggctggcttatggaaaaggagaaacttgggctggtcccaagggattaagcaagacttataggaggaattacaggta

SEQ ID NO: 82974 - DNA, 601 bp, Human
aacagttattttattaagatcatggatttcatgggtcaggaaatttggaaaggggcaccatggatgacttgtctctgcttgtatctggagccttcgatggaaaatctagaagactgtggataacttgacagctgggggaaggaattatctgagggcttactccctcctttacgtgtctggcagccgaggcttttggcctgaatacctacacgtgccctctcctggctcctctgtgggcttcctcacagcacgatggctgggttccaagaacaagtgtcccaaaaagaagcaggcagaagcwgtatcacctttcataacctaccctcaaaaatgacatagtgtgacttctgccattgtcacaaccccaaccagattaaaagagaaggaacatagattccacctttcagtaagagaagggtcagcatcgcattgtaaggtgtggaatggagggggtaggggtattgtgaccatctttggaaaatacaatctgccatactttatatataaaataaggattatatattgtggaatcattatgaagatcgaatggaataaggtatttaaagggcttagcatggtgctgacatgtaataagtgctca

SEQ ID NO: 82975 - DNA, 601 bp, Human
gacaggagtcagaagatacaactgtggccatgtgcccatgggtaagtcacttttcttctcaggcctcaggtttcacacttcgaatgatctgacattctacaaaggaaggtgtttcctgagccctcatggccagttctgtattctccttagtaccataaagaatacatagaaataaggaacaccaagtctttccttttatgatgtgtatagtctcattaggaagataagactaacacacatgaaacagtgaacttacaaagttcaggtgtatcctgggccccaagtgccatccacgggtgaygcagataggagagatagacattggtagaaggtcagtcctcatctccatctgactcggatgggaaaaaggggagacacatgattaaaccagaagcaaatatatcagccttccctagtaagctaaggcttcttacattttaccatatatgttacaacaaaactcagacagggaaaagggaattttcttacttacacacagcagattcatattcatggtgatgcttgtttttatttaacttcaacctctttttttacttaatggactctttcctcttaaatttaagataacacattgagcaaa

SEQ ID NO: 82976 - DNA, 601 bp, Human
tacaactgtggccatgtgcccatgggtaagtcacttttcttctcaggcctcaggtttcacacttcgaatgatctgacattctacaaaggaaggtgtttcctgagccctcatggccagttctgtattctccttagtaccataaagaatacatagaaataaggaacaccaagtctttccttttatgatgtgtatagtctcattaggaagataagactaacacacatgaaacagtgaacttacaaagttcaggtgtatcctgggccccaagtgccatccacgggtgacgcagataggagagatrgacattggtagaaggtcagtcctcatctccatctgactcggatgggaaaaaggggagacacatgattaaaccagaagcaaatatatcagccttccctagtaagctaaggcttcttacattttaccatatatgttacaacaaaactcagacagggaaaagggaattttcttacttacacacagcagattcatattcatggtgatgcttgtttttatttaacttcaacctctttttttacttaatggactctttcctcttaaatttaagataacacattgagcaaacaaaggtatagatagg

SEQ ID NO: 82977 - DNA, 601 bp, Human
agaaggtcagtcctcatctccatctgactcggatgggaaaaaggggagacacatgattaaaccagaagcaaatatatcagccttccctagtaagctaaggcttcttacattttaccatatatgttacaacaaaactcagacagggaaaagggaattttcttacttacacacagcagattcatattcatggtgatgcttgtttttatttaacttcaacctctttttttacttaatggactctttcctcttaaatttaagataacacattgagcaaacaaaggtatagataggagtgaagttyccccacatcttccccctttgacacacaatttattttctttttataaattttattaagatataacacacaaataaataagacacgaattataaatatacagcccaactaattttcagaaaactaattttcagtgcctgtgtaatcagcactcaaattaagaaatagatgatatcaagaatctcaggtaactctttttgtctccttcacacttctcccatgacaggagtagccgctcccctgatttctgatgcatagagtagttttatgaattgaactgtttttgaatctactgaatagaat

SEQ ID NO: 82978 - DNA, 601 bp, Human
attctcattattttatagtattccattttgtggatataccacaatttatttattcattctttctggatgaacatttgggttgttcccagtgtaaggccattataaatagggctgctgtgaagattcttgtaaaagtcttttggtatgtgtatttctgttggatgcataactaggagtggaattcctgggtcaacttatatatattttctattgtagatgctaccaaactgttttcagaagtagcatacagatttagactcatcagcaatgtatatgagttccagttgctccacatttgccyttttccttttagcaagtagatgagttgtaggatcacattatggttttaatttgcatttccctggcaactagtacttctttcatatttgttagccatttgagtagctatcctcttttataaagtacttttgtaagtctcttggtcacttttctgttaggtcatctgttcttttcttattgttgtacaagtattcttcatatagccttgacataagtccttttttagttgtatatattgttaatattgtctctcattctgtggcttatcttttcactgtcttggcagtgtgtcatgttgaac

SEQ ID NO: 82979 - DNA, 601 bp, Human
tacctacctcaaagtcataaagatattcttttatagtttcttctgaaagtttcagctttaccttttacttttagatctaggtgttctataggtatgtgtgagagagagggtcaagattttttgtttgtttgttggtacatagatatcctattgaacttgcatgatttattttaatgtcatcctttcttcttactgtataccactttcacataaatcagttaccaaatacatgcaggtctgtgtctggattcttgattctgttctgttgatatagttgtctgtctttgccagggtattaccytatcttaactacttaagctttatagtaagtcttgataactggttctgagatggaagctggatgatcccatggggtacggggtgtagaagggattctcttcacatagagactcctacgagaaaatgtctgcagtgttttctaactgtgagatactatgattctgttggattagcaatgattgtggcttttctcaagggtctggaagaaatcaataacagactctatgttagtgatttttctgaacagtttcacacctaaaagtgatgggtaaagctcaggatcaggataattgtgggtaga

SEQ ID NO: 82980 - DNA, 601 bp, Human
tgagacaaaacttccagaggaacgatcagacagcagcatttgcggttcacgaaaatccgcggttctgcagccaccgctgctgttacccaggcaaacagggtctggagtggtcctctagcaaactccaacagacctgcagctgagggtcctgtctcttagaaggaaaactaacaaacagaaaggacatccacaccaaaaacccatctgtacatcaccatcatcaaagaccaaaagtagataaaaccacaaagatggggaaaaaaacagagcagaaaaactggaaactctaaaaagcagagcrcctctcctcctccaaaggaacgcagttcctcaccagcaacggaacaaagctggacagagaatgactttgacgagttgagagaggaaggcttcagacgatcaaactactccgagctacaagaggaaattcaaaccaaaggcaaagaagttgaaaactttgaaaaaaatttagatgaatgtataactagaataaccaatacagagaagtgctcaaaggagctgatggagctgaaagccaaggcttgagaactacgtgaagaatgcagaagcctcaggagccgatgcgatcaactggaagaaa

SEQ ID NO: 82981 - DNA, 601 bp, Human
ccgcggttctgcagccaccgctgctgttacccaggcaaacagggtctggagtggtcctctagcaaactccaacagacctgcagctgagggtcctgtctcttagaaggaaaactaacaaacagaaaggacatccacaccaaaaacccatctgtacatcaccatcatcaaagaccaaaagtagataaaaccacaaagatggggaaaaaaacagagcagaaaaactggaaactctaaaaagcagagcacctctcctcctccaaaggaacgcagttcctcaccagcaacggaacaaagctggacrgagaatgactttgacgagttgagagaggaaggcttcagacgatcaaactactccgagctacaagaggaaattcaaaccaaaggcaaagaagttgaaaactttgaaaaaaatttagatgaatgtataactagaataaccaatacagagaagtgctcaaaggagctgatggagctgaaagccaaggcttgagaactacgtgaagaatgcagaagcctcaggagccgatgcgatcaactggaagaaagggtatcagtgatggaagatgaaatgaatgaaatgaagcgagaagggaagtttaga

SEQ ID NO: 82982 - DNA, 601 bp, Human
atctctcggcagaaactctacaagccagaagcgactgggggccaatattcaacattcttacagaaaagaattttcaacccagaatttcatatccagccaaactaagcttcataaatgaaggagaaataaaatactttacagacaagcaaatgctgagagattttgtcaccaccaggcctgccctaaaagagctcctgaaggaagcactaaacatggaaaggaacaaccagtaccagccactgcaaaatcatgccaaattgtaaagaccatcaaggctaggaagaaactgcatcaactaacragcaaaataaccagctaacatcatcatgacaggatcaaattcacacataagaatattaactttaaatgtaaatggactaaatgctccaattaaaagacacagactggcaaattggatagtcaagacccatcagtgtgctgtattcaggaaacccatctcatgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaa

SEQ ID NO: 82983 - DNA, 601 bp, Human
agcttcataaatgaaggagaaataaaatactttacagacaagcaaatgctgagagattttgtcaccaccaggcctgccctaaaagagctcctgaaggaagcactaaacatggaaaggaacaaccagtaccagccactgcaaaatcatgccaaattgtaaagaccatcaaggctaggaagaaactgcatcaactaacgagcaaaataaccagctaacatcatcatgacaggatcaaattcacacataagaatattaactttaaatgtaaatggactaaatgctccaattaaaagacacagastggcaaattggatagtcaagacccatcagtgtgctgtattcaggaaacccatctcatgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagtttcataaagcaagt

SEQ ID NO: 82984 - DNA, 601 bp, Human
gcttcataaatgaaggagaaataaaatactttacagacaagcaaatgctgagagattttgtcaccaccaggcctgccctaaaagagctcctgaaggaagcactaaacatggaaaggaacaaccagtaccagccactgcaaaatcatgccaaattgtaaagaccatcaaggctaggaagaaactgcatcaactaacgagcaaaataaccagctaacatcatcatgacaggatcaaattcacacataagaatattaactttaaatgtaaatggactaaatgctccaattaaaagacacagacyggcaaattggatagtcaagacccatcagtgtgctgtattcaggaaacccatctcatgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagtttcataaagcaagtc

SEQ ID NO: 82985 - DNA, 601 bp, Human
gcatacatatgtaactaacctgcacattgtgcacatgtaccctaaaacttaaagtataataataataaaataaaattaattaattaattaaaaaaagagaaaaagtagaaaagttggtgttaagtagtgcattttttaaccagttgagtctaaggtattacacagtaaagagtgtgttggggcagttagattggaggtattggctaaatcacaaatcatccagctctctgcaaattcacagaaagagcaaactcatccatagccttgaaccacagagcaaacatttttctgtgcaaaattkggttacatttcatcttgtgaattttccacccctgtttatactgaaatgatagggctttgaaaagaataaacaacattccctttctgttgcatcaagacaaaaacccccacactcaataaatcaaaactgtaccagcaaaaattgaacaattccatcatttgctgaaacctctaaaaccctcaaatttgtttgagggcttctgtaaacaacttaatcaatcaatgttagcaaaaatatgtgttaggcacctacagtggactaagaactgaactaggtgagtggtggattctcaagaaaaat

SEQ ID NO: 82986 - DNA, 601 bp, Human
aaggactgaatgttacacaggaaataaagaataaattagtaagtgctcaataaaagaatggtggactgaaaatttccttttgaactgtttaatctggtgtcattgagcagccttgaaagtaaagcggtaggtaacacattgttgcattaatccaaaatggacttcataacgtcccggactagtttctaggcagttaggagaaggaaggaactgatgaaacccacctgtatttcaatggcataattcattttctcctcttatgtcagaatgcaactgctctgattaagccaagtgagccaarccctgtaacctagctttaatcatttgagggtttagatctcagattccaaggtaactagcacataggactttgtcagtcatgaggttagacttatgttcagaccaggttcaagtgagaatcctccctgcttctaggccctcttcctgaaaccttcactgtatggctcaaatctaagccctttaaccacgttgatcagactctatcacttcttccccaactctgaaggataaagtctaaacctattaatgtatcattcgaaccctgtgaaatttagcctcatctgcttctctctcttctttc

SEQ ID NO: 82987 - DNA, 601 bp, Human
tcataacgtcccggactagtttctaggcagttaggagaaggaaggaactgatgaaacccacctgtatttcaatggcataattcattttctcctcttatgtcagaatgcaactgctctgattaagccaagtgagccaagccctgtaacctagctttaatcatttgagggtttagatctcagattccaaggtaactagcacataggactttgtcagtcatgaggttagacttatgttcagaccaggttcaagtgagaatcctccctgcttctaggccctcttcctgaaaccttcactgtatgsctcaaatctaagccctttaaccacgttgatcagactctatcacttcttccccaactctgaaggataaagtctaaacctattaatgtatcattcgaaccctgtgaaatttagcctcatctgcttctctctcttctttctctctctctctttctctctgtctctctttctctctctctctctctccatcttcatctctttctcctatattctggcctcttgtgatctgttccattccaaactcctgggccctttttgagttttcacctctctgtccttttgcctggagagtctattccatgc

SEQ ID NO: 82988 - DNA, 601 bp, Human
ggcagttaggagaaggaaggaactgatgaaacccacctgtatttcaatggcataattcattttctcctcttatgtcagaatgcaactgctctgattaagccaagtgagccaagccctgtaacctagctttaatcatttgagggtttagatctcagattccaaggtaactagcacataggactttgtcagtcatgaggttagacttatgttcagaccaggttcaagtgagaatcctccctgcttctaggccctcttcctgaaaccttcactgtatggctcaaatctaagccctttaaccacsttgatcagactctatcacttcttccccaactctgaaggataaagtctaaacctattaatgtatcattcgaaccctgtgaaatttagcctcatctgcttctctctcttctttctctctctctctttctctctgtctctctttctctctctctctctctccatcttcatctctttctcctatattctggcctcttgtgatctgttccattccaaactcctgggccctttttgagttttcacctctctgtccttttgcctggagagtctattccatgctgtctctctaatatactccttcttc

SEQ ID NO: 82989 - DNA, 601 bp, Human
atttaaataatttgttattggtttgttatatatatgttgtagatccatttatcaatagatacataatataaaaacataggaattgtgacatcaaaaacaaaatgaagaggcaagtaaaaatgtagaatttgttaattgcatataatttaaactctaaatttcaaataggttcaaatagattgttataactcaaatagattgttacaatgctaagatgctttacataagcctccttacgtaagatgttttatgtatgcaaaaacctacagtaggtacaaaaaagataaagagaaaggaatcmaggcataccactacagaaaatcatcaaatcacaaagagaagaagaaagaaagggactacaaaacagccagaaacaatgaacaaaatgtcaatagtaagtctttatctttcaataattactttaaatgtaattggattaaattatccaataaaaagatatagagtggctgaatgaataaaaaagcaagacccaactacatgctgcctataagagacttgcttcagctttaagtacacacataggctgaaagcaattgtatagaaaaagatatttcatacaattggaaaccaaaagagagca

SEQ ID NO: 82990 - DNA, 601 bp, Human
ggactagaaggatgaatgggtattagccaagtgaaaaggcaggggaaaggcatttcaggcagaaggaacatgtttgtgagccattgtcaggaacttggatcttatcttaaagatgatgggaaaccatttaaaagtttccagccagagagcaatttgatctgatttacatttttaaaggatctctctctaacttagtggttctcaactgggcatgatttttctccccaggagacatttttggatgccacaacttggggatgggagctactggtgtctaatgggtacaggctagtgatattgytaaacaccctgcaatatacatgacaggtccccaccacaaagaattatctggcctcaaatgtcaatagttcttaggttgagaaatcctgtaagctgatatatgtaaaatagaccattacagatttaaagaagggtgaccagttgggaggatattgtagcaggaagagccgcagacaaaacccctcagatactgagttaaagaagaaaggggtttattcggccgtgagcatcagcaagactcctgtctcaagagccaagctccccaagtgagcaattcctgtcccttttaagggctcacaac

SEQ ID NO: 82991 - DNA, 601 bp, Human
ccctgagcccttgaacacttagaagtcataaagagccatcagaagggactgagaaggagcagccagtgaggttacaaaaacacaggaaagtctggagttttagaaaccaagttaaaggagtgtatcaaaaacgatgccataaatacctatcaccattaaaggagttacgtaattctttctataaagagactgaactcaaattccaatgcctttttatcaaaatgcatatgtatatgctggtatttatgccctctgttatcatttccataagacaagagaagaagcattaaccaactgaaamctttaattaaaattcacatagaatgaagttgggaagggaacctgggcagaggcaagagccttttgcttataagcaagatgtgattaaacccactgtgatagtgattcatagttcctgtttatcaaggagacaggctcagcctctagccttatgtatgatcgctggatgtttgggggtagctgaacccagaactcattttaatgacatctccctggattcaaaaatgtttttattcttctctaatgctttaactttgagagatgatctgatcctgaatgttatctttgatggctcaaagta

SEQ ID NO: 82992 - DNA, 601 bp, Human
taattagtaaatggcacaactggagtcaaaccccagtcaatgtgattgccaattactgtgtgatccttccaaagcaatacgatggaaacaaccctcagcttgatttgccagtcaggatttgccatctaaaactggctagaacattaattttgagggtgactttggaaaaagtcatttaatctctcagcctcagcctggttttcctcacctgtaaaataatcaggacgaacttccagtacttgtgtctgattctaacttgttatatcagaattttaagccctttcatttgcaaaaagtgtcygtattttcagaatacagtcatctattattgtatttgattcttacaacaactatgaggcaagcaagcattattccttcttgtgttttacatacagatggggaaacaggcttgaaatgaagtaggtaccttgtccatggttaatgcagctgctccccagtcaactgctctaatataccaggtacctcgcctcctcctttatctcaggcatttttcactctcccagggcctaccccatttcttattcccaggaagatttccattgctaatttaaaagttaactgctaagaggctaaaggaagg

SEQ ID NO: 82993 - DNA, 601 bp, Human
ttatatcagaattttaagccctttcatttgcaaaaagtgtctgtattttcagaatacagtcatctattattgtatttgattcttacaacaactatgaggcaagcaagcattattccttcttgtgttttacatacagatggggaaacaggcttgaaatgaagtaggtaccttgtccatggttaatgcagctgctccccagtcaactgctctaatataccaggtacctcgcctcctcctttatctcaggcatttttcactctcccagggcctaccccatttcttattcccaggaagatttccrttgctaatttaaaagttaactgctaagaggctaaaggaagggtatacataggggcccctatccccaccagggtgctaaactggggctgagggacaggagcaggccagacccagctccccaggaacagcgactaagaaacagagacacagaccaagaacccatccagacaggatgcagagaaaggaaactttctgtaggacattcctataggttgggaagtgcaaggttgtggatgtcattgtccagggaagtctggtagctggttctccatcagttattctgggaaaactcctactaaaa

SEQ ID NO: 82994 - DNA, 601 bp, Human
gactaagaaacagagacacagaccaagaacccatccagacaggatgcagagaaaggaaactttctgtaggacattcctataggttgggaagtgcaaggttgtggatgtcattgtccagggaagtctggtagctggttctccatcagttattctgggaaaactcctactaaaatgttttctcttctagtgcttccctcctcagaaaatgtcaccactctcttctgagacaccccaaccagaaacctgggagacaagagtagggaaagggtatcctcggggttaaaaggtgaactctggacayagactgtgtgttaatggaaatacacctaaccttgccaagcttcagtttccccattcataaaatagcgctaaatatgacttccctcatagtgtgagatgaggaataaatataaacatcttgtagaattcctggaacaaaatagtcacttaaatatggagccctcaaaaaactagtgagctctattcctcaccccctgcatccaatcaatcttcaaatagaaattctacctcctgattccatttgggtttgttcatttttcctccacccttgctgccatgatgtaatccaggtaatcatctc

SEQ ID NO: 82995 - DNA, 601 bp, Human
gaaattctacctcctgattccatttgggtttgttcatttttcctccacccttgctgccatgatgtaatccaggtaatcatctctgatctgggctcctataatgttgcgtgttcatctccataccttctttttttttttttttttttttttttttttggagaaggcatttcgctcttgttgcccaggctgaaatgcaatggtgcgatctcggctcaccgcaacctccgcctcccaggttcaagtgattttcctgcctcagcctaccaagtagctgggattacaggcatgcaccaccacgtcyggctaattttgtatttttagtagagacggggttttaccgtgttagccaggatggtctcgaactcccgacctcaggtgatccacccacctcggcctcccaaagtgctgggattacaggtgtgagccaccacacctggcccataccttcattcttgtttccaccttaccctaattcattctccattctgcaaggcagggatttctccaaaaaaaaaaaaaaaatgtgaatgggctctattctccatcccttaccaccttgctgctgcaaactccttctagcacccagggccctgcttggctt

SEQ ID NO: 82996 - DNA, 601 bp, Human
ggattgcaaaggattcaaagttgaagatctcacccctaccctccagctgcttacaatctagtacaggcggagaggagaacagcttcaacaacaggtagcacatataaaccaggtaggcagagtgagataagggagacaggtgtggagggctagatggagaactgggcacagcagcagactgcatgcatgaggtcagaactgagctgagcctgtcctctgctgcactctcagcacagtgtcaggcacatagtagcctttcatagtcacagcagggacgaaggaaggatagaaggacagttgrgtccaagttctaatcctgtcacttagaggaatgtggccaaccactatcttttctgactcaagctcttcatctgtaaaatggcaactgggggaaaatacttcttcctagggagttgctgtgggagaggaacttgtggttgtcatgaaagttgtccaccagatatatccagctctcttccttttatgcacaaggcaaaattgctggtccatttccatactgatgctagttgcagacattgtatttcatctggccagtgaactatgaacagaagtgatgtgtgtcactactgagaagaagctt

SEQ ID NO: 82997 - DNA, 601 bp, Human
ctgctgcactctcagcacagtgtcaggcacatagtagcctttcatagtcacagcagggacgaaggaaggatagaaggacagttgggtccaagttctaatcctgtcacttagaggaatgtggccaaccactatcttttctgactcaagctcttcatctgtaaaatggcaactgggggaaaatacttcttcctagggagttgctgtgggagaggaacttgtggttgtcatgaaagttgtccaccagatatatccagctctcttccttttatgcacaaggcaaaattgctggtccatttccatrctgatgctagttgcagacattgtatttcatctggccagtgaactatgaacagaagtgatgtgtgtcactactgagaagaagctttaagagccagtatgtatgtcactggggatgttccagatggcagtttctctgtcattcttagccccaggaaagtgtggtaggacaagaacctccaaccagcctgccatagatacgtaacctgagcaagaaatacatctgaaaagacaacaagtcttggcagggatgtgaagaaattggctttttttttttttttttttttttttgagatgatggagt

SEQ ID NO: 82998 - DNA, 601 bp, Human
gtcaggcacatagtagcctttcatagtcacagcagggacgaaggaaggatagaaggacagttgggtccaagttctaatcctgtcacttagaggaatgtggccaaccactatcttttctgactcaagctcttcatctgtaaaatggcaactgggggaaaatacttcttcctagggagttgctgtgggagaggaacttgtggttgtcatgaaagttgtccaccagatatatccagctctcttccttttatgcacaaggcaaaattgctggtccatttccatactgatgctagttgcagacatwgtatttcatctggccagtgaactatgaacagaagtgatgtgtgtcactactgagaagaagctttaagagccagtatgtatgtcactggggatgttccagatggcagtttctctgtcattcttagccccaggaaagtgtggtaggacaagaacctccaaccagcctgccatagatacgtaacctgagcaagaaatacatctgaaaagacaacaagtcttggcagggatgtgaagaaattggctttttttttttttttttttttttttgagatgatggagtctcactctgtcgcccaggctg

SEQ ID NO: 82999 - DNA, 601 bp, Human
ctgcatagcatatcacagcatacagaatttaacagagaaacccctttatacaacctaaagtttaagtaaatataatagctaggaaagatacgaaaaaaaatatgttgctttagaagagattgcacctggctgagggggtccagaaaaacttcttgaagaagttgtcattggagatggattttgaagtgaggaagaatgtctaaaggcacatatggggaagcaagataagaagaaggtaggagtgtgcaggaaggaaagtactcagaatggacagggcggtggatgactaacaatagtcacragaagtagcataggttaccactcactctgtcagtcgctgtcctgtgtgacttacctgtacttattcttattcattttccatcactgccataacagaacttaaatcttacagcggcttaaaacaaaacaaatatattatcttacagttctgtagctcaaaagtccagtatgggctttgcagggctaaaataaaggtgtgagcagggtgatatttgtttctgggacctctggggagaatatggtgttttgctcattcaggttgttggcaaaatccacttcctgtgtttgtgagactaagatc

SEQ ID NO: 83000 - DNA, 601 bp, Human
tataatagctaggaaagatacgaaaaaaaatatgttgctttagaagagattgcacctggctgagggggtccagaaaaacttcttgaagaagttgtcattggagatggattttgaagtgaggaagaatgtctaaaggcacatatggggaagcaagataagaagaaggtaggagtgtgcaggaaggaaagtactcagaatggacagggcggtggatgactaacaatagtcacgagaagtagcataggttaccactcactctgtcagtcgctgtcctgtgtgacttacctgtacttattcttaytcattttccatcactgccataacagaacttaaatcttacagcggcttaaaacaaaacaaatatattatcttacagttctgtagctcaaaagtccagtatgggctttgcagggctaaaataaaggtgtgagcagggtgatatttgtttctgggacctctggggagaatatggtgttttgctcattcaggttgttggcaaaatccacttcctgtgtttgtgagactaagatcttggtttctttcatggttctcagctaagggctctttcctgctcctagaggatacccttagtcttcgactt

SEQ ID NO: 83001 - DNA, 601 bp, Human
aactcctttcttttattagcaaaattcagtttcttgtagatataagactgaaatccccattttcttgctggctgccactggggaccactctcagtttcttgaggccatctcagatacttgcccatggcccctccaactcagtgataggaccctccctcaaattaaatccctcccacttcaaatctctctgtcttcctcttcttcctccagatggagaaaattcttcttttaaaagactcatgtcatagattaggtacgcccagataatgttcctgtcttaagttcaactgattaataaacstaattacatgggcaaaagcaaaatcccttttgcaattgaacataacataatcatagcagtaacaccagggggcagaggtcatggggcgatcttagaattctgcctactgcacatcctatgcataacggggtggataatctcatgctcattggacatatgtggagcacagaggttaaggtccaatggcagagctggacacagggcccaggtcctagtgatgaacataatatcatgtcccagctaggaagggctgcttctcctctttgagaactggggaagaacaattcccatttcctgagg

SEQ ID NO: 83002 - DNA, 601 bp, Human
accctccctcaaattaaatccctcccacttcaaatctctctgtcttcctcttcttcctccagatggagaaaattcttcttttaaaagactcatgtcatagattaggtacgcccagataatgttcctgtcttaagttcaactgattaataaacgtaattacatgggcaaaagcaaaatcccttttgcaattgaacataacataatcatagcagtaacaccagggggcagaggtcatggggcgatcttagaattctgcctactgcacatcctatgcataacggggtggataatctcatgctcrttggacatatgtggagcacagaggttaaggtccaatggcagagctggacacagggcccaggtcctagtgatgaacataatatcatgtcccagctaggaagggctgcttctcctctttgagaactggggaagaacaattcccatttcctgagggtgaggatgaagttgaaggttccttggtgcctctttcaactcagagcaggcccagagccggctgtgtctccaattatctccttgttagagggagggcattctgagtgaggacccctgagaaaaagggggagagatacaaagttggcat

SEQ ID NO: 83003 - DNA, 601 bp, Human
ataacggggtggataatctcatgctcattggacatatgtggagcacagaggttaaggtccaatggcagagctggacacagggcccaggtcctagtgatgaacataatatcatgtcccagctaggaagggctgcttctcctctttgagaactggggaagaacaattcccatttcctgagggtgaggatgaagttgaaggttccttggtgcctctttcaactcagagcaggcccagagccggctgtgtctccaattatctccttgttagagggagggcattctgagtgaggacccctgagaaraagggggagagatacaaagttggcatttcttatcgataataattcaggcaaatttatggcaacagttcaccaagagtggaaacctgtctagatctgtgagaacattagtcttttataatactttaaagaaaaaagtttgttattttaactttgtgcaataatttgctctataacaaatgctttcctgagtaaagattctgaggaaacatgatttaatgaccctgtaagaattatggatgtatttcgattccactttcccaaaaatgggtgctcctcaagtgtttgaaatcagtttattca

SEQ ID NO: 83004 - DNA, 601 bp, Human
ggaaacatgatttaatgaccctgtaagaattatggatgtatttcgattccactttcccaaaaatgggtgctcctcaagtgtttgaaatcagtttattcactcagaataaatgatcccttgtgcaatcatgtttttgctatttattagcttaagaagtattttccctacagaggaaagcgttacaaatttcctacttatggagtttcacattcactcaacaaatattgagactgtacagttattaggttctagagaattatgaagaaatataaaatcctttaatgatttaataatttagtgyagtgctaacaatgaataggaggaaagcaaggagtgctaccaacaggaaaagtagaggagttcagagaaatgagaggtgagcgtaggaagcagcagccaggcaggcttcttggaggaggtggcacttggagctggactttaaatcattcaatccagagtccataccctagcttcggaggcaatacttgacttagtccttccttcactctccagactcatcctgtgctgccaatcatcttgaacacatgaaggcttttcctgcttcagaacctttgctcttcctgtttccactgtctagagt

SEQ ID NO: 83005 - DNA, 601 bp, Human
tcactcagaataaatgatcccttgtgcaatcatgtttttgctatttattagcttaagaagtattttccctacagaggaaagcgttacaaatttcctacttatggagtttcacattcactcaacaaatattgagactgtacagttattaggttctagagaattatgaagaaatataaaatcctttaatgatttaataatttagtgtagtgctaacaatgaataggaggaaagcaaggagtgctaccaacaggaaaagtagaggagttcagagaaatgagaggtgagcgtaggaagcagcagycaggcaggcttcttggaggaggtggcacttggagctggactttaaatcattcaatccagagtccataccctagcttcggaggcaatacttgacttagtccttccttcactctccagactcatcctgtgctgccaatcatcttgaacacatgaaggcttttcctgcttcagaacctttgctcttcctgtttccactgtctagagtgtgttcctctagatttttctcacgtctagattattctcaaccttcggctctccgcttaaatatcactccttcagagaggctttcattcactgtcat

SEQ ID NO: 83006 - DNA, 601 bp, Human
ttcttggaggaggtggcacttggagctggactttaaatcattcaatccagagtccataccctagcttcggaggcaatacttgacttagtccttccttcactctccagactcatcctgtgctgccaatcatcttgaacacatgaaggcttttcctgcttcagaacctttgctcttcctgtttccactgtctagagtgtgttcctctagatttttctcacgtctagattattctcaaccttcggctctccgcttaaatatcactccttcagagaggctttcattcactgtcatgtttatgttsgtcccttccttctctcttcctgactgtatgcctcccatcaagttagaaattacaaaaaaaaaaaatagactgggcatggtggctgacacctataatcccagcactttgggaggccaaggtgagtgggtcacctgaggtcaggagtttgagaccagcctggccagtgtggtgaaaccccatctctactaaagatacaaaaaattagctgggtgtggttgtgcatgcctgtaatcttagctactagggaggctgaggcaggagaattgcttgaacccaggaggcagaggttacagtgagccg

SEQ ID NO: 83007 - DNA, 523 bp, Human
tctgagagtggtaactgcttctaccaggtatctacacttgtccagataagcacattgtgcttgtcctcacgacagcccttttaggttgttcctgttcttatccccattttctaggtatccccatttcacagctaggtgaaaccgaggctcagagatgtgaaatgacttgcccaaaatcacacaagttaacaaatggcagggggcaggggtaggaagtctgtgsggctgctgaacttccacttaataattctctttactgcctcggaaagagctgagtgtccctttgaagaattggctggggagtttctgagtaaagagaggaagagagactgtttcctgcctccgactgctgttctgctagctcagttggggatatgtgggagggagggactgagtgtgcagggaactgagtagggtgaaaaaatacctggcaaatggggattttcaatgggttattttaagtaaaatcgctccttttaatatgtgccttgtgctggagttaacaaacgttaattaaagcaga

SEQ ID NO: 83008 - DNA, 601 bp, Human
ctgctgaacttccacttaataattctctttactgcctcggaaagagctgagtgtccctttgaagaattggctggggagtttctgagtaaagagaggaagagagactgtttcctgcctccgactgctgttctgctagctcagttggggatatgtgggagggagggactgagtgtgcagggaactgagtagggtgaaaaaatacctggcaaatggggattttcaatgggttattttaagtaaaatcgctccttttaatatgtgccttgtgctggagttaacaaacgttaattaaagcagaagygcatattgttattttatctcccatttgcttatgggtcggggtatatttttaaaaagcccacaacatcccacatttaaatatgttcccagtcctaagaacttcaaatgccagagatatgtttggccacagatgacaatgcaggcccacacctggcccactgaggcagagaccaaggcccttggagcccatctcacctctgaaaatgagctgatggatcagcagatagtaagagctctggaggtgggggcctctggatgcagagaaaccatatgttttggtattatgggccgtccggcaggc

SEQ ID NO: 83009 - DNA, 601 bp, Human
tgcagggaactgagtagggtgaaaaaatacctggcaaatggggattttcaatgggttattttaagtaaaatcgctccttttaatatgtgccttgtgctggagttaacaaacgttaattaaagcagaagcgcatattgttattttatctcccatttgcttatgggtcggggtatatttttaaaaagcccacaacatcccacatttaaatatgttcccagtcctaagaacttcaaatgccagagatatgtttggccacagatgacaatgcaggcccacacctggcccactgaggcagagaccmaggcccttggagcccatctcacctctgaaaatgagctgatggatcagcagatagtaagagctctggaggtgggggcctctggatgcagagaaaccatatgttttggtattatgggccgtccggcaggcagctataaaaagagaatagcttcttctaagaacttaagcccaaaaatacacagaaggaaatgggaggaagtcccatttataacaagagtgtgttgccaaatattcttttgtgtctaggaactgtggtaagtggtgcttgagacctgagaaggtaaatctcgagaaaggaggg

SEQ ID NO: 83010 - DNA, 601 bp, Human
aaatcgctccttttaatatgtgccttgtgctggagttaacaaacgttaattaaagcagaagcgcatattgttattttatctcccatttgcttatgggtcggggtatatttttaaaaagcccacaacatcccacatttaaatatgttcccagtcctaagaacttcaaatgccagagatatgtttggccacagatgacaatgcaggcccacacctggcccactgaggcagagaccaaggcccttggagcccatctcacctctgaaaatgagctgatggatcagcagatagtaagagctctggrggtgggggcctctggatgcagagaaaccatatgttttggtattatgggccgtccggcaggcagctataaaaagagaatagcttcttctaagaacttaagcccaaaaatacacagaaggaaatgggaggaagtcccatttataacaagagtgtgttgccaaatattcttttgtgtctaggaactgtggtaagtggtgcttgagacctgagaaggtaaatctcgagaaaggagggtggtgaccctggtctaagctggaccccttctcagcacagtgaaaaatcacatgagtggaatcagatg

SEQ ID NO: 83011 - DNA, 601 bp, Human
aacttaagcccaaaaatacacagaaggaaatgggaggaagtcccatttataacaagagtgtgttgccaaatattcttttgtgtctaggaactgtggtaagtggtgcttgagacctgagaaggtaaatctcgagaaaggagggtggtgaccctggtctaagctggaccccttctcagcacagtgaaaaatcacatgagtggaatcagatggatctgggctcacatttcaaccccctcacttgttctgtgaccttaaataaattatttattcactctgaatctgtttcctcttttaacaaaargggatgtgttagtttgttttgcatcactataaaggaacaactgaggctaggtaattcctaaagaaaagaggtttatttggctcacagttctgtgggctatacaagcatggcaccagcatctgcacagctcttctggtgaggcctcaggaagcttttactcatggcagaaggcaaagaggagcagcgtgtcacatggtaagagagggggcaagagggaggaggaagtgccaagctcgtttaaacaaccagcagttgcatgaactgatggagcaagaactcactcattaccatagggagggc

SEQ ID NO: 83012 - DNA, 601 bp, Human
ggtctaagctggaccccttctcagcacagtgaaaaatcacatgagtggaatcagatggatctgggctcacatttcaaccccctcacttgttctgtgaccttaaataaattatttattcactctgaatctgtttcctcttttaacaaaaagggatgtgttagtttgttttgcatcactataaaggaacaactgaggctaggtaattcctaaagaaaagaggtttatttggctcacagttctgtgggctatacaagcatggcaccagcatctgcacagctcttctggtgaggcctcaggaagmttttactcatggcagaaggcaaagaggagcagcgtgtcacatggtaagagagggggcaagagggaggaggaagtgccaagctcgtttaaacaaccagcagttgcatgaactgatggagcaagaactcactcattaccatagggagggcaccaagtcattcaaagggatttgcccccatgacaaacacttcccaccaggccccacctccaacattgacaatcacctttcaacatgagatttggatgagacgaacatccaaactctctcaggggatacacccacctggcccaaagaaagaga

SEQ ID NO: 83013 - DNA, 601 bp, Human
ggatacttcaggtctaaggtaccaagtaggcagttaaatatatacatttaaaaaacaggataggggatagagatctaaattggggagttttcagcctctgtgtatacaggccatgtgtccggaggagatcatgagagcaagactgtagacagggataagaagagggctgaggcttgagctttgggcacagcaatagctcaagattaagcagaaagaagaaaccagcaacggagacaaccagcaaagataagccaacctgtgaggcaggaggagacccaggagagagtggggcctaggagcraagagaagtgttttcagaagaaatcattgtcatcatcatcattatgagtaacatctttagctctgccgtgtctgtgctaagtgtgagatgtgacttactaacttcacaagtcatgagatgggattcattatctccctttttcaggtatgaaaactgaggcttagagagagtcctattccatttgtgttgctataaaggcttacccctggctgggtaatttataaagaaaagaagtttatttagctcacgtttctgtaggctgtacaagaagcatggtgccagcatctgcttctgatgagg

SEQ ID NO: 83014 - DNA, 601 bp, Human
actttgagaggctgaggcagccggatcacgaggtcaggagatcgagaccatcctggccaaagatgatgaaaccccgtctctactaaaagtacaaaaaaaattagctaggcgtggtggcgcatacctgtaatcccagctacttgggaggctgaggcaggagaattgcttgagcctgggaggcagaggttgcagtgagccgagatcacgccactgcactccagcctggacaacaagagcgagactctgtcaaaaaaaagagaaggagaagtaagcacaaagagatgtagcgatttgcccaaartcatacaaccaataagaaacaaggcaggatgcccttcagcttcatctgaaccctgagcccattctcttgacaaacaatgacagtgccctctgctttctctctaaggatcacacaataataattttcaaacaaataatggcaataggttttctgggtgtttgtgcagaagaactaataactggatagatggtttttaaaatatgtcaactactgttgcatattagcttagatcaaaggtctctgatattcgcagtagagattgagagcaggagtcagcaaactatggcccccaggccaaat

SEQ ID NO: 83015 - DNA, 601 bp, Human
gcacttgcgcttacatattgtctatggctacttttcactctgcaacagcaaagatgagtagtgcaacaaagaccataagacccacaagcctgaaatattcactacctggactttgacagaaaaagtttgctggcctctgtttaaaagcaacaaatctaaactgtgacattagaagcacacatttaaaggcctgcaatgaatcctaatcaataaccagaacaagaaatgcctatcggaaacccagagaatggtcccatcagatccttactatcttccgttagcatcaagttatgccctaaaygatacatacactattttgttaacaaaaggaaaaaagatcctttgcaaaaagagacagcctgcttccagcaccttactcccagaccatgtccgaattcatttacccagaaggcgtgaactgtccattgagcatctttcctctcccacagcccctgctcctgtggatcacttaatgctatcacttggatctcggcagtcagcccgccccttcccatttctgtgggctctgcagtacttttcacccatcatcatcattgttaatcaataaataccataaacaatcatgatagtaacaccttaa

SEQ ID NO: 83016 - DNA, 601 bp, Human
ctatgatatttacacaagatgatgatgatggcttaacagagtgttaaatatactgtgagctaacagtactgtgctgagcactttgcaggaaatccatggtgtctaacattaaattatatgttttttaatcagtaggctccactgccttcctatcttctctatcagactgtgagcccatggaagggagagaccatggcatattcacttttatctcctcagtgaccagcagtgtctgccatataggaaatgcttgcaaagtaaatgaataaatagtatggtactcacaatcctagagattccygtctcctggttcttcaaccaaacactaatctatgtaatgctatgaagagattttatagaggcaattaaaatctcaatcagttcagtttaagacacagagattatctaggtgggtctggcccaatcaggtgaactcttaataagcaagaagtcatctccagctagtggaggttagagagattcaaaaaatgagaaggatttgacaccctattgtgggcttaaagatggaggaagtcaagtgatgagaaatgcagcaacctctagaagatgacagccagcaaggaaacagtgacctcaatcc

SEQ ID NO: 83017 - DNA, 601 bp, Human
taatctatgtaatgctatgaagagattttatagaggcaattaaaatctcaatcagttcagtttaagacacagagattatctaggtgggtctggcccaatcaggtgaactcttaataagcaagaagtcatctccagctagtggaggttagagagattcaaaaaatgagaaggatttgacaccctattgtgggcttaaagatggaggaagtcaagtgatgagaaatgcagcaacctctagaagatgacagccagcaaggaaacagtgacctcaatcctataaccacaaggagatgaattctgscaacaaccagtgagcttggaagtgataagaaccacagctccagctaatgccttggcttcagcctagtgagaccctgagcagagaatctagccaccctaagacagacctctaatctacagaactgtgagataatacatgaatgttgttataagctgctgtgtttgtgtcattgtgttatgcaacaatggaatacaaatacaagcaggaacacaatacaacaatggaataaaaatccaattatatcagatattggtggtcagactgctgaccaaaggttccgctgggctttgaagaagtcag

SEQ ID NO: 83018 - DNA, 601 bp, Human
caagtgatgagaaatgcagcaacctctagaagatgacagccagcaaggaaacagtgacctcaatcctataaccacaaggagatgaattctggcaacaaccagtgagcttggaagtgataagaaccacagctccagctaatgccttggcttcagcctagtgagaccctgagcagagaatctagccaccctaagacagacctctaatctacagaactgtgagataatacatgaatgttgttataagctgctgtgtttgtgtcattgtgttatgcaacaatggaatacaaatacaagcaggaayacaatacaacaatggaataaaaatccaattatatcagatattggtggtcagactgctgaccaaaggttccgctgggctttgaagaagtcagtgctgctgagatccaacatcacaggagtcatgagttaaagaagtccatgtccacccataaatgaatcagaattaggtgagggaggtagtgtcctgcagtagctaaagtgctggataagaaatatgaaatcccagtttctagtcccagctctgtcattgccttactgtgtgactctgggctcgtcatcttaggtctccgaattatagttc

SEQ ID NO: 83019 - DNA, 601 bp, Human
cctgggaggataatcatcttcataaaaagtaatgctttgtgtttcaacagaaatttccaagtgctttcccctgtaccagtttaattccagcagcttgtatcagttaaaggaaagaaatggactgagtcgttctagttttgaaagtgttggtttctcacagtgaaggagggtaagtctcacctattatacagagcaggaagacagaggcccagctaggcaggtgactcaccaagttgtggagatggtcagtgaaagagaaaaggctctcattcccagccctggcctctaataattccagctycctgcgtttagtatggagctgggaaaatgtaactttcctggatagaggcccagcttcacctgagccagttccaaattgaaggtagggaggattgccttgccctcaagttcttatcttgtgaatcacatgcaaatgaagcattgggattaagtcagactttgaacttcttcccctagctctccagttattccaaaaatgacagttgctggctgttaagcagcaaactctttctttggtatcgtcattcagtaggcggggatgtagggactatcgttcaaggtaggctgctataaacaacaa

SEQ ID NO: 83020 - DNA, 601 bp, Human
tatagtgacgtcccaggagcaggggaccacgaggttgcctaaggaggggtgaactggcccagattggagttggagcaggtcaaaactctgatgctgatcagtcatgggatcgcgcctgtaaatagcaactgcactgcagcctgggcaacatagcgagatactgtctctaaaaaataatacataaaacaagatggcagaataggagataacctgctcatatccccctaacaacaataagaattctgcagccatccacaggaaaaaagtctctctgcaggagctttgagattcaggtaggagrttataaaacactggcagagcccaagacctaagaaggctgttttaagagtgtagaacagcacccaggtagcaaacttgagcatgctcttaggttcaaacctgtaaacaactttgttcctcaaagggcttggcttcagccctatttggctttgagcctgcaaccaaaaccatctgtcaatgggtccaggagaaatcatgcaccttcgtgcctctgcagaaagttttgtctgcctgatgacactggtcttgccagtggatctgaaagttatctggcagtttggctccagccccccaacagctg

SEQ ID NO: 83021 - DNA, 601 bp, Human
gttgcctaaggaggggtgaactggcccagattggagttggagcaggtcaaaactctgatgctgatcagtcatgggatcgcgcctgtaaatagcaactgcactgcagcctgggcaacatagcgagatactgtctctaaaaaataatacataaaacaagatggcagaataggagataacctgctcatatccccctaacaacaataagaattctgcagccatccacaggaaaaaagtctctctgcaggagctttgagattcaggtaggaggttataaaacactggcagagcccaagacctaagmaggctgttttaagagtgtagaacagcacccaggtagcaaacttgagcatgctcttaggttcaaacctgtaaacaactttgttcctcaaagggcttggcttcagccctatttggctttgagcctgcaaccaaaaccatctgtcaatgggtccaggagaaatcatgcaccttcgtgcctctgcagaaagttttgtctgcctgatgacactggtcttgccagtggatctgaaagttatctggcagtttggctccagccccccaacagctgcaggcccagcttattaaagcttgcacaaggaac

SEQ ID NO: 83022 - DNA, 601 bp, Human
tgatggccaagaagattccatcccacagcagatccagagggggcccagtctcagctttcacccctcttgctacagttgggaaactcccccacccatgcaggaaattagttgggaagtacacacatctgggctactggggtgagctcaccagcatctgtgccacagtggatcctgagggggcccagtcttggctttagttccacttaaactgcagtaagagaactgccctggccatacaggaaactgctgggaagcatacatgtctgcaacactgtaggcagggttgccaacatctgttccrcagctcctctcactatagccaggaaattgtcccacttatgcagggatctgtcaaaaaacacaaagccatatggaccagtgagacaggcgtctgaactcaggttcctacccatctttcccatacagctccagtacccgccttgactcttctctaggtccaaccaagctggagtaccatcccaacctctaagccttcacaagacttacagagaaccctagattaggataccctctagtgttgaaatagctgcagcagtcacagactctgacaacaggttagattgtcagagtcacagactct

SEQ ID NO: 83023 - DNA, 601 bp, Human
agcacaaacaaagccagattgcaaagactagaataaatatctaattcttcaatgtaaagagattgacatacatccacaagcattaagaacaatcttggaagtatgacctcacctaatggacaaaacatgacaccaatgagggaccctaaagagatggaaatatatgatctgttggacaagtgattcaaaatagctgtgttaaggaagctcaatgaattttaagaaaacacagagaaaaaattcagcaatttaacagagagattgcaacaacaaaaaaatctggaactgaaaaatacaaatkaatgaatttttttaaatgcaatagaaagcataaacagcagaagttaataaggcagaagaaggaatcaagagcttgaaaacagtctccttgaaaatacagccaaaggagaaaataggaaaaaagaatgaaatagaacaaagaaagcttatagaatctatggaatagcatcaaaagagcaaatatttgggtcattgaagttcaagagggagaagaaaaacacaaaagggtagatggcttatgcaaagaaataacagagacctatccaaacctaaagaaagatataattatccaggtagagga

SEQ ID NO: 83024 - DNA, 601 bp, Human
taagaacaatcttggaagtatgacctcacctaatggacaaaacatgacaccaatgagggaccctaaagagatggaaatatatgatctgttggacaagtgattcaaaatagctgtgttaaggaagctcaatgaattttaagaaaacacagagaaaaaattcagcaatttaacagagagattgcaacaacaaaaaaatctggaactgaaaaatacaaatgaatgaatttttttaaatgcaatagaaagcataaacagcagaagttaataaggcagaagaaggaatcaagagcttgaaaacagkctccttgaaaatacagccaaaggagaaaataggaaaaaagaatgaaatagaacaaagaaagcttatagaatctatggaatagcatcaaaagagcaaatatttgggtcattgaagttcaagagggagaagaaaaacacaaaagggtagatggcttatgcaaagaaataacagagacctatccaaacctaaagaaagatataattatccaggtagaggaaggtcaaaagtcaccaatagattcaacccaaataagactatctcagacaagttgtaatcaaattttcaaagatcaaggacaaa

SEQ ID NO: 83025 - DNA, 601 bp, Human
ataattataaatatatattcaaccagcatcagagcagttaaatatgtaagcaaatattaatagacttaaagagaactatactctgcaataaaataataggagaaacttcaacactttccacaatagagagatcatccagacagacgataatcaaagaaacaccagactagttgtttctagatgcactctagaccaaatggacctaacatacctttatagaacattccattcaagagttgtaggatatacgttatttgcaacagaacatagaacagtctacagcatatatcacatagaaaamgagtatatcacatacatatatcacaatacaaaacaagtattaacaaatttttaaaaatcaaaattatgttaagtatcttttataaccacagtgcaataaaactagcaatcaataacaagaggaactttggaaaccatacagaattacagaaattaaacaacattctcctgaacaaccaatgaatcaatgaggacattttttaaaaattttaatttcatgagacaaatgaaaatgaaaacatgacatatgaaaacctatgagatacagcaagaggaaagtttatagaaataaatacctatg

SEQ ID NO: 83026 - DNA, 601 bp, Human
caagtattaacaaatttttaaaaatcaaaattatgttaagtatcttttataaccacagtgcaataaaactagcaatcaataacaagaggaactttggaaaccatacagaattacagaaattaaacaacattctcctgaacaaccaatgaatcaatgaggacattttttaaaaattttaatttcatgagacaaatgaaaatgaaaacatgacatatgaaaacctatgagatacagcaagaggaaagtttatagaaataaatacctatgtcaaaaaagtagaaagatattaacaacctagcaytgaacttcaaagaccaaaaaaaaaaacagaacaaactaaatctcaaatttacagaaggaaataaatcataaagaccagaacagaaataaataaaataggggctaaaaacaacacaaaagctcaaaaagagttgctttttagaaagataaaactgacgaacctttagcaagactgagaaaataagagaaatgactcaaataaataaaattataaatgaaaaaggagacgttaaaattgataccacagaaatataaaggatcataagagactgttgtgataactatacacaacaaattgtaa

SEQ ID NO: 83027 - DNA, 601 bp, Human
atcaataacaagaggaactttggaaaccatacagaattacagaaattaaacaacattctcctgaacaaccaatgaatcaatgaggacattttttaaaaattttaatttcatgagacaaatgaaaatgaaaacatgacatatgaaaacctatgagatacagcaagaggaaagtttatagaaataaatacctatgtcaaaaaagtagaaagatattaacaacctagcactgaacttcaaagaccaaaaaaaaaaacagaacaaactaaatctcaaatttacagaaggaaataaatcataaagwccagaacagaaataaataaaataggggctaaaaacaacacaaaagctcaaaaagagttgctttttagaaagataaaactgacgaacctttagcaagactgagaaaataagagaaatgactcaaataaataaaattataaatgaaaaaggagacgttaaaattgataccacagaaatataaaggatcataagagactgttgtgataactatacacaacaaattgtaaaacctaggaaaaaaataagttcttagacacatgcaacctatcaaaattgaattaagaagaaatagaaaacctga

SEQ ID NO: 83028 - DNA, 601 bp, Human
tacaggctaatatccctgataaacatagatgcaataatcctccacaaaatactagcaaaccaaattcaacagcacattaaaaagatcatgcaccataatcaagtaggattcagcccagggatgcaagaatggttcaatatattcaaatcaataaacatgatacatcccattaatagaatcaagaacacaaattagatgatcatttcaatatatacagaaaaagcatttaataaaattcagcaaccttttatgacgaaaaccctcaacaaattaactatagaaagaaaatacctccacacartaaaggccatatatgaaaaatacagctaacatcatattgaatagggaaaagttgaaagcttttcccctaagatatggaactagacgaggatggccactgtccccacttctattcaacgttgtactggaagtcctagcctgagcaatcaggcaagagaaaaaaataaagaacattcaaattgaaaaagaagaagtcagatcgtccctgtttgcagatgacatgatcttctctatagaaaaccctagaaaccctccaaaaagctaatagaaattcaacaaagttgcagggtataaaatcaaa

SEQ ID NO: 83029 - DNA, 601 bp, Human
catccattccaacaagtgttcctctcttttattttcccctccgtgtgaaacgcctaggagcattcttttccacatagcaagcaatgacatatatttgttggatttcttggagtaaaccctgtctgcctagagtgaaaagggatctccaagaaatcaaggtaaagtgaagtgtcaagggatgtaggaataacacatataaggtcaacacagataagggttttgcaagcagtgtggaacaacagagcagccaacaggcccgcgtactgctgtcccgaggcacagtagactcttgggtttcttsgtaaaactcatgggttgcattggtgatttctctgattgttaaatatagggtttcaattaaacactgtcacctattgaaggctctgagcttgaggctgtcagagcacttgtcagaacgggcttaaaggtacaggggctccagaataacacttccttgataaattgaacaggatggaaagagaaatgaaatgcaaataactttaccaccataggattcattatgatatgatgccctaactgcttaccacataaaatcaccacaagtcacatgcaaatcatcttgtaatatcttgggaagccc

SEQ ID NO: 83030 - DNA, 601 bp, Human
ggttatgtttctcttcattgtttgggagataagagaggggaatagcaatctgaaaagttcaaagataaatttctcacctcataattgattatcatatttgcctttttttatcttttttatttcaaccaaattatcttccttgggtgagtgggggaaagaattgtgtctgcacacaatggtggcattccccacaatggttggactatgactattctgattctatttccaatgtattcttccttcctttccttctagtccactattttggtggcctttgccagccaggagagcaataataagrcagtctgaaaacatgtctaaaccaatcaaatgtttgcatcatgtgtataaatgcatttgcattcatacatgtttgcacaaaacatttgctgtgtatgtaattgcttatacatatttgtgatttttgtgggcaagtgttgacatatctgtgtctttgtcatcatgtgtcttgctgttatatatgtgtaaaagggagtgtgaatacgtgcatgtgggctttatcacccctgaaggacagcaaccccacagatccatgtccgtaataaggaacaaaatatggagtctctctaacaacatttga

SEQ ID NO: 83031 - DNA, 601 bp, Human
gacccgtgctcagtccctccccagagctttccacagttgatgtccatgctgctgatgcctcttccctttggcctgcaggtccctgtctggtcgcatcgttggtggcgtctggtggttcttcaccttaatcatcatctcctcatatacagccaatctggccgccttcctgaccgtggagaggatggtgtctcccattgagagtgcagaggacctagcgaagcagacagaaattgcctacgggacgctggaagcaggatctactaaggagttcttcagggtagggacatcctttgtcccaagrcactttcacaaaagggaaccacaactgtcattaaaatgtccttctcattatatagcctgagataacaggcagccagagcaagtgcttaactgactgtaagtcagggaaactcaggacatttctaagctttctaccacccccctgagaaatctacatttctacatttgtagaagcttcaaagctcctgcattgatttggatcccttgcctgtatcagtctgtgctaatgctctgagggctgcaaaagacatcaaatacaatttcctctctgttatcacggaaaccttatagtctagttagt

SEQ ID NO: 83032 - DNA, 601 bp, Human
tacggacaacagctggacctgatgctctttgtgtcccctcctatctcatagaaggagctcagtgaatgtttgttgacttgatgaataagaggatagtatatgggaaaaaaaaaactggaaaaggtgatctattaaatggtgccaggagagagagaaaatgtgaagtgggagtggaggtggtgagatgtgttttggcagaagacagtgagcggaagcaaaggagcagagagcttaggagcacagccttcaagttcagcagatggaggcccagaacctggctccatcccttacttgttctgtrcacttagcctctgtgacaccatttccattcatccatgtaatgaggagaacaatgtctatatcagagcttaacaagactaaaagagatagggtatctaaaattagaggcaaaacaaggaacaatcagtggaggttccatataccattaggacttcaaggaaatgcaaacctttgggagtcattctgaagaatgggtagagactaaagccatacagggtagacgtgtaaacatttatagatatcacaaagccagggtagacctgtaaacatttatagatatcacaaagccaggccagacctg

SEQ ID NO: 83033 - DNA, 601 bp, Human
acaatgtctatatcagagcttaacaagactaaaagagatagggtatctaaaattagaggcaaaacaaggaacaatcagtggaggttccatataccattaggacttcaaggaaatgcaaacctttgggagtcattctgaagaatgggtagagactaaagccatacagggtagacgtgtaaacatttatagatatcacaaagccagggtagacctgtaaacatttatagatatcacaaagccaggccagacctgagtaggctaagtacaacctagacaaaaggaacaacttggacagacaccsagaagcaggaaaacctgtggtttccctggactttagggatgtttatcccaggagttgaagaaacagtacatggaactaccatctatggatcaaataagaataataagaaacatttgctaccgcctacatatgaaccaggtcctgtgctaagcacaccctacacaaattatctcatttaatcctctcattaaagatgagttagagattgtccctattttatagctcagagttaggataggtccccattttatagatcagaaaattaaaagaatcacctaagatcacacagctaattagtag

SEQ ID NO: 83034 - DNA, 601 bp, Human
ttgggaaattcttttgatgcaagtgtcaggggtgggtaccaaatctgagttttcttgttccaatccaagtattcctgtcactgaaccacatggtcttaatgtggtggtgtcattaaactgacaaacatttttaaaaagatcactcaggatgacagctgggcttgtggacacatctagtctaactgtaccattttatagttgggaaaactgaggcccagagaagaaaatggtcatgccctacctaatgagaggcacagctgggatttaaaatttcaaaagtctttgttaatcactacgtcarttgacatattactgcctcttgtccacagcacaaagttaagaacctggaaccagggcagtgcatattctacaagttctgtgcccaggcctactacattggtgacaaattggttgtagtccatgtacttactttgacaggtcagtagtggttgcctagagattctgaggtcacatctgggcttgatgtgaaaggattctttgattgatatcagtgtctctcatgtatacaggaagggaaactggtaccaagaaagccaggtatgaggcattcctaccctaaagtaaaacctgaaaaaaaagg

SEQ ID NO: 83035 - DNA, 601 bp, Human
tctgggcttgatgtgaaaggattctttgattgatatcagtgtctctcatgtatacaggaagggaaactggtaccaagaaagccaggtatgaggcattcctaccctaaagtaaaacctgaaaaaaaaggcataattattagtagtcattgcactacttacagaatgccttcttgtgccaggcactgggttatgcctgtgttctcatataatctccacggcaacactgtgaagtgcacagtattattactattttcagaagaggaacactgaagctcagaaaggttatgctacttgcccaacrtctttcagctaataagatataaagcctaaaatgagggaggcagctggttgcagtggaaaggcacaatgtgtgcaatcaggaggtcagggactcttggctctgccactaacaaactgcatgacatttgacagtttattgccacatcatgggcctcagtttctttacctgtaaaaggagagtactgccaagatatgtcccatgcataagcctttccatctctgtgactctgaccttggataattatcccaccaggagtttggtgggtggggagataaggttacctaccacccccacaaggca

SEQ ID NO: 83036 - DNA, 601 bp, Human
ctaataagatataaagcctaaaatgagggaggcagctggttgcagtggaaaggcacaatgtgtgcaatcaggaggtcagggactcttggctctgccactaacaaactgcatgacatttgacagtttattgccacatcatgggcctcagtttctttacctgtaaaaggagagtactgccaagatatgtcccatgcataagcctttccatctctgtgactctgaccttggataattatcccaccaggagtttggtgggtggggagataaggttacctaccacccccacaaggcaaaaggaggraatagtgagacaagaattcttctactccagtctctgaaaaagctggcttcttgtccccatgacagcccagaacttcttggcagccccagcccagagatgcttaatcctccatcgacagtttaattaagatgtatgaagagtcatgggagctgcggatgataggagagatccaagaacaaataccctgagtatgcttccaatcttccctgccactcatgctaccttcacattcctggagattagattttcctgatagttcatcccaagtgtctgtgtgcacagccttaacatttggggcac

SEQ ID NO: 83037 - DNA, 601 bp, Human
aggaggtcagggactcttggctctgccactaacaaactgcatgacatttgacagtttattgccacatcatgggcctcagtttctttacctgtaaaaggagagtactgccaagatatgtcccatgcataagcctttccatctctgtgactctgaccttggataattatcccaccaggagtttggtgggtggggagataaggttacctaccacccccacaaggcaaaaggaggaaatagtgagacaagaattcttctactccagtctctgaaaaagctggcttcttgtccccatgacagcccmgaacttcttggcagccccagcccagagatgcttaatcctccatcgacagtttaattaagatgtatgaagagtcatgggagctgcggatgataggagagatccaagaacaaataccctgagtatgcttccaatcttccctgccactcatgctaccttcacattcctggagattagattttcctgatagttcatcccaagtgtctgtgtgcacagccttaacatttggggcactggggtgaggctgagaggacatattaattttctgcatactgttgcccagaaggctcctcagctctgcct

SEQ ID NO: 83038 - DNA, 520 bp, Human
tacttttgcatcaacctaatacattctgaggacaggtctacccatgatccagaaattcttcagtgctttcttccaataatgaaatcagattccactgatattcagctttctatttcttctggttagtataaatatggccttattgaacaatagataggtcctttaatgtatttaaaagtcaggcagggccccagtttcttaattctccccttgtttaggrggaatataattactcagaagtaattaaaagatctgagctattctgttcattctgaatttgcaagatatttgtactttggaacctactggtactaattagagcctcttattttgcaatcactcataatttgtttcttcctgagctaatctcgctcatgaatgtgtgatcaagctacactcagctcttcattaatgtgtgcaccgaccccaattccaagcgcacttaattccagctttgtttctgtccctaccagaggtctaaaattgctgtgtttgagaagatgtggacatacatgaagtc

SEQ ID NO: 83039 - DNA, 601 bp, Human
cctgaggttggaaactgacctgggggcctcagcttgctgtgactgtcactgcccatgtgttcttccccatgcctcaccttcctcctccaagtgcgtgaaacatcaatgaaccttgtgcttttgtcgtgtgatctgtaacaccccatcctttaccagacacccctgcatccaacaacgctatgaacagagttctccagcaacctgaattctttgacagaaggtggtttataatgtttgtctcaaaagaaacataaacatgttgtccaaatgaaaaatcaaatctttcgagtcctgagactcyggctgtggaaatcgaaatagcatctaatgaatagcaccaaattaattatagcacctattcttacctagagactgatttatttagcaagatatagacggtttggtaaagaagcagagtggactttactttcacgaaaagaaatcctgatattcattctcaacagctgaggaagagtcctgtagacatggagtcacaatacctagatttaattctgactgtcttacaaaaggtaaaacatatcatcttccagcccttagtttcctcatctgtagagggaggataattggcccagcccttcct

SEQ ID NO: 83040 - DNA, 601 bp, Human
aaacatcaatgaaccttgtgcttttgtcgtgtgatctgtaacaccccatcctttaccagacacccctgcatccaacaacgctatgaacagagttctccagcaacctgaattctttgacagaaggtggtttataatgtttgtctcaaaagaaacataaacatgttgtccaaatgaaaaatcaaatctttcgagtcctgagactctggctgtggaaatcgaaatagcatctaatgaatagcaccaaattaattatagcacctattcttacctagagactgatttatttagcaagatatagacrgtttggtaaagaagcagagtggactttactttcacgaaaagaaatcctgatattcattctcaacagctgaggaagagtcctgtagacatggagtcacaatacctagatttaattctgactgtcttacaaaaggtaaaacatatcatcttccagcccttagtttcctcatctgtagagggaggataattggcccagcccttcctaggtctgaagtggttgtgagttcaaatggtataatttatgttgaaggtcactgaaaacagtacactgtgaagtcacctatgagacattatgtcaatt

SEQ ID NO: 83041 - DNA, 601 bp, Human
atgtatgggccaagggggcaggagtgcagtacagcttcaccctgcagcttaccgggtaatgggcacccaggaaggtctgagacccactctctgtgctttccatttagcttcaccgattggtttccaaataccttctcacacaaagcactgtgcataatgctgcagggaatggcagtgagagatgcaatcccagtgcttaaataatgcatcatcaaatacagctcatgagcagaattatgtagatacctattatcctaccaatgccataagagagccagaaacactcaaaaaaaaaaaaaaaggaggagagtcaacgtttgcgtggtaggatttgcaatggtggaagaattgtggaagaattgtgatagatgggaagtggggagaggaggcttcatattaggggctgaagaggaaaagagagcaaatgcagaaacggaaaaaaaaaacatggggcttgttttcaggaacaacaaggggtccactttaaccagagaattcattaataggtaggagtgattggctgcggtcatattgtgaagaatctcaaatgtctctgcatgttttactatgtcagtaggagccactgaaagtcatttacagg

SEQ ID NO: 83042 - DNA, 601 bp, Human
agggacagagggtttcctcctagttgctcatcccccatactgggacgataaaacatgcttgtatcttccatgaagtccagtaggccttccctggaatcctttttttgcctaatgctaacctgagtgctacagaaggccatagagagttctcttcttttagagaatcacattgacccagaaaataattgggaaacaaataagcaagtgcttttttgtgtggcattaagtcgattgctctaaagagcccttcccaacttcggtgtgtatcaaaattacctagggagctggtttaaaatgcccyttcctagactctaatccttgagacttctgattttgcagatccaggaatatgcaatttgaacaagtcccccaggtgcctctgttctaagtaaacagcagtccactctgggaacaagggctagaagaggtcagggaggcgatgtgctagtggtctgaggaggcagaacatgaggaggaggccctgaaggaatagggggatgaatatgatgggagatgaccaggaatcctcatggaatggttcacaacccgaattcctggagtcagatcacctccactcaagtataaggcccgttaccttgcc

SEQ ID NO: 83043 - DNA, 601 bp, Human
aaaacatgcttgtatcttccatgaagtccagtaggccttccctggaatcctttttttgcctaatgctaacctgagtgctacagaaggccatagagagttctcttcttttagagaatcacattgacccagaaaataattgggaaacaaataagcaagtgcttttttgtgtggcattaagtcgattgctctaaagagcccttcccaacttcggtgtgtatcaaaattacctagggagctggtttaaaatgccccttcctagactctaatccttgagacttctgattttgcagatccaggaatrtgcaatttgaacaagtcccccaggtgcctctgttctaagtaaacagcagtccactctgggaacaagggctagaagaggtcagggaggcgatgtgctagtggtctgaggaggcagaacatgaggaggaggccctgaaggaatagggggatgaatatgatgggagatgaccaggaatcctcatggaatggttcacaacccgaattcctggagtcagatcacctccactcaagtataaggcccgttaccttgccagagtttgacctcactgggtaagtcactagaacttcataaacgtctgtc

SEQ ID NO: 83044 - DNA, 601 bp, Human
atggcctccacaaaccaagcactctgtcttgaagcactaggctaggctgcagatccacgctgcttatttgttttggaggattctggtgaaatcacaaagacaaatgggcagtaactctggttagagcccattttttatttatttatttatttttgagatggagtttcactctttttgcccaggctagagtgcaatggcgcaatctcagctcactgcaacctccgcctcctggaggttcacgtgattctcctgcctcagcctcccgagtagctgggattacagccgtgcactaccacaccargctaattttgcatttttagtaaagacgggatttcaccatgttagccaggctggtctcaaactcctgacttcatgatccatccgcctcggcctcccaaagtgctgggattacaggcatgagccaccatgcccatcctagagctccattttataatgcctggttgagaagctcataaatggcaaagcaacacattaaagagagagaggaggaaggtggtgaaagcgaggtggcagggatgtatctgggaagataaataagggaaatgaatggcctttacctaggtgagaacagcagctcagt

SEQ ID NO: 83045 - DNA, 601 bp, Human
aacccatgctgagaaattcccagccatctgtccctgtaacattttgtgaatggtcccacaggctaagatcatggcttaacaatcatatctaatcagcctgttcctcagagtgaaaggggcaaaagcccaggtgaatcctaaccaaaggaaccaacttcctctcacacagtaaaccagcagagtccccaaacaaagaaaatcaggcagggaaatttgcatatattattcatccttcctcagaacaaacgtctagtaaacaaagagcacaatgaactcttaatcatattctttattcccatgrgaataaaatgtattcctttagaggaataaaaaaaaaaaaatagttgcattagtcaagccagtctccctgtggcccacaaacacaactttcccccactcctgtatcttcgcttgtattgcttccttctgccctccacccatatttccaggtcaacgaagcaaaggccaactctcccagagaatctagcagagaatttagcatgcaggaaacccctgctgattgcttatcacatagaccagttcctacccagccaacttccatgtacatgatgactttctgagcacataatcaaatcagttg

SEQ ID NO: 83046 - DNA, 601 bp, Human
gctcttatcaatcacacaatgctataaatgaaagctgacactgaggatcacaggaaatgatgaagactagtgaacagggctatgtgtcttatctagacgggacagtctccactcattccagtctaatgttgacatgtaggaatgttgtcacatattctcatttttcaaaagaaactagaaatctcaatttttatataaactatacaacttttttagtagtgatcacatttaagagagaaggataaagagaaggcacaacccactaacaactaacgctaatacaaaggagactggaagtacsataaaaataaatagataaataaataaggcaaagtgaggaaaacatgcagttaagaattaatatcttgcccatccccagggtgaaagctctagaaaggcctccaggaggaggcagcattccctgaacagttccttaaccagtagagagaacagccaggcggaagacggggaggaaggtatttcaggaaaagccaccgcaagcataccatacaggagtgaagagaagggtgattcatgcattctttttcaatctttgttgttgctgttttcagcagggaatcacttccccaaacaaaacctc

SEQ ID NO: 83047 - DNA, 601 bp, Human
tccttagaattggcccagcttttcttcctttcattgaaccaggggtggctgagatgagaccagtgagctggctcttgtactgaatagtgtttccactccctccattaattgcggggggaccttcattcattccctctgttatcttttgtcaagcatctccaaggtatctgacacagacctgtgtgcctgctgctgctgacaaatgcttctgcattacaggaccagatgtggtttactgtgagctgcaaatgaactgttgacacctgcttctcacaatgtggggtgggctaggcatcacacwtgccttagaaatgcttgctgtctctagaattcctgttggaggagccagacttcagatccctatccaggtctctgggctgtatccactgatcttaaccaggtttcttcacagaaccctgaagaaatttacagggccagaaataaatatttgcacattttaaactgctgtgcagttttgaggggttcaagaaacccctatggtttatctcagaaattaaaaagtactccttcattcaacaaacatttatgaagcagctactgtgttagctattgtgcagtgtgcagggttcctgccaataga

SEQ ID NO: 83048 - DNA, 601 bp, Human
tagatgagtggagatggataagggaatggtgagtttgctgtgataaaacatgcaagtacagtgggaccagaaggctcagtccattctgccttgggtcactgcaggagtatttgcagagaacaacacacatcagaagcgtgtaagatgactagggttccacaaagtggtgaagtgtcctaggtagtacatgtgccaatgcagaggtgagctttagttatgctacctagtccaatccagctacctgaatttgtccagaattactctcaaagcactttcccatctgtcacctcatttactcccmactctacaggcagctggggcaggagcatgcaattattcccattttacaaatgggaaaactgaggtacagttagggtcatcaaccaccctggtttgctcaggattgagggggtttccaggatgtggaactttgggtgcaaaaaccaagactgtcccaggaaaactgggacagctggttaccctagctgtagttacatgacatgtcacataatttgatcagagatgaatgaggtactcaaatcacgccttcagactctttcctccacccagcatggagtgattaagtgagcactctgtatat

SEQ ID NO: 83049 - DNA, 601 bp, Human
tatatatcatttgctttaaaaaaaattaatttgtgtcatttgtacagtcagaaaccaaagacaaagcctctgtcttctgctgactcactgcctgaccagcatttcttctcataagatcgcagaactctctgttccttgagtatactcaagaggggaacaccatctggaatggtcaggtgtgaagggaaatttgatcctacctgtattccttaaggaacccggggatgtctgcattttaattgaggctcctgatataaccccactaactattttcttttgcttggtcactggatagcctctmccagttcactcatcaccccaacctcctgagtcagcggagtcctatggggtctgagttgtctgcccagtcagtttaccttaaatggtccacacagccagtgatgtcatagactgaactaaagacagaggactttgagaccattgtccaaaggaagccattaaggagtgcatctaggacccaggcccaccagtactagtcctgcctaaattcagccatgcttttcctcggcagtggcagggtaaatgagccttggttcctacggaggctctggtccccactcccagcaaaagaaccccggct

SEQ ID NO: 83050 - DNA, 601 bp, Human
ctcttattaataccatttaataacagaaggaatatgttaacactaaaaattaatgaaggaaacaattacaaacaaaggtctgtcctttaaatggaaaagttccatgtcctgaaaactcactacacaacgcttatctttccttcttttcccattgatgagtgaaaactatcacaaaccagttccagctcattggatgagccgtttgggaaccactgatttaatcccagctttttatctagctcgtgaatttcctccatgttattcctgacaaacagttgtcccatgaacaacatcccaacaratcatacttttcaagtagcaattatcagagggtgctaataattccaggtttgccgtcatactaagcagcaatctgtgtccctgtggctttgtctccctgatctaattctgccctctggcatctcagagaataacgctaattcctcttccactgacaaccaacctcaagtttccatgtgagtcctgcttgctttgaagtggcccactatctccatgatccctggatccagggttaaaattttcaaccttgtctcttcctctcatataagccgttatatttttcagttaattgatatacatt

SEQ ID NO: 83051 - DNA, 601 bp, Human
gactaagaccaatacacatcaaatagtagtagacaatgcagtgaactgcctgctagatgccaggcaagtttaaaggaaaggtcaatgagaaataaagtgctcaagggcagattcaaggaaaacatggggagcattgcagagcaaccaggtcttaaaagagaagttaaggagaacagcaagaagcaagcacacaggagcaggcagaggcacactggttgagaaagtaggatgcccagcagcctggtctgattaaatcagaaattccctctgtaggaggacaagcaaagcatattatcatagrctgggcagaattccaaaggtcatttcatccaacactcctcagacgctgaaactcaaggtttcgaaggcaaaagtggaagtgtagacaattgctacagaattgaagcccaacattctgtcctttgcctttcataagttgagacaaaattaaaaccatctgaaatatctcccttggctgcttttttcaaactttaatttccctgcaagtatatgataattgagtttctttagagcacaaggctggatatattggaccttaatgtgcacaagttcatcctagaaattgtctttagagtaccaa

SEQ ID NO: 83052 - DNA, 601 bp, Human
tgtagacaattgctacagaattgaagcccaacattctgtcctttgcctttcataagttgagacaaaattaaaaccatctgaaatatctcccttggctgcttttttcaaactttaatttccctgcaagtatatgataattgagtttctttagagcacaaggctggatatattggaccttaatgtgcacaagttcatcctagaaattgtctttagagtaccaagtctttcctccccaagagttccaaaactaattcaatatttagaatgctcccctggacctcccagttccagtggctgaatrtcagggctcaggcattagaggattctttttgttctttggccctcttggggactaaatgccatgtatgtcaccatgtcagtgactacagccttggtttcatcccctgatgacccacaaccatcatctcccttatgctgaacatctctctgaatcttggaattttcagatgactctaactttgccaaattagaatcatgcctgattctttttttgtttttttgtttgattgtttgctttatgtttgtttactttgctcagtgccaagcacaggatttagcataagaaaagttccactagagg

SEQ ID NO: 83053 - DNA, 601 bp, Human
gatatattggaccttaatgtgcacaagttcatcctagaaattgtctttagagtaccaagtctttcctccccaagagttccaaaactaattcaatatttagaatgctcccctggacctcccagttccagtggctgaatgtcagggctcaggcattagaggattctttttgttctttggccctcttggggactaaatgccatgtatgtcaccatgtcagtgactacagccttggtttcatcccctgatgacccacaaccatcatctcccttatgctgaacatctctctgaatcttggaattttcagatgactctaactttgccaaattagaatcatgcctgattctttttttgtttttttgtttgattgtttgctttatgtttgtttactttgctcagtgccaagcacaggatttagcataagaaaagttccactagaggttgtttattcaagtaagtaattattatagccatccgtatatgaatgctttacaaaattttggctgatggtcctcgcaggtctgttttattagtcaatttataaactcaagtttatgtcttcaacttgaccatctcctttgacttccagattcgcctcttccca

SEQ ID NO: 83054 - DNA, 601 bp, Human
tgtttccccacttgcctccctttagtcccttctcctccctgcattgggagaacttattaacttggtttaaaagggtctgtcattccctggctaagaccctccaatctcagaataaaatgctcaatcctggcctgcagagtccctgccagcctctccaacctcatctccccataagaatgtgatctcttatcacccaaccctcttctctctctagtctccgcttaaatgtcacttcctcagacccatgtttcctgaccacctctgacattttctgtcatttcaccttttgtttcctttatawcacttcacatattctcttattgcttgtttctccaattagactgtaagccttactagggcatgaaccatgtttgtcttatgcattagtacatacctaggacctctcgtggtgctagcacatagtagctgttcagctatattcatggttattaaagagggtttatggcaaagtattatggtttcccactcaatgtagatgtcccttctataaaatcataacaaataaccatctagtctccttctgaatgcctcctctccaagggtttcctcttaagacagccaattccatttcctttggctc

SEQ ID NO: 83055 - DNA, 601 bp, Human
cgtgaaactaaaacaatttccaagtcattttatctagacatttctttaaaatatgtaaggccaaacttaattaacactaatctatgaagaatatctaattaactgcagtgggcaactgacttccacttttaggagaaagaaaataaagtaatctcaggaatcttttttgttagtctgtaaaatcatttccaggtaaaatctagagcttaatccatatgttgtgccatcttttgcttttccacacctctgatcctaggtaagttagagctaacgagtatttgctgagcttctattatgggcycagcatatgttataatttcttttacacataggaatctgaggcttagagaagtttactgatttacctaatggcacaccataagtgctggggctaagatttaaactcaggtctcctgacttaattcagatggtcagctcgatggtaatcataataatattgttgttgttgttgttgttgttatttatcaacaatagtagtagctaagtcatttcatgaaacagctcattgatagtccatttgataattctgagttggaaattctattatcccatttgacagatggagacactgaagctcaga

SEQ ID NO: 83056 - DNA, 601 bp, Human
ttgctgtgggacagggccgtttagcacacaacccaggatggtccttttggctacccctaattatttacccaaaatgatggtctgggtcttgctcagggatactgaactctttttttttttaactttttttttttttttttggacaagtcagacatcaagcagctggcatgatccctcacctttattttaaggataccctttggcttacacattcaagggccattgaattggcctccaagcagggttctccatccaggtacaggtgtgaattcatgatgagttgaaggaagagagtctcatkacctgaacttgttacctctatcacaaattccaggctttagagttgaaagagagcctgcagaggatttaatcccaccctggcaaaacttcaagcattcacataccacctgtgtcgttatttgcttcacgtgttcctttaaagctactatcttcattactactttaatcgagttcatataaaaagtagcagcactactatcacaagtagaaagtcagtacttcttgcaaaaaaaagaaggcaaccatataaataactataatgacaacaaaaaaatattaaattacagtcacctttacaact

SEQ ID NO: 83057 - DNA, 601 bp, Human
atcacaaattccaggctttagagttgaaagagagcctgcagaggatttaatcccaccctggcaaaacttcaagcattcacataccacctgtgtcgttatttgcttcacgtgttcctttaaagctactatcttcattactactttaatcgagttcatataaaaagtagcagcactactatcacaagtagaaagtcagtacttcttgcaaaaaaaagaaggcaaccatataaataactataatgacaacaaaaaaatattaaattacagtcacctttacaactgagggctgctgcttcttaawaatcgagaggagcaagtgatcagtgttaaagatgatcagcaccaaactgagattttcttgttggctttactcagaaagattaaaagagaattgaaaagagaatgacatcctcactttgtagtcaatgtcatttacttcagtgtatcatctaacactgtctcccataccatccagaggtgggcaacactcactgtgtgactcgcccaagattgcccagtgactcaatgataaagctgggcatgaattcatgaactgagcttagatatcctgcccccacccccaccccccggcttgttttat

SEQ ID NO: 83058 - DNA, 601 bp, Human
acaaattccaggctttagagttgaaagagagcctgcagaggatttaatcccaccctggcaaaacttcaagcattcacataccacctgtgtcgttatttgcttcacgtgttcctttaaagctactatcttcattactactttaatcgagttcatataaaaagtagcagcactactatcacaagtagaaagtcagtacttcttgcaaaaaaaagaaggcaaccatataaataactataatgacaacaaaaaaatattaaattacagtcacctttacaactgagggctgctgcttcttaaaaakcgagaggagcaagtgatcagtgttaaagatgatcagcaccaaactgagattttcttgttggctttactcagaaagattaaaagagaattgaaaagagaatgacatcctcactttgtagtcaatgtcatttacttcagtgtatcatctaacactgtctcccataccatccagaggtgggcaacactcactgtgtgactcgcccaagattgcccagtgactcaatgataaagctgggcatgaattcatgaactgagcttagatatcctgcccccacccccaccccccggcttgttttataat

SEQ ID NO: 83059 - DNA, 601 bp, Human
gattgcccagtgactcaatgataaagctgggcatgaattcatgaactgagcttagatatcctgcccccacccccaccccccggcttgttttataatataatgccacactgtttcaccatcagcagggtaagtccatccattctggatgtactcactttctttcccctactgtcagcaaggcctggaaggcaaaaggactgaaaacacactgtgtacaagccccatccctgccctcctcacaggtaaagagcattggccatctggaaggacctgggaattcacacaatgatgctctgctccrcttgctccttccccttcccactgaatgttcctgcactaaagagaccccaggagggcaatgtcagagggacgtgagtggagaaagaaagcccttgagaccaagagatgcagaagtcattccattacccccacgccctagagactttgggctccagctatgttcctgctcagggtcaggtttcctgatttctgtaaggcacagtaggcaacagcctggagagaaccagtgacttctaggtgaatcttctgggagttatgtgtggtccaagataacatgtccgacatacaacagttatccata

SEQ ID NO: 83060 - DNA, 601 bp, Human
tcagaagcacagagggaacctgagacagtcccccagtatgtggaaagaacaaggagaaatatagggggggaaatctcctttccatatgagggagacagcaaatcaagacaacaggttaaggagaacagatgagtgggggggtttcatcaccactcgtcaccattcgtcaccatagcaacaagcccagcgattctgcaagacaggagttatatttttcttttcacctgtcactcttcttggtactgtcactctctttccccactcctggcgggaggtgaattgtgacttttccacccccccctgacaagctgcctagcttttctggtgtgcagctgctatggaataggagaatggggtaccctgaggggtgctcagaagactcaaactccatctctcccctgtccccgatcacagctgggaagtgtgtagctgtgaaatgtgagtagctgtttatacacagatccacgaggaagctgcctcttttatggacactgcagaccagaggaaccagagctgtggtcctcaaataaaaggaatttttgtccctgccccaggatttcccattttattcccacagagtgagacaaagagagtcagtaaa

SEQ ID NO: 83061 - DNA, 601 bp, Human
gcccatcactcccttgtccttggaggctatccacaaccaaggtaaacctcaagaagaaaacagcttggtgaccaaaggggcaaggtgtgctttggctattgaaagactgatcagctcatgaagtcagcagcctccagctttcttttttaccacctgccctcaggcctgtccctctacctactccttctgagctccactgtcaaccactctttactaaggtttgagctgataatacatgcctcctaaccccacccctacccctgtttaaacagaagagtttcataggaacttctgtgaactstaagtcccccaaggactctaaagcattactctccagaggaagaaatacatgccttctgaacaacaaacagggagacattttgagtgttctaaaaatcatgtgaagtgggaatttacctgttcagccaactcttgaaccaagcactgaactcattttttgcacattacccttatcaggccattatagaagagcaggagaaattttgcccctttgagtcctttgaataatcatttctactgcttccaaagccaggctatgccttgccaagtgtaacctatattcaagagccatctgctttag

SEQ ID NO: 83062 - DNA, 601 bp, Human
tttattgtacatgaacaaacaatataaacaaaggtgttagagctgccatgacatctaggaatgagtattctcctagtagttaaagatgttcttttgcctgtgtcaagagtttgactgagcaacttgctgcgcttcctgagccattacctctcaccatgaccatcagttgtgtttgattgttctcaccacttgggaaggtgttgtccctcagaccttcacttttgaactccactggaggtgacagaactcagggatgatctcaggagaccagtggccttcctctggctccacagggtgagcyctggccacctcccaccatgaccatcagttgtgtttgattgttctcaccacttgggaaggtgttgtccctcagaccttcacttttgaactccactggaggtgacagaactcagggatgatctcaggagaccagtggccttcctctggctccacagggtgagccctggccacctcccactagacatgagtacttgtcttcagactcctaggaatgaagcacccttttctgtgaccctgctcatcccaaaccagtgtaagatcttttatctcaggcaacagagatttctaaattcagccacct

SEQ ID NO: 83063 - DNA, 601 bp, Human
ccctctactctgtgctgaccttgtcatacctggtgaattgggtcttttcttaggctccactctaagaaatagacattgacaaagaggaccatgtgcagagaaaggtaagcagattagtgagatgaccccaaaccacatcaaatgtagctaacgggaactggagaagagaactgtggaggatttaagagctgtctgtaaaataccaatattttccaagtggaaaaagaaaacaggctagttctatggagtcccaaagtatacaacaagaacagatgactaaaggtgatagaggataaatgtkaacacgatacactaaatttacttttctaaaagagctatctaaagaaaggctagaatatcccaaaaagtagcaagcttcaacatcactgaaggtatacaagtagaggatgaataactcttgacaagaatatggattcaagcatcaaaaggcagtttggattaaatgatcttcaaggcccctcaacatttagcttcagtaagaaattatttgtggaagttaatcatgtgaacaataccatgatcaaggcatcatgaggactcagagaggagggaggtgcattctatgatctccagcaccttt

SEQ ID NO: 83064 - DNA, 601 bp, Human
ctccaaaatgaggaaaggttactccggtggcaaaaaaggggaacaggacaagaactaggggagctacaacctgtaccatccctcaaaaccttctctatagaccatgactcaagccagaggcccagagttggcccagtacagattataaggagttcctttcttctcattgcttgtctaagacacagtacagcatcatcatctagagtagaagctctggagaatgaacgtctgggcataaattctatcttctccatttgttaactatgtcatcttaggttttagtaactctctgatccttatttattaattaattaatttatttatttatttatttattttgagacagagtcttgctctgttggccaggctggagtgcagtggcatgatctcagctcactgcaacctccatctcctgggctcaagcaattctcttgcctcaccctcccgagtagctgggattagaggcgtgtgccaccacacctggctaatttttgtatttttagcacagatggggtttcaccatgttgaccgggctggtctcaaactcctgacctcagataatccacccacctcggccttccaaagtgctgggattacaggc

SEQ ID NO: 83065 - DNA, 601 bp, Human
tccaaaatgaggaaaggttactccggtggcaaaaaaggggaacaggacaagaactaggggagctacaacctgtaccatccctcaaaaccttctctatagaccatgactcaagccagaggcccagagttggcccagtacagattataaggagttcctttcttctcattgcttgtctaagacacagtacagcatcatcatctagagtagaagctctggagaatgaacgtctgggcataaattctatcttctccatttgttaactatgtcatcttaggttttagtaactctctgatccttattaattaattaattaatttatttatttatttatttattttgagacagagtcttgctctgttggccaggctggagtgcagtggcatgatctcagctcactgcaacctccatctcctgggctcaagcaattctcttgcctcaccctcccgagtagctgggattagaggcgtgtgccaccacacctggctaatttttgtatttttagcacagatggggtttcaccatgttgaccgggctggtctcaaactcctgacctcagataatccacccacctcggccttccaaagtgctgggattacaggcg

SEQ ID NO: 83066 - DNA, 601 bp, Human
tgaggaaaggttactccggtggcaaaaaaggggaacaggacaagaactaggggagctacaacctgtaccatccctcaaaaccttctctatagaccatgactcaagccagaggcccagagttggcccagtacagattataaggagttcctttcttctcattgcttgtctaagacacagtacagcatcatcatctagagtagaagctctggagaatgaacgtctgggcataaattctatcttctccatttgttaactatgtcatcttaggttttagtaactctctgatccttatttattaattaattaatttatttatttatttatttattttgagacagagtcttgctctgttggccaggctggagtgcagtggcatgatctcagctcactgcaacctccatctcctgggctcaagcaattctcttgcctcaccctcccgagtagctgggattagaggcgtgtgccaccacacctggctaatttttgtatttttagcacagatggggtttcaccatgttgaccgggctggtctcaaactcctgacctcagataatccacccacctcggccttccaaagtgctgggattacaggcgtgagcca

SEQ ID NO: 83067 - DNA, 601 bp, Human
gaggaaaggttactccggtggcaaaaaaggggaacaggacaagaactaggggagctacaacctgtaccatccctcaaaaccttctctatagaccatgactcaagccagaggcccagagttggcccagtacagattataaggagttcctttcttctcattgcttgtctaagacacagtacagcatcatcatctagagtagaagctctggagaatgaacgtctgggcataaattctatcttctccatttgttaactatgtcatcttaggttttagtaactctctgatccttatttattaatttattaatttatttatttatttatttattttgagacagagtcttgctctgttggccaggctggagtgcagtggcatgatctcagctcactgcaacctccatctcctgggctcaagcaattctcttgcctcaccctcccgagtagctgggattagaggcgtgtgccaccacacctggctaatttttgtatttttagcacagatggggtttcaccatgttgaccgggctggtctcaaactcctgacctcagataatccacccacctcggccttccaaagtgctgggattacaggcgtgagccac

SEQ ID NO: 83068 - DNA, 601 bp, Human
gaaaggttactccggtggcaaaaaaggggaacaggacaagaactaggggagctacaacctgtaccatccctcaaaaccttctctatagaccatgactcaagccagaggcccagagttggcccagtacagattataaggagttcctttcttctcattgcttgtctaagacacagtacagcatcatcatctagagtagaagctctggagaatgaacgtctgggcataaattctatcttctccatttgttaactatgtcatcttaggttttagtaactctctgatccttatttattaattaattaatttatttatttatttatttattttgagacagagtcttgctctgttggccaggctggagtgcagtggcatgatctcagctcactgcaacctccatctcctgggctcaagcaattctcttgcctcaccctcccgagtagctgggattagaggcgtgtgccaccacacctggctaatttttgtatttttagcacagatggggtttcaccatgttgaccgggctggtctcaaactcctgacctcagataatccacccacctcggccttccaaagtgctgggattacaggcgtgagccaccac

SEQ ID NO: 83069 - DNA, 601 bp, Human
aaaggttactccggtggcaaaaaaggggaacaggacaagaactaggggagctacaacctgtaccatccctcaaaaccttctctatagaccatgactcaagccagaggcccagagttggcccagtacagattataaggagttcctttcttctcattgcttgtctaagacacagtacagcatcatcatctagagtagaagctctggagaatgaacgtctgggcataaattctatcttctccatttgttaactatgtcatcttaggttttagtaactctctgatccttatttattaattaatttatttatttatttatttatttattttgagacagagtcttgctctgttggccaggctggagtgcagtggcatgatctcagctcactgcaacctccatctcctgggctcaagcaattctcttgcctcaccctcccgagtagctgggattagaggcgtgtgccaccacacctggctaatttttgtatttttagcacagatggggtttcaccatgttgaccgggctggtctcaaactcctgacctcagataatccacccacctcggccttccaaagtgctgggattacaggcgtgagccaccaca

SEQ ID NO: 83070 - DNA, 601 bp, Human
gttactccggtggcaaaaaaggggaacaggacaagaactaggggagctacaacctgtaccatccctcaaaaccttctctatagaccatgactcaagccagaggcccagagttggcccagtacagattataaggagttcctttcttctcattgcttgtctaagacacagtacagcatcatcatctagagtagaagctctggagaatgaacgtctgggcataaattctatcttctccatttgttaactatgtcatcttaggttttagtaactctctgatccttatttattaattaattaatttatttatttatttatttattttgagacagagtcttgctctgttggccaggctggagtgcagtggcatgatctcagctcactgcaacctccatctcctgggctcaagcaattctcttgcctcaccctcccgagtagctgggattagaggcgtgtgccaccacacctggctaatttttgtatttttagcacagatggggtttcaccatgttgaccgggctggtctcaaactcctgacctcagataatccacccacctcggccttccaaagtgctgggattacaggcgtgagccaccacaccag

SEQ ID NO: 83071 - DNA, 601 bp, Human
ttactccggtggcaaaaaaggggaacaggacaagaactaggggagctacaacctgtaccatccctcaaaaccttctctatagaccatgactcaagccagaggcccagagttggcccagtacagattataaggagttcctttcttctcattgcttgtctaagacacagtacagcatcatcatctagagtagaagctctggagaatgaacgtctgggcataaattctatcttctccatttgttaactatgtcatcttaggttttagtaactctctgatccttatttattaattaattaatttatttatttatttatttattttgagacagagtcttgctctgttggccaggctggagtgcagtggcatgatctcagctcactgcaacctccatctcctgggctcaagcaattctcttgcctcaccctcccgagtagctgggattagaggcgtgtgccaccacacctggctaatttttgtatttttagcacagatggggtttcaccatgttgaccgggctggtctcaaactcctgacctcagataatccacccacctcggccttccaaagtgctgggattacaggcgtgagccaccacaccagg

SEQ ID NO: 83072 - DNA, 601 bp, Human
ttatttatttattttgagacagagtcttgctctgttggccaggctggagtgcagtggcatgatctcagctcactgcaacctccatctcctgggctcaagcaattctcttgcctcaccctcccgagtagctgggattagaggcgtgtgccaccacacctggctaatttttgtatttttagcacagatggggtttcaccatgttgaccgggctggtctcaaactcctgacctcagataatccacccacctcggccttccaaagtgctgggattacaggcgtgagccaccacaccaggcctctratcctcattttctataaaatggaggcagtggtagtacatacctcataacattgttgtaaggattgtatgaaataatggatataaagagcttggcaaaattcctgggccccagtaagccctcagtaaataataatgacaatgataactagtatttcaaataatagttgttactagtggccagatacatcctccttaaaactttccttttattatccctatttacatgagctagggttcttaagctatatagattgtgagttccttaaggtaaggggttgtgtggacatcccacacactgag

SEQ ID NO: 83073 - DNA, 601 bp, Human
tacctcagcctcccgagtagctgggactacagtcacgtgccactacacctggctaattttttgtatttttagtagagatggggtttcaccatgttagccaggatggtctcgatctcctgacttcgtgatccactgccttgacttcccaaagtgttgggaccacaggcatgagccaccacgccccgcccttggcccactcttaaggccttaaccccctaaactcgttcagggtcatcttctcatgtggctcaacagtgcttaaaaacatcttcctcactcttcatggatgaaagaacgagakgaagaggggcagaaaagagaaagaagggtggaggagagagagagatgaaaggaagcgaagaaggaaagatgatttttcagtaacttttatgttcaaagtgatttctacacattttcattaaccatgcaataagttgttcttacaatcctacagatgaaataaaggttcaaagaagctaagtagcttttcctgactaggtcacacaagctagaaactaaaaaaccaggaattagaactccaacatggtctccacaaagcctgggcttttggtactagccaagccacttttcctaaatctct

SEQ ID NO: 83074 - DNA, 601 bp, Human
gaaaagggtgatatgtgagagtgggagactcagagagggacttcaggcagctcataacatttcggtctaattcaaattgtcatacaacagcagaaaatacataacctaagacacattgcaaattgaataaaatctcaggtcccctgcccctcccctctgcctgggcaaacagactggctcctgaatccttagctgatattaagagcagcaaagtattattcaccacctcattcccaaaggaaaataatccccagcctctctcacccccactagagatgctgacctttcaaaattatatacrgctgtgctaacatagggcatgtttaagctacagcaattgagggcttgcacattttcctggaattaatgaacagctgagagacttgataactcaaggggagcatcctccacagcaggtggtcactggtgctttgcacgcctgcctgagcaaagacattactgaagtttaagctttgattaggatattctatgtgcagaggctgagcactctcttcttagaaaagcaagtggctgagaagttaggatgcaatcactgttagggaaataaggtcccaaagggccaattttagggtctgtaagt

SEQ ID NO: 83075 - DNA, 601 bp, Human
gacctttcaaaattatatacagctgtgctaacatagggcatgtttaagctacagcaattgagggcttgcacattttcctggaattaatgaacagctgagagacttgataactcaaggggagcatcctccacagcaggtggtcactggtgctttgcacgcctgcctgagcaaagacattactgaagtttaagctttgattaggatattctatgtgcagaggctgagcactctcttcttagaaaagcaagtggctgagaagttaggatgcaatcactgttagggaaataaggtcccaaagggmcaattttagggtctgtaagttggattttttactcatccctttgtctctgaatatcagttccaaaaacaccaccaccaccctcaaggatgaactttaagaatggctggcatgtcaaggagggataagggaaagccacattcccaaaggctaggggagaagtgacagcagtttatgacagtttagccacgacggggggcggggagtgggggggagtaggaagaatcacatttagaaggtcattcatcttgtcactaggtcacatataactgttaccttaaacaagtcagtcattgtcatcag

SEQ ID NO: 83076 - DNA, 601 bp, Human
tgggagcccacaggaggtggccctgagcctgcaaaaggcaacaggctctgaggagagtggcctctgtctgccttgagaggcccccgagctggcaggcacagggggaggccagagagggaatgtgatacttagaaccccccccacccccccatcacatgcggccgacagggaggcgggggccagcctgctggggtggggcccaggtccgggaacttctcatgatacagcctgcagggtggccttggtgtttgggtcctaagtacacacatgttgtgtatgtgagtgtgtgtttctgttgtgrgggggtaacggagagagctgtacaaggtccctgctgcccacctggggagtgccatgctctgaaacctgcaatgtggaggaccctcagggacctcagggactgccgggctggggctgtgctcgcagagcccaggctgggccaccctgcctctggccagcagtgcttctctggcatagctggttactgggcctttacgggagacttttggttttgattatgttaacagagaaagattctgggaacaggaaggaaacaagggaaaccgaaaaggaagagcagacagctgtggggaggcagggc

SEQ ID NO: 83077 - DNA, 601 bp, Human
cgagctggcaggcacagggggaggccagagagggaatgtgatacttagaaccccccccacccccccatcacatgcggccgacagggaggcgggggccagcctgctggggtggggcccaggtccgggaacttctcatgatacagcctgcagggtggccttggtgtttgggtcctaagtacacacatgttgtgtatgtgagtgtgtgtttctgttgtgagggggtaacggagagagctgtacaaggtccctgctgcccacctggggagtgccatgctctgaaacctgcaatgtggaggaccckcagggacctcagggactgccgggctggggctgtgctcgcagagcccaggctgggccaccctgcctctggccagcagtgcttctctggcatagctggttactgggcctttacgggagacttttggttttgattatgttaacagagaaagattctgggaacaggaaggaaacaagggaaaccgaaaaggaagagcagacagctgtggggaggcagggcagccagggctccaaggtggaagccgccccatctgcacatcccacgcccaccaccggccacccactgtgcgccaagctgggccgt

SEQ ID NO: 83078 - DNA, 601 bp, Human
catcacatgcggccgacagggaggcgggggccagcctgctggggtggggcccaggtccgggaacttctcatgatacagcctgcagggtggccttggtgtttgggtcctaagtacacacatgttgtgtatgtgagtgtgtgtttctgttgtgagggggtaacggagagagctgtacaaggtccctgctgcccacctggggagtgccatgctctgaaacctgcaatgtggaggaccctcagggacctcagggactgccgggctggggctgtgctcgcagagcccaggctgggccaccctgccyctggccagcagtgcttctctggcatagctggttactgggcctttacgggagacttttggttttgattatgttaacagagaaagattctgggaacaggaaggaaacaagggaaaccgaaaaggaagagcagacagctgtggggaggcagggcagccagggctccaaggtggaagccgccccatctgcacatcccacgcccaccaccggccacccactgtgcgccaagctgggccgtggctgtgctgggccgggggtggtgcgtgagccaccatttactggctgtgtgactttggccaagtt

SEQ ID NO: 83079 - DNA, 601 bp, Human
ggtccgggaacttctcatgatacagcctgcagggtggccttggtgtttgggtcctaagtacacacatgttgtgtatgtgagtgtgtgtttctgttgtgagggggtaacggagagagctgtacaaggtccctgctgcccacctggggagtgccatgctctgaaacctgcaatgtggaggaccctcagggacctcagggactgccgggctggggctgtgctcgcagagcccaggctgggccaccctgcctctggccagcagtgcttctctggcatagctggttactgggcctttacgggagamttttggttttgattatgttaacagagaaagattctgggaacaggaaggaaacaagggaaaccgaaaaggaagagcagacagctgtggggaggcagggcagccagggctccaaggtggaagccgccccatctgcacatcccacgcccaccaccggccacccactgtgcgccaagctgggccgtggctgtgctgggccgggggtggtgcgtgagccaccatttactggctgtgtgactttggccaagtttcttcgtcagtgacttggggaggactctggtttgaagctcaaggtgttggatg

SEQ ID NO: 83080 - DNA, 601 bp, Human
cacgcccaccaccggccacccactgtgcgccaagctgggccgtggctgtgctgggccgggggtggtgcgtgagccaccatttactggctgtgtgactttggccaagtttcttcgtcagtgacttggggaggactctggtttgaagctcaaggtgttggatgatggggcgatcactgagaagcacagagcttggcccacagggagtgcccagtgcgctcggcacaaggcctgatcctctcccagcctctatacccaagtctgtaaaatagaagtaaagtattgagctcaggtggaccctggkcgatttagtgagctgtgaggtacagcttggcactgggccctggcagggctgggagtggtggtgatgattctgtgctcaggcttcaggacacggagacacagaagaccgcacttgacaggtcttgttggtcgttggaggctgtgtgtgtgtgaatgagtgcttgcatatgcatgagtgagtgtgatgaatgtgtatatcagtatacatatgggtgtgagtgtgcacgtatgagtagacatgagtgcatgagtgtgtatgagaacatgagagcgagtgggcatgcgggagaatgagtgtgta

SEQ ID NO: 83081 - DNA, 601 bp, Human
gtgtgtatgagaacatgagagcgagtgggcatgcgggagaatgagtgtgtatatatgtgttagtgtggatggtgtgagtgttaactgtacatgcatgagtgtgacaggatgcgcatatatgagcgtatgaataaagtgcacagggtgacctggtatcttctccctttgggctggatccccagccccaacttgccctgtggctcccacaaatggggccaacctgatcaccactaacagtaagtccttgaccctgtggtcacatgaggtgctggctcccttaccacagccaggatgatcctgyaggagcccagcctcccagagcccccaccctgctcctatgcaggggctcacgcctgtgtgcatgcgagctgtgcagctcatgtgcacgtcctgtgtgagtgcaccacctgtgacattaactgggtgtgcagagacacagcgcacatgagggcctgcacaggccatgaccacacacgccacagggctcatggggccccagggtggtgggagccacagagcctgcattaaatggaacccgatggggtgtctctgtgggactgagcacttttcacctgactgctctgccccccaccgcagcagc

SEQ ID NO: 83082 - DNA, 601 bp, Human
ccccaacttgccctgtggctcccacaaatggggccaacctgatcaccactaacagtaagtccttgaccctgtggtcacatgaggtgctggctcccttaccacagccaggatgatcctgcaggagcccagcctcccagagcccccaccctgctcctatgcaggggctcacgcctgtgtgcatgcgagctgtgcagctcatgtgcacgtcctgtgtgagtgcaccacctgtgacattaactgggtgtgcagagacacagcgcacatgagggcctgcacaggccatgaccacacacgccacagrgctcatggggccccagggtggtgggagccacagagcctgcattaaatggaacccgatggggtgtctctgtgggactgagcacttttcacctgactgctctgccccccaccgcagcagcctcaggccttggggtcacctgaaccaattgcaactttgagagaaggtagggagatgagcacagaaacagagacctggagagtgtatcccaggtgccccgtcttccctaatgtgcatgtgcacacacacacacacacgcacacacgcacaagtgtacaggctcaaatgcaaatctccacgtgt

SEQ ID NO: 83083 - DNA, 601 bp, Human
cacatgaggtgctggctcccttaccacagccaggatgatcctgcaggagcccagcctcccagagcccccaccctgctcctatgcaggggctcacgcctgtgtgcatgcgagctgtgcagctcatgtgcacgtcctgtgtgagtgcaccacctgtgacattaactgggtgtgcagagacacagcgcacatgagggcctgcacaggccatgaccacacacgccacagggctcatggggccccagggtggtgggagccacagagcctgcattaaatggaacccgatggggtgtctctgtgggamtgagcacttttcacctgactgctctgccccccaccgcagcagcctcaggccttggggtcacctgaaccaattgcaactttgagagaaggtagggagatgagcacagaaacagagacctggagagtgtatcccaggtgccccgtcttccctaatgtgcatgtgcacacacacacacacacgcacacacgcacaagtgtacaggctcaaatgcaaatctccacgtgtgcacacatgcaaagatcacatactttctggaagggctcatggagcccagcagccaccaccagctttggccaccca

SEQ ID NO: 83084 - DNA, 601 bp, Human
cccagggtggtgggagccacagagcctgcattaaatggaacccgatggggtgtctctgtgggactgagcacttttcacctgactgctctgccccccaccgcagcagcctcaggccttggggtcacctgaaccaattgcaactttgagagaaggtagggagatgagcacagaaacagagacctggagagtgtatcccaggtgccccgtcttccctaatgtgcatgtgcacacacacacacacacgcacacacgcacaagtgtacaggctcaaatgcaaatctccacgtgtgcacacatgcaragatcacatactttctggaagggctcatggagcccagcagccaccaccagctttggccacccaacgctggcccatgtgtctccagagccctgccccagagagcagctgcagaggtgtcaggggactctgagagtggactcctccatacccactttacactggaggaggtgggggctcaggggaaggaggggccccaggaaggatgtgaacccagatcttcagcactctccctcacagctcctgcccatgttaactcagccgacaccgcagcagcatggtgacaggtccccccagggtgtc

SEQ ID NO: 83085 - DNA, 601 bp, Human
gggactgagcacttttcacctgactgctctgccccccaccgcagcagcctcaggccttggggtcacctgaaccaattgcaactttgagagaaggtagggagatgagcacagaaacagagacctggagagtgtatcccaggtgccccgtcttccctaatgtgcatgtgcacacacacacacacacgcacacacgcacaagtgtacaggctcaaatgcaaatctccacgtgtgcacacatgcaaagatcacatactttctggaagggctcatggagcccagcagccaccaccagctttggccrcccaacgctggcccatgtgtctccagagccctgccccagagagcagctgcagaggtgtcaggggactctgagagtggactcctccatacccactttacactggaggaggtgggggctcaggggaaggaggggccccaggaaggatgtgaacccagatcttcagcactctccctcacagctcctgcccatgttaactcagccgacaccgcagcagcatggtgacaggtccccccagggtgtctgcctctacagaggaagggactgaagcacccagagagctggcaggtaggcctgtggagt

SEQ ID NO: 83086 - DNA, 601 bp, Human
gctattctaataatttttaagtggattccttgggattttctgtatgtaaaataatctaatcagtgaataattgttctttctttccattctggataccttttatttctttttattgcctaattactctggtgagaatctccagtactatgctgaatagaagtagagcagacatcctttccttgttcctgttcttgggggaaaaactttcagtcttttaccactaggtatgttagctgtgggtttttcatagaaccctttatcagattgaggaacttcccttctattcctggtttgttgactsttcttatcatggaggagtgttgaattttgtcaaacacttgttcttcgtctatcaaaatcatgtggttgtcctttattctattgatatggtgtattacattaattgttttgaatattaaaccatccttgtattcctgggataaatcccacatggtcttggtgtagaatcccttttatatgttgcaggattcagttggccagtattttgttgaggatgtttatgtctatacccataagggatattggtttgtagttttattgtgatgtctttgtctggttttggtattgggataatgctgct

SEQ ID NO: 83087 - DNA, 601 bp, Human
attactctggtgagaatctccagtactatgctgaatagaagtagagcagacatcctttccttgttcctgttcttgggggaaaaactttcagtcttttaccactaggtatgttagctgtgggtttttcatagaaccctttatcagattgaggaacttcccttctattcctggtttgttgactcttcttatcatggaggagtgttgaattttgtcaaacacttgttcttcgtctatcaaaatcatgtggttgtcctttattctattgatatggtgtattacattaattgttttgaatattaarccatccttgtattcctgggataaatcccacatggtcttggtgtagaatcccttttatatgttgcaggattcagttggccagtattttgttgaggatgtttatgtctatacccataagggatattggtttgtagttttattgtgatgtctttgtctggttttggtattgggataatgctgctctcatagaatgagttccctcctcttctattttctggaagtttgtgaaggatccatgttcttttgagccaactcttgatggctgggttagttcagtttcaactttaggctgtggcaacag

SEQ ID NO: 83088 - DNA, 601 bp, Human
taggtatgttagctgtgggtttttcatagaaccctttatcagattgaggaacttcccttctattcctggtttgttgactcttcttatcatggaggagtgttgaattttgtcaaacacttgttcttcgtctatcaaaatcatgtggttgtcctttattctattgatatggtgtattacattaattgttttgaatattaaaccatccttgtattcctgggataaatcccacatggtcttggtgtagaatcccttttatatgttgcaggattcagttggccagtattttgttgaggatgtttatgtctatacccataagggatattggtttgtagttttattgtgatgtctttgtctggttttggtattgggataatgctgctctcatagaatgagttccctcctcttctattttctggaagtttgtgaaggatccatgttcttttgagccaactcttgatggctgggttagttcagtttcaactttaggctgtggcaacagcaggggctgaggcctgcaagtgggtgcttgctcgattcaggtaactggagccatagggtctggctggcgtaagagcacagaaggtagagggcaggagtggct

SEQ ID NO: 83089 - DNA, 601 bp, Human
tcctggtttgttgactcttcttatcatggaggagtgttgaattttgtcaaacacttgttcttcgtctatcaaaatcatgtggttgtcctttattctattgatatggtgtattacattaattgttttgaatattaaaccatccttgtattcctgggataaatcccacatggtcttggtgtagaatcccttttatatgttgcaggattcagttggccagtattttgttgaggatgtttatgtctatacccataagggatattggtttgtagttttattgtgatgtctttgtctggttttggtrttgggataatgctgctctcatagaatgagttccctcctcttctattttctggaagtttgtgaaggatccatgttcttttgagccaactcttgatggctgggttagttcagtttcaactttaggctgtggcaacagcaggggctgaggcctgcaagtgggtgcttgctcgattcaggtaactggagccatagggtctggctggcgtaagagcacagaaggtagagggcaggagtggctgaatcaggaagggccaggttggcatgaggaggccctagaggtttagcactgagcagtgatggg

SEQ ID NO: 83090 - DNA, 601 bp, Human
caactttaggctgtggcaacagcaggggctgaggcctgcaagtgggtgcttgctcgattcaggtaactggagccatagggtctggctggcgtaagagcacagaaggtagagggcaggagtggctgaatcaggaagggccaggttggcatgaggaggccctagaggtttagcactgagcagtgatgggaatggtgtgcgtgttgattctgtgctgggtggagggggctggaggcagaggaagcctgaggagaggaagtggagggggttgccaagaggcaatggagaggggcctggcagggcrgctggaaggaggtgggatccttgaggcaggccagacaagggcactgagaacagaggcacagagatgggacagagcctcgaaggctgggtgcagtgggaagaagtccagatagcgggcctgaggtggggccttgaaaccagggtgggtgcccaggatggacagctaggtagggtcaggcccaggctgttagagccacacctgcatctggcccatcttggtggcagcttgtttgcaggtggaagatggaggaggcaggatgcctgggaggccagcaagggcctctgccggcctttggccacc

SEQ ID NO: 83091 - DNA, 601 bp, Human; identical to SEQ ID NO: 47578

SEQ ID NO: 83092 - DNA, 601 bp, Human; identical to SEQ ID NO: 47579

SEQ ID NO: 83093 - DNA, 601 bp, Human; identical to SEQ ID NO: 47580

SEQ ID NO: 83094 - DNA, 601 bp, Human; identical to SEQ ID NO: 47581

SEQ ID NO: 83095 - DNA, 601 bp, Human; identical to SEQ ID NO: 47582

SEQ ID NO: 83096 - DNA, 601 bp, Human; identical to SEQ ID NO: 47583

SEQ ID NO: 83097 - DNA, 601 bp, Human; identical to SEQ ID NO: 47584

SEQ ID NO: 83098 - DNA, 601 bp, Human; identical to SEQ ID NO: 47585

SEQ ID NO: 83099 - DNA, 601 bp, Human; identical to SEQ ID NO: 47586

SEQ ID NO: 83100 - DNA, 601 bp, Human; identical to SEQ ID NO: 47587

SEQ ID NO: 83101 - DNA, 601 bp, Human; identical to SEQ ID NO: 47588

SEQ ID NO: 83102 - DNA, 601 bp, Human; identical to SEQ ID NO: 47589

SEQ ID NO: 83103 - DNA, 601 bp, Human; identical to SEQ ID NO: 47590

SEQ ID NO: 83104 - DNA, 601 bp, Human; identical to SEQ ID NO: 47591

SEQ ID NO: 83105 - DNA, 601 bp, Human; identical to SEQ ID NO: 47592

SEQ ID NO: 83106 - DNA, 601 bp, Human; identical to SEQ ID NO: 47593

SEQ ID NO: 83107 - DNA, 601 bp, Human; identical to SEQ ID NO: 47594

SEQ ID NO: 83108 - DNA, 601 bp, Human; identical to SEQ ID NO: 47595

SEQ ID NO: 83109 - DNA, 601 bp, Human; identical to SEQ ID NO: 47596

SEQ ID NO: 83110 - DNA, 601 bp, Human
gagtgtaaaatacatacatctcactttgtattgaacccattatcgcttctcggccttttggctaagatcaagtgtattccacccactaaaagaaaactggaaacaaaaagtcagagtcaggccctatttttgaagggaacttacacattattttatgagatatagatttagcaggtgcctggctgtttcagtacccgactggaaaagaatgaatgtcactcatgcaacaaactggtcacctaaatagtgactgaccactcactgtaaataactccaggtaaaggtaaatcttgaaaatggrtatccttctatataaaatatgcaagatctatggctagcatgcttttcatatttttaaacgtgctccacctatttctctgtaacatccaattcggggtagaattaaagatgttcctaagacatgctatctgctagtttcttagccaaaagagctctaccctttctgaaagattccaggctgtccttttccattctgtctgggtgataaggtaacctgaaggcagaaatgacatacagtaatatatgtgccactctggccagttggtctgtgaatttcagtgtttcatcatgctcactgagg

SEQ ID NO: 83111 - DNA, 601 bp, Human
catagtcaaaatagatttatattttcataaatttctttaacataaaaatatgttaagtcccttctggttttttttttcatattcactctctgtatggttcaaatttctttgactcaatgtctgcctaatgcttagttttgttatttaaagactatgcaaaatgtgtgaaagggtaaattacaccaagataacaaatacttagtatttctctgcctttgcttgaaatacacatattaatctatataagttattgtctatgcatgcacttgagtgtaaaatacatacatctcactttgtattsaacccattatcgcttctcggccttttggctaagatcaagtgtattccacccactaaaagaaaactggaaacaaaaagtcagagtcaggccctatttttgaagggaacttacacattattttatgagatatagatttagcaggtgcctggctgtttcagtacccgactggaaaagaatgaatgtcactcatgcaacaaactggtcacctaaatagtgactgaccactcactgtaaataactccaggtaaaggtaaatcttgaaaatgggtatccttctatataaaatatgcaagatctatg

SEQ ID NO: 83112 - DNA, 601 bp, Human
ctctttcaaacaagcaggtcttacactttaaacatcaaccatgggacattactttaccagtagttctgatgtaagagcctggacatgatttcatcaagtatcaacatttcaaaaagaggcacaggaatctcccctgttggtgtcatgtaaggtaccgtggcttcaaaaacaactctcattagaagatcacatcccaagtgaagggattatgtctgtgaataaactttttgtacactgatatgtgattcagcatcttttcttaaaagtgtcagaaactggtgctatattggaggaaatagcygcatgatgcccagctctctttaagatatgccagcatgacatgccatactgaactgttctttgggcttgaaactggaaactgcattccttaaaagcatacttctttggttggttccatacatgtaatcgcaaatactcacattcaacattgttcttcaaactacctcttcttttgagttggtgttttagaagaaacactgcatttgttaatatcaaacatgctaaggtgtcactgtgcctgccttcccctttatacattcctgaaatattttgagtttatctgtgaagagtgtgtctagca

SEQ ID NO: 83113 - DNA, 601 bp, Human
cacttagaggtgcttagattgctggagacacaacgggaaaacttcacatttgtgccctctgcattcctcttctacaagatctatattctaaaggccctattcatccaaatagtgatttgctttagaggccttgatcgatatgaaaccgaccaaaacaaatgcctgctttattccttcatgaattactttataaaggtaatcacaattagaactattaaaggagatgattttaagttggtatctcttggtccttgaaaatattagtagttgtaggcaacattgacagttttaagctctttcraacaagcaggtcttacactttaaacatcaaccatgggacattactttaccagtagttctgatgtaagagcctggacatgatttcatcaagtatcaacatttcaaaaagaggcacaggaatctcccctgttggtgtcatgtaaggtaccgtggcttcaaaaacaactctcattagaagatcacatcccaagtgaagggattatgtctgtgaataaactttttgtacactgatatgtgattcagcatcttttcttaaaagtgtcagaaactggtgctatattggaggaaatagccgcatgat

SEQ ID NO: 83114 - DNA, 601 bp, Human
agcaatttattataaaagcagagctattctgcttttatggtggttaggggatggaagaccctgtgcccaatctgggtaccctccatcccacctcccaaccctgaggcactccacaggacacagctgaaaaatgtctggtgaattcagaagttgaagcttaaatcaaaatgcttgatattcaagacatttatgatctttctgctctcatttcccactcaacacccaagggccctttttgctgcagccacagtattaatttattctctctccacccctactccaccccaatactcctccaaagtcttttccacatctaggcttctgcattccctattcctattgtataacctaccacaatcctattacaataactttgccttgatgaatcctacctgtctcaagacaagcttaaattccaattcacacctgcctctaaaatctcacttgctgcaccatttaattggtaactgatcaagctccacgatctatgtagctatttaatttgtcctgagtttatcattcagtgggaactgagccgactacctgcttgtgtctacatctagcacacagctttacacatagaaaacatttactaaatatt

SEQ ID NO: 83115 - DNA, 601 bp, Human
cctgagggcacctgcaaaagagaaactcaaagaagagtttgaaatctgtggaaagaggcaaaacacatgagggagccaagtcctacagtggtaaataacagatcttttatgtaacaaccgcattttaaggaacacccaccacttgacagccctgtcaccatctccgaaaggcagctgggaccaccagaagccctgggaccgaggtctgcaaatggattctgaagctcttctctagaagctgtgattctatgagtctggggtagggtaacaaagctgcctctaaacaaacacctgaagtgaktcccagcttctggcaagttaagagcacttgatagtaaatccaggttggtattaataacttccccctctctaaatccactgctctatccaagtgctaattatttttcctttgcaatacctcctgcccctgcctcttccttctcatcccacaaacccaacgctggtcatccttctgcaatatctaaaacctaaactgcagcaacaagcttctcgcctggccttggcctccagtccatctggcccctcacattaggaccaactctttgcaaacataactgttattggatgcagggtttccttt

SEQ ID NO: 83116 - DNA, 601 bp, Human
aagtctcactaccatgtccccccaccctctgcatcattctaacattgtttcttaattgtcttaattatatttagcactacatgaaataatcttagtaacttcttttttatctttctccctcccccacccaaactgcaagctctgtgagagctagggtctcatctggggggtgctcattactctaccctccacatttggaactggactaggaacctagttgtagccccaaatgaaaagaaaaacaaatgaatcccactcaatgaaatgccacaaaagcccaattcaatccccatgactttggcaaacctttccgtggctacttctgtgacctgtgatctttttctcttctttatactatagtactttgggtctacatcaggctctgcaaccttttacctgccaggtactgttcacagaagcccattcccactggtgctgtatagagatagggcagcatggaaatcacccacgacatccacggctatgaagccagccctttgtcccacactgagcagcaggacactgtgactgggaactgcagcagagtccatacaacctttaaggcataagtgcactctagcagctttttatgcattggatt

SEQ ID NO: 83117 - DNA, 601 bp, Human
cccattgtctcagttcctatcatgatgttttctaaaggactcttaattttccaatcatctgactcaaagctggatacattctcaccctgaaagctcttcttttcttaaattggttttaaagatatgcacatcaataccctaagagaatgttacattttacctgtttcaaaaaaataaataatctgtcagatattatgttttctttagaaaacaatttagacattattatttatggaattttacacacaagttaatcctgtttcaaaacaaagtggtttgtttcattattcaaattttgttkcgctgttctgaaatttcagtattgccattattagcacacatagtttaaaacaacagtgaagaataatccttatgtaatagaatagttaaaaaatattaatgaaacaaatattgttgaattattttaccaaatcaacaaacttctacaccttttcttccttttaataatataaattttctcatttttcctgctatatttgacaaacttagaatttgttcattcacaatatttattgtctattcctcacctactatgattaaaaatgagaccactactatcactactatgaatagaaaaagt

SEQ ID NO: 83118 - DNA, 601 bp, Human
ttttactctttaactccaagtattgctcagcttataacagatgtattatgaaacatggcaagaagcactgcaacaagaagagggtgaaaaaatttggtacttgatcatttgatatattcagacccaaaactatcaaacagggttcccaccaccagattgatccccacccaatccccacacccaaagatttcaaagacaaatgtttaaaacatacaatagaacaggcactagaagaaggaagaaaaaagaaaatctttacaattataatttattggaaaaaatagattgatttttctggtaygtaagtaaattgcaaaatcaaaatatttgtctgttccttaccttgacaatattcaaagttcccttttttccggcagtcacctattactaaactcagtgctctccaagtgtttcttttgacagatatcattctccaccaatcgctctgctaatttcctctctccttttctgactgggacagagattatgttcaccagcccagagatcaatcttttctattgacaacaacaaagggaaaaaaaatgcatatatcacaaccagtctgaagtatcatacccatctgtttacatgataacactag

SEQ ID NO: 83119 - DNA, 601 bp, Human
ctagttaggaatattggctgtggcttaaaatatatttatatgttttcttttttcatatttatactgatgttgaaaagagaaatactctaaaagaaatgcagcaggctgatacataaataaacacgcacatgcctgaggatacacataacacttatggcagagctacttacgctgtgcataatagatcacgatgatgccagctccatcacaaggcgcaccaggctaatgcaattatttaaattattatatatgttttactggagtggtaaacaaatatataaaatattgacattacttccaagtgatatgcaaaacaagtttttaaaataattcccaccaaaatcttccctgcaaagcccaatctctattctttgcaaaggacagaatcaattccttggagctgtgcttatgcactaggcaaaggtatatactgctctctttacatgcccataactcctattaacattaatgggaggcacatatgtgcatctaaagggtaaatgcccttcagtctgcatgacagaatcctaatgaagtagttggaaaaaccaaatcactgcacatgtagtcacactttcccctgcctttgcaggaaacacca

SEQ ID NO: 83120 - DNA, 601 bp, Human
tatgcacacatactaatctgccacgtttataaacaattcaaagttactcaaaaatgaattttagttacaatgaattctattacaaatgttcactccaaaactgctctatttgttcaaataatacccagcatagtatatttgcttttatatcaatgtaaatttttaaattaatgttttacagtgaccctacagggttttaccaggcaaaagagaatttaatgctgtatatgttgaaatacactcaagaatggttaaagcctataaatctcaatgcaattcccttactctatatggaaatttytactcttactttcatttattaaaattctccttaactgcatataccataatcttattaaaattatggattattgtaccttttttacccattatacctaaatgtccttttttcattcctattgataaattgacacaagtccacaattagttatatgttttcccttcactttccagagtaattcactgcctccgattctcttctctcacagattgtttttcttgcatttcagtccacacttactgagcaccctcagtgcaagtctccaaacccaaattctttcatttctgacaccacctgcaa

SEQ ID NO: 83121 - DNA, 601 bp, Human
tactttcaatgcattgaaagaactgaacaaatgacacataaatgttttgacctagataggaattaaactattttacacagcaacaaaaataaaacaaaagatttccctatagttcagagaaattgtctaaagagtgttcttttcattaacaaggattaaaacactttcaacaaaatccaccaggtggagcaaatacacagcaataaaaaaaaaaatcccagaatttttttcatcatattttctttcacaggactttcatctctaataaattctccacttatatctctccacattgcaaattatcaaaatctatgcacacatactaatctgccacgtttataaacaattcaaagttactcaaaaatgaattttagttacaatgaattctattacaaatgttcactccaaaactgctctatttgttcaaataatacccagcatagtatatttgcttttatatcaatgtaaatttttaaattaatgttttacagtgaccctacagggttttaccaggcaaaagagaatttaatgctgtatatgttgaaatacactcaagaatggttaaagcctataaatctcaatgcaattcccttactctata

SEQ ID NO: 83122 - DNA, 601 bp, Human
ccctcctctcagcaacagagacaaaaacctgcagctctgctctgtgcaggcagccatctggacagctttccctcaaagcccagcccacaccacactgcaggcaaaatcggagggctcgagagctctgtggggctattcatgacataccaatttcacattttctgcttgtacgcttgcaacaataaatgctaatgaggactatgaatgacaattttaaagacaataaaaaggtctccaaatcccttgcatatggagacactgttttcaaaacttcaccttctgttacagagctgtgagagamtgcaggagaaaaaaagaataacctaaggaaaacaataagatgatcaaagcacaactgaatccttaagattttcagagaaagcaatctgtgtgagcccagcaaacaacagatcttaccaccgctatgaacaaccctatgaatacatgagatacctttaatctcactacctttgccttctgtagacatgcagcttaataaaagcaattcttgatgaacttgattatattcattattttggagcctgggaattctaaggatagtatttgtccaaaaataattatagtaataatcatcatcatc

SEQ ID NO: 83123 - DNA, 601 bp, Human
caaaaatgaagtctgtttaagacaaaatatcacactgaaagtaaacaaaatctatatctgtaattattacaaattgtttctgatagtgccaatgcctttaaaatatgacaatatattgtagttcatttccaccaacttattttcaacgtctaatattttaaaattttttgaaatgctataacagcttttaacacttgcactgattaaattttatgctatttaaacacaaattttaaacatactataataatacagttaaaggtagattcctacataggcactagcaaggggttaaattatrttaaaattttttaagtaaaacacttccttattaatccacaagctgaacactagctatgttaactgctgttttttttcaagtaaaagcatttcccataaaacaattcctaaaaactatacatttgcaatgtaaatctgcaaataagttaccatttacagttttctcatattttgtacagctacaaaaatcactcaggtaacatggaagacatcctaactacccatctcttattcatttgacaaggactgtaacactatatagaaaacctttgtttcaatgtcaccacctcctcatcttgac

SEQ ID NO: 83124 - DNA, 601 bp, Human
gggatagagggggaaagaaaaaactaagtgaaaaagttcattgaagtattccatcaaggttaagaggttatctgtcattttagctcccttacataaatgtctgttgtaaacaactaaacacatttacgctattccctcaaatatttcctttgggggaaatgattggcaagcatttgcacctcctcaactttcagccagcccgcagaactcacaagaactttgcttagatgacaaaagaacaggagacattattgccatcttaagaatttgaagggtgtataaacatcatgaggttaaaggkttatttagggctgtccaagagagcctaagtgctagcaatgagatggagtcaagtaaaagaaaacatgctggatagaggaaacctatcttaataggtgattatacagacattacagacgcggaaaagctttactgcctcaatcacatgcaactagtcagacaaagcactatagaacacagtggcccatggaggacatgctgtaggtctgtttagaaatcctcatctaccagggcaagtggcaggctgagagctagaagtcacaacccctagccttcacctatgacttatgtaaaactcatg

SEQ ID NO: 83125 - DNA, 601 bp, Human
aaagataaatccaattatactttgtctgcaaaaaaacacaaatggtttatgttttagttaggctacaatgtaagatacagctaaccacaagaaataagtgggatagagggggaaagaaaaaactaagtgaaaaagttcattgaagtattccatcaaggttaagaggttatctgtcattttagctcccttacataaatgtctgttgtaaacaactaaacacatttacgctattccctcaaatatttcctttgggggaaatgattggcaagcatttgcacctcctcaactttcagccagcccrcagaactcacaagaactttgcttagatgacaaaagaacaggagacattattgccatcttaagaatttgaagggtgtataaacatcatgaggttaaagggttatttagggctgtccaagagagcctaagtgctagcaatgagatggagtcaagtaaaagaaaacatgctggatagaggaaacctatcttaataggtgattatacagacattacagacgcggaaaagctttactgcctcaatcacatgcaactagtcagacaaagcactatagaacacagtggcccatggaggacatgctgt

SEQ ID NO: 83126 - DNA, 601 bp, Human
aacctttcatcaatatgcatggtgaatcacttctaaaatagaaaatcatatgacaaaatgcaatacacttttgagaaaactggatgatatccggctttaaaatggggtcttaatatcggtacactgcaagtccctaaaccgcagctcagacaattgaacttccatatgctgtgtgattatgtatcttttctatgtgtaaaaaggctttttaagctgttatctgactacagtaattgccactttaaattgatccacatcaacaaaacctggatccctggagattctcacctagaagtctgaytgcagcggggcctagctgaatgtgtgtgcatctgagactagttcagcattttctcaagaaaccagtttcctcctcttattctttaatccatggaggcaagaaaagcagaaccccatttggcagttctccctgaatagggaaacctggatatgtagttctacacagttactcagacagaataacttttcgttcataaaaataaataaataaataaataaaaggaggatatggagccaagatctctaacatccaaattgtataataaaaatagacaatcaataacatgatgaatgcatttat

SEQ ID NO: 83127 - DNA, 601 bp, Human
gtcagatggatttccacactacttgctatctccaaaaatttctgaaaacagaggcaataactctgacttctacctactcaatcttcctacacctcttcccaagagtgcacacaacctgtttcaaagcatacccacacacactctccgcacaaactaaaaatatattctcttgataaacagtgtcaatcaataagaacttctacagcccctaaatactgtacccaagaagggctgctttatccagcgaacccctcaaaaatccatcattgtcagagacaacttgtaaaaagaccacaattcrtaacgattactctgttctgtcactaatagtatactgcaccctatttatgaggccaatctttttgttcatcttagttagatgtcacttgtaatgaggttctctgtaatggatttcagtacagttaagcaccaagctcaaacattcttatgatagaaagctttatagcaggcatgagtgtgataatcaattaagtcctgctataagggcctttatggaatccagcatcctaaattagtagactttcatttttaaagagagtatttttgaaaagccacttaatgctacatgccactgattttt

SEQ ID NO: 83128 - DNA, 601 bp, Human; identical to SEQ ID NO: 47991

SEQ ID NO: 83129 - DNA, 601 bp, Human; identical to SEQ ID NO: 47992

SEQ ID NO: 83130 - DNA, 601 bp, Human; identical to SEQ ID NO: 47993

SEQ ID NO: 83131 - DNA, 601 bp, Human; identical to SEQ ID NO: 47994

SEQ ID NO: 83132 - DNA, 601 bp, Human; identical to SEQ ID NO: 47995

SEQ ID NO: 83133 - DNA, 601 bp, Human; identical to SEQ ID NO: 47996

SEQ ID NO: 83134 - DNA, 601 bp, Human; identical to SEQ ID NO: 47997

SEQ ID NO: 83135 - DNA, 601 bp, Human; identical to SEQ ID NO: 47998

SEQ ID NO: 83136 - DNA, 601 bp, Human; identical to SEQ ID NO: 47999

SEQ ID NO: 83137 - DNA, 601 bp, Human; identical to SEQ ID NO: 48000

SEQ ID NO: 83138 - DNA, 601 bp, Human; identical to SEQ ID NO: 48001

SEQ ID NO: 83139 - DNA, 601 bp, Human; identical to SEQ ID NO: 48002

SEQ ID NO: 83140 - DNA, 601 bp, Human; identical to SEQ ID NO: 48003

SEQ ID NO: 83141 - DNA, 601 bp, Human; identical to SEQ ID NO: 48004

SEQ ID NO: 83142 - DNA, 601 bp, Human; identical to SEQ ID NO: 48005

SEQ ID NO: 83143 - DNA, 601 bp, Human; identical to SEQ ID NO: 48006

SEQ ID NO: 83144 - DNA, 601 bp, Human; identical to SEQ ID NO: 48007

SEQ ID NO: 83145 - DNA, 601 bp, Human; identical to SEQ ID NO: 48008

SEQ ID NO: 83146 - DNA, 601 bp, Human; identical to SEQ ID NO: 48009

SEQ ID NO: 83147 - DNA, 601 bp, Human; identical to SEQ ID NO: 48010

SEQ ID NO: 83148 - DNA, 601 bp, Human; identical to SEQ ID NO: 48011

SEQ ID NO: 83149 - DNA, 601 bp, Human; identical to SEQ ID NO: 48012

SEQ ID NO: 83150 - DNA, 601 bp, Human; identical to SEQ ID NO: 48013

SEQ ID NO: 83151 - DNA, 601 bp, Human; identical to SEQ ID NO: 48014

SEQ ID NO: 83152 - DNA, 601 bp, Human; identical to SEQ ID NO: 48015

SEQ ID NO: 83153 - DNA, 601 bp, Human; identical to SEQ ID NO: 48016

SEQ ID NO: 83154 - DNA, 601 bp, Human; identical to SEQ ID NO: 48017

SEQ ID NO: 83155 - DNA, 601 bp, Human; identical to SEQ ID NO: 48018

SEQ ID NO: 83156 - DNA, 601 bp, Human; identical to SEQ ID NO: 48019

SEQ ID NO: 83157 - DNA, 601 bp, Human; identical to SEQ ID NO: 48020

SEQ ID NO: 83158 - DNA, 601 bp, Human; identical to SEQ ID NO: 48021

SEQ ID NO: 83159 - DNA, 601 bp, Human; identical to SEQ ID NO: 48022

SEQ ID NO: 83160 - DNA, 601 bp, Human; identical to SEQ ID NO: 48023

SEQ ID NO: 83161 - DNA, 601 bp, Human; identical to SEQ ID NO: 48024

SEQ ID NO: 83162 - DNA, 601 bp, Human; identical to SEQ ID NO: 48025

SEQ ID NO: 83163 - DNA, 601 bp, Human; identical to SEQ ID NO: 48026

SEQ ID NO: 83164 - DNA, 601 bp, Human; identical to SEQ ID NO: 48027

SEQ ID NO: 83165 - DNA, 601 bp, Human; identical to SEQ ID NO: 48028

SEQ ID NO: 83166 - DNA, 601 bp, Human; identical to SEQ ID NO: 48029

SEQ ID NO: 83167 - DNA, 601 bp, Human; identical to SEQ ID NO: 48030

SEQ ID NO: 83168 - DNA, 601 bp, Human; identical to SEQ ID NO: 48031

SEQ ID NO: 83169 - DNA, 601 bp, Human; identical to SEQ ID NO: 48032

SEQ ID NO: 83170 - DNA, 601 bp, Human; identical to SEQ ID NO: 48033

SEQ ID NO: 83171 - DNA, 601 bp, Human; identical to SEQ ID NO: 48034

SEQ ID NO: 83172 - DNA, 601 bp, Human; identical to SEQ ID NO: 48035

SEQ ID NO: 83173 - DNA, 601 bp, Human; identical to SEQ ID NO: 48036

SEQ ID NO: 83174 - DNA, 601 bp, Human; identical to SEQ ID NO: 48037

SEQ ID NO: 83175 - DNA, 601 bp, Human; identical to SEQ ID NO: 48038

SEQ ID NO: 83176 - DNA, 601 bp, Human; identical to SEQ ID NO: 48039

SEQ ID NO: 83177 - DNA, 601 bp, Human; identical to SEQ ID NO: 48040

SEQ ID NO: 83178 - DNA, 601 bp, Human; identical to SEQ ID NO: 48041

SEQ ID NO: 83179 - DNA, 601 bp, Human; identical to SEQ ID NO: 48042

SEQ ID NO: 83180 - DNA, 601 bp, Human; identical to SEQ ID NO: 48043

SEQ ID NO: 83181 - DNA, 601 bp, Human; identical to SEQ ID NO: 48044

SEQ ID NO: 83182 - DNA, 601 bp, Human; identical to SEQ ID NO: 48045

SEQ ID NO: 83183 - DNA, 601 bp, Human; identical to SEQ ID NO: 48046

SEQ ID NO: 83184 - DNA, 601 bp, Human; identical to SEQ ID NO: 48047

SEQ ID NO: 83185 - DNA, 601 bp, Human; identical to SEQ ID NO: 48048

SEQ ID NO: 83186 - DNA, 601 bp, Human; identical to SEQ ID NO: 48049

SEQ ID NO: 83187 - DNA, 601 bp, Human; identical to SEQ ID NO: 48050

SEQ ID NO: 83188 - DNA, 601 bp, Human; identical to SEQ ID NO: 48051

SEQ ID NO: 83189 - DNA, 601 bp, Human; identical to SEQ ID NO: 48052

SEQ ID NO: 83190 - DNA, 601 bp, Human; identical to SEQ ID NO: 48053

SEQ ID NO: 83191 - DNA, 601 bp, Human; identical to SEQ ID NO: 48054

SEQ ID NO: 83192 - DNA, 601 bp, Human; identical to SEQ ID NO: 48055

SEQ ID NO: 83193 - DNA, 601 bp, Human; identical to SEQ ID NO: 48056

SEQ ID NO: 83194 - DNA, 601 bp, Human; identical to SEQ ID NO: 48057

SEQ ID NO: 83195 - DNA, 601 bp, Human; identical to SEQ ID NO: 48058

SEQ ID NO: 83196 - DNA, 601 bp, Human; identical to SEQ ID NO: 48059

SEQ ID NO: 83197 - DNA, 601 bp, Human; identical to SEQ ID NO: 48060

SEQ ID NO: 83198 - DNA, 601 bp, Human; identical to SEQ ID NO: 48061

SEQ ID NO: 83199 - DNA, 601 bp, Human; identical to SEQ ID NO: 48062

SEQ ID NO: 83200 - DNA, 601 bp, Human; identical to SEQ ID NO: 48063

SEQ ID NO: 83201 - DNA, 601 bp, Human; identical to SEQ ID NO: 48064

SEQ ID NO: 83202 - DNA, 601 bp, Human; identical to SEQ ID NO: 48065

SEQ ID NO: 83203 - DNA, 601 bp, Human; identical to SEQ ID NO: 48066

SEQ ID NO: 83204 - DNA, 601 bp, Human; identical to SEQ ID NO: 48067

SEQ ID NO: 83205 - DNA, 601 bp, Human; identical to SEQ ID NO: 48068

SEQ ID NO: 83206 - DNA, 601 bp, Human; identical to SEQ ID NO: 48069

SEQ ID NO: 83207 - DNA, 601 bp, Human; identical to SEQ ID NO: 48070

SEQ ID NO: 83208 - DNA, 601 bp, Human; identical to SEQ ID NO: 48071

SEQ ID NO: 83209 - DNA, 601 bp, Human; identical to SEQ ID NO: 48072

SEQ ID NO: 83210 - DNA, 601 bp, Human; identical to SEQ ID NO: 83118

SEQ ID NO: 83211 - DNA, 601 bp, Human; identical to SEQ ID NO: 83119

SEQ ID NO: 83212 - DNA, 601 bp, Human; identical to SEQ ID NO: 83120

SEQ ID NO: 83213 - DNA, 601 bp, Human; identical to SEQ ID NO: 83121

SEQ ID NO: 83214 - DNA, 601 bp, Human; identical to SEQ ID NO: 83122

SEQ ID NO: 83215 - DNA, 601 bp, Human; identical to SEQ ID NO: 83123

SEQ ID NO: 83216 - DNA, 601 bp, Human; identical to SEQ ID NO: 83124

SEQ ID NO: 83217 - DNA, 601 bp, Human; identical to SEQ ID NO: 83125

SEQ ID NO: 83218 - DNA, 601 bp, Human; identical to SEQ ID NO: 83126

SEQ ID NO: 83219 - DNA, 601 bp, Human; identical to SEQ ID NO: 83127

SEQ ID NO: 83220 - DNA, 601 bp, Human; identical to SEQ ID NO: 47991

SEQ ID NO: 83221 - DNA, 601 bp, Human; identical to SEQ ID NO: 47992

SEQ ID NO: 83222 - DNA, 601 bp, Human; identical to SEQ ID NO: 47993

SEQ ID NO: 83223 - DNA, 601 bp, Human; identical to SEQ ID NO: 47994

SEQ ID NO: 83224 - DNA, 601 bp, Human; identical to SEQ ID NO: 47995

SEQ ID NO: 83225 - DNA, 601 bp, Human; identical to SEQ ID NO: 47996

SEQ ID NO: 83226 - DNA, 601 bp, Human; identical to SEQ ID NO: 47997

SEQ ID NO: 83227 - DNA, 601 bp, Human; identical to SEQ ID NO: 47998

SEQ ID NO: 83228 - DNA, 601 bp, Human; identical to SEQ ID NO: 47999

SEQ ID NO: 83229 - DNA, 601 bp, Human; identical to SEQ ID NO: 48000

SEQ ID NO: 83230 - DNA, 601 bp, Human; identical to SEQ ID NO: 48001

SEQ ID NO: 83231 - DNA, 601 bp, Human; identical to SEQ ID NO: 48002

SEQ ID NO: 83232 - DNA, 601 bp, Human; identical to SEQ ID NO: 48003

SEQ ID NO: 83233 - DNA, 601 bp, Human; identical to SEQ ID NO: 48004

SEQ ID NO: 83234 - DNA, 601 bp, Human; identical to SEQ ID NO: 48005

SEQ ID NO: 83235 - DNA, 601 bp, Human; identical to SEQ ID NO: 48006

SEQ ID NO: 83236 - DNA, 601 bp, Human; identical to SEQ ID NO: 48007

SEQ ID NO: 83237 - DNA, 601 bp, Human; identical to SEQ ID NO: 48008

SEQ ID NO: 83238 - DNA, 601 bp, Human; identical to SEQ ID NO: 48009

SEQ ID NO: 83239 - DNA, 601 bp, Human; identical to SEQ ID NO: 48010

SEQ ID NO: 83240 - DNA, 601 bp, Human; identical to SEQ ID NO: 48011

SEQ ID NO: 83241 - DNA, 601 bp, Human; identical to SEQ ID NO: 48012

SEQ ID NO: 83242 - DNA, 601 bp, Human; identical to SEQ ID NO: 48013

SEQ ID NO: 83243 - DNA, 601 bp, Human; identical to SEQ ID NO: 48014

SEQ ID NO: 83244 - DNA, 601 bp, Human; identical to SEQ ID NO: 48015

SEQ ID NO: 83245 - DNA, 601 bp, Human; identical to SEQ ID NO: 48016

SEQ ID NO: 83246 - DNA, 601 bp, Human; identical to SEQ ID NO: 48017

SEQ ID NO: 83247 - DNA, 601 bp, Human; identical to SEQ ID NO: 48018

SEQ ID NO: 83248 - DNA, 601 bp, Human; identical to SEQ ID NO: 48019

SEQ ID NO: 83249 - DNA, 601 bp, Human; identical to SEQ ID NO: 48020

SEQ ID NO: 83250 - DNA, 601 bp, Human; identical to SEQ ID NO: 48021

SEQ ID NO: 83251 - DNA, 601 bp, Human; identical to SEQ ID NO: 48022

SEQ ID NO: 83252 - DNA, 601 bp, Human; identical to SEQ ID NO: 48023

SEQ ID NO: 83253 - DNA, 601 bp, Human; identical to SEQ ID NO: 48024

SEQ ID NO: 83254 - DNA, 601 bp, Human; identical to SEQ ID NO: 48025

SEQ ID NO: 83255 - DNA, 601 bp, Human; identical to SEQ ID NO: 48026

SEQ ID NO: 83256 - DNA, 601 bp, Human; identical to SEQ ID NO: 48027

SEQ ID NO: 83257 - DNA, 601 bp, Human; identical to SEQ ID NO: 48028

SEQ ID NO: 83258 - DNA, 601 bp, Human; identical to SEQ ID NO: 48029

SEQ ID NO: 83259 - DNA, 601 bp, Human; identical to SEQ ID NO: 48030

SEQ ID NO: 83260 - DNA, 601 bp, Human; identical to SEQ ID NO: 48031

SEQ ID NO: 83261 - DNA, 601 bp, Human; identical to SEQ ID NO: 48032

SEQ ID NO: 83262 - DNA, 601 bp, Human; identical to SEQ ID NO: 48033

SEQ ID NO: 83263 - DNA, 601 bp, Human; identical to SEQ ID NO: 48034

SEQ ID NO: 83264 - DNA, 601 bp, Human; identical to SEQ ID NO: 48035

SEQ ID NO: 83265 - DNA, 601 bp, Human; identical to SEQ ID NO: 48036

SEQ ID NO: 83266 - DNA, 601 bp, Human; identical to SEQ ID NO: 48037

SEQ ID NO: 83267 - DNA, 601 bp, Human; identical to SEQ ID NO: 48038

SEQ ID NO: 83268 - DNA, 601 bp, Human; identical to SEQ ID NO: 48039

SEQ ID NO: 83269 - DNA, 601 bp, Human; identical to SEQ ID NO: 48040

SEQ ID NO: 83270 - DNA, 601 bp, Human; identical to SEQ ID NO: 48041

SEQ ID NO: 83271 - DNA, 601 bp, Human; identical to SEQ ID NO: 48042

SEQ ID NO: 83272 - DNA, 601 bp, Human; identical to SEQ ID NO: 48043

SEQ ID NO: 83273 - DNA, 601 bp, Human; identical to SEQ ID NO: 48044

SEQ ID NO: 83274 - DNA, 601 bp, Human; identical to SEQ ID NO: 48045

SEQ ID NO: 83275 - DNA, 601 bp, Human; identical to SEQ ID NO: 48046

SEQ ID NO: 83276 - DNA, 601 bp, Human; identical to SEQ ID NO: 48047

SEQ ID NO: 83277 - DNA, 601 bp, Human; identical to SEQ ID NO: 48048

SEQ ID NO: 83278 - DNA, 601 bp, Human; identical to SEQ ID NO: 48049

SEQ ID NO: 83279 - DNA, 601 bp, Human; identical to SEQ ID NO: 48050

SEQ ID NO: 83280 - DNA, 601 bp, Human; identical to SEQ ID NO: 48051

SEQ ID NO: 83281 - DNA, 601 bp, Human; identical to SEQ ID NO: 48052

SEQ ID NO: 83282 - DNA, 601 bp, Human; identical to SEQ ID NO: 48053

SEQ ID NO: 83283 - DNA, 601 bp, Human; identical to SEQ ID NO: 48054

SEQ ID NO: 83284 - DNA, 601 bp, Human; identical to SEQ ID NO: 48055

SEQ ID NO: 83285 - DNA, 601 bp, Human; identical to SEQ ID NO: 48056

SEQ ID NO: 83286 - DNA, 601 bp, Human; identical to SEQ ID NO: 48057

SEQ ID NO: 83287 - DNA, 601 bp, Human; identical to SEQ ID NO: 48058

SEQ ID NO: 83288 - DNA, 601 bp, Human; identical to SEQ ID NO: 48059

SEQ ID NO: 83289 - DNA, 601 bp, Human; identical to SEQ ID NO: 48060

SEQ ID NO: 83290 - DNA, 601 bp, Human; identical to SEQ ID NO: 48061

SEQ ID NO: 83291 - DNA, 601 bp, Human; identical to SEQ ID NO: 48062

SEQ ID NO: 83292 - DNA, 601 bp, Human; identical to SEQ ID NO: 48063

SEQ ID NO: 83293 - DNA, 601 bp, Human; identical to SEQ ID NO: 48064

SEQ ID NO: 83294 - DNA, 601 bp, Human; identical to SEQ ID NO: 48065

SEQ ID NO: 83295 - DNA, 601 bp, Human; identical to SEQ ID NO: 48066

SEQ ID NO: 83296 - DNA, 601 bp, Human; identical to SEQ ID NO: 48067

SEQ ID NO: 83297 - DNA, 601 bp, Human; identical to SEQ ID NO: 48068

SEQ ID NO: 83298 - DNA, 601 bp, Human; identical to SEQ ID NO: 48069

SEQ ID NO: 83299 - DNA, 601 bp, Human; identical to SEQ ID NO: 48070

SEQ ID NO: 83300 - DNA, 601 bp, Human; identical to SEQ ID NO: 48071

SEQ ID NO: 83301 - DNA, 601 bp, Human; identical to SEQ ID NO: 48072

SEQ ID NO: 83302 - DNA, 601 bp, Human
atgtcatggtattttgtgaatacaagtccttatattatttcttttctccaagcagtttacaatacttccccactaggtacatagctgtttaataagctgcaatttatggataaattaaagagcactttactacaagctacttttgtcatggtgacaccaaactgttgcaaaagcagaattgttttgttcaaatggagtgcgaaataaagtatcttttaagaaaccccaagtgtaaacttctgattgtgtagtgcctccttttcaaaactctaagaacaccttgaaatgcagcaggatttayatctgtcagtcattctgccagaatgttactgactgaagaaacatagaattcattagacacaatgagttaactcagagagtatacacttattctgttttgtcaggtaaagtgattattttcactgtacactgatgcttcaacaatgacactattattgatcaacataataaaattaggaacaaatatctctttattatatatctatattcatctatatgaataatattccttatatccatcacaattaaaattttctgtacatctgcaaagtcaatcttaataaacctgtaattttaataa

SEQ ID NO: 83303 - DNA, 601 bp, Human
taggaacagttatcaaaatcaaatatatactggcattttaaagaaatgctcaaaacgtttcaaaatatatgcctacaactataataaaatgacccagatatcactttcaaaagacactagaaagacctcaattctttgataattaaaaaaaatcctgcatattttgatgggtcaagggagaagctttgttttctttttcttttaatttgtttcaaacaaaattttaatgatgaaaatattatataaattcatatttgtacccataacaatgaaaataataaaaacaacagctccccccccmaaaaaaatcaatgccaatatcttcagcaatattttctttctcattaactttagaaattacccaaaccagttaaacaattgtgatgtttactaactttatgggaaatactgccatctattgaatttttagagcttgatcctccaatattacatggcactaaaccaactgcagtcacaagtgagtttacgttcttggcaatttactatcatttaagttctggagaaagttatgttagattaagctaacataatgatagcaaatttccaaaaactgaagctcacttgtggctgcagttggtgc

SEQ ID NO: 83304 - DNA, 601 bp, Human
ttaaacagaggaaaaaagagaaatggaaacatctagtatcatcttggaagactttaacatctctctcaataacagacgagcaaaaattctataaggatatagaaaattggaatggtacaaggaataaacttgaatgaaatttacatatgtagaatactaaacatgcagctgcagaatttatcttatttcaaagtgagtaggaacagttatcaaaatcaaatatatactggcattttaaagaaatgctcaaaacgtttcaaaatatatgcctacaactataataaaatgacccagatatcaytttcaaaagacactagaaagacctcaattctttgataattaaaaaaaatcctgcatattttgatgggtcaagggagaagctttgttttctttttcttttaatttgtttcaaacaaaattttaatgatgaaaatattatataaattcatatttgtacccataacaatgaaaataataaaaacaacagctccccccccaaaaaaaatcaatgccaatatcttcagcaatattttctttctcattaactttagaaattacccaaaccagttaaacaattgtgatgtttactaactttatggga

SEQ ID NO: 83305 - DNA, 601 bp, Human
aagagaaagatatcaaagccttcgatctgtgtgcatccaatagcatggtttaaaactgcatctaagaaaaattaaacagaggaaaaaagagaaatggaaacatctagtatcatcttggaagactttaacatctctctcaataacagacgagcaaaaattctataaggatatagaaaattggaatggtacaaggaataaacttgaatgaaatttacatatgtagaatactaaacatgcagctgcagaatttatcttatttcaaagtgagtaggaacagttatcaaaatcaaatatatactgkcattttaaagaaatgctcaaaacgtttcaaaatatatgcctacaactataataaaatgacccagatatcactttcaaaagacactagaaagacctcaattctttgataattaaaaaaaatcctgcatattttgatgggtcaagggagaagctttgttttctttttcttttaatttgtttcaaacaaaattttaatgatgaaaatattatataaattcatatttgtacccataacaatgaaaataataaaaacaacagctccccccccaaaaaaaatcaatgccaatatcttcagcaatat

SEQ ID NO: 83306 - DNA, 601 bp, Human
ctataggagacaaattagactttaaggtatggagtattattagaactatagacatatatttcacaataaaacaattttaatcaagagaaagatatcaaagccttcgatctgtgtgcatccaatagcatggtttaaaactgcatctaagaaaaattaaacagaggaaaaaagagaaatggaaacatctagtatcatcttggaagactttaacatctctctcaataacagacgagcaaaaattctataaggatatagaaaattggaatggtacaaggaataaacttgaatgaaatttacataygtagaatactaaacatgcagctgcagaatttatcttatttcaaagtgagtaggaacagttatcaaaatcaaatatatactggcattttaaagaaatgctcaaaacgtttcaaaatatatgcctacaactataataaaatgacccagatatcactttcaaaagacactagaaagacctcaattctttgataattaaaaaaaatcctgcatattttgatgggtcaagggagaagctttgttttctttttcttttaatttgtttcaaacaaaattttaatgatgaaaatattatataaattca

SEQ ID NO: 83307 - DNA, 601 bp, Human
aaaatattagctaagtggtcacaagaaacatttataaattaagaataaaaaattaagaacaataaagtttgaaagtacaattatagaaaacattataccacacaaaccataaccaaaaagaaatgaagaaaaaaaagaaacctctggaatagctataggagacaaattagactttaaggtatggagtattattagaactatagacatatatttcacaataaaacaattttaatcaagagaaagatatcaaagccttcgatctgtgtgcatccaatagcatggtttaaaactgcatctaagcaaaattaaacagaggaaaaaagagaaatggaaacatctagtatcatcttggaagactttaacatctctctcaataacagacgagcaaaaattctataaggatatagaaaattggaatggtacaaggaataaacttgaatgaaatttacatatgtagaatactaaacatgcagctgcagaatttatcttatttcaaagtgagtaggaacagttatcaaaatcaaatatatactggcattttaaagaaatgctcaaaacgtttcaaaatatatgcctacaactataataaaatgacccagat

SEQ ID NO: 83308 - DNA, 601 bp, Human
cttattataataaatacataataattttcaattatctttataaactaaatatcatgatgtaagataaaaatattgtgtttctatgaaggctaaatgaaaataaaataataatattactcatttaaagttaatttaataatttcatctttattttagagttcatcctttcaatttagccacatagaatacaaattgatagagaatacatctaattatcttccataatctttctatttaaacttaagtggaatgatctttcaaatctggatatgatggaggggtatatctaactctgtcatayaaaacaactctaaaagatgcatagtatatagaaaatgactgttttaaggcattgaaggcaattaatgtagggaactcaggatggagtatgattcttgagagaaagaaaccataacaaaacaaattttatatgcacatatactgagggtatttaaaaatatgtagtgctggttgaaagagtccaagcaaaaattgtgtagcttttggagacaggttggagttcagagctggcacaggggctgagaaattgaggacaaaagcacagagaagaagaaacctcaggtaagtgaggaaaaaaaca

SEQ ID NO: 83309 - DNA, 601 bp, Human
cacacacacacacacacacacacacacacacaaagtattctgagattttcctgcatttaagagacttaagctgaatattgattattaagcattgtggttggctctacgtgcaatgttttttaaaacataaataaagtaaatttaagtactactgccatttgaatgccataaataaaaagggcaattttcctctatcagaatctttactgttctaagaaatatctttaaaatcgtttaacccaatacattctgtttctatgtgtcaacatgcactataggaaagctgattattctatagaawgttttttttttctctcaagtattatagtggaacactttctttgttttctctcactcttaatcataaataacacataaatgcttgaagaaagactattagaaattttaattgaaattcagtccactttttaagtattctttgaaggtgtgcaaattgatttgtaatgcctaactataagaatcaaattatttccaagaaatatatgcttattaccataaacatacctacctaaacaaaatattatgtaaaggaaaaggaattattctgtaactttattatagtacacaaccacatagatta

SEQ ID NO: 83310 - DNA, 601 bp, Human
tgtcatttacttgaataagtcattccctatgattaccccaaggccctatcttacaaaagctgtaataaatttaatcattacatttgttagaactatttactattttatagtatttacttgagaaagtgagatgcttctcagggaaaactgactgacatgtgagaggttagaaactatgatgtctgacttacagagtttgcctgtctttcctgataaaattaaccagacagtttttataatctccactttaaatgtttatgcaaatacagtttatgctgagaatgctaatttcaaattaaaccacacacacacacacacacacacacacacacacacaaagtattctgagattttcctgcatttaagagacttaagctgaatattgattattaagcattgtggttggctctacgtgcaatgttttttaaaacataaataaagtaaatttaagtactactgccatttgaatgccataaataaaaagggcaattttcctctatcagaatctttactgttctaagaaatatctttaaaatcgtttaacccaatacattctgtttctatgtgtcaacatgcactataggaaagctgattattctat

SEQ ID NO: 83311 - DNA, 601 bp, Human
ttgtcatttacttgaataagtcattccctatgattaccccaaggccctatcttacaaaagctgtaataaatttaatcattacatttgttagaactatttactattttatagtatttacttgagaaagtgagatgcttctcagggaaaactgactgacatgtgagaggttagaaactatgatgtctgacttacagagtttgcctgtctttcctgataaaattaaccagacagtttttataatctccactttaaatgtttatgcaaatacagtttatgctgagaatgctaatttcaaattaacacacacacacacacacacacacacacacacacacacaaagtattctgagattttcctgcatttaagagacttaagctgaatattgattattaagcattgtggttggctctacgtgcaatgttttttaaaacataaataaagtaaatttaagtactactgccatttgaatgccataaataaaaagggcaattttcctctatcagaatctttactgttctaagaaatatctttaaaatcgtttaacccaatacattctgtttctatgtgtcaacatgcactataggaaagctgattattcta

SEQ ID NO: 83312 - DNA, 601 bp, Human
tttgtcatttacttgaataagtcattccctatgattaccccaaggccctatcttacaaaagctgtaataaatttaatcattacatttgttagaactatttactattttatagtatttacttgagaaagtgagatgcttctcagggaaaactgactgacatgtgagaggttagaaactatgatgtctgacttacagagtttgcctgtctttcctgataaaattaaccagacagtttttataatctccactttaaatgtttatgcaaatacagtttatgctgagaatgctaatttcaaattacaacacacacacacacacacacacacacacacacacacaaagtattctgagattttcctgcatttaagagacttaagctgaatattgattattaagcattgtggttggctctacgtgcaatgttttttaaaacataaataaagtaaatttaagtactactgccatttgaatgccataaataaaaagggcaattttcctctatcagaatctttactgttctaagaaatatctttaaaatcgtttaacccaatacattctgtttctatgtgtcaacatgcactataggaaagctgattattct

SEQ ID NO: 83313 - DNA, 601 bp, Human
atcacaaaaagtgatattactaccaaaatatataattatcttcaaaatgctagttttgcttggattttcagtgtgtgaggcttagattttctgagatatgaggtagggcaatgtgcatttttcaattttaggcaccaaattgtttatagtatcaataaaatatatataaatatataaattataaatacataaataaaatatatataaattatgttctaactcattagaattttttttactttttaatttcttcaagtagtactagaataatttattctggttttaagactacataattttwcacagcttaggaatacagatctcactgtgtaacagctttgtatctggatgcaccatagttttgtatgccacatgtgatcttttcacataatttcttagactgcatcataatatactactgattatggaaaatacacttaaggaaggaagacatggtgggaataataaaagggcatttgtctcactgaggcttgtcccttttaatatactttcttttcctccaggacagcactgattctagttgctttttaaaagaccttgtgtctttactacagtaattttgtcatttacttgaataagt

SEQ ID NO: 83314 - DNA, 601 bp, Human
taaacatggcagggcgtggtggctcatgcctgtaatcctagcattttgggtggccaaggcaggtggatcacctgcagtcaggagttcaagatcagcctggccaacatgataaaaccctatctctactaaaagtacaaaaaattagctgggcatggtggagggcacctgtaatcccagctaatcaggaggctgaggcagaagaatcccttgaatccaggaggcggagggtgcagtgagccaagatcgcaccattgcactccagcctggtgaagaagagcgaaactccatctcaaaaaaaaartaaataaataaacataaaattaccatatgatctagcaattccgcttctggatatatacttaaaagcactgaaagtggggtgttacacccatattcacagccaccttactcatgatagccaaaaggtagaatcactccaaacatgcagcaacagaggaactgataaaatgcagtatacacattaaataaaatattaattatcattacaaaataagttaaaatttgatacatcttacagcctggatgaaccttgaaacattatgtttaccaaagttagccaggcacagaaagacaaatattg

SEQ ID NO: 83315 - DNA, 601 bp, Human
tcttatacatagaaagccatagggagtacacaaatacagacacacccccacatacaaacacacacaaacttttagaactaataaagtaattcagcaaagttacaagataatgaataattgcaaaagaaaataaagcaattccgttcttaataccataaaaatgataaaatatttaggaataaatctaacaaaaaatgtgtgcactgacaatgacaaaatattgtggaaataaattaaagacataaataaatgcaaactattataagttaacactgcaaaacacacacacacacacacaatgcaatcttttaaataggcaaagaactggaatagacatctctccaaaaaagataaaaaattaaaattaaaaaaaaagaagacaatgactagtgttggtgaggatgtggagaaattagaactcttgtgccctgttagtggagcagtgaaatggtatagccattgtggagaacagtatggaggcctctaaaaaaattaaacatggcagggcgtggtggctcatgcctgtaatcctagcattttgggtggccaaggcaggtggatcacctgcagtcaggagttcaagatcagcctggccaacatg

SEQ ID NO: 83316 - DNA, 601 bp, Human
cacagatgacatgatcttatacatagaaagccatagggagtacacaaatacagacacacccccacatacaaacacacacaaacttttagaactaataaagtaattcagcaaagttacaagataatgaataattgcaaaagaaaataaagcaattccgttcttaataccataaaaatgataaaatatttaggaataaatctaacaaaaaatgtgtgcactgacaatgacaaaatattgtggaaataaattaaagacataaataaatgcaaactattataagttaacactgcaaaacacacamacacacacacaatccaatcttttaaataggcaaagaactggaatagacatctctccaaaaaagataaaaaattaaaattaaaaaaaaagaagacaatgactagtgttggtgaggatgtggagaaattagaactcttgtgccctgttagtggagcagtgaaatggtatagccattgtggagaacagtatggaggcctctaaaaaaattaaacatggcagggcgtggtggctcatgcctgtaatcctagcattttgggtggccaaggcaggtggatcacctgcagtcaggagttcaagatca

SEQ ID NO: 83317 - DNA, 601 bp, Human
agaaaggtacatttgtccctgtggtttcaacatcaacatataaacttatggctcccaaatgaatagtcacttctactatatcctgagtttctgttaaaatattcaaaggatggtcatctccaactttacgctgggcatttacaatcttgcatctttttttaaaaaaggaaattgaaactatttggaaaatttaaaatgtagaacaatgaaaaaagaataaattgtttaaagtttacaacaaaagaaggacataggaaactgaatgaaccaaatatgaaggttaaacttcatgtaacactcmccatttgctgatacaaactatattgaaaacaaaacaaataaaaaacaagaaatgaaaaaactaaatgataattgtatttttaaaatatcaatttgataacaaaattaaattatctcctcacttccctaaaattgtttatgtccatgaaacttacaactgttaaataattatgtttagtattaaaaattactcaagttggctgtagcaaaggacatcccacaatgaagagatgtgttatctttagtaaattccagctatttaagccacatagaaacagtaatggtaatataacttttagaa

SEQ ID NO: 83318 - DNA, 601 bp, Human
ttgtttgtttgttttgttttgttttgttttttgacacggaatctcactctggctggagtggaatggtgcatcttggctcactgcaagctctgcctcctggcttcacaggattcttctgcctcaacctcctgagtagctgtgattacaggcccgcaccaccacacacagctaattttttgtatttttagtagagacagggtttcactatgttggccagactggtcttgaactcctgacctcgtgatccacctgtctctgccttccaaagtgctgggattacaggcatgagccacttcgcccrgcctgtttttaaagagactatccttttctcattgtgtattcttagcaaccttgttgaagatgattttactacctgtgtctggatttatttagaggctctactctgttccactggcctacatatctgtctgtatgccattaccatactattttaattactgcagcattttaaaatattttgaaatcagcaagtgtgttgcctccagctttgttcttctttttcaacattgttttgcttcttcagggcctttgtctttccacatatattttagaattgttctttgctctccctgtaaaaaaa

SEQ ID NO: 83319 - DNA, 601 bp, Human
atctagtatggttgtagcggaacatatttcatgtttttatcttataatttacttaaactttaaaaaacaaatttataactttcagtgtttactcttaagacccatctcaaatcatgtgttaaataaaagggtttgataatattttacccatggtggggtatggaaatcttaaaaatacacagtacttggttatgaaagtgttttatgtctcctataggcagggatacacttgtagtacacatagatacacactcaggaaaattatcagtacattcacagtaaattaatttttgaaaattcktatcctatcagaagctacaactttaagaggaaaataaaactgataggttttccacattcagaagttatagaaatgcatattttgataagtgaaaccaaaaagataatccaaaagatatttatgactgaaatgtacctgaacatgttgtactacaaatacgatatttaacgtaaacttaaaaaaagtcttctcttgaagaagcaggaagaggaagttgattgccaagaaacatgaagacagtatatacattgtgttgtaatatacacacggtatttcattcttagtttgcttccagttaaa

SEQ ID NO: 83320 - DNA, 601 bp, Human
taaatctagtatggttgtagcggaacatatttcatgtttttatcttataatttacttaaactttaaaaaacaaatttataactttcagtgtttactcttaagacccatctcaaatcatgtgttaaataaaagggtttgataatattttacccatggtggggtatggaaatcttaaaaatacacagtacttggttatgaaagtgttttatgtctcctataggcagggatacacttgtagtacacatagatacacactcaggaaaattatcagtacattcacagtaaattaatttttgaaaaktcttatcctatcagaagctacaactttaagaggaaaataaaactgataggttttccacattcagaagttatagaaatgcatattttgataagtgaaaccaaaaagataatccaaaagatatttatgactgaaatgtacctgaacatgttgtactacaaatacgatatttaacgtaaacttaaaaaaagtcttctcttgaagaagcaggaagaggaagttgattgccaagaaacatgaagacagtatatacattgtgttgtaatatacacacggtatttcattcttagtttgcttccagtt

SEQ ID NO: 83321 - DNA, 601 bp, Human
aggttctaaaattctattctcctaactaataagagaagagactcttcatgacctcttctttgtctgattcctatgcttcaccagcatccagattttagttccaagattgggtagatagggtcgatatcaacattttcatacataaaattgtcatcttaatcattaaataaaatggcctagaccaggaatagtgactgacatcattattaattttttgttttctggaaaagtatttaacttatattatggtattttgtcaaaacacaggaaaattgtatgaatttaagcagcgtttctccasctaggcttttgtattataatatgctttgtggcccttgtcagaggtctggcctggatgatggacagtctgtggaaaccggagtatatgcataagctttctcatcatatatttctctatacagaagaaagtaattcttattcattgtgtataattctaaggacactgatacaaataaatattacatgtttgctttctgtcatttgaacactggacaaataagtgcaaagatctttcatttcaaatagcttaagtatacattatattatacagaaagtatgcttattattatttatatataat

SEQ ID NO: 83322 - DNA, 601 bp, Human
ccgtatgagtcaattattcttagagtttagagaggttctaaaattctattctcctaactaataagagaagagactcttcatgacctcttctttgtctgattcctatgcttcaccagcatccagattttagttccaagattgggtagatagggtcgatatcaacattttcatacataaaattgtcatcttaatcattaaataaaatggcctagaccaggaatagtgactgacatcattattaattttttgttttctggaaaagtatttaacttatattatggtattttgtcaaaacacaggaaaattgtatgaatttaagcagcgtttctccagctaggcttttgtattataatatgctttgtggcccttgtcagaggtctggcctggatgatggacagtctgtggaaaccggagtatatgcataagctttctcatcatatatttctctatacagaagaaagtaattcttattcattgtgtataattctaaggacactgatacaaataaatattacatgtttgctttctgtcatttgaacactggacaaataagtgcaaagatctttcatttcaaatagcttaagtatacattatattatac

SEQ ID NO: 83323 - DNA, 601 bp, Human
ctctttctaacttgtaaagtagtactttctcctctaatattaatccatttcatattactatagttagttatcattttcccatcaatcgtttcccagccagatttacatattcaggactttttaattgtttctcattaatcacttctattattccttaaatcaccctattatattcttctctggaactatataaccattataaatacaaggatattgaaaatgctgtttagccaagttgccgtatgagtcaattattcttagagtttagagaggttctaaaattctattctcctaactaatmagagaagagactcttcatgacctcttctttgtctgattcctatgcttcaccagcatccagattttagttccaagattgggtagatagggtcgatatcaacattttcatacataaaattgtcatcttaatcattaaataaaatggcctagaccaggaatagtgactgacatcattattaattttttgttttctggaaaagtatttaacttatattatggtattttgtcaaaacacaggaaaattgtatgaatttaagcagcgtttctccagctaggcttttgtattataatatgctttgtg

SEQ ID NO: 83324 - DNA, 601 bp, Human
ttttttttctagtgaccacctccattcttataagtttagataatattgtgttatcaccatacaataaacagcaattaaaataaaatagactgtttccatcttctcccatttcacttaaatatttgtaacttttaatttttgtttacttttgtactcttagtaatgcttatagatctaatatttgacttattagctcggacttatattttttcattcttagttattactaataaattttttttaaacttacaatcctatgttcttaggaaaagaggtattgtttctacagtttttaaggcayatgtttacattctgataaactactctgatcctgatgttaatcacagtcagtgttcctgcctgtcattacccattagtacccacaagtatttcttggtaagatacattacttcccaataaaatatccttcaatccaccccccccaaagaaatataattatttattgtttctaaatacagaattttacattgatcccaattaaaggtgctaactaatatttaggtagattattccaactggtcagaagtttttttagtttcattttatttttaatgacacaataattatacatatttacggg

SEQ ID NO: 83325 - DNA, 601 bp, Human
gttttgttttactggaatggtgcttagaattgtcctgtgggtgctgagaaatgaagctgcttaatgttgcttaatatttgtattggcttattattttctgttaatcctactatattcgtttcctagggatgacataacaaattgccacaaacaggttgggttgtaacaacagaaattaccttgaagttctgaagtcactaagtcagaaatgtggcagaaccacaccctctctgggaactctagacaatccattcctcacttttttcagtttttgtggctgccctagcctgccccagaagamagatacccctacatgattggacactcaatttatattgtaattcaaccacttgcaggatgaaactctaggtttaatgtccagaaatcataattttgcagttataggtgatgaagatttcttccaggggaaacatagaagactttgggtactttatgcaaagtacccgtaggggcagtggcaagcagagctacagactcagagaggaaagtattgagccttacaagaatcagctcaaaatggattaaagacaatgtaagacctaaaacgataaatctactagaagaagaaattgaggggaaa

SEQ ID NO: 83326 - DNA, 601 bp, Human
tactactccagggtgggggtaaacattttgagggacttctttgccagaactgacggatggatggaaaccatgtggagccatgaaaaaaatgagtagattattttaggttgggacaggaatttagaagcagttgaattaacgcaactggaaatattttaacaacctcatttgtgaagaaaagctggtgaggctgaattgccggtacagggaaactgtgagaaaattatactcatttatttatgcctggatattttagagttatatatataatagaaattattgtattatttggttttacccmaaaaaaatggtatttatagtattagtattatagtgattatttttctattactgtaactctgggaaaactactcaagtacccatcttccacaccttttaaatagttgagtaaactattaaagttgtcttccacgctttcttagttaaaaaaaaaaatcccaggtgaggcacggtgcctcatgcttgtaatcccagcactttgggaggccgaggtgggcggatcacgaggtcaggaggtcgaccatcgtggctaacacggtgacaccctgtctttactaaaaatacaaaaattagccgggtg

SEQ ID NO: 83327 - DNA, 601 bp, Human
atataaaaggctgtgtgaaactaagatgaacggatgtagttttaaaagttaaaagctcccatggtgaggtgagtgaaggtgattcggagaccagtcttccattttaaactggatgaagtatccactgatgctggtcttcctgttaaagatctgtgagaaacagcagaatagagaattttcatttctatttatgccactgattttgtacaagcctgcttcaatctcaaagtgtctttttttggcaggaacagaatggtcattccctgcagagaaattgaggcattgtcctttacattaaggrtcaatatcatagtcaattcaggttgctataacagaataccatacactgggtggcttaagccaacatcaacgttcctttcagagctggtgtctggtaggcatcctctttctggtttacagacggcctcttacttgctgtatcctcacacaacagagaaaccatctctcccttgtctcttcttataaagacacaaatcccattcatgaaggtttcgctctaattacctaattatgtaccaaagacctcacctccaaataccatcatatcacactggggattagatttcaacatatgaatttt

SEQ ID NO: 83328 - DNA, 601 bp, Human
ggaatggaaaaccaaacattgtattttctcactcataagtgggagctaagctatgaggatgcaaaggcacaagaatgatacaatggactttggggacttgggggaaagggtgtgagggtgaggaataaacactacacattgggttcagtgtatactgatcaggtgatgggtgcaccaaaatattaaaaatcaccactaaataacatattcatgtaaccaaacatcacttgttccccaaaaacctattgaattttttttaaataggccaaaacagaaaacaagtagttgtatgactaaatgygttataattatgtttggcctaggggaaaaaatcattttatatcagataatatctttagctatgtgcttttggaccattcagccttcaaagtctaaagatatgttcatctatgaaagaatagagttgtcttagtcatctttatgtccccctgagttctcaagtatcatgtgtttatgacattgaacaataaaccattaatcaatctcagtgttctaatatcagcaatatataatgtgatacaatttcaaaatacaggttgtagacaaagacttttgattttaagcaagaatttgctttctg

SEQ ID NO: 83329 - DNA, 601 bp, Human
caaaataccaccatcattcttcacaaaactagaaaaaaaatcctaaaattcatatggaaccaaaagagagcctgcatagccaaagcaagactaagcaaaaagaacaaattctggaggcatcacattacctgacttcaaattatattataaggccatagtcaccaaaacagcatggtactggtataaaaaataggcacatagaccaaaggaacaaaatagataacccagaaataaagccaaatacagccaactgatctttgacaaagcaaacagaaatgtaaagtgggaaaaagatacccarttcaacaaattgtactgggataactggcaagccacaggtagaagaatgaaactggatcctcatttctcacccttatacaaaactcacctcaagatggatcaaagacttaaatctaaaacctgaaaccataaaatttctagaagataacattggaaaagtccttctagaaaatggcttagacaaagacttcatgaccaagaatcaaaaagcaaacacaacaaaaacaaagataaatagatggaacttaattaaagtaaaaaggttctgcacagtaaaagaaataatcagtagagtaaacag

SEQ ID NO: 83330 - DNA, 601 bp, Human
catgctcatagatggagtcaatcaatattgtaaaaatggccatactgccaaaagcaatctacaaattcaatgcagttcttaacaaaataccaccatcattcttcacaaaactagaaaaaaaatcctaaaattcatatggaaccaaaagagagcctgcatagccaaagcaagactaagcaaaaagaacaaattctggaggcatcacattacctgacttcaaattatattataaggccatagtcaccaaaacagcatggtactggtataaaaaataggcacatagaccaaaggaacaaaatasataacccagaaataaagccaaatacagccaactgatctttgacaaagcaaacagaaatgtaaagtgggaaaaagatacccagttcaacaaattgtactgggataactggcaagccacaggtagaagaatgaaactggatcctcatttctcacccttatacaaaactcacctcaagatggatcaaagacttaaatctaaaacctgaaaccataaaatttctagaagataacattggaaaagtccttctagaaaatggcttagacaaagacttcatgaccaagaatcaaaaagcaaacacaa

SEQ ID NO: 83331 - DNA, 601 bp, Human
aacacttctcttcaagtagcagaagtcctagccagagcagtcaaacgagagaaagaaataaaggacatccaattgataatgatgaagtcagattgttgctgtttggtgatgacatgatcctatacctagaaaatcctaaagactcatgcaaaaagctcctagaactggtaaatgaattaagaaaagtttcaggatacaaaaataatgtgcacaaatcagtagctctgctatacactaatagtgaccaagctgaaaatcaaatcaggaactcaacccctttataatagttgcaaaaacaaamaaaaaaaaaactcaggaatatatttaaccaagaagaagaaaaacctctacaaggaaaactacaaaacactgctgaaatacatcatagacaacataaacaaatggaaacatatcccatgctcatagatggagtcaatcaatattgtaaaaatggccatactgccaaaagcaatctacaaattcaatgcagttcttaacaaaataccaccatcattcttcacaaaactagaaaaaaaatcctaaaattcatatggaaccaaaagagagcctgcatagccaaagcaagactaagcaaaaagaa

SEQ ID NO: 83332 - DNA, 601 bp, Human
tattatgaacaactttatgcacataaaatagaaaaccaagagtagatggataaattcctggaaatatacaaccctcctagattaaacaaggaaaaaaatataaactctgaacagacaaataacaagcagtgagattgacagggtaattaaaaagttaccaacaacaaaaaaaagtccaggaccagacagattcatggctgaattatattagacattcaagcaaaaattggtaccaatcctattgacactattccacaagacagagaaggagaaaatcttccctaagtgattccatgaagcyagtatcattctaatactaaaaccaaaaggggacataacaaaaaaagaatactacagaccaatacacagacccggatgaacatatatgcatcagacccttatgaacacgatctaggacagttgtatatttccaggaatgtatccatctcctcttggttttctagtttactatgaacaaagttgttcacagtagcctagagttctcttttgtatgtctgtggtatcagttgtaatatctcctgttgcatttctaattgagcttgtttggatcttcttgcttctcttcttggttaatctcact

SEQ ID NO: 83333 - DNA, 601 bp, Human
gcacatagtcatcaggttatctaatgtcaagatgaaggaaagaatcttaagaaatgtgtggaaaaacaaacaaacaaaaacaccaggtaatctataaaggaaaacgtatcagattaacagatttctcaggagaaatcctacaagctagaagaaattgaggtcctatcattaacctgcttgaacaaaacacttctcagtcaagaattttttatccagcaaaactaagtttcataaatgaagggaaaatacagtctttttcagacaaacaaatgctgagagaatttaccactaccaagccagsactacaagaactgctaaaaggagatctaaatattgaaacaaattctcaaaatacaacaaaatagaatctccttaaagcataaatttcaaatgacctataaaacaacaacacaatgaaataaaccaaggtattcaggcaaaagatagtataatgaatataatagtaccttacatctcaatactaacattgaatgtaaatggccgaaatgctgcacttaaaagatacagaatggcagagtgcataaaaactcaccaaccaagtatctgctgtcttcaagagactcacctgacacaggactaa

SEQ ID NO: 83334 - DNA, 601 bp, Human
cccctgggaatataactccattggcctgggaaccacatccccatcctccacagcagccacagcaagacctgccaaagtctgagctcagaaaagcctaacagtgcccccatctgatggtctttctgtacctaccctggtagcccaggacaaagtacataatctcttgggagccgtatggctctgttgactgcctgatcctccctatacaatcgcaactgatgtgctcttgaaagcaccacctcctggctggaggtcaaccaacacaaaaccagcacacttaacaaaaatgcaaccaaggacmctcacagagtctacttcactcccctgctacctataatggagtaggtgctggtatccacagctgagagacctgaagatgggttacatgacaggactttttgaagacactccccagtatcagcccagagcctggtagctccactgggtggctagagctagaggagaaataacaataattgaagtttgactctcaggcagccccatccctagaggaaagggaagaacaccacatcaaggaaacatcctgtgggagaaaagaatctgaacaacagcctgagtcacacatcttccctctgacata

SEQ ID NO: 83335 - DNA, 601 bp, Human
cccacttccctggtgagctatgtgatgcagcagagaaagccataatccccctgggaatataactccattggcctgggaaccacatccccatcctccacagcagccacagcaagacctgccaaagtctgagctcagaaaagcctaacagtgcccccatctgatggtctttctgtacctaccctggtagcccaggacaaagtacataatctcttgggagccgtatggctctgttgactgcctgatcctccctatacaatcgcaactgatgtgctcttgaaagcaccacctcctggctggaggycaaccaacacaaaaccagcacacttaacaaaaatgcaaccaaggaccctcacagagtctacttcactcccctgctacctataatggagtaggtgctggtatccacagctgagagacctgaagatgggttacatgacaggactttttgaagacactccccagtatcagcccagagcctggtagctccactgggtggctagagctagaggagaaataacaataattgaagtttgactctcaggcagccccatccctagaggaaagggaagaacaccacatcaaggaaacatcctgtgggaga

SEQ ID NO: 83336 - DNA, 601 bp, Human
gctcaaatgatcctctcgcctcgaccttccaaagtgctaaaattacaggtgtgagccaaaacgcctgaccttggactcacctttagcttaacaaaaagtcacgcacctgaagtatagcttagattcactttacgaattatgattccctttgttaacattgggaatgcaatttaatacacaagccatgcattgagaaaataatctttctaaaaaaaagaaggtataatttctcacataaagtgagtattgtgcttatgtgcttaataggatggacagcacacatggcacatagatatttgcrgatactttttaacctcctgaatcaaaacttccatccaatgaagcaaaattaagctaaacctctgcacatgcaattataatgtttcttcctggtatttatgactctaagtaagtgagatatcagaaattgcattaatcttgagttctagaaatgctacaaaaccttattagaatttttttattcagaaccagcctgaccaacatggccaaactctgtctctactaaaaatccaaaaattagccaagcatggtggcacatgcctgtagtcccagatacttggaagactgaggcaggagaatc

SEQ ID NO: 83337 - DNA, 601 bp, Human
cccataggcaaaccttaactaatttcacactgacagataaatggatccattcatgcctcacccagtacaggagatcttgccaagttcccaatataacttataaatactggctataattttttatttctacaccgctctttgttctatcattcaacttctgtaccatttcatatctctagtaaatgttttaaagcaatgatgaaagtaaaaagaaaatgcattatattgaagtgagatgaaaatttattattcaaattagtacttcagggaccaaaaaacagacagaaaatttatgaccatrgtaaaaattcaatctcaataatgattacctttactcaaatattttcttccacagaaactactttaaacaaaccatgcaggtcatcatttggaactcagcttccctttgattaggtatacattcgtgataatcaatactcatattaaagtgtattagaaatgttatttttcatttcaataacagctcttcagtcctcagtggcacttattttcattatattctgtccatttcaccacaagaaattaatttaaaacttatgtaacagaaatccatttttacagtgacctacttagagaaata

SEQ ID NO: 83338 - DNA, 601 bp, Human
gtgtgaaataagcatcaaaatggtatcttcactaaacactactgtgaaagttgtatgatcaatgatcaataagatgtctcctagttatagattagagaaagtacaattaagttactgacagctcaaatttgctcagtggtctttattagccctctaactggacaagtcccataggcaaaccttaactaatttcacactgacagataaatggatccattcatgcctcacccagtacaggagatcttgccaagttcccaatataacttataaatactggctataattttttatttctacaccrctctttgttctatcattcaacttctgtaccatttcatatctctagtaaatgttttaaagcaatgatgaaagtaaaaagaaaatgcattatattgaagtgagatgaaaatttattattcaaattagtacttcagggaccaaaaaacagacagaaaatttatgaccatagtaaaaattcaatctcaataatgattacctttactcaaatattttcttccacagaaactactttaaacaaaccatgcaggtcatcatttggaactcagcttccctttgattaggtatacattcgtgataatca

SEQ ID NO: 83339 - DNA, 601 bp, Human
agtcacagattcttagccttgtttatttagaatgtaaagatcaattccaggaaaattatttctaaaatagacacagcatatatgtgaatattatatcaagccatagtaagataatcactccaggtttgaaaccaagcaaacctgttaatcacagctgtatcacttagcattgtgaccttaagagatttagtctctctgagctgtctccatgagtgaaatggagaaccatttacataataattttcttgtgatgattaagtgaagtgatatgtgaaaatcacttatgcttgagggttaaatsataggccttcatagaaaacagctatcacttgttttaaggcttctcaggaagacgtttttctccctttctttcttgggaagcttcagtctattttgataagacagttcatagattgtaagtactggttgtttctttctcctacgactgcactataaacacagtgggttatgaatagggttactactgaataaacaagagtctctatataaatagccagaacttcagcctgtttctgaaaattttgtcagaaaattaatttttaatttactgcttaattcacatagagcaatttttatttgg

SEQ ID NO: 83340 - DNA, 601 bp, Human
ggatgagggttgaactggttaggaaatgacagatgtcttatcatgtggaaaggacagcatcctttaacatgtagtcagtaggctttctggctattttattatctaatgttaacctgtctttaagaaattgtccatttttggttactgtaagaaaatcagcttctgtatctgaaatttggaggattcaaatttggaacttattattcagcttcaaagttgcctgcagcaactatcagaaaagctcagattgtagtgctatagatccctatgaaatatggcagagcatgtctcattttagaarttagatcaccttacaactgtcagtctggaagaaaataggttttgttttgttttgttttctgaaaatatgtagtctttttgccagagcaatctcctcttttttagccacttcacactgggctttctaacataagtgctaatatcagtggcttaatatttttagagttaaacattttaatttatatagttttaaattatgtttatatattagaaaaatggtaagcatactgctaggcatgcatctttagactcatgttatttgcttccgagtttcctaagctatctagctctctagggaaat

SEQ ID NO: 83341 - DNA, 601 bp, Human
ctacagaatagtgggaaatctgtatgtcactggggttcccaaagcataaagccatgctacagtaaaaccattgtacttaattcagattgagtctatactagaaaaaaaacaaaacccttcttataacatccctttcccagaggaaaaatgctgaggatgagggttgaactggttaggaaatgacagatgtcttatcatgtggaaaggacagcatcctttaacatgtagtcagtaggctttctggctattttattatctaatgttaacctgtctttaagaaattgtccatttttggttactstaagaaaatcagcttctgtatctgaaatttggaggattcaaatttggaacttattattcagcttcaaagttgcctgcagcaactatcagaaaagctcagattgtagtgctatagatccctatgaaatatggcagagcatgtctcattttagaaattagatcaccttacaactgtcagtctggaagaaaataggttttgttttgttttgttttctgaaaatatgtagtctttttgccagagcaatctcctcttttttagccacttcacactgggctttctaacataagtgctaatatcagt

SEQ ID NO: 83342 - DNA, 601 bp, Human
agttatattctaatttcatttaacacagtcatatctacctttatgattccagaagtattacggatatatatttttttatgttgtttcctgagcttaggtgtttatcacaatggaatattctgggtggaggtagaacaagagtcatcctcaactgtagatcacgtatgttacttgaagagagcctaaacctggctgttgaaattccaagaattattcttttactgtaagttctataagtgtttttgaaacttgagcagaggtattatattgacaaaataatcaatgtgcaattatacatttytctttctttcttttttcctaaactatcacacatatcaagtcattccaatgacttgatagtgtaagtaaggcaaaagcaaatgaaaaagcaagtctcccaattagaaggagaaccaaatgcccttgactcaaggatgaggcataagtgttctgtgatgccacttttccatcaccatgccagaattacagtaaggaggaaggcataagacttattcatgctatctgataatgagaaattatatctaatacactccgcttactctcctagatcctgatatcaaaaataaagattatgagagcc

SEQ ID NO: 83343 - DNA, 601 bp, Human
tcaaatgtgaagtattcttaatctctaatatattcatggtttttttcatgaatacatcaaaacatttcctaaatgtatgtataacctcttcgtacacttttaaagtgaggataattggtacttttggtctacttacgaatatgttaaaaaaactttattgttatgaagatggattcattttcttagagttatattctaatttcatttaacacagtcatatctacctttatgattccagaagtattacggatatatatttttttatgttgtttcctgagcttaggtgtttatcacaatggartattctgggtggaggtagaacaagagtcatcctcaactgtagatcacgtatgttacttgaagagagcctaaacctggctgttgaaattccaagaattattcttttactgtaagttctataagtgtttttgaaacttgagcagaggtattatattgacaaaataatcaatgtgcaattatacatttctctttctttcttttttcctaaactatcacacatatcaagtcattccaatgacttgatagtgtaagtaaggcaaaagcaaatgaaaaagcaagtctcccaattagaaggagaacc

SEQ ID NO: 83344 - DNA, 601 bp, Human
taacgtctggttattttgaagatgaaaataaccagaaatgattacaattgaactcactcatggattctttagagaacccctttaaaagtaattagtgaaaggttacttttacagagatattatggtgaaaaactaattcaaatggaagccacttgagctaattttgcagacaccaaaatccaagtagaatcaaaaacactgaagtagcctcatgactgctacataactaagggcaatagaagcatgcataaactacagtgcaataccacctcacacccactagaatggctataataaaaaracatatagtaacaaatgttggtggaaatatgaagaaataggaaaccctattgctgtcagaaatgtaaaacagtgcatccacattggaaaacaatctgctagttcatcaagtggctacacataagagttaccagcaatttcactcctaggcatatactcaagagaaatggaaacatttccacaactacttttacaccaatgcctacagcaatattattcctattaggaaaaaaatggaaaccagattaatgtttgtcaagtaaagaatggataaatatgtggtatatcaatacaatagaat

SEQ ID NO: 83345 - DNA, 601 bp, Human
tagaaaatacttgggtagcgtggtgatgttgaggttaaggttgacaaacaattgtacatggcaatgttcccaatgacattaacaggcaattaagccacggaatcggtgcatgcatttcatttctaaatacagtctcccaacatggctataaaatctttactagtgctctttctttctatacacctgtttatgattagaattaaattatattttagtaatgctcattgaggtgttctccaaggttgttttattaccacctaaaaactcagaaaattacaatttactgtactgctttacttcrtagatatagattaactcaaaccccatataaagtactgcacataataaaaatatacctatattttaccaagtaaatatataattaggatgttacttagtaaaaacaggaatttattttggtgatgactgcaaataacataattttcatgaatgcatgaactcatatatattcataaactacattctacttaattcaaatattatttggagtgaggtagtgaaaaaaaattaatctaaagcatggcttctgattgaaatgcttctggagttgattctcttttctgaagaattagctcaatgc

SEQ ID NO: 83346 - DNA, 601 bp, Human
tatcatttattaatatattctgcatgagttaattgaaagatactttaagataaagattataaagtacccaataccaacatactggaatagtagctaaaatacagaaaattttaagaggtaaaagaatgatgaacatagtcaaatgtcacaaagaaatgacggaaagataaaaggtaaaaagtattgataggttttggttattaggcagtcactgatgccttatttgtagttcctaacaaagagttggaatgaaaatatgcataatatgcattataccagggacacataaagggaaaattgygtgatagcatgtaagtttgaaggaaagtttattatccagtaagaatctcatagccattggagaagagctcatcccagctggcacatgatctcagccttttgagaccttaagtagagaacccagttgagcccacctggacttctgacctacagaaatcatattattatatgttacacaacaacagaaaactaattcgaattaccaaacagctgtattatagattgcacagagggaagatggtgttacccactgcagaaatgttctgtaggcctttacttagaaagtactttttcccaaaaa

SEQ ID NO: 83347 - DNA, 601 bp, Human
aactttagcatgaatgagaaacagatggaaggcctggtacaaccagggtcgctgggcctcaaccacagagtgtctgattcactagatctgggccaaggcctgaggatctgcattatttgttcccatggaacacactttgagagctactggtttggaatgtaaaatgctgaagaccttctccaggaaaaaatgaatctcagaatctcagatgagcagtgggtatggcactcgaggtgattcaaaaatataatgtgtagtcaggtttgagatccagatattgtgaaagatcactcagataacsgtgcaaatgatacagtctatggtactgtgatggttaattttatgtgtggacttgattgagccatggagtgctcagatatgtatagttacacattattctaggtgtttttggatgagattagcatttgcatcaggagactgagtaaagcagacagtctttcatattgttagtgggcctcattcaatcagttgaaggcctgactagaaccaaagtaattcccccccagtgacagagaattctcctgcttcacagttttgcatgagtttttctggttctatagcagtctgcctgccttcagac

SEQ ID NO: 83348 - DNA, 601 bp, Human
acaatatgcaatttttgttgtttcatttgtaaattctggaaatagcagaagctttcagacacattgaaagtttcaataaagtatcatctcccaaactttggctcttttggaaatttatctattatacaagcaatgaatgattagagtttccttttggtgaactgaccaggtcaaagaaatttttacatttagtgcacagaacaaggttaaataggatatttgcattaaatgaagaataaattgtgtagtgaatcatgaagttgttgagctggtatgatgggtggagaaactaggagcaaawtatatttatgtatttaacaaaatttactaaccacgttctatacaccaagacattcactaagtatttgacaatactatgatgaacaaagataagttagaccagatttctaaacttgacatggttacaagcccatagaggtgaaaaaatactacaatgaaatgcaataagtgttatacttaatgcatgcagaacatttaactgtggaagaaaagaaactgtacatttgtctaagttgttgaaaaacttttacagttgtgacatttgaaacagttcttaccagtaaataactttggaaagcag

SEQ ID NO: 83349 - DNA, 601 bp, Human
gttatatggcaatggattgatacatatatgtatacacaatattcctgaaaagcattttgtttgattacttttgatcattggttaaggcaatactgatttctttctgtgctattcccttcgcgagctaagtaaaagtgctaattaggatctctttgtgtgctaagggaaattggtaatacaaacacatttgtggaagacaaattgcatacatcaaaataagcacattgataataataaaataatgtttataagctacagggtcttaaaaatactcactccgaggtgacgggtttttatattsttagatgcagctgctaaccaaaaataacttcatattaaagggcaacaaggaatacactcacaaacactaaatttcatttctattatctgacattaacagttggattacatttgaaatttgtggattctagtctttggatatgtttgcatgagagtcgagaaaaaaataactaaaaagactcaatgaataaagaaaacacaaacattggtttgtggactcttatgtccacaagtgaaaaagagagctgaagcaatgtatacaatatgcaatttttgttgtttcatttgtaaattctggaaa

SEQ ID NO: 83350 - DNA, 601 bp, Human
gtttattgatgttttctgttactacattatgaagtaatctgttatatggcaatggattgatacatatatgtatacacaatattcctgaaaagcattttgtttgattacttttgatcattggttaaggcaatactgatttctttctgtgctattcccttcgcgagctaagtaaaagtgctaattaggatctctttgtgtgctaagggaaattggtaatacaaacacatttgtggaagacaaattgcatacatcaaaataagcacattgataataataaaataatgtttataagctacagggwcttaaaaatactcactccgaggtgacgggtttttatattgttagatgcagctgctaaccaaaaataacttcatattaaagggcaacaaggaatacactcacaaacactaaatttcatttctattatctgacattaacagttggattacatttgaaatttgtggattctagtctttggatatgtttgcatgagagtcgagaaaaaaataactaaaaagactcaatgaataaagaaaacacaaacattggtttgtggactcttatgtccacaagtgaaaaagagagctgaagcaatgtatac

SEQ ID NO: 83351 - DNA, 601 bp, Human
gtgatgtattctgaggcattaaatttgtagccaatgtatttttttgggtctttttttttaaatgttagacttccatttgacaacatttttctaatgcatcattctaacaaagttctttccaatgaacttttagtaacaacataaactttatcaatgtattgcttctattgaaatactaaatattataaattattgaaaatattccgcatttatgcttgtcactgggttgttgacaccaagatgatctgaagcaatagttaagaagtaccttatacataatttctgatgattaacatttttwtattttcatttcctttacccagaactaaggtgaaaacagaagacattccttatctttaactttcgacaagatatgtgtatatgtgtgagtgcctgggtttgtatcttggttcattcattatgagtgtcatattttcatttatttggaagtatttgatttgacttagtagtatgtagtatcacttatgttttaaaaggaacattatgacagctgggtgaataacaagaagtctaagattaagacccaaagcccaaaggaagctaaggttaggacccaaagaaagctcttaaaataccccag

SEQ ID NO: 83352 - DNA, 601 bp, Human
atgtttccataaactcgaacatggtattttgtttgacaatcccacacctggctatttacccaagacaagttaaaatgtgtgttctcacacacacacacacacacacacacacacaaacaaaattgggctgggcacggtagctcacacctgtaatcccagcacttagggaggctggcgtgggtggatcagctgagatcaggagttcgagaccagtctggccaacatggtgaaagcctgtctctattaaaaacaaatgcaaaaattagccaggtgtggcttcctgaaaataatgactcataarcttgactcataaacttgactcattaacgcaaaagcttcctgaaaagaatgactcaaaggtgtccacagtatctacttgtcattctcattacatttgaaaaaggcaaaactataggtagttaccaggacttggaggtgagagaagagaaatccctttaacttttgtggacgaaggttgtggaaagtgactagatgcctctgcaaaattcattatactttacacattaaaatggtaattttactatgtaaattgctctccatgaaagctgacttgttaacaagagtgatgtattctgaggca

SEQ ID NO: 83353 - DNA, 601 bp, Human
tctttgaaaaactcactaaatacagcgttcattaagaaaatgaaaagataagacaaaaatatgtgaatatattcaaaaaaatgaacatctgattaactcatatatctgcatatattaaaatctcaaattcaaacaataaaaatctaaataactttataaaattttgcaaaatcctgaacagaaaatccaccaaagaagaaaatgcagatggcacatgaaaatattttcaacatcatttctctgtggtgaaatgcaaataaaaaccacaataagatgtcactacatacttattagaatgacrgggaaaaataccctggcaacacatgcggaagacgtgaagcaactgctgatggtaatgcaaagttgtatagccagtttggaaagcaatttggcatgtttccataaactcgaacatggtattttgtttgacaatcccacacctggctatttacccaagacaagttaaaatgtgtgttctcacacacacacacacacacacacacacacaaacaaaattgggctgggcacggtagctcacacctgtaatcccagcacttagggaggctggcgtgggtggatcagctgagatcaggagttcgag

SEQ ID NO: 83354 - DNA, 601 bp, Human
aagaaaaatgtaggagaactcacactatctgattttgtgtcattataaaactatagcaatcatagcaccgtagtattagtatatacattgtcagtggtaccaatgagagcccagaaattgataaatacacaaatgctcaagggtttatggacaaactagccataacaattaattgagaaaatgatagcattaagacaaatggtggatccattgtaaattcatattaaagaaaattaaacttgactcttaccactcatcatatataaaacatggcccaaaggaaaccatagatataaatatraaacctcaaagtttaaatatataaaactaataaaggaaatttttgttaccttttgtttggcaaagaattattcgaaaaaaacacaaaagaaaaaacataaaaaagccaataaattgtaattttctttttttattttattattattatactttaagttttagtgtacatgtgcacaatgtgcaggtttgttacatatgtatacatgtgccatgttggtgtgctgcacccattaactcgtcatttagcattaggtatatctcccagtgctatccctcccccttccccctaccccacaacagt

SEQ ID NO: 83355 - DNA, 601 bp, Human
tgttctaaaataacccaaacaatttcaaaaaggaggaagaaaaatgtaggagaactcacactatctgattttgtgtcattataaaactatagcaatcatagcaccgtagtattagtatatacattgtcagtggtaccaatgagagcccagaaattgataaatacacaaatgctcaagggtttatggacaaactagccataacaattaattgagaaaatgatagcattaagacaaatggtggatccattgtaaattcatattaaagaaaattaaacttgactcttaccactcatcatatatraaacatggcccaaaggaaaccatagatataaatataaaacctcaaagtttaaatatataaaactaataaaggaaatttttgttaccttttgtttggcaaagaattattcgaaaaaaacacaaaagaaaaaacataaaaaagccaataaattgtaattttctttttttattttattattattatactttaagttttagtgtacatgtgcacaatgtgcaggtttgttacatatgtatacatgtgccatgttggtgtgctgcacccattaactcgtcatttagcattaggtatatctcccag

SEQ ID NO: 83356 - DNA, 601 bp, Human
tgtttgtatgctgaattctacatatgttgctttgagaaatgtttaaaagacctagataactgaaaacatactgtgtttactcatggataaaatgctcaatgttgttcattgaggtgtccatgctcccaaattgaaacttagattcagtgtaataccaaccaaaaatccgatattgttgaataatttgataagctgattctaaaagttatatgcaacaaaaactgttctaaaataacccaaacaatttcaaaaaggaggaagaaaaatgtaggagaactcacactatctgattttgtgtcaytataaaactatagcaatcatagcaccgtagtattagtatatacattgtcagtggtaccaatgagagcccagaaattgataaatacacaaatgctcaagggtttatggacaaactagccataacaattaattgagaaaatgatagcattaagacaaatggtggatccattgtaaattcatattaaagaaaattaaacttgactcttaccactcatcatatataaaacatggcccaaaggaaaccatagatataaatataaaacctcaaagtttaaatatataaaactaataaaggaaattt

SEQ ID NO: 83357 - DNA, 601 bp, Human
ctgagaacagatttgttgctgttcggggttaacaccaccattcttgtaaagataacacactgagttatttatgaagctatttatgaagcccaaaattgattgattctaagtgagggaagaacttgaagattctttcaaaacactaagcgtggcaacacttctaattctataaaattacctgagattttataattgcctaactgttctccttaattggaacataattttagcaaatctcttttatgaagtcttgggaaactttcaacttaaagtacgttacacaaattctgaatccattctrtgcgtatatcccattattttgtttaatatttaaataaactacataattacaataagaagtttgactggtttggaaatagaacttaaaaaaaaaatccaccttagtcaggaaagagcaactgattaaaactggcctgccatcacaaaggatcgtaaaatggaataaaatatataaaaaagaaaatagataatgctaagaatgctctctgggagaagagacttacataatctgagccccaggactatctcaggctttgataatacattcattatgaccaagtgagggatatcctaggaaaag

SEQ ID NO: 83358 - DNA, 601 bp, Human
tacaaagtcaaagtaatttacctctagttgaaagtaattacattgagagaatgtaagaaattgtattgattataaagtaaacgaaaaatatgtattctattcttgtgaaaatgtcacaattggcccactcaattatataagaaaatctaccaaatataacatttattttctactttttgtaataattcagttttaacatgttttttctatcttggcctatttgtgtataacgcctgtgaacttttctatcttttatctttatagagtatataggatttaccttgtgatgaacttttatgcygtcttttgcatttataattacaatcatatttttaatgctgcttagaactttactaacaaaatggattataagtttattctttctttttctgggtgtgcaatctaattataataaaaatttccttatcagatagaatcaacatcaaaaataataatgttaattaaagcaaaacagctactatgtaaaataattaataaaaataatgatatatatattttaaatgtttgtataaatatattgaaatgcataattattcatcaaactgcaatctctcaatgtaggagtatggacctaactctg

SEQ ID NO: 83359 - DNA, 601 bp, Human
tttttaaatatattatttaaatatcagtaaaaaaaatcaaatattgtattcaaaataatttgctataatttatatgaaaggtgtatatcatatataataaattactcctcaaatatccctttactgtatccatataaaaagttttaaaataaagcattctgtgaattttatgcaacagaatattaaaccaactctgtgtttaaggtctgttatttcataggaaggagcataacacgtgtagaaatatttcaaaaattacaaagcatttagaaacacatcacataaaacttatcccatatakttattcaacttttgtcagtttacagtaagtgctctcatttattacatagttatcatacaaattctagattgaagtgaattatttaaaatgaatcttgactcttttcagtacattattttgttccagttgcctataaatcctccaataattccttatatatatcattaatattattacctgagagtaacaggagttagaagctttaaaattaaagctgtgcctttgctgttaggaatgaacactttgttccgttaaccagaactacaaagtcaaagtaatttacctctagttgaaagtaat

SEQ ID NO: 83360 - DNA, 601 bp, Human
ctattaaatctacttaaacaataatttatatgtaaaactctcacaatgtctggtacatgctggtgccactaatatgcttctttttctcttttttaaatatattatttaaatatcagtaaaaaaaatcaaatattgtattcaaaataatttgctataatttatatgaaaggtgtatatcatatataataaattactcctcaaatatccctttactgtatccatataaaaagttttaaaataaagcattctgtgaattttatgcaacagaatattaaaccaactctgtgtttaaggtctgttrtttcataggaaggagcataacacgtgtagaaatatttcaaaaattacaaagcatttagaaacacatcacataaaacttatcccatatagttattcaacttttgtcagtttacagtaagtgctctcatttattacatagttatcatacaaattctagattgaagtgaattatttaaaatgaatcttgactcttttcagtacattattttgttccagttgcctataaatcctccaataattccttatatatatcattaatattattacctgagagtaacaggagttagaagctttaaaatta

SEQ ID NO: 83361 - DNA, 601 bp, Human
ctatgaaaagatttccttataggaaaatttagaactaaaattactctcattcttttgaatacttactgtgggctgatgctgggacattttaacgtgcttggttaatgctttgtttgttaacaaatatgtttccattattttctttaataaatatgtaacaataagttttgcaaacaggtgctcaaatgaaaacaaactatccacttaagtgtatttgtttgatttgaaatgagagtagtttttccattgtaaaatcttgtatatgaaagtcatattaagttttagttaaaaaaaagtgagytaaatcaattaatacatattataaactactttataatactattaaatctacttaaacaataatttatatgtaaaactctcacaatgtctggtacatgctggtgccactaatatgcttctttttctcttttttaaatatattatttaaatatcagtaaaaaaaatcaaatattgtattcaaaataatttgctataatttatatgaaaggtgtatatcatatataataaattactcctcaaatatccctttactgtatccatataaaaagttttaaaataaagcattctgtgaattttatgc

SEQ ID NO: 83362 - DNA, 601 bp, Human
aaatgaaaagacttatctactactataataaaaatttacagggaatatgaacttaaataatcacatttatagctgtctaagtttcataaatgcccatgagaataaagatggtttataaattgtatttttggtctgtctgatttagatttctatgaaaagatttccttataggaaaatttagaactaaaattactctcattcttttgaatacttactgtgggctgatgctgggacattttaacgtgcttggttaatgctttgtttgttaacaaatatgtttccattattttctttaataaayatgtaacaataagttttgcaaacaggtgctcaaatgaaaacaaactatccacttaagtgtatttgtttgatttgaaatgagagtagtttttccattgtaaaatcttgtatatgaaagtcatattaagttttagttaaaaaaaagtgagttaaatcaattaatacatattataaactactttataatactattaaatctacttaaacaataatttatatgtaaaactctcacaatgtctggtacatgctggtgccactaatatgcttctttttctcttttttaaatatattatttaaatat

SEQ ID NO: 83363 - DNA, 601 bp, Human
agccttcttgcagcattctggtattttatgatatgagatatttctgtagttgtgaactgaaaactacccatgggtctctatatattatttcttgtgtccttgggtcagtattttaccctttaaatgtcaatcactctacctataaaatgtaaacctattcatgggatttacaagcattttgctaaggctaaaattggataattccttaagaccttaaagcactatttctattattgttattataatttttatatttatgcttcatttctagaaaacaattttcatattcttttgacagcasagtaaataaaatatattgaaatcatgcaaacataaatataaatcatattctcagcactcttcaggagcagaacttcaataaattatttgcaatttattgatgtgcattaattatttaatttgtaagcctataataagagttatttaacttgccaagttgtgtttttgagaaacaattaacggtaactatgtcaactttataatactgagcctgggaaaaagcagaatgtacatcttaataatttctgaatattaaaatagaaacaaagccaaaatatatgcatgtattttccagcaccaa

SEQ ID NO: 83364 - DNA, 601 bp, Human
gataaatttgattgcactaaaacatgatttcttactcattttctccaaatatatcatgaagaggaaaaaaattacaatttgggtgaacacatttgtggcacacgtaactgacaaaggacttgtatctgtaatatataatttaacatattgaaacaattttaaaagccaacacaatataaaaataggcaaatattaatggccaacagttaatagaagagataatataaataaaaaataaacatgaaaaaaaatcagtctcattagtatgaaaaaaagtaggttaatcaaaataagttaacayttaacataagccagactaacacaatactaagaagtttggcaagatttctccaaatgctggattgaatatagacaaagaaaggcctataaagttaactcataaggaataacttgtatattctcatgctctagatgatgtaatttccctgatttatacctataggaaaactcttgaatatacatactatcagtacaattaatggcaacaacgacaataggaaaataaaaatattcaacaactcctgaatggatacaaaactttgatgcatttatatcatacagaaaataaataacaacacag

SEQ ID NO: 83365 - DNA, 601 bp, Human
attgataaatttgattgcactaaaacatgatttcttactcattttctccaaatatatcatgaagaggaaaaaaattacaatttgggtgaacacatttgtggcacacgtaactgacaaaggacttgtatctgtaatatataatttaacatattgaaacaattttaaaagccaacacaatataaaaataggcaaatattaatggccaacagttaatagaagagataatataaataaaaaataaacatgaaaaaaaatcagtctcattagtatgaaaaaaagtaggttaatcaaaataagttawcatttaacataagccagactaacacaatactaagaagtttggcaagatttctccaaatgctggattgaatatagacaaagaaaggcctataaagttaactcataaggaataacttgtatattctcatgctctagatgatgtaatttccctgatttatacctataggaaaactcttgaatatacatactatcagtacaattaatggcaacaacgacaataggaaaataaaaatattcaacaactcctgaatggatacaaaactttgatgcatttatatcatacagaaaataaataacaaca

SEQ ID NO: 83366 - DNA, 601 bp, Human
gtttgtgcatgcctgtactcccaactactggggaggctgaggcaggagaatcacttgaacctgggaggcggaggctgcagcgagctgagctcacgccactgcactgcagcctgagtgacagagtgagactccttctcaaaaaaaaaaaaaaaaaaaaggagagttgctgtaccatttatcaaggcttactacacttaacaccctatgactatgtcacagggatagacaaacagaacagaaacacaaaacagaacccagccaaagacccactatacatagaaatttaatatatggtgatgayggcattacagatcaatggtgaacgtacgggttaatcaataaatagtacaacttgttattcacataataataatagtagtagtaacaataagaataatgacattgatcttatgttacacttacacaaaaacatgttttaaattattaaagacaagtatataaggcaaaatcatacatattttgggaaaaatggttagcattaatatgtgcacttaagttacatgcacaatttcaaaacacaaaattcactaaaacaagaaggaagaattgataaatttgattgcactaaaacatgatttct

SEQ ID NO: 83367 - DNA, 601 bp, Human
ggtaggaggaacacctgaggtcaggagatcgagaccagcctggccaacatggagcaacctcgtctctagtaaaaatacaaaaattagccaggtgtgtttgtgcatgcctgtactcccaactactggggaggctgaggcaggagaatcacttgaacctgggaggcggaggctgcagcgagctgagctcacgccactgcactgcagcctgagtgacagagtgagactccttctcaaaaaaaaaaaaaaaaaaaaggagagttgctgtaccatttatcaaggcttactacacttaacaccctaygactatgtcacagggatagacaaacagaacagaaacacaaaacagaacccagccaaagacccactatacatagaaatttaatatatggtgatgacggcattacagatcaatggtgaacgtacgggttaatcaataaatagtacaacttgttattcacataataataatagtagtagtaacaataagaataatgacattgatcttatgttacacttacacaaaaacatgttttaaattattaaagacaagtatataaggcaaaatcatacatattttgggaaaaatggttagcattaatat

SEQ ID NO: 83368 - DNA, 601 bp, Human
gtgaattaaatgaaagatgataaagcatatacataatcactcaagaacatattaagaaatacaaaaaataaaatgcaatattcatatattctaaaaaccatccaataaaacaacaaatgacaagaaaaattgcatcatacatcattcttaatggtgaaaaatctaagaattaaaggaacctatgaataaatctaacaaagtatatgaaagacccatatgcagaatactttactgaatttcattaaaaaagatataaagatattaagagctgtattacgtctgcggttaaagagacaaaatrtcacaaataaggacataccatccagattgatggtattttcaatgtaatctaatacaaatccaatgaaagttgttcatagcaattgaaaactgcttctaatatttataaacactaagataattcagacttgtatgaagaagaggaataaagcagaattgcacgccgggcatggtggctcacgcctgtaatcccagtattttgggaggctgaggtaggaggaacacctgaggtcaggagatcgagaccagcctggccaacatggagcaacctcgtctctagtaaaaatacaaaaattagcca

SEQ ID NO: 83369 - DNA, 601 bp, Human
caaatttaaattgtaacaacatacaatacattaataataagactagtaaaaaagatacaacaatattgggaaaaagggaataaatacttatagagaagttattcatgatagtaagaaaatagatgggttaaaaagtgtcttaagtagctctaaaataaatagaaaatctaagtagtgctgtattaaagtaactagagaaaataaatttttcagtaaaaagttaatttttgcaaagagagaaaaaaatttgtcccagattttttacttaaagtaacaggtaattacagtctacacatttttyccctagaaaatataagaaagaggaaatatttcaaaatttttatttatttatttatttattttgcttgtgaaactttggaaccaatactagacactaccactcacgacacatattaagtgtcaactgcctaaacaaaataatagtaaacacactccactgagttgttcttgataattcttgatcagttttgtcccaggaatgtttgtttagctcaacaaaaaaagacggaagaggtacagaaaagaagtaaattttcataaagatacaataaaagttattcacaagttagtgaattaaatg

SEQ ID NO: 83370 - DNA, 601 bp, Human
aaaatgatattttgtcatatcaaggaaattacatgttatcaggaacttgagtgggagaaagttgtcagaattcattgtatgctgtcagagtctacaggatgaacaattggtttcatcattaatctaagaaaaacacagcagttggtaaaaaataattacctaatctttaaaaaagtttaatgttcaaatctaactaaactcaaagaaaacaaaaaataaatttctttacacaaagaatcattttcttatggcagaatatatgcagagtgtgatgttaagtcacgctcggggaaaaataaakaataattgaaatcaaaatttagcatgagattcatacatgcaatttacatgtaactctcgtagatatcaaaatatattcaatagtttcaaaaacatcttaaactaagactttttatcttttcagtgggtttattaattctgagatgtaacaaaaacataaatgtctggtatattttacaagtccaagctagagattcagaatacataatgaacaaattaaatctctctgtctggctttctctttgctaatgtatctgtcattctctgaagcaattcaaatttaaattgtaacaacatacaa

SEQ ID NO: 83371 - DNA, 601 bp, Human
aagctttatgaaattatttccactgagtacaaaattacactgtgggctttgggggattatacctaagaataataaaaataaaggcgcttgcatttattccattcaaatgaggaggaaggaaacaattaacttacctggccaggcttagaattttcacatacaataatatcatattccctggcaagttcgggtggattgtcattgacatccagaactctaatacccactgtgacatggctcagcaaatcaggattatctgcaaaatacacaggaatgtatttagtatttccatgcacacttyagaggctcggtttaaaacaaatctctttaatactgtagcttgtcactggttccatatgccatagctggacttttggcaaacgacaactttatgaaggcgctctttgctagaactcattaacttacaggaaaatgaaaaatgaacaccatggcatgacatgaatgccaaaatgatattttgtcatatcaaggaaattacatgttatcaggaacttgagtgggagaaagttgtcagaattcattgtatgctgtcagagtctacaggatgaacaattggtttcatcattaatctaagaaaaac

SEQ ID NO: 83372 - DNA, 601 bp, Human
atcaatttggaataactttcagctataatcatcttaaatattatttcagtcccattctctctcatatgcctctcagaattgaaaaacttttatattacacttgcatgtcccatatgtctctcatactcttatttatattttctttttctttccatgcttcaacatggatttttttattctgacttactttccagttcccttatttttcttgcactatgtctaagctgctgttattaccagtaattgagatactgtattttcttaaatttaaattttccattagaatgtttaatattttttmatcaactgtgcttttataatgtatttcaagaacattatgttaggatgtatgcatccatttttaatagaattgaaataaaatttgctgaatatttaataatatatttatactataaaagtatttactggttttgaaatcagtgcatagaaaaatatttaagcatataaaataataatcttaatattttaagtgaataaattatataaactgtacaatgctttcaagtataactttactgtgtcctcattcatatttctaattttctcatgggaaatgttaaattaattaagtaggaggcca

SEQ ID NO: 83373 - DNA, 601 bp, Human
agaggtgtttatagtattctctgatggtagtttgtatttctgtgggatcggtagtgatatcccctttatcattttttattgtgtctatttgattcttctctcttttcttccttattagtcttgctagtggtctctcaattttgttgatcttttcaaaaaaaacaagctcctggattcattgattttttgaaggttttttgtgtctctatctatgaattcaccacaatttgcttaaccattcacctattgaaggatgtctttgttggttccagtctgggttttttataaataaaactgctakaaataattgtgcacattttgttgtataaacataaaatttcatatctctgtgggaaatgcccaaaaatgcagttctgaattttatggtagctgcatatttaattttttatgaaactgtcaaaatatgtttcccagtagcagtaccattttacactttcaccaatgatgtagaaatgacctaatttctccacaatttaccaaaaagtttagctcttatgctaggcctgtagcgatatcacattgtagttttaatttctatttacctaatgtgaatagaaataatttttaaaaaatatgtgga

SEQ ID NO: 83374 - DNA, 601 bp, Human
gactgtatccatttcttctagattttctagtttatttgcaaagaggtgtttatagtattctctgatggtagtttgtatttctgtgggatcggtagtgatatcccctttatcattttttattgtgtctatttgattcttctctcttttcttccttattagtcttgctagtggtctctcaattttgttgatcttttcaaaaaaaacaagctcctggattcattgattttttgaaggttttttgtgtctctatctatgaattcaccacaatttgcttaaccattcacctattgaaggatgtctktgttggttccagtctgggttttttataaataaaactgctataaataattgtgcacattttgttgtataaacataaaatttcatatctctgtgggaaatgcccaaaaatgcagttctgaattttatggtagctgcatatttaattttttatgaaactgtcaaaatatgtttcccagtagcagtaccattttacactttcaccaatgatgtagaaatgacctaatttctccacaatttaccaaaaagtttagctcttatgctaggcctgtagcgatatcacattgtagttttaatttctatt

SEQ ID NO: 83375 - DNA, 601 bp, Human
atttatttttctaacttcttaagaataatgcttaggcttttaatttgcattattttatcttctttattatatgcatttaaaattataaatttcctgttagttatggctgaactgtttcctagaaatttttatatggacttatttacattatcatttcatggaacttgttttttcatttaagtttgttcttcttcatggaatattaagttacttagaagtgcattcctttatttgcaatatgattttttttttatactttaagttctagggtacatgtgcacaacatgcaggtttgttacayatgtatacctgtgccatgttggcttgctgcacccattaattcgtcatttacattagatatttctcttaatgctatccctcccccattctcccaccccatgacaggccccagcgtgtgatgttccccaccctgtgtccaagtgttttcattgtccaattcccacctatgagtgagaacatgcagtatttggttttctgtccttgtgatagtttgctcagaatgatggtttccagctttatccacgtccctacaaaggacgggaactcatcgtttttatggctgcatagtattccatggtgt

SEQ ID NO: 83376 - DNA, 601 bp, Human
caccaagcccagctaaatctattcttgtgtcagctttgacaaactttacttttctaaaaatatatgcattatgtctaaactttcaaattttagtaaaagacgacattgtaatatacaattggcttctgatatctgtaaagtctatagttacaagaggcggtaagcctcttgattttttcctaatattcttcatttgttctatttctctcttttgtttttaacaatttaccagggacttatctgtcttttcaaataactaagctgtgaactcttcaatgttttcttttggttcatttccatktcattaaattcatctcataaattgttattctattttatttggattaaattgatttatttttctaacttcttaagaataatgcttaggcttttaatttgcattattttatcttctttattatatgcatttaaaattataaatttcctgttagttatggctgaactgtttcctagaaatttttatatggacttatttacattatcatttcatggaacttgttttttcatttaagtttgttcttcttcatggaatattaagttacttagaagtgcattcctttatttgcaatatgattttttt

SEQ ID NO: 83377 - DNA, 601 bp, Human
tttattttctgagacaaggtctcactttgttacccaggctggagtgcagtggcaggatcacagctcactacagacttgacctccagggctcaagggatcctcccacttaagactcccaagtagctgggattataggcatgagccaccaagcccagctaaatctattcttgtgtcagctttgacaaactttacttttctaaaaatatatgcattatgtctaaactttcaaattttagtaaaagacgacattgtaatatacaattggcttctgatatctgtaaagtctatagttacaagaggyggtaagcctcttgattttttcctaatattcttcatttgttctatttctctcttttgtttttaacaatttaccagggacttatctgtcttttcaaataactaagctgtgaactcttcaatgttttcttttggttcatttccatgtcattaaattcatctcataaattgttattctattttatttggattaaattgatttatttttctaacttcttaagaataatgcttaggcttttaatttgcattattttatcttctttattatatgcatttaaaattataaatttcctgttagttatgg

SEQ ID NO: 83378 - DNA, 601 bp, Human
gtttgaatttggaacttaggttttaaagggaagcagagcataaaagtttggaaaatttgaagcctgacaatgaaataaaaaagacaaaaccattttctgaggagaaattcaagttgtgtaagtatcgaggagccaaatgttaatcaccaagacaatggagaaaatgtctccagggtatgtcagaggtgtcctcggcagcccctcccatcaccaacctagaggcctaggaggaaaaactgtttttgtgggccagcccaggaccatgctgctttgtgcaggacttggtgccctgcatccaagycatagctaaaaggggccaatacacagctcagcccattgcttcagagaaaataagtatcaattaagccaagagcaagggctgggtgttattggcctagatttgcagcagactacataggtagcatgggactagcaaccattgttgtgccatattatgagaatatactttaaccttaaagctttgaaatgatcttgaaatttaaaaatacaatctatatgcttatttaaatgaatttttaaaattataattagtccgaaaacaatgtctgatgcaaacataagcccatgcttggttctttaa

SEQ ID NO: 83379 - DNA, 601 bp, Human
tagggatctgtgaaactttgaacttgagagagatgatttagggtatctagtggaagaaatttttaatagcaaagagcaccctggtgctcttaaaatcattcagttttatgcatttcaaagggatggtttgaatttggaacttaggttttaaagggaagcagagcataaaagtttggaaaatttgaagcctgacaatgaaataaaaaagacaaaaccattttctgaggagaaattcaagttgtgtaagtatcgaggagccaaatgttaatcaccaagacaatggagaaaatgtctccagggyatgtcagaggtgtcctcggcagcccctcccatcaccaacctagaggcctaggaggaaaaactgtttttgtgggccagcccaggaccatgctgctttgtgcaggacttggtgccctgcatccaagtcatagctaaaaggggccaatacacagctcagcccattgcttcagagaaaataagtatcaattaagccaagagcaagggctgggtgttattggcctagatttgcagcagactacataggtagcatgggactagcaaccattgttgtgccatattatgagaatatactttaacctta

SEQ ID NO: 83380 - DNA, 601 bp, Human
gactcttgctatgctttagcaaagagactggtggcattttgcccctgctctagggatctgtgaaactttgaacttgagagagatgatttagggtatctagtggaagaaatttttaatagcaaagagcaccctggtgctcttaaaatcattcagttttatgcatttcaaagggatggtttgaatttggaacttaggttttaaagggaagcagagcataaaagtttggaaaatttgaagcctgacaatgaaataaaaaagacaaaaccattttctgaggagaaattcaagttgtgtaagtatygaggagccaaatgttaatcaccaagacaatggagaaaatgtctccagggtatgtcagaggtgtcctcggcagcccctcccatcaccaacctagaggcctaggaggaaaaactgtttttgtgggccagcccaggaccatgctgctttgtgcaggacttggtgccctgcatccaagtcatagctaaaaggggccaatacacagctcagcccattgcttcagagaaaataagtatcaattaagccaagagcaagggctgggtgttattggcctagatttgcagcagactacataggtagcatg

SEQ ID NO: 83381 - DNA, 601 bp, Human
aatggtagctaaatgtatagtgttttaaagtgcaaaaaggagtaaccacataatcaacttacaaaacttaatcaaaatattagaagggtagtaatgtcaaatgctaagtgtagtaattacctttttgatatggttaggttttgtgtccccactaaaatcatattgaattataatccccataatccccacattataatcccacataacccctacctggagagaccaggtggaggtaattggatcatgagggtggctttcccctatgctgttctcctgttagtgagttctcaggagatctgatttttttttttttttctgagaccaagttttgctcttgttgcctaggctggagtgcagtggtgcaatttcagctcactacaacttacgcctcctgggttcaagcgattctcctgcctcagcctcccgagtagctgggattacaagcacctgccaccatgcctagctaattttttgtattttgaaagagatggggttttgccatgttgggcaggctggtcttgaactcctgacctcagatgatctgcctgccttagcctcccaaagtactgggattacaggcatgagccaatgcacccagccg

SEQ ID NO: 83382 - DNA, 601 bp, Human
aaagggtgaaaaaaaatagacagttgctatttataaataattaccagggagtatttttgatatctacaaatagatgtatccacttttaaaaatatactttcaattgtctgttaattgagacagactgttactgttaattagagttactgttactgttactgttaattagagtactttattagggaaaagtcagtatcacaaatatataaaatttgtctaatctaataccataatgttagttttggcaaatgaacttgcttggcttaagcattttaaaaaggaagttctttctttcttttctttttttttttttttttgtggcagagactcactctgtaaccaaggctggagtgccagaggcacgatctctcaatctcagctcactgtaaccttcacctcctgggttcaagtgattctcgtgtctcagccaccgagtagttgggattacaggtgtaagccaccatgcctaatttttgtatttttggtagaaatgggtttttgctatgttggccaggctggtctagaacccctggcctcaagtgatctgccctccttggcctcccaaaatactgggattacaggtgtgaatcactgcgcctgg

SEQ ID NO: 83383 - DNA, 601 bp, Human
tcagggatccagaactagaaatgccatttgacccagccatcccattactgggtatatacccaaaggattataaatcatgctgctataaagacacatgcacacgtatgtttattgcggcactattcacaatagcaaagacttggaaccaacccaaatgtccaacaatgatagactggattaagaaaatgtggcatgtatacaccatgaaatactatgcagccataaaaaatgatgagttcatgtcctttgtagggacatggatgaagctggaaaccgtcattctgagcaaactatcgcaagracaaaaaaccaaacaccacatgttctcactcataggttggaattgaacaatgagaacacatggacacaggaaggggaacttcacacactggggcctgttgtgggttgggaggaggggcgagggataacattaggagatatatctaatgttaaatgacgagttaataggtgcagcccaccaacatggcacatgtatacatatgtaaccaacctgcacgttgtgcacatgtaccctagaacttaaagtataatttaaaaaaaagaagagagaaactcctagtctctacataaaaaatgagga

SEQ ID NO: 83384 - DNA, 601 bp, Human
acctctggtagaatttggctgtgaatccatctagtcctggactttttttggtttgtaggctattaattattgcctcaattccagagcctgttattggtctattcagagattcaacttcttcctggtttagtcttgggagggtgtatgtgtcaaggaatttatccatttcaaatcaatgtggaaaaatcacaagtattcttatacacacataacagagagccaaatcatgagtgaactcccattcacaattgcttcaaagagaataaaatacctaggaatccaacttacaagggacatgaargacgtcttaaaggagaactacaaaccactgctcaatgaaataaaataggatacaaacaaatggaagaacattccatgctcatgggtaggaagaatcaatattgtgaaaatggccatactgcccaaggtaatttatagattcaatgccatccccatcaagctaccaatgactttcttcacagaattggaaaaaactactttaaagttcatatggaaccaaaaaagagtccacgtttccaagtcaatcctaagccaaaagaacaaagctggaggcatcatgctacctgacttcaaactatac

SEQ ID NO: 83385 - DNA, 601 bp, Human
gtttactttttatccaagaatcgaatttcggagtgattggtgaagaatatttcatttgagttaactgagccagtttatggtttctgttatcactgctgtgggattattattttctttactatacatttcagttagtatacaaattattttaattatttcttaatatttttacaaatatgagcttattatacctgttaaactctgatataattcctattctattgtgtttgtaaggcatctttttcacttttttacagataatttcaaatgcgaattaaacagaaagctcacatatgacaaycgtgtttttttaagagagaaactccttgtgatttttgcacattgattttgtatcctgagactttgctgaagttgcctatcagcttaaggagattttgggctgagacgatggggttttctagatatacaattatgtcatctgaaaacagggacaatttgacttcctcttttcctaattgaataccctttatttccttctcctgcctgattgccctggccagaacttccaacactatgttgaataggagtggtgagaaagggcatccctgtcttgtgccagttttcaaagggaatgcttcca

SEQ ID NO: 83386 - DNA, 601 bp, Human
tcatttcttagaacattataactaatttcaaccagttcaatattttccaaagaaggtaattcaccaaaggatatcacagttaaaacttaaatttctctgcgtgttctgagcccattagtttgtcagaaagatgaggaggaaaataaaagtactgagaagtgggggtgagtgacagtaacaccagaaaagcatgtgttttcatgaagtgacagtgaagaaagtacttcaggatacagaagagatcaacttcctcattatgtttactgggctcactctttcaccgcctttccatcactgctcraaagatacatgtttagcaagatcctatgtgctccttacccctgcctccatctccaaataagtctctatccttcttgatttccctccatatttatttataagctgaaaatcttttttttttatttgaatacaactagtctctgggtagattgtttttccccttgttttcacttagagtaggggaatacattgatggataatcagatatattgtaaaaattccagtgctgcctcatctgaggaacatatatacattagctagacattagttacttaatacaaaattgaaataaaatgtcaat

SEQ ID NO: 83387 - DNA, 601 bp, Human
aaaacgagaaacaaagagagagaagatagagctgtgaaaataatatttcctgtttctgaaatacattgaactaatatcatttcttagaacattataactaatttcaaccagttcaatattttccaaagaaggtaattcaccaaaggatatcacagttaaaacttaaatttctctgcgtgttctgagcccattagtttgtcagaaagatgaggaggaaaataaaagtactgagaagtgggggtgagtgacagtaacaccagaaaagcatgtgttttcatgaagtgacagtgaagaaagtacytcaggatacagaagagatcaacttcctcattatgtttactgggctcactctttcaccgcctttccatcactgctcaaaagatacatgtttagcaagatcctatgtgctccttacccctgcctccatctccaaataagtctctatccttcttgatttccctccatatttatttataagctgaaaatcttttttttttatttgaatacaactagtctctgggtagattgtttttccccttgttttcacttagagtaggggaatacattgatggataatcagatatattgtaaaaattccagt

SEQ ID NO: 83388 - DNA, 601 bp, Human
tttaaatgttcatatagatcttttggctttgtgcgcattttgatactttgttatatttaaagatgttcagggaaaatgggaaaaatgcttttggcaggttgtcatttagtgacttgcatttgaaaatcttctcccggaagtgaagagaaagggaattcaatgtttacttcaaaatgtatgtgccactgttttctgcatgtgattctgaggcaagtgttaaattccaaatagcagcatattcagataaacataatcaaatatatagtttggacaaagaaaaagttgatcctaatcagaaaaytgcacataccatatggcttaatgtttccctaatgtatgaagaatgacttatatggaaccttgagaaatgtaccaaagaggacatctaaataatgaagaaacttccgtagttactaaattatgggattatttttaaccacactatacagaaggctaaatgaaaatgattcaaaaatttccaaaatatgctgcatacttctgtgtatccttctacccatattttggacaatgcttataataacaagaggaaatataatttgtaaagcacatcttgatagccttgctcatacaagatgattgc

SEQ ID NO: 83389 - DNA, 601 bp, Human
atggatcaacatatgattccaatctcctaaggaagcaagttaaataacctctgccaaattttacaattctttgaaatatggaaaaatatgattttttcacaagtttcacatagttaatcatactaagtatatttgaattataagacagcctgttctaatgtaagtaaatgtacaatagtcagttaaatgcaatttgtcatacacaaacatgcacaaatattgattcccataagcagagctgacatagggccacttaaaatgtgagagacaattaagctttaaatgttcatatagatctttyggctttgtgcgcattttgatactttgttatatttaaagatgttcagggaaaatgggaaaaatgcttttggcaggttgtcatttagtgacttgcatttgaaaatcttctcccggaagtgaagagaaagggaattcaatgtttacttcaaaatgtatgtgccactgttttctgcatgtgattctgaggcaagtgttaaattccaaatagcagcatattcagataaacataatcaaatatatagtttggacaaagaaaaagttgatcctaatcagaaaactgcacataccatatggcttaatg

SEQ ID NO: 83390 - DNA, 601 bp, Human
tctgttttttctaaaatacattcagagttatacctatgtaggttaaactgcttgaattgaacacatcttcaaatcgaagtcaaattttcattgtaatgttatcaaatttaaattattttaaaatataaatttttattggaatagaaaaaaatgcaactgaaacataagtacatggatcaacatatgattccaatctcctaaggaagcaagttaaataacctctgccaaattttacaattctttgaaatatggaaaaatatgattttttcacaagtttcacatagttaatcatactaagtayatttgaattataagacagcctgttctaatgtaagtaaatgtacaatagtcagttaaatgcaatttgtcatacacaaacatgcacaaatattgattcccataagcagagctgacatagggccacttaaaatgtgagagacaattaagctttaaatgttcatatagatcttttggctttgtgcgcattttgatactttgttatatttaaagatgttcagggaaaatgggaaaaatgcttttggcaggttgtcatttagtgacttgcatttgaaaatcttctcccggaagtgaagagaaaggg

SEQ ID NO: 83391 - DNA, 601 bp, Human
gaagtaacaaaagcatttttgtcataatttatgcatttttcattagtcagagcaaattcatttttctgatttctttctcaattcattcactatcttttaaatttttggttctcaggcttatcatgaacaacaacatgcatctctttctctctctctttttttgaaaaatctgtttctgtgcccttgctttttgtcatatagcaatttgggagatgtcactaaaccaatagctttctgatcactcatcctggtttcggggctatgtctgatttctgttgtttctctcaatacagactttcakgtgagaagtaggcacagaaagtaataatttttttctagatttatttctttatattctgggggcttgtaaatgtcagttaacttacataggcacagaaaatgataaattttcttctagctttttttttttaatgttctgtgggcatgtaaatgtcacttaacttacataatacaaagcccaagcacacaagaccctgcagtccagcattttctgacccttattccactgtattttcattttaattgatctccagagtacatgaataaatatatgtatgtaagcatgtgcatatgcatgtat

SEQ ID NO: 83392 - DNA, 601 bp, Human
ctggaagaaaataaaaaattaatgcctctgctcgcaagacatgaagaaatgcaagagtttcatgagaaattgtgccctagcatgaacatcctgaggagaagaattgaagatctgaagaagtcctggtattattgctcacaaagggaaactgttccgtagtcttaaggtattttacaatagttacaattaaagatgattgataccactgcacttccttgctcacaatccattatctacatatcagccaaaatattcctttagaaatcgtactacatcactcatgttaaaaagttagtttcgmtatcttccattgaaattatgattgattttttaaagaaacaaaaactgagattgacttctcacagcctaagaaatcaagctggctatagattgcctctccagacaactctaactttaatttccactttcaatacctatgttgactttatatggaactttagccagttccttaagctcactctgctactcttcctcatatcttagggcctttaggcttgctaaacttcttgcctataaattttagccattccctcttttcttgttaagcttcattcatcattcagttgtcaagttacgtatc

SEQ ID NO: 83393 - DNA, 601 bp, Human
cacagcaaggagcataagttcttcttcagatttgtttccttataccttaaggtgaagaggagtgatgtggaggccccaggtggtgtgcagcacacagtgggtttgtacctcaactaaggaatcttaaatttagggagcctggatctttgataataaattgtaagaaaacatgcccaatctctgtatcagagagtatcattatccttattaatactatacatcaaataaatacgtcttttcaacctaaggaagacactgtatcttccaaggctgattggtatacaaacactgcagaagagayagtctggaagaaaataaaaaattaatgcctctgctcgcaagacatgaagaaatgcaagagtttcatgagaaattgtgccctagcatgaacatcctgaggagaagaattgaagatctgaagaagtcctggtattattgctcacaaagggaaactgttccgtagtcttaaggtattttacaatagttacaattaaagatgattgataccactgcacttccttgctcacaatccattatctacatatcagccaaaatattcctttagaaatcgtactacatcactcatgttaaaaagttagtt

SEQ ID NO: 83394 - DNA, 601 bp, Human
agatttttttctcttccactgtcctgccacataaagaaaagtgttccttctgtccaaaggtgtcatcttggaagcagagcccaggcccttacagacaacaaatgatcttagagttcccagcttccacaactgtgagaaataaatttttcttctatacaaattctcagtctcaggtattccactatagcagcacaaaacatgtgacattcaataaaaaattctctatatatcaagaaataagaccatgtgttccagtcctgtctccactttcccctacccccaccaggacaaaaaaaaaggyaaacaaacaaaaaactggcatttgttctagatattagaaaaggctgacaatgattgtaaaatcattaagaataaaatgctaaagaaaatgttaaaaataaagaatttcactagtgatttacatgtctataaaataatcaaatggatatcaaccaaagctgtatgtgtatagaccacattttctttgaatggatgtatttgttcttataggactgttgcttccttaagcagttcattagctccatgctagtatttccaccaatatattcccagcacatgtcacagtaataaaacctaggtc

SEQ ID NO: 83395 - DNA, 601 bp, Human
aaaaaaaaaaaaggctttcaggagtgagatttttttctcttccactgtcctgccacataaagaaaagtgttccttctgtccaaaggtgtcatcttggaagcagagcccaggcccttacagacaacaaatgatcttagagttcccagcttccacaactgtgagaaataaatttttcttctatacaaattctcagtctcaggtattccactatagcagcacaaaacatgtgacattcaataaaaaattctctatatatcaagaaataagaccatgtgttccagtcctgtctccactttccccyacccccaccaggacaaaaaaaaaggcaaacaaacaaaaaactggcatttgttctagatattagaaaaggctgacaatgattgtaaaatcattaagaataaaatgctaaagaaaatgttaaaaataaagaatttcactagtgatttacatgtctataaaataatcaaatggatatcaaccaaagctgtatgtgtatagaccacattttctttgaatggatgtatttgttcttataggactgttgcttccttaagcagttcattagctccatgctagtatttccaccaatatattcccagca

SEQ ID NO: 83396 - DNA, 601 bp, Human
gaagtttaacagaatgctaaacctctaagctgaaaagccctggaagacaaaagaaaagcttttttgttatatcttggtgttgaacagtgattaaagctaaaggccactgtgagtgcacaaggaggctctcagtctagagccctagagggtcatcttctaaaaacagacaaatcagagacaaactgaaactaaacaaaactgcaaatcagctgtgactcagttcagactctgagtggattaaagtgactacaatcctctctaattgcttaccagagaaatggtgaatactctcttgggaaayatattatcatttgatcttctgttagtgctatagcttgaatgtttttgtcccgtcccaaattcatgtgttggaatcttagtcaccgacacaataatgttgggaggtggggcctaatgggtggtgtttaggtcttgagagctccagtcccatgaaggaattaatgccacagtaaaaagggctttcaggccgggcacattgactcacacctgtaattccaggattttgggaggccaaggcgggtggatcacttgaggtcaagagttcaagaccagtctggccaacatggtaaaccctgtctcc

SEQ ID NO: 83397 - DNA, 601 bp, Human
agcaaaccgttggttgcaaaacagcctttcttctataggtatttacttatattaggaactaagaagaggctgggattctaagctggggacagagaaatgaggggagtttttggaagtttcctggatctacaattaaattggaaattgagggacatggctgattttccctaaagacatttgttacattcaaaatttagattgaaagttaaattggaagtttaacagaatgctaaacctctaagctgaaaagccctggaagacaaaagaaaagcttttttgttatatcttggtgttgaacagkgattaaagctaaaggccactgtgagtgcacaaggaggctctcagtctagagccctagagggtcatcttctaaaaacagacaaatcagagacaaactgaaactaaacaaaactgcaaatcagctgtgactcagttcagactctgagtggattaaagtgactacaatcctctctaattgcttaccagagaaatggtgaatactctcttgggaaatatattatcatttgatcttctgttagtgctatagcttgaatgtttttgtcccgtcccaaattcatgtgttggaatcttagtcaccgac

SEQ ID NO: 83398 - DNA, 601 bp, Human
cactcaaactttcattaacagttcgtactgtgagaacataattctttgggaagaattctttgggaaggatatgtagcaggcatgtaaaagtaatagaggcaacaagtgcctgagaaacagggaatattggttgaaatggtgactaatcctcagagattttggagagaaacttggatttgctaggtacatgagatggggttctaacccaatttaattaaatttgaaagagcaaatatctgtagcattcaaaggaatatccaggcagcaatcatcttcatgataattagactatcattgaacrgcatcctttctctgaaactccatttatgtcccaattacttaatgaaacttttctcaaacaaatggttcttcatttataaaatgtaggtctaggtaaaatacgcagtttttgatcgacaaattctcccactaaaaacaaagagagaagcttaaaatatcaataaaatctcagccgggagctgtggttcacacctgtaatcccagcactttgggaggccgagatgggcagatcacctgaggtcgggagattgagaccagcctgatcaacatggagaaaccccgtctctactaaaaatacaaa

SEQ ID NO: 83399 - DNA, 601 bp, Human
tataatttctgtcacctgatatcccttttcagatggctactaagctggcctttcctttccctgcagtctgtacactcaaactttcattaacagttcgtactgtgagaacataattctttgggaagaattctttgggaaggatatgtagcaggcatgtaaaagtaatagaggcaacaagtgcctgagaaacagggaatattggttgaaatggtgactaatcctcagagattttggagagaaacttggatttgctaggtacatgagatggggttctaacccaatttaattaaatttgaaagarcaaatatctgtagcattcaaaggaatatccaggcagcaatcatcttcatgataattagactatcattgaacggcatcctttctctgaaactccatttatgtcccaattacttaatgaaacttttctcaaacaaatggttcttcatttataaaatgtaggtctaggtaaaatacgcagtttttgatcgacaaattctcccactaaaaacaaagagagaagcttaaaatatcaataaaatctcagccgggagctgtggttcacacctgtaatcccagcactttgggaggccgagatgggcag

SEQ ID NO: 83400 - DNA, 601 bp, Human
aaatgtcagcccgagggaattggggtgtgtgtgtgtgtgtgtgtgtgtgtgtgtgtaaagcgtttgtcttcattttgaattaggtccaataagtgaatatattcatattgacaatatgcaaagtgtatttaatagacatttcataagaaatcctatattttcaatcaatttatcattgtttttatatgtgattatattcaacacttcattgtttctggtaaatgtttaatcacattagtttagagaaagtttattttacacttcacctttgaaaaatgtttattcttatttcatcttattktcatttggcaataatagctccaacagttacatagtcaatattgaaaaatcccttattgtaactttttgccaaatgaattttattataaataatacagttgttgttttctgtaacattcagtattttgaaataccattgcttacttgtctcatgagtgttatcttagaaaaggattcttttattgtagttctttctttcaaatatcactaaaagaagatcaactggctgttcacttctaattttacaaatgagtattttgacactatctactacttttacaatttaaattcactgtgtgga

SEQ ID NO: 83401 - DNA, 601 bp, Human
aatttctcttaagaagaaaggcgttctttccaaggaacataaggaagggtgatgataaataataatttgatgtgaggctagagtggtacatgctggacagatagcttaaaatgtcagcccgagggaattggggtgtgtgtgtgtgtgtgtgtgtgtgtgtgtgtaaagcgtttgtcttcattttgaattaggtccaataagtgaatatattcatattgacaatatgcaaagtgtatttaatagacatttcataagaaatcctatattttcaatcaatttatcattgtttttatatgtgatyatattcaacacttcattgtttctggtaaatgtttaatcacattagtttagagaaagtttattttacacttcacctttgaaaaatgtttattcttatttcatcttattttcatttggcaataatagctccaacagttacatagtcaatattgaaaaatcccttattgtaactttttgccaaatgaattttattataaataatacagttgttgttttctgtaacattcagtattttgaaataccattgcttacttgtctcatgagtgttatcttagaaaaggattcttttattgtagttctt

SEQ ID NO: 83402 - DNA, 601 bp, Human
tatggccatagtttattcactatagatgtgaagttaagcagttaaaattatacaatgaaattatttgatgttaaaattaaaagttgacatcacaacttaaagtaagaaaaaaactacattttaatcagaaaacatttcatacttttttgttgttttagaaaatacaactttaaatgctctaacttaaaaatcatctttgaactctggtttttaaattttaaataaagttatgttattaccaacatattaattaacgataaaaataaggtcaatattaagcaaaattatgtattttacaatrtatattataaaagaaaaacccttcacttggttattctctgaatcaatgttaaatatttaataaattgggagaaataactttccagataaatacggaggatttcttggcacaattttttctagccaccacaatttggtactaaagcaactaaagaatgaatgtcagagtatcttatactggagtacagaataaggcacagtgcttagtcattagtatgttctcatgagtgaattaaaatgccattgagtctcttctttgctacatttccctctctagatttttccaaccaagtaattgacg

SEQ ID NO: 83403 - DNA, 601 bp, Human
gatttcatattgggggattaggttgcacttgcatattacaaatgaatgaacatggttattatattcctggaagtctggctcaagcctatattcataaatttagtaataatatggccatagtttattcactatagatgtgaagttaagcagttaaaattatacaatgaaattatttgatgttaaaattaaaagttgacatcacaacttaaagtaagaaaaaaactacattttaatcagaaaacatttcatacttttttgttgttttagaaaatacaactttaaatgctctaacttaaaaatyatctttgaactctggtttttaaattttaaataaagttatgttattaccaacatattaattaacgataaaaataaggtcaatattaagcaaaattatgtattttacaatatatattataaaagaaaaacccttcacttggttattctctgaatcaatgttaaatatttaataaattgggagaaataactttccagataaatacggaggatttcttggcacaattttttctagccaccacaatttggtactaaagcaactaaagaatgaatgtcagagtatcttatactggagtacagaata

SEQ ID NO: 83404 - DNA, 601 bp, Human
aacatttaaaaattcccttgatttccaatgtgtatcaaactacatacctgcatttccctaccaatggagtgtgaaatttgaaaagactccaaaagacttctttctaacagttacatagtcaacactgaaaatatcccttattgtaacttctatgcaatatcagcttaaagttatatcttctttcgccaaccccaaatagccacaagaaaaaaagttttcctgtttccttttaagtgttttgttaaaaattataaagcaacttataaatgttatgatcatttttaggagaatgaatgctgcaaaaaaaaacaagtaataaagccaaagaaaacagtaaatcttcagaatgccaccaacaaagtaataatgacactccaagaaatcttgtttcataggattaaaaaaattaatttccagtgcattttttcttgtcttagaaataatgtgttatgttgactcatttatttttaaagaattcaagtatctatgagaatggaaaacacatacaaaaaaagagaacataataaaaaccgatgtgagtagtagatattcctgatagcaaatcatcaaaaaaaaataagcattttcaaatgtaaaagac

SEQ ID NO: 83405 - DNA, 601 bp, Human
ctgcaaccttcacctcgcgggttcaagtgattctcctgcctcagcctcccaagtagctgggactacaggcgtgcaccaccacacccagctaatttttatatttttagtagagacagggtttcaccatgttggccaggatgatctcaatctctggacctcatgatctgcacacctcagcctcccaaagtgctgggattacaggtgtgggccactgcgcccagccaaaattagcaatgtttttgttttgtttttctacttctatttttttgcttagtgaatatgagtcagttttctttcattygtgagtaggagtaaaaaggtgagaggtggtgtgggctggcaaatccataaggggaaaaataattttatatataggtaaaacaacaatcaatgtttctatgttttacatatatatataaaacaacaattaatagagtttgaaataaccagagagagaacaaaagcatatctttctacctaaagcaatagagccactaaaatggatcactacagttaatccacaatcttttacattttagggtcaagattgtatacatgctctttaatttctcactagtcaagcttgagtgtctgcattcag

SEQ ID NO: 83406 - DNA, 601 bp, Human
aggctggggcactggagtgcagtggtgcgatcttggcttactgcaaccttcacctcgcgggttcaagtgattctcctgcctcagcctcccaagtagctgggactacaggcgtgcaccaccacacccagctaatttttatatttttagtagagacagggtttcaccatgttggccaggatgatctcaatctctggacctcatgatctgcacacctcagcctcccaaagtgctgggattacaggtgtgggccactgcgcccagccaaaattagcaatgtttttgttttgtttttctacttctrtttttttgcttagtgaatatgagtcagttttctttcatttgtgagtaggagtaaaaaggtgagaggtggtgtgggctggcaaatccataaggggaaaaataattttatatataggtaaaacaacaatcaatgtttctatgttttacatatatatataaaacaacaattaatagagtttgaaataaccagagagagaacaaaagcatatctttctacctaaagcaatagagccactaaaatggatcactacagttaatccacaatcttttacattttagggtcaagattgtatacatgctc

SEQ ID NO: 83407 - DNA, 601 bp, Human
gcggcagaaatagaatctattcataatttaaccattatcagagtgcatgcatcaaacaatggtgttttgcattccctcaaagctccctttccataatcggtacttgattaataatgatttgaactacactcagcaggaacttgtcttctgttacaattttattatattgacatggaggaagaaattgaaagcaaaatgaactaatatatcttgtaacacttcagcagcatgttctctttatgctctttaacgaaggtttatttcttcgtattctctgacttccctttctttgaatcttacrgtggcttaatctccattttcggactctggattctgcttgttcatctcagtttgcaaacatccttgtggccttacttgtctttctgccaaactacaaatgcatgatccaatatgtcattatgttctgatctgcaccctggaatgtcatccctttgaccatctgccacactccttcctacttgataatcttaaaatcctggataaatacagtgtccattgtctatttctgctttggattcacaaataatgctgatacaaattataaccatcttaactgattccacctagtatatagaaaaat

SEQ ID NO: 83408 - DNA, 601 bp, Human
ggcatggtttcatattgtctctgagtttttttcagtcttgcggcagaaatagaatctattcataatttaaccattatcagagtgcatgcatcaaacaatggtgttttgcattccctcaaagctccctttccataatcggtacttgattaataatgatttgaactacactcagcaggaacttgtcttctgttacaattttattatattgacatggaggaagaaattgaaagcaaaatgaactaatatatcttgtaacacttcagcagcatgttctctttatgctctttaacgaaggtttatktcttcgtattctctgacttccctttctttgaatcttacagtggcttaatctccattttcggactctggattctgcttgttcatctcagtttgcaaacatccttgtggccttacttgtctttctgccaaactacaaatgcatgatccaatatgtcattatgttctgatctgcaccctggaatgtcatccctttgaccatctgccacactccttcctacttgataatcttaaaatcctggataaatacagtgtccattgtctatttctgctttggattcacaaataatgctgatacaaatta

SEQ ID NO: 83409 - DNA, 601 bp, Human
tctctaattagaccaaaaaattttttaatgtgtatgaagagaaagctaggaaatacggctcaacttccaccagacaaatcaataggcatggtttcatattgtctctgagtttttttcagtcttgcggcagaaatagaatctattcataatttaaccattatcagagtgcatgcatcaaacaatggtgttttgcattccctcaaagctccctttccataatcggtacttgattaataatgatttgaactacactcagcaggaacttgtcttctgttacaattttattatattgacatggagraagaaattgaaagcaaaatgaactaatatatcttgtaacacttcagcagcatgttctctttatgctctttaacgaaggtttatttcttcgtattctctgacttccctttctttgaatcttacagtggcttaatctccattttcggactctggattctgcttgttcatctcagtttgcaaacatccttgtggccttacttgtctttctgccaaactacaaatgcatgatccaatatgtcattatgttctgatctgcaccctggaatgtcatccctttgaccatctgccacactccttccta

SEQ ID NO: 83410 - DNA, 601 bp, Human
tagtttaatgcagaaatagtgttgcatgtattttaatatttaaaaatagatgacaatgcattatttattttgttatgtgatcccatttcttgttcaaaaagaatatggacacaaataggatgaagcagggaggttttcacatgcatatataatatcaggcttatgcctacactctaataataccctgtgataactgtgaaataattgaaatttcatttatttgaaaagcaatcataataataaatataatttatccatctttctagcaataaatattccaaagatgtttacaattggtaawaatgttgtggggctatttcacaaaaatatttgtcataaaatatattgttaggtagttatgcattcaacttctgtatttctacaggccacagaatacattagtagaatacaagtcacatgcttctggagatcagatgtagttttcttgagctactattatatgtctcatttttttgttcaatagtttgaaagaccttgcaggatagactttaatttatgtgccactgtagcaaactataatacagttcaatttaaaataaggcatgtctttaaaataggttttggggcaaaaataaatcct

SEQ ID NO: 83411 - DNA, 601 bp, Human
ttttcattataaccaatatgttcctagtatttccataaaccatacccttagtttaatgcagaaatagtgttgcatgtattttaatatttaaaaatagatgacaatgcattatttattttgttatgtgatcccatttcttgttcaaaaagaatatggacacaaataggatgaagcagggaggttttcacatgcatatataatatcaggcttatgcctacactctaataataccctgtgataactgtgaaataattgaaatttcatttatttgaaaagcaatcataataataaatataatttmtccatctttctagcaataaatattccaaagatgtttacaattggtaaaaatgttgtggggctatttcacaaaaatatttgtcataaaatatattgttaggtagttatgcattcaacttctgtatttctacaggccacagaatacattagtagaatacaagtcacatgcttctggagatcagatgtagttttcttgagctactattatatgtctcatttttttgttcaatagtttgaaagaccttgcaggatagactttaatttatgtgccactgtagcaaactataatacagttcaattt

SEQ ID NO: 83412 - DNA, 601 bp, Human
ttgaaaggatggctgcactggagtactgggcatagttttgggttcactgcattaaaagtaaaattttaaaccaataatatgtgtttagaagactttgagaccttaaaaaatagtttggaaaatatttcacatgaagaattaacagaatgtttacatgtcatatatgaattttgttgacaaaagggcccctgaaaatgtccagaaaattttggaaaactttttatctttttcattataaccaatatgttcctagtatttccataaaccatacccttagtttaatgcagaaatagtgttgcaygtattttaatatttaaaaatagatgacaatgcattatttattttgttatgtgatcccatttcttgttcaaaaagaatatggacacaaataggatgaagcagggaggttttcacatgcatatataatatcaggcttatgcctacactctaataataccctgtgataactgtgaaataattgaaatttcatttatttgaaaagcaatcataataataaatataatttatccatctttctagcaataaatattccaaagatgtttacaattggtaaaaatgttgtggggctatttcacaaaaa

SEQ ID NO: 83413 - DNA, 601 bp, Human
atcacatagggaggatcttgaatagcagctttattttaaaatatagatagatgattgaaaggtaggtaaataggtacataggtaaatgatagatagattagatagacaaatatagacatatagccataagtctacagagctgtcaaacaagctaaacaatctgagagcattcaataaagataagaaatttctgcttctctttattgaaaggatggctgcactggagtactgggcatagttttgggttcactgcattaaaagtaaaattttaaaccaataatatgtgtttagaagactttgrgaccttaaaaaatagtttggaaaatatttcacatgaagaattaacagaatgtttacatgtcatatatgaattttgttgacaaaagggcccctgaaaatgtccagaaaattttggaaaactttttatctttttcattataaccaatatgttcctagtatttccataaaccatacccttagtttaatgcagaaatagtgttgcatgtattttaatatttaaaaatagatgacaatgcattatttattttgttatgtgatcccatttcttgttcaaaaagaatatggacacaaataggatgaa

SEQ ID NO: 83414 - DNA, 601 bp, Human
gcagtggatcacacctgtaatcccaacgctttgggaggccaaggcgggtggatcaactgaggtcaggagttcaagaccagcctggccaacatggtgaaaccccgtctctactaaaatatacaaaaattagctgggtgtggtggcgggcgcctataatctcagctacttgggaggctgaggcaggagaattgctggaactcgggaggcagaggttgcagagagccgagatcacgccattgcatgccagcctaggctgtcagcagtgagactctgtctctaaataaataaataaataaataagatattatagaaagtctcaaatggcatccaaatgaataagaaaaattaatataggctgaataaagagaaaacatagcatgatagaacatctgtggatgagaagtactaattgtcaatgtcaatctctaataatgtgcaccatagctgggttcttaattctaactctctatagcttggatgaagacagcagattatagaacacttggaagccaagctagtaaagctaatgtattagattaagattcgaggagattttgtatagccagaacaaagaaatttaacaataagacaggaaataaag

SEQ ID NO: 83415 - DNA, 601 bp, Human
gtggcgccacctcggctcactgcaagctcagcctcccgagttcatgccattctcctgcctcagcctccagagtagctgggactacaggcgcctgccaacatgcctggctaattttttgtatttttagtagagacggggtttcaccgtgttagccaggatggtctcgatctcctgacctcacgatccacccgcctcggcctcccaaagtgctgggattacaggcgtgagccactgcgcctggccagctgtctatttttaaacatgttataggatagagaaagaagtggagaaatgacatcaygtgtattatataataatttatcagtcatgtttactctcccagaaaacctgacttttgtggaagcagatctatcagctgtaggatgttgcatcacaatgaacagaagtctttagtctatgggaaatgtgtgaaataagtattcacgggcacaaacatgtttgacaatcttacagctgctcctctgaaaaagagatgtgagacactggtccctgaatctcaggaaacacgaataataacatgtgaaatgacagaacatgcagtgtagatggcggctctttcatggctcaggcctagcatacg

SEQ ID NO: 83416 - DNA, 601 bp, Human
ttcctgttgccgtagctatagattgccacctgcccccaggtcacacttctggaatagcatataactaacgactcactgctgaaaggttacaaacgttgggccatcccccttcctgcactactgacaatactgatggacaactttagctccagagcttttccatagggtcagccattaagagacattaagagtgaatgtcagctccatctgtcactctacgctgtcgttcttccttctcctgtgatctacagatgttgatcccaatggcatactccactaacacctgcgctccaaatgccarttcaactccagggaactcaataggcagctacatctatgagttaattattttgcactaaaaagtaagtgggtcattagacaattacaattagggcctctttttctcttaacaatgtcttttattctgaaaatagaaattgtattttatgtaggtatgtttataacagtcacagtgcaatatcctaaaatgatattatttattgtacattgctaaattaacataataaaaaagctaatttttaaaatattcaatgtactacatataataaaacacaagaaaatatgcacatacatacatata

SEQ ID NO: 83417 - DNA, 601 bp, Human
aaaatagtgggaagacaaagcaggaggaagcaatgaacattttggacatggacctaatagctataagatttaaagggatgcggacggcctgaagtcatacacttagggtcctatactttgaagtgagccaatgagattttctccaaacctagaggctctgaatataggtaataggagcacaaatctgtatttttagcaaactactgaggtgaagttgatgcataaaacaggtataagaataactggtttagataatatttctatggagacagtagatcaagcaacaaactttttagacttrgctgtgatttgaagctgtattgtttgaccatggggaagttaatgatgaataaaatagctaatcatatttttaaaaatgtgtttattaaatgcaatgtactataataaatgcctgcatgatatattgtgttcaatctataaaactttatgagggacaggatgctaaattctttaattcatagctgaaaataatttttgttataaatactaatttaaaagtaaataaccctagtcccagagtgttagttgcccaaaatcacaaagctagtaaatgataaggataaaacctctattctagaac

SEQ ID NO: 83418 - DNA, 601 bp, Human
taaatctcctccgccttgtcagaatgctggctgtgttatctatgatagacataagcaaaacaaaatacacttagtcaagccgccattcaagattcacatttcctttaatggataaaatggggatgtgtatctttcttgtttcagtttatgaaatggacaagggaacacgaaggggcaattattaaagagaagctaatattggttctccaactgagaaacctatttagaaaaattaatacagccacactaaagatgaaagaaaatagtgggaagacaaagcaggaggaagcaatgaacattktggacatggacctaatagctataagatttaaagggatgcggacggcctgaagtcatacacttagggtcctatactttgaagtgagccaatgagattttctccaaacctagaggctctgaatataggtaataggagcacaaatctgtatttttagcaaactactgaggtgaagttgatgcataaaacaggtataagaataactggtttagataatatttctatggagacagtagatcaagcaacaaactttttagacttggctgtgatttgaagctgtattgtttgaccatggggaagtta

SEQ ID NO: 83419 - DNA, 601 bp, Human
cagtaccataaaaggaataaaaaacaggctgctaagagaaagaaaaaagactttggacacaggtccccacttgatgaagcagaaagattccttacatccatctttcttgttattacaatacagatttgctatcttgtttcaaagagcattctaaagagtttatagttatagaagctcttcatgcggctgtgaaaagatttagattattacaacagataatgtaaaattagagaaagtgtgttttttaataaactgtaatgaaaatttcaaataaaaaatttattttattttattattattwtttttttgagactgagtctcactttgttgcccaggctggagtgcagtggcgcgatctcagctcactgccagctccgcctcccaggttcatgccattctcctgcctcagcctcccgagtagctgggactacaggtgcctgccaccacccctggctaatttttttgtattttcagtagaaacggggtttcactgtgttagccaggatagtctcgatctcctgacttcgtgatccgcccgcctcggcctcccaaagtgctgggattacaggcgtgagccaccgcacctggccaaaaattattg

SEQ ID NO: 83420 - DNA, 601 bp, Human
gggttgaacgttatttcagaattacgagttcaaaaataaagttttgctacatttggttttgtcgatatttatgccgaaaatcataatctcataaattaacttcaacattattttaaaattacagatggctatatcctgtatcccttggctagatactttctgaataacaataaaaacgaatcaatgccatgaaaagcaaatattgcattataatatataattgtagttatatattttcactaattttattagttgaaacttaaatatgcttttagagcatcttctcaccaattccatcttcttctctttgtccaccacgtgttcacaccaaacccacttcgatccccatttatccggaaatttatatctaggataaggagcagtccatgcctcacttacggtggcctcacctaggtcacctgcttatatgtgaggtatggactgaaaggggagctggcagaggtcccagtcagatcacggctcaaatatgcttttacagcatatttgagtttcaactaataaaaatgaaaaagtaaacatatcatatagtaactttattagtcttgagggatataataaaatttacaaatgttctattact

SEQ ID NO: 83421 - DNA, 601 bp, Human
ttgtctttatttccaataatgctgcaaacattagaagatgtgatagaaatgtgtcttgggaactttgctttggccatttatcaatattttcaactgtttctatttgatgaaattaaactgttactaaatagaaatagttccctcacatcaaatttgttataggctgtgttactaggctgagtattatttacttcagctctatagactgctcttttcctgctcagctgatattctaggctttatgatggtgataatgatgcccattaatatttttaacattctttacttcataataatcagrgaggtacattcgattgacatttaaggttgttatatttagcaaacaaaaataaatggcaggattctcaattaaacgtgaatttgagatcaataacagcacacacacacacacacacacacacatgcttctcaacctacagtaagcttacattcttataaacccatttgaagttgaaaatatcttaaatcaaaaatgcatttgatacacataatttagtaaacattatagcttagcctagcctaccttaaatgtgctcagaacacattagcctacagtttgccaaacttatctaacacaaaa

SEQ ID NO: 83422 - DNA, 601 bp, Human
gagcttcacttcaggtctgatatccctccggtacttgagctcctcagcagcagaaggattcctcaaggctgtgatgtcaaaggcctctgtgtcttcctctccgcctccttcatcatcataggtgaccacgttctcccgtacatcctcttctgaaatgatcaagggctcttttttgctgcgcctcagggtgataaaaagtaccacaattgctgaggaagaatggaaaaaggatgaagaattaagaaaacaggaaggaaattcttagagattttacaacagcaatttcccattttcccattcrtcattaaccacattccagagttaggctggcattgcagcacaactcactctgtgctctctgaataacaccgcaaggtactgtaatgcctcaaataatgtaaaagatgattaccccaggagacattgcgaattgctgatcttctatagaaaaccacaatactctcagtttgctaagatgtaggtttcttggctcatatttcagtaaaaccatttagtgattaaagtgagataaacacatgatgaaaaaataatatgaaattttaactcaaaaaataatgtagtgagctggtctctctataga

SEQ ID NO: 83423 - DNA, 601 bp, Human
tccttacacccattaatttgttgaatgttttggaaacatgtaactttctttggttttagtttttgaacggatcccatttttagccctgcacaaatgattacatgttggttcctatcttaggtggtgagcccaatgaacttttgaaaggatcaagggggcaatttacaacgaatcttagatatgaagcatgaatgaagtgttgtttaatttatcaccctcagcagagtatagcccaaatacactggcaggggtgtgtaaagtctttttttgtcacagaatcccgctgaaccgtacttatttsaaattccatcaccccttaccgtgtacgtgatggtttcttcggtgtcctgtgacttgaccagcgccagagtcagcatagttaggaaaagggctttcaacattgtgaatctcaaagaaaatacaggacaaactaatgtttagtatctgctgcggggaaagtaacaaaactttagcagtgagcacaagcgaggaaaggagggtgggagaggctgaggctccaccatactcaacttccaatctgctttctcatctcccctccccctcctgaaccttctcggtagccaacgaacgaggcagcaaa

SEQ ID NO: 83424 - DNA, 601 bp, Human
ttaccttacacattgccgcaaggatcaaaggagatcgtgtctccacagcgggatactcagaaatagttattatcttgtcctttaaccatgaattattaggcatacaaaatttaaaggagaataggcccaatcttagcacaaaagggtaacatatctggaaaatttgttacaataataatgaaccctagttagtggtcttaaaactatcatgtttaagccacagggaaccttctctggtaaaaatgaggaagatttaggtgattagcaaagggaagggcatagaagataagcaactggaaargaagtaaaatcttttatgagatgattataaaagtgggtagtgaatttaattttagctccctgagaaggcagtaagtttagtctgaataacaaaacattttcattttaagataaacagcacatgccttcatttttcttgcttaatttatcttcagcagaggaagcaactgcatttaacatgaagttaacaaaatatttgtattaagctattttatttatagtggatctgaacaacagaaaggaacatttgccagatgaatactaacattctagggataatgtggtaccaaaaagtgagata

SEQ ID NO: 83425 - DNA, 601 bp, Human
tgtaaatataatgctcatgcctttttggtataacacagacaggacaggaagagtgacacaagagatggagacagaaggcaatgatcacatggaagtctttgaagctggctcacctttgcattgctgtctcacaggatcccactcatatccgtcagtgcattgctgtgaagaaaacatcaaaggtggggccaggagacagttaattggtgtgtccattccctaagaaatcactctaaaagcttcattcttatggcaacaatccttgtgctaaagtcctagatatatgatgagatgggtggtytaacattctatcgcttttttttcaaaagacaagtctgtgcattggacagcttcgggggtccattctcaaccatcagctgcctaaactcttctgttctttttggtacagttgcccagtaccatcttcttttctgttttgagactaatcttctccaacttctctgactgctctttattaatttgccttttttcccacattggaaatgttaaaaaaaaaaaagaccaaattctctctctttcctcgccctctcccccgcccccacccccaaccagccctggactcttctctctctctctaaat

SEQ ID NO: 83426 - DNA, 601 bp, Human
ccatctcctttagaaagattatatagagactattgccaggtacagtggctcaggcctgtaacaccagcactttgggaggctgaggtgggcacatcatctgaggtcaggagctcgagaccagcctggccaacatggtgaaaccccatctctactaaaaatacaaaaattagcagggtgtggtggtgcacgcctgtagtcacagctactcgggaggctgaggcacaagaattgcttaaacccagaaggtggaagttgcagtgagccaagatagcacctctgcactccagcctgggtgacagcrtgagactctgtctcaaaaaaaaaggagaaagagactatgcaataaaggtgtagaaaactaaagtgagccatcaacagattataatatattccccattcattcaacttctttttggtgtagatgagtatctgttgtctttgaggcagatgatatctaatggaaacaattaatttcgaaaactctatctatacatggccccaggtatgtaacactgaaatgatcttcattttatagatgccaagaataatgtcagtcatgggaaactcccagcgttactggctcccacagcatgatcctcat

SEQ ID NO: 83427 - DNA, 601 bp, Human
ctcactggacaagcaatgcctcaacctgaaaaaatggctctaacgttaggacttcttcactcttgtctgtgaggtgcaggcgatttggctgtgtgggtatgctaggggctcaaccatcctatttgcctgggacaaaggcatttccaggaacatggagcttttggttttgaaactggacagtcctggtagacagagatggtggaaaccctagggtatgtttttttcatatttctcaatgatactttatacaacataagccaggtactgtactcgatttggttttacaatcaactttattggrcattcgtactgagttcatttctcgatggcacagtttctttaccaagttagtagtcatgcctgtaagtcctgacagggtttattagtggcttaattaccaggtatgcaaaatgccatgtgttttaatttttttaaagttcaattaaacaaacaagtttcttcaattagggcaatcaatgctttctctttcttgtcagttcccaaatgactttttttttttaatacaggaatggaagtcttagaaagttatatatgattttaaaaaatcctttctcaacttcatctagtgatttctaactcc

SEQ ID NO: 83428 - DNA, 601 bp, Human
tttatatagcagaagttaagattaagttaaggcattggttctcagacttgagtaggcgtccatattatgggattgttaaaacaatatatagttatatgttatataactatatgtagttatattgttataacaatatatttaattgtcttattataacaatatatgttatataatatattgttaaaacagtataatcccagaaccagattgctggtgctggccccagagtttctgattcagtcagtctggggtgggacctgggaaatttgcatttctaataagttacctgatgatgcttgaygcatctggtctagggactacactttgagacccactgaattagggaggtgtgtagcacagtcctgctgcaggagagtgatcatactgacctcttctatccttccacctctaacggttgtcattcaatttttatgaagcaattttaagaacactttctgactgtgtatgaatcagatacctataaatactgctcacaaatgtgtattgaaaatgacataaattgactagaaatttaatggctgcagcatattgaaaagtaaattatgaaacaatgctagattttttttaggagtaaatcaat

SEQ ID NO: 83429 - DNA, 601 bp, Human
atttctcttgggatatacttttcttttttagaagtggaatcttttgatatcacacatttacaaattgtaaaaatacgattctgaggattaaacagcaaactctgaaaaacagacttacactgccctttgtcattctggtatattagaaaatattgggatatataagttttcagaaaatagtaaaaatgttaatttaatggcatgctggtgtgaatgtatgtacaagaggagggctttgctgcaaaatatttcacaagggaaatctaacatcatcattgaataaaaattcttccctaacccrggttgtgacagacttggtctgcaaggtgggcagtgagttggaccccatgagttgtttcccactttggattgtgttctgtggcttcactcaagggagtaggattggattccttgcaacacacaaggctgtttagagtgaaaacttatttcaccaccttccccacaacgatttaactacatgcagttccagctcctgtcatgattctcattttaactaggcacacataaaagcacatgcagtttttatggctgtcttggattcccttccctacgtcactcttatttcacctacagttcaagt

SEQ ID NO: 83430 - DNA, 601 bp, Human
tatctgcttaaattgcacgacaattaaatttccttcttccatttagtttctttttaccattagcttaccccccaccctgacccacgacaatcactgaaggagggaggtcatatgattgaagttcagaacaaagccctgcatctttttttttttttttttttttagacggagtctcgttctgtcacccagactagagtgcagtgtgtgatcttggctcactgcaacctctgcttcccaggttcaaacaattctcctgcctcagcctcccaagtagctgggattacaggcatgtgccatcacrcccagctaatttttgtatttttagtagggacggggtttcaccatgttggccaggctagtctcgaactcctgacctcaagtgatctgcctgcctcggcctcccaaagtgctgggattacaagcttgagtcaccatgcccagccaaaacccttcatctttaccagcttgtatgggaggacttttttttctggctccctccctggattaagattcttctgatattccaggacatgaactgttttaacaaaaggtgcccacagcttttactgcaaagtttaattcataatgaatgactggaatt

SEQ ID NO: 83431 - DNA, 601 bp, Human
cccctggctaatttttgtatttttagtagagacagggtttcatcgtgttggtcaggctggtctggaactcccgacctcaggtgatctgtctgcctcagcctcccaaagtgctgggattacaggtgtgagccaccgcgcccagcctgattttccaataattctttaaagctctattagaatcctaatactgtttgtagccaagtttttacaatgaaattagatagtataagctctttttctaacagactgacattctaatagtccatttggtgtattaaccttctgtgataggttggtttaytggaaactaatgctctggcatgcttacacaatccatttttctgcttaaactgaaaaatcaatgaaaatatttttcagtttacttagagttgagctctaatttacaatagttttgctatttaacatttttttgaatgagctgttcactaatctttcctgttctacagaactattattatctgcttaaattgcacgacaattaaatttccttcttccatttagtttctttttaccattagcttaccccccaccctgacccacgacaatcactgaaggagggaggtcatatgattgaagttca

SEQ ID NO: 83432 - DNA, 601 bp, Human
aattatttcttctcttctaagggatagtggcttttttttttttctttttcttttttttttttttttgctgagcaacagctttggcataacaataatatattacctattagaataattacaaaacttaggatctccaactgcaaaggcttggtatgaatttgaacctgcactgattcttcttttcctatcttctcagcctatcaagatttacactgaaaaataaacaggtctgttgcttgcagttagttttatccacttctcaggacttttactcaattttttgaagctatggagaaaatgmaaaataccattcacatttttaaataattagtgtaatcttctttattaaggtcttcctgattttctcttgtcactataaacttttcctttaatctgaaaccagaaactatgtattttactaagaaaatttcatagtaagttcataatacttttggtaatgtgtaaagtctgcctgttcctgactttgatactgtaaacagattttccaataattcttttttgtgtgtgtgtgacagagtttcgctcttgttgcccaggctggagtacaatggtgcaatctcggctcactgcaacctccacc

SEQ ID NO: 83433 - DNA, 601 bp, Human
tctctctccctctttttctctgcatgtatcctattgggtctgttttcctggagaaccttgactaaatacagaggttcacctaactgtgacagagaaattatttcttctcttctaagggatagtggcttttttttttttctttttcttttttttttttttttgctgagcaacagctttggcataacaataatatattacctattagaataattacaaaacttaggatctccaactgcaaaggcttggtatgaatttgaacctgcactgattcttcttttcctatcttctcagcctatcaagwtttacactgaaaaataaacaggtctgttgcttgcagttagttttatccacttctcaggacttttactcaattttttgaagctatggagaaaatgaaaaataccattcacatttttaaataattagtgtaatcttctttattaaggtcttcctgattttctcttgtcactataaacttttcctttaatctgaaaccagaaactatgtattttactaagaaaatttcatagtaagttcataatacttttggtaatgtgtaaagtctgcctgttcctgactttgatactgtaaacagattttc

SEQ ID NO: 83434 - DNA, 601 bp, Human
aggtggtgctagagggtgagtgtcactgaaacttgagatttgcagaagatccaggaagtaccatcaatagcttgagtttttcatgataatagcatgcagtatatattttttaaattgaccaataggcaagcaacaccaagtcatgaattttcagcaattgctgttacccagttgtgatctttgtggttaagagtttgtgatggttaattttatgtgtcaacttgactgggctaagggatgcctagatagctgttaaaatattatttctgagtgtgtctgtgatggtgtttccagaatagayagcatttgaattgactgagtaaagcagatggccctcaccaaagcaggtggatgtaatctagtccattgaaagcccaaatagaacaaagagtcagaggaaggattaattttctttttctcttcttgagaggggacatccatcttctcctgcccttaagaaaggagcattggagctactcctggttctcagattttttggactctgggacttacactagcagttcccatctcccacaccctttttagccctttagacttagaccaaattacaccactggctttccttgttttccagcttgta

SEQ ID NO: 83435 - DNA, 601 bp, Human
tgtgtggtggtggtaggtggtgctagagggtgagtgtcactgaaacttgagatttgcagaagatccaggaagtaccatcaatagcttgagtttttcatgataatagcatgcagtatatattttttaaattgaccaataggcaagcaacaccaagtcatgaattttcagcaattgctgttacccagttgtgatctttgtggttaagagtttgtgatggttaattttatgtgtcaacttgactgggctaagggatgcctagatagctgttaaaatattatttctgagtgtgtctgtgatggtstttccagaatagacagcatttgaattgactgagtaaagcagatggccctcaccaaagcaggtggatgtaatctagtccattgaaagcccaaatagaacaaagagtcagaggaaggattaattttctttttctcttcttgagaggggacatccatcttctcctgcccttaagaaaggagcattggagctactcctggttctcagattttttggactctgggacttacactagcagttcccatctcccacaccctttttagccctttagacttagaccaaattacaccactggctttccttg

SEQ ID NO: 83436 - DNA, 601 bp, Human
ctacaggagaaaattctattaattagtaagagagggaaatatctgtgatttatagctatagctgttacaatgtaatttgtattggagaaacagtatctaaccaaaggagaaaaatgtatttttgaaaagtaaccacatgcaaatttgactctatccagattataccccatttgctgctgcagaaagtagaagatgaagaatccattagacatatcagtttcttggtaggaaggatactgtcagctactggaagacaggttctgcatacatcaacaaaaccagggagcttgttagaaatgtrtaatgtcatgccttaacccagacctacccagaatcagaattttcattttaacaggatccccagggaactgatatgttcattaatatttgagaagcactaatctataatgcataacacacaggagattctaaaaaacatattaaacaattgaatcccaaatctaaagacttctttagccaattttataaaaacagcaaaaccaatttattaggtgtcaccttttctattttccttcatcagtcttttgagggacatatgcatttatacaaatatatatgcatgtatacatatatatgtata

SEQ ID NO: 83437 - DNA, 601 bp, Human
cctttacattttacatggggttatattaatatatgcaaaaagtttatttcctgcgcaccaaaataaaaataactcctttccaagctaggattgaaatgaagtctggggctgtggcatgaaccacaataccgtaattacccatgtcagtgcctggggaaaagactgcagtgatctagcttttaaagcttcagtgatttggtgcagacttttagcaaacaactagtagtaggtgtgaactgttttgtcaataaagattcaggtgattagaaccagctggttttttgcttctgagtcattaatkctattataatcacagaatgcacctgcattcttcccaaggtggattttgacttgcctcggtatgttttcctgataaaaatgccatccaaaaggcaaaaatgaactatcaatggaaacagcttaaatgccaggcatatatcaatcaagaaccatatcatcaccatacatccacaaggcttacagcctagacaaagtgcactcattttctctctgtctctttctctttcctgttctttgtaaataatttcaagtaagagctgaaaggacaactcttaattttaatagctgagaaaactatcca

SEQ ID NO: 83438 - DNA, 601 bp, Human
agtgctggcacctttacattttacatggggttatattaatatatgcaaaaagtttatttcctgcgcaccaaaataaaaataactcctttccaagctaggattgaaatgaagtctggggctgtggcatgaaccacaataccgtaattacccatgtcagtgcctggggaaaagactgcagtgatctagcttttaaagcttcagtgatttggtgcagacttttagcaaacaactagtagtaggtgtgaactgttttgtcaataaagattcaggtgattagaaccagctggttttttgcttctgmgtcattaattctattataatcacagaatgcacctgcattcttcccaaggtggattttgacttgcctcggtatgttttcctgataaaaatgccatccaaaaggcaaaaatgaactatcaatggaaacagcttaaatgccaggcatatatcaatcaagaaccatatcatcaccatacatccacaaggcttacagcctagacaaagtgcactcattttctctctgtctctttctctttcctgttctttgtaaataatttcaagtaagagctgaaaggacaactcttaattttaatagctgaga

SEQ ID NO: 83439 - DNA, 601 bp, Human
tttaccaaaaaaacccaaaactttgctttggattttagttatactttctaatagctgaattagccttttctctatttttctctctggttaattgacaatctggctactagagtattcttcatggggaaactggatgtggctggcagctgtcccttcatgccaccatctcatattataggtcctgctattattgttaaattggtttctacctttatcgatttttagtcatatatctttcctcttttcctcagagtgctatcctacttcattagtgccgctttgttgaaaaataagccactaycctgcctcttattgagatacctattccttgggaccccaagaaaattcatgttagattttgttgcttctgaagttttaactcttaaacaacctatttattgtaatcttaggatatgttcagtgcatgtcttctagtagacttttggggcaaaagaaacgatgtaaacatatttaaacataaaggtgatgattctaggagcaggtttttgaatagactgtgggaagaaaaatgtgaacagaacagaacagggatttctaggagagagatggagaatgtgatatccatgattccctaacaaac

SEQ ID NO: 83440 - DNA, 601 bp, Human
acgaataaatatattgctcaataatattagaaacaaactgttcaccctacttagagtcaaacttgtttagaatcactgtttcacacagcagaagctgctctgtggcaaaataatgaattatctattataaataattttaaactaattattatgatccagaaaatagtccttacgtagcacactctctttttatgcctcttactagcatactttatgtacagtacttgaaagttaatgcaattctttctttaaaaactcactcccttttccataaatcagactgacataggcccttaccacyaatgctccccacctcagtcccattaagatgatttaacacatttaaccatatgtgtaaatgtatttttttcctcctcatcctacacctgtctggagatagggttttcattatgtcactcttcgctcaaaatctgtcactaattgtgacagtaataaatctaaatggcttaaccaagaattctgggtcctacctcaactgtcttccaatggaattttccgatcttgtttcctgctgcacccacagtacctgccttgcctcaacccaaacagtgacactgggactggggtggggaacagtggt

SEQ ID NO: 83441 - DNA, 601 bp, Human
aatagtctcacactttgaaatgatgtttagggatccagctacaggatacctagtctggggttttgtgctatctccccagctgtaactaacaaagcaatatcaatttttccccgatcttattcttcctaaatctgatagaaaataaaaagtaaattccagataatgaacacatcatctccagcagacccccaccattgagaaggaaaagtacaggtatgactattattaatgaagtgtttcagaatggaaacttaaataggtcaataaatggataaaccaggtgttttacctttccaaactagctgtggggtctcccaagaaaaaaagtcaagacttagtgaagtgagatcgaaatccagttaaaattcttttggattaatccataaactaaaccatctattcttatgttcttaaattcttgttttattagctcggcagtccagcctcacccctactcccaaacctctttctgtaccgcttttaaattcttatttttatataaaaataacctttaactggaaaatgtttcccctagatgtatcaggaaaacttgttgctttcctctatctacaaccagattactttttagttcatgcttatt

SEQ ID NO: 83442 - DNA, 601 bp, Human
tatttataaagactacctagcacacataacattaactagagctctaattagaacctacatgtaattctgagagagaactattgtgtgaacaagttctagctatgaaaaagatatgaaaaatgtaaatttcagcagcaacttttatttatttatttttttgagaatgttaaggacattgtggtcaccatctttcaagacagtaataaaattatcgatcagaactatgaaaaaacagggaatattttcaaatgtcatagagttaaatgcatataaagccaggacaaggatttctggtcatttgttcttaataacaaagcttagagttagactttaagatgaaaatgttgtatgcctgacttttcaaataagcaggttggcagagtcttcactaagcagcatggtgatctacaccacttgtatttaatgaaacattcattcagtcatatcagataggagagtttaattttgggccaatatttgtttttttaaatgttgtgctagtaatatagtaaaaccatggcatattagaaaagtattcttttggaaagttaattatagtttctttgaatacaaaatgaccttcttcaaatgccttcattat

SEQ ID NO: 83443 - DNA, 601 bp, Human
tggtatgaccttcccctcctttggcatattccagatgaatggatacaagaacaggcaaacacagcctttcttgctaaaagttatttctcattaggaaaattgaaaacattcaaacaaaacaaaatctgtcaaaacaaaacaaatctagtatcttctgcatttcataatatttgattccataaaatcagtcctatcagaggaaaggactgttgatggctacagaatcgcttcatggcaatgaagtattaatatttataaagactacctagcacacataacattaactagagctctaattagracctacatgtaattctgagagagaactattgtgtgaacaagttctagctatgaaaaagatatgaaaaatgtaaatttcagcagcaacttttatttatttatttttttgagaatgttaaggacattgtggtcaccatctttcaagacagtaataaaattatcgatcagaactatgaaaaaacagggaatattttcaaatgtcatagagttaaatgcatataaagccaggacaaggatttctggtcatttgttcttaataacaaagcttagagttagactttaagatgaaaatgttgtatgc

SEQ ID NO: 83444 - DNA, 601 bp, Human
tgcttgagacagaagggtgggtaagatcacaggttttagagtcaaataggtctcagttcaaatccaagcaacatcacgttttagttatgtgtcctgggaaagttatttgacttttctactcttccaaatctcactgccacatctatgaagtcggggaatgttcagttcaaaatgatactgtgaggacaattaaaacaatacacactcaaaatggaggtacctggtccacagtaagtgctcaataaattatacttaacagtgtgaagacttaaattggtagtgggatcagggtggtacttcwgctatatacagatggaaggaagcaagaacactgcaggaagttggggtttttaatgtaattttctatatactttcacattattaaatatcctacctttgttttgttgcttagtgtcatgttttcaatatggtctttatgactaacacccaatcaacaggagcatctatggtatgaccttcccctcctttggcatattccagatgaatggatacaagaacaggcaaacacagcctttcttgctaaaagttatttctcattaggaaaattgaaaacattcaaacaaaacaaaatctgtcaaaa

SEQ ID NO: 83445 - DNA, 601 bp, Human
tggttatttattccttctctcttccttgagcaggaaaacagttacgaaattttagactcattatttcttgtcctgtattaaggatttttcaggaaggaagactcagtcttcatcatgttaaggcataagattattccgtgatcaaaatgttaaacttgtgcccaaatccttcagataacattaaatcaagtgagatctgacttcctggttttgttccaaattgataccatagttaccatttcctccaagttatccataaattatcatgcattcttggacttaatttgttgataaattatgwtgacataggctgtgggattttcctccctctatgttaaaacactttcagtgttgtgaagcaacagcattcaaataactcctgaatattagctcaaggagtgcctaaaggccataagggacaaaagaaaatctgttcaaaaaaacttctgaccctgtgagtgttgcaattctaaaggcttctcaaagctagcatataaaatagtctttggactttaaaatgagtctggggcattttactttacatttccattggggacagaaataagtttctcagaaaatacattctctgagatctgtttca

SEQ ID NO: 83446 - DNA, 601 bp, Human
acctcccagattccagcgattctcctgactcagcctcctgagtagctgggattacaggcgcccaccaccatgcctggctaattttttgtatttttagtagaggcagggtttcactatgttggccaggctggtctcaaacgcctgaccttgtgattcacccaccttggcctcccaaagtgctgggattacaggccttcttaaacttaattattaatttagaaaatgtttgggaaaagaaaaccctgatatttgggatattaacaaccattcatcagtctgctaccttgtggaggtaaacctrtattttgaaacaaacagcaacatcagtctttgctccagagtggctcagtactagaaattaaagaccctttgtgtgaaggtttaagcccatgccacacaggctggagacctgcttcaaagtggatggccttgggaggaattaagatcccgccctattatgggatgcctctgcactgacatttcaattgtgttttcctggttcccggccacttgatctctcctctcctctatctcccacttccccggctccggctcaaacactggtgagtgatgaactgaatggagactgactacattcaac

SEQ ID NO: 83447 - DNA, 601 bp, Human
gcaatcttggctcactgaaacctccacctcccagattccagcgattctcctgactcagcctcctgagtagctgggattacaggcgcccaccaccatgcctggctaattttttgtatttttagtagaggcagggtttcactatgttggccaggctggtctcaaacgcctgaccttgtgattcacccaccttggcctcccaaagtgctgggattacaggccttcttaaacttaattattaatttagaaaatgtttgggaaaagaaaaccctgatatttgggatattaacaaccattcatcagyctgctaccttgtggaggtaaacctgtattttgaaacaaacagcaacatcagtctttgctccagagtggctcagtactagaaattaaagaccctttgtgtgaaggtttaagcccatgccacacaggctggagacctgcttcaaagtggatggccttgggaggaattaagatcccgccctattatgggatgcctctgcactgacatttcaattgtgttttcctggttcccggccacttgatctctcctctcctctatctcccacttccccggctccggctcaaacactggtgagtgatgaac

SEQ ID NO: 83448 - DNA, 601 bp, Human
attaagtaacaagagagaactgtcttaatcgatggccagcagtagatttatagttctagattcttatcagttctggcaaaacagattgttaataatttggtgtgctttaaatgataaacaaaaatatcaccaaaatcaacaaattatcagcctccctgatagttcatttctttgttttagagagtggcgaaatcaagtgtcctagaagcccttggcattgcattgtgttctatcagaactttacaatatgctgttctcataggaaaaaaatcatgctacttcgaattgcttttctagcaaygatgacggatttgcattgcaaatggacccccctcacgtagcttcctctgtggacaacagtgttcatttgccagatgattggatgaggttaggcatacagttcatgaacatggggaagaaaaccaactaatgcatgtgaacgaccaatctgtgactcatctgtactacacataaaccagatgaaccaatgggtcataggctgaaacagaggaagagcaaagaaacaaaggctttacttctcattcttcagctgtttttgcccactggcaacatgaagcttatgctttcagaatctcaagga

SEQ ID NO: 83449 - DNA, 601 bp, Human
ttacctaatggagctaaaaatgtatgaagcagagtaacaaggtatatctgagaaacacagcaaaatcagtaagatgttagtaaaagaaaaatgatgttgagcaagtgagtccaggagtgcagaggctatgaggtataaagcagattcgccagaagaggtgggttctccactgcattttgaagaagacgagatacatgggttgccaggaaaaggaagctgtttctaggcagaaagcagctcacattagaaaatgctgataagacaaaactggtttccatgagaagaatggcagacagatggmgtcagcacagctgccggggctctgtgtgaggagcctggtgcagtgcctggttgaagaggatcatgaaatgctagatctgtcgtgaacaaaattcaaggccttaaaggcaggattagagagtctggattgaacaacataaggagtctctctgaactatgtagacagagcctaatgttaacattaccaaagaacaaaataatagattgtgcttcctaaaataccataacacatttcgtcattctaatacattaacaatagctaatggcaatatttggtgattccctcatttttcaaaaatgt

SEQ ID NO: 83450 - DNA, 601 bp, Human
aaataccagaaagctcactatgatacaaaatttactaaaatggacaatgatgtcagaaactcaaagcagaatacccatccctgtgcagatgctctggaaaaggtggctctcccaggagtgttgatgacagtccactgccctctacttgctcctgacttcccatagtgcaaacacagccttttgtaggtatctccatggtgtgtaagaaaaatctgtttcctacatttgtatgggagaatatctgcattagcaaaagcaatgctttatttataagggaaactactcaggtcagccatgattytcctgataatctaggacaaattactatggggagaaattttttgttgtttttgcatgattataatttatccttgacagttaagctcacttggtttttcaggcagtcagttaataaatttcctgggacctggacccaagctctttgggtggggatgggggatctatgtcttattttcccccctgtattcccagtgcctaggatagtgcatgaaacatggtggattttcaataaatatttgtgcaataaatggataaatgagttattaccatttgctgagaattggtacctaaagtttcagga

SEQ ID NO: 83451 - DNA, 601 bp, Human
gttgtttcttgttattgtggaaaatggattggtagtctataaaaaaataaggaattattggctaccactctccaaagaaacatgaatgctttgattggaatgcttgaggttgaaacagttaaggtactcaagacaggaccgtgctcactgcactgtggtacttacctacgcactgctcccctcgcttctgatatccaggagggcactgacatgcaaaggatccccgtaaattgatgcacacttggtctgctctacagttgtgcgtccctgcagtgcactcgtctatgtctgtcagagacaygcaacacagaaagaattgtcagttgtgaagatgttgatatttcctccattttgccacttcttaagctaaatttttactttattcttaaaagtttataatgttcttgcattggaaatgtttaaaattataaattatttcaagtgttcagaaaataattttgcaaataccagtgagtactgctcagatttaacaaatgctaacattttgtcatgttggtcttggctcattttgttttgttaagaaacatttcagatacagctaaagcctcacaccatcctcatcccttgacccatcagctac

SEQ ID NO: 83452 - DNA, 601 bp, Human
acacaagatgacctggtcttgctgtcagggagctcacgctcttaggccctccagcagaggcacgtgctgaacttggctttgtactcatggtaccctacaaaggcttgcagtataaagagcctttaatacccatctgttgactcagaatacaacgatagcaaacagctttactgcacagggacaggcactattctaagcattccctacatgagctctggaggtagggcctagtatcatctccacagtacaagtgaacatagtgagacacaggatttaagtaacttgctcaaggtctcaaagygagctggggttggtgcttggaatgcaactccaccatttgctctatgtgctgtgctatgctatgctctgcagcagtgaatggtgaatgaagcccacagtaccagtgtgttagcgcgatggcccccaaaacagcaaatttaaatttttttgtggttgtttttattgtcccattcataccccaaatttctgctcttgcttcgtctaacatttaaccaacactttgttatccagaatagctcaacctttaaggttgtttcttgttattgtggaaaatggattggtagtctataaaaaaataagg

SEQ ID NO: 83453 - DNA, 601 bp, Human
ttcttaagttgcctgggtttcatatatacacacacacacacacacacacacacacacatatatattttttttgttctgctcaacagtccagaggaagtaatacacttttgaggtgagctaaagagagtaaaaatattgcaaattctgaaatagaaatacaaaactttataagcagctaaaaggcaaattctaacaatatcagcttatttccctctatgacttcatagcacaaaaagtttttcttatcatgacttttactgaatcattgctgacaatttggctaatcctggacctaactacrctactgaatgaattggcttgtggttgacggccttcattttggactctgcagacccatccaggatgtagagttcatgtttgtcttctcagaaattgggtgactttgaagccaagttcatttgagctttgaatgccaagtcccctaacctgtgcaagcttccagaatgacagcttggcaggatctgactttcaggggaagaatgctttgcatttctgaatagtgatgtccctacagtttactcagaagggcagaggcagctgtcctgaggtagcctctttcagttttgagtgtaatggcatg

SEQ ID NO: 83454 - DNA, 601 bp, Human
cattcttttgttgctttgtgtaaatttaagtgtttgtactagcttttccaggattttctacgtttttggttttatctgacagtcctttccctgttaagaaaattttcaactacatgcaacattggaggtagggtcctttttttttttagatcttcctgagaaactctgaaatcataccattgtggggagctgcctcttccacttacgtataggtgtgaagatcatctgaatgtttattttgaaactggacccaaggtcattagctattttggggctagtagttttctctaaaatattcaastatattttacaacatattaggctgacttttctcagcacctacattcttacgcaatttataatccttgtgttttagagggctaagactggatggaggtatgtttaactcacatattgagcttatgctctaaactcaaactcacaggtgaaacattttaataactgaatcttttccagtggatgatttgaagatgtatctcaaagagatgatgtaggttacatagaatacatatcaatattttattaaaattatttatcttttaaggacgaaaaatgtcggcattagcatagaatcacctct

SEQ ID NO: 83455 - DNA, 601 bp, Human
ggaattattttgggtttgaattatatgtatgtctatgtataattaattaaccatcaatgattagtgatacctacttggggggtatgttgggtgggggcagaggcggggggatgggaggcttgtattttcgtggtcacacacaactctatcagagtctgccaaacttaatatttgagtgatttcagggatgctacttaatctttctgcatctcacttttctcctctgtaaaaaatggagatgaatattaatatctatctggcagtgttaccaagaggaataaatgaaataatgtagctggarggccttacacaatgcctacacataagacactttaaatgtttgctttccttccacatgtggataccacacaacaacaacaacaacaacaacaacaacaaactcccatctttctcaatagttaaggctgccttcaggatacttactcgtaggtagaactctccattttcatttccagatttaatccgaaaagtattgatggtgttggcataaatagttgtggcctgtatctggaagatgtctgatggcacagacctatcagatcggatgctcatgtatttgtagactattgactggggcagt

SEQ ID NO: 83456 - DNA, 601 bp, Human
atatggtaaatgctaagatatatgaggttatgcagggtacgtatgaagatacataaaggtgtatgtataaagggaagaaaaggaagagccctgaagcactgagggaaagcttttgaatgcctgatgagagtcaccaggcataaatgaaagttttgtaaagtaatatgttcagaagaactgggtgcagtttcattttgatgaataatatgatgggctcttgtgagtggagggagatgaggttggagaggcaggtaagtggatgtgtgagtttgaatgccaagggatagagtcatggattagkatttagcagtcacctcaatgggtggacattaaaccaagggagagaatgctttggttagggctacttgttatatactcatgagcagcttgcaaccctctgctgcagcagtcaacatctttctgatcacttgttcaatgtcttgactacaagctccacgggggcaggaactggcttggctttattcattgttgtgtctccaggatcttccacggtgcatacctcttgtaaacaatagttgtaggtaataataacaccttgaaggtgttgattgaattaatttattcatttaaattttatttt

SEQ ID NO: 83457 - DNA, 601 bp, Human
ttgtaaacaaagttgtcacttttcattttctcaacattgtgcatctgtttacattctagtaagtaaagagaaatggaaacagtttttcaacagaatatggtaaatgctaagatatatgaggttatgcagggtacgtatgaagatacataaaggtgtatgtataaagggaagaaaaggaagagccctgaagcactgagggaaagcttttgaatgcctgatgagagtcaccaggcataaatgaaagttttgtaaagtaatatgttcagaagaactgggtgcagtttcattttgatgaataatrtgatgggctcttgtgagtggagggagatgaggttggagaggcaggtaagtggatgtgtgagtttgaatgccaagggatagagtcatggattagtatttagcagtcacctcaatgggtggacattaaaccaagggagagaatgctttggttagggctacttgttatatactcatgagcagcttgcaaccctctgctgcagcagtcaacatctttctgatcacttgttcaatgtcttgactacaagctccacgggggcaggaactggcttggctttattcattgttgtgtctccaggatctt

SEQ ID NO: 83458 - DNA, 601 bp, Human
aatttctaaacttgtaaacaaagttgtcacttttcattttctcaacattgtgcatctgtttacattctagtaagtaaagagaaatggaaacagtttttcaacagaatatggtaaatgctaagatatatgaggttatgcagggtacgtatgaagatacataaaggtgtatgtataaagggaagaaaaggaagagccctgaagcactgagggaaagcttttgaatgcctgatgagagtcaccaggcataaatgaaagttttgtaaagtaatatgttcagaagaactgggtgcagtttcatttygatgaataatatgatgggctcttgtgagtggagggagatgaggttggagaggcaggtaagtggatgtgtgagtttgaatgccaagggatagagtcatggattagtatttagcagtcacctcaatgggtggacattaaaccaagggagagaatgctttggttagggctacttgttatatactcatgagcagcttgcaaccctctgctgcagcagtcaacatctttctgatcacttgttcaatgtcttgactacaagctccacgggggcaggaactggcttggctttattcattgttgtgtc

SEQ ID NO: 83459 - DNA, 601 bp, Human; identical to SEQ ID NO: 83423

SEQ ID NO: 83460 - DNA, 601 bp, Human; identical to SEQ ID NO: 83424

SEQ ID NO: 83461 - DNA, 601 bp, Human; identical to SEQ ID NO: 83425

SEQ ID NO: 83462 - DNA, 601 bp, Human; identical to SEQ ID NO: 83426

SEQ ID NO: 83463 - DNA, 601 bp, Human; identical to SEQ ID NO: 83427

SEQ ID NO: 83464 - DNA, 601 bp, Human; identical to SEQ ID NO: 83428

SEQ ID NO: 83465 - DNA, 601 bp, Human; identical to SEQ ID NO: 83429

SEQ ID NO: 83466 - DNA, 601 bp, Human; identical to SEQ ID NO: 83430

SEQ ID NO: 83467 - DNA, 601 bp, Human; identical to SEQ ID NO: 83431

SEQ ID NO: 83468 - DNA, 601 bp, Human; identical to SEQ ID NO: 83432

SEQ ID NO: 83469 - DNA, 601 bp, Human; identical to SEQ ID NO: 83433

SEQ ID NO: 83470 - DNA, 601 bp, Human; identical to SEQ ID NO: 83434

SEQ ID NO: 83471 - DNA, 601 bp, Human; identical to SEQ ID NO: 83435

SEQ ID NO: 83472 - DNA, 601 bp, Human; identical to SEQ ID NO: 83436

SEQ ID NO: 83473 - DNA, 601 bp, Human; identical to SEQ ID NO: 83437

SEQ ID NO: 83474 - DNA, 601 bp, Human; identical to SEQ ID NO: 83438

SEQ ID NO: 83475 - DNA, 601 bp, Human; identical to SEQ ID NO: 83439

SEQ ID NO: 83476 - DNA, 601 bp, Human; identical to SEQ ID NO: 83440

SEQ ID NO: 83477 - DNA, 601 bp, Human; identical to SEQ ID NO: 83441

SEQ ID NO: 83478 - DNA, 601 bp, Human; identical to SEQ ID NO: 83442

SEQ ID NO: 83479 - DNA, 601 bp, Human; identical to SEQ ID NO: 83443

SEQ ID NO: 83480 - DNA, 601 bp, Human; identical to SEQ ID NO: 83444

SEQ ID NO: 83481 - DNA, 601 bp, Human; identical to SEQ ID NO: 83445

SEQ ID NO: 83482 - DNA, 601 bp, Human; identical to SEQ ID NO: 83446

SEQ ID NO: 83483 - DNA, 601 bp, Human; identical to SEQ ID NO: 83447

SEQ ID NO: 83484 - DNA, 601 bp, Human; identical to SEQ ID NO: 83448

SEQ ID NO: 83485 - DNA, 601 bp, Human; identical to SEQ ID NO: 83449

SEQ ID NO: 83486 - DNA, 601 bp, Human; identical to SEQ ID NO: 83450

SEQ ID NO: 83487 - DNA, 601 bp, Human; identical to SEQ ID NO: 83451

SEQ ID NO: 83488 - DNA, 601 bp, Human; identical to SEQ ID NO: 83452

SEQ ID NO: 83489 - DNA, 601 bp, Human; identical to SEQ ID NO: 83453

SEQ ID NO: 83490 - DNA, 601 bp, Human; identical to SEQ ID NO: 83454

SEQ ID NO: 83491 - DNA, 601 bp, Human; identical to SEQ ID NO: 83455

SEQ ID NO: 83492 - DNA, 601 bp, Human; identical to SEQ ID NO: 83456

SEQ ID NO: 83493 - DNA, 601 bp, Human; identical to SEQ ID NO: 83457

SEQ ID NO: 83494 - DNA, 601 bp, Human; identical to SEQ ID NO: 83458

SEQ ID NO: 83495 - DNA, 601 bp, Human
gcttccaggattcagtgagtgaaggtgcacaggtgcccgtggttgggaactgtctgtggtctgcccctgactggcccccatccgtgtccacccacaggaccatgggctccatgttccggagcgaggaggtggccctggtccagctctttctgcccacagcggctgcctacacctgcgtgagtcggctgggcgagctgggcctcgtggagttcagagacgtgagttgggtgggcaggcgtgggaagggggctactgccaaggttagcccggaggccggtccaggatggggactgcccccccyccgccatagggccctggccccatttgaaccccagcggcccctgccatgggcactgctcatgggaagcccgcagctgaggcccctgagctggctcctccccataccctcctggggcatggggtctggtctgtgctctgatctgcgtcttgtggctcccagggcactccacacctttctggaggaggcagctaaggcctggggagagtcaggcctgggctctagggtgaggagctccctgacccccttcccgggacactcacccctccgtgtggcacccacagctcaacgcctcggtgagcg

SEQ ID NO: 83496 - DNA, 601 bp, Human
gcagcaggtggggccctcaactgttgagacaacctcaactgcaccccactcccgttcctctgcgcccagccttcctgcaggaggaggtgcggcgggctgggctggtcctgcccccgccaaaggggaggctgccggcacccccaccccgggacctgctgcgcatccaggaggagacggagcgcctggcccaggagctgcgggatgtgcggggcaaccagcaggccctgcgggcccagctgcaccagctgcagctccacgccgccgtgctacgccagggccatgaacctcaggtcagctcccrcccaggcaggagactggggggctggggaggggctgtccagcctagggctcatggtgcttctgggttcctagctggcagccgcccacacagatggggcctcagagaggacgcccctgctccaggcccccggggggccgcaccaggacctgagggtcaagtgagtgagggatgacctcatgccctttctggccagcccagaacccctggccagtcgctgggctgggccaggctgagctccgactccttgtccagtgctctccccaggctggccccgcctcctccttcaggcccggaacttcc

SEQ ID NO: 83497 - DNA, 601 bp, Human; identical to SEQ ID NO: 46211

SEQ ID NO: 83498 - DNA, 601 bp, Human; identical to SEQ ID NO: 46212

SEQ ID NO: 83499 - DNA, 601 bp, Human; identical to SEQ ID NO: 46213

SEQ ID NO: 83500 - DNA, 601 bp, Human; identical to SEQ ID NO: 46214

SEQ ID NO: 83501 - DNA, 601 bp, Human; identical to SEQ ID NO: 46215

SEQ ID NO: 83502 - DNA, 601 bp, Human; identical to SEQ ID NO: 46216

SEQ ID NO: 83503 - DNA, 601 bp, Human; identical to SEQ ID NO: 46217

SEQ ID NO: 83504 - DNA, 601 bp, Human; identical to SEQ ID NO: 83495

SEQ ID NO: 83505 - DNA, 601 bp, Human; identical to SEQ ID NO: 83496

SEQ ID NO: 83506 - DNA, 601 bp, Human; identical to SEQ ID NO: 46211

SEQ ID NO: 83507 - DNA, 601 bp, Human; identical to SEQ ID NO: 46212

SEQ ID NO: 83508 - DNA, 601 bp, Human; identical to SEQ ID NO: 46213

SEQ ID NO: 83509 - DNA, 601 bp, Human; identical to SEQ ID NO: 46214

SEQ ID NO: 83510 - DNA, 601 bp, Human; identical to SEQ ID NO: 46215

SEQ ID NO: 83511 - DNA, 601 bp, Human; identical to SEQ ID NO: 46216

SEQ ID NO: 83512 - DNA, 601 bp, Human; identical to SEQ ID NO: 46217

SEQ ID NO: 83513 - DNA, 601 bp, Human
acttgaattgatatcatccagtcttagaaactaccttaatggagcaagaggaaaagaatcccgttcttgtaaatcaatgctagtgaacaaattgcaactaaagtttagtctgacctggtgtgcatttttcttccatctgatgagttcattgtatgccacttttttcttcagaaggaaagaggcatgttagaatatttaaaccagtgactcattatttttaccctccttgctttgtctgagtctttttttagtctttatgaacatttatcaatataaatcaaattactttatgccattttaygtaatcttgatttaacattgtgtgatattctgtttatactatatactttaatatatactacattgtcacttatatgctaggaatagtgttcctgcattcagttaactgtgtatctcttgattgtggtagtggtttccgtctctatacacacgtcaaaacttatctaattgtgcattttaaatatgtaaagcttactgaataccccagcaaagttgcttgtcatgtgtacacatacacacaccttttggtagttaaaatagctgccgtcttcaggaagtacacttttatttggtgtggttt

SEQ ID NO: 83514 - DNA, 601 bp, Human
tttgagtagagcagtcatccacagtcactagtgtgaatcctgcagcttatcatctgttgggcccatagaagctggcctttgtttagtatcagcatgggctgtgtttctgccttacctttatttctaagttacaagcactaggaatgttgtcacggttttagatctagtgacacagctctaaataatttgagtatttctagaaaaggaattcatcccatgtgatcataactcgtttttatctttttaaaaataacttttattttcttttgattttaaagttttgctaaagattttaagagamgattatttaactattataacccaaaggaatagacccaggtgcatactattttttttattcagtgtcttgatatgattggttatagaagagaccctcctaaaatatgttctctaactggcatcattagaagaaaaagcctttctacagaatgctgacttctcaacaggatttttccatgtcgttgcagttagctgtaaggcataacctgaaaaatactttaacttattctcaacaattttctgtttatagatgtcgagaaatttttaaggcataaaatctaactacaagtggattactaac

SEQ ID NO: 83515 - DNA, 601 bp, Human
tctgtttatagatgtcgagaaatttttaaggcataaaatctaactacaagtggattactaacattaattaataccctgatctgtggacagattgcctataataatgtatgtgactgcctggctaacctagtctgattaaaaattaacctaaattgacaacataaacttatgttagagagtgttggactttttttccctccaagtgaactttagccctggtgaaaggttccctgcagcagaaaattcattgagcatgtaaagcttgttggcattttttgtttattcccatggatttttggatttttttttttttttttttgaggagagtaaggttccagtattcgtatctgttctttaagcttcttgaatttgccataacgtgtttccaggactccaaagtaaaaaataaacaatcctagcagtggaactatgggtgccttccatttggtggtggtgagatagaaagcgcctgttccactcccccttcatcacctccaaatgctgtgtctggcctatctaaatattgtattaggaatctgttttgtgactgcaaatatttaggttcttaatagtcaaatcaagattattaagatagttcatg

SEQ ID NO: 83516 - DNA, 601 bp, Human
catgtaaagcttgttggcattttttgtttattcccatggatttttggatttttttttttttttttttgaggagagtaaggttccagtattcgtatctgttctttaagcttcttgaatttgccataacgtgtttccaggactccaaagtaaaaaataaacaatcctagcagtggaactatgggtgccttccatttggtggtggtgagatagaaagcgcctgttccactcccccttcatcacctccaaatgctgtgtctggcctatctaaatattgtattaggaatctgttttgtgactgcaratatttaggttcttaatagtcaaatcaagattattaagatagttcatgtggacctctaaagaaaactacttttggtttcggctcacatgggccaatttctgacgtgtattccgaaagacacaaatttttgtcccaatcttttaggtggcctgtgaatgcctaaaccatgtcacttttccacagaagtttcatgtatgagtctgttttcaaatagtatatgtatcctgaaattagtagcagcattatacctttacatttcataatcacacttttcgttattttagtcattaaaattgttca

SEQ ID NO: 83517 - DNA, 601 bp, Human
gatttttttttttttttttttgaggagagtaaggttccagtattcgtatctgttctttaagcttcttgaatttgccataacgtgtttccaggactccaaagtaaaaaataaacaatcctagcagtggaactatgggtgccttccatttggtggtggtgagatagaaagcgcctgttccactcccccttcatcacctccaaatgctgtgtctggcctatctaaatattgtattaggaatctgttttgtgactgcaaatatttaggttcttaatagtcaaatcaagattattaagatagttcwtgtggacctctaaagaaaactacttttggtttcggctcacatgggccaatttctgacgtgtattccgaaagacacaaatttttgtcccaatcttttaggtggcctgtgaatgcctaaaccatgtcacttttccacagaagtttcatgtatgagtctgttttcaaatagtatatgtatcctgaaattagtagcagcattatacctttacatttcataatcacacttttcgttattttagtcattaaaattgttcatacttttaaaatatatatactaaaagtttgttttgtatttgccaaa

SEQ ID NO: 83518 - DNA, 601 bp, Human
ggaaagttatccaccatcatccccaaaagcatgtgaaaaagtgcaaagtgccctcctcctttctctccctctcccaacctgtatttcctgagtaagcatcatacttcccaagacatcctagatttgataaactctgaaaagcagcatttcctttgtggagaagtgggattatagttggatttttaaaggactgtggaacatatttaaccaccaaataccacttggcataatatgctgccaccctaaagagaccacatcaacaaaacccgtgttcgtttcagaagtatgctttagatatatytacattcacttatctaaatctaaattctgtagttttaaaatatcacataattttgagttaccaggaagttagtagttgtacagtaactggtcctataaagataataaatttttatcattaatttgattttatgtgataaaatagatatcaaaaatttatttcctgctaacaaaattttcctttcatattcactgggaaaagcacctttccaaagaccttttaagttgaaattaaatattatattttctgggaagtcaaatttgttatgcatgaaacaaggaagaggagttaacctctgtt

SEQ ID NO: 83519 - DNA, 601 bp, Human
tttgtgcccagtcagatttcagagcctgggtgctcttttaactcctccctgccttggcttcaatatttttcagcccattccagtgtcagacatgttgattgaaaggttgtattttctaacggaagtagttaagaatgaaatgatacaatgtctgagatttgctttaaaacatttaagtagggacaaaaatgaaacaaattgttataccagacactgtggaggcccctcgatagacacatgggatccattatgccattctccactttcatgtatgttcgaaaattttcataacaataaggctttttttttaaaaaaaaaaaaagttattccctgcattaaactgaaaagttcattagattttaggatgtaatttccttgtttgaattttaattttttcccctattggaaatatttgactggcctttcttacacacttattttttgaaaagttactgctactcaatagagttcttattgttttgacaatgaagaacaactcttactttcatgtttctgtattttataatgtacaaaaattgttttgtgagagggctttactttgtccaagtttgtatgaaatcattgcacctagacatatatt

SEQ ID NO: 83520 - DNA, 601 bp, Human
cagtcagatttcagagcctgggtgctcttttaactcctccctgccttggcttcaatatttttcagcccattccagtgtcagacatgttgattgaaaggttgtattttctaacggaagtagttaagaatgaaatgatacaatgtctgagatttgctttaaaacatttaagtagggacaaaaatgaaacaaattgttataccagacactgtggaggcccctcgatagacacatgggatccattatgccattctccactttcatgtatgttcgaaaattttcataacaataaggcttttttttwaaaaaaaaaaaaagttattccctgcattaaactgaaaagttcattagattttaggatgtaatttccttgtttgaattttaattttttcccctattggaaatatttgactggcctttcttacacacttattttttgaaaagttactgctactcaatagagttcttattgttttgacaatgaagaacaactcttactttcatgtttctgtattttataatgtacaaaaattgttttgtgagagggctttactttgtccaagtttgtatgaaatcattgcacctagacatatatttagtgtca

SEQ ID NO: 83521 - DNA, 601 bp, Human; identical to SEQ ID NO: 33277

SEQ ID NO: 83522 - DNA, 601 bp, Human; identical to SEQ ID NO: 33278

SEQ ID NO: 83523 - DNA, 601 bp, Human; identical to SEQ ID NO: 33279

SEQ ID NO: 83524 - DNA, 601 bp, Human; identical to SEQ ID NO: 33280

SEQ ID NO: 83525 - DNA, 601 bp, Human; identical to SEQ ID NO: 33281

SEQ ID NO: 83526 - DNA, 601 bp, Human
ctgtgttttgcattgagtggcctctcatacccaccggcctacataaaccaccctgggtttcagcttccggattgctgaaggtctgggtggtagggtgagggaggctcttcctttttgccctccacatgagctgagcaccctgggtgtttcacaggggctggctgtgggcaatggactctcctcctatgagcagaatgacaactccctggtctactttgcctactaccatggccttctggggaacaggtatgggatagggcagttgggcaatctctggggtgaggcaggtcacatgatctcrggtctgtcctccaggcacatgatatgacaggcccagcccaggtttatgagcagcaggtgggttgcagaaagaacctagtgctgaaaggccaaagaatagagatcagtttttctttctttctttttttttttttttgagacagattcttactttgtcacccaggctggagtgcagtggcacgatcttagctcactgcaacctccacctcccaggttcaagcaattctcatgcctcagactcccaggcagctgggactacaggcgcgtaccaccacacctgcctaattttttgtatttttag

SEQ ID NO: 83527 - DNA, 601 bp, Human
tgtatttttagtagagatggggttttgctgtgttggccaggctggacttgaactcctggcctcaaatgatcttcccaaagtgctgggattacaggcatgagctacagcgcccagccagaaatcagattttaaaggaactaaggaggcctgtctgtatgaccctggggcacctctttgggagctagcttagatgacatacagaccacaccctgtgatatctttcccagtctcctagggtcagggaggttggtgggaggtggggggtatgctcgcctcctctgccttcctcttcccaccagcrgctgatgcgcttttcactctcatctcctacaggctttggtcttctctccagacccactgctgctctcaaaacaagtgtaacttctatgacaacaaagacctggaatgcgtgaccaatgtgaggttctgccatcactttgcatgagctctcccatccctaatcctgagaacaggaccacattccctccttggggactccttgttctccgtccctcattgctttcttgcacctttaagcaatttagtgttctctgggacatgtgtctaagtgtgtattcccaccaccacctcctatggtggc

SEQ ID NO: 83528 - DNA, 601 bp, Human
gctgctctcaaaacaagtgtaacttctatgacaacaaagacctggaatgcgtgaccaatgtgaggttctgccatcactttgcatgagctctcccatccctaatcctgagaacaggaccacattccctccttggggactccttgttctccgtccctcattgctttcttgcacctttaagcaatttagtgttctctgggacatgtgtctaagtgtgtattcccaccaccacctcctatggtggcaaatcccataacctccgtgaggagaaaggacttcttcacatttatcaaacacctgcaaygtggcaggcactgtgctgaactgtgtctatgtagattatttaagcttcaagattccccctcaaatgagatcatactacccacattttccagataaggaaactgagggctatgaattttgaaatcactgtctgaagtcacagtgttgggaggcagtgatgctaggatttggacccaggtctgggaagattcctgccactgagcctcagtttccctacctgtgaaaaaaagtgggtgaagaggtgaaatccaagagcagtaaatcttgggacaacttggtggggtcgtggagaggccgggga

SEQ ID NO: 83529 - DNA, 601 bp, Human
tgcaatgtggcaggcactgtgctgaactgtgtctatgtagattatttaagcttcaagattccccctcaaatgagatcatactacccacattttccagataaggaaactgagggctatgaattttgaaatcactgtctgaagtcacagtgttgggaggcagtgatgctaggatttggacccaggtctgggaagattcctgccactgagcctcagtttccctacctgtgaaaaaaagtgggtgaagaggtgaaatccaagagcagtaaatcttgggacaacttggtggggtcgtggagaggcyggggatctgtaaagcatggtggcttggtgtatcattgcagcttcaggaagtggcccgcatcgtgggcaactctggcctcaacatctacaatctctatgccccgtgtgctggaggggtgcccagccattttaggtaggtgctgctgggtgcccctggagccaaccccagccccatctggaggctccacacccattccccacctcacattgcaggtatgagaaggacactgttgtggtccaggatttgggcaacatcttcactcgcctgccactcaagcggatgtggcatcaggtgtgcaag

SEQ ID NO: 83530 - DNA, 601 bp, Human
tgtggaggattgggagcgggtatgcctgggagtggccagctggctgcctggctctggcccacagagggcaagtgtggaggaattcccagccctaaggtcttgctggtagctgtgagcaaggatgcagctgctgtaggctgatgtctttcctggtggggcagatggaggtgcagcgccggccctggttagtgaagtacggggacagcggggagcagattgccggcttcgtgaaggagttctcccacatcgcctttctcacgatcaaggtagggactgggcctgctgagagataactgggccrgaggcaaaggagcaggacccacccgtcctttccctctggctgccttttaggctgggtcatgggtcaccatctggcccctgtatgggcaagtttttttggagaggggtggggagggttctgggaagaataaagggtttgggatgaaggaattgcccccgagtgagcagttatatggggaggagggaatggtggggtcaggagctcacgaacattgctcctcagggcgccggccacatggttcccaccgacaagcccctcgctgccttcaccatgttctcccgcttcctgaacaagcagcca

SEQ ID NO: 83531 - DNA, 601 bp, Human
gtcgagtgaagcagtaggagtggagggggaacaaagaaatctataactggctgtgatcaattagttataaacacctgtgtacttgaaccagccaggatctgccactttctatctgcataatcctgagcaagttaccaaaactttctgggtttctgtttcatcatctgtgaaacagagataatgacagttatgacatagatcgttatgaggggaaacgagtgaggcaatccttgttggctacaattacagttagaagagttgaagggagaatagactccagtccagttggatgagtcctccsgaaagtctcctgagtggagaaccattgcccggcccctggatgcccaagaggagatgacgggagccatgcgcccatgtgggagcccaccgggtatgctttccacagaggcacaagtctggcttatctcactaaggagcccaagaccaaaagatacctgtttgaatccttttttttttggagacagttttgctcttgttgcccagtctggagtgcaatggtgcggtctcggctcactgcaacctccacctcccaggttcaaatgattctcctgcctcagcctcccgagtagctgggattaca

SEQ ID NO: 83532 - DNA, 601 bp, Human
cgcctgtaatcccagcactttgggaggccgaggcaggcggatcacgaggtcgggagattgagaccatcctggctaaaacagtgaaaccccgtctctactaaaaatacaaaaaaattagccaggcatggtggtgggcgcctgtagtcccagctactcgggagactgaggcaggagaatggcgtgaacccgggaggtggaacttgcagtgagccgagattgcgccactgcactccagcctgggtgacagagcgagactccgtctcaaaaaataaataaataaataaataaataaataaataattaaaagaagccaaacacaaaagcatgtgtattgtaggatttcatatatatgaacctcaaaaaggtaaaactaatatggtgttaaacgtcagatggtggtaacctttcaggaggaggctgtgggaggtactgaaaaaggtatgaaggaggctgctgaggtgctgtttgtcatgttctgttccttaattttggtggtggtttcatgggaatgttcactcattgaactgttatatcagcagctataattaatgtcccttttctgtgtctacgttgtccttctttttttatttttattttattt

SEQ ID NO: 83533 - DNA, 601 bp, Human
aatacactgtagattgtacatatgatggaaaattccacaggaataaaaatgaatgaactcatgctaaatgaagtaataagaatgaatcaaaagaagtcaaacaccacgcctgtaatcccagcactttgggaggccgaggcaggcggatcacgaggtcgggagattgagaccatcctggctaaaacagtgaaaccccgtctctactaaaaatacaaaaaaattagccaggcatggtggtgggcgcctgtagtcccagctactcgggagactgaggcaggagaatggcgtgaacccgggaggyggaacttgcagtgagccgagattgcgccactgcactccagcctgggtgacagagcgagactccgtctcaaaaaataaataaataaataaataaataaataaataaataaaagaagccaaacacaaaagcatgtgtattgtaggatttcatatatatgaacctcaaaaaggtaaaactaatatggtgttaaacgtcagatggtggtaacctttcaggaggaggctgtgggaggtactgaaaaaggtatgaaggaggctgctgaggtgctgtttgtcatgttctgttccttaattttggtgg

SEQ ID NO: 83534 - DNA, 601 bp, Human
ctggtctcaagcgattcttctaccgcagcctcttgagtagctgggattgcaggtatgagccaccaagcctggcttgtaacttttttactctataaatttttaaatttttctttataaaattttttatttttaaaaactttgactctcttgtaataacacttagcttaatacacaaacacattatacagctgtacaaaaatattttctttttaaaaaaatctcaaattctgttattcttttttctttttttatgtctttggtgcttgaatcagaacaaaaatatttgctttatatctttatyctacaagctttttttctcttaaatttttttttcttttactttctaaacttttttgttaaaaactaagacacaaacacacacattagcctagacctacacagggtcaggatcatcaatatccccatcttccacctccacactttgtccccctggaacgtcttcaggggcaaaaacacgcatggagctcccatctcctatgataacaatgctttcttccagaatgtctcctgaaggacctgcctgaggctgttttacagttaacttttttcttttttaataagtagaaggagtcaactctaa

SEQ ID NO: 83535 - DNA, 601 bp, Human
tgtgctaaaaacacaaaaattagctgagcatggtggcctgcactcatagtcccagcttctcaggaggctgaggcatgagaatctcttgaacccaggaggcggaggttgcagtgagccaagatcatgccactgcaatccagcatgggtgacagaatgagactctgtctcaaaaaaaaaaaaaaaaaaagagttagtaattaatagaagatagatcgaagaaatattcaaactaaagcacaaaaaacgaaatgatgaaaaacacacaaagaagtataagagacacaaaccatggtgaaaaagtctaacatataataataataaacttagaggtcttttcattaccagatatcatgatattttataaacatactgaaattaagacaggatagtattgcagaagaataggtaaatataccaatggaggctaggcatggtggctcacacctgtaatcctagcactttgagaggccaaggtgggcagattacttgagatcaggagttcgaggccaacctggccaatatggtgaaaccccatctgtactaaaaatacacaaattagctgggcatggtggcacgtgtctgtaatctcatctactcggga

SEQ ID NO: 83536 - DNA, 601 bp, Human
aggcggatggatcacttgagcccaggagtttgacaccagcctgagcaacatggcaaaaccccgtctctaccaaaaatacaaaaattagccgggcgtggtggtatgtgcctgtaatcccagcttctcaggaggctgaggcaggagaatcacttgaacccgggagggggaggttgcagtgagctgagattgtgccactgccctccagcctgggtgacagagtgagactctgtctcaaataaataacataacataacataacataacataacataacataacataacataacataacaacaacaacataaataaaagtggccaagacacaggcagagggaagaggaaaaagagccagcaaaggagctgcacagtcatgcagcctcaggagaggccaactgagaaccacacaggttcttccccactacttcttcatggtttcctttgcccatagagcagcaaagcttgtgtggggtcaagtctgggcctgagagaggggcttccatcctccagtgccctttctgttcattcatctgttactatacagggacaaaccgtgatctattagcactgggttactgtgggtaggatgccaagccctcctc

SEQ ID NO: 83537 - DNA, 601 bp, Human
taggaatgagaaaaacaataattacatgttttgaaaagagatcaaggaaaggagattaagatgtcccacctccatgagtcagctaacactgaaatttagaaagtgagaagaactcagtgaaacctaaacttggaaaggcagtaagactcactacagttagaaaatagtcacatttgcccttcaaaatattgatgaactgggcctgtctagtcattagccaaaaacatgggagctgaactggggcaccctcagtgttattggacatgagagggaaagcagggtctttacggctaagaaattyaccttaagaccatgctaatatgtgctcaaagatttagctaaaacaatgtcccaagcagtatcatttatagtagtgaaaaattagagacaatataagtgcccaagaagaaaggacttattaaatcaattatggtacatctattaacaatgatgttacagacgtgtgtgtgctgattggaaagatgatacactgataagtgacaaatgtgagaggccaaaaagaatatatcatgtgaccctaatgttcaattatatatagaaactgtcatgaatacatttacaacaaattattattattatt

SEQ ID NO: 83538 - DNA, 601 bp, Human
gcacctgtctgctattgaatatgagagattattctaacttcaaaggagacaacccaacgcaaagacaaatacctatatgctaataaaaaatcctttaacagggtttactgtgccttgcatttgaatatattaaatcatactgaaaaggtcagagagaacgtactcttccatccggagtcctgggaccagagtaaggtggaacttcacccatcagaaccggccacacatcaaaaaattcctaggaatgagaaaaacaataattacatgttttgaaaagagatcaaggaaaggagattaagaygtcccacctccatgagtcagctaacactgaaatttagaaagtgagaagaactcagtgaaacctaaacttggaaaggcagtaagactcactacagttagaaaatagtcacatttgcccttcaaaatattgatgaactgggcctgtctagtcattagccaaaaacatgggagctgaactggggcaccctcagtgttattggacatgagagggaaagcagggtctttacggctaagaaattcaccttaagaccatgctaatatgtgctcaaagatttagctaaaacaatgtcccaagcagtat

SEQ ID NO: 83539 - DNA, 601 bp, Human
aacctcatctctactaaaaatataaaaattagccagacataatggtggggcacctgtaatcccagctactcgggaatctgaggcaggagaattgcttgagcccaggaggcggaggttgcagtgagctgagatcatgccactgcactccagcctgggcaacagagtgacagtccatctcaaaaaaagaaatggacattttttttggaatcccacaggagaaaaactgcaaagtttttctttcccagaattaacaaaaagatcagtgtgctttgggtaactaggctttttccactcactgtakctcagtcaaagtctttaaagccatattcatgtacaaattcaccagcctctggaaagtcaaaactgagtcatcaagagtacctttgttaccttctacctgagcagctgacacaaggggctttgaaagagccacagatacccatggaaatacaccactttttaaaagactgctatttttttttccatgaaggctttttagcctgtataacttttaaatatttaaaacatacacacactattttatttttaaaagtagatgaagcaagatgtagctgacactgtgaggctttcgacctaagat

SEQ ID NO: 83540 - DNA, 601 bp, Human
ttaaaaagtctggagatgatgtaaggtctcttattaggaaagtggttgtacagtggacaccacacgtttccagagcaagattgctgtgcctgtgctgaaagggaaaggtgacaaaatattcagttaagtgaaaaaagcaaggcacaaaatagaatcatagcgttagtgcagaggggtggtggtggaatacgtatacttctctgtggatatctggatatacctaaatgttcctgcaaagagagtttgctaacagcagctgcttcacaggggctgactaggaggaaggtggcacttaatttcrtatggagtgaacttttcactgtgctcatatattatttttccaacatacaaaccaattttctttttttatattttttattttgctttattttattaatttactttttttgagccaggatctcattctgtcacccaggctggagtgcagtggcacaatcttggctcactggagcctcagtttcccaggctcaagcaatcctcctatcttagcctcccaagtaactggtaatacaggcacgcgtcaccatgcccggctacttttctttttttcttttttttttagttagagacaaggtctcac

SEQ ID NO: 83541 - DNA, 601 bp, Human
caatatctctcaaagatcaaaacagacatattatttgacccacatgtggtgatggatcctagagatatactcccaaatgtgggtaaaagcattttttgccccgtccaagggtcttagctagactgctttaaaaagtctggagatgatgtaaggtctcttattaggaaagtggttgtacagtggacaccacacgtttccagagcaagattgctgtgcctgtgctgaaagggaaaggtgacaaaatattcagttaagtgaaaaaagcaaggcacaaaatagaatcatagcgttagtgcagagkggtggtggtggaatacgtatacttctctgtggatatctggatatacctaaatgttcctgcaaagagagtttgctaacagcagctgcttcacaggggctgactaggaggaaggtggcacttaatttcgtatggagtgaacttttcactgtgctcatatattatttttccaacatacaaaccaattttctttttttatattttttattttgctttattttattaatttactttttttgagccaggatctcattctgtcacccaggctggagtgcagtggcacaatcttggctcactggagcc

SEQ ID NO: 83542 - DNA, 601 bp, Human
atgtgttaaaataaaaactataggaggcccttgttttggacaaagctctgcaccaagctccaacaaaccaaactaaaaatcagtgtggagtcaccgtgataacgttccacttcaccaaatctaaactaagttgttttctgatcctcttagagattaggagagaggtaaacgccaatttcccaaaaagtcctgttccagtctttaataggcatgataatgaagttcctctgctttaatccttacaccaaaaaaaaaaaaaaaaaggtagcagtaacctgacattaatcagttatttttctaytgttctatctccctctcccaccttataagaaaagtatcttaaaaatgattaacatgttctttgatctttgcttgtctttcttcagtccttctctgtctataaagtcaaccttgtcagaacacttatgtattttatggaatgaagtgttgcccaattccagaatcaccgataaagccaattgagatctttaagctaatttgttgtcattttgtcttttgacaggtgaaacttacgggatgactttgatgtcctctttgccatgcaggatgtagtcaatgaccttgtaaaagttaatttcct

SEQ ID NO: 83543 - DNA, 601 bp, Human
gaagttgataatgtgcctgcagttttccatgttttgagatgtgttaaaataaaaactataggaggcccttgttttggacaaagctctgcaccaagctccaacaaaccaaactaaaaatcagtgtggagtcaccgtgataacgttccacttcaccaaatctaaactaagttgttttctgatcctcttagagattaggagagaggtaaacgccaatttcccaaaaagtcctgttccagtctttaataggcatgataatgaagttcctctgctttaatccttacaccaaaaaaaaaaaaaaaaaggtagcagtaacctgacattaatcagttatttttctattgttctatctccctctcccaccttataagaaaagtatcttaaaaatgattaacatgttctttgatctttgcttgtctttcttcagtccttctctgtctataaagtcaaccttgtcagaacacttatgtattttatggaatgaagtgttgcccaattccagaatcaccgataaagccaattgagatctttaagctaatttgttgtcattttgtcttttgacaggtgaaacttacgggatgactttgatgtcctctttgccatg

SEQ ID NO: 83544 - DNA, 601 bp, Human
ctgatttcatcccagtctcattctatacatgggactctaaggtccagacaaaccacttactggccctggctgtgagattgggactcagagcacctgactcacaacctggtccactgtagccctcatcaaggctctggtcaagtcttcccccttcttgggcctcactgctcaccctctgagtctctctaccgtctcacactgcctccttcccactctccctgcctctaaccaactgtggggtctcattggatttggtcagtgttgatcttggaatgagtatcttttggaagttgataatgtrcctgcagttttccatgttttgagatgtgttaaaataaaaactataggaggcccttgttttggacaaagctctgcaccaagctccaacaaaccaaactaaaaatcagtgtggagtcaccgtgataacgttccacttcaccaaatctaaactaagttgttttctgatcctcttagagattaggagagaggtaaacgccaatttcccaaaaagtcctgttccagtctttaataggcatgataatgaagttcctctgctttaatccttacaccaaaaaaaaaaaaaaaaaggtagcagtaacct

SEQ ID NO: 83545 - DNA, 601 bp, Human
aatgtcaaaaagtagaaaacagcatcttagaattaatgaaaggtaatgtatttctttcttaaccaggctggcaatctttgtcatttaacttgaacatctagttgatttatatttttttaaattattggccattgcatcagcttatgcctataatctgagcactttgggaggctaagttgggaggattgcttgagctcaggagtttgaagaagccagcctgggcaacatggtgagaccccatctctattaccaaaaaaaaaaaaaaaaaaaaaaaaattattggccaggcaaggtggctcaygcctgtaatcccagcactttgggaggtagaggtgagaggatcgcttgaacccagaaatttgagaccagcctggcaacatagtgagactgtctctataaaacactaacacgctaattaaataaataaaattcaaataattgatatatttgaattcgaatttcaccttgatatgtacattttgttttcctacctgctctatgttcttctctccttctttctccctctcttttttagtgaaagtgtctcactatgttgcccaggctggagtacagtggctattcacaggtgcaatcatagctc

SEQ ID NO: 83546 - DNA, 601 bp, Human
ctatttcagaaatgtcaaaaagtagaaaacagcatcttagaattaatgaaaggtaatgtatttctttcttaaccaggctggcaatctttgtcatttaacttgaacatctagttgatttatatttttttaaattattggccattgcatcagcttatgcctataatctgagcactttgggaggctaagttgggaggattgcttgagctcaggagtttgaagaagccagcctgggcaacatggtgagaccccatctctattaccaaaaaaaaaaaaaaaaaaaaaaaaattattggccaggcawggtggctcacgcctgtaatcccagcactttgggaggtagaggtgagaggatcgcttgaacccagaaatttgagaccagcctggcaacatagtgagactgtctctataaaacactaacacgctaattaaataaataaaattcaaataattgatatatttgaattcgaatttcaccttgatatgtacattttgttttcctacctgctctatgttcttctctccttctttctccctctcttttttagtgaaagtgtctcactatgttgcccaggctggagtacagtggctattcacaggtgca

SEQ ID NO: 83547 - DNA, 601 bp, Human
aacgatcacacaattctatttcagaaatgtcaaaaagtagaaaacagcatcttagaattaatgaaaggtaatgtatttctttcttaaccaggctggcaatctttgtcatttaacttgaacatctagttgatttatatttttttaaattattggccattgcatcagcttatgcctataatctgagcactttgggaggctaagttgggaggattgcttgagctcaggagtttgaagaagccagcctgggcaacatggtgagaccccatctctattaccaaaaaaaaaaaaaaaaaaaaaaaawttattggccaggcaaggtggctcacgcctgtaatcccagcactttgggaggtagaggtgagaggatcgcttgaacccagaaatttgagaccagcctggcaacatagtgagactgtctctataaaacactaacacgctaattaaataaataaaattcaaataattgatatatttgaattcgaatttcaccttgatatgtacattttgttttcctacctgctctatgttcttctctccttctttctccctctcttttttagtgaaagtgtctcactatgttgcccaggctggagtacagtgg

SEQ ID NO: 83548 - DNA, 601 bp, Human
attttacacaacaaatcattgcccaattctagagtctcaaataaagccatttgagatctgtagatgaaacttattgtaactttgtcttttgactatggttatgaccgagttcacacctaggcaataacaactttgtcatgtctgccatggctaacaacgatcacacaattctatttcagaaatgtcaaaaagtagaaaacagcatcttagaattaatgaaaggtaatgtatttctttcttaaccaggctggcaatctttgtcatttaacttgaacatctagttgatttatatttttttaamttattggccattgcatcagcttatgcctataatctgagcactttgggaggctaagttgggaggattgcttgagctcaggagtttgaagaagccagcctgggcaacatggtgagaccccatctctattaccaaaaaaaaaaaaaaaaaaaaaaaaattattggccaggcaaggtggctcacgcctgtaatcccagcactttgggaggtagaggtgagaggatcgcttgaacccagaaatttgagaccagcctggcaacatagtgagactgtctctataaaacactaacacgctaattaaat

SEQ ID NO: 83549 - DNA, 601 bp, Human
tgctgggtttataggtgtgagccactgtgcccggcaacaagccagtttcaattggcatgatgatgaagtttcctctgctttagtccttacacacacacaaaggtagcctgaaatagcttgatgtttacttctcagtcatttttctattgtcctatttccctgtcctgccttacaagaaaagtagctttaaaatgaccaatctgcttttttgttctttgttcctataaaaccaaccccttctgctcaactcattggaacacttactctattttacacaacaaatcattgcccaattctagartctcaaataaagccatttgagatctgtagatgaaacttattgtaactttgtcttttgactatggttatgaccgagttcacacctaggcaataacaactttgtcatgtctgccatggctaacaacgatcacacaattctatttcagaaatgtcaaaaagtagaaaacagcatcttagaattaatgaaaggtaatgtatttctttcttaaccaggctggcaatctttgtcatttaacttgaacatctagttgatttatatttttttaaattattggccattgcatcagcttatgcctataat

SEQ ID NO: 83550 - DNA, 601 bp, Human
cagaatattttctaatttccattaattgattcttttatccataggttgtttggtttcagaagggtatttcttagttcccaagcatatgagaatttcctaattagctttttgttactggcttaaagcagtgttctatctatatttattaggttaaattcattaattggattattcaaatattctatattctgtttgttcattttagtttgctccttaagtcaattagcaaacagattcatctatatctccttgtatttctgttagtttttgttttatattttttgaggtcatgttatgaggygcttgcaaatttagaatggtaatatcttcctgtaatattgaggtagattgacccctttatcattaagtgactctttatctctactaatgctctttggtatgtctatttttctatgatattaacatggttatacaagttttcttttgattagcatttgcatggtatgtcttttttcagtcttttatgttcaacctctttgtattctctttcagattagtctcctgtaaacaggatataggatttttcatcatatcttgggagtaatcattgttgactaacttttgtatgtgcagagaaaga

SEQ ID NO: 83551 - DNA, 601 bp, Human
cccagtggctgttagcaagaatgatagtattctttaccccacctgtctttgctgagattctcatcacctcttacttgaatgatgctctggttactttgcctgcagtcctagtccttcagatccacttcccaggaagctgctagagttatctttcttttctttctatttttttcttttagagacagggtctccctctgttgcccaggctggaatgcagtggtgcaatcatacctcactgcagcctggaactcctgggctcaagggatactcctgtctcagcctcttgagtagctgggactgygggcttgcaccaccatgcctggctaatttttaaattttttgtagagacggagtcttggtatgttgcccaagctggtctcaaactcctgggctcaagtgatcctcctgcctcagcctccctaagtgttgggattacaggcgtgagtcactatgccctgccagagttatctttctaaaatgaaaattgactatgtgaatctcctgcttgtctacctgtcacctgtagattaaaatcccaccttttgaggatgagcatggtggttcacgcctataatcccagcactttgggaggttgaggcag

SEQ ID NO: 83552 - DNA, 601 bp, Human
ataacctctccagtgccaaacccaatgagggttttcaattctctcaccagttcactctgctgcatgtcatcatttccttccctgttgaaactttccacttccttccagacactttccactttccacttccagagagacactgccctctcctgggtctccaaacacctctgaaccttccttctgtttctctatccaccctcctctttctccacccactctgtagatgccaacaccctccattattgcaccctaggtccactgcctgtctccctctccctaagtggcttcctccacactcatratttcaaacaccatctggtcctgatatcttccaaatctctgcttccaacactcctctctctccatggcatcagaattgtctcttcatctacctgctggacagctgctcctaaaaaatgtcatagttttaccttgtctgaaactgacctcgtcatcttacatccaagcatgatgacagcactatctattcagtctagaagcctgaaattagctttgactcctctcttccccattctctgcctacaaccaatcacaaagccctgccagcttcaccctctcaatattggacctgacccattat

SEQ ID NO: 83553 - DNA, 601 bp, Human
tggtgacctggttcaggcacacttgagttactattcagatgttgatgaaagaaagcccatcttatagatgaggcctgagtatcatcatcttcacaggtaaggatatgtccaggtgttacatgataagatgtgagttcctgggagaagtaggttctttattttattttttttttgagactgagtcttgctctgttgcctaggctggagtgcagtggcacaatctctgctcgctgctacctctgcctcccagtttcaagtggttctcctgcctcagcctcctgagtagctgggactacagacrcgtgccaccacacccatttaatttttgtatttttagtagagatggagtttcactatcttggccaggctggtcttgaactgctgacctcaggtgatctgcccgctttggcctcccaaagtgctgggattacaggcatgagccatcgcacatgggctaggtcgttatcttttatgtgtgtttgtgtctttgtcacacatgcctggcattgtgttttgcccatgagtaaatgctgaatttttgcacttgtaaagttttctacttagaaacaactaaaacgttcatcaactgatgaataaaata

SEQ ID NO: 83554 - DNA, 601 bp, Human
gcctaggctggagtgcagtggcacaatctctgctcgctgctacctctgcctcccagtttcaagtggttctcctgcctcagcctcctgagtagctgggactacagacacgtgccaccacacccatttaatttttgtatttttagtagagatggagtttcactatcttggccaggctggtcttgaactgctgacctcaggtgatctgcccgctttggcctcccaaagtgctgggattacaggcatgagccatcgcacatgggctaggtcgttatcttttatgtgtgtttgtgtctttgtcacrcatgcctggcattgtgttttgcccatgagtaaatgctgaatttttgcacttgtaaagttttctacttagaaacaactaaaacgttcatcaactgatgaataaaatatagtccatcctggctgggtgcggtggctcacgcctgtcatcccagcactttgggaggccgaggcgggtggatcacctgaggtcaggagtttgagaccagcctggccaacatggcgaaaccccgtctctactaaaaataccaaaaattagccggtcatagtggtgggcgcctgtaattccagctactcggggggc

SEQ ID NO: 83555 - DNA, 601 bp, Human
agtctgggtgacggagcaagactctgtctcaaaaaaaaaaaaaaggaagagtttgtagtggctgatagaaacgcatgctcactcgctctctcctgttacaagttcaggccaagaaaaatcaagaaagggtttgttccacagagaacaatcctaggcacgctggtcttggtgccattttgggagggtgactggtcggtggtattgggcgacctcacggacatagaaatatttattttgggcaaacattgccagactttcctgatgacttgtggacaggacaggaagtggtcattttgggagygcaggttgctggtagagcacctgagggctctgcccttgccttgcccagcatttgtgtgtgggagagcagtgagacctggacctctcatgctcagatctgctaagaggagagtgattgctacctctgcagcagctcatctgaaacgtgctggccgtacgctaccaaagataggtgtaaagaacaggtgtccttagccgggcgcagtggttcacgcctgtaatcccagcactttgggaggccaaggtggatggatcacctgaggtgaggagttcgagacccgcctggccaatgtggcaaaac

SEQ ID NO: 83556 - DNA, 601 bp, Human
cacggatctttgcagctcaggttgcaacggtaagagtattgtcaatgagacaaaggaggtgagagtgccagttgtctgaattggttgggatgttggtcagatgacatctaaaagaacacggccattttgttattatttggttagagacaaggtctcactctgtcacccaggccggggtgcagtgtcacaatcatggctcactacagcctcaacctgccaggctcacgtgatcctcctactttagcctctcaagtagctgggactacaggcatgcagcaccacgcctggctaagttttgtawtttttgtcgtgacagggtctcactgtgttgcccaggctagtctgaaactcctgggctgacgtgaccctctcccctctgccacccgaagtgctgagattacaggtgtgagccaccgcacttggccggaacacggccattttagttcccctccttagaggagtaaggccaggaatgagcctgtggtctgaaagccgtggctgttggttaatgtggagaagggaaggtggtgagagccagcccaaacccctgccgagtgagactgattctggcagctttagggagcagggatgagcccctcac

SEQ ID NO: 83557 - DNA, 601 bp, Human
tttgttattatttggttagagacaaggtctcactctgtcacccaggccggggtgcagtgtcacaatcatggctcactacagcctcaacctgccaggctcacgtgatcctcctactttagcctctcaagtagctgggactacaggcatgcagcaccacgcctggctaagttttgtaatttttgtcgtgacagggtctcactgtgttgcccaggctagtctgaaactcctgggctgacgtgaccctctcccctctgccacccgaagtgctgagattacaggtgtgagccaccgcacttggccrgaacacggccattttagttcccctccttagaggagtaaggccaggaatgagcctgtggtctgaaagccgtggctgttggttaatgtggagaagggaaggtggtgagagccagcccaaacccctgccgagtgagactgattctggcagctttagggagcagggatgagcccctcacaggctgggtggtagttagaggaggcagatttcagaaggccacgcagcgctctttctcagcaggtcaggcaggcagcagaggtcgggcaggggcatggggtcgagggcccgatgctggtgtgttca

SEQ ID NO: 83558 - DNA, 601 bp, Human
tctcaaccggagcgtactggtcccgtcttcctcctcctttctccactttgtggaccttcctcctgccatcctgtggtgggaggtttccattagtcttgggtctctgtgtcatgattctgggaagtagagaaagaggaggaagagatcggtctgactctggctttgctgttctgtcgcccagaaaagggcctcagtggctgggctgcctgcaggacaggtgccggccaggtgcctaccgtcaggtttcctgtctgaggtgacgtggccggcagccaagtgtgcacacgtctcctccgagccrctctctgctgggggtggggaacgcccaggagtctggtgatgtcggcgtctcccagcctcgggttgggccctgagtgtacggcatacacacttctgctgccgcctcggcacagaccctctgtgcagccccaggggcggtagatcctagtgtccgtgcgtagccggcctgccctgggctcccctgagcctcttcgggcccagtgcgtggtctgtctgttgctgccgggggactgatgatggggtttctggcagtgacgggtttggacacactgtcctgcggcgggagggggaggtgagtggg

SEQ ID NO: 83559 - DNA, 601 bp, Human
aaccggaaggcagaggttgcagtgagcggagatcgtgccactgcactccagcctgggtgaaagagcaaaactccatctcaaaaaaaaaaaaaaaaaaagagaagtacgtagctatcttctgtttagctctcatctgatgtcttggttatctttttgttgtttgtttagaatgttgcatgagctctgtctcactcatgctgaacacccagcaccgagagcagtggctggcgcacagcaggcacctgagtgcttgttgggtgggtgggacccccagggaggatgagccatgcgtgttattgaygtcatagagtgactagaccacagcccgtggtggctcggccatccaggcagtgctgccgggactgagctcggtgctccctgcaggatgatctgtctgctgtgcgtccggaccgcgtcctctgtggacatagaggtcagtgcctcccctccccagggccggcccatttcaccctggtttctgggaggctggggcttgggggttgagccctgtgtgccacctgctggctgtgtagccctgggcaagctgctcggtctctctgagcctcaggagtcccccatgtaagtcaggatagccgggcgc

SEQ ID NO: 83560 - DNA, 601 bp, Human
tcacagggctctcctgatcctctgctcttcctgctacccccctccccgtaggggcggtggggggatgttgtctttgtgcacagcttgcagccgaactcagggcagctttcagttgctgctgggctggcccaccgggtgcccaggattcagttgctggtctgtccgagtcagggactttgcaggcaggcatgggggtggggcccgtctgggtcctgactgtgctggagcatgtagaaacccctcctgggcgccccacctgctgtttctgcggcccctgataaacgtgtggtgggcactgcgsgctcaggcgtgctactctcggtcccaagggtgactgggagggcgtcccacagcaagcaagcagctctgaccctgtgtgctggccgggctcgtgttccaggccatggcatgtccgaacgaggtggtgtcctatgagatcgtcctgtccatcaccaggctcatcaagaagtataggaaggagctccaggtggtggcgtgggacattctgctgaacatcatcgaacggctccttcagcagctccaggtggggtgggggcaggagctccggggagcaccgggaacccagacaggcaggctcggc

SEQ ID NO: 83561 - DNA, 601 bp, Human
ccccctccccgtaggggcggtggggggatgttgtctttgtgcacagcttgcagccgaactcagggcagctttcagttgctgctgggctggcccaccgggtgcccaggattcagttgctggtctgtccgagtcagggactttgcaggcaggcatgggggtggggcccgtctgggtcctgactgtgctggagcatgtagaaacccctcctgggcgccccacctgctgtttctgcggcccctgataaacgtgtggtgggcactgcgcgctcaggcgtgctactctcggtcccaagggtgactgrgagggcgtcccacagcaagcaagcagctctgaccctgtgtgctggccgggctcgtgttccaggccatggcatgtccgaacgaggtggtgtcctatgagatcgtcctgtccatcaccaggctcatcaagaagtataggaaggagctccaggtggtggcgtgggacattctgctgaacatcatcgaacggctccttcagcagctccaggtggggtgggggcaggagctccggggagcaccgggaacccagacaggcaggctcggcccactcagaagatggtaccttgggccccatctctggg

SEQ ID NO: 83562 - DNA, 601 bp, Human
accgtgttctctggtgattcgcagtggcgctcatccaccttccaccggagacaggtctgatttttccagacgtggtgcatcgtttaggccccagacaggaatatgcagtaggtgagccggggctgggccagtgctgtccacagtccgcagagtgacctgcaggccgccttcgtggcctgagtgggccccggcacagttcccagagggatgccagtgtggcttccgcatgactttggaggaccgcattagtcgagtctgttaaccacagctttaaggaggactccacggccacacgggctcrtcagcataggggccctggggaggcgaggctagtatccagcagcctcagggctgtgccttttcctggagcctggggcgggtgatgtacaggaggccaggcagcagaagggaggccgggacttcgccgggacttagcagggactgaagtcctctcagagcctgtcgctgggccagagcattgcccccgaccgctggtggcagtggcagaggtcatagcctggggcttctaaaagaggctggacctgggagaggcaagaaaggcttgtagttgtggctactcttggccctcctgcccgagctt

SEQ ID NO: 83563 - DNA, 601 bp, Human
acagctttgctctttgattttcagatgcattttggtttctgcacagtcactcgggtataaagggcatctttgcttttgagcaataaagatgaaggccgggcacagtggctcacgcctgtaatcccagcattttgggaggctgaggcaggtggattgcttgagttcaggagttcaagaccagcctggccaacatggtgaaatcctgtctctactaaaaatataaaaattagctgcacgtggtggcgggcacctgcaatcccagctgctcaggaggctgaggcaggagaatcgcttgaacctrggaggtgaaggttgcagtgagccaagattctgccactgcactccagcctggacgacagagcaagactctgtctcaaaaagaaaaaaaaaaagggccgggcacggtggctcatgcctgtaatcccagcactttgggaggccaaggcaggcggatcatgaggtcaggagatcaagaccatcctggctaacacggtgaaaccccatctctactaaaaatacaaaaaattagctgggcgtggtggcgggcgcctgtagtcctagctactggggaggctgaggcaggagaatggcgtgaacctgg

SEQ ID NO: 83564 - DNA, 601 bp, Human
tggcctgtgtccgccttgcagctgcggtgagtggtgctgctgtgaaccttctcctacgagggctccgccgggcctgcattttcacttttgggtctgcacctaggagtgaattgttgggccctaggtttagtctgcatttggtgtttcaaggcgataccaggctgttttccactggtgctgtgccattttccatccactcgagcagcatgtaagggttctgatttatctttttttttttttttttttttttttgatacagtctcactctgtcgcccaggctggagtggagtgcagtggcgcratcttggctcactgcaaccttcgcctcttgggttcaggcgattctcctacctcagcctcctgagcatctcgtattacaggcacctgccaacatactcggctaattttttgtattattagtagaaactgggtttcaccatgttggccaggctggtcttgaactcctgacctcaggtgatcctcccgccttggcctcccaaagtgctgggattacaggtgtgagccaccacgcccggcctgcctctacttttcaaagcctcacagcatcacttacgtgtgactgtcagtgtcagtatcgtgt

SEQ ID NO: 83565 - DNA, 601 bp, Human
ctgcacctaggagtgaattgttgggccctaggtttagtctgcatttggtgtttcaaggcgataccaggctgttttccactggtgctgtgccattttccatccactcgagcagcatgtaagggttctgatttatctttttttttttttttttttttttttgatacagtctcactctgtcgcccaggctggagtggagtgcagtggcgcgatcttggctcactgcaaccttcgcctcttgggttcaggcgattctcctacctcagcctcctgagcatctcgtattacaggcacctgccaacayactcggctaattttttgtattattagtagaaactgggtttcaccatgttggccaggctggtcttgaactcctgacctcaggtgatcctcccgccttggcctcccaaagtgctgggattacaggtgtgagccaccacgcccggcctgcctctacttttcaaagcctcacagcatcacttacgtgtgactgtcagtgtcagtatcgtgtaaaatataatgtatgaatcagtttgctcaaaagctcatccttaagatgttggatggtagaacaatttcctgtcatgtttatatgtcatgggtt

SEQ ID NO: 83566 - DNA, 601 bp, Human
ccagatcacgccattgcactccagcctaggcaacaagaatgaaacaacgtctcaaaaacaaaacaaagcaaaaacaggcatcacctccttggtgtctcatccacatgagcaccatgctctttactgactggttgggaaggggtgtgctgggctgtgggggcctatggcctgggagaactgagaacctttctgcttctgcagagggaaggaaagaggttctgttgcccttacttggaactccagccctggaggcctgagggtctgggctgcagaactgagatatttcctagttgaggcagastcctggttctggctgctttcatttctttatttttttgagatagagtctcaccactatgtcacccaggctggagtgcagcggcacgatctcacctcactgcaacctccgcctcccaggttcaagcaattctcttgcctcagcctcctgagtagctgagatgacaggtgcgcaccaccacacctggctaatttttgtatttttagtagtgacatggtttcaccatgttggccaggctggtctcaatctcctgacctcaagtgatccacccaccccagacccccaaagtgttgggattacagg

SEQ ID NO: 83567 - DNA, 601 bp, Human
ggtggagggacccctgccccagctcgcagcttttgggactgacgtcagaggtccccagccaagggcatgtcactgaatgtggatgtctcccatctgtgcttttcctaagtggggctcccgtgccgttcacctcacattcctggtgtgttacttggcaggcactcccaccactccgaaagggaggcccttcctgggagggaggcaagaaggctccccagcccctttgccccctttcctgggcctgcgttcccagggcctccccagcccctctggctaccccgtgacctggccgctggggagrggtttcatgcctggatttggtcatcagctttcaggcccaaagacactggagcggctccgaggcgccccagaaggcttctccagaactgacttgcacctggccgtggttccagtgctgacagcattaatctcttaccataactacctggacaaaaccaaacaggtaggaggtcagagcaggacaggcgagcttgatggggcctgggattcgagggcctggcccaggtaggccccacatttttctcataaacgagtttctgccaggccagggatgagtgagttggctctgcttccctgggtg

SEQ ID NO: 83568 - DNA, 601 bp, Human
ctccagcctgggcaacagagcgagacaccgtctcaaaaaaaaaaaagagagaagtgaggccgggcacggtggctcacgcctgtaatcccagcactttcggaggccgaggcaggcggatcatgaggtcaggagatcgagaccatctggcgaacacggtgaaaccccgtctctaataaaaatacaaaaaaactagccaggcgtggtggcgggcgcctgtagtcccagctacttgggaggctgaggcaggagaatggcgtgaacccagggggtggagcttgcagtgagccgggatcgcgccacygcactccagcctgggcgacagagccagactcatctcaaaaaaaaaaaaaaaaaaaaaaaaagaggtgcggaagcctttcctcacggatcacacaaatggtaggcgacagctcgaattggcccagaagctgtggttggctggccatgggaccgagagttgaggccagggtcgggaaagccacgtccgtgtggccgtggccttctctcctctgcagcaccccatcgctgccgtgggcagagcagccgtgttggccttcagaggcgctgcacgggaccccggctcccctgaccaccctctcca

SEQ ID NO: 83569 - DNA, 601 bp, Human
ggaccgagagttgaggccagggtcgggaaagccacgtccgtgtggccgtggccttctctcctctgcagcaccccatcgctgccgtgggcagagcagccgtgttggccttcagaggcgctgcacgggaccccggctcccctgaccaccctctccattaccgcagctctggccaggctgccgcacctctacaggaactttgccgcggagcagtatgccagtgtgttcgccatctccctgccgtacaccaacccctccaagtgagtggtcgccccaggccctgtgcctcccagccgtggccccsgctaggccttgcggcagaaagccccggcagcctttgtccccaaggcctgagcgcctcggttttttgcacttcatgccctggggatgtttccctgctgccaggatggagtgccagcccccttctcatctcaggtttaatcagtacatcgtgtgtctggcccatcacgtcatagccatgtggttcatcaggtgccgcctgcccttccggaaggattttgtccctttcatcactaaggtgggctcagggccggtgaaggctgtgtctctcggtaggccagggcttgctttgcccttggctgtc

SEQ ID NO: 83570 - DNA, 601 bp, Human
gcggggctggcctgagcgccatctttctgccagtcacccacagagctgtggacactcaggggcgattgcagacttggccctcttgggatatttgggggtaacttttgttttttttttgagacagagtcttgctctgtggcccacgctggaacgcagtggcgcaatctcggctcactgcaagctccacctcccgggttcacgccattctcctgcctcagcctcccgagtagctgggaccacaggcgcccgccaccacgcctggccaatttttttgtatttctagtagagatggggtttcacygtgttagccaggatggtctcaatctcctgacctcgtgatctgcccgccttggcctcccaaagtgctgggattacaggcgtgagccaccgcgcccagccatttgggggtaacttgtaagtctccagaggtgagctgtgaggggcgatccaggtggctgaggtggggcaggggcctgtggcgaaccaagtgacttccatggcagagagttgccctccccgcctggaggctgcaagtccgagaccaaggtgctcctcggcaggaggtgctcctcagaggcctcaatccttggcatgcagttgg

SEQ ID NO: 83571 - DNA, 601 bp, Human
cggggctggcctgagcgccatctttctgccagtcacccacagagctgtggacactcaggggcgattgcagacttggccctcttgggatatttgggggtaacttttgttttttttttgagacagagtcttgctctgtggcccacgctggaacgcagtggcgcaatctcggctcactgcaagctccacctcccgggttcacgccattctcctgcctcagcctcccgagtagctgggaccacaggcgcccgccaccacgcctggccaatttttttgtatttctagtagagatggggtttcactrtgttagccaggatggtctcaatctcctgacctcgtgatctgcccgccttggcctcccaaagtgctgggattacaggcgtgagccaccgcgcccagccatttgggggtaacttgtaagtctccagaggtgagctgtgaggggcgatccaggtggctgaggtggggcaggggcctgtggcgaaccaagtgacttccatggcagagagttgccctccccgcctggaggctgcaagtccgagaccaaggtgctcctcggcaggaggtgctcctcagaggcctcaatccttggcatgcagttggt

SEQ ID NO: 83572 - DNA, 601 bp, Human
agagctgtggacactcaggggcgattgcagacttggccctcttgggatatttgggggtaacttttgttttttttttgagacagagtcttgctctgtggcccacgctggaacgcagtggcgcaatctcggctcactgcaagctccacctcccgggttcacgccattctcctgcctcagcctcccgagtagctgggaccacaggcgcccgccaccacgcctggccaatttttttgtatttctagtagagatggggtttcactgtgttagccaggatggtctcaatctcctgacctcgtgatcygcccgccttggcctcccaaagtgctgggattacaggcgtgagccaccgcgcccagccatttgggggtaacttgtaagtctccagaggtgagctgtgaggggcgatccaggtggctgaggtggggcaggggcctgtggcgaaccaagtgacttccatggcagagagttgccctccccgcctggaggctgcaagtccgagaccaaggtgctcctcggcaggaggtgctcctcagaggcctcaatccttggcatgcagttggttttttccctgtgtcctcacaggctctttcctggatgtctg

SEQ ID NO: 83573 - DNA, 601 bp, Human
ttgcagtggcctctttctcctccctgtaccagtccagctgccaaggacagctgcacaggagcgtttcctgggcaggtatcgcctctcagagggaagcggttggctgcagagcgccactctgcctcataggtgctgtgctcgtcgcctcatccgcccacccccatggtccgtctgcctccattgccctggggagcaggtcccgactcgcatgaggacgtctgtgcagaatgtctttggcttggccagcgggatccccttgacttggtccctttgtggctgagccctgttcccacgctgtgcragcactcccggcccagcttcaggcctgaggggtgggggtggcctgagtctccatggtgacatcagctgagctgcagactctgatgggtggcagctgtttagggggaagcccacccctgggcctgcaccgagcgggccttgccctggcctttggtggctcccctggcctctggaacccacagatggggctgcctcaagtcccaggttgaccaggggccctgcagaccgacctctgcctgttgcccccaagccctggtggggagtgctgtgacctgcatggtgctcccctgccaggtctcca

SEQ ID NO: 83574 - DNA, 601 bp, Human
ccctctggtcaggagaaggctggttctcggaggccacgtcagggccagggcctggcccagccccacatccagcagccccgtctgtgtcctcccagactccgccgtggtcatggaggagggaagtccgggcgaggttcctgtgctggtggagcccccagggttggaggacgttgaggcagcgctaggcatggacaggcgcacggatgcctacagcagggtgagtgtggctcagagcctggaccctgctgacctcggggggctccttaggggaggcagggctctgcgtgggtgtgcctgcacyctgggaactggctctgaacttgggggagatgttcttccacatccctcgtgcacagacggtctgcactttgcagccatccacctgggccggccctggctgctgggcagcctgtggtctcaggggatgctgatacctctgctcacgcagtgtggggcacagctggtggcagtgctgctgcgtcaacgggcgggggccgtagcctggtgctcgggctggtctgtggccctgggatggaggacagatagggcctcaccacctccaggtcaaccccaggtgggctcgagggtgcctgctgacagg

SEQ ID NO: 83575 - DNA, 601 bp, Human
acgtgtgtggtgaggacggccagttcacctactgctggcacgatgacatcatgcaaggtacggcctggcgcctacccgctcctgctgccccaggcctcagggcacggctcccatccagtcctgctaccccacgccctggggcatggccctggcacccccacctgctccagctccccacgcctcaggttccgagcctaacagcgtgggcatggaggcagtgatggggctggtggctttgcgtcccaaagccctgcccctggggagagccgaggaccactggccaggcaccagaggacgtggyccccgcaggcccccagagcccctggagtaatcaggaggtgccccagtgcaaggcacagagggcctcagcactggccccacaaacccatccggccctgctcaccctcagccgtcttccacatcgccaccctgatgcccaccaaggacgtggacaagcaccgctgcgacaagaagcgccacctgggcaacgactttgtgtccattgtctacaatgactccggtgaggacttcaagcttggcaccatcaaggtgagtgaggggccgtcagtgaggctgggccccaggcaggtgcccactgctg

SEQ ID NO: 83576 - DNA, 601 bp, Human
ctggtgtccctgcagtgcaggaaaggtagggccgggtggggccctgcagtgcaggaaaggtagggccgggtggggccctgcagtgtggcgccaagagccctgggcctggcgtgaccaccaagtctccccagacatggagggccttgtggacaccagcgtggccaagatcgtgtctgaccgcaacctgcccttcgtggcccgccagatggccctgcacgcaaatgtgagtgggggtgggtccaggcgtgagctggtgggacaggcccaggtgccacctgatagtgagctcaccccctgcctmcgtccccagatggcctcacaggtgcatcatagccgctccaaccccaccgatatctacccctccaagtggattgcccggctccgccacatcaagcggctccgccagcgggtagggaatatggggctccctcagcggggtgtgctggctgcccaagctgtggggcgggtgtgtgggcagagcggttgccacgcctcccagacttactgcccaagccgcctctgccttcagatctgcgaggaagccgcctactccaaccccagcctacctctggtgcaccctccgtcccatagcaaagcccct

SEQ ID NO: 83577 - DNA, 601 bp, Human
caggaaaggtagggccgggtggggccctgcagtgtggcgccaagagccctgggcctggcgtgaccaccaagtctccccagacatggagggccttgtggacaccagcgtggccaagatcgtgtctgaccgcaacctgcccttcgtggcccgccagatggccctgcacgcaaatgtgagtgggggtgggtccaggcgtgagctggtgggacaggcccaggtgccacctgatagtgagctcaccccctgcctacgtccccagatggcctcacaggtgcatcatagccgctccaaccccaccgayatctacccctccaagtggattgcccggctccgccacatcaagcggctccgccagcgggtagggaatatggggctccctcagcggggtgtgctggctgcccaagctgtggggcgggtgtgtgggcagagcggttgccacgcctcccagacttactgcccaagccgcctctgccttcagatctgcgaggaagccgcctactccaaccccagcctacctctggtgcaccctccgtcccatagcaaagcccctgcacagactccagccgagcccacacctggctatgaggtgggccagcggaag

SEQ ID NO: 83578 - DNA, 601 bp, Human
gtggattgcccggctccgccacatcaagcggctccgccagcgggtagggaatatggggctccctcagcggggtgtgctggctgcccaagctgtggggcgggtgtgtgggcagagcggttgccacgcctcccagacttactgcccaagccgcctctgccttcagatctgcgaggaagccgcctactccaaccccagcctacctctggtgcaccctccgtcccatagcaaagcccctgcacagactccagccgagcccacacctggctatgaggtgggccagcggaagcgcctcatctcctcsgtggaggacttcaccgagtttgtgtgaggccggggccctccctcctgcactggccttggacggtattgcctgtcagtgaaataaataaagtcctgaccccagtgcacagacatagaggcacagattgcagtcagacagctcttttattgactttgtctgcttggtgcgggggttgggggggtgtcgaggctctagaagcggccatgcccacagaagtggtacacagaagcaggcacagccagctccgagggccttgaggctgcctgggccatacagcacactcgcgcgtgcgcgcgcgca

SEQ ID NO: 83579 - DNA, 601 bp, Human; identical to SEQ ID NO: 83553

SEQ ID NO: 83580 - DNA, 601 bp, Human; identical to SEQ ID NO: 83554

SEQ ID NO: 83581 - DNA, 601 bp, Human; identical to SEQ ID NO: 83555

SEQ ID NO: 83582 - DNA, 601 bp, Human; identical to SEQ ID NO: 83556

SEQ ID NO: 83583 - DNA, 601 bp, Human; identical to SEQ ID NO: 83557

SEQ ID NO: 83584 - DNA, 601 bp, Human; identical to SEQ ID NO: 83558

SEQ ID NO: 83585 - DNA, 601 bp, Human; identical to SEQ ID NO: 83559

SEQ ID NO: 83586 - DNA, 601 bp, Human; identical to SEQ ID NO: 83560

SEQ ID NO: 83587 - DNA, 601 bp, Human; identical to SEQ ID NO: 83561

SEQ ID NO: 83588 - DNA, 601 bp, Human; identical to SEQ ID NO: 83562

SEQ ID NO: 83589 - DNA, 601 bp, Human; identical to SEQ ID NO: 83563

SEQ ID NO: 83590 - DNA, 601 bp, Human; identical to SEQ ID NO: 83564

SEQ ID NO: 83591 - DNA, 601 bp, Human; identical to SEQ ID NO: 83565

SEQ ID NO: 83592 - DNA, 601 bp, Human; identical to SEQ ID NO: 83566

SEQ ID NO: 83593 - DNA, 601 bp, Human; identical to SEQ ID NO: 83567

SEQ ID NO: 83594 - DNA, 601 bp, Human; identical to SEQ ID NO: 83568

SEQ ID NO: 83595 - DNA, 601 bp, Human; identical to SEQ ID NO: 83569

SEQ ID NO: 83596 - DNA, 601 bp, Human; identical to SEQ ID NO: 83570

SEQ ID NO: 83597 - DNA, 601 bp, Human; identical to SEQ ID NO: 83571

SEQ ID NO: 83598 - DNA, 601 bp, Human; identical to SEQ ID NO: 83572

SEQ ID NO: 83599 - DNA, 601 bp, Human; identical to SEQ ID NO: 83573

SEQ ID NO: 83600 - DNA, 601 bp, Human; identical to SEQ ID NO: 83574

SEQ ID NO: 83601 - DNA, 601 bp, Human; identical to SEQ ID NO: 83575

SEQ ID NO: 83602 - DNA, 601 bp, Human; identical to SEQ ID NO: 83576

SEQ ID NO: 83603 - DNA, 601 bp, Human; identical to SEQ ID NO: 83577

SEQ ID NO: 83604 - DNA, 601 bp, Human; identical to SEQ ID NO: 83578

SEQ ID NO: 83605 - DNA, 601 bp, Human; identical to SEQ ID NO: 83553

SEQ ID NO: 83606 - DNA, 601 bp, Human; identical to SEQ ID NO: 83554

SEQ ID NO: 83607 - DNA, 601 bp, Human; identical to SEQ ID NO: 83555

SEQ ID NO: 83608 - DNA, 601 bp, Human; identical to SEQ ID NO: 83556

SEQ ID NO: 83609 - DNA, 601 bp, Human; identical to SEQ ID NO: 83557

SEQ ID NO: 83610 - DNA, 601 bp, Human; identical to SEQ ID NO: 83558

SEQ ID NO: 83611 - DNA, 601 bp, Human; identical to SEQ ID NO: 83559

SEQ ID NO: 83612 - DNA, 601 bp, Human; identical to SEQ ID NO: 83560

SEQ ID NO: 83613 - DNA, 601 bp, Human; identical to SEQ ID NO: 83561

SEQ ID NO: 83614 - DNA, 601 bp, Human; identical to SEQ ID NO: 83562

SEQ ID NO: 83615 - DNA, 601 bp, Human; identical to SEQ ID NO: 83563

SEQ ID NO: 83616 - DNA, 601 bp, Human; identical to SEQ ID NO: 83564

SEQ ID NO: 83617 - DNA, 601 bp, Human; identical to SEQ ID NO: 83565

SEQ ID NO: 83618 - DNA, 601 bp, Human; identical to SEQ ID NO: 83566

SEQ ID NO: 83619 - DNA, 601 bp, Human; identical to SEQ ID NO: 83567

SEQ ID NO: 83620 - DNA, 601 bp, Human; identical to SEQ ID NO: 83568

SEQ ID NO: 83621 - DNA, 601 bp, Human; identical to SEQ ID NO: 83569

SEQ ID NO: 83622 - DNA, 601 bp, Human; identical to SEQ ID NO: 83570

SEQ ID NO: 83623 - DNA, 601 bp, Human; identical to SEQ ID NO: 83571

SEQ ID NO: 83624 - DNA, 601 bp, Human; identical to SEQ ID NO: 83572

SEQ ID NO: 83625 - DNA, 601 bp, Human; identical to SEQ ID NO: 83573

SEQ ID NO: 83626 - DNA, 601 bp, Human; identical to SEQ ID NO: 83574

SEQ ID NO: 83627 - DNA, 601 bp, Human; identical to SEQ ID NO: 83575

SEQ ID NO: 83628 - DNA, 601 bp, Human; identical to SEQ ID NO: 83576

SEQ ID NO: 83629 - DNA, 601 bp, Human; identical to SEQ ID NO: 83577

SEQ ID NO: 83630 - DNA, 601 bp, Human; identical to SEQ ID NO: 83578

SEQ ID NO: 83631 - DNA, 601 bp, Human; identical to SEQ ID NO: 83553

SEQ ID NO: 83632 - DNA, 601 bp, Human; identical to SEQ ID NO: 83554

SEQ ID NO: 83633 - DNA, 601 bp, Human; identical to SEQ ID NO: 83555

SEQ ID NO: 83634 - DNA, 601 bp, Human; identical to SEQ ID NO: 83556

SEQ ID NO: 83635 - DNA, 601 bp, Human; identical to SEQ ID NO: 83557

SEQ ID NO: 83636 - DNA, 601 bp, Human; identical to SEQ ID NO: 83558

SEQ ID NO: 83637 - DNA, 601 bp, Human; identical to SEQ ID NO: 83559

SEQ ID NO: 83638 - DNA, 601 bp, Human; identical to SEQ ID NO: 83560

SEQ ID NO: 83639 - DNA, 601 bp, Human; identical to SEQ ID NO: 83561

SEQ ID NO: 83640 - DNA, 601 bp, Human; identical to SEQ ID NO: 83562

SEQ ID NO: 83641 - DNA, 601 bp, Human; identical to SEQ ID NO: 83563

SEQ ID NO: 83642 - DNA, 601 bp, Human; identical to SEQ ID NO: 83564

SEQ ID NO: 83643 - DNA, 601 bp, Human; identical to SEQ ID NO: 83565

SEQ ID NO: 83644 - DNA, 601 bp, Human; identical to SEQ ID NO: 83566

SEQ ID NO: 83645 - DNA, 601 bp, Human; identical to SEQ ID NO: 83567

SEQ ID NO: 83646 - DNA, 601 bp, Human; identical to SEQ ID NO: 83568

SEQ ID NO: 83647 - DNA, 601 bp, Human; identical to SEQ ID NO: 83569

SEQ ID NO: 83648 - DNA, 601 bp, Human; identical to SEQ ID NO: 83570

SEQ ID NO: 83649 - DNA, 601 bp, Human; identical to SEQ ID NO: 83571

SEQ ID NO: 83650 - DNA, 601 bp, Human; identical to SEQ ID NO: 83572

SEQ ID NO: 83651 - DNA, 601 bp, Human; identical to SEQ ID NO: 83573

SEQ ID NO: 83652 - DNA, 601 bp, Human; identical to SEQ ID NO: 83574

SEQ ID NO: 83653 - DNA, 601 bp, Human; identical to SEQ ID NO: 83575

SEQ ID NO: 83654 - DNA, 601 bp, Human; identical to SEQ ID NO: 83576

SEQ ID NO: 83655 - DNA, 601 bp, Human; identical to SEQ ID NO: 83577

SEQ ID NO: 83656 - DNA, 601 bp, Human; identical to SEQ ID NO: 83578

SEQ ID NO: 83657 - DNA, 601 bp, Human; identical to SEQ ID NO: 83553

SEQ ID NO: 83658 - DNA, 601 bp, Human; identical to SEQ ID NO: 83554

SEQ ID NO: 83659 - DNA, 601 bp, Human; identical to SEQ ID NO: 83555

SEQ ID NO: 83660 - DNA, 601 bp, Human; identical to SEQ ID NO: 83556

SEQ ID NO: 83661 - DNA, 601 bp, Human; identical to SEQ ID NO: 83557

SEQ ID NO: 83662 - DNA, 601 bp, Human; identical to SEQ ID NO: 83558

SEQ ID NO: 83663 - DNA, 601 bp, Human; identical to SEQ ID NO: 83559

SEQ ID NO: 83664 - DNA, 601 bp, Human; identical to SEQ ID NO: 83560

SEQ ID NO: 83665 - DNA, 601 bp, Human; identical to SEQ ID NO: 83561

SEQ ID NO: 83666 - DNA, 601 bp, Human; identical to SEQ ID NO: 83562

SEQ ID NO: 83667 - DNA, 601 bp, Human; identical to SEQ ID NO: 83563

SEQ ID NO: 83668 - DNA, 601 bp, Human; identical to SEQ ID NO: 83564

SEQ ID NO: 83669 - DNA, 601 bp, Human; identical to SEQ ID NO: 83565

SEQ ID NO: 83670 - DNA, 601 bp, Human; identical to SEQ ID NO: 83566

SEQ ID NO: 83671 - DNA, 601 bp, Human; identical to SEQ ID NO: 83567

SEQ ID NO: 83672 - DNA, 601 bp, Human; identical to SEQ ID NO: 83568

SEQ ID NO: 83673 - DNA, 601 bp, Human; identical to SEQ ID NO: 83569

SEQ ID NO: 83674 - DNA, 601 bp, Human; identical to SEQ ID NO: 83570

SEQ ID NO: 83675 - DNA, 601 bp, Human; identical to SEQ ID NO: 83571

SEQ ID NO: 83676 - DNA, 601 bp, Human; identical to SEQ ID NO: 83572

SEQ ID NO: 83677 - DNA, 601 bp, Human; identical to SEQ ID NO: 83573

SEQ ID NO: 83678 - DNA, 601 bp, Human; identical to SEQ ID NO: 83574

SEQ ID NO: 83679 - DNA, 601 bp, Human; identical to SEQ ID NO: 83575

SEQ ID NO: 83680 - DNA, 601 bp, Human; identical to SEQ ID NO: 83576

SEQ ID NO: 83681 - DNA, 601 bp, Human; identical to SEQ ID NO: 83577

SEQ ID NO: 83682 - DNA, 601 bp, Human; identical to SEQ ID NO: 83578

SEQ ID NO: 83683 - DNA, 601 bp, Human; identical to SEQ ID NO: 83553

SEQ ID NO: 83684 - DNA, 601 bp, Human; identical to SEQ ID NO: 83554

SEQ ID NO: 83685 - DNA, 601 bp, Human; identical to SEQ ID NO: 83555

SEQ ID NO: 83686 - DNA, 601 bp, Human; identical to SEQ ID NO: 83556

SEQ ID NO: 83687 - DNA, 601 bp, Human; identical to SEQ ID NO: 83557

SEQ ID NO: 83688 - DNA, 601 bp, Human; identical to SEQ ID NO: 83558

SEQ ID NO: 83689 - DNA, 601 bp, Human; identical to SEQ ID NO: 83559

SEQ ID NO: 83690 - DNA, 601 bp, Human; identical to SEQ ID NO: 83560

SEQ ID NO: 83691 - DNA, 601 bp, Human; identical to SEQ ID NO: 83561

SEQ ID NO: 83692 - DNA, 601 bp, Human; identical to SEQ ID NO: 83562

SEQ ID NO: 83693 - DNA, 601 bp, Human; identical to SEQ ID NO: 83563

SEQ ID NO: 83694 - DNA, 601 bp, Human; identical to SEQ ID NO: 83564

SEQ ID NO: 83695 - DNA, 601 bp, Human; identical to SEQ ID NO: 83565

SEQ ID NO: 83696 - DNA, 601 bp, Human; identical to SEQ ID NO: 83566

SEQ ID NO: 83697 - DNA, 601 bp, Human; identical to SEQ ID NO: 83567

SEQ ID NO: 83698 - DNA, 601 bp, Human; identical to SEQ ID NO: 83568

SEQ ID NO: 83699 - DNA, 601 bp, Human; identical to SEQ ID NO: 83569

SEQ ID NO: 83700 - DNA, 601 bp, Human; identical to SEQ ID NO: 83570

SEQ ID NO: 83701 - DNA, 601 bp, Human; identical to SEQ ID NO: 83571

SEQ ID NO: 83702 - DNA, 601 bp, Human; identical to SEQ ID NO: 83572

SEQ ID NO: 83703 - DNA, 601 bp, Human; identical to SEQ ID NO: 83573

SEQ ID NO: 83704 - DNA, 601 bp, Human; identical to SEQ ID NO: 83574

SEQ ID NO: 83705 - DNA, 601 bp, Human; identical to SEQ ID NO: 83575

SEQ ID NO: 83706 - DNA, 601 bp, Human; identical to SEQ ID NO: 83576

SEQ ID NO: 83707 - DNA, 601 bp, Human; identical to SEQ ID NO: 83577

SEQ ID NO: 83708 - DNA, 601 bp, Human; identical to SEQ ID NO: 83578

SEQ ID NO: 83709 - DNA, 601 bp, Human; identical to SEQ ID NO: 21810

SEQ ID NO: 83710 - DNA, 601 bp, Human
atagttttgggaagtggttttctctcttttatggttgcagtacaatttcattacctagcactgtgatatttattttaatttttgtgatttttgggattcatatggatatttatgagggaaaagttcctgattcttgacacatagctggatttttttgtatgaacagctatggaagacattctttcccttggctaccaggaaactctgaacttagtccatcccccctgccttttaaataaacattatttttagaagagttttaggttcaagcaaaattgaacagaaaatacagacagttccyatatatttctccttccttccccctgcctccccattatcagtatccaccatagattggtacattgattacagttggtgaaccgcattgacacatcgtcgccctgtgaagtctgtagtttacattagcgttcattcttgatgttgtgccttctgtgggtttcgacaaatgaataataccgtatattcaccattgtagtctctcactgggtagcttcaccatcctaaaagtcctctgtgctccgcctggaatttttggaaaaatatttcaaatcatttaaataaatgacttactacatcataa

SEQ ID NO: 83711 - DNA, 601 bp, Human
acagttggtgaaccgcattgacacatcgtcgccctgtgaagtctgtagtttacattagcgttcattcttgatgttgtgccttctgtgggtttcgacaaatgaataataccgtatattcaccattgtagtctctcactgggtagcttcaccatcctaaaagtcctctgtgctccgcctggaatttttggaaaaatatttcaaatcatttaaataaatgacttactacatcataaggagtaagcaatagcagcgatatagacattatgagagcagcatattaattcaatttacttgaattcartttacccatagagctaactaacggagtgttccaatgattttaccatttgtgagtgaaaatggtgagggtgaggtgttctttctgaagtccccacagccttgggctggggaaatccttttgcattttcatctttctgtctttttgtttttatgagacagagtctaactctgtcacccaggctgtgtgatgacagctcactgctgccccgacctcctgggctcaagtgatcctcctgcctcagcctcctgagtaactgggaccacaggcgcatgccgtgctaacattttcatgtcatgactt

SEQ ID NO: 83712 - DNA, 601 bp, Human
atctagtgttatatttaaaatgcctttcattttccaggattgttttttttcttttccaccttgatggtagttttaagaaaatatttaatttttgtctcaggcataattggcttcatttgagcaatcagagacatctttgacaacacacggaagtcgctcctcttttcaacagcagagctacacattctctggttattagattacaagatggattgtgtcataagttcctacgaatgcgtagttatatttcttaaagatgaaatgtagaccacaggctgacagtttttaccttcttttgatyaaaatttttggaatttaaaaatttggaatatttttcagttttcattgggttgatattccaggaaagtctaggtactaatggatggagagggtgatgggcatgggctcagctgacaccactgtggccttccactgtttcttacatgctcacttatgcttgcttggtggggtctagagttaggttgggccccccagctcctggagttctccatgaattacagaagcctgggttattcactggggcagggcgggcagcctggacatagttccttgtttctggagcccctacctgtgtagtgtt

SEQ ID NO: 83713 - DNA, 601 bp, Human
gtggttctcaatcctaactgaatatgagaaaaatcttgcgagctatcaataaaaattcttggtcaggtgctgtggttcatgcctgtaatcctagcactttgggaggctgaggaaggcagatcgcttgagcccaggcattcaagaccagcctgacaacatggcaaaacctcgtctctactaaaaaatacaaaagttagctgggcgcttggtggcttgcacctgtggtcccagctactcaagaggctgaggtggggggatcacctgagcctagggaggttgagactgcaaatgagccatgatygtgccattgtactccagcctgggctacagagtcatcctgtcccccccaacggccccctgccccgccacccccccgccccaaaaaaaagaaaaaagtcttgcacaagccccactcctgtccaggtaaaccagaatctctactttaaccaaaatcgcttgtttgtcactatgggccactcagtgactggcagtttgctgccaccagactaccttgccctccctgctctgccccgcttatcacatggtggcattcagcacatctggggaattttttttaataggacttgcttctaacttattc

SEQ ID NO: 83714 - DNA, 601 bp, Human
tgctgtggttcatgcctgtaatcctagcactttgggaggctgaggaaggcagatcgcttgagcccaggcattcaagaccagcctgacaacatggcaaaacctcgtctctactaaaaaatacaaaagttagctgggcgcttggtggcttgcacctgtggtcccagctactcaagaggctgaggtggggggatcacctgagcctagggaggttgagactgcaaatgagccatgattgtgccattgtactccagcctgggctacagagtcatcctgtcccccccaacggccccctgccccgccmcccccccgccccaaaaaaaagaaaaaagtcttgcacaagccccactcctgtccaggtaaaccagaatctctactttaaccaaaatcgcttgtttgtcactatgggccactcagtgactggcagtttgctgccaccagactaccttgccctccctgctctgccccgcttatcacatggtggcattcagcacatctggggaattttttttaataggacttgcttctaacttattcagtgtgttgtccaaccagatgttctctttgttactaagaaaggatacttggtcgggtgcagtggctc

SEQ ID NO: 83715 - DNA, 601 bp, Human
tgcctgtaatcctagcactttgggaggctgaggaaggcagatcgcttgagcccaggcattcaagaccagcctgacaacatggcaaaacctcgtctctactaaaaaatacaaaagttagctgggcgcttggtggcttgcacctgtggtcccagctactcaagaggctgaggtggggggatcacctgagcctagggaggttgagactgcaaatgagccatgattgtgccattgtactccagcctgggctacagagtcatcctgtcccccccaacggccccctgccccgccacccccccgcccmaaaaaaaagaaaaaagtcttgcacaagccccactcctgtccaggtaaaccagaatctctactttaaccaaaatcgcttgtttgtcactatgggccactcagtgactggcagtttgctgccaccagactaccttgccctccctgctctgccccgcttatcacatggtggcattcagcacatctggggaattttttttaataggacttgcttctaacttattcagtgtgttgtccaaccagatgttctctttgttactaagaaaggatacttggtcgggtgcagtggctcacacctgtaatc

SEQ ID NO: 83716 - DNA, 601 bp, Human
tttgaggctttctttagaatgacttctgcgtgtctgtgttaacagagttcagttccttaaaatgagaaagtgtccatggacctttaagtctacagttcttagtcttcggttgaaaagaatgtgtcacatttctgtcttttaacctttttataatgtaaccttttctatctttttctaaaagatagaaaattgtaaaaataatggaaattttatggaaaagtgtagttaaataaattatccatagttttacatagccagggtagtacctcatgtttattctgatatgtttgtttccaaattwttttttctgtgtgtggcatatgatttttaaatacaatatcccgtcctaccatgtatttgtttatttaactgattgattttttaatgtctttttagtcccttttttgccatcttaaccatttttaggcgtgcagttcagtagtaagtatgtttgcattgcacatacttttatctttctaacaaacctagcattatcttatgaacatgtccttttattaagcattattcaaaaattcggcttctcaatggctgcagcctgtagtcctgtgattccagcagtcctttgctttgggctctgagg

SEQ ID NO: 83717 - DNA, 601 bp, Human; identical to SEQ ID NO: 21811

SEQ ID NO: 83718 - DNA, 601 bp, Human; identical to SEQ ID NO: 21812

SEQ ID NO: 83719 - DNA, 601 bp, Human; identical to SEQ ID NO: 21813

SEQ ID NO: 83720 - DNA, 601 bp, Human; identical to SEQ ID NO: 21814

SEQ ID NO: 83721 - DNA, 601 bp, Human
cttgtcacctctcccatcctttgtcgtgcgttgactcatgatgcctccctctcgcactcggtgacgatgatctcttatgttcccttgttaccgtggcccatgggtctctgtgcccctttgtctcctgtggtcttggtcgtcccgtgccctccaggctcgcgttggacgacgccattcgacacaagccgctgaacatgtcatcccgtttttcacccagggtggcaggggagaatgacttccttcagactgttataaacaaagtcatcgctgccaaagaagtcaaccacaaggggcagggtaygtattttcctattttgtttctatcagcgtgtatttgcatgcgttggggcagtgctgtctgggttggttttagtttgatgttgatcatgatggtggtgataatgatggggatgacagtgatcgtggtggagaatgtgtgtgacagttgcccctgtgtacagtgcatgatggttttcttacccgtcacctttgtgaacattgctgagagcccactcctggatggagagtggggtcagattagaagtttagaggaacatgcaggcggtaggcgtaactccctctgcccgtgttgtgtgctaat

SEQ ID NO: 83722 - DNA, 601 bp, Human
gcgttgactcatgatgcctccctctcgcactcggtgacgatgatctcttatgttcccttgttaccgtggcccatgggtctctgtgcccctttgtctcctgtggtcttggtcgtcccgtgccctccaggctcgcgttggacgacgccattcgacacaagccgctgaacatgtcatcccgtttttcacccagggtggcaggggagaatgacttccttcagactgttataaacaaagtcatcgctgccaaagaagtcaaccacaaggggcagggtacgtattttcctattttgtttctatcagygtgtatttgcatgcgttggggcagtgctgtctgggttggttttagtttgatgttgatcatgatggtggtgataatgatggggatgacagtgatcgtggtggagaatgtgtgtgacagttgcccctgtgtacagtgcatgatggttttcttacccgtcacctttgtgaacattgctgagagcccactcctggatggagagtggggtcagattagaagtttagaggaacatgcaggcggtaggcgtaactccctctgcccgtgttgtgtgctaatctttgcctgttctgggtcttccctgct

SEQ ID NO: 83723 - DNA, 601 bp, Human
cctgttctgggtcttccctgctggtctccctaagaaggtgatttcatttgtgcagacttgctcccctgagttctgtcatttaagtgatttctccgcccctacactccgcctcacactcactgtttttaatcctgcactgacacgtttctgagcagctgacctgctgctggcagaaggaatgaatcagtcacctcgggctggtgacagttggcacttggctggccaggagggctgccaggaaacaactgtgactgaggccccgcctccagcccaaggggaagtcaccttcagaacttgaccrtctcactccctgatccatgcagactgcccgtaaacgcggtagagcttaggtgaacagacctgcttcatcgtccagctaccttatgtcactagacttttaaaaaacaattatcttgattcatttccactgttctaaaggagaatgtgaattgagcctgaagaatgttttagagaatgagccttcctagggatctgcagggacctccagctttcttctggtgtgaactacccccctttctggcaaacagtagcaggacaaaaaccccaacccagaacgttaatgagatgtggcctctgcaga

SEQ ID NO: 83724 - DNA, 601 bp, Human
tctgggtcttccctgctggtctccctaagaaggtgatttcatttgtgcagacttgctcccctgagttctgtcatttaagtgatttctccgcccctacactccgcctcacactcactgtttttaatcctgcactgacacgtttctgagcagctgacctgctgctggcagaaggaatgaatcagtcacctcgggctggtgacagttggcacttggctggccaggagggctgccaggaaacaactgtgactgaggccccgcctccagcccaaggggaagtcaccttcagaacttgaccgtctcrctccctgatccatgcagactgcccgtaaacgcggtagagcttaggtgaacagacctgcttcatcgtccagctaccttatgtcactagacttttaaaaaacaattatcttgattcatttccactgttctaaaggagaatgtgaattgagcctgaagaatgttttagagaatgagccttcctagggatctgcagggacctccagctttcttctggtgtgaactacccccctttctggcaaacagtagcaggacaaaaaccccaacccagaacgttaatgagatgtggcctctgcagacagag

SEQ ID NO: 83725 - DNA, 601 bp, Human
gtgaggaagtgcctggccctttgcccatctgtctgcttacctattctgcaggtctggagctgctgttagctcagggtgcttttgtgtgaattagaaaaaggggcctcatcaaccaggtgagtagggagatgcagccagcgccaggacctgtggctctgtgagcgagtagaggcagggtttagctcccacttgccttttgtggtcacttgtctagtgaaatgcacattctgggcagtggtacatgtgctcctgtctgggtgccatccccgatacctctttggggaccgctttctattggtgsttcttccttcttcaaactctccctcccatgatctggaatttcatatcttaaaaagaaaggaaaaagaaaaaaaatatttttaaaaaaaaaaggaaagaaaagaaacaccaagaagcagtcctaccctgagtaatacatctgtctctgtctatgtggcctctccctctggtcttcgtctcccattcatcttcacccttctgcctcccagcatcggccctctccctgagcgcccccgccccctctgcccccgtctcccaccaggagccctgtggctgcatgggcaccatctgtcccagtttt

SEQ ID NO: 83726 - DNA, 601 bp, Human
gacctgtggctctgtgagcgagtagaggcagggtttagctcccacttgccttttgtggtcacttgtctagtgaaatgcacattctgggcagtggtacatgtgctcctgtctgggtgccatccccgatacctctttggggaccgctttctattggtggttcttccttcttcaaactctccctcccatgatctggaatttcatatcttaaaaagaaaggaaaaagaaaaaaaatatttttaaaaaaaaaaggaaagaaaagaaacaccaagaagcagtcctaccctgagtaatacatctgtcyctgtctatgtggcctctccctctggtcttcgtctcccattcatcttcacccttctgcctcccagcatcggccctctccctgagcgcccccgccccctctgcccccgtctcccaccaggagccctgtggctgcatgggcaccatctgtcccagttttccatttcccctgttatctctgaggtctctgtccccttgtgagctctcaaagtgggcctttctcctgcctcttcggggctcttctttccttccccactctgggtgcttgcccttcaggcagctctgcctggagcgagcgggtctt

SEQ ID NO: 83727 - DNA, 601 bp, Human
gttcttccttcttcaaactctccctcccatgatctggaatttcatatcttaaaaagaaaggaaaaagaaaaaaaatatttttaaaaaaaaaaggaaagaaaagaaacaccaagaagcagtcctaccctgagtaatacatctgtctctgtctatgtggcctctccctctggtcttcgtctcccattcatcttcacccttctgcctcccagcatcggccctctccctgagcgcccccgccccctctgcccccgtctcccaccaggagccctgtggctgcatgggcaccatctgtcccagtttyccatttcccctgttatctctgaggtctctgtccccttgtgagctctcaaagtgggcctttctcctgcctcttcggggctcttctttccttccccactctgggtgcttgcccttcaggcagctctgcctggagcgagcgggtcttcctattccaaggaacggtgcccccgggacttgctagtggttgtgcctgcaaggggcaccgtctctgtaagctgcgcctcctcctaccccaactccccgtggttctgctgacttgaccttcacgctggtccctctcccaccctccatagtggcattc

SEQ ID NO: 83728 - DNA, 566 bp, Human
acatacagatacagacacagacatacatacagatacagaaagacacagatacagaaacacagacagacacagatttagccacacgcatacagatacacagacacagatacacagagacacacacagacacacacgtgtacagacacacatggacacacagacacacacacacacatgcacagatacagatacacagacacacagtgactcacacagacatacgcacagccacaggcatgcgcgcatacccatgctagtagcagaartgaggacagaggctttgatgttctgaggggcagatgaggccctaccaagctgagtggggggaagcaagcaggcagccccccgtgaggcctcagggacagagcacccccatgtgctggcttatagtgccagccccttcccatggggggaaaagatgccgtcgtcgtagaagacagctcaggccgagcccctgcctgccccgcctttgacttgttggaatgtgtggcttgtttccttgtactgtcacctcctatttggttgctactcagtatttatacaaaccacagttctttgtcagcctt

SEQ ID NO: 83729 - DNA, 601 bp, Human
agatacagaaacacagacagacacagatttagccacacgcatacagatacacagacacagatacacagagacacacacagacacacacgtgtacagacacacatggacacacagacacacacacacacatgcacagatacagatacacagacacacagtgactcacacagacatacgcacagccacaggcatgcgcgcatacccatgctagtagcagaaatgaggacagaggctttgatgttctgaggggcagatgaggccctaccaagctgagtggggggaagcaagcaggcagcccccygtgaggcctcagggacagagcacccccatgtgctggcttatagtgccagccccttcccatggggggaaaagatgccgtcgtcgtagaagacagctcaggccgagcccctgcctgccccgcctttgacttgttggaatgtgtggcttgtttccttgtactgtcacctcctatttggttgctactcagtatttatacaaaccacagttctttgtcagccttgcagggaggaagatcccgcgcacatcccgcacacacgcccttacacatagaccccaccgggtttactgccctctccccagg

SEQ ID NO: 83730 - DNA, 601 bp, Human
gatacagaaacacagacagacacagatttagccacacgcatacagatacacagacacagatacacagagacacacacagacacacacgtgtacagacacacatggacacacagacacacacacacacatgcacagatacagatacacagacacacagtgactcacacagacatacgcacagccacaggcatgcgcgcatacccatgctagtagcagaaatgaggacagaggctttgatgttctgaggggcagatgaggccctaccaagctgagtggggggaagcaagcaggcagccccccstgaggcctcagggacagagcacccccatgtgctggcttatagtgccagccccttcccatggggggaaaagatgccgtcgtcgtagaagacagctcaggccgagcccctgcctgccccgcctttgacttgttggaatgtgtggcttgtttccttgtactgtcacctcctatttggttgctactcagtatttatacaaaccacagttctttgtcagccttgcagggaggaagatcccgcgcacatcccgcacacacgcccttacacatagaccccaccgggtttactgccctctccccagga

SEQ ID NO: 83731 - DNA, 601 bp, Human
gttctgaggggcagatgaggccctaccaagctgagtggggggaagcaagcaggcagccccccgtgaggcctcagggacagagcacccccatgtgctggcttatagtgccagccccttcccatggggggaaaagatgccgtcgtcgtagaagacagctcaggccgagcccctgcctgccccgcctttgacttgttggaatgtgtggcttgtttccttgtactgtcacctcctatttggttgctactcagtatttatacaaaccacagttctttgtcagccttgcagggaggaagatcccgcrcacatcccgcacacacgcccttacacatagaccccaccgggtttactgccctctccccaggatacccctggcatctaggtttagaggctttgaaagtcttcatttctctcttggagaaaagagccgagagcggctggggctttgttttcttttgcggtggcactgtggtacagagggcctgggctccacaggctgcacctgtcctggctgtggagggctgtcctgctggtggccctgcagactggtgctccactgctcgcccaggttgtgtgatgctgcttagctacttgaaactttgat

SEQ ID NO: 83732 - DNA, 601 bp, Human
tccttgtactgtcacctcctatttggttgctactcagtatttatacaaaccacagttctttgtcagccttgcagggaggaagatcccgcgcacatcccgcacacacgcccttacacatagaccccaccgggtttactgccctctccccaggatacccctggcatctaggtttagaggctttgaaagtcttcatttctctcttggagaaaagagccgagagcggctggggctttgttttcttttgcggtggcactgtggtacagagggcctgggctccacaggctgcacctgtcctggctgyggagggctgtcctgctggtggccctgcagactggtgctccactgctcgcccaggttgtgtgatgctgcttagctacttgaaactttgatgggttctcgaagctacgaattcacctccagaatcctcccctgcctttgtctttcctgggagactagaaaatgacagacttctcagccacctcctagaaaaaggtggcctgctgatttatcttaaatgtctacccactcaaaagagacattggtccttggcattcctcagcagcacagtgggtgcacagcagctgctgatgtgcgttcagct

SEQ ID NO: 83733 - DNA, 601 bp, Human; identical to SEQ ID NO: 21815

SEQ ID NO: 83734 - DNA, 601 bp, Human; identical to SEQ ID NO: 21816

SEQ ID NO: 83735 - DNA, 601 bp, Human; identical to SEQ ID NO: 21817

SEQ ID NO: 83736 - DNA, 601 bp, Human; identical to SEQ ID NO: 21818

SEQ ID NO: 83737 - DNA, 601 bp, Human; identical to SEQ ID NO: 21819

SEQ ID NO: 83738 - DNA, 601 bp, Human; identical to SEQ ID NO: 21820

SEQ ID NO: 83739 - DNA, 601 bp, Human; identical to SEQ ID NO: 21821

SEQ ID NO: 83740 - DNA, 601 bp, Human; identical to SEQ ID NO: 21822

SEQ ID NO: 83741 - DNA, 601 bp, Human; identical to SEQ ID NO: 21823

SEQ ID NO: 83742 - DNA, 601 bp, Human; identical to SEQ ID NO: 21824

SEQ ID NO: 83743 - DNA, 601 bp, Human; identical to SEQ ID NO: 21825

SEQ ID NO: 83744 - DNA, 601 bp, Human; identical to SEQ ID NO: 21826

SEQ ID NO: 83745 - DNA, 601 bp, Human; identical to SEQ ID NO: 21827

SEQ ID NO: 83746 - DNA, 601 bp, Human; identical to SEQ ID NO: 21828

SEQ ID NO: 83747 - DNA, 601 bp, Human; identical to SEQ ID NO: 21829

SEQ ID NO: 83748 - DNA, 601 bp, Human; identical to SEQ ID NO: 21830

SEQ ID NO: 83749 - DNA, 601 bp, Human; identical to SEQ ID NO: 21831

SEQ ID NO: 83750 - DNA, 601 bp, Human; identical to SEQ ID NO: 21832

SEQ ID NO: 83751 - DNA, 601 bp, Human; identical to SEQ ID NO: 21833

SEQ ID NO: 83752 - DNA, 601 bp, Human; identical to SEQ ID NO: 21834

SEQ ID NO: 83753 - DNA, 601 bp, Human; identical to SEQ ID NO: 21835

SEQ ID NO: 83754 - DNA, 601 bp, Human; identical to SEQ ID NO: 21836

SEQ ID NO: 83755 - DNA, 601 bp, Human; identical to SEQ ID NO: 21837

SEQ ID NO: 83756 - DNA, 601 bp, Human; identical to SEQ ID NO: 21838

SEQ ID NO: 83757 - DNA, 601 bp, Human; identical to SEQ ID NO: 21839

SEQ ID NO: 83758 - DNA, 601 bp, Human; identical to SEQ ID NO: 21840

SEQ ID NO: 83759 - DNA, 601 bp, Human; identical to SEQ ID NO: 21841

SEQ ID NO: 83760 - DNA, 601 bp, Human; identical to SEQ ID NO: 21842

SEQ ID NO: 83761 - DNA, 601 bp, Human; identical to SEQ ID NO: 21843

SEQ ID NO: 83762 - DNA, 601 bp, Human; identical to SEQ ID NO: 21844

SEQ ID NO: 83763 - DNA, 601 bp, Human; identical to SEQ ID NO: 21845

SEQ ID NO: 83764 - DNA, 601 bp, Human; identical to SEQ ID NO: 21846

SEQ ID NO: 83765 - DNA, 601 bp, Human; identical to SEQ ID NO: 21847

SEQ ID NO: 83766 - DNA, 601 bp, Human; identical to SEQ ID NO: 21848

SEQ ID NO: 83767 - DNA, 601 bp, Human; identical to SEQ ID NO: 21849

SEQ ID NO: 83768 - DNA, 601 bp, Human; identical to SEQ ID NO: 21850

SEQ ID NO: 83769 - DNA, 601 bp, Human; identical to SEQ ID NO: 21851

SEQ ID NO: 83770 - DNA, 601 bp, Human; identical to SEQ ID NO: 21852

SEQ ID NO: 83771 - DNA, 601 bp, Human; identical to SEQ ID NO: 21853

SEQ ID NO: 83772 - DNA, 601 bp, Human; identical to SEQ ID NO: 21854

SEQ ID NO: 83773 - DNA, 601 bp, Human; identical to SEQ ID NO: 21855

SEQ ID NO: 83774 - DNA, 601 bp, Human; identical to SEQ ID NO: 21856

SEQ ID NO: 83775 - DNA, 601 bp, Human; identical to SEQ ID NO: 21857

SEQ ID NO: 83776 - DNA, 601 bp, Human; identical to SEQ ID NO: 21858

SEQ ID NO: 83777 - DNA, 601 bp, Human
gattataaaatggcttacattatgttgctaatgaaaatattattgattaatttgacaggtatttatcattggactgattgctgatagaaaatttcagcattttaatcctgttttggaaacttacattaagaaacactttagtgcaacgttagcctacacgtaagttcctactttgttttaaaaccaatacttctttttttggtatttgtgttatttagagtctttttcatgtacttttgtctatgactgtgtatttactcctgctcaaaactctgagtttactggaataatttttagtatygtttccctcttaacatacctaaaaaccttgttgaaagagatatgtgataaatcatcgtaatattctggaataaattcttgttctccctcacaccttccatttatctttgaaatcttcactttatgttcgatgaaactgagctttggatgcggagtgtctgacaccgcggcttcctcgcgagcctttgatgaatggataaatgcatgtgttcccgtgttaaggagattggttgtttagtgtgaattagatgcagttttgtactttgcaatgtatctccttgctctttaaagagcaccttcc

SEQ ID NO: 83778 - DNA, 601 bp, Human
agagatatgtgataaatcatcgtaatattctggaataaattcttgttctccctcacaccttccatttatctttgaaatcttcactttatgttcgatgaaactgagctttggatgcggagtgtctgacaccgcggcttcctcgcgagcctttgatgaatggataaatgcatgtgttcccgtgttaaggagattggttgtttagtgtgaattagatgcagttttgtactttgcaatgtatctccttgctctttaaagagcaccttcccttttctttgacaagcttcagctgtcactgtcttgrattccttctatccacccctctgcccgtctgtgccccagaggtctaggaagacaccagaggctatgcatggtgcctgggccagcttagcagtgtgcctggtattgaagagcagagccctggagtctggagtcaggctgcctgggcttgatgtgcagctctgtccctcacaagctctgtgatcttgggcaagttgcttaacctctctgtacctcagccttcttgtctgtaatcagagcatgattgtaggcttgtgtggaaattttaataagttattacgtgtagagtgcttggactaatccc

SEQ ID NO: 83779 - DNA, 601 bp, Human
attctctgggccaggcgaaattccagtaatattatcccagagtgtccttgtcctcttctcctctagaaggctttggtaggtacaggcttactttagactcttgtccatgtagcctctctcctttggtaaatgttgagatctttagcccttcttcccaacaacaccaagagaaggaatgaaagattttggcaatggggagtcctcttccgcacctcgagctgtgtctgcggctcccctgcgtgggtagttcatggatgctggagccccactggactgaccagcactggtacaagtgagaatkaagggaggcatcggctttgggggctgctcttccataaaaccagcatgactgggctcctttttgtccaccctatggagctgctgcaggctcctcactggcaactgatgctccatctgctccgccccctctagccagtgccaaggggttgctttttgtgcaggtataagatggcctggcagatttatttttatttattttctttttgctgtctaattccaggttaagattcatttgctggttctaggtccttcttttatttattttctttctttttgctgtctaattccaggttaagataca

SEQ ID NO: 83780 - DNA, 601 bp, Human
ttactggctgcacgcatggtgctagtttttggagagttgcagtgcagctcagtacattaaaaaatgaccgtgtgttgttgttaattcagttgttcttttattatgtgtaagctattgcttgagggtcatccttatgaacaaggattattatttgatgagtcagtaatggttgaaagtgtagaagtgtggatagaattaaaaatggcagatcctcactactgcctctatcatttaaaaataacacatgctcaacggataaaaaatagtaaagaaatctcacattactcaaatgttatagtgyagacgataaaagttcccttgtatgtaatgctacatattggagatatctactgtgccagcatttattttctatgtttatattaacattgttattaagattatgactaatatgtctgcatattttacaaaacagcattgttatttttgcttgcttaaaatttaaaaacttaaaaattgttataatttgcatacaacaaaatgctcattttaattttgtttggacggtttttgtatgcccttggaactactgcccaaaacaagacataagacattgccattccccacaaacatccctcttggc

SEQ ID NO: 83781 - DNA, 601 bp, Human
cttgagggtcatccttatgaacaaggattattatttgatgagtcagtaatggttgaaagtgtagaagtgtggatagaattaaaaatggcagatcctcactactgcctctatcatttaaaaataacacatgctcaacggataaaaaatagtaaagaaatctcacattactcaaatgttatagtgcagacgataaaagttcccttgtatgtaatgctacatattggagatatctactgtgccagcatttattttctatgtttatattaacattgttattaagattatgactaatatgtctgcrtattttacaaaacagcattgttatttttgcttgcttaaaatttaaaaacttaaaaattgttataatttgcatacaacaaaatgctcattttaattttgtttggacggtttttgtatgcccttggaactactgcccaaaacaagacataagacattgccattccccacaaacatccctcttggcctatctgagcccatcccactcccagacaagcagccactctgtggtttctgttaggaatgtgttttgcctgttcttaaactttacaccagtggggtcatgcactctttttgtatctgg

SEQ ID NO: 83782 - DNA, 601 bp, Human; identical to SEQ ID NO: 21859

SEQ ID NO: 83783 - DNA, 601 bp, Human; identical to SEQ ID NO: 21860

SEQ ID NO: 83784 - DNA, 601 bp, Human; identical to SEQ ID NO: 21861

SEQ ID NO: 83785 - DNA, 601 bp, Human; identical to SEQ ID NO: 21862

SEQ ID NO: 83786 - DNA, 601 bp, Human; identical to SEQ ID NO: 21863

SEQ ID NO: 83787 - DNA, 601 bp, Human; identical to SEQ ID NO: 21864

SEQ ID NO: 83788 - DNA, 601 bp, Human; identical to SEQ ID NO: 21865

SEQ ID NO: 83789 - DNA, 601 bp, Human; identical to SEQ ID NO: 21866

SEQ ID NO: 83790 - DNA, 601 bp, Human; identical to SEQ ID NO: 21867

SEQ ID NO: 83791 - DNA, 601 bp, Human; identical to SEQ ID NO: 21868

SEQ ID NO: 83792 - DNA, 601 bp, Human; identical to SEQ ID NO: 21869

SEQ ID NO: 83793 - DNA, 601 bp, Human; identical to SEQ ID NO: 21870

SEQ ID NO: 83794 - DNA, 601 bp, Human; identical to SEQ ID NO: 21871

SEQ ID NO: 83795 - DNA, 601 bp, Human; identical to SEQ ID NO: 21872

SEQ ID NO: 83796 - DNA, 601 bp, Human; identical to SEQ ID NO: 21873

SEQ ID NO: 83797 - DNA, 601 bp, Human
tcaatgacatgatgagcagcatgtcagaccagaccgtccgggtgaaggtgagtgccggccactgccaaggcagacttctccttctttttttctttcattatctcttttggaggtaggtattttgattacagttaattaacttgccccaaataccatagttgttaatgtcagagatctcaatttgatttcaagagctgtgctttttttttttttttttttttttttgagacagaatcctgctctgttgcccatgctggagtgcagtggtgtgatctcagctcactgcaacctctgcctcccrgcttgaagcaattctcctgtctcagcctcccgaattgctgggactacaggcgcatgccaccatgcctggcaaatttttttgtatttttagtagagatggggtttcaccatattggtcaggctggtctccaattcctgacctcaggtgacccacccacctcagcctcccaaagtgctgggattataggcgtgagccactgtgcccggcctttttttaattttaattttatttttagatgacacataaaaactgtacatatttatgggacatacgctgatatttcagtacaggtatacgatg

SEQ ID NO: 83798 - DNA, 601 bp, Human
gagaatcatgttttacacctaatttctcagggtgtccatgccctggaaagggtggtgaaccttcatgcttcagtggatctttgcctgtgcagaagagcgagccttccagtgcccctgtccttctgtccttcttccctcttttgatgacctggtctcaccctgttgtcctttggaagaaagatcccttccactcacatgaggcctgagtgttctttaggatgctcactggtgtggaagtgcctgggaggcccatggagcagccgcaggacccccacactcttggttatcctagttatggcgrttttcactgggctgacttattgcagaaggagctgtacaacttgcaatttgctgcctgcactaattccttcaaagaacaagaatcttccaaatgattagcttacatctttcactcgactgatcatggtagacgcctctgttcttcctcttttaatgtttgtttaacgtataattttagaaggcattcttatggctagtgtcttaaaaatattttggtcaagtcgcttcccagccttaaagctttgccatatgccctggaacaaagatgtatgtgtgctgagacgtggctgatggttgctgt

SEQ ID NO: 83799 - DNA, 601 bp, Human
agtgactagggaccgggaagaccgtgcttcagtgggtgttttattataagacacaagtgaattgagtgacgtgtgtgcattgatgcaaaccttacatctgcaagacagacgcacggcgttttattaggcatgtcacctcccttctggtaattggtatcgtattatttcacaataggtgctttctcgatgacgttggaaatttaaagattcccatcgtgggagcctgacttttgtgttgttttaactctttcagttttgctgtgtctaaatggaaggaaataccttgtgaaccatcttccayagacaaagtatattttcagactgtgacatttaaaggttaaacattgtttccccaagtgtggccctcgttggtaccaaacggttggtaccttcccggttcaagtgattctcctgcctcatcctcccagtagttgggattacaggcacccgccagcatgcctggctaatttttttgaatttttagcagagaaaggctccatccccttcttggtaccaaacctgccactggcatcaactttgcggattagagtcagccacggggttttacgcctcattgaagagggagggcaggaggaacttc

SEQ ID NO: 83800 - DNA, 601 bp, Human
gagggagggcaggaggaacttcagaagtcatttattgcaggataagcatggtctccagctagaattttcaacaggactgttttcattgatttagtgacaaaatttttccaaggtcatttaagtgagaaaacacaaatggaggacgcgtgggccagtttttatgttaagtcaaatgtccaggaaactccactgagtgtgtggatgctgcctgccttcactccccttcccagcggccgtctcccgtcacccccgctccccaggcgcccgccgtgcccagatgtttcagtaccgcctcaccgtccctcagtgaatggccctcagccctggggctgcagccaaatactttttgaaaacatactgccgtggccaaataacatgaaattccccatttctaagtgtcccgttcagtggcattaagtacagtcacactgttgtgcaaccatcatcaccatccctctttagaacttttacgtctttccaaactgaatggaactccagccccatcaaacaccaactccctgcagcccctggcagccaccggtccactttctgggtctaagaatttaatggctctgggaacctcatggaagtggactcatac

SEQ ID NO: 83801 - DNA, 601 bp, Human
ctcagtgaatggccctcagccctggggctgcagccaaatactttttgaaaacatactgccgtggccaaataacatgaaattccccatttctaagtgtcccgttcagtggcattaagtacagtcacactgttgtgcaaccatcatcaccatccctctttagaacttttacgtctttccaaactgaatggaactccagccccatcaaacaccaactccctgcagcccctggcagccaccggtccactttctgggtctaagaatttaatggctctgggaacctcatggaagtggactcataccrcatttgtccttttgtgtctggctttttttcttttttttgagacggagactcgctcagtctcccatgctggagggcagtggcacagtctcggctcacagcaacctctgccttcccggttcaagtgattctcctgcctcatcctcccagcagctgggattacaggcacctgccaccatgcccggctaatttttttgaatttttagtagagacggggtttcaccatgttagccaggctggtctcgaacacctgacctcaaataattcacccgcctcggcctcccaaagtgctgggattacagg

SEQ ID NO: 83802 - DNA, 601 bp, Human
gctgtgtgtctcgtgcacattttgcctccgcacctgtccctggatagaggctcggcctgttcccacctcatggtggttgtggttcatgctgctgggaactggggtgtacaggtgcctcttgaagaccctgctgccagtgctccagaagtggaattgctgtttctcgtggtaattatgcttgaattttttgaagaatcatcctgtttttcccagcaccccaccatgctaccgaaacctcacttgaaattccatattgactttccctcagcagccctttccgcagctcctccagctccaggcrtatcctctgccgcacatcacctaccttgagtgaatgatgcggctccgactgctgcattgaaaaggcctggggtcagaggcggaggttgcagtgagccgagatcgcgccattgcactccagcctgggcaacaagagcaaaactccatctcgaaaaaaaatgataaaagaaaagacctggggtctctcggtatcacctcttcctgtctgttttcctctgaagaggagaagcccacctgctgtgcagtgctgaccgtccccctccctgagacccgctccacccctagctgtttcctcaccatc

SEQ ID NO: 83803 - DNA, 601 bp, Human
tcgtggtaattatgcttgaattttttgaagaatcatcctgtttttcccagcaccccaccatgctaccgaaacctcacttgaaattccatattgactttccctcagcagccctttccgcagctcctccagctccaggcatatcctctgccgcacatcacctaccttgagtgaatgatgcggctccgactgctgcattgaaaaggcctggggtcagaggcggaggttgcagtgagccgagatcgcgccattgcactccagcctgggcaacaagagcaaaactccatctcgaaaaaaaatgatraaagaaaagacctggggtctctcggtatcacctcttcctgtctgttttcctctgaagaggagaagcccacctgctgtgcagtgctgaccgtccccctccctgagacccgctccacccctagctgtttcctcaccatctcagatcttctgtcttcaccttgagctgccccttcacccggcccagatgttctggaaattcaacccgtgccttctggattcttctttgccctcggcgtttctctctcctacctgacaagagggtccttggccccattgcctctgccctctagtcgtgttctgt

SEQ ID NO: 83804 - DNA, 601 bp, Human
cctctgaagaggagaagcccacctgctgtgcagtgctgaccgtccccctccctgagacccgctccacccctagctgtttcctcaccatctcagatcttctgtcttcaccttgagctgccccttcacccggcccagatgttctggaaattcaacccgtgccttctggattcttctttgccctcggcgtttctctctcctacctgacaagagggtccttggccccattgcctctgccctctagtcgtgttctgtgttctgccccaagagattgtggctgctgttcctcccaggtgcccccgcygcccccagctgcggtgtctccagtcagcctcggaattcccttctgctgtcttctcttctctgtgctactgtgactgtggtttcatgaaccactgggcttgctaggtccccagttcttcgtcttgaaattagggcagaaaagtcttggaaccgtttcctgcatgctgatgctggacctgccccttttttcctcggcatctcttttggtgttttcctgaaactcccatctggtgatgacttgctgtttctcagaaaactgtgctgttcttcagctgccaggagaaatgggtcagattccagt

SEQ ID NO: 83805 - DNA, 601 bp, Human
ccttcacccggcccagatgttctggaaattcaacccgtgccttctggattcttctttgccctcggcgtttctctctcctacctgacaagagggtccttggccccattgcctctgccctctagtcgtgttctgtgttctgccccaagagattgtggctgctgttcctcccaggtgcccccgccgcccccagctgcggtgtctccagtcagcctcggaattcccttctgctgtcttctcttctctgtgctactgtgactgtggtttcatgaaccactgggcttgctaggtccccagttcttcktcttgaaattagggcagaaaagtcttggaaccgtttcctgcatgctgatgctggacctgccccttttttcctcggcatctcttttggtgttttcctgaaactcccatctggtgatgacttgctgtttctcagaaaactgtgctgttcttcagctgccaggagaaatgggtcagattccagtgtgtgacatccagacagcttcataggcagcccacctggctctccaagcctttttccctcgtggagacccaagtagaaccagtgcgttccccaggaaacaccaaacatctgggtgtgagg

SEQ ID NO: 83806 - DNA, 601 bp, Human
ccctggttggctagttccagaaccactctctttcccatttggctcctagagacagtgttgctaagtcctggctatcccgtggtgtttggaaacagggcccatgcctgccatccacatcaatggagaacaggctggatgctttgggctggaaagatgccgacattatccctggtggagctttccatcgaagtggacatgcataaagcaacttaaaaactctggtgaaatgccacaagaattgggtgagtgtgaaggggagggaggagagttagaaggggctggtcacgaaggcttgtgggargagaccttggcgatggccccactgtgttggcagcaggtggctgtatcttggccactcgtggattgcagtgctggattgaggcgtttggggctttgcagtcagttcttacaggcattgacatcatttcaagtccacaaatgttactaccttcccttaggatgaccctgggaaaagactactgcatgcaggaccttggcatagtctgttccatctggggctgagaatgccagaattttctatagaaggaaactttgaccatgatccacagtaggaaattgatgcttacttggtatatgtgtg

SEQ ID NO: 83807 - DNA, 601 bp, Human
agcaacttaaaaactctggtgaaatgccacaagaattgggtgagtgtgaaggggagggaggagagttagaaggggctggtcacgaaggcttgtgggaggagaccttggcgatggccccactgtgttggcagcaggtggctgtatcttggccactcgtggattgcagtgctggattgaggcgtttggggctttgcagtcagttcttacaggcattgacatcatttcaagtccacaaatgttactaccttcccttaggatgaccctgggaaaagactactgcatgcaggaccttggcatagtctgttccatctggggctgagaatgccagaattttctatagaaggaaactttgaccatgatccacagtaggaaattgatgcttacttggtatatgtgtgtgagtgtgtctgtgtgcattgtatgtgtgtgtgtgtatgtgtgcgtgtgtgttgtgcatatgaagctggaaaatgctcatgaagaagttctacactgattccctgtgatgcattctggcattttctagtctagtctcctttagtctattctagactaatgtatttcagttaaaaaaaaattgctggttgacaggcactaaatt

SEQ ID NO: 83808 - DNA, 601 bp, Human
tttttacagtgatgagctctttttgcttatttagcattatcctatatatatacacacacatatgtatacacccacacctatatatacacacatataaatgtaacatatgtatagtataaattctcatgtgtatacacacacacacacacttttacagtgttgcatttttctgtatatatctacctgtgtccttcagtatttttcaagcacacattttgaaaggttacacattgcctcatggctgtatgataacttacttaaccagttttccatttgagggcacatagctggtttctagttktcagttttcatgaacagtgcttggctgacctctctgtctatggcaaaggccttgctccatctggtttgctctgaggcatccagattttcaaatgctctaaagtccgatgaaagtcatgatcaaggcgattagggcttgattcctgggtgatgactctgtgcttctttcattggcgccgtgtgtctgccctgccttggtttccactagagctcccgtctgtttcttttccacttccttctatgcttcttgtcattgggctatgcagctgccatggtggatgagtcgggagccacttccctc

SEQ ID NO: 83809 - DNA, 601 bp, Human
tcaaggcgattagggcttgattcctgggtgatgactctgtgcttctttcattggcgccgtgtgtctgccctgccttggtttccactagagctcccgtctgtttcttttccacttccttctatgcttcttgtcattgggctatgcagctgccatggtggatgagtcgggagccacttccctctctcagaagccacctgcttctgtgacctttgtgtttcttggtacaggattgttggccaagttaggtaaggagacgagaactccggtgcgttccactccctctgacctgacgaatcagggyctggagcaaaccaaccaatgagatgttggcaccgtcatagaccagcaagcagcttaaagaaatttgggagtattttgagtcagaagggtttcccaagagcaagtaataaaatattttcaccttcttgattttgagtggaggagggggtgcactgatggtgttaattgatctgaggatgtcatgggcatgagtcaggagtctatttgagagtctctcatcattcgtggggacacagatgcggtggtttggatgaggaccgtctaggtcacattgtctgtatggagacagacttgttgaatt

SEQ ID NO: 83810 - DNA, 601 bp, Human
gagtggaggagggggtgcactgatggtgttaattgatctgaggatgtcatgggcatgagtcaggagtctatttgagagtctctcatcattcgtggggacacagatgcggtggtttggatgaggaccgtctaggtcacattgtctgtatggagacagacttgttgaattagaatattgggcagctgaggctggcaactcaggtgaagccaaccatgacaggaaggactacacttgttgagaatcagcaacaggccaggccttctggagagttctcctgcaacaaagagaagagagggaggtsccagagtcgaggaggtgagtaggccaagtttggaagttgctctaacaaaatactacaaacttggtagcttaaaacagtggtttttttcttctctcagagccttggagattagaaacttgaaatcagggtggcggcagggcaggttccttttggctgctccaagagatgatgtgttctgtgcctttctctaggtttctggtgatccttggtatttcctgacttgcagatgccttgctccagtctctgcccccgtcttcacgcagcactctccctgtgtgtctgtctttgtgtctcttctct

SEQ ID NO: 83811 - DNA, 601 bp, Human
gccaggccttctggagagttctcctgcaacaaagagaagagagggaggtcccagagtcgaggaggtgagtaggccaagtttggaagttgctctaacaaaatactacaaacttggtagcttaaaacagtggtttttttcttctctcagagccttggagattagaaacttgaaatcagggtggcggcagggcaggttccttttggctgctccaagagatgatgtgttctgtgcctttctctaggtttctggtgatccttggtatttcctgacttgcagatgccttgctccagtctctgccccygtcttcacgcagcactctccctgtgtgtctgtctttgtgtctcttctcttcttatgaggttgttaaattcagggccaactctactgtggcgtggcctcaggtcaacttgattatatctgaaaaaagactgtttccaaaacattcacaggtcccaagggttggaacttgaatttagcccttttttttttttttttttttttgagatggagtctcgccctgtcacccaggctggagagcagtggtgtgatctcggctcactgcaacctccacctcccgggttcaaacgattctcctgcctca

SEQ ID NO: 83812 - DNA, 601 bp, Human
aagagaagagagggaggtcccagagtcgaggaggtgagtaggccaagtttggaagttgctctaacaaaatactacaaacttggtagcttaaaacagtggtttttttcttctctcagagccttggagattagaaacttgaaatcagggtggcggcagggcaggttccttttggctgctccaagagatgatgtgttctgtgcctttctctaggtttctggtgatccttggtatttcctgacttgcagatgccttgctccagtctctgcccccgtcttcacgcagcactctccctgtgtgtctstctttgtgtctcttctcttcttatgaggttgttaaattcagggccaactctactgtggcgtggcctcaggtcaacttgattatatctgaaaaaagactgtttccaaaacattcacaggtcccaagggttggaacttgaatttagcccttttttttttttttttttttttgagatggagtctcgccctgtcacccaggctggagagcagtggtgtgatctcggctcactgcaacctccacctcccgggttcaaacgattctcctgcctcagcctcccgagtagctgggattataggcaccc

SEQ ID NO: 83813 - DNA, 601 bp, Human
ttttgtatttttagtagagacagggtttcaccacatttgccaggccggtctcgaactcctgaccttgtgatctgcccgcctcggcctcccaaagtgctgggattataggtgtgacccactgcacctggcctgaacgtaaccttttgaaggacacagtttcacccacggtagacgtcatcgtggacgtcagtgtagagttcactggcaggtcagtggtgaacaaaggactggagaggaagtgggtccttagccaggcacccacagtcagtttgacatgggagctgcaggactggaaacttcwtagaatctagtgtgcacatgagtcacctggaggtcttgttaaaatgtgattccgactctgtagggagggggcctcaagatgtttcattataatcaactcccagctgatgctaaggttgtgggtccctggccatatattgagtcagaagtggccacgcctcgccttgcacagacagctgctgtgtgagcagtagtgtttgtgggtagggcacctggtctcagttcttgcagccttcaaggctggcttcattcaggctgcctgccctcagctgtctgacgttctggactattttgatttgat

SEQ ID NO: 83814 - DNA, 601 bp, Human
ccacatttgccaggccggtctcgaactcctgaccttgtgatctgcccgcctcggcctcccaaagtgctgggattataggtgtgacccactgcacctggcctgaacgtaaccttttgaaggacacagtttcacccacggtagacgtcatcgtggacgtcagtgtagagttcactggcaggtcagtggtgaacaaaggactggagaggaagtgggtccttagccaggcacccacagtcagtttgacatgggagctgcaggactggaaacttcttagaatctagtgtgcacatgagtcacctgraggtcttgttaaaatgtgattccgactctgtagggagggggcctcaagatgtttcattataatcaactcccagctgatgctaaggttgtgggtccctggccatatattgagtcagaagtggccacgcctcgccttgcacagacagctgctgtgtgagcagtagtgtttgtgggtagggcacctggtctcagttcttgcagccttcaaggctggcttcattcaggctgcctgccctcagctgtctgacgttctggactattttgatttgataagtttgccctacacacagatgatgacaca

SEQ ID NO: 83815 - DNA, 601 bp, Human
caaaaaaaaaaaaaaaaaaaaaaaaaaaaaaggagagttgttatgtctgggaaattaggtggccatcaagttttttcatggtttttgtttcattgattgattgattgatttgattgacgtactgagaccgagtctcactgtcacttacgctgtagtgcagtggtgcaatcttggctcactgtagccttgacctcctgggctcaagtgacccttccgcctcagcttccaaagtagctgggactataggccagcaccaccacagatggctaatttttgtaatttttgtagagatatggtttcrtcatatattagtctattttcacactgctataaagaactacctgagactgggtaatttataaagaaaagaggtttacttgactcacagttccacaggtttaacggaagcatgattaggagacctcaggaaacttacagtcatggaggaagacgaaggggaagcaaggaccttcttcacatggcggcaggagagagagcggagggggaagtgacacacactttaaaccatcagatctcatgagaactcactgtcatgagaacggcaagggggaggtctgcccccgtgatttagtcacttccc

SEQ ID NO: 83816 - DNA, 601 bp, Human
aaagaggtttacttgactcacagttccacaggtttaacggaagcatgattaggagacctcaggaaacttacagtcatggaggaagacgaaggggaagcaaggaccttcttcacatggcggcaggagagagagcggagggggaagtgacacacactttaaaccatcagatctcatgagaactcactgtcatgagaacggcaagggggaggtctgcccccgtgatttagtcacttcccaccatgccgctcacccgacacgtggggattacaatttgagatgagatttgggtggggacacagarccaaaccatatcactccatgttgcccaggctgagtgctagattcctgtgtgttattttagggcactttatacttttattatttaccagtgtttgagaagtttatgatggttcacaaaactttctcttcctacgtgggtcttatgtgtgtttttgagtgagctgatgatacactcgtggccagcactgttctgtgctgtgtttctccacccagtgtgtggacatcttgctatgtgcacaggtaatatgtccttcttacacagaggggtgcaaaggttgagtcaaatcagcatccaaggagt

SEQ ID NO: 83817 - DNA, 601 bp, Human
gccccagggagtggtgagggttcctgcagcatatgcagctgcatcccccaccccagcaccctgatttctcctcactgctcagctcctctggaatccttgccttcccacctcattggtggagctgctccattgaaacccaagactccattccaggcctggcctcagccccatctctgcccagggctgacaggggggctccgtcatctaccccagggcctgtgccttccttcttcctcctggtggcatttccatgttgggggcccctgcttgtccctggggtgcaggaattcttaagcacctytggcattttgctcctgccttcttgcctggagtttcactgctgtctgcaggcctttgagaacagaggcagggaggtgccagaagcccttgagagtgtggtgattaggggttggatgccctgtgcgaatggcaaggaggatgattcttgaaagaaaatgtcagggtaacttaaatttctctgaggtcagcttgcttgttgttaattaagttcttactacgagggccgagcgcggtggcttatgcctgtaatcgcagcactttgggaggctgaggtgggtggatcacttgaggtcaggagttt

SEQ ID NO: 83818 - DNA, 601 bp, Human
tggaatctgaacctcttgatcccatttgcctcagcaactctgactccttcagactgaaactttctatcccacagtattttcttgtttccatcaagaaaggaagagatttaaactctgttctgcaattctgtctgcatttcctctctggaatccttctctctctccaaacaaagtggttacctctttaaaataggcagtgaacatcaaggaaaaccttgcataggctgaaaagggcaaagtgctcacctttgcttgcattgggaagtaatttcttttaagtgtgcatagagacagactaataaaaaaatctgttgagtgtgtcatgtggcagtcagtctttagaagtgttgttcctttgtcttttaatcattctcagaattagcacaccagttgtgtgatatgtaaaagtctattcctggcagggtgaggtggctcatgcttataatcccagcactttgggaggccgaggagggcggatcacctgaggtcaggagttcgagatcagcctgaccaatgtggtgaaaccctttctcttctaaaaatacaaaaattagctgggcgtgtaggtgcatgcctgtaatcccagctactcgggaggctg

SEQ ID NO: 83819 - DNA, 601 bp, Human
tgcctgtaatcccagctactcgggaggctgaggcaggagaattgcttgaagctgggaagcggaggttgcagtgagccaacattgcgccactgcactccagcctgggcgacaagaatgaaactctgtcccaataaaaaataaataaataaatcttttccctagctcatttttttttgactgtgttaaattcagtggagcaaggtctcatttatatcctccttattcataatttggggtaattagcatagtggttgggctgccattcacctcttacagctaggaaaatgaggctttgcgagasgaatgcaaaaatataaacaggattaagtcattgatggcatgctcatacttcctaggagaattaagtcttttcaggtaccacagtatgtatgagtccttcttaactctcatttccaccagatctccaccaaggagtttagaactgatggactccaagtctccctctggatgagacattctgagttcttgccaatatcatgctaagctgggttgataatttcctttgaaaaatttcctttgaaaatgagtagcatttcatcttttggaaatttatcattcttcagacttttcactgacctgt

SEQ ID NO: 83820 - DNA, 601 bp, Human
taaacaggattaagtcattgatggcatgctcatacttcctaggagaattaagtcttttcaggtaccacagtatgtatgagtccttcttaactctcatttccaccagatctccaccaaggagtttagaactgatggactccaagtctccctctggatgagacattctgagttcttgccaatatcatgctaagctgggttgataatttcctttgaaaaatttcctttgaaaatgagtagcatttcatcttttggaaatttatcattcttcagacttttcactgacctgtcccctcccatagcygaccccctcctgtaccccagggtttgattgatatttgcttttgtattgtaattactatttaatatccagccctcctgaggtttgcttcactgcagtcacattgtattgcaagcagaaaatgtcacgtcgcctggagctgttggggtagtgtggttgtggtcctttgggtatttcctggcacacctggctcatgacatcgtgcagagctgaacaggctctaggaggaggaaggaaaccttgcctgggtacttaaaattatctatcacagtggatcctgagtctgcctctcagcctgtcttg

SEQ ID NO: 83821 - DNA, 601 bp, Human
tcagagactgtaagacccatccattttatttccttttattagaagatagaacgattttcttagatgagcagttatcagctgatgttcaccttcttggaggaagggactgctggcggttttacttcaaatgcagccatttgaagtatctgatttggaacattccatacctggtgcagaggccacttgtttctacaggtttgtcctggtggtctgtcctctgtgccattgaactcccagagtcctctgcagaggacatgtaataattcttgcctattaatttgtggaccctgtatgtggggctttttttttttttgcctgtttgagacttcctgcctttaggagtagacaatgacctttcatacgtttaatgcttctgttgttctcaagtttgagaatgtggtgtgtcccctgggtcccctccttacatgaaatccaacccaaagggtcagtgtgtttcttgtgtgtttctgtcttcactcctctgtccgctttcatctctttcctggtgagtctctgccctgtcataagcaaataaccttagttgtttcctccccagtaatggtggcttcaattgctgtggatttcctggcctgatttcaag

SEQ ID NO: 83822 - DNA, 601 bp, Human
cttagactgggtcatgtataaagaaaaagaggcttaatttaagggactcacagttccacatggctggggaggcctcacaatcatggcggaaggtgaaggagtagccaaggcatgtcttacatggcggcaggcaagagagcgtgtgcaggagaactgccctttataaaaccgtcagatcacatgagacttattcactatcatactgtcatgagaacagcatgggaaaaacccatccccatgattcagttacctcccaccgagtccctcccacaatacatggggatgatgggagctacaattmaagatgcaatttgggtggggagacagcccaaaccatatcagggttgcagaggcttatgtgggaggatcaagagtgacagcaactgtctggctggaggggaaggagacagaacctgtccctgggccttcgtctcctttccccgtgccccacacctagccctggggagcccgattccctcctcacactcccttggctcccttcttgtctctgtacacagccccaagcacaaaacgactgctcattttcctggccatgctgtgctttgctgtctccatgtctttgtgagcagggatctttctc

SEQ ID NO: 83823 - DNA, 601 bp, Human
tgtgcaggagaactgccctttataaaaccgtcagatcacatgagacttattcactatcatactgtcatgagaacagcatgggaaaaacccatccccatgattcagttacctcccaccgagtccctcccacaatacatggggatgatgggagctacaattaaagatgcaatttgggtggggagacagcccaaaccatatcagggttgcagaggcttatgtgggaggatcaagagtgacagcaactgtctggctggaggggaaggagacagaacctgtccctgggccttcgtctcctttcccygtgccccacacctagccctggggagcccgattccctcctcacactcccttggctcccttcttgtctctgtacacagccccaagcacaaaacgactgctcattttcctggccatgctgtgctttgctgtctccatgtctttgtgagcagggatctttctccttggaaggcctgttctcttcctgtcttccaggacatctgcctgtcagcagtcagccttctatatccactgcagaggccatttgtttctgcagatttgtcctggtggcctgtcctctgtgccattggactcccagagtcct

SEQ ID NO: 83824 - DNA, 601 bp, Human
acatggggatgatgggagctacaattaaagatgcaatttgggtggggagacagcccaaaccatatcagggttgcagaggcttatgtgggaggatcaagagtgacagcaactgtctggctggaggggaaggagacagaacctgtccctgggccttcgtctcctttccccgtgccccacacctagccctggggagcccgattccctcctcacactcccttggctcccttcttgtctctgtacacagccccaagcacaaaacgactgctcattttcctggccatgctgtgctttgctgtctccrtgtctttgtgagcagggatctttctccttggaaggcctgttctcttcctgtcttccaggacatctgcctgtcagcagtcagccttctatatccactgcagaggccatttgtttctgcagatttgtcctggtggcctgtcctctgtgccattggactcccagagtcctctgcaaaggacaccatgttttcattaaacacatagaggaggcatgttggcaaatgtcatttgcagatctgtcttctctagcagggcaatgctcttggccattgaacattttgcctggcatgccacaggttcca

SEQ ID NO: 83825 - DNA, 601 bp, Human
ttgatgattaaagaattgttatttttttacctcctttatccttaaatccttcacccataatctcctgtttataattgcaggtgtctaatgattcataattagttaattcttggttggtgagtgattgtttcatattgcaattaggaagatcatgcataaagccatttctagttaaatgtgtgtatgttctttaccaggcttgtgttcaagagttctgtagttaccacgttatagtaatctctgaccttatttttgttaagcaaagacatctggttcaaagaccctctctcaccagcaagcrgttctcattcaatctaagcatgttgaaaaaggccctttccctaaatgggcttgggagcaatactggggtcgtggctgtcctcagggtgtctgagcgcttctttggtagtctgcaggggaaaataccaacactggtaatgccccattcagatgcagtattctgtccaacaaggcacaattgcctgcctgggaataggaggctgagataccattgattgtttcctatgtcacttgtcaagtggaacacaacacaagtgaatgtctgcacaaaatgtactttgctatacctttctaacgggtt

SEQ ID NO: 83826 - DNA, 601 bp, Human
agttaaatgtgtgtatgttctttaccaggcttgtgttcaagagttctgtagttaccacgttatagtaatctctgaccttatttttgttaagcaaagacatctggttcaaagaccctctctcaccagcaagcggttctcattcaatctaagcatgttgaaaaaggccctttccctaaatgggcttgggagcaatactggggtcgtggctgtcctcagggtgtctgagcgcttctttggtagtctgcaggggaaaataccaacactggtaatgccccattcagatgcagtattctgtccaacraggcacaattgcctgcctgggaataggaggctgagataccattgattgtttcctatgtcacttgtcaagtggaacacaacacaagtgaatgtctgcacaaaatgtactttgctatacctttctaacgggtttacatgagggaatggagctcaaacttcacaggatattctatgcagagtaggtcttaccctagggatgctcctgctgctctcactccacctgtcctccacccaccaaggcacagagactccagcaaatgtgaggaagagggtggggattggttgatgggcagagctggct

SEQ ID NO: 83827 - DNA, 601 bp, Human
aatctaagcatgttgaaaaaggccctttccctaaatgggcttgggagcaatactggggtcgtggctgtcctcagggtgtctgagcgcttctttggtagtctgcaggggaaaataccaacactggtaatgccccattcagatgcagtattctgtccaacaaggcacaattgcctgcctgggaataggaggctgagataccattgattgtttcctatgtcacttgtcaagtggaacacaacacaagtgaatgtctgcacaaaatgtactttgctatacctttctaacgggtttacatgagggratggagctcaaacttcacaggatattctatgcagagtaggtcttaccctagggatgctcctgctgctctcactccacctgtcctccacccaccaaggcacagagactccagcaaatgtgaggaagagggtggggattggttgatgggcagagctggctctgtgaaagggggttaatctgaggcatcttacctcctgaagacttgggtgatgggagggagatgtttctggagcccagggcagctactgtggcattgagaccaccttagcctgggttggcatggaagactggaaatcttgcc

SEQ ID NO: 83828 - DNA, 601 bp, Human
agggtgtctgagcgcttctttggtagtctgcaggggaaaataccaacactggtaatgccccattcagatgcagtattctgtccaacaaggcacaattgcctgcctgggaataggaggctgagataccattgattgtttcctatgtcacttgtcaagtggaacacaacacaagtgaatgtctgcacaaaatgtactttgctatacctttctaacgggtttacatgagggaatggagctcaaacttcacaggatattctatgcagagtaggtcttaccctagggatgctcctgctgctctcaytccacctgtcctccacccaccaaggcacagagactccagcaaatgtgaggaagagggtggggattggttgatgggcagagctggctctgtgaaagggggttaatctgaggcatcttacctcctgaagacttgggtgatgggagggagatgtttctggagcccagggcagctactgtggcattgagaccaccttagcctgggttggcatggaagactggaaatcttgcctttattcctgtcttgttcgttgtcctctgattgaatctctgcgttttagcccattgtcttcccaaagcttga

SEQ ID NO: 83829 - DNA, 601 bp, Human
acttgggtgatgggagggagatgtttctggagcccagggcagctactgtggcattgagaccaccttagcctgggttggcatggaagactggaaatcttgcctttattcctgtcttgttcgttgtcctctgattgaatctctgcgttttagcccattgtcttcccaaagcttgattctcacctcttcctctcaactcctggcctctgtaataatggagaagccttgggcctggaatttggaggggaagaaagggaggttaagaatccttatctttttgctttcttcattatgtggcttcctygatctttttgtacaacagtaagcaggcttttatgaactagtagatattaaaaaccacatcagtgccaactaaacaaattatatccaccagatacttttgagccctctggtgtgtgccaggcaatattctaggcatggagctctatcagtgggcagggggtacaggtggcagtaatatacagctgaccttatgttctcatcatggcaaagagacagtagagaattgcattatccatcagttagggataaaacaacaaatacccactgctgtttattatctctgtcctcttatttaagaaag

SEQ ID NO: 83830 - DNA, 601 bp, Human
tcttgttcgttgtcctctgattgaatctctgcgttttagcccattgtcttcccaaagcttgattctcacctcttcctctcaactcctggcctctgtaataatggagaagccttgggcctggaatttggaggggaagaaagggaggttaagaatccttatctttttgctttcttcattatgtggcttcctcgatctttttgtacaacagtaagcaggcttttatgaactagtagatattaaaaaccacatcagtgccaactaaacaaattatatccaccagatacttttgagccctctggtrtgtgccaggcaatattctaggcatggagctctatcagtgggcagggggtacaggtggcagtaatatacagctgaccttatgttctcatcatggcaaagagacagtagagaattgcattatccatcagttagggataaaacaacaaatacccactgctgtttattatctctgtcctcttatttaagaaaggaactcttggccgggcgcggtggctcatgcctgtaatcccagcactttgggaggccgaggcaggcggatcacgaggtcaggagattgagaccatcctggctaacatagtga

SEQ ID NO: 83831 - DNA, 601 bp, Human
tcctcttatttaagaaaggaactcttggccgggcgcggtggctcatgcctgtaatcccagcactttgggaggccgaggcaggcggatcacgaggtcaggagattgagaccatcctggctaacatagtgaaaccccatctctgctgaaaatacagaaattaccagggcatggtggtgggtgcctgtagtctcagctactggggcggctgaggcaggagaattgcttgaacccaggaggcggaggttgcagtgagccgagattgcgccactgcactccagcctggcaacagagtgagaccccrtctaaaaaaaaagaaaaagaaaggaactctttgccttcttagagcaggagggaactgagttcttcatagagaacagatctaaattatagaagccattattattatttttcaccatttttcttattgtatcacagtccagttgtgggacattgtggatcactgcaggctgcacacaggcatttgggaggcatgacttctttctgggtactgtgcctttttaaagcctttggtgattttattcatacttgctttcattcaacaaatgttttccagcaccaactgaaggccagatgctatggg

SEQ ID NO: 83832 - DNA, 601 bp, Human
gggaactgagttcttcatagagaacagatctaaattatagaagccattattattatttttcaccatttttcttattgtatcacagtccagttgtgggacattgtggatcactgcaggctgcacacaggcatttgggaggcatgacttctttctgggtactgtgcctttttaaagcctttggtgattttattcatacttgctttcattcaacaaatgttttccagcaccaactgaaggccagatgctatgggaggtgctggaaaggtattagagcctcatctcttcaggagttcgtgactcsgtgcggggatgcaagagggattcagtgagggagacacaccccccgccccttacagtcctgttctgtgctgctgttggatgaaactgctctgcaggtcttaggaaccagccctggaaaccccacctcccatccccccacccccggtgcaggaagggaacttagtcttcattatgtgaccacccacttatgtagacttcccacatttccccccaaattagtccccaggagctgagtaaccttctctttgagtccttataacatttttatctgaaatgcaaaaacacatttgcttgaaacctc

SEQ ID NO: 83833 - DNA, 601 bp, Human
atcacagtccagttgtgggacattgtggatcactgcaggctgcacacaggcatttgggaggcatgacttctttctgggtactgtgcctttttaaagcctttggtgattttattcatacttgctttcattcaacaaatgttttccagcaccaactgaaggccagatgctatgggaggtgctggaaaggtattagagcctcatctcttcaggagttcgtgactcggtgcggggatgcaagagggattcagtgagggagacacaccccccgccccttacagtcctgttctgtgctgctgttggrtgaaactgctctgcaggtcttaggaaccagccctggaaaccccacctcccatccccccacccccggtgcaggaagggaacttagtcttcattatgtgaccacccacttatgtagacttcccacatttccccccaaattagtccccaggagctgagtaaccttctctttgagtccttataacatttttatctgaaatgcaaaaacacatttgcttgaaacctccatgctagtttggcatgattttagaagttacctggcagaatgaatacaaaagaagcaaagaaatttaacatgaacttg

SEQ ID NO: 83834 - DNA, 601 bp, Human
gggaggcatgacttctttctgggtactgtgcctttttaaagcctttggtgattttattcatacttgctttcattcaacaaatgttttccagcaccaactgaaggccagatgctatgggaggtgctggaaaggtattagagcctcatctcttcaggagttcgtgactcggtgcggggatgcaagagggattcagtgagggagacacaccccccgccccttacagtcctgttctgtgctgctgttggatgaaactgctctgcaggtcttaggaaccagccctggaaaccccacctcccatccscccacccccggtgcaggaagggaacttagtcttcattatgtgaccacccacttatgtagacttcccacatttccccccaaattagtccccaggagctgagtaaccttctctttgagtccttataacatttttatctgaaatgcaaaaacacatttgcttgaaacctccatgctagtttggcatgattttagaagttacctggcagaatgaatacaaaagaagcaaagaaatttaacatgaacttggcattttcttgctggcatgaacataattattggatgtcattataaataaaccttt

SEQ ID NO: 83835 - DNA, 601 bp, Human
tgcaggtcttaggaaccagccctggaaaccccacctcccatccccccacccccggtgcaggaagggaacttagtcttcattatgtgaccacccacttatgtagacttcccacatttccccccaaattagtccccaggagctgagtaaccttctctttgagtccttataacatttttatctgaaatgcaaaaacacatttgcttgaaacctccatgctagtttggcatgattttagaagttacctggcagaatgaatacaaaagaagcaaagaaatttaacatgaacttggcattttcttgytggcatgaacataattattggatgtcattataaataaaccttttaaaagtcactttaaaaatagaataattggctacattgcagagatcatgaaagatcatgaatatgtatataacagttaattaaaaaaaactgctaatattatttaaatgggtgattgtggcttgggaaaaatttttctgtggttcttaaaaagtcccgtgtcttaagcacttcagattgacgtaaaatgatgacgaaaatgggtcttggtgatgatggagacactcacgtcaaagggacatgtaaaaagttagtgta

SEQ ID NO: 83836 - DNA, 601 bp, Human
ttggcatcatttaggaccatttacccgaagtagaaccaaaataatttggtattaattggtcattaaatagataaggaaactttggctacaaatacacatcttggaattacatggggactctcaccctggacttcctttgtcatagctttatttttatacacaattgtattgatcaaattctagaccttacaagctccacagctgaattatttaattctctctgatgatcgtctcaattcattttccaataaatgtaattattttcttgccagcgttcgtatttaattgctaagttttctcygatttgctctaaatcatcttttacaaatgcgtagtgaaaggcagcaggttttctcttctgatggtggcaattataaatgtaattttatttaacttgataaccagttcgctgccaccaagggcctcatatttttctttatcatatgtttgggcacactgtgaaatcatcaaacaccaaaccttttataaattggatgtgcatgcttttgtccttttcgcttattattgtactgtttaccgtcgtcttctgtgacattttctcttgccttcagtcaattttggaagcaggcacattcttctg

SEQ ID NO: 83837 - DNA, 601 bp, Human
tctgccatccttttccctgcccatacacatggagccctggacacggtggcccgcactgcccttgatggagtgccttgtccctggacccctcccgtgactcagctctgctcctgttggccttcttgtcttctgtctctggtcagcctcttttggtctctcctgtggactttgcttcttgcccctgttctctgtgtgtttcttgatgctctttcccatggccactccctggaggcccccacatctggattcagaccccctacccctcgggcctcttgcgcctcctccacctagccccttcctyctttttttccttggcttctcctgtgcacccactttgtttccttccattctgctgttcactccagcctcaatctccactctcagtgacttactgcttccttctcctggggacctcaggaaaacggaggattctgacccccacacctaagataataggaaagagcctccctcccccaggagagggggctgcccctgcccactgcccctggccaagtccaggcttcaggctggctctgcctttccaggccatggatgatgtttgaatgaggccctgggcagggcgtggagatggagtgagccc

SEQ ID NO: 83838 - DNA, 601 bp, Human
gccactccctggaggcccccacatctggattcagaccccctacccctcgggcctcttgcgcctcctccacctagccccttccttctttttttccttggcttctcctgtgcacccactttgtttccttccattctgctgttcactccagcctcaatctccactctcagtgacttactgcttccttctcctggggacctcaggaaaacggaggattctgacccccacacctaagataataggaaagagcctccctcccccaggagagggggctgcccctgcccactgcccctggccaagtccrggcttcaggctggctctgcctttccaggccatggatgatgtttgaatgaggccctgggcagggcgtggagatggagtgagccctcgagtcctgggtggtggatgctcttgtctccaggagagatgctgcccagtgctggcgtgtggacaccgtgccatttagtcttccccaactagcttttcctttggaggagaaaagattgtctgacttgtggcaatacttttagttccataactgtaaacttttctttctcttttttggtggcatttataaaaattccctgtcctacatatctgacca

SEQ ID NO: 83839 - DNA, 601 bp, Human
gtttgttgagacacagctgaaggattgttgaaaagcaactgtagagaagcagcaggagcttgtttaaggggtgggaggtgtgggcggcagttctggacagtgattgctgttcgggacactgggatgcttctcctttctggcttcctgggattttttttcctgggcaggttctattaaaccttgcttaatgaaggcactggcactgatagtggcttgcatttggcaagacatggctgttcctgggtaccaggcagtggcaccggaactcattaagaaggtgactaatttcagggccgtgttracatagactgaggctccatcatggttcccaggtgtttgtcggtcgccgctggagaccattgtgtggatcagtcacatggtctgctgcagtgtgagtgacagacggtgacttgctatcagtatgcaaaggtcacccggtgactattccaagaagtgtcattttccagtggagaatgggactttttttttttcctgttaataatttatttcttaattgcggtaaaatacatataacataaagttaatccttttaaccatcttaacacgaacaattcagtggcatggggtacatttacagtac

SEQ ID NO: 83840 - DNA, 601 bp, Human
gcaggttctattaaaccttgcttaatgaaggcactggcactgatagtggcttgcatttggcaagacatggctgttcctgggtaccaggcagtggcaccggaactcattaagaaggtgactaatttcagggccgtgttaacatagactgaggctccatcatggttcccaggtgtttgtcggtcgccgctggagaccattgtgtggatcagtcacatggtctgctgcagtgtgagtgacagacggtgacttgctatcagtatgcaaaggtcacccggtgactattccaagaagtgtcattttycagtggagaatgggactttttttttttcctgttaataatttatttcttaattgcggtaaaatacatataacataaagttaatccttttaaccatcttaacacgaacaattcagtggcatggggtacatttacagtacatcaccactaggtagttctagatcatttccgtcaccccagaaggaaaccccacagccgttacagtcactctgtttcccccttcacactgcctggcaaccacgaatttgttttctgtctctacgattagcttcttctgcgtatttcatataaatggcactatag

SEQ ID NO: 83841 - DNA, 601 bp, Human
ggctgttcctgggtaccaggcagtggcaccggaactcattaagaaggtgactaatttcagggccgtgttaacatagactgaggctccatcatggttcccaggtgtttgtcggtcgccgctggagaccattgtgtggatcagtcacatggtctgctgcagtgtgagtgacagacggtgacttgctatcagtatgcaaaggtcacccggtgactattccaagaagtgtcattttccagtggagaatgggactttttttttttcctgttaataatttatttcttaattgcggtaaaatacatawaacataaagttaatccttttaaccatcttaacacgaacaattcagtggcatggggtacatttacagtacatcaccactaggtagttctagatcatttccgtcaccccagaaggaaaccccacagccgttacagtcactctgtttcccccttcacactgcctggcaaccacgaatttgttttctgtctctacgattagcttcttctgcgtatttcatataaatggcactatagaatatgtggctttttttggtatatggcttcttttacttagtatattctcagggttcatccatgtgttg

SEQ ID NO: 83842 - DNA, 601 bp, Human
taatccttttaaccatcttaacacgaacaattcagtggcatggggtacatttacagtacatcaccactaggtagttctagatcatttccgtcaccccagaaggaaaccccacagccgttacagtcactctgtttcccccttcacactgcctggcaaccacgaatttgttttctgtctctacgattagcttcttctgcgtatttcatataaatggcactatagaatatgtggctttttttggtatatggcttcttttacttagtatattctcagggttcatccatgtgttggcaccccattmctgttcatggctcggtagtattccattgtatggacagaccacaggtgtttatccatttatctctggatgcacacctggcttacttcaccttttggctgtagcgtatagagctgctatgagcattcctgtacaggcttctgtttgaacgtctatttggttttttttttttttttgagacggagtctcattctgttgcccaggctggagtgcagtagtgtgatctcggctcactgcaagctctgcctcctgggttcacaccattctcctgcctcagcctcccgagtagctgggactacaggt

SEQ ID NO: 83843 - DNA, 601 bp, Human
acgaatttgttttctgtctctacgattagcttcttctgcgtatttcatataaatggcactatagaatatgtggctttttttggtatatggcttcttttacttagtatattctcagggttcatccatgtgttggcaccccattactgttcatggctcggtagtattccattgtatggacagaccacaggtgtttatccatttatctctggatgcacacctggcttacttcaccttttggctgtagcgtatagagctgctatgagcattcctgtacaggcttctgtttgaacgtctatttggttttttttttttttttgagacggagtctcattctgttgcccaggctggagtgcagtagtgtgatctcggctcactgcaagctctgcctcctgggttcacaccattctcctgcctcagcctcccgagtagctgggactacaggtgcccgccaccgcacctggctaattttttttgcatttttagtagagacggggtttcaccatgttagccaggatggtctcgatctcctgacctcgcgatccgcccgacttggcctcccaaagtgctgggattacaggcgtgagccactgcgcccagcctg

SEQ ID NO: 83844 - DNA, 601 bp, Human
ctgtagcgtatagagctgctatgagcattcctgtacaggcttctgtttgaacgtctatttggttttttttttttttttgagacggagtctcattctgttgcccaggctggagtgcagtagtgtgatctcggctcactgcaagctctgcctcctgggttcacaccattctcctgcctcagcctcccgagtagctgggactacaggtgcccgccaccgcacctggctaattttttttgcatttttagtagagacggggtttcaccatgttagccaggatggtctcgatctcctgacctcgcgwtccgcccgacttggcctcccaaagtgctgggattacaggcgtgagccactgcgcccagcctgaacgtctatttttaattcttttgggtatacatcgaggagtgaaactgctgggtctgtttctgttgagttgactgaagaaaggatattcgttttattgctctatctacatggacctctcctgcattacttcagtgagttgtgaaggttggtctggatcgctttccctctttcctttttgaattgtgcctttagctgtaggttgaacacaggtgctatctttcacgttttcagatctctg

SEQ ID NO: 83845 - DNA, 601 bp, Human
ttttaattcttttgggtatacatcgaggagtgaaactgctgggtctgtttctgttgagttgactgaagaaaggatattcgttttattgctctatctacatggacctctcctgcattacttcagtgagttgtgaaggttggtctggatcgctttccctctttcctttttgaattgtgcctttagctgtaggttgaacacaggtgctatctttcacgttttcagatctctgagatcttcactggggatcaaggtccaaggaatcaaagctcatgctgtgtttgctcctgagcaggagagagcrttgtttagagggagggagaaggggaatgcttgaggtcagaatcacaggacagcaaatccgtcttgagatttcagaaatcaccataaatctgtgtcccttcccagagaagagcgtgtcaaaatgcagcattcgtaattgaagaaagcaaaatcagctgactaagtcgtaagacctaggatggtgaagagtctcagagtgaccaaaaacacacagaccctgttctcagggaagctcctgtgcaccgactgcatgctctatagacccctgccctgtgggggcccattcatgcttacagggtac

SEQ ID NO: 83846 - DNA, 601 bp, Human
gaatcaaagctcatgctgtgtttgctcctgagcaggagagagcgttgtttagagggagggagaaggggaatgcttgaggtcagaatcacaggacagcaaatccgtcttgagatttcagaaatcaccataaatctgtgtcccttcccagagaagagcgtgtcaaaatgcagcattcgtaattgaagaaagcaaaatcagctgactaagtcgtaagacctaggatggtgaagagtctcagagtgaccaaaaacacacagaccctgttctcagggaagctcctgtgcaccgactgcatgctctrtagacccctgccctgtgggggcccattcatgcttacagggtacatcctctgggagaaagcatgacaagttggtaccggggaacctgagggccgggatgaatttcaggataaaaagagcagacttagggatgctgccatagtatatcgtctagatttgtactgccctattgaaattcaaataaaatacagctaaatgttccatttctcagtcaccctacctgtatttcaagtgcctgatggacacctgtgcccagtggtgactgtactggccagagctgctgtagaatagtcccatcactg

SEQ ID NO: 83847 - DNA, 601 bp, Human
aggtcagaatcacaggacagcaaatccgtcttgagatttcagaaatcaccataaatctgtgtcccttcccagagaagagcgtgtcaaaatgcagcattcgtaattgaagaaagcaaaatcagctgactaagtcgtaagacctaggatggtgaagagtctcagagtgaccaaaaacacacagaccctgttctcagggaagctcctgtgcaccgactgcatgctctatagacccctgccctgtgggggcccattcatgcttacagggtacatcctctgggagaaagcatgacaagttggtacyggggaacctgagggccgggatgaatttcaggataaaaagagcagacttagggatgctgccatagtatatcgtctagatttgtactgccctattgaaattcaaataaaatacagctaaatgttccatttctcagtcaccctacctgtatttcaagtgcctgatggacacctgtgcccagtggtgactgtactggccagagctgctgtagaatagtcccatcactgcggaaagttctgctggtcaggtctggctggaccgtagacacaggagtggccatagcagtagtgctgggagctgaga

SEQ ID NO: 83848 - DNA, 601 bp, Human
caaacgaggggcttcaaacaacatcagtgtgttctctcattgttctggaggccagaagtccaagagcaaggcatcaccagggccgtgccctctctgaaggctctagaaggctgtagggcagaatccttcctggtctcttccagcgtccagggctgctggcagtcctcgatgtgctgtggtttgtggctacatcatgctcgtgtctgcctctgccttcctgtggtgtgtgcagctttgcatctgaatctccctctccttttttctttctttctttctttcttttctttctttctttctttcttcttttttttttttttttttttggagacagggtctcgctctgtcatcccggctaaagtgcagtggcgtgatctcggctcactgcaacttccaccttccaggctcaagtaatcctcctacctcagcctcccgagtagctgggaccacaggcatccaggctggagtgcagtggcatgatctcagcttactgcaaacctccaccttccagggtcaagtaatcgtcctacctcagcctcccaagtagctgggatcacagacgcgtgccattgcgcccacctaatattttgtatttttggtagag

SEQ ID NO: 83849 - DNA, 601 bp, Human
tatgtggctgagtcctcatggcctaatcacattattcctaaagttcctacctctttgcctgcctgtagtcccagctacatgggaggctgaggtgggagtatcacttgtccccaggaggtagaggctgcagtgagttgtgatcattccgcagcactccagcctgggcgacggagtgagaacctgtctcaaaaacagaaaaacaaacaaaaaatcccacatcttaataactgttacaatgtcaatgtcgattaaatttcaacttgaattttggaggggacagatatttaaatgatattacacrggttaggtcttgaaatttttttggcagggtcacaattccatgcactgcatatgggagtggaaggggtatgcctgcgggtggggagccaggggcttgagctccactctgcattcactttttgctctaccccaaagccttcccttcccctgtcctgctccctctacctgtgagtgtctgtgtaccctggccatcctcgatggcagtgagtctgagtattggtagggtgggctagagcctgggacagcgaggcagctggagggtggttgagggtggacgggtgcacgctggacaggcagaata

SEQ ID NO: 83850 - DNA, 601 bp, Human
tttttcagtttgggctttgtgatacagaaacacgcagatacttgtgggaacaacgtccctcaggcgttaaattgacatttgggattgagtgaaccgaagcattggtggtagagatggggaatgctatctgaaaaaccagaatcagctttaaggaagctgattacaaagagaattgattacaaaaagtatttttggatttaaaatacataagatgtaggcagtcctaatttaataagatataagggattgaagcaattgttgccatcgtctttctttttgttctggactgctgtcacacacrccatagagatgcctccttgagtgtcttcaaagtgctgtggatttcctttcttcagccgcctccgaccatcacgtccagccatctgtcctgtttgatcaagtccgcagagtgggtcgaggggcaccaattggcagaactggtcttggtgcattttcccctatcaagtttatctgtttttccggaggctgtttggctcttccccaaatcttccaaagacagaacacttaagtctaaaaggaggatttgtggaccatatatattttagctcaaaacctccaagtggaatcattttaatgtgcg

SEQ ID NO: 83851 - DNA, 601 bp, Human
accgaagcattggtggtagagatggggaatgctatctgaaaaaccagaatcagctttaaggaagctgattacaaagagaattgattacaaaaagtatttttggatttaaaatacataagatgtaggcagtcctaatttaataagatataagggattgaagcaattgttgccatcgtctttctttttgttctggactgctgtcacacacaccatagagatgcctccttgagtgtcttcaaagtgctgtggatttcctttcttcagccgcctccgaccatcacgtccagccatctgtcctgtytgatcaagtccgcagagtgggtcgaggggcaccaattggcagaactggtcttggtgcattttcccctatcaagtttatctgtttttccggaggctgtttggctcttccccaaatcttccaaagacagaacacttaagtctaaaaggaggatttgtggaccatatatattttagctcaaaacctccaagtggaatcattttaatgtgcgttttcttgagaaatatgtaaattaataattgcttcatacattattcaagaaaaacttattttgtatcacccataactcttctaatcttatat

SEQ ID NO: 83852 - DNA, 601 bp, Human
ccgaccatcacgtccagccatctgtcctgtttgatcaagtccgcagagtgggtcgaggggcaccaattggcagaactggtcttggtgcattttcccctatcaagtttatctgtttttccggaggctgtttggctcttccccaaatcttccaaagacagaacacttaagtctaaaaggaggatttgtggaccatatatattttagctcaaaacctccaagtggaatcattttaatgtgcgttttcttgagaaatatgtaaattaataattgcttcatacattattcaagaaaaacttatttygtatcacccataactcttctaatcttatataaagatatgctaatggatttaattaaaataattatactgaataatgtagcctgaactttattctaaaatagcatctattaatcatcatcatcagtaatatttttagccagagagacacttacaaccttaagctgatactagatggaaagtgcatttattgttttatttttcagtttggattaagttggcattctcatgagatctgggacaattacatttgcttagagacgagtataaaatttatttctgggccgggcatggtggctcacc

SEQ ID NO: 83853 - DNA, 601 bp, Human
ctgtcctgtttgatcaagtccgcagagtgggtcgaggggcaccaattggcagaactggtcttggtgcattttcccctatcaagtttatctgtttttccggaggctgtttggctcttccccaaatcttccaaagacagaacacttaagtctaaaaggaggatttgtggaccatatatattttagctcaaaacctccaagtggaatcattttaatgtgcgttttcttgagaaatatgtaaattaataattgcttcatacattattcaagaaaaacttattttgtatcacccataactcttctmatcttatataaagatatgctaatggatttaattaaaataattatactgaataatgtagcctgaactttattctaaaatagcatctattaatcatcatcatcagtaatatttttagccagagagacacttacaaccttaagctgatactagatggaaagtgcatttattgttttatttttcagtttggattaagttggcattctcatgagatctgggacaattacatttgcttagagacgagtataaaatttatttctgggccgggcatggtggctcacccctgtaatctcagcactttgg

SEQ ID NO: 83854 - DNA, 601 bp, Human
tagagacgagtataaaatttatttctgggccgggcatggtggctcacccctgtaatctcagcactttgggaggccaagacaggtggatcacgaggtcaggagttcaacaccagcctggccaacatggtgaaaccccgtctctactaaaaatacaaaaattagctgggcatggtggcacacacctgtaattctagctactcaggaggctgagacaggagaattgcttgaacctgggaggtggaggttgcagtgagccaagattacaccattacactccagcctgggcaacagagtgagactstatctcagaaaggagaaaaaaaaaattattttatttctttaacctgaagtatttcagcaattagaaaacttttagcctcttctgccctttcctgtttcttcttttccctctaaagctttggtttcagtgtgttcttgtccttttggttcagttttgacctcagtttccctcccaagagttgtgattgctgaatacgatgagttcctgattgcctggatattaagaggtgaaccaaatcttaagagggacactcagcagcctgcctgtcttaatataaatagaaatagttttaccactggc

SEQ ID NO: 83855 - DNA, 601 bp, Human
ttagctgggcatggtggcacacacctgtaattctagctactcaggaggctgagacaggagaattgcttgaacctgggaggtggaggttgcagtgagccaagattacaccattacactccagcctgggcaacagagtgagactctatctcagaaaggagaaaaaaaaaattattttatttctttaacctgaagtatttcagcaattagaaaacttttagcctcttctgccctttcctgtttcttcttttccctctaaagctttggtttcagtgtgttcttgtccttttggttcagttttgayctcagtttccctcccaagagttgtgattgctgaatacgatgagttcctgattgcctggatattaagaggtgaaccaaatcttaagagggacactcagcagcctgcctgtcttaatataaatagaaatagttttaccactggctgtgattctctctgattttgtttgtgttatctttctgtggcttgctggctttccatcagtgctcaatgaatggttgggagcccttatgcatttggtggtaatttcagtttctccttaggcctctctcatgcctgagtgtgcatgggacccaggtatgt

SEQ ID NO: 83856 - DNA, 601 bp, Human
cttcccactttcgtccctcacccccagtgaactgattagtgattatcccgctctgctgcagggaaccttgccagtgcctgggaggcaccgtggagcagatacctgctgagggactggcatcctggcctctcacccacaattcaaaacagctttgcacattctgagcacagttttatttaaataaagatcttcactgatttacaaaaataacaaaaggcaaacaaaaacaggaaaaatcttcaatgtcctcaatttctatcaccctgatcttttttgtgatttgggaactgattctactcartatttgccacaatgaagatggcactttacaaatggaagtttgcaccgaatgaagattcaggtttgagagatgtgcacgctgaggaggttttccatgtcaacacgtgcatgggtccacacgctgtcctgccgccactgctgctggtagctgtggccaacgtctgttgagcaggagcaatgagtcgagcttatcacatgcacaacacgtcattccattctcccacagccccttgaggcaggccctgttgatcaccactgttttgcccatgagaagcccgataggaaatgctaccttcccaaa

SEQ ID NO: 83857 - DNA, 601 bp, Human
agattcaggtttgagagatgtgcacgctgaggaggttttccatgtcaacacgtgcatgggtccacacgctgtcctgccgccactgctgctggtagctgtggccaacgtctgttgagcaggagcaatgagtcgagcttatcacatgcacaacacgtcattccattctcccacagccccttgaggcaggccctgttgatcaccactgttttgcccatgagaagcccgataggaaatgctaccttcccaaattcacatagcgagtgatggaggagcccggacagcaccccagagccctgacctygtctaccatggtgctgccttcctttgatggtgctggttagggtcccccacatgcattcatagatttttatttttggaggtgtctttcggcagataagattccacgcagcaccatctatccacagggcagatgtcccctgcttcgtctgttgggtgctctgtgtcttgacaagctattgaggcaggagctgtttccactcgaaagagacctgaatttagtgaagcagccagactccacagaggaaactgaaggtttttcctgcaagcacaagcagaatccaaaacacttgaaactctgaca

SEQ ID NO: 83858 - DNA, 601 bp, Human
cgtctgttgggtgctctgtgtcttgacaagctattgaggcaggagctgtttccactcgaaagagacctgaatttagtgaagcagccagactccacagaggaaactgaaggtttttcctgcaagcacaagcagaatccaaaacacttgaaactctgacaaataaccaatattagaaatgaatcaagctaggtgtggctcttacaatagtgggtaatggaaccctcctgccaaggaaagccagagcctgtggtaggaaggaatctgagttccctttgcatcttgtccttgtctggctaatcaractggatggggaagacaactttttcccttagttaaggaggtgatttctgtggctgaatgcagagagaggaatgcttcttgaaaataaagaggtcacgactatatatgaagtttgcagtcagtttgggagtcatggagggtcgacttcccaatgtcctctgtgaggacagaaggagacaaagcagactgaaatagtctctgtccttacctgtgaggagcttattgtctatggggaatacggacaaattgaccttccattgcagtccaaataggaatgtctctagatgctgtattcatctct

SEQ ID NO: 83859 - DNA, 601 bp, Human
tgggtgctctgtgtcttgacaagctattgaggcaggagctgtttccactcgaaagagacctgaatttagtgaagcagccagactccacagaggaaactgaaggtttttcctgcaagcacaagcagaatccaaaacacttgaaactctgacaaataaccaatattagaaatgaatcaagctaggtgtggctcttacaatagtgggtaatggaaccctcctgccaaggaaagccagagcctgtggtaggaaggaatctgagttccctttgcatcttgtccttgtctggctaatcaaactggayggggaagacaactttttcccttagttaaggaggtgatttctgtggctgaatgcagagagaggaatgcttcttgaaaataaagaggtcacgactatatatgaagtttgcagtcagtttgggagtcatggagggtcgacttcccaatgtcctctgtgaggacagaaggagacaaagcagactgaaatagtctctgtccttacctgtgaggagcttattgtctatggggaatacggacaaattgaccttccattgcagtccaaataggaatgtctctagatgctgtattcatctcttttgcgt

SEQ ID NO: 83860 - DNA, 601 bp, Human
gaaactctgacaaataaccaatattagaaatgaatcaagctaggtgtggctcttacaatagtgggtaatggaaccctcctgccaaggaaagccagagcctgtggtaggaaggaatctgagttccctttgcatcttgtccttgtctggctaatcaaactggatggggaagacaactttttcccttagttaaggaggtgatttctgtggctgaatgcagagagaggaatgcttcttgaaaataaagaggtcacgactatatatgaagtttgcagtcagtttgggagtcatggagggtcgactkcccaatgtcctctgtgaggacagaaggagacaaagcagactgaaatagtctctgtccttacctgtgaggagcttattgtctatggggaatacggacaaattgaccttccattgcagtccaaataggaatgtctctagatgctgtattcatctcttttgcgttgctataaaggatacccaagcctgggtaacttatagagaaaagaggtttattttggccccggttctgcagggtgcacaggaagcatagtgcagtcatctgcttctggtgagggcttccagaagcttctgctcatgacag

SEQ ID NO: 83861 - DNA, 601 bp, Human
gctggcagaggggcctggcccacctgggaaactggaagaggctcggcttggtgggagagagtcctgcaggtaccaagggtgagtctggggtggtggggccagagcccatggccctccatgggtgtgggataggttccctgtgtcccatgagcaggggacgttgccacagtatctaaattccatttgcattttcagaaggctgctctggctgcccagtgaggagtgtccttgaggggtcagcgtggaggcagggagggcgggtaggaggctgtggcagcaaagccaatgggaggcagtagcsgtgcggcccaggtgctgtttgttccggggggagttaacagcctgaaccgagggctctgtcgctgcctagaagggggctgtgaggaagagagaacacccggtgtgatgcccaggcctgtggcatgcagctggggcttggcggtgcagcgcctggcactggaatccctagggaaggcgaggcagcggtggcttccaccaaggcagggggagtttgcaatgtctagggtcagccagggtggaccccggtgggtgtggggtgtgggtgttgggctcaggaggaaggggagccctggagatggat

SEQ ID NO: 83862 - DNA, 601 bp, Human
ttggcatggcaggaggtgaggtcccttgtgggatatgtggagggaccccgaggaacccacaggcaaggggctgggggagcagggccctgcgcagggagctggaaggagggtggagaggcaggtggccaccctgggagtgagggccacgcgtgccccagaggtgaggtggccaaagtgtcatcagaaaggccacttgagaacagcctgaagtcatcgtggccttggcaggaacagagctgtggtgcgggccggagtcaggctgcagtgggagtgaggaggggtcgtgtgggaagtggacgcrggccttgcccacactgtggggtattgtccgatggagcagaggctcgcagggcctggggctgcttttccgggtgagaggctggtgtgggcttcatgatagaaagcaggaggcagaggggtgagaactgaaggctctgaggagagagagaggacaaagggcaggagggccttgagcagacagcaggggaagaggttggagccccacagggcaggcaggtgccccgaaaacccaaggcaggggcagaggttgggagctggagtcttgtgtttggtttgggtggttggaagcttagcgagttcc

SEQ ID NO: 83863 - DNA, 601 bp, Human
ctctctgtcctgtctttgttctgtcacccaggactgatagcagatgcgggttcctcccagttcttgctaaacctcatttaccgaaagacacaaaatcatcttggtcggttaagcagaattctggtttaatcagcattttgggatcactggcattccatgtccccgcctcagggggcacaaccccttctctgagggtgtcatcatgacatttttgatgctaggagctcgggaagaccacggcagggaagactttgggagccctcgccccgcttggcggtctgtcggtcccgattcacacagygtccggcagcccaaggggagccagcagcaggtgggccataaaggcctgtcttgtttgtggccgattcaccctggtgaaatggtatttatgaacttgctacaggcggttgatgctttgctgggcacagtataaaatgcatgaagccagttcgtgcctcaccctctgggcgttcgcaagcgaaacgagagaccgggagactgagcaatcagcctgtgtgaacgctggctattaaatgtcacaataaatgttttctgttttttttcaaagcaacactgaggttgtggaagcagaacatttgaa

SEQ ID NO: 83864 - DNA, 601 bp, Human
gggcacaaccccttctctgagggtgtcatcatgacatttttgatgctaggagctcgggaagaccacggcagggaagactttgggagccctcgccccgcttggcggtctgtcggtcccgattcacacagtgtccggcagcccaaggggagccagcagcaggtgggccataaaggcctgtcttgtttgtggccgattcaccctggtgaaatggtatttatgaacttgctacaggcggttgatgctttgctgggcacagtataaaatgcatgaagccagttcgtgcctcaccctctgggcgttygcaagcgaaacgagagaccgggagactgagcaatcagcctgtgtgaacgctggctattaaatgtcacaataaatgttttctgttttttttcaaagcaacactgaggttgtggaagcagaacatttgaaatcagaatgaaattattacgatttagtgctcttttgaaaagttgcatcccaaagcagacggttgggatctggtgggccttgaaggacagggcaaacactgaggtgaacaacagcatggatcgttctggagtggagatttatggggctaaagttgctttatcctctactctat

SEQ ID NO: 83865 - DNA, 601 bp, Human
gccagcagcaggtgggccataaaggcctgtcttgtttgtggccgattcaccctggtgaaatggtatttatgaacttgctacaggcggttgatgctttgctgggcacagtataaaatgcatgaagccagttcgtgcctcaccctctgggcgttcgcaagcgaaacgagagaccgggagactgagcaatcagcctgtgtgaacgctggctattaaatgtcacaataaatgttttctgttttttttcaaagcaacactgaggttgtggaagcagaacatttgaaatcagaatgaaattattackatttagtgctcttttgaaaagttgcatcccaaagcagacggttgggatctggtgggccttgaaggacagggcaaacactgaggtgaacaacagcatggatcgttctggagtggagatttatggggctaaagttgctttatcctctactctatttttggtgaagttgaagtgtggcggttttgcaaaattagctttggggctgcacagaccaaccccaaatcccagcagtgctgacctgggccaaagacttcactttcacatgtctccactgtctcctccgtgaaaggggatagtaatagg

SEQ ID NO: 83866 - DNA, 601 bp, Human
gtacaatttacatacagtaaaatttattcttttttaatgtacagctctgccagttttgacaaaggcataatgcattcatcccacgggagggcccctgagccccctgtattcccctgcccgcttccccaccagccactgacatgctctccatttctgtagttttgccttttccagaatgttatgaaaattgagtcacatgggatgcagcctcttgcatatgtcttgttttatttatcactgtgtcgttcacgtgcatctgtgttctaggtaacagtggttggtgcttcttgttactgcgtcragttccattgtatgaattcccctcttgaagggacatttgggttgtttctagtgtttggagattacaaataaagctgctagagacgtccacataagggttttgtaaccgtcataggtttcctgtcccatgtacgtgccaagtcaatgtgctgcgactctgggttgcagcagagaaagagttttaatcgtaggaccgccaaaacaggagaaggaggaaacctcatattgtctgctgcaggagtttggggctaggtattgttaaggttttcggagcaggcctaagtgggttgaagagcgtggg

SEQ ID NO: 83867 - DNA, 601 bp, Human
ttacatacagtaaaatttattcttttttaatgtacagctctgccagttttgacaaaggcataatgcattcatcccacgggagggcccctgagccccctgtattcccctgcccgcttccccaccagccactgacatgctctccatttctgtagttttgccttttccagaatgttatgaaaattgagtcacatgggatgcagcctcttgcatatgtcttgttttatttatcactgtgtcgttcacgtgcatctgtgttctaggtaacagtggttggtgcttcttgttactgcgtcgagttccrttgtatgaattcccctcttgaagggacatttgggttgtttctagtgtttggagattacaaataaagctgctagagacgtccacataagggttttgtaaccgtcataggtttcctgtcccatgtacgtgccaagtcaatgtgctgcgactctgggttgcagcagagaaagagttttaatcgtaggaccgccaaaacaggagaaggaggaaacctcatattgtctgctgcaggagtttggggctaggtattgttaaggttttcggagcaggcctaagtgggttgaagagcgtggggtgaagg

SEQ ID NO: 83868 - DNA, 601 bp, Human
taaggttttcggagcaggcctaagtgggttgaagagcgtggggtgaagggacagggagatgaagaaactgcattgcattgctgattcctttcctctgtcgggggttttcaaaccagttggcagcagcagtttccctggaattcaggatctgagaaacaccttaagcaattcttaaacaaaagacttatgattctaatgtcagaaatcctatctgcaggaacgttggggatgcagatgaccagtatctagtgctgcgtgactttggattacgagtaagtgggctgaagtgcagcctgttccrtgcttaattatcactgtattgctgtccagagttcttgttaaccttatgaggatgccttcagtttttgtgaatgtaggttttcacttcatttgaggaggtggccaggagtacaatggctgggtgctacggattatgaatgtttacctatgagaaactgctgaactctcttctaaagttgctgaactatttttgcattcagactagcagtgttatacaaagagcatgttgtaggaattctgttttgttttcatgattcttatagatgttgcttgtatcttattgtcattttaatttgcattt

SEQ ID NO: 83869 - DNA, 601 bp, Human
atgattcataattaaaatatatgcagatatacaggaaaacatttttggaatggaacaaagacagttgactttaatcattgaatgtagaagagttgaagtgaatttaatggaagaggattattctgagggggacaggtcttcattttgctttatcctcacagagctctgcaggggtaaaaggagaaaatcacatgcatgcttagcacacagtataggcacttaggccacaggtgataagtgttggcttctgttaataataattttattatgtgtcaggacaacctgtgagaagttagcattstttgagcattctttgtaggttagagattcattttcttttttgagacaggatcttgctttgttgccggggctggattgccatgctgtgaacacggctcactgcaacctctacttcctgggctcaggtgattctcctgcctcagcctcctgaatagctgggactacaggtgcaagccaccaatgcctggctaattttttttgtatatttttgtaaaggtggaatttcgccatgttacccaggctggtctcgaactcctgagctgaagcgatctgcctgcctcagcctcccaaagtgctggga

SEQ ID NO: 83870 - DNA, 601 bp, Human
aaaatatatgcagatatacaggaaaacatttttggaatggaacaaagacagttgactttaatcattgaatgtagaagagttgaagtgaatttaatggaagaggattattctgagggggacaggtcttcattttgctttatcctcacagagctctgcaggggtaaaaggagaaaatcacatgcatgcttagcacacagtataggcacttaggccacaggtgataagtgttggcttctgttaataataattttattatgtgtcaggacaacctgtgagaagttagcattgtttgagcattctktgtaggttagagattcattttcttttttgagacaggatcttgctttgttgccggggctggattgccatgctgtgaacacggctcactgcaacctctacttcctgggctcaggtgattctcctgcctcagcctcctgaatagctgggactacaggtgcaagccaccaatgcctggctaattttttttgtatatttttgtaaaggtggaatttcgccatgttacccaggctggtctcgaactcctgagctgaagcgatctgcctgcctcagcctcccaaagtgctgggattacaggtgtgag

SEQ ID NO: 83871 - DNA, 601 bp, Human
agacagttgactttaatcattgaatgtagaagagttgaagtgaatttaatggaagaggattattctgagggggacaggtcttcattttgctttatcctcacagagctctgcaggggtaaaaggagaaaatcacatgcatgcttagcacacagtataggcacttaggccacaggtgataagtgttggcttctgttaataataattttattatgtgtcaggacaacctgtgagaagttagcattgtttgagcattctttgtaggttagagattcattttcttttttgagacaggatcttgctytgttgccggggctggattgccatgctgtgaacacggctcactgcaacctctacttcctgggctcaggtgattctcctgcctcagcctcctgaatagctgggactacaggtgcaagccaccaatgcctggctaattttttttgtatatttttgtaaaggtggaatttcgccatgttacccaggctggtctcgaactcctgagctgaagcgatctgcctgcctcagcctcccaaagtgctgggattacaggtgtgagccactgcgcctgatgacttttgttctttgctctattttcatcgtg

SEQ ID NO: 83872 - DNA, 601 bp, Human
gagggggacaggtcttcattttgctttatcctcacagagctctgcaggggtaaaaggagaaaatcacatgcatgcttagcacacagtataggcacttaggccacaggtgataagtgttggcttctgttaataataattttattatgtgtcaggacaacctgtgagaagttagcattgtttgagcattctttgtaggttagagattcattttcttttttgagacaggatcttgctttgttgccggggctggattgccatgctgtgaacacggctcactgcaacctctacttcctgggctcargtgattctcctgcctcagcctcctgaatagctgggactacaggtgcaagccaccaatgcctggctaattttttttgtatatttttgtaaaggtggaatttcgccatgttacccaggctggtctcgaactcctgagctgaagcgatctgcctgcctcagcctcccaaagtgctgggattacaggtgtgagccactgcgcctgatgacttttgttctttgctctattttcatcgtgttagccgtcagcccctcatctggaagtgatctttctcttctcagtatttctgcggttcttctcata

SEQ ID NO: 83873 - DNA, 601 bp, Human; identical to SEQ ID NO: 21874

SEQ ID NO: 83874 - DNA, 601 bp, Human; identical to SEQ ID NO: 21875

SEQ ID NO: 83875 - DNA, 601 bp, Human; identical to SEQ ID NO: 21876

SEQ ID NO: 83876 - DNA, 601 bp, Human; identical to SEQ ID NO: 21877

SEQ ID NO: 83877 - DNA, 601 bp, Human
aggtatacaccaaagtcctagggtaatcagcatacattgtagcctttaagatatgtggttgtctgtcctggggaggcaatcacttcgctccattgtgatgattgcaaggaaaagaattcgagttttctttaaatctgaaagtaatggttttatcttattctgaactttgcattctttgacagcatttcttcaaatcctactcaaagtaataagaatttcaatgattcttcaactcatttatcctgcagaacactttatatttccctatgttatctccctgccctttttagtaatcattttytttctatttggacagattaaattaatattttacccttgtcaagcagttttattgaaagcttaaaacctctgcataattccacaaacttcctcatttattggaggcaaatgtgaagtctgttgagtgacattctgactgagaagcatggatttattcgattccatttgtgcctggacatttggctgctccattcattttctgttgtcctcattcttggtgttgttctcagttcccctgtgctttcacggatcccagacttgggatgtccctgttaagttacgggctgggtttggaacacac

SEQ ID NO: 83878 - DNA, 601 bp, Human
gttgccgaggctggagtgcaatggcacaatctcagctccctgcaacctccgcctcccgggttcaaatgattctcctgcctcagcctcctgagtagctgggattataggcacccaccaccatgcctagctaatttctgtatttttagtagagatggggtttcaccatgttggtcaggctggtctcaaactaccgacctcaaatgatccacccgcctcggcctcccagagtgctgggattacaggcgtgagccaccgagcctgaccccagatattttttcctctattaaaacttgctcatttytttaggtcgtagaaagcttgaaggaaacttactgtttatattcgacgattttgttagcttaggtgtttgtaattgtgttctgtccctctttcctatgccccatttctgtttcattcttgttctctaagccttttatcttagacagcctgaagtcctgttttggaagtatgcaggatgtgaataactgcttagctttgtttaatatggaattaccaggtcatgtaatattttgaaataattaacctgctgtcatctttttaagtacggaattaggattttgatcttagtataagcaagttg

SEQ ID NO: 83879 - DNA, 601 bp, Human
ctccgcctcccgggttcaaatgattctcctgcctcagcctcctgagtagctgggattataggcacccaccaccatgcctagctaatttctgtatttttagtagagatggggtttcaccatgttggtcaggctggtctcaaactaccgacctcaaatgatccacccgcctcggcctcccagagtgctgggattacaggcgtgagccaccgagcctgaccccagatattttttcctctattaaaacttgctcatttctttaggtcgtagaaagcttgaaggaaacttactgtttatattcgaygattttgttagcttaggtgtttgtaattgtgttctgtccctctttcctatgccccatttctgtttcattcttgttctctaagccttttatcttagacagcctgaagtcctgttttggaagtatgcaggatgtgaataactgcttagctttgtttaatatggaattaccaggtcatgtaatattttgaaataattaacctgctgtcatctttttaagtacggaattaggattttgatcttagtataagcaagttgtacccaatgtagtaaatgaggttgtatgaaatatatgaatcccaaa

SEQ ID NO: 83880 - DNA, 601 bp, Human
gaaagagacccactggttgctttgcactaaaacatttctttttatctccgcctgatataatgacaagtggatctgtttgcaagaggctggcagtgaattctgaaactggtgttgttcctctgcagaaaagcctttcgttgccaggtctgggtcccagtaggccaggccttacagtgccttggttgtttctggccttgttttccccatttctctctcttggagaacatggaaaccgtaggtgcatcctgagtttgttgggcttcataggaggcacgtctttgggcttgtcaaagcaagacarctctgtgtggtccagtccatgtgggactggcctgaatgaggacaccaggcctgcgtcactgcggccatttgctcacagagcattcagccttcctctgcccttctgttctatccaggccctcaaggattagatgatggccacccacactctgcaggatggacatgcttgactcagtcccccaatcccaatgctaatctctgctggaaacatccttacagacacactcagaaataatgttcagccagctctctgggcatccgtggtgcagtcatttggcatttaaaattaaccatcacagag

SEQ ID NO: 83881 - DNA, 601 bp, Human
tgagagtaaattttagtggtaaggctacccctttttggtcttgcaaatagttggatactctagatagattgcttttctgtaagcctgctctgtgtagttttctgtttgtctgtttgttgtttttctggtggttggactctggcagtgagtaggaatgggaaagaggccattccctcataccctggctctcctggggctcctcccttcactatagcaaacaggctccttgtagacagtgttcatgagtcttttcaaacttcatttgctttcatttttgagcttcttgaaagtgtaagcctgktaagtttaaattattttccttattcttattttcaaggtgaatgattcttctagttatcaagcagagtaaaactctcctttttaatggtggaaacattagttacagcagccctttgaaatctgagggcaaaatcccagacacttactgggactagctattaggaaatattgaagtcagatttctacactattatcattgtgatttgatccatgatagaaatttatatctcaaaaattaccctattaataaacttattatgccttaaattatagaaaagttgcgtgtttaaaacaaacccat

SEQ ID NO: 83882 - DNA, 601 bp, Human
tcctttttaatggtggaaacattagttacagcagccctttgaaatctgagggcaaaatcccagacacttactgggactagctattaggaaatattgaagtcagatttctacactattatcattgtgatttgatccatgatagaaatttatatctcaaaaattaccctattaataaacttattatgccttaaattatagaaaagttgcgtgtttaaaacaaacccataatataccttcttaatgttttgataaaagcatttttgattaaaaaaaccaaaataaaatctcttgagctttactrttgtggaaaatagaaatatatcgaaagggatcttaaacctggagctactctgcagtagttttgttaacttgatagatgttgtgcagaaggaaaaattggggttggggtcaattttgccacattcacttaatgtaccactcatatagcattctgcagtactttaattagatagttgtgctgatgacttctgatgaacggtaccagctgtgaaccctgaagactgattcttttaaataatggtggaatgtaaacatcattttctcttctgtttctttcatgccttgagaaaactttttatct

SEQ ID NO: 83883 - DNA, 601 bp, Human
ggtggaaacattagttacagcagccctttgaaatctgagggcaaaatcccagacacttactgggactagctattaggaaatattgaagtcagatttctacactattatcattgtgatttgatccatgatagaaatttatatctcaaaaattaccctattaataaacttattatgccttaaattatagaaaagttgcgtgtttaaaacaaacccataatataccttcttaatgttttgataaaagcatttttgattaaaaaaaccaaaataaaatctcttgagctttactattgtggaaaayagaaatatatcgaaagggatcttaaacctggagctactctgcagtagttttgttaacttgatagatgttgtgcagaaggaaaaattggggttggggtcaattttgccacattcacttaatgtaccactcatatagcattctgcagtactttaattagatagttgtgctgatgacttctgatgaacggtaccagctgtgaaccctgaagactgattcttttaaataatggtggaatgtaaacatcattttctcttctgtttctttcatgccttgagaaaactttttatctgtaatactgca

SEQ ID NO: 83884 - DNA, 601 bp, Human
ctttaattagatagttgtgctgatgacttctgatgaacggtaccagctgtgaaccctgaagactgattcttttaaataatggtggaatgtaaacatcattttctcttctgtttctttcatgccttgagaaaactttttatctgtaatactgcacctttttcatccctcattctgtatatcattctctgtctttcattatatatgtttttgaaaagaccatttgttataacactgcaggattttagaaatgacttattgaatgtaggagggtgaactcaatttcaggtttttaattgtttcygtttcaattccatcataattcattgaatatcttccgtgtgctcaggaccattgattagcgagtttgcttcctttgagagtcttcagagtcatctacttaaaaatgtagaattggaaaagagtgattatctcaatgctcagataaggacaccagagttcagccagaagcctggcagggagctgtccaccgccgtggtgctgattgaggaggtggcttcttacaaatctatcagcccactcttttcttaaactgtttcacacccaccatatgagtaatgcattctgaaaactgaatttactt

SEQ ID NO: 83885 - DNA, 601 bp, Human
catctacttaaaaatgtagaattggaaaagagtgattatctcaatgctcagataaggacaccagagttcagccagaagcctggcagggagctgtccaccgccgtggtgctgattgaggaggtggcttcttacaaatctatcagcccactcttttcttaaactgtttcacacccaccatatgagtaatgcattctgaaaactgaatttacttcaaatgccatatggagcaagacaaaatacaaataagtgaataaataaacatacaaataaattaaatgtataaagtatacagtgttgtgcwtatatgttcatggagttttaatagtttttctcttctttctgtgtgggacctttatctgtgatcaaattggtggtgccaacagtttatggtatagttggtgtaaactttatcatcgtctgttgagttctgctgtcacttctgggtgggcttctgttcctgttgctggatgttgaatgcaagaagaacgatctgagaagagactgtgttggttgtgctgtatttagtcatgtgcacactgggcaccaggaaagcaagtccctgagtctctttagtacatgatttcttctagctcctggtagc

SEQ ID NO: 83886 - DNA, 601 bp, Human
tgaagtgcagattaccgcatttctaacaatttcagccctctgcccagtggccctgttccagtcagaacacgtaaaaggtactgtcgggcagcttggaacagaaacactgtacaggccatttgtgtttactccattttacagactaggaaactaaggtgcagaaaggaaaagtgacctaccaagggtaacttgatgttgatttattctctggtactgctaactttcatgacttgttaggttagaatgattcttgaaaaatttgctttgcgtctgttatgtaaaaatgcctgaatcatacagrtttacacacacgtgtacctgcatgggtcctttactctgggggctccagctgaggaatcaggctttttttttttttgagacggagtctcgctctgtcacccaggctggagtgcagtggcgcaatctcggcttactgcaagctccgtctcccaggttcacgccattcttctgcctcagcctcctgagtagctgggactacaggcgcctgccaccgtggccgactaattttgtttttgtatttttagtagagatggggtttcactgtgtcagccaggatggtctctatctcctgacctcatgg

SEQ ID NO: 83887 - DNA, 601 bp, Human
agcttggaacagaaacactgtacaggccatttgtgtttactccattttacagactaggaaactaaggtgcagaaaggaaaagtgacctaccaagggtaacttgatgttgatttattctctggtactgctaactttcatgacttgttaggttagaatgattcttgaaaaatttgctttgcgtctgttatgtaaaaatgcctgaatcatacagatttacacacacgtgtacctgcatgggtcctttactctgggggctccagctgaggaatcaggctttttttttttttgagacggagtctcrctctgtcacccaggctggagtgcagtggcgcaatctcggcttactgcaagctccgtctcccaggttcacgccattcttctgcctcagcctcctgagtagctgggactacaggcgcctgccaccgtggccgactaattttgtttttgtatttttagtagagatggggtttcactgtgtcagccaggatggtctctatctcctgacctcatggtcctcctgactcagcctcccaagtgctgggattacaggcgtgagccaccgcgcccggccggaatagacatctaataattctgactccga

SEQ ID NO: 83888 - DNA, 601 bp, Human
agactaggaaactaaggtgcagaaaggaaaagtgacctaccaagggtaacttgatgttgatttattctctggtactgctaactttcatgacttgttaggttagaatgattcttgaaaaatttgctttgcgtctgttatgtaaaaatgcctgaatcatacagatttacacacacgtgtacctgcatgggtcctttactctgggggctccagctgaggaatcaggctttttttttttttgagacggagtctcgctctgtcacccaggctggagtgcagtggcgcaatctcggcttactgcaarctccgtctcccaggttcacgccattcttctgcctcagcctcctgagtagctgggactacaggcgcctgccaccgtggccgactaattttgtttttgtatttttagtagagatggggtttcactgtgtcagccaggatggtctctatctcctgacctcatggtcctcctgactcagcctcccaagtgctgggattacaggcgtgagccaccgcgcccggccggaatagacatctaataattctgactccgatggtgcgtagaggtgcagtcctgaaggtcccttcactcagctcccagctc

SEQ ID NO: 83889 - DNA, 601 bp, Human
taaggtgcagaaaggaaaagtgacctaccaagggtaacttgatgttgatttattctctggtactgctaactttcatgacttgttaggttagaatgattcttgaaaaatttgctttgcgtctgttatgtaaaaatgcctgaatcatacagatttacacacacgtgtacctgcatgggtcctttactctgggggctccagctgaggaatcaggctttttttttttttgagacggagtctcgctctgtcacccaggctggagtgcagtggcgcaatctcggcttactgcaagctccgtctcccrggttcacgccattcttctgcctcagcctcctgagtagctgggactacaggcgcctgccaccgtggccgactaattttgtttttgtatttttagtagagatggggtttcactgtgtcagccaggatggtctctatctcctgacctcatggtcctcctgactcagcctcccaagtgctgggattacaggcgtgagccaccgcgcccggccggaatagacatctaataattctgactccgatggtgcgtagaggtgcagtcctgaaggtcccttcactcagctcccagctcccacatctgtga

SEQ ID NO: 83890 - DNA, 601 bp, Human
cggcttactgcaagctccgtctcccaggttcacgccattcttctgcctcagcctcctgagtagctgggactacaggcgcctgccaccgtggccgactaattttgtttttgtatttttagtagagatggggtttcactgtgtcagccaggatggtctctatctcctgacctcatggtcctcctgactcagcctcccaagtgctgggattacaggcgtgagccaccgcgcccggccggaatagacatctaataattctgactccgatggtgcgtagaggtgcagtcctgaaggtcccttcacycagctcccagctcccacatctgtgaagtgtggggctaaggagatggctctgcgattccttccagtgtcggcaccgtcttctgtatttctgttgtttgaagacttgaatggagggaggaaagcacgtgaacatgttgaaacctgtgggtccaggattcttagatggttggaaaataagacaattgactatacaagatgaatagcaaacaccccccatgtatatgattcttactgtttaattcttaggaaaagtgttattctggatctcagttctatgtaacacagagttattaaatgcact

SEQ ID NO: 83891 - DNA, 601 bp, Human
cttctgcctcagcctcctgagtagctgggactacaggcgcctgccaccgtggccgactaattttgtttttgtatttttagtagagatggggtttcactgtgtcagccaggatggtctctatctcctgacctcatggtcctcctgactcagcctcccaagtgctgggattacaggcgtgagccaccgcgcccggccggaatagacatctaataattctgactccgatggtgcgtagaggtgcagtcctgaaggtcccttcactcagctcccagctcccacatctgtgaagtgtggggctaasgagatggctctgcgattccttccagtgtcggcaccgtcttctgtatttctgttgtttgaagacttgaatggagggaggaaagcacgtgaacatgttgaaacctgtgggtccaggattcttagatggttggaaaataagacaattgactatacaagatgaatagcaaacaccccccatgtatatgattcttactgtttaattcttaggaaaagtgttattctggatctcagttctatgtaacacagagttattaaatgcactttatggatcatttatttaatgtgaccaaactaaaaatta

SEQ ID NO: 83892 - DNA, 601 bp, Human
ttatttaatgtgaccaaactaaaaattaagaagtacattactctgttcataaaaatgaatgttttcaatggacaaattcattcttgtatttgcatcttgctttaatgtagagctgtaatggggttatggtcagatattctgcttgggcatttataagctgataatgcttattgaataccttttataaagattaatattttttactctgtcctcattaccagagcattaatcatcctggcttcggcccttgcagctgaggatgaacagatgttgaattattgctgtctgtaatcattgtggwtcacactggggaagggccgtgaaagggtggctggtgtgatcttcacagctgatttgcatggagcctggctacctttatagctctgtgcatggcagaggaaaccaggatagctgtgccagctgattctagcttcctcgtaggtcaccgtagcctaagtcagcactgacaagcactggcggtcctggagtcacgtacgtgtgacagggtgtctgataagagagagctgtggccatgactctgcttacaataaatgccagttcataaaaatgagaagtcacatacaaggtctttaacatcggc

SEQ ID NO: 83893 - DNA, 601 bp, Human
ctgttcataaaaatgaatgttttcaatggacaaattcattcttgtatttgcatcttgctttaatgtagagctgtaatggggttatggtcagatattctgcttgggcatttataagctgataatgcttattgaataccttttataaagattaatattttttactctgtcctcattaccagagcattaatcatcctggcttcggcccttgcagctgaggatgaacagatgttgaattattgctgtctgtaatcattgtggatcacactggggaagggccgtgaaagggtggctggtgtgatcytcacagctgatttgcatggagcctggctacctttatagctctgtgcatggcagaggaaaccaggatagctgtgccagctgattctagcttcctcgtaggtcaccgtagcctaagtcagcactgacaagcactggcggtcctggagtcacgtacgtgtgacagggtgtctgataagagagagctgtggccatgactctgcttacaataaatgccagttcataaaaatgagaagtcacatacaaggtctttaacatcggctttctagcattctctgagactgtgctgtccagcagaaataga

SEQ ID NO: 83894 - DNA, 601 bp, Human
gcactaattagatttcacatgctcagaggtttccatgttgggtatcacagctctgaggtattagttttcttttgtgtccttttagttgaacagctgactttgtataatactataccttctgttaaccaccatttgttgtaggctcatatttgctaaatacacacatcgtatcatttagttctcagtcaacctgggagacgaccaacagcatccccattttgcacattagaaaaattaagacctagagagtttaagtaactcttaaacgctctagatacaaagcaaagagccagcagggggkattgcattatttctttatacgtgtgggtaaactgattaaaaggctttccccaaatcccataaagtgacccaggttcctggacttctggtcaagtgtttgttccagagtattcaaaagatgatgtgtttttctttaaaatataagacccctcctccttttttttttttttctcctggtggattatttgttggcttcccaggccatctgttttggaactaatgggactatcagtgccaaacctgtagaaatgacattttgtccatgggaaaagtattcaggacatttaggtgtgttgtccat

SEQ ID NO: 83895 - DNA, 601 bp, Human
atacacacatcgtatcatttagttctcagtcaacctgggagacgaccaacagcatccccattttgcacattagaaaaattaagacctagagagtttaagtaactcttaaacgctctagatacaaagcaaagagccagcaggggggattgcattatttctttatacgtgtgggtaaactgattaaaaggctttccccaaatcccataaagtgacccaggttcctggacttctggtcaagtgtttgttccagagtattcaaaagatgatgtgtttttctttaaaatataagacccctcctccttttttttttttttctcctggtggattatttgttggcttcccaggccatctgttttggaactaatgggactatcagtgccaaacctgtagaaatgacattttgtccatgggaaaagtattcaggacatttaggtgtgttgtccataggaagataggagattcctcttccttggctgccagagacagctgttcatgctttaaaataggtcattgtagggtatatgtatatgtgtgtgtgtgtgtgtgtgtgtgtgtgtgtgtgtctatctgtccgtctgtctgtccatctgtctgtttttgt

SEQ ID NO: 83896 - DNA, 601 bp, Human
ccataaagtgacccaggttcctggacttctggtcaagtgtttgttccagagtattcaaaagatgatgtgtttttctttaaaatataagacccctcctccttttttttttttttctcctggtggattatttgttggcttcccaggccatctgttttggaactaatgggactatcagtgccaaacctgtagaaatgacattttgtccatgggaaaagtattcaggacatttaggtgtgttgtccataggaagataggagattcctcttccttggctgccagagacagctgttcatgctttaarataggtcattgtagggtatatgtatatgtgtgtgtgtgtgtgtgtgtgtgtgtgtgtgtgtctatctgtccgtctgtctgtccatctgtctgtttttgtagtatacgttcctcagtgctcttgatttgctatcttaagacaaaattcaagagtcttactgttacttaaaacgtgtactcccaccacttcttgaaaaaacctatctgtagacagaaatatagagtaagagaagtcccttaaaaaatgaggttttaagaaatttatgtttttgcttttggggaaggcagctgagtggctact

SEQ ID NO: 83897 - DNA, 601 bp, Human
agagaagtcccttaaaaaatgaggttttaagaaatttatgtttttgcttttggggaaggcagctgagtggctactgtactggatagtgcagctgtaaggctttagttttctttgtatatttttagttgaaaaggctgactttgtatactgatatttgtattattgttattaacagctaccatttcttgagggttgagagtggcagacctgcttttaactgcagactttagtttgataccacatgtgcgtaattgcaagttaatccaagacacacacactcataccaccactatcatcaggccttggtttatgtgcttggatatgccatttaagaaaaataggaaggcttctgctcttatggagattgcatatcagcaaggaggaacagataattaaagcaatcagtatttcagtgttccgataacggggcattggaggccttcctgtacctgggtccagtgggggctgtgctgaggccagcagatcacaggtcaccagggaggtgcactccttggctttgctgccttcagcttcggtcctcccaccctctcctagtggctctggggaattgcctttctttgggggcctgggatgggttgct

SEQ ID NO: 83898 - DNA, 601 bp, Human
gaaggcttctgctcttatggagattgcatatcagcaaggaggaacagataattaaagcaatcagtatttcagtgttccgataacggggcattggaggccttcctgtacctgggtccagtgggggctgtgctgaggccagcagatcacaggtcaccagggaggtgcactccttggctttgctgccttcagcttcggtcctcccaccctctcctagtggctctggggaattgcctttctttgggggcctgggatgggttgctgtggaccaggtgacggacggtactgtaaggtgccatagccygtgtgaccctctgcctggaggcatggttgaaatccctggcatgggcagactgacctttggcctttagggaaagagcctcgttgccagcctggtcctcctcagtgacctggttctgttttggggtcggggtggagtttcctgatgctgatggtgccgggggagacctctcactgaggcatgttggatggctttttacacagtccttcctcaagcagcatctcattttgtctcgacagttaaagtagacatcgccccacctccccacttgatcttgactggccatggatggctgggtcatga

SEQ ID NO: 83899 - DNA, 601 bp, Human
gccccacctccccacttgatcttgactggccatggatggctgggtcatgaaggctgaggtgcagttggattctggtctatcaggatggttataacaattttttttttttttttacatcttcttgggggcttagtgaatgaaatgtctgtattgggacaaaatgacagtgacatttctaaaagttttgttgtttctcatcaggagaggctggatagcaaacaggtgaaggtagcgcagtcctccaggtggggtggatggtgaacgttaccaccaggtaaccaaagatggttgatagcatccyccagccaaagatgaacagacagacacctctttcttctcaccagagtaattctaacaaatgagaccagcacactcaattagctctgagaatagcacagaccacaactgcctacccagcatgacagataaatggtgcggtgagggatgaatttaggccaggacatctgggtaccagagcctacagggccagctctgctgtttctgagcccagtgctatgttcctctgattttctggaatcacttatggacacaccctccttccagcctgtactggctggtccgttagaccttttccctctct

SEQ ID NO: 83900 - DNA, 601 bp, Human
ttttttttttttttacatcttcttgggggcttagtgaatgaaatgtctgtattgggacaaaatgacagtgacatttctaaaagttttgttgtttctcatcaggagaggctggatagcaaacaggtgaaggtagcgcagtcctccaggtggggtggatggtgaacgttaccaccaggtaaccaaagatggttgatagcatcccccagccaaagatgaacagacagacacctctttcttctcaccagagtaattctaacaaatgagaccagcacactcaattagctctgagaatagcacagaycacaactgcctacccagcatgacagataaatggtgcggtgagggatgaatttaggccaggacatctgggtaccagagcctacagggccagctctgctgtttctgagcccagtgctatgttcctctgattttctggaatcacttatggacacaccctccttccagcctgtactggctggtccgttagaccttttccctctcttgggtccatcctaagcttgcttcagaagacggcttctaagcttatgtagtcatttttttccttagtcacattgtcaggggctgtcattacctgctcagg

SEQ ID NO: 83901 - DNA, 601 bp, Human
aagatgaacagacagacacctctttcttctcaccagagtaattctaacaaatgagaccagcacactcaattagctctgagaatagcacagaccacaactgcctacccagcatgacagataaatggtgcggtgagggatgaatttaggccaggacatctgggtaccagagcctacagggccagctctgctgtttctgagcccagtgctatgttcctctgattttctggaatcacttatggacacaccctccttccagcctgtactggctggtccgttagaccttttccctctcttgggtccrtcctaagcttgcttcagaagacggcttctaagcttatgtagtcatttttttccttagtcacattgtcaggggctgtcattacctgctcaggttttagtggttctaactgctgcctctgaggtttcttggaaattcagcttgttttccagaatggtggcagtgctagggatgaccaagtgacagggttgggccagggctctccccatgttgaggttggcacagtgtgtgatgtgtttccagccaaagggcaagaggactcatttgggagatattatggtgggcaccacgaggaagagtgct

SEQ ID NO: 83902 - DNA, 601 bp, Human
acaactgcctacccagcatgacagataaatggtgcggtgagggatgaatttaggccaggacatctgggtaccagagcctacagggccagctctgctgtttctgagcccagtgctatgttcctctgattttctggaatcacttatggacacaccctccttccagcctgtactggctggtccgttagaccttttccctctcttgggtccatcctaagcttgcttcagaagacggcttctaagcttatgtagtcatttttttccttagtcacattgtcaggggctgtcattacctgctcaggtyttagtggttctaactgctgcctctgaggtttcttggaaattcagcttgttttccagaatggtggcagtgctagggatgaccaagtgacagggttgggccagggctctccccatgttgaggttggcacagtgtgtgatgtgtttccagccaaagggcaagaggactcatttgggagatattatggtgggcaccacgaggaagagtgctggcagggcggggctcagataagggtgtgctgaggaagcattccagccagctgggctagagcatttggagttaaaccctacgtcggatgctgtg

SEQ ID NO: 83903 - DNA, 601 bp, Human
ccctacgtcggatgctgtgttgtggttaaggtcagcagctcaagagtcactaaagttggatgtagtttgtaaacatcgaggttctataggaaaggcattgagatttgggggtatttgtggaaatagtgtgtcccatgtgttagcgtttccaggctggattcactcccatgaggtcattttcttgttcatttctcttagactggctttgttctcgggtggctctaacactagggcagtctcctacacgggcagcccatcttggcactgtgctctccctcactgacctcctgtgggattccasacaccacagccttcgaggctgacctggcctctttccagaagatgtgcagctcttagcacgtcatacatttcttctgcctaagtgttgactactggcattgtgaaattaacaggtacattcttattttcctttattaattggacaaaacttcttgtaaaaatggagttgctctcactcctttcttggcgaatcaacaaaaaatggaattggggaaggccttggccatgagccgcccacatgtgatccgctggagacaggggagtagaggggtttgtgtttcttctcagtctttgtttctct

SEQ ID NO: 83904 - DNA, 601 bp, Human
atctttaatgttgtaagtcttaaaatataaaatcctgaaaaccggctaagtctgtttaaggttttagagcactgctgtctcctcttgtgctctgcgtttaaaggaaacaagaatggctgggctagtgtcaaaacacagaactggtgttgtaaatagatagtccatgctggagagtggatgatgctccagctaagctggatttcccaactggaagagacaattagggattgcatttcacctttcattgtatttgtatctgtttccctgttgctctgttattttctgaacatccttcctctgygcttattgaaagaacaaatggaaacccaaacctgctttgcctctgatccttacaccatggcatcccttcattttatagccatgcgtcccagagtggggcctctgcacctgcttttcatttcctgttcctcctcagcccactccaggaagctgtcttgagaaggattctgtgtgccttaaattgccacattccaagattggcatcttctacctaggagaaggaaatcatactttggctcaccttggcatagatgagaaaagctgcaattcaaataatttgtgttgtaggaagtatttcttt

SEQ ID NO: 83905 - DNA, 601 bp, Human
tctttaatgttgtaagtcttaaaatataaaatcctgaaaaccggctaagtctgtttaaggttttagagcactgctgtctcctcttgtgctctgcgtttaaaggaaacaagaatggctgggctagtgtcaaaacacagaactggtgttgtaaatagatagtccatgctggagagtggatgatgctccagctaagctggatttcccaactggaagagacaattagggattgcatttcacctttcattgtatttgtatctgtttccctgttgctctgttattttctgaacatccttcctctgtkcttattgaaagaacaaatggaaacccaaacctgctttgcctctgatccttacaccatggcatcccttcattttatagccatgcgtcccagagtggggcctctgcacctgcttttcatttcctgttcctcctcagcccactccaggaagctgtcttgagaaggattctgtgtgccttaaattgccacattccaagattggcatcttctacctaggagaaggaaatcatactttggctcaccttggcatagatgagaaaagctgcaattcaaataatttgtgttgtaggaagtatttctttt

SEQ ID NO: 83906 - DNA, 601 bp, Human; identical to SEQ ID NO: 21878

SEQ ID NO: 83907 - DNA, 601 bp, Human; identical to SEQ ID NO: 21879

SEQ ID NO: 83908 - DNA, 601 bp, Human; identical to SEQ ID NO: 21880

SEQ ID NO: 83909 - DNA, 601 bp, Human; identical to SEQ ID NO: 21881

SEQ ID NO: 83910 - DNA, 601 bp, Human
tgattatatatgtaacaaattatcattaatggactataattaataaaatcccctgagtttttttgtgagagcttttgcctttgacaagggccatttttcatctcattaagggttataattgatttactctttacagggtaaatggattcaatgacaaccactggggcttgcatgttaatgtttctctggtgttggtgttcattggtgtgtccttccccaggggccaacccagaggcacgtccagattatcatggagaaacttctccggaccgtgaaccgaaccgtcatttccatgggacgrgattctgaactcattgtaagtgcttggtgacatatgtttggatatttaactggggctgacagcatccttctccaactgctgtttgaacatagcttattatactgcaatgtagtgagcagttgagatacagcttggtatataaaatgtcctcattttccaaatgaatgtcaaagttgaagggtaagcaaaccaactttaaagatggaaacatttggctcttgttttctcattacttacttatagcaaaagacatgtattttctgctgagtcgtcattcttctggcagtttctccatagtgt

SEQ ID NO: 83911 - DNA, 601 bp, Human
ctcattacttacttatagcaaaagacatgtattttctgctgagtcgtcattcttctggcagtttctccatagtgtttacacttaaggtgccattaataaaattttatgaaggaccctaaaaagtaattgagattcttcaccttagttattttattgtctactctaatgtattgtaggtgtttttcttaaacagtaattaggcaggagcctattcatttttttcaagaatattttactaatttagacagtccatcaagtttctgatcatggtgccttttcccagggttcactgctgtcctcygcacccccttaccttaagtctgtttccttcagcaaaaaatgcatgagtagatctcgtttaatttttttttttttgaggttcaaggggttataatttctttcctttttttttttttctttaatttctgggatacatgtgcagaacatacaggtttgttacgtaggtatgcgtgtgccatggtggtctgctgcacctatcaacccatcatctaggttttaagccctgcatgcattcggtatttgtcctaatgctctccctccatttgccccccactccccagcaggccccggtgtgtgtggt

SEQ ID NO: 83912 - DNA, 601 bp, Human
ttccttcagcaaaaaatgcatgagtagatctcgtttaatttttttttttttgaggttcaaggggttataatttctttcctttttttttttttctttaatttctgggatacatgtgcagaacatacaggtttgttacgtaggtatgcgtgtgccatggtggtctgctgcacctatcaacccatcatctaggttttaagccctgcatgcattcggtatttgtcctaatgctctccctccatttgccccccactccccagcaggccccggtgtgtgtggttctcctccctgtgtgcatgtattytcattgttcacctcccacttatgagtgagaacatgtggtgtttggtgttctggtcctgtgttagtttgctgagaatgatggcttccagcttcatccatgtccctgcaaaggacatgaactcattcttttttatggctgcatactattccatggtgtataggtgccacattttctttattcagacacatgtacacgtatgtttattgcagcactgtttacaatagcaaagacttggaaccaacctgaatgcccatcaaagatagactggataatgtttaaaatatttagcacatgttatca

SEQ ID NO: 83913 - DNA, 601 bp, Human
tgtcgtgtgcgtcacagacaggtcgcacagatggacaaatgctgccttagtgtgtttccatccagtgaaacagttcatgtcttagagcttcagcacatgtgaggttcagattttcctttttaaagtgtttaaacttaaagtttaaacttaaactcacattttcctttttaaagtgtttaaacttaaagtttaaacttaaacacttttaagtttggattacaacatgtatgaatcaggaaataaaatgtttccatgtaaattggctttatttacagtagacttttccattattacataaacrtaaatttgcctgccttttcttattctccatgataattattcatagtcttgaaacacatttggaacacattaatatggaatgggcactgagcccatggagaaggatttgcagtgactccacgagccacctgttgacccctgaggtctggcgttgacccctgatgtccagcgttgacccctgacgtctgacgttcctgtcttcttggagtcgtgccgcaggtgcactctgcacagtctcaggagtggaactggaaagggccttatgtagagcaaagagcatgtggcttgaacttgaaccaag

SEQ ID NO: 83914 - DNA, 601 bp, Human
gcgttgacccctgacgtctgacgttcctgtcttcttggagtcgtgccgcaggtgcactctgcacagtctcaggagtggaactggaaagggccttatgtagagcaaagagcatgtggcttgaacttgaaccaagtgtggttctgccaagaccctcttgggatgggcggacttagagaggctggggatgacatgatggcatgcaggggtggtggcagatgagggagagggtagaagtggaggcaggtggtctcatgagactgttttgtctctgtttaggggagcatggttctgcctgtgcttagggaaacatggttctgtctctggttagtgggtcttggtcctctctctccgattaggaggtcctgtctctggtcaggggggcacagtccagtctctggttagggggtgtggtcctgtctctagttggggcacaatcctgcctccagttagggtcttcttttttttttttttttcccctgagatagagtcttgctctgtcacccaggctggagtgcagtggtgcaatcttgactcactgcaacctctgtctcctgggttcaagtgattcttgtgcctcggactcccgagaagctgggattac

SEQ ID NO: 83915 - DNA, 601 bp, Human
tgacccctgacgtctgacgttcctgtcttcttggagtcgtgccgcaggtgcactctgcacagtctcaggagtggaactggaaagggccttatgtagagcaaagagcatgtggcttgaacttgaaccaagtgtggttctgccaagaccctcttgggatgggcggacttagagaggctggggatgacatgatggcatgcaggggtggtggcagatgagggagagggtagaagtggaggcaggtggtctcatgagactgttttgtctctgtttaggggagcatggttctgcctgtgcttagggaaacatggttctgtctctggttagtgggtcttggtcctctctctccgattaggaggtcctgtctctggtcaggggggcacagtccagtctctggttagggggtgtggtcctgtctctagttggggcacaatcctgcctccagttagggtcttcttttttttttttttttcccctgagatagagtcttgctctgtcacccaggctggagtgcagtggtgcaatcttgactcactgcaacctctgtctcctgggttcaagtgattcttgtgcctcggactcccgagaagctgggattacaggt

SEQ ID NO: 83916 - DNA, 601 bp, Human
tccgattaggaggtcctgtctctggtcaggggggcacagtccagtctctggttagggggtgtggtcctgtctctagttggggcacaatcctgcctccagttagggtcttcttttttttttttttttcccctgagatagagtcttgctctgtcacccaggctggagtgcagtggtgcaatcttgactcactgcaacctctgtctcctgggttcaagtgattcttgtgcctcggactcccgagaagctgggattacaggtgcacatcaccacactcaagataatttttgtattttttagtacmgatggggtttcaccatgttggctaggctggtctcaaattcctgacctcaggtgatccatccgcttcggcctcccaaagtgctgggattacaggcatgagccaccatgcccagccttatttagggtctttatgctaggtgtgtgttcacttgacttgtagcccactggtcaacagttaaactggagggaagagggcacagaaaaagctcataaagtttggatgggaagctgggaatgtggagagattataagatgtgctcacagcttcatcaaagggtagaatagaccctgcagggaatga

SEQ ID NO: 83917 - DNA, 601 bp, Human
cgattaggaggtcctgtctctggtcaggggggcacagtccagtctctggttagggggtgtggtcctgtctctagttggggcacaatcctgcctccagttagggtcttcttttttttttttttttcccctgagatagagtcttgctctgtcacccaggctggagtgcagtggtgcaatcttgactcactgcaacctctgtctcctgggttcaagtgattcttgtgcctcggactcccgagaagctgggattacaggtgcacatcaccacactcaagataatttttgtattttttagtaccgwtggggtttcaccatgttggctaggctggtctcaaattcctgacctcaggtgatccatccgcttcggcctcccaaagtgctgggattacaggcatgagccaccatgcccagccttatttagggtctttatgctaggtgtgtgttcacttgacttgtagcccactggtcaacagttaaactggagggaagagggcacagaaaaagctcataaagtttggatgggaagctgggaatgtggagagattataagatgtgctcacagcttcatcaaagggtagaatagaccctgcagggaatgata

SEQ ID NO: 83918 - DNA, 601 bp, Human
tgagcatgcatttacgtgctatgcactctataatgaacaggaagattctcatttaattctcacagtgccctgcagacagacaagaaacagttcaagatcccacagctagcatggcagcacttgtttccagcctggatttggttcccatgtatgctgtcagtcccttctataagacacaggcacacgatgctgatggccgtggtccacttcagaagtcatcgaaaggactgagctgctcctagatccctgtcctgcttagggagacagctgttcagggaaataagcacctttctattttctrtcatgtcgtatccatggtccaactctaggatctccttgctagaagggccagaccacaagctaggtgcccatttcctgaagggcttgggatgctccagcttggaagaacccctgtgttctaaggaaccctgaggagttcctccggaagaagccttgcatgttctaagaagggggtgtgacagcgaggacccatgcttggtcttatccagagccacattgatatcaagcatttggcataggggtctaagcactgtccgggaatggaagaggtagaacaaacttcccacctccagaaccatcc

SEQ ID NO: 83919 - DNA, 601 bp, Human
gacacaggcacacgatgctgatggccgtggtccacttcagaagtcatcgaaaggactgagctgctcctagatccctgtcctgcttagggagacagctgttcagggaaataagcacctttctattttctgtcatgtcgtatccatggtccaactctaggatctccttgctagaagggccagaccacaagctaggtgcccatttcctgaagggcttgggatgctccagcttggaagaacccctgtgttctaaggaaccctgaggagttcctccggaagaagccttgcatgttctaagaagggrgtgtgacagcgaggacccatgcttggtcttatccagagccacattgatatcaagcatttggcataggggtctaagcactgtccgggaatggaagaggtagaacaaacttcccacctccagaaccatcctccacagccctgatcttcccaaacagaagcctcaaagtgggaagaggagagaggtcttaaacggactcctcccaattccaccatctctaagatctgtaaagaagtaaaaaaaatccttggagtttcttttataaaatgcagctgtcttgaaaggactctcaaaaaaattctg

SEQ ID NO: 83920 - DNA, 601 bp, Human
gcataggggtctaagcactgtccgggaatggaagaggtagaacaaacttcccacctccagaaccatcctccacagccctgatcttcccaaacagaagcctcaaagtgggaagaggagagaggtcttaaacggactcctcccaattccaccatctctaagatctgtaaagaagtaaaaaaaatccttggagtttcttttataaaatgcagctgtcttgaaaggactctcaaaaaaattctgaataagctataatcatttaatgagtgatgacaacatcaagatgttttcaagaagggtgttygccactgaaaattcgagttgtttagtgggaccttgtaatccccaaccagccacgagccccctctctggagtcaacagagcagtgtgagtgaaatgctaccctgtttaggatgcctgcccttgctcttccaatttgcatcaaatgtagatttgtgcattaactttttaaagtcgttgttgctctgtgaatttagattagaggaagatcaaggcaaaaagtatccctgacaaggtggacaaaaaccttaatcagtagaccttctagagtggaaaaagagtagaaaatagttcataggtctgt

SEQ ID NO: 83921 - DNA, 601 bp, Human
agaccttctagagtggaaaaagagtagaaaatagttcataggtctgttttgggtaggctgttccattccattatatcttagagatttcagcctttatgtgttactcatttttgctaaatatagtggaaattatgtaactatgaatcagcttaaaaattctaagtaatcactgaaaatgagtttttaaaaattaaagtgattaaaaagaactctgaaattaatatactttacttaatgatttattccatgatgttgtcaacaacagtactagaaatgtggcctctttccatcggaataaggyattaactgggaatgtgattatgccctgacagcttccccctattaatgtaaggaatagaaaactggggaacttcacacttaattagataaattgggatatgcaatataaggcttttctttatctgtgggattttacaaaaactcgactttgcagtcagttgtatattgtttgctttagttgattatatttgaaatgggtgattggaatgcgtctcgtgcctaggataataatgtgctatgatccgaagtattacatccttaagaaaaaaccaaaacaactctatttggcagttgcagaatt

SEQ ID NO: 83922 - DNA, 601 bp, Human
tgtttgctttagttgattatatttgaaatgggtgattggaatgcgtctcgtgcctaggataataatgtgctatgatccgaagtattacatccttaagaaaaaaccaaaacaactctatttggcagttgcagaattgtagaccatgtgaatacctagcacatgcccagagacagaagcgttgcaataaccttgccacagaacaaaaaggtcattttatctttactctgatgtagtctgatgctgtagaagcatggagtgaaatacttatttttatattaagtcagacttcaggatttatttyagccttcctttttgagaagctttctaagccctcagcattaagcagcatttttcctcatcacacacggatctgagcaggtgaccgcggctgggataggtgctgttgtgttgtgtgcaggtgggctggccagccattgggtgtgtgtttttcctagagtaagaagcactccaggctgagatgagagctgttgaaatgagtaacatttccgtctcctgtgatacgcgctgctgttgcttctttcaaatgatcagatttacattcttttaatgggtcctttaaaaatgtaatcgagtgagaagg

SEQ ID NO: 83923 - DNA, 601 bp, Human
tggccagccattgggtgtgtgtttttcctagagtaagaagcactccaggctgagatgagagctgttgaaatgagtaacatttccgtctcctgtgatacgcgctgctgttgcttctttcaaatgatcagatttacattcttttaatgggtcctttaaaaatgtaatcgagtgagaaggacttctaaagatttttctttggcctggatacacacgaggggattggaaattactaattcatgaaaatgaaaatgtgggcttcttttaaggaaaaattccctttgaacattgacagaagtgggcrtagggaaggggaagattttgcctggattctccacttaactcttgtcaccactggagcatcctgactccctagacacaagtgatggaagttattttgtttccactctaaacactgtctcagggggacattgatgggatggtggagggtgtgtttcattgtgacaacagcatctttggtggggaatttgctgttggtgaaaacccagtgctttctctgagcatgggtgattgataagggcctgacatgctccttcatttggaaaatggtattaatagaattggtttcccagtgaatagtgcc

SEQ ID NO: 83924 - DNA, 601 bp, Human
tgattgataagggcctgacatgctccttcatttggaaaatggtattaatagaattggtttcccagtgaatagtgccttttacccaagactcataaccaaatattttcacaaagatgttatatccccatgcatgagcattcattttgagatgttcattataatagagtttaagtatgaatgtgttttaaaaatgattttaaaatcatctgcaaaaaaatgttgtgtttcaaatggacagtgtctgggttttgtatagtcatcataaaaatgtctataattgtactgtttgctaataaacctrcctgctttcagaaaatcatcctaacgtgtgtgtgtgcaccaatggttttataagttcatttttctttggggcagctacagcaattttaggtttgttttcatattcctgtgaccctggtattttttcaaggttggttactagctatgggtttactgcagaagaagtaaaaaccacattgttgaatgggcacaatatgctctgcaatccttacatattcataccaaacagcaaagatatttgcaaaaccagactgccttaagttaatttttgcgcaacttaaaatgaccttgtcattgacca

SEQ ID NO: 83925 - DNA, 601 bp, Human
aacatctttgatttttttatttaaaaattaataaagaacttaacgacaagtataataatttaatctctatatgcaatgccatgtgtacatctacataagggaaccctgtgcgttttaccttgcttttgtatcagagtttttacttgaatctttccaagagaagaatcaccatctgttagtgacgtgttgcaattaaactatgaaatgattttgacaatagtttttctattttgaacacactttaatttttagggatgaattaatttatcttcagaagttcctttttgactctgaacatttyaattttatttttttttggtctagactggtgtgaaacagtgacattattttgtgtactaggatgtcctcttgtttagacagatttgtgttactaattagaaaactgctaatacccttatttcaatttactgagatagttgggattcttaaaacataaggagagagaacttgttggaaacatttttataactttagttaaaaacagtataaaaaacatgaaacccatttttaaatatttagtctacgtgaaacagttacacttccttcatgttacaggatcaacttcctcattgttcttgca

SEQ ID NO: 83926 - DNA, 601 bp, Human
aaaaacactgtctgccatggcacagaatgcctgtgatttattggtgggtggattatccatcgtgtatctctatgtatgttctcagattcttgccagaatgtattatttggcctttgggtaccaaaagattaaaaatgagatctaagaaaacttagtgtccaatagctctgaccctgtctacttgcagtgattaaaggcatatcctgactttgggggactcctggctgctggccatttggaaaatgagcagtaaacatgtcgtaagtctggagatgaagaggatgctaaatttgaggtgtcrttgtgacactgagatgtggtcacttggcttagcgctatagcacatgaaggcaaatatacatatagtcacattttagagattattcatggtctccgaccacttgaaaaaattgtgctttctccggaatttgatgtgctgaaaattgcactcgccccctgcttatttgcaaaatgaaacataaaaatgaagtccttcgcaaacataaggcttgctttttcttctcattatttaaaaaaaaaatcaaggcttgaaaataattatgagttatagctgtgtacagggtgacagcctgccatctcg

SEQ ID NO: 83927 - DNA, 601 bp, Human
attgtttgtccacagtctgttcacatgggcctcatggagtaaaacagaaaaccaaaagtatgagtgggcaggggtcaccttagtacatctataccaagtgcacgcaaggtccgttcctgtgcaatgtatcacaagatcagagaaatctatttctctgatctcccacctaaaacaattctggaaggaaatgaccttggctgacattctccttgtaaaagcttatctgtctgaaaatctgataagggccatagtgcccaacgctggggaaaatagtgtgttcatggagtcaacaccattgaayggtactctgccattactaaccacagtttctttgggagaagcgtggggagtgttcagtaaagacaacacagaagtaaaattccatcactcaagccatggcgtgcaagcacagagccaatgtggaagcacatttgccaagcagtgataatgtttgcattagaagatggtgttaaagatgatttttgaactatgttatttcttacagcatttctccgaaaattgctgtcaacttgtctagagccctctcgtctccatgtctttgaaaaggaccacatttgatcttctaacttggagtcctaac

SEQ ID NO: 83928 - DNA, 601 bp, Human
tccacagtctgttcacatgggcctcatggagtaaaacagaaaaccaaaagtatgagtgggcaggggtcaccttagtacatctataccaagtgcacgcaaggtccgttcctgtgcaatgtatcacaagatcagagaaatctatttctctgatctcccacctaaaacaattctggaaggaaatgaccttggctgacattctccttgtaaaagcttatctgtctgaaaatctgataagggccatagtgcccaacgctggggaaaatagtgtgttcatggagtcaacaccattgaatggtactcygccattactaaccacagtttctttgggagaagcgtggggagtgttcagtaaagacaacacagaagtaaaattccatcactcaagccatggcgtgcaagcacagagccaatgtggaagcacatttgccaagcagtgataatgtttgcattagaagatggtgttaaagatgatttttgaactatgttatttcttacagcatttctccgaaaattgctgtcaacttgtctagagccctctcgtctccatgtctttgaaaaggaccacatttgatcttctaacttggagtcctaacaggtctgc

SEQ ID NO: 83929 - DNA, 601 bp, Human
ggaccacatttgatcttctaacttggagtcctaacaggtctgcttggcagctgggataggacccccggtccatgcatcgtttttctgtgatgatctctgcattgaggagttctgcttcccttcccactcaccctgtccctccttgggacctctgcgttctgggccaggccttgggaggattccgctctgtcctccttccatgtctggtctggatgccagactaaatgtcagtagatttcagtaaaggctcagcgttgatgataatgcatgagctcataacattttataaccagtggaaccrtaaaccatttataaacatgaaatcctattgatttagagaaccattaatcctagacaaattttgacattttggaaagacagaaacagccaagctatattatctggagttttaaaacaagttcaggacccatctaatgggccatttcatgttttaaatccactgttccatttttctcattgtcagtgactctaatattactcaaaaaattaaaaaaaaaaattgccagagaagtttatggctagtgacctcctgctcccaaaacaagttatccttttcccttttttcgaagagcctctttga

SEQ ID NO: 83930 - DNA, 601 bp, Human
cagatcgtaaccgtttcaacagccccagattggttttgggttattagaacagagagaaggcgctagcatctcctaggctaacagtacaatttcggctacctgtaattattgaattcccattaagcaactacactgggaatcctgttattaaccaatttatcacaccaaggaaccatgtaatcacagagtaatctaatctgagttcttgttaacaaaatgactcgactttatctgtcgagttgattcctgtttgcactccccattatgctgccctgggaatctgcaaccagaggcaggttcyttggtagagggcacttatgagtctgtgagtgcccacttggaaacgcctgccagcaagttgaccctgaggtccgccccccagcccatctccccatctgtcacatgtgagttgcagtggatctgcgtgtgggatgacgcccgtgcaccagccaggcaacgtgtgcagaggtgtgaaggaataatgtgcattgttctggacactgcttcctgctcaaggacttttcttggggaagcacaccaagtctctcggttgagtttgacacaccaagtctctgggttgagtttgacacaccgagtctct

SEQ ID NO: 83931 - DNA, 601 bp, Human
caactacactgggaatcctgttattaaccaatttatcacaccaaggaaccatgtaatcacagagtaatctaatctgagttcttgttaacaaaatgactcgactttatctgtcgagttgattcctgtttgcactccccattatgctgccctgggaatctgcaaccagaggcaggttccttggtagagggcacttatgagtctgtgagtgcccacttggaaacgcctgccagcaagttgaccctgaggtccgccccccagcccatctccccatctgtcacatgtgagttgcagtggatctgcstgtgggatgacgcccgtgcaccagccaggcaacgtgtgcagaggtgtgaaggaataatgtgcattgttctggacactgcttcctgctcaaggacttttcttggggaagcacaccaagtctctcggttgagtttgacacaccaagtctctgggttgagtttgacacaccgagtctctgggttgagtttgacacaccgagtctctgggttgagtctgaagcagaaacctgactggaggaggcagcatcagaaggttaacggtctggccaactctggctgacatcgaacaaaggtccctttag

SEQ ID NO: 83932 - DNA, 601 bp, Human
atgctgccctgggaatctgcaaccagaggcaggttccttggtagagggcacttatgagtctgtgagtgcccacttggaaacgcctgccagcaagttgaccctgaggtccgccccccagcccatctccccatctgtcacatgtgagttgcagtggatctgcgtgtgggatgacgcccgtgcaccagccaggcaacgtgtgcagaggtgtgaaggaataatgtgcattgttctggacactgcttcctgctcaaggacttttcttggggaagcacaccaagtctctcggttgagtttgacacaccaagtctctgggttgagtttgacacaccgagtctctgggttgagtttgacacaccgagtctctgggttgagtctgaagcagaaacctgactggaggaggcagcatcagaaggttaacggtctggccaactctggctgacatcgaacaaaggtccctttagtcttaatagctaaatggatcaaaaggcagcaacacctgctcttctggttagagtagtggacttggagaaaagctgccggtagatgttccagggcactgggactgccctgcacacagacctccctctgtatttgagacagc

SEQ ID NO: 83933 - DNA, 601 bp, Human
gctgccctgggaatctgcaaccagaggcaggttccttggtagagggcacttatgagtctgtgagtgcccacttggaaacgcctgccagcaagttgaccctgaggtccgccccccagcccatctccccatctgtcacatgtgagttgcagtggatctgcgtgtgggatgacgcccgtgcaccagccaggcaacgtgtgcagaggtgtgaaggaataatgtgcattgttctggacactgcttcctgctcaaggacttttcttggggaagcacaccaagtctctcggttgagtttgacacaccaagtctctgggttgagtttgacacaccgagtctctgggttgagtttgacacaccgagtctctgggttgagtctgaagcagaaacctgactggaggaggcagcatcagaaggttaacggtctggccaactctggctgacatcgaacaaaggtccctttagtcttaatagctaaatggatcaaaaggcagcaacacctgctcttctggttagagtagtggacttggagaaaagctgccggtagatgttccagggcactgggactgccctgcacacagacctccctctgtatttgagacagcgg

SEQ ID NO: 83934 - DNA, 601 bp, Human
gggaatctgcaaccagaggcaggttccttggtagagggcacttatgagtctgtgagtgcccacttggaaacgcctgccagcaagttgaccctgaggtccgccccccagcccatctccccatctgtcacatgtgagttgcagtggatctgcgtgtgggatgacgcccgtgcaccagccaggcaacgtgtgcagaggtgtgaaggaataatgtgcattgttctggacactgcttcctgctcaaggacttttcttggggaagcacaccaagtctctcggttgagtttgacacaccaagtctctsggttgagtttgacacaccgagtctctgggttgagtttgacacaccgagtctctgggttgagtctgaagcagaaacctgactggaggaggcagcatcagaaggttaacggtctggccaactctggctgacatcgaacaaaggtccctttagtcttaatagctaaatggatcaaaaggcagcaacacctgctcttctggttagagtagtggacttggagaaaagctgccggtagatgttccagggcactgggactgccctgcacacagacctccctctgtatttgagacagcggcttgtcca

SEQ ID NO: 83935 - DNA, 601 bp, Human
caggttccttggtagagggcacttatgagtctgtgagtgcccacttggaaacgcctgccagcaagttgaccctgaggtccgccccccagcccatctccccatctgtcacatgtgagttgcagtggatctgcgtgtgggatgacgcccgtgcaccagccaggcaacgtgtgcagaggtgtgaaggaataatgtgcattgttctggacactgcttcctgctcaaggacttttcttggggaagcacaccaagtctctcggttgagtttgacacaccaagtctctgggttgagtttgacacaccragtctctgggttgagtttgacacaccgagtctctgggttgagtctgaagcagaaacctgactggaggaggcagcatcagaaggttaacggtctggccaactctggctgacatcgaacaaaggtccctttagtcttaatagctaaatggatcaaaaggcagcaacacctgctcttctggttagagtagtggacttggagaaaagctgccggtagatgttccagggcactgggactgccctgcacacagacctccctctgtatttgagacagcggcttgtccagatagtgcctgggggcctg

SEQ ID NO: 83936 - DNA, 601 bp, Human
ggccaaaaattatgttgtgtcctcccctgtgtcctcccacaatgagaccccttccttgccacagacaaatagggctctgcctggaggcattgtcagaaccactccagatggagtctgtggcctggttctattctatcagaacttatcgaagatcctgaaacattttctgcaagacatactccaggatctttttggagcctggctcccatgccacggtcccctcctttccgtcttctaggattctacagtaagatcttggatagaatgggtggggccagcagggtctgcttgtgagtgaccrgctaccacagtcgctgtgctaaggggagcgtgagagttactttgtccccttttcacttgcctgtggacagcaggtggaggtctagctggatgttttctgggtgatgtttgttctgagcaccatcacggtcccaggccaccagacgtgctgtgtgcacctgctttcccagggcggctccagtgcaggggctcattctacagccacacgggcacgtgggaagccggggctccaaaccttgttgtggtttctgaggactctggctgtggctttgcacagtccccttgcaacctcccaggcctc

SEQ ID NO: 83937 - DNA, 601 bp, Human
aaaccactgaggcatgagaagatagtcattgctgtggattcagtgctttggaaagagtggggtaccacaaaatattcaatgaaaaaggtagagacaggtcaagtatggattcagaaggattctgatctcagattctgccacaggactttgctccactttaaagacaggaaaattggtgtggctcatggcagatcatttgaaactgtagtgggggtgccacattcaaagaaaacgtctgggcctcacctctaaaggctgccctaacttgaaatcattcaaatgggagatttcaattcatgcrattcaaattaaaataacatgtttaagttaggtacatgtcaattttttatgatttccccattgattgatttttcaattaatggaccagaagtgaactttcactccctttatcatctcttcctgcagacctcagaaaactcttatccaacataataaccaccttaagagtaatcgttaaactttaattatttccattataacatgatagggagtttaggaagcagcatttgatgagctatgttccacttggtagtcacagtgcagtctttatttgaatactagttcatttcttgagtttcac

SEQ ID NO: 83938 - DNA, 601 bp, Human
ggattcagtgctttggaaagagtggggtaccacaaaatattcaatgaaaaaggtagagacaggtcaagtatggattcagaaggattctgatctcagattctgccacaggactttgctccactttaaagacaggaaaattggtgtggctcatggcagatcatttgaaactgtagtgggggtgccacattcaaagaaaacgtctgggcctcacctctaaaggctgccctaacttgaaatcattcaaatgggagatttcaattcatgcgattcaaattaaaataacatgtttaagttaggtacrtgtcaattttttatgatttccccattgattgatttttcaattaatggaccagaagtgaactttcactccctttatcatctcttcctgcagacctcagaaaactcttatccaacataataaccaccttaagagtaatcgttaaactttaattatttccattataacatgatagggagtttaggaagcagcatttgatgagctatgttccacttggtagtcacagtgcagtctttatttgaatactagttcatttcttgagtttcacactagtttatttcattgacaggactcaatgaaata

SEQ ID NO: 83939 - DNA, 601 bp, Human
caggctaccgagggccacatctctattcagtttctgaagatgccacccaaatcacccgtctgtaaaatcacatctgcagtaaaagttctcgatgagtagtcatgcattttccctgctcgtatgagataaccagagcgatcacagtgcctcgccctctacctagtgagtcttcctaagtcttggcaaattcctgtggtgcttggtcactcgcagttcttctagcaagtggaccagtggctgatgtattcggattcatgtagagtgatgtttgagccagttcaaaacagtgaccactcgagtmattcctgaaaggacagatttctgtccttcagagacttattcagtcacttttaatgtcactttttataggagtgaattctggatttagagctaagttcatttaaattatttcagttaggttaaacagtgttcacatatatatatattttttttcgatcacccacagaatattacgtaggtttaggctgaacagctcattctctgaacctaccctggatgtcttgactcactgttgcttggttgcgttaaagacggtatgagctttagcttccaaactaacagaagctgaactctgagtacg

SEQ ID NO: 83940 - DNA, 601 bp, Human
tgcctcgccctctacctagtgagtcttcctaagtcttggcaaattcctgtggtgcttggtcactcgcagttcttctagcaagtggaccagtggctgatgtattcggattcatgtagagtgatgtttgagccagttcaaaacagtgaccactcgagtaattcctgaaaggacagatttctgtccttcagagacttattcagtcacttttaatgtcactttttataggagtgaattctggatttagagctaagttcatttaaattatttcagttaggttaaacagtgttcacatatatatatwttttttttcgatcacccacagaatattacgtaggtttaggctgaacagctcattctctgaacctaccctggatgtcttgactcactgttgcttggttgcgttaaagacggtatgagctttagcttccaaactaacagaagctgaactctgagtacgtgccaggtcatctacactctgcacttcctaacgtactgatgttcacggagggtcattttatgtcagtgttacagccctttgttgttgattcaaaattctcttttgcaagatgagtggagtgaaaagtttcccattaagcaaact

SEQ ID NO: 83941 - DNA, 601 bp, Human
ccagtttgctcctgtctctgctttcgttgtacaaaaccaatgcaacacctacagctaagatgatatttaaattaaatttagaagtgaacataagctcctggatgaagtaaataatatgatttcgttataagcacagggaatgtgggatgtttcaatgcagatttatggtgttttaaagaaactttgaggaaaaaccaaccacatacacatatgctgactccatggcttatgtttgctctaccccacctgtcctgctacaactgggactggcaaagtgcggcctgcaggccaaatcccgccrgggcctggttttgtccagcaaactaagaatggattttacatttttaagcacttgaaaaaaaattgaaagcatataatatttgtgacacatggaaatgatccgaaattcaaatttcagtgtccatgaataaagtttttacttttgaaaataaaatggtgaaaatttttatgaaaatacctatttctagtatcctcaattttgcctcttggtctgcaaatccctgaacatttactctctggctctttagagaagaaaatgccaagccttatgttagaatgtcttactcccattgccataact

SEQ ID NO: 83942 - DNA, 601 bp, Human
ataaagtttttacttttgaaaataaaatggtgaaaatttttatgaaaatacctatttctagtatcctcaattttgcctcttggtctgcaaatccctgaacatttactctctggctctttagagaagaaaatgccaagccttatgttagaatgtcttactcccattgccataacttctgagttactttccctggctttattctctggtcagttctgtcagacccctgaggccgggcagattttggcctttgtaggggaggttgctaattctcccccctaattaaaaaattaataataatgaycttggggtctttctgtagtatattgttgaaggttgtataaacataaagggttgatgatgagaattttctggaccaggctggagttgccttggctgtttcttggtccagccacctaggaacagctggggagtgtttcatgccttcacagtttctcctattttatccagcctttcctctctgacatttttaacatgcagatgtgtattttctgggtattattttgtgtccaggcacagacatgataaccggaatgttaaatttgtggcaggagaaaagctcccatctgcattagcttataaa

SEQ ID NO: 83943 - DNA, 601 bp, Human
tgtcagacccctgaggccgggcagattttggcctttgtaggggaggttgctaattctcccccctaattaaaaaattaataataatgaccttggggtctttctgtagtatattgttgaaggttgtataaacataaagggttgatgatgagaattttctggaccaggctggagttgccttggctgtttcttggtccagccacctaggaacagctggggagtgtttcatgccttcacagtttctcctattttatccagcctttcctctctgacatttttaacatgcagatgtgtattttctggrtattattttgtgtccaggcacagacatgataaccggaatgttaaatttgtggcaggagaaaagctcccatctgcattagcttataaacactctgggggcaaatttccacgtacagagctactcaccagagtaacagtgtgcacagaaggtcttctgtcaacattgctagtcagtactttttatcccctttgctgtgtaaacttctctgcatcatgggttttaaattgaaaataacttttgttttcctcattatattgtctgttacatcaacatttgacaaaaggattgtctgctacatgc

SEQ ID NO: 83944 - DNA, 601 bp, Human
gtggcaggagaaaagctcccatctgcattagcttataaacactctgggggcaaatttccacgtacagagctactcaccagagtaacagtgtgcacagaaggtcttctgtcaacattgctagtcagtactttttatcccctttgctgtgtaaacttctctgcatcatgggttttaaattgaaaataacttttgttttcctcattatattgtctgttacatcaacatttgacaaaaggattgtctgctacatgccgtgattgtctcagtgggcttgcaaaactcagacgtgacctcatggttmtgtgcagtttgttgatcaagtgaccatattctgctccaaagtgttgccaggcactttctgtgattcatcatatttcagccagaattggaattacagtatggctgtctctatcgtctttccatcatcacctcccacatgaggtgcctttggaaccccacagcaggccattccgttctcccgttggctttgtcaggagagagggggatgaacagcctgtgccttatcccctccccttgttcctcaccagacacggtgattttgtagtccttacccctttcctcctcatggcaagccccaaga

SEQ ID NO: 83945 - DNA, 601 bp, Human
attggcagcttgggataggcaatgaacctgacaatgagaggacaaaggcttcaggcacctgaaatgtacaagaggaatcttccaggaccttggagtacttcagtaagaaattgcttttctgaatcttttcttctcttttctttacttttcttttctctttttcttcttcttcttcttcttcttcttttttttttttttttttttttgagaccgagtttcgctcttgttgcccaggctggagtgcaatgggcacaatctgggctcaccacaacctccgcctcctgggttcaagcgattctcytgcctcagcctaccgagtagctgggattacaggcatacgccaccactcccggctaattttgtatttttagtagagacggggtttctctatgttggtcaggctggtcttgaactcccaacctcaagtgatcttcccgcctcggcctcccaaagtgttgggattacaggcgtgtgccaccatgcctggcccgagatattgctcttctaaagcccttcctgaaaagactttactgcagtcactttgtagaaagcacatattcctccattacggtcagtaagcaaatagttattaagtacatac

SEQ ID NO: 83946 - DNA, 601 bp, Human
tacctgaatttttttgtgtgtaaatacacacacatacatacctttgtaaatttattttcaaaagtagtgacaattcggggcatgcaggtcttcagttaatcctttttggaccaatagcaaaagagggaatatatgcacctttgtatatttattttaaaaactggtgacaatttggggtatacgtgttttcagttattccttttacggaccgttggcaaaagagggcatcacgggtagacatttgaaaagaaacaaagaagggcaggcccatggcagagctggtgctgcagtttttgtgacrccactgcaggaatgataaaggaggagggtggctgccggcctcagcctgagagccgcaccatggccacgtcctgggtggcagggactccgaggagcagggcacgggagggctggacggcatctgctctttcatgctgacaccacagggagatctaagtcagcagggccctgggtgttaggaagggtgttgagaaatgtcagagaaagatcactgcaagctttcttcccggccacatatccaagctctgcttagtgtctccgagaccttgaagatggggcctgagaggcaggactaacaact

SEQ ID NO: 83947 - DNA, 601 bp, Human
caaaagtagtgacaattcggggcatgcaggtcttcagttaatcctttttggaccaatagcaaaagagggaatatatgcacctttgtatatttattttaaaaactggtgacaatttggggtatacgtgttttcagttattccttttacggaccgttggcaaaagagggcatcacgggtagacatttgaaaagaaacaaagaagggcaggcccatggcagagctggtgctgcagtttttgtgacaccactgcaggaatgataaaggaggagggtggctgccggcctcagcctgagagccgcaycatggccacgtcctgggtggcagggactccgaggagcagggcacgggagggctggacggcatctgctctttcatgctgacaccacagggagatctaagtcagcagggccctgggtgttaggaagggtgttgagaaatgtcagagaaagatcactgcaagctttcttcccggccacatatccaagctctgcttagtgtctccgagaccttgaagatggggcctgagaggcaggactaacaactctgaggcaatcataacaaaacatgaattgtttggttaaaaggtcaggaaagaaaaaaa

SEQ ID NO: 83948 - DNA, 601 bp, Human
atggggcctgagaggcaggactaacaactctgaggcaatcataacaaaacatgaattgtttggttaaaaggtcaggaaagaaaaaaaaaaaaaagtctctcactgtgctgtcattagaagcaaagaccgagaaagtgacaagcatctcctagaggaatggttagcaagtggaaactaattttacagtacctaatagtaattacagtactagtattgggttattggattgatgtaaatgtgctgtttttactgccatagtctcacaacactgtttccttcataagatcttaaattctcaatggaaagttctcttctcacattcctgggtgactggatggggcatttgtgtgtgcctggtctggttgcagagttcagcagcatgctgtgggcccctccctggaagatgtgttcagtactcagtgcaggggagggcaagtgacccagttgttgatttgctgctcttttaaatgccttgttaattttcagccagttcagagcttctagcatgtcagggagcagcacgttggatagtgctgaaatcaaagcatgaccttctaagtgtggtcttcaaaatgttcattacatagggtatggcaattgt

SEQ ID NO: 83949 - DNA, 601 bp, Human
tgtttggttaaaaggtcaggaaagaaaaaaaaaaaaaagtctctcactgtgctgtcattagaagcaaagaccgagaaagtgacaagcatctcctagaggaatggttagcaagtggaaactaattttacagtacctaatagtaattacagtactagtattgggttattggattgatgtaaatgtgctgtttttactgccatagtctcacaacactgtttccttcataagatcttaaattctcaatggaaagttctcttctcacattcctgggtgactggatggggcatttgtgtgtgcctgktctggttgcagagttcagcagcatgctgtgggcccctccctggaagatgtgttcagtactcagtgcaggggagggcaagtgacccagttgttgatttgctgctcttttaaatgccttgttaattttcagccagttcagagcttctagcatgtcagggagcagcacgttggatagtgctgaaatcaaagcatgaccttctaagtgtggtcttcaaaatgttcattacatagggtatggcaattgtcacactgaatcaattcagaggctgtatcctaggtttacctgtatggaccttagcta

SEQ ID NO: 83950 - DNA, 601 bp, Human
aagcatgaccttctaagtgtggtcttcaaaatgttcattacatagggtatggcaattgtcacactgaatcaattcagaggctgtatcctaggtttacctgtatggaccttagctagagatggtggttgttgcagatataaaaaaggcatggtctctgctctcaaagaaaatgtttttgccgttaatttattctcttaagtttgatctctcttgttctttcagttttcttactggatgcaacaaccgtttttttcttctgcattcttacccaggtttgtgcactagctgtctcttctcgatractaagccatcatttatgtcagcatcttgaagggctttttcacttaatagtctcaaagtgacattaattagaggcataaaatgataccaccactattgctgggagaaattaagtttcaaaaagtagtaaaggcactgttttcagtgattccctcctatgtttgagagccactctgagcagtagatttggcttgtttctgaatctaaggtctcaccaggagtttgccagattatgccccggacatgtacttattttagatgtcagctgtttacagctaaagtggatttagacttcaccata

SEQ ID NO: 83951 - DNA, 601 bp, Human
tatgaacatgcattttctatagtgtttcttgtatacagttgtgtcccaattgattagtttaagggagatctatttttgtcatcccatgtgagaacttggaagtaatatatctctaagaacatgatagttagatctgatagcattctaatgctgaatctccatatagattaaaggattttgagggctaccctggcaacctcaacacaaattacttagcaatgatgtttggagcacagctaattcagaagttgagttgggtctgtcttcatcccatttctctttaccttactttttttccatkgtagggcaaagttctcagaatcacacacatcccattcccctaaagccaggaatcgagatttaaaccctggaaggatcacctgtacatgtaaactccatgtggtctcatttaacatgtcaggataattttcaacaagcctagttatttctacttagtgttctaatcatagactttaatggactttgctacaaaggagccgacataacgagccggcctccccaggcctgccagtcccagttcatctggggcttgctgtgtgtcagcactgtgcatggcctgtgctggggaacagttgcttgg

SEQ ID NO: 83952 - DNA, 601 bp, Human
gagacttctccgccacatttatcgccatggagtataccgggagctgtagctatttcgctttccctgtctccctccacgagaaggtcaacacaatgtgggcagaggtttttgtctgttcccgggcgggcaaactttcagtgcccacctcagggccagaagtagagtagatgactgagaaatatcttttgaataatgcttgagtgaatgaatgaatgagtgaatgaatgaggagtctgtgtgagtgcccttttgggtgaactgataacatgcccttttgcttctgaaagggaaaataggactytcacaattttgtgatgcgtctgtctaaatagtattcatattagcccattttaaatttcctcaaacaagtagaaaaaagatcagtcgtcttctgcttccgacacccagttttgaaaataaatagcttagtcttgcacctaaaccaggcccacttccgtgtctggataaagccttcctttttttttttttttttttgccctgaagcaatcctggtggacgtgttccaggaagaaacacccttaatgaactcagtggctttctttcgatggtgtggacaaattaacttttattggcctcgcag

SEQ ID NO: 83953 - DNA, 601 bp, Human
tcttgagcagctgagattacaggtgcccgccaccacaccccactaatttttgtatttttgtagacacgggatttcaccatgttggccaggctggtctcaaactcctgacctcaggtgatccacccgcctcggcctcccagagtgttgggattacaggcgtgagccactgctcccggccctgcctccttgtttttgttgctcctctctgtagccctgtcccagcaacttgtatgcttcctttttcacagagccatcatgcatgatgaagaaaatggaatgcatcagtattttatagacattmttattgtcagaaatacatgcagatttggacagggacaaatacagagatgaacactattattaaggcaggactttttattttttagctttagtgccttttaatcatattttcataatataaaatcataacataaatatcaggaaagctagtaattattattttgtgtgtggactgcctggctatattataaacagggcaaagcttacattttccttccttcattcatgcagtcagggaaatactaagttgcaaaatgatgacaatgatacaaacaagtcatttggcccagaaggcaccagg

SEQ ID NO: 83954 - DNA, 601 bp, Human
gatgctttctccagaagatgaattggcatgaaccctaccaggcctgggagggtaggagcttctgtagccttttcaagtaaaagggaaaatccagacttgcattagcaaaaaaattaaaaaatttaaaaaatgcctgcattttcttatttatttatttattttctgagacggagtctcgctctgtagcgtaggctggagtgcaggggcacaatctcggctcactgcaagctctgcctcccgggctcactccattctcctgcctcagccccccaagtagctgggactacaggtgcctgccacyacgcccagctaattttttttatttttagtagagacagggtttcaccgtgttaggcaggatggtctcgatctcctgacctcgtgatccacccacctcggcctcccaaagtgctgggattacaggcgtgagccaccgcgcccggcccaaaaaaatgcctgcattttcattagttcatgttggttccccattttcaggggagagagaagatgagtgggccggtctgacagcccagatgtgaattctggcattaacatgtcttaccagctttttgaccttggagaaggtactgagcatatccaa

SEQ ID NO: 83955 - DNA, 601 bp, Human
gaaagaatatgaaatgtgcttcccatttcaaaatttcaaagaaatgataacttatatttggggtttcgaacttgaatattctattgcaaataaataaaagccattagtttcaacagaaaaagaaaagaaaatggcttccctgaaaacaattcaaaggattgcaaccttgcaggacagagaccaactctagcatttgtagtactgggagagataaggaattgatgaagtgtcaagaggaaaaagaaaacagaacagtgggatcattgcacacttttattgatggagatctgcagcgaggttyccccccgccccgaaacttttatgagtattataaggcagtggctgaaattgtgatgttctcagacatctctatagaatatgttcttggagcagaaaggagcctctagggcctctcctctcatttggaccatgttcctttcatatcaaaaaatgtagctcagaggctaggccagggtgaactaaaacaaaatccaggtctcctgacgctacatcagctcccctgcccgtgacaccaaatgaactggtcctgtccttttctctggaaaccaccaagacaaagcttcatgtctccatttagtga

SEQ ID NO: 83956 - DNA, 601 bp, Human
acctcctctcctcaaaattgggccattctcagctaaccaggtggaagactttgatctctattaagtgggtaggttttggcaagaacaacctaatcatcctgctagagagtgcatagccaaattgggatgggatcacctcactgtgcccagctttccccttggctcttggaggggtgagcctgggaagccaggaaatcagactctaagcccacaccttcgtgattcctcagcgtttatgcacagctgctgcagcggtgcacaattttccatgtgggttctttctgctctgtaacttaaatartccccttatgcttcctctgtaattgtgatgcagtatttattctgtttgggcattggtaattagagcaaattcagagatttcttatcccctgacaggtctctctgattctgagtgatttgtcaatatgaggacataagatacagcaagtatatcatttctacccatctagcatcaatattctaggttaacgcaagtcacatcacgcaaacatgttctgtgatggctttttatttctgctgctgggagaatgagacctttttcatgtttccaagagatgctgtcatatacattatacataca

SEQ ID NO: 83957 - DNA, 601 bp, Human
ttatgcacagctgctgcagcggtgcacaattttccatgtgggttctttctgctctgtaacttaaatagtccccttatgcttcctctgtaattgtgatgcagtatttattctgtttgggcattggtaattagagcaaattcagagatttcttatcccctgacaggtctctctgattctgagtgatttgtcaatatgaggacataagatacagcaagtatatcatttctacccatctagcatcaatattctaggttaacgcaagtcacatcacgcaaacatgttctgtgatggctttttattyctgctgctgggagaatgagacctttttcatgtttccaagagatgctgtcatatacattatacatacatattaggtatatgtgtgtcatacacacacagagttccaaagcaggaccccaggttgtatgggctgatgaacaattaagcgtatatttgaacagcctgaatgccgatgaactgtgaacccctcaaaggctgggcccgaattcctttgactctcacatcccctcattgcctggcacagtgtccatcacttcagtgatgtttggcagaaaccttctaaatgtgtgaatgaatgata

SEQ ID NO: 83958 - DNA, 601 bp, Human
gcttcactctgggcagtgacagattctgatcatgtgcttgatatcctcaagtaaagcttctcacgatcatttctggtcttctccaaatagcagagtatcattaggctgtcaccagccaatggacacttcaagagactaaatgtttggcgtaggaaatctaagaggcaaagagcgctgtcggggttgccacactgtagttgctggtgagtttacccaatgagccaccaagacctacaccccattggtctgaggatctcctgcccaggaatcccatagctgctacagtgaattagcactgttstaataattgattgggttttttaaatccactgtcccatttgccttgttcttagccttcaatgactcccattagtgacttatttaggtagcctgtgtgaccctgaacttccccagaagacacaagcataatactaagagctctgaaataagcaggataattcttggcattcatgcaagcccgcactgcataaagcagagtgattttagtgaattgccccagtgttttacaagggactaaaaggcgtgattttgcatactttttgcacatctaacctacttgcagaattcatcccactgaaat

SEQ ID NO: 83959 - DNA, 601 bp, Human
aaggagagtctcttacgaaaaataatttggaagctactgagagcggttgtagccagtgacacagaaattcctgcacaggttaagaactacagggaagcacttgcctgacaaactcaatagtgaaaagaagtcctattaaagagattttacaataaacatgttctaagaaacatacattgcccagggccatcagcgggattcaaagaatactggcttcccaaggagcaggcccatgacccctttgggccaggtcagaccttaagtatagtgtggaaatgtgggggcaagatttgtcacttgyattcaaactcatgggctccgaggtgcctgccctcactaggactcttctgaatgcagatgaaattctgttggaagcccctgtatgctttattggggtggcaagtggggagaggaactgactttccccagcttcaagagtgttctccagctcctgatttgtaggctttagaatattttccaagaaaagttccattgattttatttttatttttttgagatggagtctcgctctgttgcccaggctggagtgcagtggtgtgatcttggcccactgcaacctccacctcccgggttcaagcaa

SEQ ID NO: 83960 - DNA, 601 bp, Human
tcttacgaaaaataatttggaagctactgagagcggttgtagccagtgacacagaaattcctgcacaggttaagaactacagggaagcacttgcctgacaaactcaatagtgaaaagaagtcctattaaagagattttacaataaacatgttctaagaaacatacattgcccagggccatcagcgggattcaaagaatactggcttcccaaggagcaggcccatgacccctttgggccaggtcagaccttaagtatagtgtggaaatgtgggggcaagatttgtcacttgcattcaaactsatgggctccgaggtgcctgccctcactaggactcttctgaatgcagatgaaattctgttggaagcccctgtatgctttattggggtggcaagtggggagaggaactgactttccccagcttcaagagtgttctccagctcctgatttgtaggctttagaatattttccaagaaaagttccattgattttatttttatttttttgagatggagtctcgctctgttgcccaggctggagtgcagtggtgtgatcttggcccactgcaacctccacctcccgggttcaagcaattctcctgcc

SEQ ID NO: 83961 - DNA, 601 bp, Human
gtgcccgccaccacgcccgactaatgtttgtattttttagtagagacgggatttcaccatgttggccagactggtctcaaactcctgacctcaagtgatccactcgccttggcctcccaaagtgctgggattacaggcatgatccaccgtgcccggcctccactgatattttaacttggtcatttgagttcattgtcgtatcatataataactatgtatcagtgtacacagagtgcattttcctgttttctttttttgtttgtttgtttttttaaaccatgagatgcaactaaaataccarcttcccagttcagatctggtacataaagtaagccctgtgaatccctcgttctaaagtcctagaacttgcccttcaagggattggttgggtgctgagtggagcagagtgttacatttttaggatttcatgagattgaaattggccacggtagcagtatttacaccatggaaatcagcagatgctacttcccttccctccagagcctgttgttccagatgtcccagcccagtgctggctgccactgctcacagctgtcactcctgggactctgtgctgtacccagggtctgggaagggatgg

SEQ ID NO: 83962 - DNA, 601 bp, Human
aggaacacaacagagacctgcctttctaccttccaccgtgagcttgtgctggcagcaactgaactaggattgattttaaagtaaaaccatcctttgtcttgatttaaggtgcccaagtcctcagatgcttaagaaccaggcactgtgccatgttctgggataccggagtgaatgacatttcgtgatgatggaaatgttccgtagctgcactgtcttatgtatgtggctatcgagcatttgaaatgtgactgctgtgactgtgaagtttcaattgtcattgagtttgaatttcaatagccaygtgcagctagtggccactgtattggatagagcagctccagagtttcagggacagtcttgtgtggcagcctgtgtgccgggcatataggggatgcattcatcacattggacgcccacaagaccactaagtcctccccagacccctgctccagcattgctggccagcaagatcaacactcatgccactagtggacatctacccattcagacacacctgccactaggctgaacacattagaaggtcaccccatgtcattccatcccctgtctgcaggacagacagtgatctcaacttacaggt

SEQ ID NO: 83963 - DNA, 601 bp, Human
tgcctttctaccttccaccgtgagcttgtgctggcagcaactgaactaggattgattttaaagtaaaaccatcctttgtcttgatttaaggtgcccaagtcctcagatgcttaagaaccaggcactgtgccatgttctgggataccggagtgaatgacatttcgtgatgatggaaatgttccgtagctgcactgtcttatgtatgtggctatcgagcatttgaaatgtgactgctgtgactgtgaagtttcaattgtcattgagtttgaatttcaatagccacgtgcagctagtggccacygtattggatagagcagctccagagtttcagggacagtcttgtgtggcagcctgtgtgccgggcatataggggatgcattcatcacattggacgcccacaagaccactaagtcctccccagacccctgctccagcattgctggccagcaagatcaacactcatgccactagtggacatctacccattcagacacacctgccactaggctgaacacattagaaggtcaccccatgtcattccatcccctgtctgcaggacagacagtgatctcaacttacaggtgaagaaagaaggcacaga

SEQ ID NO: 83964 - DNA, 601 bp, Human
gtacggttttcctttcttgtgttcgtgggtgttcagccctctcaggttcttctttgggcacacactcctgtgagtatgcacattagtgtacatatttcattttacaccatttggtgaactttatttcaccaaagatgttggcatctttctcttttgctgtctggtttaattcactaccaactatatcaacatcagtgactgggtcaatgtttgaccttttaatttttttgcaggaatgtggactactgatcagtaaatcactggtctcccccaccccacgcctgatgagtgttgcttttgsatctgtactgatggaaatgggatgaaaatggagatgtaaacccaagactgaacaaggccttttggaaatgttatatggtgttagattacctatgaatctactgttaagatttttgtacatttggctggcagttctttttgcttaagagcatcaagctgtagacaggcctcctgcaccaagctggagcagccagagcccagggcaggacctgccccagcctctccactgctggagctgggcctttcacctcagcctccaccttaaggcaggaggtgtttcctccccattctttgcagtcag

SEQ ID NO: 83965 - DNA, 601 bp, Human
cttctttgggcacacactcctgtgagtatgcacattagtgtacatatttcattttacaccatttggtgaactttatttcaccaaagatgttggcatctttctcttttgctgtctggtttaattcactaccaactatatcaacatcagtgactgggtcaatgtttgaccttttaatttttttgcaggaatgtggactactgatcagtaaatcactggtctcccccaccccacgcctgatgagtgttgcttttggatctgtactgatggaaatgggatgaaaatggagatgtaaacccaagaytgaacaaggccttttggaaatgttatatggtgttagattacctatgaatctactgttaagatttttgtacatttggctggcagttctttttgcttaagagcatcaagctgtagacaggcctcctgcaccaagctggagcagccagagcccagggcaggacctgccccagcctctccactgctggagctgggcctttcacctcagcctccaccttaaggcaggaggtgtttcctccccattctttgcagtcagcaaactgtctaactcagccacagcaatcctcttaaggaaactttgtgc

SEQ ID NO: 83966 - DNA, 601 bp, Human
acagggcgctgcctccgatgttacctccagtacacaggctagcaggaacacagacactttcaaggggcaatgggcaagagaggtctcggcaatccaggcgaagtccgataacccccagacccagagtagaacaggctgctttgtatcagctgagcacatgccggcctgtaggaggcttccgcactggggagctcaagaactaaaaccccacctttaggtcatttgtttttaaagatgctgctgcacagtttaaacttcaaaacatgaagtgcaagatggtcttatcaacgcaataaagtaytggccgtgaagttagtatcattctttctgcagccccactggacacatagggcagcccgtggggaagggcatctgtctcctaatcatatacagtcaggactggtctcacaatgcccattgcttctttgggttccaggtacagaatggaaaacacactgtctatgatgtaaagccttgtacagtcctgaataccaatattatttcaattatttattataagcaagtcagcatttacttttccaaatgtcacatgaaatttcctttctcttcctaatacgattcctaagaggcctgtggcctc

SEQ ID NO: 83967 - DNA, 601 bp, Human
tttaggtcatttgtttttaaagatgctgctgcacagtttaaacttcaaaacatgaagtgcaagatggtcttatcaacgcaataaagtactggccgtgaagttagtatcattctttctgcagccccactggacacatagggcagcccgtggggaagggcatctgtctcctaatcatatacagtcaggactggtctcacaatgcccattgcttctttgggttccaggtacagaatggaaaacacactgtctatgatgtaaagccttgtacagtcctgaataccaatattatttcaattatttrttataagcaagtcagcatttacttttccaaatgtcacatgaaatttcctttctcttcctaatacgattcctaagaggcctgtggcctcttctcttcctgattctcttcttatttagaatagatattttggactggcatatgttgttatacattatcaatatcataaacctttagccctagcagaataaaaggaaaggtctatcaattcattctaagcataggtatggtttgaattcaaggccagaaagatgaacattaaccagaaagcgtatcgtgcaggatgcagtgacgtctagtatc

SEQ ID NO: 83968 - DNA, 601 bp, Human
atcaagaaacccaatgatgctgcctcttctgctttgcaaattatcttttcacacgcgtgactccccttcttaggcagatggtttaccaagtgctacttatttggtttgcgttttgactattttttgaggatgacgtcattaatctattgctggaatctgggagagctgctgttttaaagacttactggagctgccacgtctcgagcagataaatgtggagagccctccgaggaggaacggaaagaaatctatttgcgtgagccgttatggattccgggggagagttggccgtgctcctggrtgggaaccgtgaaggagaagtcgtcgaggggtggtcgcttctcatgggttaacatcagctctaaaaggaacgtgggtttccctgcatctacaaaggccatgtttgcaactccttttattccatggagagtggtactggaaaataattcttaaaaaaaaaaataaaagaaattactcattctagaatcaagttttgtgttgtgatcacaacctccgaaaatgaaaacaatggtggtggtttcagtacttaaattctgaaagcaaataaaactatgaggctttatgttaatcatgcaaattc

SEQ ID NO: 83969 - DNA, 601 bp, Human
ggaggatactagggttcagagatgttgcgtcatttttcggtgtcacacaggaaataagcagcgcaggcaggagcaggaccctactttagtggaccgctgaatccatgctgttctcatagacccagctgtccaacagacagaggcatgacccctccccacatccttagcccttactgagttagcatgacaggccgaggtgcacggtggttccataagggggaagaagagacaacttcacagccaccatctaaaagtaagtgacatgactagccctctattaaaatgacctctatgtctcagrccagcctggtcttgtcaccttgctggcctccactgctgttcactggatgaaagagtgaaggaatcaaattcttcatacattatgctatgaacaactaacaggtaatcatgtgtaagaacaacaaaaaacaatctctgcagcatttgatttaggtgggaccagagtttctaaatcctggcactactggtatttcaggatggatcatttgctgttggaggggctttgctgtgcggtgcagggtggtcagcagtccctggcttctccccactgaagaagtagcaccgctccctcccagtgtga

SEQ ID NO: 83970 - DNA, 601 bp, Human
gatgaaagagtgaaggaatcaaattcttcatacattatgctatgaacaactaacaggtaatcatgtgtaagaacaacaaaaaacaatctctgcagcatttgatttaggtgggaccagagtttctaaatcctggcactactggtatttcaggatggatcatttgctgttggaggggctttgctgtgcggtgcagggtggtcagcagtccctggcttctccccactgaagaagtagcaccgctccctcccagtgtgacaactagaaatgtctccagccattaccagatgagcctgggagcagtgtcttgcctggcagagaaccactgcattagcccttgcacctctggatgcctcgggctcttgttcgattatcctatagtgtgtcctgaaaggtgaggcttgcgtagacagcaaaggaagtccttggtgctttactaggtgctgggggtatttggagattgctgcaatttgaaacttgaaaaactgggcagttttagagaggagagaaaaggcaagaaacagactggagatgcaccaatatcttggccccgtttgggatggctagatgataggtggaaggagggacaaggcgtgcctgctca

SEQ ID NO: 83971 - DNA, 601 bp, Human
atgtatagttaaatgtttagcagaagatatgtcaatatttgagcaaacgtactgtaaggaaggaagttagcatctgttttaattagaaataaaacagactcaatagtctgaaggcaattttgtggggttccattagctgccaagagaaactctccattggattctgtccattcttaaaatgtccgtgctgatttgcaggtttgcagtttgaccctgtgatgggatttgtgggggaagatgcaggcagctgccagtctgaccgagacacctcccagggcccagcagtctccgcatatagtargatagctaggcaagcagtcagaggagtgccacaagggattgtatgaaattatgggttttcctagtggctttctcactgttcagacaccttggagtcaaagatgctggtggggattcaagatgaactgggtcagcattttcttccatatgccaagggggtgcctgaacatgaggctactcagaatgggagaatggtgaaaatgaacatcccattcttcaccaccggcttccaccggaaggggaggtaaaatagaacctcactcactaaatgaagtcactcacattgtgaaatagttaactt

SEQ ID NO: 83972 - DNA, 601 bp, Human
cagtgacagagtgtgagacaggagggctgtgctttgaacacagctcatgagtacctttagttacgatagcaggtgtcccactgaccctggaggcttcctggtgatgaagcaacaatcagctggtagtttggggcccatcagaggcgggagttggcaggacacagaagaggtggtctcccttttttagacttagtgggaatctcactcacatgaaaacacaaagatacatactagaatgtacttggggagtgctttgccttcctgattatgctgaatcttttttttttttttttttttttttactaaacagcatgttttgactcatgatttatctgaaactaaaactaggacattgattttttcccccctaaaaatgacttatatcaaaggagtctgttttccctgacacttcccagtcttatttgaggataccctattggaacaatcagggcaggatatctgcttggaggtaatggtcactacaatggaagtcatttagagttgaagatgcagtctgtctttctggcaaggccatgggaatgcccatcaactcgaccatcagaatggatccctcttgtattttcatcgtagtatgaaaatg

SEQ ID NO: 83973 - DNA, 601 bp, Human
taaaaccatatccagagatctttatcttctgaactttggcatgactaccttgagtggttgttgtacaaatgtttccggtgctgatgggagagaaggagatggcacacacactcacaaaaatgagtagatggcacagaaatggtacaggttctatatttaaccatgcagtatattggggccccatactgttgtagaaaatgtgacttgctaggaattatcagaaggtttgttcttatattactcaactttcttcttgggtactcccaagatatggtagtggcaaaataaattgagtttaatwaaaaaatctcaatagcttggaataacaacgttttagagcatggcacctttcctaaactcagttgtctaatctgctctagaggatgaatcactggctttcagagggaaaaaaacaatagagggtctggggcatacccagggttctagtgacttccaagggtgtattagtccattctcacactgctatgaagaaatgcctgagactgggttatttataaaggacaggtgtttaacggactctccgttctgcattgctggggaggcctcaagaaacttaaaatcatggcagaaggcaaaggag

SEQ ID NO: 83974 - DNA, 601 bp, Human
gcatgactaccttgagtggttgttgtacaaatgtttccggtgctgatgggagagaaggagatggcacacacactcacaaaaatgagtagatggcacagaaatggtacaggttctatatttaaccatgcagtatattggggccccatactgttgtagaaaatgtgacttgctaggaattatcagaaggtttgttcttatattactcaactttcttcttgggtactcccaagatatggtagtggcaaaataaattgagtttaattaaaaaatctcaatagcttggaataacaacgttttagakcatggcacctttcctaaactcagttgtctaatctgctctagaggatgaatcactggctttcagagggaaaaaaacaatagagggtctggggcatacccagggttctagtgacttccaagggtgtattagtccattctcacactgctatgaagaaatgcctgagactgggttatttataaaggacaggtgtttaacggactctccgttctgcattgctggggaggcctcaagaaacttaaaatcatggcagaaggcaaaggagaagcaggcaccttcttcacaaggctgcaggactgaatg

SEQ ID NO: 83975 - DNA, 601 bp, Human
ccttgagtggctgattaaaaactgtacggttgtcttagacttatactttaaagctgcatttgctagtggtcactctcactgactcttcagatacagttagaactgatgcttccatgtggaattattttaaataattactaggagtgagttggggtccagtctctgccactcactcagtagttgacctgcccagtgcagtgtggggccaaccctgccagtgagcctgggcactctgtctgaggctccagtgtccagccacctgctaacttctgtcattcagcctcaccctgggtgtttttgscacatggacaaatgtgatagacacaataaataaagtagatatatattcagaataaatattatatagcaagactaaaatataaatagcaagtgcaaaacaaattaaatgaggatatgaatgacttcagtgaagccactgagctaacaactacctttaaaactaaaacagtaagtaattgagaaatgcagttatcattgggcaagaagtcaaatgaaaaatacggtttgaaagtgaacagcatattttcagcattcctttaagttcacacagtacgtttgcacatggcacattatctaagct

SEQ ID NO: 83976 - DNA, 601 bp, Human
cctaccacttggcttaagctccaggactaatgtctgctgggctcaggagtgcaatctcaagcatcacccacgaagtgagccggggcatcactctctgcctgtaatctcctatcctgattctacctgggagtctttaggctcctgccacttccttgccacctcctcccctcctcctggacttgagcttcttggagtcctctcacttggtcttgtaacaccttacacattgccttggccactgctgcaacagctcagtacatatccacaaatcagaagtcctctctgaacaaagccatctgcrtatccatctaccttccctatgcttgccccatttaaaaatcccaggttttatatctttgctgcattttttaaggatgctaaaatcacttactacaaaaataagcagatttcactgtacaaaatgcaggtagtaagaggtatctaaaatgtaaccactaagtacacatagaaaagatttttaaaaacatgaagaaggaccattgacaaatacaagatccttcctagagaagaacaagggtgggggatctcacatcaccagtggaatgacctagaaacacaaagactgctcaatttcattaag

SEQ ID NO: 83977 - DNA, 601 bp, Human
ttgcagaaatctcattgtgcagacatggagcttcccagcttttgccttgttagcctatttcttaaccagtaattctgtttcttaataggataaagggcctgacttacatgaaagctcaaagtcttaatcacaatgataaaatacaaagtcgtggcaactgtaataagtttaaagacatatgtagcttttcaaggacatcttgtctttaaggaaaagtctttcatttagctaaagaaattaaactgaattgtttagtcttttaaacaaaatgatgaatttagtgaagaaaacaaaactctcmatggctaatgtaatttatgcaaaatcatgcaattagtgatagctgtgctagactttttcttttccttaaccaaatgcgcctctaataaaaccatcgtgaggagcagtgccatctaatgtaagtagtaaacatggatagtaaatgattaatatctggtgaggcatgcagatggcaggacttccattttttctttgagctccttgtgcatgtttgctaatcattcttgcaaaaaaattgcaaagataaatatgaactttcaaaagtaacattcaacaggatatgaatgtaagaaatagtaca

SEQ ID NO: 83978 - DNA, 601 bp, Human
taagggttatatcattttcatgtatgtactactctgggaatggcccgggtcttgtgagtggtattttttcatcaagtacccagccagcgcagtcaccctgacagtccccccactgagataaggcatggaaaggtaaccctctagcaagtcctcgttgaggggggagcgttcaagtgcacagacgtctaccctgtgctatcctgagctgtagtcttctgaaatgatcgtttcgcttcccagccaaggcagggctcccccaaagttcattcccactcttgcagtttcacctcgggatgcttcygcagaatttcagcgcctaagcagacaaggtcaaagtaaaccgcttcgctgcttctggcgcaggggcccagagcgcgtgcagctccccagcacagaccaacagcaggagaggggtccgggcgggagccctgggctgtagataagcaaaacgcacccattttctctcctatttactccagaggcacctctcctcccccactcctggcatctctttatcactggctccctctccctgtggcatatttttgggtagtagaatgctgaggtcacagggagcggctctttatccaagcagtgggga

SEQ ID NO: 83979 - DNA, 601 bp, Human
ggaccaagagtgaaaacaggtcaacataaatgcatgcccagcaaggcagtgctcagccacaggtggcactgtgaactggcaagaaaacagctccaaggacagtgctatctgagattcgcatgatgtataactccaggaagaaaatggaaagccgtaattggcaggttagaaaatccacttacatgaagaggagagtataacggaattctgtagcatcatcaggactgcttagagttgttcaattgtgtagtagacttacagttgttttgctaagtctattaaaatcattggcatcgcttcttttttttttttttttgaagtaggaaaccatttacatattgtagtgcttaagtgcatgtcttcagcatcacaaatcaaaatattggtgaaaacttgcctcaccttacctttggctctggagagatattccacatgggtgaggtgtgtgtcatcatgctccaggctttaaagcaagcatcatgctgggggctggctggagagaagggagtttcagccatcttcctgcccacagatccctcttgcatttttttttaatagatgggatgtaggcatatttttagggtctagaatgagtcaatat

SEQ ID NO: 83980 - DNA, 601 bp, Human
acggaatagtgcaggattccttccctgctccatttttcaaagctttgctccattggaacttaacaatgtgctgtctttcagtacgtctgaaggtctttttcaatttaaatcagtttattcctgtttttaccatatccagctccctgctactcctaatataaacagacttagtggcctattaagtattttacttctaatgcttttgagttttttcttggcagtggaggtgtaatctctcccaaaacctgcctgcacttcacagagaataggaccgcaattgccagaagaaactgaacctttrtgggggaaaaagaaaaatacagccttccctcattctccagtcttaattgagctaactcaatttatgccaaccagttcttgctggtcatagttctagagctttatgagaattaaatcctgatctcaccttaatcctcctaaaatctccgtgaaactgggcactgttatcagcaccattgtgaaatgaggcagcaagtacagggcggtccctaaatgtgactaagtcaggaatcttatgtagaaagcttacaaggaagttggggggtgattaggaattgtctccagaaataccagataaaca

SEQ ID NO: 83981 - DNA, 601 bp, Human
taactcaatttatgccaaccagttcttgctggtcatagttctagagctttatgagaattaaatcctgatctcaccttaatcctcctaaaatctccgtgaaactgggcactgttatcagcaccattgtgaaatgaggcagcaagtacagggcggtccctaaatgtgactaagtcaggaatcttatgtagaaagcttacaaggaagttggggggtgattaggaattgtctccagaaataccagataaacagttcaaattttagtgaagcaaaagataggcatattttggccttgtttaacttrtacctgaatgtaccaataacacttttggaagacttggacgtactcttcctcttttcccaggaaaatgggagagtattcattcctgtacatattgagaacatggacaattctcacattttaggattgtcttaataggcaactgactttattatctacgtgttgattgaaagaatagctcatagcaggtgttaaaagtttttcctaaagagctacattataaatattttggactttgaaggccataacatcgtaacatttcaaaggtcatgaaaacccagctctgctggtgaagcagggaag

SEQ ID NO: 83982 - DNA, 601 bp, Human
atttgatgatccagaatcagttccttggtttttaactttatttccatccacaacaagtggcagctttgagaaggtttcatgttctttacactgagattccagtggatgagtctgaatgtttaactcccagaagttaggagaagattgagcttgcttttggagtttaagaatgaaaatgcaagtgcatgtgcctattttagggcctaagttggattttcataaaataaagcaaaatctgaggtcaccctgtgtgggaaaacctcatccgagactggagattgaaaataggagcaagggccaraagtagccgcctggagagcagagctaaggactgggtggtgcctgtgtgtcctttgggcacctggtgactttcaggacatcatagacgcaagggtgagggcccatctcatccttactgtcagaggcaacagtacagccctggggtgtatttcacattataccactagagctgggtgcttaaagggcatcatcaaatccatttttctttccttgagtggaggtgcctttcatttgtaaatgatggatttgaaaaatggacaagtagtgaaaatgcaggaaaatgattcacatcagtaggtgc

SEQ ID NO: 83983 - DNA, 601 bp, Human
caggacatcatagacgcaagggtgagggcccatctcatccttactgtcagaggcaacagtacagccctggggtgtatttcacattataccactagagctgggtgcttaaagggcatcatcaaatccatttttctttccttgagtggaggtgcctttcatttgtaaatgatggatttgaaaaatggacaagtagtgaaaatgcaggaaaatgattcacatcagtaggtgctccagcagatgtggagtaaaaatcaacatgtcccacaaatgggcaattaaaggttacacatagaatttatgraaagaactttggagtgtcccagggattgcaaaggtggttataaatgcatgtgctcacctcttcctgttagcacacacacctaaatacgcagaatctctcagcagagacattccgttgagagcctacttaataaacctcattttaattttattcaccttagtaaggctgcaggagttggtaagtcccgtggacttggagacttaggttaaggaattccaaacttgactgctaggctgctggtacaaatcatctttctctctttctagtcacctggatacattatgatgcgatgccagactt

SEQ ID NO: 83984 - DNA, 601 bp, Human
tcgtgagatctaatccatacagaagttgagaatgtgtttccattagaaggtaaagagcctctagtattcaaagcctttgattcagcgggcaggtgcgaacggtggaggactgtgcttctcgcttgcagacacctcgaattatttttctttagctccctctgtgctttcagggagcctgcgtgagttaagcctctccttgtagtgatttcccgatgcccagcaaggccgaagctctcatttcctttaggagtgttgttttttttttctcaatgaaggatgaattttctaaatccataattayacctgaccatgatggcagcttctctgttaagggcttggaaagtaccttgttaattacttgacttattttgtcaacattttttcatgttctccccaccccttgccaaaaaaaaaaaaaaaaggatggagaatctcatttttgcttcagcgtctcttctgtgatgatttcttgcttttcaattcacgtttggaaaaatgttttcatttaaacaacctccctatttaaaaaatttaacagtaatacctgctttttgtaatgagtgaagataatacaataaggatgtatgaagtcaaagctaat

SEQ ID NO: 83985 - DNA, 601 bp, Human
aatgtacaccaagcatttgtagaagagggattagggctcagcattacagtgttttcctaactttccttactcacaggctccttatttatttattttttgttaggctgccgtggccagcgttccaggaaacacactttgggaaatgacgctcctttggctgtgtagcgcacaaggggctgtgagcttcccctgtagacgtttctgccttattccagctgatcagtaatattcatcagcatcatttcattcttttttttaagacggagtcttgctctgtcgcccaggctggagtgcagtggcrccatctcagctcactgcaagctccgcctctggggttcacgccattctcctgcctcagcctctcaagtagctgggactacaggcacccgccaccatgcctggctaatttttttgtattttttttctttagcagagacaaggtttcactatgttagccaggatggtctcaatcacctgaccttgtgatccactcgcctcggcgtcccaaagtgctggggttacaggtgtgagccactgcacccgatctttttttcacttttaaatcaaaacagatcattcatacaagagaagaaatacatat

SEQ ID NO: 83986 - DNA, 601 bp, Human
tttcattcttttttttaagacggagtcttgctctgtcgcccaggctggagtgcagtggcgccatctcagctcactgcaagctccgcctctggggttcacgccattctcctgcctcagcctctcaagtagctgggactacaggcacccgccaccatgcctggctaatttttttgtattttttttctttagcagagacaaggtttcactatgttagccaggatggtctcaatcacctgaccttgtgatccactcgcctcggcgtcccaaagtgctggggttacaggtgtgagccactgcaccygatctttttttcacttttaaatcaaaacagatcattcatacaagagaagaaatacatatgtagagatgacaaatcattcagtgggcctctctgtaatgcttcccgctccagtccctgagtagctccccccgcccagctgtgcacgtcttcttctttgtgatgtggtctctacacagatttgggattcattttccctcgcttctctttttagttttaccacatattaatgtatccttaaacaatatgttcttaagccttgcttccttttgccgtttatagaagcagagtcaaacaatatat

SEQ ID NO: 83987 - DNA, 601 bp, Human
cattcttttttttaagacggagtcttgctctgtcgcccaggctggagtgcagtggcgccatctcagctcactgcaagctccgcctctggggttcacgccattctcctgcctcagcctctcaagtagctgggactacaggcacccgccaccatgcctggctaatttttttgtattttttttctttagcagagacaaggtttcactatgttagccaggatggtctcaatcacctgaccttgtgatccactcgcctcggcgtcccaaagtgctggggttacaggtgtgagccactgcacccgayctttttttcacttttaaatcaaaacagatcattcatacaagagaagaaatacatatgtagagatgacaaatcattcagtgggcctctctgtaatgcttcccgctccagtccctgagtagctccccccgcccagctgtgcacgtcttcttctttgtgatgtggtctctacacagatttgggattcattttccctcgcttctctttttagttttaccacatattaatgtatccttaaacaatatgttcttaagccttgcttccttttgccgtttatagaagcagagtcaaacaatatatatt

SEQ ID NO: 83988 - DNA, 601 bp, Human
tggggttacaggtgtgagccactgcacccgatctttttttcacttttaaatcaaaacagatcattcatacaagagaagaaatacatatgtagagatgacaaatcattcagtgggcctctctgtaatgcttcccgctccagtccctgagtagctccccccgcccagctgtgcacgtcttcttctttgtgatgtggtctctacacagatttgggattcattttccctcgcttctctttttagttttaccacatattaatgtatccttaaacaatatgttcttaagccttgcttccttttgccrtttatagaagcagagtcaaacaatatatatttttccatgacatgcttttagctttcagcactgtggttttgcagtctctccaggttgatgggtgcagctgtggtccattcgttttcttagctgaataatactcctgttgtaggaatagatggcagcaagcgtaacccctcttcatggatgggtacctgggtgatgccagtgtttgctattaggacagcgtgttagatcctgcatttagcgatctccaggcacacctgcgggagagcgcctccaggaaacacaccccggggtaggattgcc

SEQ ID NO: 83989 - DNA, 601 bp, Human
tagagccagagaactttggttcacaatggaatcatcaagtcataaaacttttgaacttcaagggatttttccatttttttttggttggaggtggtgatagggaaatcttcttcaatgacaataagttaatgacttgcattacttcttggccaaagttaagactagaacagaagttttccgactcccagtctgttcagtattttccccatcatacctgtgattatcaaccttttctcactctgccaaccaaaaatgttcccttggaatgacttctgactgtttgtgctgaaatgaagcagtrgtttttcaaagctcacacatgaccgtatggactctgcacagttggtgccatattaaaatacaatgtctcttacctttttttccctccactttctgttgttatttcccaatcaaagtaaaaccagtattaaggtctgtcttagttcactttgtgatgttataacaaaattacctgagactggtcatttataaagaacaaaaatttgtttctcgtggttctggtggctgggaagtccaaaatcaaggcaccagcaagtttggtcgtctggtgaggtctgctctctacttccaagatggcgcc

SEQ ID NO: 83990 - DNA, 601 bp, Human
ggttgagcatatggctatttctgagttacttagctttatattaactttctcatcaccagttggcctacttgcttaggccaattagtccttggccattttgtctatgtgggcatgctaggtcatgtcagggctgattttttcttctcaaaaatttttaattgtggtaaaatatatatcacatagaatttatcacctttgccattttaagtgtacagttcaatattgtgaagaacattcacatttgtgcatgactaaattccagaactctttttatgttataagactaaaactctctacccaytaaataacaacaccccatttctccctcctctcagcacctgtagaaccaccattctacttcctgtctctatgagtttggttactctaggttattgggccaattttgacagcctttcttgaggtggaatcctcttcccaacatacttatttccattgccaaccatgaccctgcccatggagctctatcctacactctatcccatccccgtcttcagcccatcctgtttggtgacacccaccatggccccagcccacatcttcagcaggtgcagaatgtctcttagtgttgacttacaccctg

SEQ ID NO: 83991 - DNA, 601 bp, Human
tatttctgagttacttagctttatattaactttctcatcaccagttggcctacttgcttaggccaattagtccttggccattttgtctatgtgggcatgctaggtcatgtcagggctgattttttcttctcaaaaatttttaattgtggtaaaatatatatcacatagaatttatcacctttgccattttaagtgtacagttcaatattgtgaagaacattcacatttgtgcatgactaaattccagaactctttttatgttataagactaaaactctctacccattaaataacaacaccscatttctccctcctctcagcacctgtagaaccaccattctacttcctgtctctatgagtttggttactctaggttattgggccaattttgacagcctttcttgaggtggaatcctcttcccaacatacttatttccattgccaaccatgaccctgcccatggagctctatcctacactctatcccatccccgtcttcagcccatcctgtttggtgacacccaccatggccccagcccacatcttcagcaggtgcagaatgtctcttagtgttgacttacaccctggcagtcctgtgcacc

SEQ ID NO: 83992 - DNA, 601 bp, Human
aaaatataagatatgcagtcaaattttaatttcaggtaaaaaaaaacttaagtctatccatgcaatatttaggatatacttacactagaaaaaatgttgcttatctgaaattccaattttactgagtgtcctggattttgtcttgcaaccctagctgtaaagggaagaaggagctttgtagggtagagccaagcattggacaaaggcatggatggaggagcgatcggtgtccccagtccagttcagtaatatggagggcggagggtggagattacaagaattacaagcaaagatgggggcygtagaattccatcttctacctttaaagaatttgcccttttttttttccctttaattgatttttccctctgtttttaagttgttctcttttgaatactctgcttatagatttatttcctaaacaagtgctgttaaatggcctccacttcacaggctccatggaggagcagagctctcctctctctatgccgatgctttcagcatcctcagaatagcagctggaaggcagtaggttttatggggataactgtgcactcaccagtttagatgtgtggttgctaagagtcacggtatttgtttg

SEQ ID NO: 83993 - DNA, 601 bp, Human
tttatttttcaattagctatggaaagtacaagaaaatcaagttgctaagcaatttctgttgaattggatgtgggtggaaccattatcaaaggttggaagaaatcgtaaaaatggaggagcattttatattcacgttgtttttcctatgtcttcaagttctttaaaggaactgaaactggaaattgcagaaaatgcattatgggtgtgatttatgaggtaaagaagagtacacagtgcatggtgtgttgttatggcaaccctaggaaactaacatcaagatcttaactcaagatattgatcytcatgtatgttaacgtgagagacatgtgtgtcttgtgtggagggcctctccaggtgagagggtggctgtgctttcactcatggtcagctccagtctgctcagggagctctgggcatccatgtgcccatgtgtcatccttgtgacatcccttcagtgtcagctacttttatcctttgatcaattgctccagggctcataatacatgatgtaattggttggaaacgtggatgtccaaaaagtgcatcaacgctcaaggtcatgtgtcctttgttttgaggtgtcactctgggcagagctgtc

SEQ ID NO: 83994 - DNA, 601 bp, Human
ttcatttatttccttaatttaatggaatgccttagtgctatttcaattaaaaaatattgatggtaaatgtttgggaggacattctgcatcctttgatgctcaagattttctgttctccaaagcagtagagacattagcctcactcaaaggagagtaaaattatgttcaatgtgtaaacttgcttgctgcgtaacaaagtaatattatggcagggtgtttgacagagactctttagcttaatgaaattctatcagggagatgcagttttaatagcgtcgttcattgctttttgtccctgtastctttaaaggctcacatgtggggaggacagtggctgcatctgagctgccagcagcagtgcaggagttcagatgtgaaatttcactcatgccagcatttccagcatttatttttaatcaggatctgcgcttaccgatggcctgttaaaaaggaattgtgtaattagcctactaaatcaccttttcttcctcagtctcttcacatctctgaaaaacagcccccatatcactgtggcttactctctctctctcaatatgttgtaggaactacagaagtttcagcatacccacaaatactgggt

SEQ ID NO: 83995 - DNA, 601 bp, Human
acaagcacttgccactacgcctggctaatttttttctttcttaaaaattttttgtggagattaggtctcactgtgttgcccagactggtctcaaacacctgggctcaagcgctccttctgccttagcttccccaaattctgagattataggtgtgagccgctgtgccgagccagtttctcctaggttttaaaagattgactttatagtttggatctgcaaataagttttaaaaaattgtagaacctgttcccatgtatccttcattcagtctctgccctcattattgacattttgtgttaycatgtcacagtggtcacaactaataaatcaatactgaaaatctctttgaatttataacaatgtctgattatttagttttactaatctcaaaatttggaacaacataaatcagcaactttcaaggtttttttctgaaagaaagtagcttagaaatgtatacaaaagcaaatcaactcaaagtgtgtgtttatcatttagaaaggtaaaaatctatttttcctatcaaaattatctcttaatgctttttaatttattttcttgagtttagtaattctatcttgctaatgtaccttcaatttc

SEQ ID NO: 83996 - DNA, 601 bp, Human
tttattcttattcaccaagaaaccaccagagaagacatcaagcatcaagtgaaagctacagatgagcactttacttttttgggagtgctgtttgttcgtataaagaagtgaggctttttaagaagtggcctttttaggccttagcacctttttaagctgatcactgtctccttgtctatagaggggacccaggaaatcttaggtgacagtgaggctcagggtggagcttggttacttgtctcagcatcaagggacaggatcaggggaaaggatgctgagctgtgcttgtgggtgagaaatragttaattaagccctttctgccatgataactctggtgtttgttttctgctatttaggctatcaaagttagttagtgactcacagcaaaaagaagatactgatattttcttgggttttgtttataatcatgttttgagcttatatagacatgctctttcttaaaattcatttatttgcttttcatccatggaaaaccagttttttttcaatgagttataaagtatttaataagaagagattctgatttaattatatccagagatggctttggatcatgttatttaagatggagaatgacta

SEQ ID NO: 83997 - DNA, 601 bp, Human
aaagctacagatgagcactttacttttttgggagtgctgtttgttcgtataaagaagtgaggctttttaagaagtggcctttttaggccttagcacctttttaagctgatcactgtctccttgtctatagaggggacccaggaaatcttaggtgacagtgaggctcagggtggagcttggttacttgtctcagcatcaagggacaggatcaggggaaaggatgctgagctgtgcttgtgggtgagaaatgagttaattaagccctttctgccatgataactctggtgtttgttttctgctrtttaggctatcaaagttagttagtgactcacagcaaaaagaagatactgatattttcttgggttttgtttataatcatgttttgagcttatatagacatgctctttcttaaaattcatttatttgcttttcatccatggaaaaccagttttttttcaatgagttataaagtatttaataagaagagattctgatttaattatatccagagatggctttggatcatgttatttaagatggagaatgactatttagaaatattaatgtttggccgggtgcagtggcacacacctgtaatcct

SEQ ID NO: 83998 - DNA, 601 bp, Human
aaaaaaaaaaagatgtagttaatagcatatgcttctccttaagtgatcacccaagttgttggagtttcctaatcatcagtttttttctctgtcattttgagcttcctggaataggactgaatttgcaagttgaatgattatgcataaggctcaagaaaaacttgaaggcagataaaattgatttatactccttagctctaccctaccctatctacaggtatttcttggcggtcagtgaaggatcaaacaagaacagggttgggtaatgctgtcagcaggcccactacatcccatgccaggygctcatggcgtcctgtctctgctcctgcctcactttccacctctctgcccagcccccataaatagtatgtgggaagctgggcacagtggctcacacctgtcatctcagcactttgggagccgaggtggatggatcgcttgaggtcaggagttcgagaccagcctggccaaaatggtgaaaccccatctctactaaaaaatacaacaattagctgggcatggtggtgcgtgcctgtaatcccaagtactcaggaggctgaggcaggagaattgcttgaacccaggaggcagaggctgcagt

SEQ ID NO: 83999 - DNA, 601 bp, Human
aggactgaatttgcaagttgaatgattatgcataaggctcaagaaaaacttgaaggcagataaaattgatttatactccttagctctaccctaccctatctacaggtatttcttggcggtcagtgaaggatcaaacaagaacagggttgggtaatgctgtcagcaggcccactacatcccatgccaggcgctcatggcgtcctgtctctgctcctgcctcactttccacctctctgcccagcccccataaatagtatgtgggaagctgggcacagtggctcacacctgtcatctcagcactttgggagccgaggtggatggatcgcttgaggtcaggagttcgagaccagcctggccaaaatggtgaaaccccatctctactaaaaaatacaacaattagctgggcatggtggtgcgtgcctgtaatcccaagtactcaggaggctgaggcaggagaattgcttgaacccaggaggcagaggctgcagtgagccaagatcgtgctactgcattccagcctcggtgacaggggaagactgggtctcagaatgaaaacaaacaaacaaacaaacaaaaaaaagagtgggtggggctcctgatg

SEQ ID NO: 84000 - DNA, 601 bp, Human
gccccaagccccagcaccggacttggcctatagcaagtgacaatgcttgtttttattaacgaatgagtacacgatcccaggaatctcgttgaagtccagttctccacgtggccacccttgactcccacagctgacctgggattgacaccgtggccagccctgttcctcacctgatgcctgcctgtagtcttcggccttgctgctccagaacttttcatcgtggcccctttagggccatggcagcacaaatacacttagtaggtgaggccatgaggacacctaccaccattaaggatgcctrtggggagtagggagatggaggataggctggtaagaccctgccagtgcgggcctgcctcagtgccttggaacgaggtattcccagtgcctctgagctgcatcccagtgtgtcctgagcacccatctggcctggcaagaagcaggcacgaaaggcatatgggccgtagcctctagcctcctgccacctgcattccaagccacgttccagtagcactttaactgaaacatctagctacacaagatgggctgagcactctacacagatgctggtccatgcagaaacaaccctaccccttctgca

SEQ ID NO: 84001 - DNA, 601 bp, Human
cacgaaaggcatatgggccgtagcctctagcctcctgccacctgcattccaagccacgttccagtagcactttaactgaaacatctagctacacaagatgggctgagcactctacacagatgctggtccatgcagaaacaaccctaccccttctgcacctgaaagggttccctctgattagaaaaggtttgcttcaagttcggttataaaggaaggcttgtgcatagttagtggggaagccacagggatgtgcaacttttccctacagccctgaggttccaggcactaagaacttggcacrtctttccatgctggctgaaatcaaaatgaaaccttctttgacttttgccccttctgctggggcattgacattggggtttgacactggctcagacagtcaaatctggaagccaaaccttagaagccaaatcttagggtggcattaggactaagctgagaataaattctcagtgatcccattcatctgcctcccagtgtactaaagtaggactttgaaccttccagaaacctgatatgttggcaatttctcaagctttgactctttcttccccattgcctctaaaccctagcttgaatttta

SEQ ID NO: 84002 - DNA, 601 bp, Human
agccaaaccttagaagccaaatcttagggtggcattaggactaagctgagaataaattctcagtgatcccattcatctgcctcccagtgtactaaagtaggactttgaaccttccagaaacctgatatgttggcaatttctcaagctttgactctttcttccccattgcctctaaaccctagcttgaattttactggctgccttataattgctatttgttaaaaatcaaaacgattttccatcctggtaaaatggtaaaaatatcagtagtttgcagacagtaaatatctgtctttaatamttcaaaaacaagccatatttgcctcctgcctgttttccttatgagggaattatgctgtggggtggtagagtgagaagggttaaatcactggggacccaccttccctcgttcctcatggaatttagatgaatgtgctcttgctaaattctccagaacgtgtatgtgcgtcacccccacgctgcccggcccggaggtggctggaagtctcactttgtttttcatctgctgggtggtgaccagcagagagcactgagcggactgttctttccaatgctataaaaagcctgtttgcaaaatgag

SEQ ID NO: 84003 - DNA, 601 bp, Human
tcattatgtcaacatttttaaattttattgtttaaattgacgaataaaaattatatatatttatgatgtacgacatgatgttttgatgtatgcttacattgtggaacagctaaattgagctaactaacatgcattctctcacatacttatttttcacgtgtggtgagaacacttaaaaactaccgtctttggccgggtgcagtggctcacacctgtaatcccagcactctgggaggcttaggcgggtggatcacctgaggtcaggagttcgtgagcagcctggccaacatggtgaaacccygtctttactaaaaaatacaaaaaattagccgggcgtggtggtgcgcacctgtaatcccaggctgaggcaggagaatcgcttgaacccaccaggcagaggttgcagtgagccgagatcgcatcactgcactccagcctgggtgacagagcaagactccatctcaaaacaaaacaaaaccaaccaaccaaacaaacctcacaaaactactgtctgcagttttcaagtgtgcagtatattgctattaactgaagtcaccgtgatgtagacttcttgaacttattctgcctgtctaaatgaaat

SEQ ID NO: 84004 - DNA, 601 bp, Human
agctaactaacatgcattctctcacatacttatttttcacgtgtggtgagaacacttaaaaactaccgtctttggccgggtgcagtggctcacacctgtaatcccagcactctgggaggcttaggcgggtggatcacctgaggtcaggagttcgtgagcagcctggccaacatggtgaaaccctgtctttactaaaaaatacaaaaaattagccgggcgtggtggtgcgcacctgtaatcccaggctgaggcaggagaatcgcttgaacccaccaggcagaggttgcagtgagccgagatygcatcactgcactccagcctgggtgacagagcaagactccatctcaaaacaaaacaaaaccaaccaaccaaacaaacctcacaaaactactgtctgcagttttcaagtgtgcagtatattgctattaactgaagtcaccgtgatgtagacttcttgaacttattctgcctgtctaaatgaaattttgttttctttgaccatcgtctccccggtccccccgctctccagtccttggtaaccacaattctactttctgcttctatgagttcgacttgtagagtccacttagaagtgagatca

SEQ ID NO: 84005 - DNA, 601 bp, Human
aagactccatctcaaaacaaaacaaaaccaaccaaccaaacaaacctcacaaaactactgtctgcagttttcaagtgtgcagtatattgctattaactgaagtcaccgtgatgtagacttcttgaacttattctgcctgtctaaatgaaattttgttttctttgaccatcgtctccccggtccccccgctctccagtccttggtaaccacaattctactttctgcttctatgagttcgacttgtagagtccacttagaagtgagatcatgctgtgtttgtctttctgtgccttacttattycccttaaaataatgccctccaggtccatctatgttgttccaaatgatggtatttccaccttttttaaggctgaacagtactccactgtgtttttagatcacattttccgtatccatccattgatgcacgcttaggctgtttccctattttgactattgtgaataacgctacagtgtacatgggagtgcaaatatgtcttcaacatattgatttcatttcctttgggtatattctcagaagtgggattgcagcatcatttgatgattttagttttaatttttcgaggaccctccattgtgc

SEQ ID NO: 84006 - DNA, 601 bp, Human
cgacttgtagagtccacttagaagtgagatcatgctgtgtttgtctttctgtgccttacttatttcccttaaaataatgccctccaggtccatctatgttgttccaaatgatggtatttccaccttttttaaggctgaacagtactccactgtgtttttagatcacattttccgtatccatccattgatgcacgcttaggctgtttccctattttgactattgtgaataacgctacagtgtacatgggagtgcaaatatgtcttcaacatattgatttcatttcctttgggtatattctcrgaagtgggattgcagcatcatttgatgattttagttttaatttttcgaggaccctccattgtgctttccgtaatggctgtttacaaatttacactcccatccacagcacacaggggctcccgtttctccacatcctaacacttgttcttattccttttgttgatagtagccattctaacaggtgtaaggtgataatttattctggttttgatttgcatttccctgattattagtgatgttgagcattttttcatacatatgttggccactttttattttgaaaaatatctatccagtgat

SEQ ID NO: 84007 - DNA, 601 bp, Human
cttttctttgccttttaatgttctttcaaacaaatagaagactgagtgcattcgctcagacatcttcatttgttcaaataaactccattttttcagacagacttgaacaaatggagagacagttcgtgtgtcacctaggtaaaggctgtctgctaggggtccttcaacaagcaaaaccaaggtccctgcacacatggagttcatattctagtgaggagagacataaacaatttatgcaatttgtgtcaacctgattggtgcatggagaaggcagaaaaggagggaaggaagtgagccaggyggtcagctggcagagaagcgttccgtagagggtacaggtagagtacaatcctgaagggtgcagaccttttagttctgcatcttggtggtcatatgtattggaagagcttgagaaaaatgaaaataccatttagcttaagaagttgtgagttatctgcaagtcaactcatttcaggagtggaagaatccccggaatgatttcctaatatcaaaatgtatgcaggtttctcttttgaatgtcttgtatatttagagagggtgctgtacaaagtctcttgttttccatacagcaaattccagg

SEQ ID NO: 84008 - DNA, 601 bp, Human
agtactactttgcggatttacctcccactgcatgctgttaagatctcatctaagcaagattaataaaaaataaaaaatcttgactaaacatctgttgcaaagtgactttcaatttggctcttcaccatgtgactagtgattagagtttttggtttaggttaaggggatttgatttgatttggcatggtccctttttaattttatgtatgaggcaaataactgaaatgtccctgattgtcataagtgaaaaaatatcattaaaatatttgaattttgttcaaggagattaatctctataaaycaatgttttgtattccctaattagaattatggtagtcaccagtatgatcaatgctaagtgtttatttggtaattaggaagtgcaagctctaaattttgataagattgatgaaatggcctcttctcatattttcattatgtccgtataaacataacttagaagttggaaatatgaattttgtctacataacagtggacatgctacaacaaacaaatatatagctacaaacaaagctatatatttacattgatatccccttgattatttttctcaatgagcagacattcaagagattttttt

SEQ ID NO: 84009 - DNA, 601 bp, Human
ttaagacctacagtgattagaaaagacaacacaaaaatattgacagatgttggtttgatgtatttagaaaccctctccaaagtgggggaaaaatagtttggaagtaataggagaattctgtaggttcaattgcaaaatgtacacatcaaattcaatagtttaccctaatatacaaataaaaatacacaaaatgttcaaagggttatttaaaaaagcactccctccaaaagacacaaaaataaaaggagctgttaaagatccgtatgatgaaaaccacaaaacattcctgaaatggcataaraatagacttgaacaaatggagagacagtttgcatgtctaagtgggaaggctgatattgtaagcctcttcaattaatttaaaaattcaatggaattccaatttgaatcccaataggaccttgtttcagactcaataatgtgtttctaaagtacatgcaaaagaataaattggcaggaatactcaagaaaaatgtgaaaaacaagggtaatgtgaagtaggccttgcaatactgaatagcaaaaccatttgaaagctacaataaagtattaattaaattgaaagtactctgtttctatataa

SEQ ID NO: 84010 - DNA, 601 bp, Human
aaaaatagacttgaacaaatggagagacagtttgcatgtctaagtgggaaggctgatattgtaagcctcttcaattaatttaaaaattcaatggaattccaatttgaatcccaataggaccttgtttcagactcaataatgtgtttctaaagtacatgcaaaagaataaattggcaggaatactcaagaaaaatgtgaaaaacaagggtaatgtgaagtaggccttgcaatactgaatagcaaaaccatttgaaagctacaataaagtattaattaaattgaaagtactctgtttctatayaagtgtaagagcaagaaggaatcctttcaaatacaacattaattacatatggcttataggacatggtgattttcagattttcttctttattttaaaatatataaaatatatactttatattttatacatataaagtatatggattttatacataaaaagtaaataatatatgtacattttatacatatataataaatacatataagtatatatactgtataaagcatatatacttatacataaatctatataaagtatactttatatactttgtatgtatagaatactttatatatgtat

SEQ ID NO: 84011 - DNA, 601 bp, Human
gcatgtgtaaactttcttttctgacataccaaaaagttggtcacagacacagggacacatcattcctcgcttcatgcaactcctatgaataactgctctgtaggcacaggaatattatgatgcctatgaaaatgaacaatgattcccgaatagaatgtaagatctcttccctgtgaggttttccctttgaccttaagggtccccaccatttgtcttgtcaaatgctgtatactctgaatctgtctattcatttcctcatgatggaacatttttggcaaaaaaagtaactacttaagtgatsctgtgtgcttagcattctacctaaaggcccatactataattaggaagaatctatagggtgttgttttcagattgagtgagtgtcttcgtccccaaagaccttttacctcgaggtttcagtgcccattgaggagcctcctctggaccaaccattcctttaggagttgaaaccttcagttatcaagttctcttcttcattccgtgtttttttggctcatagtcttccgtaggtcacagctttacttttgccctcaaccctgccacgtcgcctatatgtctgtgtagacacatggattttttt

SEQ ID NO: 84012 - DNA, 601 bp, Human
tgtttgttgtcatcgttcattttgatattcagattgtctcaagcatcccacacgtggccaggggagcctccccacaccacctcctgtgtccttttgacatggccccactagcctagaagaaagacgtgacccagcctcccactgaggtcattctggtcaggggctgtttttatctcctgctgacctactcttgggaactcaatgatgtcaacacactgcacactcattgaatgttggttgagtgttgcacttggcagtgctcttcatggttttgaatcttcttgtcattttagccttatcmcctccatttctcatgacccattctagaaggacccatttagggaagcttcaatttcccctggggtgtggggaaagtgagacaaggggtggaagtagaacctcagtgggttgtgcttcctgtgttgatgctttcctgcacaccctgctggacaggtacagggctactgcagaattcctcgtgggttcccacaaattgagtctcagtccaccacagtaggcgattttgaaaataagcattaggcatttatgactaaaatcactttggtagcttatgtagttgtaagtagataagctattggat

SEQ ID NO: 84013 - DNA, 601 bp, Human
cttttgacatggccccactagcctagaagaaagacgtgacccagcctcccactgaggtcattctggtcaggggctgtttttatctcctgctgacctactcttgggaactcaatgatgtcaacacactgcacactcattgaatgttggttgagtgttgcacttggcagtgctcttcatggttttgaatcttcttgtcattttagccttatcccctccatttctcatgacccattctagaaggacccatttagggaagcttcaatttcccctggggtgtggggaaagtgagacaaggggtggragtagaacctcagtgggttgtgcttcctgtgttgatgctttcctgcacaccctgctggacaggtacagggctactgcagaattcctcgtgggttcccacaaattgagtctcagtccaccacagtaggcgattttgaaaataagcattaggcatttatgactaaaatcactttggtagcttatgtagttgtaagtagataagctattggatgatcacttgtcatgtgcagtgtttgagcatacaaccgcatacaacatatgtatgtattatgagtacatacatatttataagaaataccat

SEQ ID NO: 84014 - DNA, 601 bp, Human
attctagaaggacccatttagggaagcttcaatttcccctggggtgtggggaaagtgagacaaggggtggaagtagaacctcagtgggttgtgcttcctgtgttgatgctttcctgcacaccctgctggacaggtacagggctactgcagaattcctcgtgggttcccacaaattgagtctcagtccaccacagtaggcgattttgaaaataagcattaggcatttatgactaaaatcactttggtagcttatgtagttgtaagtagataagctattggatgatcacttgtcatgtgcagygtttgagcatacaaccgcatacaacatatgtatgtattatgagtacatacatatttataagaaataccataaaagattatctatgtttttatttactataatctcatatttcaaagtatcttttattctccttacgattcatttatttaatgttttaatactttataatacttaagtatcatcataaatatttaatacttaatatttaatgatgtgtgtgacatttctccttaatacatcatccaaccaatgttaacaatgttgaggacagtatccttttatgatttatgtaaggcattc

SEQ ID NO: 84015 - DNA, 601 bp, Human
atttaagaacaggttaattttgttgtagtagttccaaatagctaaaagatgacattagtgtaagttattttctgttttatatagttttggcttttttttttttttaacaaacattcctcactctaaagttctttataaaataaagaaattgtaatatttgggagattaaatgagtaaaaattaattatatattgaataaaggcatcatgggaatgaattcatctttaaatgaaaaaaggaacaatttcaccatgggttgtttatatgggaaaggttttatgagttcactgatgagaatggrcacccattttccggtgagcttcagttttaacaataatacctgaatcagcctttttattatgtcttatgcttaatcaaatatttaattaataaaacgtgacatactttttgagggcacagcgatgactcctgacattcaatgtatgcggcactgcacactatcctctgtcctcattttacaacatcgttctttctatatttttaattattctttctttcttatactccccgcccccttaatcttaaaaggattttgaggtagctttaaagaaattctatataatatgaaaacacatgtgtg

SEQ ID NO: 84016 - DNA, 601 bp, Human
tcctttggaatttagagaacttagaagaacgttaaaatttctgcctgtgttgtgtgtcccagagagcaaatctgtgctttgtacaaagtgtgagctccagggtcgattgagacagctcttgtctggctgatgaaattaccaggagcaattttataccctgctatccaagtcacatggctaagtccatttttattacaccttcacagctcctcaagaatatgaattaaaaccctttggatttttttcttctaattcatacttagaccttccactaggcatagttgacaaaggcactgtttamaagatatgtctcatcctgagtttccattcaccagtctgtgcttttgttagccttttgtttttatatcctgcaatgacatcctgcattcaacttgcctgtcaccgaatgtccccctgctccaccaccagcaccccattctacctgtgctgttttccttctactgagactcacttccacctgtgcccagttccacctgcctttccttctacccagcctcagttctacttgtgctcaattccacctgcccttccttctacctgtgctcagttctacctgttctccatttttcctatcaaccta

SEQ ID NO: 84017 - DNA, 601 bp, Human
gattgagacagctcttgtctggctgatgaaattaccaggagcaattttataccctgctatccaagtcacatggctaagtccatttttattacaccttcacagctcctcaagaatatgaattaaaaccctttggatttttttcttctaattcatacttagaccttccactaggcatagttgacaaaggcactgtttaaaagatatgtctcatcctgagtttccattcaccagtctgtgcttttgttagccttttgtttttatatcctgcaatgacatcctgcattcaacttgcctgtcaccraatgtccccctgctccaccaccagcaccccattctacctgtgctgttttccttctactgagactcacttccacctgtgcccagttccacctgcctttccttctacccagcctcagttctacttgtgctcaattccacctgcccttccttctacctgtgctcagttctacctgttctccatttttcctatcaacctacctagtgaaatgggggcccaaacacatttaaaactggggcactgaggtacttccaggagggctgggggtgtgcggggacgacttctgtccagggctccctccag

SEQ ID NO: 84018 - DNA, 601 bp, Human
tctttctggaccacctttaaaaatattaacatactttctctttataaaaacaatctgggcttagtctccctccactcatgactatctggtatcttttctagtcattttttgtttttcttgtactatatattctttatattggtcaaatgtgtatacataattactgcagttttcctcttcaattattttctcatgctattaaaatattccatatttgcataatgtttcatgatttaatggttgcacaatatttcatcataacacaagttatgattgcttgacttgccaaataaaaatatargacccccagttcagcttgaacttcaggtaaacaacagttttttttttctagtatatgtatctctcatgtaatatttcattgcaacgtttgggacatatttatttttctttgtttatctgagattcaaatggaactgggcatcctgtactttatcttgcaaccctacaaaatatcacattatttacacagtttcttgtggtggatgtttagaattttcagcaatgctatggacatctttgggtatgaaattttctattttgaattacttcctttggtagattatcagaagtagaattactt

SEQ ID NO: 84019 - DNA, 601 bp, Human
cttcaattattttctcatgctattaaaatattccatatttgcataatgtttcatgatttaatggttgcacaatatttcatcataacacaagttatgattgcttgacttgccaaataaaaatataagacccccagttcagcttgaacttcaggtaaacaacagttttttttttctagtatatgtatctctcatgtaatatttcattgcaacgtttgggacatatttatttttctttgtttatctgagattcaaatggaactgggcatcctgtactttatcttgcaaccctacaaaatatcayattatttacacagtttcttgtggtggatgtttagaattttcagcaatgctatggacatctttgggtatgaaattttctattttgaattacttcctttggtagattatcagaagtagaattacttaggagatgagtatttattttcaagacttttcaaacctatctccaaatcactttttaaaaaggttatagcaatttatgttcccaccaacagcacacaagagtcctcgttccctgcacccttgctcacattatcatcattgaaatacttctttgctattttggcaggcaaataatgat

SEQ ID NO: 84020 - DNA, 601 bp, Human
tcttatttttacttattgacttatttttactcagctgctggtgctggagcctagtccctatgttcaggctcagggatggttctgcacagtggcttttgctcccagcctacctgctagcctacccattgtctagaagataaaagcttcatttaggagtcatctcccaaatgcatttaaaataaatcagttaaagcacagaatagtaattttcttctgagcacacagaattaaagttttattttcacagagctcgctcacttttgttcctaataaatgactggtttcaaaaggcttccataamtacccgttttatccacccttataagcccacagatatgctgcagggttctgctgtgttcatggaaaccataaggcttcatggtatctgcagtatttgcccaaaaaaatactgataacccaaggatgggactccattcccaaagggcagggaggaaggggaggggcatttcagtgaattttaatatgcagatcatccgtttcctaatggagttcatgcttcaccttagagctgaaaaagcaagacttactttcgctaagaaaggaaagactgaacgatgcacatgacttctggaacatttcc

SEQ ID NO: 84021 - DNA, 601 bp, Human
tctggaacatttccttaagtttggtaaagagggcacgcacagtgcccggcagcaccgcctctaacttgtggagatggcccatccttctggcccttctgggcctcctgtaattaatccccatcgcagttaaacaaggggccgcgtggttgccttctctgatatgctcttccagagagacttccccacggggcatttacatcctcccaggacttgttttatggaaattgctgtgttcgcttcagtttttcgttttctgtgttacaacggttttggcatttgttgccttgcatgaatttctccrcatgacgtgacagtctgctgcctgaattcagtatgtccacgtcacctgttcacgtcatctggcctgagtctggctgcactgatgtttctcattagtgttactctgtgctcataccctcagcattttgagaccccctcaaggattatgcttttctttctactttcagcctgatcatttaagctaagcacattgatacattgcttctggtgataaatagctgactttgtgatttcatttattctaatgtgtaagtctccattgtgtaactggtttgacctgcagaaaattgatttcagcacc

SEQ ID NO: 84022 - DNA, 601 bp, Human
aagcgattctcctgcttcagcctcccgagtagctgggattacaggcatgcaccaccacacccggctaattttttttgtattttttagtagagatggggtttctctatgttggtcaggctggtctccaactcccaacctcaggtgatcctcccgcctcggcctcccaaatggcctcccaaagtgctgggattacaggcatgagccaccacgcccggcttactctgacaactattaaataaaagattattttgtacagaattatttgatgttatttcgtatttcaatatgaaagtggccaaamcactttccatttttttttaaattttattattattatactttaagttttagggtacatgtgcacaatgtgcaggttagttacatatgtatacatgtgccatgctggtgtgctgcacccaataactcgtcatttagaattaggtataactcctaatgctatccctcccccctccccccaccccacaagagaccccagagtgtgatgttccccttcctgtgtccatgtgttctcattgttcaattcccacctatgagtgagaacatgcggtgtttggttttttgtccttgcaatagtttactg

SEQ ID NO: 84023 - DNA, 601 bp, Human
tcctgcttcagcctcccgagtagctgggattacaggcatgcaccaccacacccggctaattttttttgtattttttagtagagatggggtttctctatgttggtcaggctggtctccaactcccaacctcaggtgatcctcccgcctcggcctcccaaatggcctcccaaagtgctgggattacaggcatgagccaccacgcccggcttactctgacaactattaaataaaagattattttgtacagaattatttgatgttatttcgtatttcaatatgaaagtggccaaaacactttccwtttttttttaaattttattattattatactttaagttttagggtacatgtgcacaatgtgcaggttagttacatatgtatacatgtgccatgctggtgtgctgcacccaataactcgtcatttagaattaggtataactcctaatgctatccctcccccctccccccaccccacaagagaccccagagtgtgatgttccccttcctgtgtccatgtgttctcattgttcaattcccacctatgagtgagaacatgcggtgtttggttttttgtccttgcaatagtttactgagaatgatg

SEQ ID NO: 84024 - DNA, 601 bp, Human
tggggttgtttgtttttttcttttaaatttgtttgagttcattgtagattctggatattagccctttgtcagatgagtaggttgcaaaaattttctcccattttttaggttgccttttcactctgatggtagtttcttttgctgtgcagaagctctttagtttaattagatcccatttgtcaattttggcttttgttgccattacttttggtgttttagacatgaagtccttgcccatgcctatgtcctgaatggtaatgcctaggttttcttctagggtttttatggttttaggtctaaygtttaagtctttaatccatcttgaattaatttttgtataaggtgtaaggaagggttccagtttcagctttctacatatggctagccagttttcccagcaccatttattaaatagggaatcctttccccattgcttgtttttctcaggtttgtcaaagatcaggtagttgtagatatgcggtgttatttctgagggctctgttctgttccattgatctatatctctgttttggtaccagtaccatgctgttttggttactgtagccttgtagtgtagtttgaagtcaggtagtgtgatgcc

SEQ ID NO: 84025 - DNA, 601 bp, Human
cccatgcctatgtcctgaatggtaatgcctaggttttcttctagggtttttatggttttaggtctaatgtttaagtctttaatccatcttgaattaatttttgtataaggtgtaaggaagggttccagtttcagctttctacatatggctagccagttttcccagcaccatttattaaatagggaatcctttccccattgcttgtttttctcaggtttgtcaaagatcaggtagttgtagatatgcggtgttatttctgagggctctgttctgttccattgatctatatctctgttttggwaccagtaccatgctgttttggttactgtagccttgtagtgtagtttgaagtcaggtagtgtgatgcctccagctttgttcttttggcttaggattgatttggcgatgcgggctcttttttggttctattttcttgagactatttccttttaacaagtactaattcaggttctcaaatttagccctttttggttgagtgagtcattttcatacaaaatcacacttactatcaacaccagtgacagtgagcatatagagcacaagcggaatgactgatccagaagagaaaaacaatagacat

SEQ ID NO: 84026 - DNA, 601 bp, Human
ggtaatgcctaggttttcttctagggtttttatggttttaggtctaatgtttaagtctttaatccatcttgaattaatttttgtataaggtgtaaggaagggttccagtttcagctttctacatatggctagccagttttcccagcaccatttattaaatagggaatcctttccccattgcttgtttttctcaggtttgtcaaagatcaggtagttgtagatatgcggtgttatttctgagggctctgttctgttccattgatctatatctctgttttggtaccagtaccatgctgttttrgttactgtagccttgtagtgtagtttgaagtcaggtagtgtgatgcctccagctttgttcttttggcttaggattgatttggcgatgcgggctcttttttggttctattttcttgagactatttccttttaacaagtactaattcaggttctcaaatttagccctttttggttgagtgagtcattttcatacaaaatcacacttactatcaacaccagtgacagtgagcatatagagcacaagcggaatgactgatccagaagagaaaaacaatagacatgttcagctcagaactctgag

SEQ ID NO: 84027 - DNA, 601 bp, Human
ctcccccccccaaaaaaaaaaaaggaaaccatgattcctgccacctcaattcatccgttgaaagcacgttggcatatttgcttccgtcatgtgtctccaagtgtctctatctatacagccaacccctttcagtcagtgagagacagggatgcacctgccctaagctgttcagcaaacgtctctggggactaaagacattctctattggtcatattgctccatgagaattcagcaacaacccctcatgccatttgtattcagatttcctccattctttccaaatttttttgtccttttcackcattgcatttgatgattgtgtctctttaatctttctttttctaaaataaatccatcaccatcacactgttttattttcttttcatagcattgcttttcagtttttttgaagagaccaatccactagcttttgtagactatctcccattctggactttttttgtgctgccttgtaatatgcctttcgactggtttctttatccccctgtatgttctgcaaaccagaagcttgttctgagattcaagctcaactccttggcaagagtgtttcagcattgctgtcgaaagcttcctgctgtgt

SEQ ID NO: 84028 - DNA, 601 bp, Human
ctctatctatacagccaacccctttcagtcagtgagagacagggatgcacctgccctaagctgttcagcaaacgtctctggggactaaagacattctctattggtcatattgctccatgagaattcagcaacaacccctcatgccatttgtattcagatttcctccattctttccaaatttttttgtccttttcacgcattgcatttgatgattgtgtctctttaatctttctttttctaaaataaatccatcaccatcacactgttttattttcttttcatagcattgcttttcagtttytttgaagagaccaatccactagcttttgtagactatctcccattctggactttttttgtgctgccttgtaatatgcctttcgactggtttctttatccccctgtatgttctgcaaaccagaagcttgttctgagattcaagctcaactccttggcaagagtgtttcagcattgctgtcgaaagcttcctgctgtgttacttcaggaagtaacacaggaagtgggcttgtcatgctgacccactactggcgatgctgaatttcaccactgggttcaaagctggtaacttccagatccctcc

SEQ ID NO: 84029 - DNA, 601 bp, Human
tttttttgtccttttcacgcattgcatttgatgattgtgtctctttaatctttctttttctaaaataaatccatcaccatcacactgttttattttcttttcatagcattgcttttcagtttttttgaagagaccaatccactagcttttgtagactatctcccattctggactttttttgtgctgccttgtaatatgcctttcgactggtttctttatccccctgtatgttctgcaaaccagaagcttgttctgagattcaagctcaactccttggcaagagtgtttcagcattgctgtygaaagcttcctgctgtgttacttcaggaagtaacacaggaagtgggcttgtcatgctgacccactactggcgatgctgaatttcaccactgggttcaaagctggtaacttccagatccctccattgtgaaagtatgtacctcttcctacctttgcaattgtcagataatctttggataaaactttgaatccacaaaaatgtggccatgtcctatttccctaacaatccttcatcggatgggttgaaaatctgtggctggtccttgtccataatggttactcctttggctgagcagaatgg

SEQ ID NO: 84030 - DNA, 601 bp, Human
tggcgatgctgaatttcaccactgggttcaaagctggtaacttccagatccctccattgtgaaagtatgtacctcttcctacctttgcaattgtcagataatctttggataaaactttgaatccacaaaaatgtggccatgtcctatttccctaacaatccttcatcggatgggttgaaaatctgtggctggtccttgtccataatggttactcctttggctgagcagaatggaaatttcctaagtctaagagtgaagatgctttgtctttagtctaagagcattgggaagccattggggwaatgggttcagtgtgatgtctggaaagcattgatgccttgatgagatttgtcatttgaaaagtgaagcatggggacaagaaaggacaaggatggacctaagttgatggatttggagtcccctgtggcagtccaggtgcgagaggatggctgttttattctagtgggtgggcacagggatggaaaggtgcagacagaggtatgacacgattttgcctctgaagcagatggatggctgctattagagcagcctgcttattgtataagacatcctgtgaatagtcaaactaaaacatgcagcc

SEQ ID NO: 84031 - DNA, 601 bp, Human
tctaagagcattgggaagccattggggaaatgggttcagtgtgatgtctggaaagcattgatgccttgatgagatttgtcatttgaaaagtgaagcatggggacaagaaaggacaaggatggacctaagttgatggatttggagtcccctgtggcagtccaggtgcgagaggatggctgttttattctagtgggtgggcacagggatggaaaggtgcagacagaggtatgacacgattttgcctctgaagcagatggatggctgctattagagcagcctgcttattgtataagacatcctrtgaatagtcaaactaaaacatgcagccgggcacagtggcttacacctgtaatcccaacactttgggaggccgaggcaggaggattccttgagcccaggagttcaagaccagcctgggtaatatagcaagatgccatttctactaaaaataaaaaaactagccaggcatggtgatgcacacctgtggtcccaggatactcaggatactgaaacgggaggatcacttgggtcccagggttgaagctacagtgaactaagatcgtgccactgtactccagcctgggtgagggaatgaaataaa

SEQ ID NO: 84032 - DNA, 601 bp, Human
tgaagcagatggatggctgctattagagcagcctgcttattgtataagacatcctgtgaatagtcaaactaaaacatgcagccgggcacagtggcttacacctgtaatcccaacactttgggaggccgaggcaggaggattccttgagcccaggagttcaagaccagcctgggtaatatagcaagatgccatttctactaaaaataaaaaaactagccaggcatggtgatgcacacctgtggtcccaggatactcaggatactgaaacgggaggatcacttgggtcccagggttgaagctrcagtgaactaagatcgtgccactgtactccagcctgggtgagggaatgaaataaataaataaaataaatagaaactaaaacaaaaaatgcaacaggaataaatccacattgaatgatgaaattttcacaaaatatcccttgttgacttggagaccctagtggaacagtccggtaagcctcatcagctgctcaaggcaaacacagttgttaggggccaccgccatggctagtgaattatgcagaaaacaaggacgccttgcagaacctcatctcccactagatgcagcattttgtttgatc

SEQ ID NO: 84033 - DNA, 601 bp, Human
tcaggatactgaaacgggaggatcacttgggtcccagggttgaagctacagtgaactaagatcgtgccactgtactccagcctgggtgagggaatgaaataaataaataaaataaatagaaactaaaacaaaaaatgcaacaggaataaatccacattgaatgatgaaattttcacaaaatatcccttgttgacttggagaccctagtggaacagtccggtaagcctcatcagctgctcaaggcaaacacagttgttaggggccaccgccatggctagtgaattatgcagaaaacaaggaygccttgcagaacctcatctcccactagatgcagcattttgtttgatcagcaaagtaccaaaatttaacagctgagccatactaatgaagtatgggactgtgtctcttagaaaagaaagagaattgggaaaatatgcttctcttccagaataataaaaacgagaggctgtagctcaattattaggctttgagaagtaatcatcaagaaagccagcaatttcatgcaaatagagatgtgactgaattacggtactcagcctacaaaatatgcagcctggtcgttaaaatgggaaactcttga

SEQ ID NO: 84034 - DNA, 601 bp, Human
cagagcacctgtcaagctctggaaagtaggaaaccttctaattctgatagacacatactggagtccctaggaaccggctaccccttcctgatgtcaggcacattccatggaagcagggtagagcagctgggtgtgtacggaaccctgcttcttttcagttgccctgcgaagtacacagcatcatctaagacatcagaagcataactcggtagcttttggggatgtagctgccatctaggagagtttggcaacacggccgcacactcaaatggtttattgcatgccaaatctgtgcagatgrtcaggagtacctgttggagcctttcgttttgaaattccgtaagagaaaggaacagacagtagtatcccgtattcaatctgatgtgtcctgttcatcatgaaaaattgatttagagcaaacataagaaaaagctgtaacctgcaagccttgtttgttaaaatcatgttttcctagaagcagaaagggcttgaatgcctattcctaacctttggggatttactctttaactattagagagacatgctcagggactgtttcagaatatattcttgaagaagccgtctcagacaggaggtgctc

SEQ ID NO: 84035 - DNA, 601 bp, Human
catactggagtccctaggaaccggctaccccttcctgatgtcaggcacattccatggaagcagggtagagcagctgggtgtgtacggaaccctgcttcttttcagttgccctgcgaagtacacagcatcatctaagacatcagaagcataactcggtagcttttggggatgtagctgccatctaggagagtttggcaacacggccgcacactcaaatggtttattgcatgccaaatctgtgcagatggtcaggagtacctgttggagcctttcgttttgaaattccgtaagagaaaggaayagacagtagtatcccgtattcaatctgatgtgtcctgttcatcatgaaaaattgatttagagcaaacataagaaaaagctgtaacctgcaagccttgtttgttaaaatcatgttttcctagaagcagaaagggcttgaatgcctattcctaacctttggggatttactctttaactattagagagacatgctcagggactgtttcagaatatattcttgaagaagccgtctcagacaggaggtgctcaggtaaacagaaagacaggtctaattcacagctcctatgaaatatatcttcat

SEQ ID NO: 84036 - DNA, 601 bp, Human
gctgccatctaggagagtttggcaacacggccgcacactcaaatggtttattgcatgccaaatctgtgcagatggtcaggagtacctgttggagcctttcgttttgaaattccgtaagagaaaggaacagacagtagtatcccgtattcaatctgatgtgtcctgttcatcatgaaaaattgatttagagcaaacataagaaaaagctgtaacctgcaagccttgtttgttaaaatcatgttttcctagaagcagaaagggcttgaatgcctattcctaacctttggggatttactctttractattagagagacatgctcagggactgtttcagaatatattcttgaagaagccgtctcagacaggaggtgctcaggtaaacagaaagacaggtctaattcacagctcctatgaaatatatcttcattacttttcaggatgtgttcattcagcctttaaaatggggtattttataatctaattgacaggagggtatcatgtttacctttttctttgtgggccatttcagtgttttgtttttttatttcaggatttcctaatggaaacattcatcatgtttaagaacctcattggaaagaa

SEQ ID NO: 84037 - DNA, 601 bp, Human
ccagcaatcataccatggctatcatagaattctccttggttgttaatgagaatgtgaccacttgcttgaatttttgtgtctcttctagtcttagggtttgccttcgtgctccagtagggtgcttgagtttatgtactaataacccctactagaattttaagtgataggaatgacctggtaggaagtgagtctgccaggtaaaccgaatccctttgtcacctcgaagaaaccgtttcttattaactgctttacttttgcttgagaaaggcatttctacaacatgtggtgggtgagagagagrccagtactgaatgtaattttccctattttggaattagactttcttgttcgtattgactacatagcgtgtaacaaaaccttatccacagttgtcagctactgagacttgtaacggaatttttaaaaattcaactactccagctcacagcttccctagtcctccctgcctactgtaccctctgctctcaggataataaagacatgaaaccagcatttgcatttcctcagagctagtgtagtttgcaactgtgattatcaatcgcttccaggcattcctctctgttggcataggttttgtgtt

SEQ ID NO: 84038 - DNA, 601 bp, Human
ccttaagccctagaaagggattccaccttggagatgccagttccttaaggataagtcgtgttggtgctcagaaggcaaatttgcagggtaggctgtttgcaggtactttgccatttgctttcgttgccgtgaaggaatttgagtcgttgaccacactgagctgagggcttggatcaggggaaaggcaccgcttgccttaggatgggagagagggaaaaattagtgcccacgtgcagggggcctgcccccaggaccatggcaccagtggcaacctgtggatggccaagtcaggaggactgcktgttttctttcctgttctacctccgtccagagaagcacctctgcatcccaattaagggtgcatagttgaatattctttgtgcaggttgaaatcatggttataaagcatttggggcttgagaaactcttggattattacttcttaacatcttttttcctttctttgaagcctggattttagttgatgttgtgacttctcatttaatttatttttaatatttattggcttactattgaggttttgcacagccaatggcttgatgattttaggcacactttagaattatttttttcctttgaa

SEQ ID NO: 84039 - DNA, 601 bp, Human
ggggacacagggacattggcagttctctctcagcagcttttgggcctagatatggttgcagatggtgtatcagagcccactgcaccttgggatggaaactgacctacgaccaaatgctacctgttcgagttctgttcattcttaaggcctagtcataaattatttcagatactttccataacagttattctatttcatgtctgcttttgctctttgcttaataactaaaacaaataatttccagagttttacctggttgtttataaccaatgtattgcacatagcctagatattttaaacygtgtcgtcttattcagattgcctgttttaaattttaattcagagatgaaaaatcaacctactctcaaaggagtggcagtgatgaagagctctcagcaggactcttatttagggaagcttgctttaaaggaaagtttgaaaagggcaaagtctgtttaagaattctcagagatcacgcgcacctcgtcgggagtgcctggctggtactgatgccgcatcccgctggcacttaatgccggaggaggcacttcatgttacgaggaccgaagccaagtgccctctctattttatgcatgaaaca

SEQ ID NO: 84040 - DNA, 601 bp, Human
tgatgctcagtaactgttagaaatacatagaaatatgtgtgcagtggctcatgcctgtaatcccagcactttgggaggccgagggagttcgagaccagcctgaccaatatagtgaaaccctgtctgtactaaaaatacaaaaaaaaatcagccaggcatggtggcatgtgcatgtagccccagctactcaggaggctgagacaggagaattccttcaacccaggaggcggaggttgcagtgagccgagatcgtgccactgcactccatccagcctgggtgacagaccgagactccacctcaaaaaaaaaaaaaaaaaaaaaaagaagaggaaagaaagaaagaaatatatgtgatttattgcagtgactctcttctccttgtttccccatttctcagccacccttctctgccatgtgacctcagccaaaccagcgccctctagaacaaataatagcagctagctgctgaagataggactggtcttcacttattaggggggtgtccgagaattggaggtggtttccccaagtcgctctgccaggggctccagtgtctttgcaggagatttttgtgggctttgatttggggtggtgtttggga

SEQ ID NO: 84041 - DNA, 601 bp, Human
atagaaatatgtgtgcagtggctcatgcctgtaatcccagcactttgggaggccgagggagttcgagaccagcctgaccaatatagtgaaaccctgtctgtactaaaaatacaaaaaaaaatcagccaggcatggtggcatgtgcatgtagccccagctactcaggaggctgagacaggagaattccttcaacccaggaggcggaggttgcagtgagccgagatcgtgccactgcactccatccagcctgggtgacagaccgagactccacctcaaaaaaaaaaaaaaaaaaaaaaagaaraggaaagaaagaaagaaatatatgtgatttattgcagtgactctcttctccttgtttccccatttctcagccacccttctctgccatgtgacctcagccaaaccagcgccctctagaacaaataatagcagctagctgctgaagataggactggtcttcacttattaggggggtgtccgagaattggaggtggtttccccaagtcgctctgccaggggctccagtgtctttgcaggagatttttgtgggctttgatttggggtggtgtttgggagcaagatggcattggaatcacagtga

SEQ ID NO: 84042 - DNA, 601 bp, Human
ttggcactgggggggatatctcttctgaacatttcagtggctgcactgtacactgtcccattacccaacacacagtaggtgctcaacaggcagtgactgtgtaactgctgggctgaaagaaggtgtatccctaggaaatgttctaggaacaaagtgaaccaataaaatacatgaaatacttttgtagcagttcattttggagaataaaaggcagttactctttttatatttgagtccacaaagaaacaattgcagctataaatatgcagtgaacaaatacctcttattctctttaagatcaattagccagagctaattccttaattgaatgttgttctaaatttaccaccaaaatgcatgagggcgatctgtgtttgtatgtttcagccaactgcatgacatcagttccatcacaactgcaggaggatggaggaaggctgctgtgcacgattacttgctgttttgtggtcaacctttcccataagacttcagagaaggtttttacttaatactgtacctgtcaaattcccagagctgcaagtaaattgaagatacaaattatgttgtaaagtgaaatattttgtgttattcgcgttattct

SEQ ID NO: 84043 - DNA, 601 bp, Human
tatccctaggaaatgttctaggaacaaagtgaaccaataaaatacatgaaatacttttgtagcagttcattttggagaataaaaggcagttactctttttatatttgagtccacaaagaaacaattgcagctataaatatgcagtgaacaaatacctcttattctctttaagatctattagccagagctaattccttaattgaatgttgttctaaatttaccaccaaaatgcatgagggcgatctgtgtttgtatgtttcagccaactgcatgacatcagttccatcacaactgcaggagratggaggaaggctgctgtgcacgattacttgctgttttgtggtcaacctttcccataagacttcagagaaggtttttacttaatactgtacctgtcaaattcccagagctgcaagtaaattgaagatacaaattatgttgtaaagtgaaatattttgtgttattcgcgttattctgcagtttggttgatttaggaagaaaatgaactctgacagcttgatcttttcagttcagtggattctaatgtttcaaaacaaaagacctgcactgaagcctctttcctccatgctttggcagagac

SEQ ID NO: 84044 - DNA, 601 bp, Human
gacatcagttccatcacaactgcaggaggatggaggaaggctgctgtgcacgattacttgctgttttgtggtcaacctttcccataagacttcagagaaggtttttacttaatactgtacctgtcaaattcccagagctgcaagtaaattgaagatacaaattatgttgtaaagtgaaatattttgtgttattcgcgttattctgcagtttggttgatttaggaagaaaatgaactctgacagcttgatcttttcagttcagtggattctaatgtttcaaaacaaaagacctgcactgaarcctctttcctccatgctttggcagagacaccactgtgagctcttcttcatgctcaaacctcggcagctaccggctccatgtcatggacacacagagtcctaggaagagatagattctgctaaatgctaatgtttgtaaatataaatattaaccataccccaaaagggaaggagttcttttgctggctgactgaatgggtagcttttagcacctgccacttttctcagcatgcaatctattttttatagacagaaaaaatctctttttctagtttttctggtttgctgctgttgcctcagt

SEQ ID NO: 84045 - DNA, 601 bp, Human
ttatgttgtaaagtgaaatattttgtgttattcgcgttattctgcagtttggttgatttaggaagaaaatgaactctgacagcttgatcttttcagttcagtggattctaatgtttcaaaacaaaagacctgcactgaagcctctttcctccatgctttggcagagacaccactgtgagctcttcttcatgctcaaacctcggcagctaccggctccatgtcatggacacacagagtcctaggaagagatagattctgctaaatgctaatgtttgtaaatataaatattaaccataccccraaagggaaggagttcttttgctggctgactgaatgggtagcttttagcacctgccacttttctcagcatgcaatctattttttatagacagaaaaaatctctttttctagtttttctggtttgctgctgttgcctcagtgatattgcttgggatgcagaggtttggcaaagaggttggaggagcacccctgcattagtccgtgttcacgctgctgataaagacatacttgagactgggcaatttacaaaagaaagagtttattggacttacagttctatgtggcttgggaggcctcacca

SEQ ID NO: 84046 - DNA, 601 bp, Human
ttttagcacctgccacttttctcagcatgcaatctattttttatagacagaaaaaatctctttttctagtttttctggtttgctgctgttgcctcagtgatattgcttgggatgcagaggtttggcaaagaggttggaggagcacccctgcattagtccgtgttcacgctgctgataaagacatacttgagactgggcaatttacaaaagaaagagtttattggacttacagttctatgtggcttgggaggcctcaccatcatggcagaaggtgaagggcatgtctcacacggtggcagamaagagaagagagcttgtgcatggaaactcttctttttaaaaccctcagatcttgtgagacattcactatcaagaggaacagcacgaaagacctgcccccatgattcaattacttcccaccaggtccctcccacaacatgtgggaattcaagatgagatttgggtggggacacaggtccctcccacaacacgtgggaattcaagatgagatttgggtggggacacagccaaaccatatcaaccacctttcctcttctgttctgtggttatgctagacggcctcaccttcttttcttattct

SEQ ID NO: 84047 - DNA, 601 bp, Human
ttcagggactgtttgggccactgtgcagagcacagggagtaggagatttgtgtgcaaactggagggccagcgagagccctggggataagctacaccagcgatggccatgtctttggctaaggtagtcattgggaagagggaaacaatgagagatttggggcatgttttgcaggccacatgaacctgtacaaactagatgtaagaagtgaagaaaaatgaacaatcaaggaaaagtcttaatatttttggcttgagccaaaagtgattggtggaaagtttaaagataaagaagcgggcttgygaggtgggagtgttcccgagctctgttttggcctagcgcagtgtttctcaaccctgtttattttttttcccattatgaccctcctaaggagagaagtaaattcactttaattaagaagagaaatttaatgctaaggaataagaatttgtggggtagggtgtgctttggaggaccacaagcagaataatatctaaaatgttctttaccctcctcccaagaatcaatttcacccccttagtggagatgtttcccccagtgtggatgtgtggcctggttaattctcaggtgcccaggaggtgg

SEQ ID NO: 84048 - DNA, 601 bp, Human
gggcatgttttgcaggccacatgaacctgtacaaactagatgtaagaagtgaagaaaaatgaacaatcaaggaaaagtcttaatatttttggcttgagccaaaagtgattggtggaaagtttaaagataaagaagcgggcttgcgaggtgggagtgttcccgagctctgttttggcctagcgcagtgtttctcaaccctgtttattttttttcccattatgaccctcctaaggagagaagtaaattcactttaattaagaagagaaatttaatgctaaggaataagaatttgtggggtagsgtgtgctttggaggaccacaagcagaataatatctaaaatgttctttaccctcctcccaagaatcaatttcacccccttagtggagatgtttcccccagtgtggatgtgtggcctggttaattctcaggtgcccaggaggtggcccaatagagaagtttagctagcaactggaaattctacactgacgttcagaagaaaggtaaggctagaaggtacaatttgggatttagatgatgatattcaggccacctggggggcagtgtctctagggaagagaagccgacccaggctaatgcctc

SEQ ID NO: 84049 - DNA, 601 bp, Human
aaaacacaggagagagaagacagtgctgaatttctgagagagagcatagaaattaacagagaagtaaccaaaggatttggccacatagtggtcactgctcccatggaccagagctgcctcagtggagtggagtggcagaggaggaggccagcctgctgtgcggcatggaggaaggcatggaaggaggtaggcaccctggctgtgggcgttcattgggttttcatggcgctcagggtcagacagatggtgtgtcgggagctgtgataccaggagagtttgtaggaatttgctgttgatttasggcatgttgggaacactggtggagatgagcggatgatgggtgaaggtggaaacgctgggatggaggaggttcatgagggcaatgagttctagatgaaagggatggtacaggaggggctggcctggagaggagcaaggtcaggtgatttgttgcaacaggagaggacagagggaggtacaggtgtcaacctgtgtgtagatgtaggtggtggttggatgatggaaaaaaacccatgtgacttctgctttcctactgcagaatgaagtcaggtaattagtgagaaggggtgcagagaatagt

SEQ ID NO: 84050 - DNA, 601 bp, Human
atttttcctatattatcccaattactctttggtctccatgaagccattgtttttccaattcctctattgcagaatgcatgcagggaatttagaaatcacatggtaaacgttatgggccatttcctattgctgactttaccttcctagttcctcagagatgtaagatgaatgtccctggtgccagtgagcagccagtcagtgtgcacagagctggaaaaactaatagactagatgcatcttactgatcacgttgatgtggaggggcctcatctctctggtccagctggaaatgtgattgctkcctggggtggccatgactaagggattcctgtctcagctgcctctatatggagaactgagctcaactggtaaacgctcagtttccctttcagaaaagaatgttactctcaagagcagcagtgattcaaatggccttttgactttaaaaaattctccatttaaaaatgtagaagcattttatcctatacaattataaacattattggtagctaataaaaaattttgatgaggcagcagatcattaagaaaatacatatagaccttgcacacttcattttgacttccaatagataaatagatc

SEQ ID NO: 84051 - DNA, 601 bp, Human
cagtcagtgtgcacagagctggaaaaactaatagactagatgcatcttactgatcacgttgatgtggaggggcctcatctctctggtccagctggaaatgtgattgcttcctggggtggccatgactaagggattcctgtctcagctgcctctatatggagaactgagctcaactggtaaacgctcagtttccctttcagaaaagaatgttactctcaagagcagcagtgattcaaatggccttttgactttaaaaaattctccatttaaaaatgtagaagcattttatcctatacaattataaacattattggtagctaataaaaaattttgatgaggcagcagatcattaagaaaatacatatagaccttgcacacttcattttgacttccaatagataaatagatccatttcacaaagcatgtgcatttgtcaggttgctttttcttggttttgtttttttatttgacttaagataggtctatagatgagtgtttgccttcgttttctgtgagccagttttcatacctttaaagttgaataagggctgggcatggtggctcacacttgtaatcccagcactttgggaggccgaggcag

SEQ ID NO: 84052 - DNA, 601 bp, Human
acgctcagtttccctttcagaaaagaatgttactctcaagagcagcagtgattcaaatggccttttgactttaaaaaattctccatttaaaaatgtagaagcattttatcctatacaattataaacattattggtagctaataaaaaattttgatgaggcagcagatcattaagaaaatacatatagaccttgcacacttcattttgacttccaatagataaatagatccatttcacaaagcatgtgcatttgtcaggttgctttttcttggttttgtttttttatttgacttaagatagrtctatagatgagtgtttgccttcgttttctgtgagccagttttcatacctttaaagttgaataagggctgggcatggtggctcacacttgtaatcccagcactttgggaggccgaggcaggtggatcacctgaggtcaggagttcgagaccaggctgaccaatatggtgaaacctcgtctctactaaaaaatacaaaaaattattagctgggtgtggtggcgggcacctgtaatcactgctactggggaggctgaggcaggagaatcgcttgaacctgggacgcagaggttgcagtaagc

SEQ ID NO: 84053 - DNA, 601 bp, Human
gaaatcagtggctgcagaggcaagctacgtgcaggtaagttaagggcttactatagaaatgcaaaatgccaccattcttcactgtgttctgagaggtttcatactgttgtcgacacctgtgctggtgtagaattgcagatctctttctgtcttttttttgttgtttttctccttttcattttttcattttttactccacgctaagaacatcggaatattttcaactttaccattggtaaaatagtgcaaaggaagtgaagatcacgtcagcccatggtccatattttattccttgagttarcaaatcaccaacactatttagtttagcgagttactcctttggaatttacagtaaagccatatttaatatatttccatttagcaagtatttgttttaaataacagccttggcttccttgtttggtttgtgagggagactttgcttctgtgtttccaacgtggctggaagtggaggctccagggctttgcctcactcatacagttttatttttaaattgaaaagtggatttgtttaacatcctccaagaagcaaactcataaagctcgggctttcctaaaatgcattgccaaaatcataatt

SEQ ID NO: 84054 - DNA, 601 bp, Human
gctcaagtagttttgtggcttgttgagaaaatgatacagagtttaggaagcagaaggacacagcaatgacacaggagagcctcacaaacaacaaacactgcctttgccaggagaattgggaatgggaccattcttgaccttcctggaagaactcagaaggacgtttcactccaggaggcatcaggagggaagtctttcattgttttcaaggaatctgttgtccctgggagtgggtcacaagtgctgcacacacacttggtgtctctgaaggagcctcaccacatattagagatgaggttcytccttgcctcaggaccccatgcctcattggcattgctgcagggagaccccaggggcttgtggcagtcagaggtcagcagaagacacgcagggttgatctgtgctcatggactctgatctcacatcaagagccaggttccttttgaccgggatgatttgagaaatggtgggagcagggcagttatcaattcagatgagtagatgctgacttagctctgtacagctccctggcaccacccatggtacagggaggcagggattaggagaatgctggcctccctgtaggtcagtgatgttgcat

SEQ ID NO: 84055 - DNA, 601 bp, Human
cacctgagagacacaggcaggatttcctctcgctttagaaattgagcagcctgcttggagcaggcttgttctcagattcattgacacttctgcccatcagggtgatctgcaggaatgaaaagtggttagaattctgttgcaaaggttaattttaaaaggccagtgaacacccacaagggggtcaccagggcaaaaccacagcacacacccgcctctccgtttaactcacactagtccaggtgctctgcctgctcttacctgcttttcctcttggttgggtaacaagcattcagttgactgyatattctcctccctcagtttcttctgacatcttcgtgagacctgagagcaagctctgccttggcgacaaccagttgtcatttcttagtggcagcctttatttttcaaaaaatgaagaaggataggcagtctctgcagagtgatagtggggagctgccagaggggcagcagggtcctgcgtgtatcctaccaactgtgtttccattctcttttctcccaccacagaagaacaagtaagcgtagagctgacagggaaaggtctccccaccagggctgtctgtcctgagagtttagaatgtgc

SEQ ID NO: 84056 - DNA, 601 bp, Human
aatgaaccatcaattctgtttcccagctgtgcttccacaccctcactcttggatgggactgctgggttccttgtctgccacaagcagcaattgctggaagtagcaggtcagaaatgggaaaggaggcctggactgcatagccaggcaagccagtgaggttggagcaaacccttgaacaggggctgggcccacctttgtagtcttgtcaccaaggaggttactgaagcctccagaaggcacactgtctgatccaactcacatgccagaggaacactgaatagtttccttccgatgcattacrttcattagttatagaaggaataaagccatcctatatcttctctgaaaaatgaaggagtgaaaagagcacaatgtaatcctattatggttgcaactcttcccagtttggttttctgcagatctatttacatgcatactttattctttcataatcatggtgtaatatcatctgtgtactgcattattttacttaccattctatcacaagcatttttccatgttactccagcattttcattgccaactttcttattggctgcatgagagtctatccagtgggtataccataacttgtcagcac

SEQ ID NO: 84057 - DNA, 601 bp, Human
tatattaaactttttgtttgtctagaatttaatgctttgtattaaatgcatgtaagttgattttttaaattgcaactagttattacagcaccatttattaaataattcttcatagtttaaaagtggttcttccagttaaggttttaacataatgttagggataatttctgggcaatttgttgcttcaataataacatgtttggccaagcacagtggctcatgcctgtaatcccaacactttggaaagccagagtgggaagatcacttgagggcaggatttcgaagttatggtgaggtattwtcatgtcactgcactccagccagggtgaaaaagtgagaccctgtctctaaataacagtaatcatcatcatcaccttttattcttgggttagtaccacattgttttaattaccatttctttatggtgtgttttagatatttggcatcggccaggtgcggtggctcacgcttgtaatcccagcactttaggaagctgagacaggtggattgcttgagcccaaaagttcaaaactagactgggcaatatagtcagaccttgtctctacaaaaaaaaaatttaaaaattagctgggtgaggtgg

SEQ ID NO: 84058 - DNA, 601 bp, Human
acagtgaaagatgagaagtaaatggctcatcctccataaatggccatcgctgactgtttcatgtagaactttctggcctgtgcccatatcttctctcttcaggctttggcagtggggctgatacttcacaggctgttccagtaccactgcaccttcactctggaggtgggagtgggactccgtgctgaggaccctagatgcacatctgttcccttagcagggagccatgtccagagagtgaggcatgcagggagtggtcatgtggaaggtgcggtcagaccgccaaggtcatgccatcttytgggcactggtagtccctatggagctgctgctggccagtgggaagatttggaggatttgaggatactcttcagagtgtgcttccacagtctaaccctcctgcttgacgacctgttatgtgtgagatggtggctttgtcacaggaatcacctgaaagacctctatctgggctccgtgaaactacctaagcaggtcagtctttcagtgaactgatctgatatcattgggctatcacgagcctgaggctggctccccactttcaaatcatcctcaaaaggcagggcaagtgttttcctctggt

SEQ ID NO: 84059 - DNA, 601 bp, Human
gatactcttcagagtgtgcttccacagtctaaccctcctgcttgacgacctgttatgtgtgagatggtggctttgtcacaggaatcacctgaaagacctctatctgggctccgtgaaactacctaagcaggtcagtctttcagtgaactgatctgatatcattgggctatcacgagcctgaggctggctccccactttcaaatcatcctcaaaaggcagggcaagtgttttcctctggttggtgatggtgtcctagcatgccctttttccagctggcttcccactgggctcagcccgatgsgtctactgcaatccccctttcctgtgttgccctcggataactccatgtgtaggcctgaatcgtgttcatttccaggaaaagtaaatgatgcatatcttactttccatctgtggtcattttttttctgcttgagaaacacctgggtctgcttgtttttgaattctctttttgtttgtctgaaaaagaaatctattttatttcaaaaattcaatattgaaggataattcagatttagaatttgaggctagcagttgatttctttcagcacttcaaagataattattgcaccatcttttagct

SEQ ID NO: 84060 - DNA, 601 bp, Human
tgtaaagtaaggaaatacattttccataggaaaaaaaatcaacatgaattcatactatatttgcatttccaatttaggattatggagattttagttaccttctttgattttatatgtgtaatttgtctcttacactgaaaatttgggtccctaatgacacaaacatgatgtcttgttgctttgtatgtatatataaaatatataataatttgtaatatacagcataatatagaatacatagtatatactatactatgtatatatttcacacacacacacacacacacacacacacacacayaaaatagtttcagaataacaataccaattgttactttaaaagtttgttttctccttaggatatatcctgcagacatacacaatcaagtcatgtttctcaggcacttgagatgaatccttgcatgtagctaaactcatcaatttgatatttaggataattttattttgtttttgatttttagtgattgcacttttttatttagaataatgtgtctcagatatactaagcaagtgttttcatagtattttcacttctgcccctacctttccctacaggaaaccacttttattcatttgttgt

SEQ ID NO: 84061 - DNA, 601 bp, Human
tggaactcaattacagatttgttagaccttaggcccacatcacatacatgtcttatgctttttttttttttactttatttttcattcattttctctctgtattttattctagctatatatttctgatatattttttacttttgtatttctttcttctgtcctataatctgctggtaaattcatgcatttttgttctctgtttctgttatggagttttcatttggttatttttgctaattggaaactaaaatttcctattcagtcttttggtcccttaaagactcttggtggttctgtttcygtggatgtgtttctgttgagttttttgggaagaagtcagtcttgttttatgatcacgtcctggtttctggtatgcctggattttcctgaaatgaatgctgtagatcatatgtaaaagatatacagacttaattgaaggtacgatgatgttatcttactccagatagtgtttatttttttccataatttcctgtgtttttatgttgtgtatatttgtttaataccatgaaactccttttctgtgatattcaaaatgaaggtcgtggtagttttgagtggaaggcagttttgtattgtgttt

SEQ ID NO: 84062 - DNA, 601 bp, Human
tttcctgtgtttttatgttgtgtatatttgtttaataccatgaaactccttttctgtgatattcaaaatgaaggtcgtggtagttttgagtggaaggcagttttgtattgtgtttttaaaactttattttccagcaattaaagatgtccacagttatgagaaataatacaaagagatcctgtagcgccttctctcagtttcctctagtggtaatatctggcataactgtaatatatcacaaccaagaacttgtgtcactcttttataggtcaagcctcttttctcctcctcgccctacccmgtttctgacaaccactaatgccttctttatctgcgtaactttttcaccgtatgaatgttacataaatgggctcatacagtaggtaaccttttgagactggcttcttttccactcagcataattcccttgaggtccatccaggttgttgtatatagcaatagtttgttccttttattactgagtagtatcccataatatggatatagcataattattttcaaccatacaagggcatttgggttgtttctagttttgggttattttgaataaagctgctttgaacatttgtgtgcagttttt

SEQ ID NO: 84063 - DNA, 601 bp, Human
atatcacaaccaagaacttgtgtcactcttttataggtcaagcctcttttctcctcctcgccctaccccgtttctgacaaccactaatgccttctttatctgcgtaactttttcaccgtatgaatgttacataaatgggctcatacagtaggtaaccttttgagactggcttcttttccactcagcataattcccttgaggtccatccaggttgttgtatatagcaatagtttgttccttttattactgagtagtatcccataatatggatatagcataattattttcaaccatacaaggscatttgggttgtttctagttttgggttattttgaataaagctgctttgaacatttgtgtgcagttttttgtgtgtgcacaaaagtttttatttctctgagttaaatgcccaggagtgcagttgctagatcccatggtaattgcatgtttagttttgtaaacgtctgggaggcaggactttaaggttgctggggcctcagggatgcataggacagctggggctttgcatcctcgactgcttcagctgaagacacagtctagagtctgtgtactctggcttaggttgagattgggaagacat

SEQ ID NO: 84064 - DNA, 601 bp, Human
agcaatagtttgttccttttattactgagtagtatcccataatatggatatagcataattattttcaaccatacaagggcatttgggttgtttctagttttgggttattttgaataaagctgctttgaacatttgtgtgcagttttttgtgtgtgcacaaaagtttttatttctctgagttaaatgcccaggagtgcagttgctagatcccatggtaattgcatgtttagttttgtaaacgtctgggaggcaggactttaaggttgctggggcctcagggatgcataggacagctggggcyttgcatcctcgactgcttcagctgaagacacagtctagagtctgtgtactctggcttaggttgagattgggaagacatcccttgttctcacttccagccctctcacttcagtcaagacttttgcttacaaagggcagcacagaggctcaccgtgcttaagtgtcacgtggatttactggacagaccatttgcacacatgtgaggcaagtggtatcgaattttacctggtagcaggtgccagcttccttcctgcatgccctgtcccctttatcctcaaagcaggcagagaatatggccact

SEQ ID NO: 84065 - DNA, 601 bp, Human
gtttattatagcctacgtagagagaatagagggacagacagcatttctggtgacagggcatatccagtgaaatgcagacataaatcatcttttaaacaagggtgggtttgcggtaggaaggcctgtgtgaggaaataggccctctctgggctccctccgtccttcacagagtgcctcctgacccagggtcgcaagccaggttctgtgccaggcaccactccagagcaggtatctgtggcttgacaaggatgcacagggcagccgatccttggaaagtctgtgtgtccaaagtgcctctggwtatatttcaaggacctgcctgagctgagtcacagttagcctctgacaatatttctaatagaccactctgttgttggacagtttttaccatttgcacttccagtatgaccactccaggtctctgcattaatttttctttttaaatcctctgttttaatgttttcggggtggggggggcccacttctatctgaaaatgcccatccagacactgtgggttctgtgccaatgccagggaaggaagctcagggttctgccctgggccctaagaccttagtgactcaggcagccctgctactggtt

SEQ ID NO: 84066 - DNA, 601 bp, Human
gagtgcctcctgacccagggtcgcaagccaggttctgtgccaggcaccactccagagcaggtatctgtggcttgacaaggatgcacagggcagccgatccttggaaagtctgtgtgtccaaagtgcctctggatatatttcaaggacctgcctgagctgagtcacagttagcctctgacaatatttctaatagaccactctgttgttggacagtttttaccatttgcacttccagtatgaccactccaggtctctgcattaatttttctttttaaatcctctgttttaatgttttcggggkggggggggcccacttctatctgaaaatgcccatccagacactgtgggttctgtgccaatgccagggaaggaagctcagggttctgccctgggccctaagaccttagtgactcaggcagccctgctactggttgggagcgctctccactggccacctctgctgcaaagctcttttctcttgcttcatgagaagtggaagagtgtgaaacagtacacggaggcctttctggctgtttacaagggagatgggccaccagtgtttgtcaccggagcttcagggtagcatgcctaggagaggagc

SEQ ID NO: 84067 - DNA, 601 bp, Human
agtgcctcctgacccagggtcgcaagccaggttctgtgccaggcaccactccagagcaggtatctgtggcttgacaaggatgcacagggcagccgatccttggaaagtctgtgtgtccaaagtgcctctggatatatttcaaggacctgcctgagctgagtcacagttagcctctgacaatatttctaatagaccactctgttgttggacagtttttaccatttgcacttccagtatgaccactccaggtctctgcattaatttttctttttaaatcctctgttttaatgttttcggggtrgggggggcccacttctatctgaaaatgcccatccagacactgtgggttctgtgccaatgccagggaaggaagctcagggttctgccctgggccctaagaccttagtgactcaggcagccctgctactggttgggagcgctctccactggccacctctgctgcaaagctcttttctcttgcttcatgagaagtggaagagtgtgaaacagtacacggaggcctttctggctgtttacaagggagatgggccaccagtgtttgtcaccggagcttcagggtagcatgcctaggagaggagca

SEQ ID NO: 84068 - DNA, 601 bp, Human
ccttggaaagtctgtgtgtccaaagtgcctctggatatatttcaaggacctgcctgagctgagtcacagttagcctctgacaatatttctaatagaccactctgttgttggacagtttttaccatttgcacttccagtatgaccactccaggtctctgcattaatttttctttttaaatcctctgttttaatgttttcggggtggggggggcccacttctatctgaaaatgcccatccagacactgtgggttctgtgccaatgccagggaaggaagctcagggttctgccctgggccctargaccttagtgactcaggcagccctgctactggttgggagcgctctccactggccacctctgctgcaaagctcttttctcttgcttcatgagaagtggaagagtgtgaaacagtacacggaggcctttctggctgtttacaagggagatgggccaccagtgtttgtcaccggagcttcagggtagcatgcctaggagaggagcaaacaggggccttggggctgtggagtcatgctgggaagatgaagaaaagacagttggtaactgacaaattgcaggtgtgatcattactctctgtgact

SEQ ID NO: 84069 - DNA, 601 bp, Human
gatgggccaccagtgtttgtcaccggagcttcagggtagcatgcctaggagaggagcaaacaggggccttggggctgtggagtcatgctgggaagatgaagaaaagacagttggtaactgacaaattgcaggtgtgatcattactctctgtgactccctgtttctcagatgcactgttgcttacatctttgtatgcttttgcattcctgctgattgattcaaggtgcaacgtgcctgcttgtcaggtatgctgttgatcacattatttaagaagaaataaagtcgttcccgcagctccacstgcagtgatgggctttaatgttttgtgcttcccgaggaaaacctgccgatgatgtgaagtgacattcaacccgccgagagctgatactggcagacaaatttcatgtcctgtctcctgatcaccagtttgctgcctccaagttgttagggatattaaaaacaggggtgggaagtccccacttgacaggttcaatttgtaatgtgaaaggtgctgagaaacaaagcaaggacccaggcagctttctgccaaggctgctggccccacactcagcaaggcaaagagaaaggggatctatctgct

SEQ ID NO: 84070 - DNA, 601 bp, Human
caggtgatccacccaccctggcctcccaaagtgctgagactacaggcgtgagccaccacacccagtcaaatgtagtgtttcatgtgagttgccctattttttttttttttaagatggagtctggctctatcacccaggctggagtgcaacggcgtgatctcggatcactgcaacctccgcctccctggttcaagtgattgtcctgcctcagcctcccaagtagctgggactaaagatgcatgcccagctaatttttgtattttttagtagagacgagttttcgccacattggccaggctgstttcgaactcctgacctcagttgatccgcccgcctcagtctcccaaagtgtcaggattacaggcgtgagccaccacacctggccaagttgtcctattcttaaataaggatagcacatatagaattattatggggattcaggtgtaaccccagggctttgggaggcctaggtgggaggatcacttgatgccaggaatttaagttttcagcctgggcaacaaagtgaaaccccttctgtgagtccattttgtgttgctctagaggaatacctgaggctgggtaacttgataaacaagaggtt

SEQ ID NO: 84071 - DNA, 601 bp, Human
tagaggaatacctgaggctgggtaacttgataaacaagaggtttatttggcccatagttctgcaggctgtacaagcgtggtaccagcatctgctcagctctcagaggccttaggaaacttttactcctggcagaaggcagaaggagagcaggtatgacacatggcacgagcaggagcaagagagggagaggaggaggtgccagcttcctttgaacaaccagctttcgtgtgaactatcaaaccagacctcactcattgccacagggaaggcaccaagttattcataaggtatccactcccrtgacccaaacacctcccactatgccccatctccagcattgggggtcacatttcaacatgagatttggaggggacaaaacgtccaaaccatatcgccccctccctacaaaaaaaatttagaaatacctaggtgtggttgtgtgcacctgtactcttagctacttgaggggctgaggcgagaagattgtttgagcccaggaatttgaggttacagtgagctgtgattataccactgcagtccagtgagacactgcccaccccaccccgataaaaaaaaaaaaagaactgtgattgggagggt

SEQ ID NO: 84072 - DNA, 601 bp, Human
cagttaggagggagttttcccttcatttttaaatgtactggagtatccttcagttctccttgagtgagaagcaatcgctttgaccattgtcaaccagaaagaatttccccacggcatttctctctttcccagctgggccataaattgtctcatgactgaggttgctgtctgctcctgagcaagctggaagcaatgatgagctcagagctgggctttattaaatcctaggaagacacataaaaattgttagcagttgatttcgcaggaaacacctagcaaacttgtcggggtttatattacraagcccagggcctgcagttagcagatcatcttttttgaaaagcatttgggtacctttgtcagagcttttctgcattttgacgtaggaggatacctgagggccatggttgtgagaaaggagagaacccacccaggtgtcctggggattgttttattcataaagtaattcggatgatctcgaggtggtccagggagatgggatagagtcagccaaggtgtctattgtaagatagattgtgaacccctcaaagataggctgaagtccttattcctgtcacctgtgattgtaaccttatttgga

SEQ ID NO: 84073 - DNA, 601 bp, Human
ccttattcctgtcacctgtgattgtaaccttatttggaaatagggtctttgcagatataatcaggttgaggtgggtgcatgttggagaaggatgggctctttattttttgtttgagaccatgtcttgctctgtcactcaggctggagtacaatagcatgatctcagctcgctgcaacctccacctcccaggttcaagtgattctcgtgcctcagcctcccgagtagctgggattacaggcatgcgccaccacacctggctaatttttttgcatgtattttggtagatacagggtttcaccwtgttggccaggctggtattgaactcctgacctcagatgatccacctgcctcggccctccaaagtgctgggattacaggcgtgagccgccgcgcccggccaagaagggtgggctcttaatccaatggctggtctcttataaagaagagaagacacagacacacaggaaaaatgctgtgtgaccgtggaggtggatcagagtgaaacatctgcaagtcaaggagattgccagcaacaccagaaactaagaggaaggcatgggacagagtcttccagacgggcttcagagggagcatcgcctt

SEQ ID NO: 84074 - DNA, 601 bp, Human
ggccacaaaaatagaaaagagatatcgccctcccttttatagcacaaatgttaccagtcatgctagtatcaaaaattatattccagtttactttctgcttccctttcaggcctgagatgcctggttgatccatcttcgaatactttcagggagctagtttttcttgggcctttttccctcttaggggccaccacagaatggcctccccagccgttttctctccctaattctggagcctggcctgcctgtcctcccgagagccccacctgactttctttgctttgctttgcctctgtggctsagcttgtttcatccgttcctccttgccattttgaaggcagtgccagcactggagaaccctatcagtgcttgcaaccccaccacgaggccggcagccgggagggctgggcgcatccgctcactgtaatctccagaacagataccagcttttcctaaccccctagcctgttctaacccttgaactgcttgagagatgtcaaaatcataactctctggggaagaggagtcagtgtttctgtcctagcagcacgcatcagtgcaatcagagctctgtaaaagccaggatccaccaaggggagga

SEQ ID NO: 84075 - DNA, 601 bp, Human
caacaacaacaaaaaaactcacataagtgtaccttaggctttttttgttttttgtttgtttgttttgcttaccttttatgtaagtccaatgcttctttttgaacgtggttccactgatgagcttctataatgcctcatcaacagttctgcctacaattttttaaagtggagttagtcacatttttcaggttttccagttgtctcaccccagtctaattttgcatattttttttagctctttacctttattatagcctttgtaaagcattccatttagttttccaaaactggttctttttcrtggcactaataattcattttctcatgtcacatttatttgaattacgtaattatagtagcaaggagaattggtattaagtaagttttaggtgaaacccatcgactttgggattgtgcactctgatgagtcgggcagaagagtccaggtgttctaggggagcctgtcactggtcagtggtcagtgtatcccgaggcattgcaaatcctcgcttatctgaaggacttgcttccctggaaatcttgtctgaggatttttgtgttcctcgagtgcccaacacacattgctggaccttaaggggac

SEQ ID NO: 84076 - DNA, 601 bp, Human
tcctccttgccacctcgttggtggaggtgacctgggatgctggacccactcttgtttggactcagtgtaggattctctacctctttctcccagttacacagccttgaccaagcttctttattcctctgatcttttttgtttgtttgtttttactttaagttcctggatacaagttcagaaggtgcaggtttgttacataggtatacatttgccatggaggtttgctgtacctatcaacccatcatctaggttttaagccccacatgcattagctatttgtcctaatgctctccctcccctkgctgccaaccccctgacaggccctggtacgcgttgttctcctccctgtgcccatgtgttctcattgttcaactcccacttatgagtgagaacatggagtgtttggttttttgttcctgtatgagtttgctgaggatgatggcttccagcttcatccatgtccctgcaaaggacatgaactcattctttttttatggctacatagtattccgtggtgtatatgtgccacattttctttattcagtctatcattgatgggcttttgggttggttccatgtctttgctattgtaaatagtgtc

SEQ ID NO: 84077 - DNA, 601 bp, Human
tttgatttgcatttctctaatgatcagtgatgttgagcttttttttttcacatttgttggcaccatgaatgccttcttttgagaaatgtctgttcatatcctttgcccactttttgatggggttgttcatttttttcttgtaaatttgcttaacttccttgcagattctggatatcagacctttgtcagatgggtagattgcaaaaattttctcccattctgtaggttgcctgttcactctgatgatagtttcttttgctgtgcagaagctctttagtttaattaaatcccggttgtcaattttttgcttttgttgcagttgcttttggcattttgatcatgaagtctttgcccatgcctgtgtcctgagtggtatagcctaggttttcttctagggtttttatcattttgggttttacatgtaagtctttaatccatcttgagttaatttttgtataaggtgtaaggaagggatccagtttccgttttctgcatatggctagccagttctctcagcaccatttattaaatagggaatgctttccccattgcttggcttgttgaagatccctctgatcatttttaaggctggttgagacca

SEQ ID NO: 84078 - DNA, 601 bp, Human
gtgatccgcctgccttagcctcccaaagtgttgggattataagcgtgagccactgcgcccggcctgctttacactttttacatagatcctggtgagaatcggacctgggatttttctatgaatgagagcctgttgtatgccatacccccaccccacccccttacccccacccctacagccttcctaatataaggaagaaatgaagcagccgagccatcattaagcagatcacctctgaaaatgaaggaaattggatgaaagctctgccccggcagctgagtgctaaattagggagaatcaygggaggccaagggcatggccgggctttgtcgctgccttattatggatttgataagaaacaacttttttgactgtttacattatggaaatgtgataacccgtttgtattacttaaactgtgcattttgtaagtgttgtcaaagggagggagtaatttgtaacagaagcagagtatgtagaaactgttctcgtaaaagcgttctctaaattgctttgcttgcagctgtggaggttgccataaagaatgatttctcatattggattttcaaagccgcaggagtggccacagagcaggcaacgg

SEQ ID NO: 84079 - DNA, 601 bp, Human
aaaatgaaggaaattggatgaaagctctgccccggcagctgagtgctaaattagggagaatcacgggaggccaagggcatggccgggctttgtcgctgccttattatggatttgataagaaacaacttttttgactgtttacattatggaaatgtgataacccgtttgtattacttaaactgtgcattttgtaagtgttgtcaaagggagggagtaatttgtaacagaagcagagtatgtagaaactgttctcgtaaaagcgttctctaaattgctttgcttgcagctgtggaggttgccrtaaagaatgatttctcatattggattttcaaagccgcaggagtggccacagagcaggcaacggacagcccaatgatttaagattatttaatgccccagttgtcgtgaaatagaaggaaataaactccagtgggctgctagaacacattactacaatctcttaatgccccaaactaggagactgatttatctcctgttatgtcttattaagtgacattcagaagaagaaaagaaaaaaaaggacagccaaagctgatggctgaaaattaccctgaaatgagtgtgatgcaggcaggcttgt

SEQ ID NO: 84080 - DNA, 601 bp, Human
gccaggctgacaacatatattctcgtggttcaaatggtggcttttgttttcatggcattctgtcatgaacccagagctcttgatgcctaagagctgcctaaggcagacccattactgcctaagaagaagagaattggggctattaaacttgcaggtttgcaggtatcccagccagcactcttgagaggcagtgtccatagaaatagcggtgatgatcaccaggctctccagtacggattcctaggacggggcagcagagccatgcactccccagtgcactggctggtactggggccctcartgcccctctgggggctgcaaacacaagagatctgggctcccaggccctatgcacttctgcagggcacaggctgcttcttgcattcttaagtccccatggataggaaagcccaatgaattgggatggtctccagtgagggcttcacacttcctttataacatgcagcattttaggttggtgactggtgtgcactgggccaagggtccactctgtctctgtccttacccccgggcttgaggactagcccctgccaaatgtcttacgggctcatcccagtgggcttgttgagtgggctgctga

SEQ ID NO: 84081 - DNA, 601 bp, Human
ctctgatattgttgtgggcttgctttagacctaaccgtacccttcagggggcttactgcaggtgcacattttcagaaggatggagtcctgagagaaggccctcgttcctggtcctcacccatcctccacccctctcgacccgcagcagacacccccaggtctcctcttttccccccgcctccctggtttccctttggaggtgctttcaggatatgctgcctaatgctggttcctgttagacaggttcgcctgagggctgagggatttcatctagaactacagcccctcgaggggactccargaactcttggctctttggctcccatctggctcccagcttgctcgtatttgtttgatccgggcctgtgtgtgttacatttttataggatctccctccgatgtgcacatcgatttgttctgttcagatgctttgtgtggaacgtattttatgtggtggtttttggagtgttgcaccctctagagaaaatgacctttcatgcccgtgaataatgaggctggaaatatttctcttaactcagaagcatctgcacgcacttgttttcacacttgagttgatgagcctgctcatggcatgactttc

SEQ ID NO: 84082 - DNA, 601 bp, Human
tgcacttggcatggcggagagctgccccctcctccgtgagagtgggttagaagatggtggtggtgttaacaaggaaaaataacacctaatgtacacagagctatatccacgggaacctgttctgtggactattaaaaatccaaaattcatgttgaggtcctacctctcagtaccttagaatgtgactgtatttgcagataggacccttaaaaaggtaattaaggttaaagaagatcattaagatatggcctcatcccatctgactggtgtctttatagcaagaagagactaggacacagayacacacagaggagaggccatttgaggacacggggggaagatgaccctctaccagccaaggagagaggcctcagaatgaaaccaacacatctcacaccttgatcttgaacttcagcctccagaactgtgtgaaaagaagtttctgttgtttaagccccactacctgtggccttttgttagggcagccccaacgaactaatacggagtcctattaccaatctttgttatgagagctgcccctgaagtcacatcagttgcatttccggattccaaataccttttccacatagctgggttgggg

SEQ ID NO: 84083 - DNA, 601 bp, Human
cctcagaatgaaaccaacacatctcacaccttgatcttgaacttcagcctccagaactgtgtgaaaagaagtttctgttgtttaagccccactacctgtggccttttgttagggcagccccaacgaactaatacggagtcctattaccaatctttgttatgagagctgcccctgaagtcacatcagttgcatttccggattccaaataccttttccacatagctgggttggggtctctctctgtcgcccaggctgcagtggcgcaatctcggctcactgcaacctccgccctcctgggttsaagtgattctcctgcctcagcctaccgagtagctgggattacaggtgcctgcccccatgccgggccaatttttatatttttagtagagacggggtttcaccatgttgcccaggctggtctcaaactcctgacctcaagtgatccacccacctcagcctcccaaagtactgggattacaggtgtgagccactgcaccccgctggggacaggcttttgaatccttactctttaaaaagaaaaaaaaaaggtgtatatttaaggcctacaatgggatgtgttgatacacgtagtgaagtgatg

SEQ ID NO: 84084 - DNA, 601 bp, Human
gaatgaaaccaacacatctcacaccttgatcttgaacttcagcctccagaactgtgtgaaaagaagtttctgttgtttaagccccactacctgtggccttttgttagggcagccccaacgaactaatacggagtcctattaccaatctttgttatgagagctgcccctgaagtcacatcagttgcatttccggattccaaataccttttccacatagctgggttggggtctctctctgtcgcccaggctgcagtggcgcaatctcggctcactgcaacctccgccctcctgggttgaagtkattctcctgcctcagcctaccgagtagctgggattacaggtgcctgcccccatgccgggccaatttttatatttttagtagagacggggtttcaccatgttgcccaggctggtctcaaactcctgacctcaagtgatccacccacctcagcctcccaaagtactgggattacaggtgtgagccactgcaccccgctggggacaggcttttgaatccttactctttaaaaagaaaaaaaaaaggtgtatatttaaggcctacaatgggatgtgttgatacacgtagtgaagtgatggctac

SEQ ID NO: 84085 - DNA, 601 bp, Human
cctgtcagcctccccttgctgcaaacacctgctctgccccactggatcccaggtacactcgtggccatgtgtgtgggtgggcttgaacattgccactccccctccaagaacaaacaccccctctccaacactaagaaaaatatcagcatggaacataaacgttcccctcagataatcaaataattcaccccaaactgtccactgtgccgtcactggctaaagcgagctgacttttctgtatacacgccatatcattttcctggattatttcccaaaacttgacagaccttaggaaagctatttttgagactttgctgacagtttttctggacccacagtatgtatttcagacatttcagtaataactctgtgacctcattatatgcgtatttttgtatgatcctgtgggtattggtgtgaggacacaccttgtattcttatttaaaaatcccaagttaaaaacagccctggccttttcgagtcacgtccgtacatctgagtttggactaggagagtgacttagttcactacaacattttaccaaaagatattgaagcaatgttttttccaaaatatggcataacacagaattcttggattt

SEQ ID NO: 84086 - DNA, 601 bp, Human
aatactgatcacatcagtaagaaaactgtttccatccctgatttgcttttcttttaaataggatattcagtcatagcttcactataaaattgatttattgtgttgaaataatttccgtagcaggggaactaattggattgtgtagcataaagaaaatgtatgtgggacaatggggaagaattgagccaaaatgaatccaatatattttaatctctgcaatacagattatattttcaattaagaagcttaacttgcatgtgttcggcgggcgggagcttcccagagcacttctcgcatgtgtttatgggtaataaatcacttagcattaagaaggtagacgatcattagcccatgatcactcagttgcctcctgttaatagcaaagtcaatgcacaccatcactgtggccatattcgggtggtaaaatgtggagttacatggaaagtggaactgttatattggtgaatacgatttactagacggaacaaggaaaacctgaattccatcccctgtgggccatggaaagcccatattcacagtcaagtgtgaaagtggcttttgggccacccgtgccctgcctgaaagcagagcatcatgtggc

SEQ ID NO: 84087 - DNA, 601 bp, Human
tcccagagcacttctcgcatgtgtttatgggtaataaatcacttagcattaagaaggtagacgatcattagcccatgatcactcagttgcctcctgttaatagcaaagtcaatgcacaccatcactgtggccatattcgggtggtaaaatgtggagttacatggaaagtggaactgttatattggtgaatacgatttactagacggaacaaggaaaacctgaattccatcccctgtgggccatggaaagcccatattcacagtcaagtgtgaaagtggcttttgggccacccgtgccctgyctgaaagcagagcatcatgtggccacgtgtctgctcggctctgccttactaattgtgtttaacctgagctctgctacagacagactttggtctttgctccatgcgtgcttctggcatgacctaggagttgcttgccagtgatgggcagagggcgagggcaagacgctggctagcctttgtccagtggtccacttgtctgggatcgcatttcatcttaaagcaacccatgaggtggaggaaccatgatcatcatattatataggccatggaatctgcctcgtgggctgtcgtagcagagca

SEQ ID NO: 84088 - DNA, 601 bp, Human
agtggctggctgggtaggcaggggccgccaacacgcaggggccaatgcagccaaggagcagttgcgtaagtccttgcgtaagtagaatgagatgcccagggctcccttgagcgcggccacgtggctgggaacctgtcaggttttatagcatccaatcagacaccgtgcaccaggatggagagcccggaaagaggtcagagctggggaaggcaggtgggggctgtaaacccaacagcagtgtgaggaatgggctcaaggcggatggagtgagcagaggtgtcccagggacagtggcgagccygaaactagacatggggagagaagagacagagacaagaataacaatggtagtaaggtggcagatcctcagtttaaaatctggccacgatgccattcacttaggcacttgcttgttctagaaatatttattaagcactaggtgtggcaggtgtagaatggatttgcccccaggaaaccctggatctggggctccgagtcatctgtctacgtcctctggagccttccttgtcgattgtcccttcacctccagattcttctactgcagggaagctcccttgacctcaccctcaccctcactgtg

SEQ ID NO: 84089 - DNA, 552 bp, Human
aaaaaaaaagagaatgaataatgagcaagaatgataggccatggcagattggcacacacataattttataatttcccctttttttttttttttcctggagacagagtcttactctgctgcccaggctagagtgcagtggtgtgatctcagctcactgcaacctctgtttccagggttcaagtgatcctcccgccttagcctcctaagtagctgggattacaagcatgtgccaccatgcctggataatttttrtatttttagtagtgatggggtttccccatgttagccaggctgatctcaaactcctgacctcaagtgaaccacccatctcagcctcccaaagtgctggattacaggaatgagccactgcacccagctggcacacacataattttctaaaccaggggttgacaagctgtaactgatgacccaatccagccctccatctgtagtgtgtatgcatgtgtgtgtcccacaagctaggaatagattttatgtttttaaaggattgaaaaaaggcaagaatactattttataacagatgaaaattat

SEQ ID NO: 84090 - DNA, 601 bp, Human
aatgagcaagaatgataggccatggcagattggcacacacataattttataatttcccctttttttttttttttcctggagacagagtcttactctgctgcccaggctagagtgcagtggtgtgatctcagctcactgcaacctctgtttccagggttcaagtgatcctcccgccttagcctcctaagtagctgggattacaagcatgtgccaccatgcctggataatttttgtatttttagtagtgatggggtttccccatgttagccaggctgatctcaaactcctgacctcaagtgamccacccatctcagcctcccaaagtgctggattacaggaatgagccactgcacccagctggcacacacataattttctaaaccaggggttgacaagctgtaactgatgacccaatccagccctccatctgtagtgtgtatgcatgtgtgtgtcccacaagctaggaatagattttatgtttttaaaggattgaaaaaaggcaagaatactattttataacagatgaaaattatatgaatttaaattttgctgtctatacataaagttttattggcacatagtcatacccattcactttttg

SEQ ID NO: 84091 - DNA, 601 bp, Human
gagtgcagtggtgtgatctcagctcactgcaacctctgtttccagggttcaagtgatcctcccgccttagcctcctaagtagctgggattacaagcatgtgccaccatgcctggataatttttgtatttttagtagtgatggggtttccccatgttagccaggctgatctcaaactcctgacctcaagtgaaccacccatctcagcctcccaaagtgctggattacaggaatgagccactgcacccagctggcacacacataattttctaaaccaggggttgacaagctgtaactgatgacccaatccagccctccatctgtagtgtgtatgcatgtgtgtgtcccacaagctaggaatagattttatgtttttaaaggattgaaaaaaggcaagaatactattttataacagatgaaaattatatgaatttaaattttgctgtctatacataaagttttattggcacatagtcatacccattcactttttgtattgtcagtggctgcttttgcgctgttataatagcagagtctattagtgaatgcaaaagagaccatatggcctgcaaggcctgacttctttactgtctgatcatttac

SEQ ID NO: 84092 - DNA, 601 bp, Human
cctctgtttccagggttcaagtgatcctcccgccttagcctcctaagtagctgggattacaagcatgtgccaccatgcctggataatttttgtatttttagtagtgatggggtttccccatgttagccaggctgatctcaaactcctgacctcaagtgaaccacccatctcagcctcccaaagtgctggattacaggaatgagccactgcacccagctggcacacacataattttctaaaccaggggttgacaagctgtaactgatgacccaatccagccctccatctgtagtgtgtatgyatgtgtgtgtcccacaagctaggaatagattttatgtttttaaaggattgaaaaaaggcaagaatactattttataacagatgaaaattatatgaatttaaattttgctgtctatacataaagttttattggcacatagtcatacccattcactttttgtattgtcagtggctgcttttgcgctgttataatagcagagtctattagtgaatgcaaaagagaccatatggcctgcaaggcctgacttctttactgtctgatcatttacagaaaaagtgtactgatcccttgactagactg

SEQ ID NO: 84093 - DNA, 601 bp, Human
ctggcacacacataattttctaaaccaggggttgacaagctgtaactgatgacccaatccagccctccatctgtagtgtgtatgcatgtgtgtgtcccacaagctaggaatagattttatgtttttaaaggattgaaaaaaggcaagaatactattttataacagatgaaaattatatgaatttaaattttgctgtctatacataaagttttattggcacatagtcatacccattcactttttgtattgtcagtggctgcttttgcgctgttataatagcagagtctattagtgaatgcaraagagaccatatggcctgcaaggcctgacttctttactgtctgatcatttacagaaaaagtgtactgatcccttgactagactgtcaagaatggaaagtgcactgttaagaatgggcacatcttattcacagactgcaatcaataatcaataatcaatcactctgatgtaacctgagaacatactgtgtagaaagcatgctgtagaggatagcgtgtgcttccccttgtgctccccagtctgtttcacaagttctggatgattgatcaatgctcgatcaatgcgagctcccttctccatc

SEQ ID NO: 84094 - DNA, 601 bp, Human
aagctgtaactgatgacccaatccagccctccatctgtagtgtgtatgcatgtgtgtgtcccacaagctaggaatagattttatgtttttaaaggattgaaaaaaggcaagaatactattttataacagatgaaaattatatgaatttaaattttgctgtctatacataaagttttattggcacatagtcatacccattcactttttgtattgtcagtggctgcttttgcgctgttataatagcagagtctattagtgaatgcaaaagagaccatatggcctgcaaggcctgacttctttmctgtctgatcatttacagaaaaagtgtactgatcccttgactagactgtcaagaatggaaagtgcactgttaagaatgggcacatcttattcacagactgcaatcaataatcaataatcaatcactctgatgtaacctgagaacatactgtgtagaaagcatgctgtagaggatagcgtgtgcttccccttgtgctccccagtctgtttcacaagttctggatgattgatcaatgctcgatcaatgcgagctcccttctccatcatgggaagaatgggaagcctgctcctcccctgtggt

SEQ ID NO: 84095 - DNA, 601 bp, Human
tccagccctccatctgtagtgtgtatgcatgtgtgtgtcccacaagctaggaatagattttatgtttttaaaggattgaaaaaaggcaagaatactattttataacagatgaaaattatatgaatttaaattttgctgtctatacataaagttttattggcacatagtcatacccattcactttttgtattgtcagtggctgcttttgcgctgttataatagcagagtctattagtgaatgcaaaagagaccatatggcctgcaaggcctgacttctttactgtctgatcatttacagaaraagtgtactgatcccttgactagactgtcaagaatggaaagtgcactgttaagaatgggcacatcttattcacagactgcaatcaataatcaataatcaatcactctgatgtaacctgagaacatactgtgtagaaagcatgctgtagaggatagcgtgtgcttccccttgtgctccccagtctgtttcacaagttctggatgattgatcaatgctcgatcaatgcgagctcccttctccatcatgggaagaatgggaagcctgctcctcccctgtggtgcatctggcatccgagctggt

SEQ ID NO: 84096 - DNA, 601 bp, Human
gcctgacttctttactgtctgatcatttacagaaaaagtgtactgatcccttgactagactgtcaagaatggaaagtgcactgttaagaatgggcacatcttattcacagactgcaatcaataatcaataatcaatcactctgatgtaacctgagaacatactgtgtagaaagcatgctgtagaggatagcgtgtgcttccccttgtgctccccagtctgtttcacaagttctggatgattgatcaatgctcgatcaatgcgagctcccttctccatcatgggaagaatgggaagcctgcycctcccctgtggtgcatctggcatccgagctggtgttcatcgcttccctctctgctgggtgaggacctcgtgggtgaggacttccacataaaaatgaggggtaaggcgcaaacatcagaccagagtcacaggagacattatcttccccgtggccgccctgcctggtgagtttactgatttgcctaagggtggtgctggtgtgtgtcttgcaccatgcctccctccagcctctcagatatgtcctgtccggtggggacgtctctcctgtgtatatttttggtggctgagcaaagtgcttgt

SEQ ID NO: 84097 - DNA, 601 bp, Human
gggtggtgctggtgtgtgtcttgcaccatgcctccctccagcctctcagatatgtcctgtccggtggggacgtctctcctgtgtatatttttggtggctgagcaaagtgcttgtggttcctttcagccaattgtgctgaggcaaaggcgggccacttaaattgcagtttctctgatgtatcttctaaaagccaaacgtcgttatccacaaagggtacttttgtgtaacaccaggcactcgagtagatctgtggggtcttccctctgtgggtgatgagtctgggtttcagcatcccgcttcyccagaccacatggccactgatccgtggggtgcacagaaggacaggcagtcacatgcctgcttctttgagttctgccacctacgagctgagtaacctgggcaagtggtgaacctcatggattctttgttgccaccagcaaattggggagagtaattgagagggcatttctgagctcctggctcagcaggtagcatgttagagctgcttgatcaatgcgagcccccttctccttcatgggaagaacaggaagcctgctcctcccctgtgctgcatttggcatctgagctggtgttcagtgct

SEQ ID NO: 84098 - DNA, 601 bp, Human
catcctccagacccacagcttcttgccactagaacacagggtccagcgttgggcactgtccttcaacactgggcttcctacacacacacatccaatccacgcacagcccgggagagtccctgaaacattttagctcatccacataccttgcatggtgtggaattcaacaaggagaacccatttctcttaatcattacactcattaagaaaacacgaagctcacaacagaaaataatttctaactattattattctgtggtttctgcttttgatcaagataagaatagccgaagcacccacycaggtcactctcatggaatggggttttctgattaaagattggcaagcaactgacaagcttgtagcacatcctttaagctggcactcgctgtttgagtacttgagagttatttgcagacttcctaagtctttcgttttgctaactgtgtgtcaggaactgttctgggcactctatgcaatgtgagcttatttaatggttaccacctaggaggctgatgtgctcttgacacccatttcacagatgcagaatctaaggaaatctgctcagtgtttacacagccaactggtcagtggtacagcc

SEQ ID NO: 84099 - DNA, 601 bp, Human
ccctaccagaccaccacgaaaaagtgaagtttgcaataaagcaagtcacacagattttttggtttcccagtgcatatatgttatgtttacactataaagtattttattaagtgtgaaaagtatgtcttaaaaaaacagtgtatataccttaatagaaatactttattgttaaacaatgctaacaattatctgaggcttcagcaaatctaaatctttctgctgatagagagtcttgcgtcaatgttgatggctgctgactgatcaggatggtggttgctgagggctgaggtggctatgacarttttttaaaataaggcaacagtgaaatttgccacatcatttgatgcttcctttcactcaagatttctctgtagcctgtgatgctgtttggtagcattttacacacactaaaacttcttttcacatgggagtcaatcttctcaaactcggccaactgctttggcaactaactttatgtaatattctaaatcctttgtcatttcaacaatgttatcagaatcttcaccaggagtagattcatctcaagaaaccactttctttgctcacaagcatgagtgggaactccttatccatccaagtt

SEQ ID NO: 84100 - DNA, 601 bp, Human
tacacacactaaaacttcttttcacatgggagtcaatcttctcaaactcggccaactgctttggcaactaactttatgtaatattctaaatcctttgtcatttcaacaatgttatcagaatcttcaccaggagtagattcatctcaagaaaccactttctttgctcacaagcatgagtgggaactccttatccatccaagttgtatcatgagattgcagcaattcagtcacatcttcagagtccacttctaattctagttctctgctatttccactacatctgaatttacttcttcctctraagtcttgaaccggtcaaagtcaaccatgaagatcagaatccacttcttccaaactccagttaatgttgatattttgacctcctcccatgaatcatgactcttctaaatggcttttagaatgctgaattttttccagaaagttttcaatttactttggtcagatccattagagaaatcactatctctggcagctatagccttataaaatatatttcttaaataataagacttgaaagtcaaaattgctcgtgattaatggactgtggaatggatgttgtgttagcaggcatgaaaacaac

SEQ ID NO: 84101 - DNA, 601 bp, Human
gttctctgctatttccactacatctgaatttacttcttcctctgaagtcttgaaccggtcaaagtcaaccatgaagatcagaatccacttcttccaaactccagttaatgttgatattttgacctcctcccatgaatcatgactcttctaaatggcttttagaatgctgaattttttccagaaagttttcaatttactttggtcagatccattagagaaatcactatctctggcagctatagccttataaaatatatttcttaaataataagacttgaaagtcaaaattgctcgtgattartggactgtggaatggatgttgtgttagcaggcatgaaaacaacattcacctccttgtacatctccatcagagctctgggttgaccaggtgcattgtcaatgagcagtaatatttttgaaaggcatcttgtttctgagtatcaggtcttaacagtgggcttaaaacattcagtaaaccatgctccaaacagatgtgctgtcatccaggctctcttcttgcatttatagagcatatgcagagtagatttagcataattcttaagggcgctaggatgttcagaataacaaataagcattggct

SEQ ID NO: 84102 - DNA, 601 bp, Human
tgaaacatgccctctttccttcttgtgttttttcttttttattgtgattttatatatataaataaatattatatatatgtaaccacaatagaaaagaaaaaatacatacattacaaagtttgccatttaaccgtttataagtgtatcattcaatggcataattacatccacagtgttgctcagttatcactactgttgatttccagaatgtttgttcaccccaagcagaaactctcaactccctgttcccatcccccatgtatatggaactaggaaaagactccagtggcagctgatgacrcacattcctacaccccggcaagcagagcatccaggacaacctgtcctgtgcccgaggggtggggcacggtcaccctgacctcccctgcttcccctgcccatccatggctgtccttcactcacccaattagtgatcataggacaacaggaggagcctgggagaggaaggaggaggcctgagggatggacactggggtgctgaggcggaggtctctggggtgagcagacactggggtgctagggcagggtctctggggtgctgtggtggggatccctggggtgaacggacactggggtgctg

SEQ ID NO: 84103 - DNA, 601 bp, Human
tgaagttgaaataggtggacgaggcaggattgggaggaggtagaggcgaataagaaggaccaagtagtggagagtagagggagagtgggtggccttatgatattgaaaacacaatcctgaaattagactgttagtgatgacaggcttggtgctctggaggtgaagctgagggtacctgcctaccttgatttccagactggtttatcccaacacttgctaactccacgttagggctcttagtggctaattgtctctaagcttgatttccagactggtttatcctaacacttgctaactccgmgttggggctcctagtggctaatcggctccaagctttggagggagcattttaaggtcttttcaatcaacacattttattttctgatgacctagaaacaggtgtgaactctccgactccccaccaaaagaaagtagatgaagaactcttcaaaatttgtagagaggacatatcagaattgaatcacaacttttcaggccttggcaaaattttctttaaagaaccaacacaggcacacctactcagcactgctagtgtagtggggaaatggctggctaatccctactaaaagagttttgctgt

SEQ ID NO: 84104 - DNA, 601 bp, Human
acattttattttctgatgacctagaaacaggtgtgaactctccgactccccaccaaaagaaagtagatgaagaactcttcaaaatttgtagagaggacatatcagaattgaatcacaacttttcaggccttggcaaaattttctttaaagaaccaacacaggcacacctactcagcactgctagtgtagtggggaaatggctggctaatccctactaaaagagttttgctgtgttctaataaaactttatttaaaccacctcacaccgattaggatggctacatcagaaaaaaaaaaaaasagggaaataacaagtgttgatgagggtgtggagaaattggaacccttgtgtactgttgctgggaatgtaaaatggcacagccactatggaaaatagtaggatggttcctctaaaactttaaaatagaattaccagatgatctggcaattccacttctgggtatcatcaactgaagaatcataaggtacataaatttggaaagcagagctttatttctcataaagggttgcagcctgcaggccagccattccgcagaccaggaagcgtagcctccagcttctgccaagagcaagcacttcc

SEQ ID NO: 84105 - DNA, 601 bp, Human
tatcagaattgaatcacaacttttcaggccttggcaaaattttctttaaagaaccaacacaggcacacctactcagcactgctagtgtagtggggaaatggctggctaatccctactaaaagagttttgctgtgttctaataaaactttatttaaaccacctcacaccgattaggatggctacatcagaaaaaaaaaaaaacagggaaataacaagtgttgatgagggtgtggagaaattggaacccttgtgtactgttgctgggaatgtaaaatggcacagccactatggaaaatagtargatggttcctctaaaactttaaaatagaattaccagatgatctggcaattccacttctgggtatcatcaactgaagaatcataaggtacataaatttggaaagcagagctttatttctcataaagggttgcagcctgcaggccagccattccgcagaccaggaagcgtagcctccagcttctgccaagagcaagcacttccagggaggaggaatgagacaggaatttatgctgagtgggttggctaagtatacataatcaataagctatagaagaagtcatgaatattaatgaaggagaa

SEQ ID NO: 84106 - DNA, 601 bp, Human
aacagggaaataacaagtgttgatgagggtgtggagaaattggaacccttgtgtactgttgctgggaatgtaaaatggcacagccactatggaaaatagtaggatggttcctctaaaactttaaaatagaattaccagatgatctggcaattccacttctgggtatcatcaactgaagaatcataaggtacataaatttggaaagcagagctttatttctcataaagggttgcagcctgcaggccagccattccgcagaccaggaagcgtagcctccagcttctgccaagagcaagcactyccagggaggaggaatgagacaggaatttatgctgagtgggttggctaagtatacataatcaataagctatagaagaagtcatgaatattaatgaaggagaaacacacacatgtgtgattgagccatgcctcttcgtgggtcccgtgttcaaaaaaataccagcattaggatgacccaagggtggaggttttggccctctgatgtcaaaagttcaaacagaggccacgaaaaccctcactgcacatcctccttcgactggccagagccaccctgcagttggtagcctctcagcaggagggc

SEQ ID NO: 84107 - DNA, 601 bp, Human
aagctatagaagaagtcatgaatattaatgaaggagaaacacacacatgtgtgattgagccatgcctcttcgtgggtcccgtgttcaaaaaaataccagcattaggatgacccaagggtggaggttttggccctctgatgtcaaaagttcaaacagaggccacgaaaaccctcactgcacatcctccttcgactggccagagccaccctgcagttggtagcctctcagcaggagggcatgcagtgtcaaactggcaagctgtcacgtggaaactgcaaagagggagggggagtccacttayggctcagacaagtggctaaaggtgatataggaatgagttgtctgcttcttgttttctagagccagtttctgcttcctccttaggagagaattctggttaaaggctattaaggaaagggtatactgaagcgggtccaacctcccatctcttcatggtcatgggctgactcagtttttgttgttgttgttgtttttgtttttttttgttgttgtttttagacagagtcttgctcttgttacccaggctggagtgcagcggcgcgatccagctctctgcaacttctgcctcccaggttcaagc

SEQ ID NO: 84108 - DNA, 601 bp, Human
ccaccctgcagttggtagcctctcagcaggagggcatgcagtgtcaaactggcaagctgtcacgtggaaactgcaaagagggagggggagtccacttatggctcagacaagtggctaaaggtgatataggaatgagttgtctgcttcttgttttctagagccagtttctgcttcctccttaggagagaattctggttaaaggctattaaggaaagggtatactgaagcgggtccaacctcccatctcttcatggtcatgggctgactcagtttttgttgttgttgttgtttttgttttttkttgttgttgtttttagacagagtcttgctcttgttacccaggctggagtgcagcggcgcgatccagctctctgcaacttctgcctcccaggttcaagcgattctcctgcttcagcctcccgagtagttgggattacagacgcctgccaccatgcccgggtaatttttgtatttttagtagagatggggtttcaccatgttggccagattggtcttgaactcctggcctctggtgatccacccaccttggcctcccaaagtgctgggattacaggcgtgagccacggcgcccggcccggat

SEQ ID NO: 84109 - DNA, 601 bp, Human
ctgcaacttctgcctcccaggttcaagcgattctcctgcttcagcctcccgagtagttgggattacagacgcctgccaccatgcccgggtaatttttgtatttttagtagagatggggtttcaccatgttggccagattggtcttgaactcctggcctctggtgatccacccaccttggcctcccaaagtgctgggattacaggcgtgagccacggcgcccggcccggattcagtttttaagtcttctctggggtccctttggccaagaaggagtctgttcagtccattgggaaacttagrattttatttttatttctcaatatttatccaaaataattgaacataaggacttgaagagagatctgtacactgatgttcatagcaacatttttcacagttgcgaaaaggtagaagtactcaagtgtccatcaacagataaatgggtggtatacacgatgtggcatatgcatcccaaagcctccatttcctcatttgtaaaatattgtgtgattcataccccgcaagacttgtgagcatgaaataacatgatctgtgtgaaagcaatgacagtgtctggaacttagggggtgctcaccaaat

SEQ ID NO: 84110 - DNA, 601 bp, Human
gagtttgatggaggcttaagcttttattgatttgaaaaagaaaagaaagggaatcttggaaaaaagtaactcgctgtagtgcagacaggaaataatagcaatgaaatcttttggcttccctgctcctgaccccagaggtcccttcctcgctttaaaatcctcaggcaccccctccacccctgttgcccacaagcaaatatgcagactccagagccccacatccccgtctctcacggtctggcccagttgatctctctcacctcattccgaaaactttctagtgacattggtcttcccaccrtttcccaaatcccaaagacacgaggcagatcccacccagtcccccagctttgcattactttgcccttgtgatactgggggacgttcttagaagtcacttctttccacatatatggtttttgtttcccagtcaaggtcccaaggtaggaagtttctggccatgtgagtcaccacctggatgaaggagccaccctgccaagtgtggggaggtgccaggagacggagcggctgagatgaagcattcattatctctccttcccatggaactgaagtgacattctctgcatctctattatcactt

SEQ ID NO: 84111 - DNA, 601 bp, Human
tccagggagcttagaggcactggggttgagtgctttcatttgtcagtggagaagatgagggtctcgaaaacttgagcaacattttttttgttttaacatttttaaaattctattgtaaattgacaaataataattgtgtatgtgtatggtatgcagtcgatgttgtgatacatgcattcattgtggaatgattaaatcaaatgaattaacatgtctgttccctcacatacttctcatttcttggtggtgttgaacaacgttccgaaggtcaggtagctccacgtttaaatggacatgaagycattgatagatagatagacatacttgaattaagactttaattgtacaaatgtgtgtatgtgtaggctacaattaaactcatatttgacactgtcaagaattagtagtttttgttgctaatggggttaaatgtccaggataggaaagcttactggtttgttgttgctttaattgcattggcttgggagtgaacccatctccctttcttattgacctcacatttttttaagtggataatgttatgacaagtttgataaaaatgatgcttctgactttctggagacaggaatcaattaccaag

SEQ ID NO: 84112 - DNA, 601 bp, Human
atatcatttatgcatgtcctggaagtttctgtgcaagtgacgcagcccttgatgcattgagcccaagcatcatctgatctttgtttactgcactgattatggttttatttgatctttccttcagctttcctcatgctacttgaatttccacgttgtttttgtcccggcatttaaaaaaatttatagggaatctgaattacagaatctacctctcagccctgcactttctcagtcgtcagtttcttaaaaggtttttgttcagccttcacattattttagcatgacatacatagtttttttkttttttttttaatttgagacaagtctcactctgtcacccaggctggagtgcagtggcgcaatcctggctcactgcaagctccgcctcccaggttcgcaccattctcctgcctcagcctcccaagtagctgggactgcaggtgcccgccaccacacccagctaattttttgtatttttagtagaaacggggtttcactgtgttagccaggatggtctcaatctcctgacctcgtgattcacccaccttggcctcccaaagtgctgggattacaggcgtgagccaccgcgcccagctgacat

SEQ ID NO: 84113 - DNA, 601 bp, Human; identical to SEQ ID NO: 21882

SEQ ID NO: 84114 - DNA, 601 bp, Human; identical to SEQ ID NO: 21883

SEQ ID NO: 84115 - DNA, 601 bp, Human; identical to SEQ ID NO: 21884

SEQ ID NO: 84116 - DNA, 601 bp, Human; identical to SEQ ID NO: 21885

SEQ ID NO: 84117 - DNA, 601 bp, Human; identical to SEQ ID NO: 21886

SEQ ID NO: 84118 - DNA, 601 bp, Human; identical to SEQ ID NO: 21887

SEQ ID NO: 84119 - DNA, 601 bp, Human; identical to SEQ ID NO: 21888

SEQ ID NO: 84120 - DNA, 601 bp, Human; identical to SEQ ID NO: 21889

SEQ ID NO: 84121 - DNA, 601 bp, Human
aactggagaatttttcaagtgccaagagagccaaaatccttaacaagtaagttctcatctagctctgaaactgcaggcaggagcctccaactctaatcgcataattttcatgtcatttctaagccaacttgatacaaattgagatgtaatcacggtgtaatgaaagggtggttttaaatcaccaatcaggtattgccttttctaacccatgaatcaagatctaaaattgcaggactcatcctggaaggttccaggtcagtgtaatccaagactattagtgcaacacagaatttcagcttcyggagataattccttttgctatgcactattctgatgtcatttcacatgtggttgactttattgcttaattcttcaattcgaaaggagcttctgatgaaagctcttggctctattgggattgttgaacagctcactggggagttagagctatcggggttccttcttggcagcagataacccctgtcttcttccgggcaggagctttgaatggactgaagcggcaccttctatcattgtaaataaacctctccaaagctccatgaaagccgagatccttgccggcccctccagctctgtaacc

SEQ ID NO: 84122 - DNA, 601 bp, Human
cggtgtaatgaaagggtggttttaaatcaccaatcaggtattgccttttctaacccatgaatcaagatctaaaattgcaggactcatcctggaaggttccaggtcagtgtaatccaagactattagtgcaacacagaatttcagcttccggagataattccttttgctatgcactattctgatgtcatttcacatgtggttgactttattgcttaattcttcaattcgaaaggagcttctgatgaaagctcttggctctattgggattgttgaacagctcactggggagttagagctatcrgggttccttcttggcagcagataacccctgtcttcttccgggcaggagctttgaatggactgaagcggcaccttctatcattgtaaataaacctctccaaagctccatgaaagccgagatccttgccggcccctccagctctgtaaccccagtttgcatcatgcaccgctcatgactcagtatcaagaagcaccattgttgcatgggtttccttcccctgtttggacacccggagggtcttgcttcgtctctttctgcctccgtttcactaatttctcactgctgtcggtgttcctttca

SEQ ID NO: 84123 - DNA, 601 bp, Human
tttcagaaggtggcagctgctcttatatcctgtgagtctgtatctcactttcaaggcaaatccaaagcacatcatctctggagagtaagaattatagtcataagctgggctctggtgctcagccagtagtggtaataccagctacttaggaggctgaggcaggaagatcacttgagcccaggaggtcaaggctgcagtgcaccacgatcatacctgtgaattgccatgcactccagcctgggcaacatggcaagaccccctttcaaaaaaaaagagaagaaagaaagaattatagtcacgyactgcataaccacagactacatgctgtatttttactgtaacttttctttgtttagatacacaaatactcaccattgtgttacatttgcctgtggtatttattgtagtcacatggtacattacaaacatgttgtacgggtttgtagactagtaacagtaggctataccgtatggccgatgtgtgtagtaggctgtagtatctcagtttgtgtaagttcactcagcagcgttcacacgacgacaaaatcacccagtgacatatttctcagaacatatccctgtcattaagcaaagcatgagt

SEQ ID NO: 84124 - DNA, 601 bp, Human
cacttgagcccaggaggtcaaggctgcagtgcaccacgatcatacctgtgaattgccatgcactccagcctgggcaacatggcaagaccccctttcaaaaaaaaagagaagaaagaaagaattatagtcacgtactgcataaccacagactacatgctgtatttttactgtaacttttctttgtttagatacacaaatactcaccattgtgttacatttgcctgtggtatttattgtagtcacatggtacattacaaacatgttgtacgggtttgtagactagtaacagtaggctataccrtatggccgatgtgtgtagtaggctgtagtatctcagtttgtgtaagttcactcagcagcgttcacacgacgacaaaatcacccagtgacatatttctcagaacatatccctgtcattaagcaaagcatgagtatatttcagcaaatcatttactcagcctgtactttatgtcagtgactttctaagcatttcatgtgcatttttcttctataatcattaaaaagcaaaaccattccttaggccctcgtatctgccctagtttctagatgaggaaggtcacacacagtgaccgagccactt

SEQ ID NO: 84125 - DNA, 601 bp, Human
caggaggtcaaggctgcagtgcaccacgatcatacctgtgaattgccatgcactccagcctgggcaacatggcaagaccccctttcaaaaaaaaagagaagaaagaaagaattatagtcacgtactgcataaccacagactacatgctgtatttttactgtaacttttctttgtttagatacacaaatactcaccattgtgttacatttgcctgtggtatttattgtagtcacatggtacattacaaacatgttgtacgggtttgtagactagtaacagtaggctataccgtatggccgakgtgtgtagtaggctgtagtatctcagtttgtgtaagttcactcagcagcgttcacacgacgacaaaatcacccagtgacatatttctcagaacatatccctgtcattaagcaaagcatgagtatatttcagcaaatcatttactcagcctgtactttatgtcagtgactttctaagcatttcatgtgcatttttcttctataatcattaaaaagcaaaaccattccttaggccctcgtatctgccctagtttctagatgaggaaggtcacacacagtgaccgagccacttggccagtccc

SEQ ID NO: 84126 - DNA, 601 bp, Human
agatcacctttcacctggccatctttccttcaggcctcctcagctgggtgattcctgcctgacagccatctgtgtaaacagtgatcattgttcagaaacaagaaatgcacttgctgagccaagcactgagaatggtgtaggcagagtgggtgctcgcctgtgactaccgaagcggcacgcagcagctgcagcccaccaccttggggcctgcacaggtgtctgtcgctcgtcctggcttccagcatcaagagacagacttctccaggctgcatcttctggagactggctcagcaggggcgcrggctcctgctttgtggaatgcacgctccctcagggcccaggggaagggagggatggtgctttgtaattgttgctgttcttgttgatttgcctttgtgctgggaattgtagtgcagacggtagtgaccaacacacacaaagcacagtgcggcacaacgcacttcaacgcactgtaatccaccaggtgcggacacacctccttcagcacacgccccttgttgtcccgtccagcaaaaggacagctcggccacagcaggtgaagccacctgcccaagtgtccagcgcccgctattgggtgaag

SEQ ID NO: 84127 - DNA, 601 bp, Human
tttcacctggccatctttccttcaggcctcctcagctgggtgattcctgcctgacagccatctgtgtaaacagtgatcattgttcagaaacaagaaatgcacttgctgagccaagcactgagaatggtgtaggcagagtgggtgctcgcctgtgactaccgaagcggcacgcagcagctgcagcccaccaccttggggcctgcacaggtgtctgtcgctcgtcctggcttccagcatcaagagacagacttctccaggctgcatcttctggagactggctcagcaggggcgcgggctcctsctttgtggaatgcacgctccctcagggcccaggggaagggagggatggtgctttgtaattgttgctgttcttgttgatttgcctttgtgctgggaattgtagtgcagacggtagtgaccaacacacacaaagcacagtgcggcacaacgcacttcaacgcactgtaatccaccaggtgcggacacacctccttcagcacacgccccttgttgtcccgtccagcaaaaggacagctcggccacagcaggtgaagccacctgcccaagtgtccagcgcccgctattgggtgaagctgggacc

SEQ ID NO: 84128 - DNA, 601 bp, Human
tgcacaggtgtctgtcgctcgtcctggcttccagcatcaagagacagacttctccaggctgcatcttctggagactggctcagcaggggcgcgggctcctgctttgtggaatgcacgctccctcagggcccaggggaagggagggatggtgctttgtaattgttgctgttcttgttgatttgcctttgtgctgggaattgtagtgcagacggtagtgaccaacacacacaaagcacagtgcggcacaacgcacttcaacgcactgtaatccaccaggtgcggacacacctccttcagcacrcgccccttgttgtcccgtccagcaaaaggacagctcggccacagcaggtgaagccacctgcccaagtgtccagcgcccgctattgggtgaagctgggacccgagcccagccacagctcctggcctcggagatgcctgcgggagaagagaggtgaatttaaactggaaatctgcctcaaaagagctggcatcttcttagtggtggggccgagcaccccgcaagccccagcagggcagctgtgtgctgggcccttccttctgttggtgtgagcgttaagagcctaaggcaacatcaagacat

SEQ ID NO: 84129 - DNA, 601 bp, Human
cacaggtgtctgtcgctcgtcctggcttccagcatcaagagacagacttctccaggctgcatcttctggagactggctcagcaggggcgcgggctcctgctttgtggaatgcacgctccctcagggcccaggggaagggagggatggtgctttgtaattgttgctgttcttgttgatttgcctttgtgctgggaattgtagtgcagacggtagtgaccaacacacacaaagcacagtgcggcacaacgcacttcaacgcactgtaatccaccaggtgcggacacacctccttcagcacacrccccttgttgtcccgtccagcaaaaggacagctcggccacagcaggtgaagccacctgcccaagtgtccagcgcccgctattgggtgaagctgggacccgagcccagccacagctcctggcctcggagatgcctgcgggagaagagaggtgaatttaaactggaaatctgcctcaaaagagctggcatcttcttagtggtggggccgagcaccccgcaagccccagcagggcagctgtgtgctgggcccttccttctgttggtgtgagcgttaagagcctaaggcaacatcaagacatgc

SEQ ID NO: 84130 - DNA, 601 bp, Human
ctgcgggagaagagaggtgaatttaaactggaaatctgcctcaaaagagctggcatcttcttagtggtggggccgagcaccccgcaagccccagcagggcagctgtgtgctgggcccttccttctgttggtgtgagcgttaagagcctaaggcaacatcaagacatgcactaacagcggtgcggtggctcatacctgtaatcccagcactttggaaggccaagatgggaggatcacttgagtccaggagtttgagaccagcctggacaacacaacaacacccccttctccacaaaaaatasaaaaattagccaggtgtggtggcgcgcacctgtggtgccagctactcaggaggctgaagtgggaggatttcttgagcccagggggtcggggctgcagtgagccatgatcacacgactgcgctccagcctggctgacagagtgagaccgtctgtctcaaaaaccaaaacgaaaagaaaaaaaaacattaacctcgaagggccttggctactaaagaaaacgtttgcttcccacgtagtggcgtggattcagaatcttcaaagccacggaaaattacacacagccagctggtgtcgccccct

SEQ ID NO: 84131 - DNA, 601 bp, Human
atatgtctaaaatgtaaaaggaatgacttttgattagcagccagcttgataattttgttatgtaagacacgtgcatcctggtgtgggacagtgtgttgaatgactgcaaaggagcttctgtgttcaggaccggaagaggaacagggttcatgaattgggcctcccacatatctaagcataaaatgctcacttaaaatttcagcgcaagaggttaagtttgatggcaaagtccagctcagtgcagagagaccatccacaaagacctccccacctggtccctaggctgttttcagttttggcgggggtgggtgggttgtttttgtttttgtttttttgtaattatagaagtctgcagtgttctaagaggataggtttcacaatgggaccaaaatatccccatctgaccaaacactgggttctgcagaatcttctccagaagattatgtcaaactctagatactacctttaaggaaactaacaggaaataaacatgccatgcatgccgttttgcagcgtgacctaatcagaagctgcaattgtatattcctgattataacaggagatacgatcaatttaatttgtgtctgtgctcatttttttc

SEQ ID NO: 84132 - DNA, 601 bp, Human
aaagactctatttccaaataaggtcacagtcatggataccagggtttaggacttcaacatagctttaaaggggagacaatccaacccacactagtcatgaccaatagacttttcttttcttttttcagtgaaatagaatctaggaaaaaatatcagcattcattgcaggcagtaaggttaagcatcatttcataaaactttatacacatgcatgtatattaatatatgtgctggttaatacatgtattttttatgtcagaaaagtttatgaaacttaaaaaaaaagtggcggcagcggggrcgctttaaaaaaaacctgcctcctgcagcctctgctcacggtgcaccccctcaccccctggtctctcaaacaggagccagctctgtgttctgtagccccacccaccaggcactcccctactccctccctgccatggggccttggcgcctgctggtcctcctgcccagaatgctcttccctaccctcttcgtccagatttcgtctctccttcaaatctcagagcaaatattattgtcctagagaactcctgccagagccaagctgagcccactgttacattttctcacagttcccatgttt

SEQ ID NO: 84133 - DNA, 601 bp, Human
ctatttccaaataaggtcacagtcatggataccagggtttaggacttcaacatagctttaaaggggagacaatccaacccacactagtcatgaccaatagacttttcttttcttttttcagtgaaatagaatctaggaaaaaatatcagcattcattgcaggcagtaaggttaagcatcatttcataaaactttatacacatgcatgtatattaatatatgtgctggttaatacatgtattttttatgtcagaaaagtttatgaaacttaaaaaaaaagtggcggcagcggggacgctttaaaaaaaacctgcctcctgcagcctctgctcacggtgcaccccctcaccccctggtctctcaaacaggagccagctctgtgttctgtagccccacccaccaggcactcccctactccctccctgccatggggccttggcgcctgctggtcctcctgcccagaatgctcttccctaccctcttcgtccagatttcgtctctccttcaaatctcagagcaaatattattgtcctagagaactcctgccagagccaagctgagcccactgttacattttctcacagttcccatgttttccctat

SEQ ID NO: 84134 - DNA, 601 bp, Human
cttcaacatagctttaaaggggagacaatccaacccacactagtcatgaccaatagacttttcttttcttttttcagtgaaatagaatctaggaaaaaatatcagcattcattgcaggcagtaaggttaagcatcatttcataaaactttatacacatgcatgtatattaatatatgtgctggttaatacatgtattttttatgtcagaaaagtttatgaaacttaaaaaaaaagtggcggcagcggggacgctttaaaaaaaacctgcctcctgcagcctctgctcacggtgcaccccctcaccccctggtctctcaaacaggagccagctctgtgttctgtagccccacccaccaggcactcccctactccctccctgccatggggccttggcgcctgctggtcctcctgcccagaatgctcttccctaccctcttcgtccagatttcgtctctccttcaaatctcagagcaaatattattgtcctagagaactcctgccagagccaagctgagcccactgttacattttctcacagttcccatgttttccctataaagccatgatcctggcttttgcagaaacaattcctctatgtat

SEQ ID NO: 84135 - DNA, 601 bp, Human
aacatagctttaaaggggagacaatccaacccacactagtcatgaccaatagacttttcttttcttttttcagtgaaatagaatctaggaaaaaatatcagcattcattgcaggcagtaaggttaagcatcatttcataaaactttatacacatgcatgtatattaatatatgtgctggttaatacatgtattttttatgtcagaaaagtttatgaaacttaaaaaaaaagtggcggcagcggggacgctttaaaaaaaacctgcctcctgcagcctctgctcacggtgcaccccctcacsccctggtctctcaaacaggagccagctctgtgttctgtagccccacccaccaggcactcccctactccctccctgccatggggccttggcgcctgctggtcctcctgcccagaatgctcttccctaccctcttcgtccagatttcgtctctccttcaaatctcagagcaaatattattgtcctagagaactcctgccagagccaagctgagcccactgttacattttctcacagttcccatgttttccctataaagccatgatcctggcttttgcagaaacaattcctctatgtatctat

SEQ ID NO: 84136 - DNA, 601 bp, Human
agtaaggttaagcatcatttcataaaactttatacacatgcatgtatattaatatatgtgctggttaatacatgtattttttatgtcagaaaagtttatgaaacttaaaaaaaaagtggcggcagcggggacgctttaaaaaaaacctgcctcctgcagcctctgctcacggtgcaccccctcaccccctggtctctcaaacaggagccagctctgtgttctgtagccccacccaccaggcactcccctactccctccctgccatggggccttggcgcctgctggtcctcctgcccagaaygctcttccctaccctcttcgtccagatttcgtctctccttcaaatctcagagcaaatattattgtcctagagaactcctgccagagccaagctgagcccactgttacattttctcacagttcccatgttttccctataaagccatgatcctggcttttgcagaaacaattcctctatgtatctatccgtgtttatcttgtgtgattattttattaatgttcgtctctcctaccatgctcatagcccactgtggtttgtgagtcttgtctgttctccatatcatagtaatattaatattcc

SEQ ID NO: 84137 - DNA, 601 bp, Human
acagggacatcatcactctcttgttgttcacaaaagcctaggattgagcaccatgcaccattctggcagcactacagatgaggagactgagggtcagagtggtcaagtaaattgcccggtgtgcttagattcaggctcaggctggccttacccccaagcctgagctatcactcgggggtatgtttcttggagtgaaggtgcaagaaaccaggtgctaagattaggccacagggaccaaattcacacgattttatgtccgggttacagcctggatgtgggatcccagatctccctggacgayaggaagtgtgcctcctaagcgtaggttctcctgctcactcacaccgtgggtgggctcaggtaagaagctctgggcagagcacggtgaccccagctctaggccatcctggctcggtggagtcgggcatgtgtgttccccactgtgaatctcagctcttattgagaaaatgggcacagaaatgtcagcttgctcagctcatagtcttattccaaaatcaagtgaaaggaaagcactttgaaagatgtgacgctgtgtcgtgctgtggaggcatggaaagtccctgtcctgggggtgcgtgct

SEQ ID NO: 84138 - DNA, 601 bp, Human
gcttagattcaggctcaggctggccttacccccaagcctgagctatcactcgggggtatgtttcttggagtgaaggtgcaagaaaccaggtgctaagattaggccacagggaccaaattcacacgattttatgtccgggttacagcctggatgtgggatcccagatctccctggacgataggaagtgtgcctcctaagcgtaggttctcctgctcactcacaccgtgggtgggctcaggtaagaagctctgggcagagcacggtgaccccagctctaggccatcctggctcggtggagtcrggcatgtgtgttccccactgtgaatctcagctcttattgagaaaatgggcacagaaatgtcagcttgctcagctcatagtcttattccaaaatcaagtgaaaggaaagcactttgaaagatgtgacgctgtgtcgtgctgtggaggcatggaaagtccctgtcctgggggtgcgtgctgtgggtgtgggagtctgaggacttggattctctactctccttcccggtgaggatggccatgtcattttgcttctctcctgtatgactagtgcagtccccttggctgtttattgctagagagg

SEQ ID NO: 84139 - DNA, 601 bp, Human
tagggctgcgcttagagctagcgtgtcctggtagggagtggcctaggctccagttccttttcttcaccagcactgtgggccaaggcgcatggcctcccacgcaccacagcagagctgccaggtgagattgatcttctgtggttgagatgatcactcttggctgtagcccactcatgccgtgagtgacagacaggtgcttagggcaccagagtcttctctaataaggtggcagctggccgcggttgttgatttaccggccaggatcttcgcctcaagaaccacagtgcgctcttctgtaatyagtgctttccttctcacatctcctgacacgaggatgagcagagcaggctcgatgacacagctgctcaactgtaatcctgtatgataattttgcaaattattatttttaatatcagctttttccttaggcaataaaagaaaaagttaaattgctcacaaactaataaaggtttatcttctggagcatcaaattctgtttactcatgaaacacacacctcctctatgcacccatcgagaggaaaattagcatttattttccctgataaacaaaaacagtggaagatttgttggcatcttttg

SEQ ID NO: 84140 - DNA, 601 bp, Human
acaaactaataaaggtttatcttctggagcatcaaattctgtttactcatgaaacacacacctcctctatgcacccatcgagaggaaaattagcatttattttccctgataaacaaaaacagtggaagatttgttggcatcttttggtgttaagcccttccttacatttaaaatgacatagaggaatgcaagaactttggaagaggtctgccctgactctggatttaattttaactttggaaagcaacctgttgtgtgcagtaggatgttatgtggtgtctgcagtgcctagacgctaacracatgcatggaaccaagctcccccttgggcccaggagccaagagattgaagaaagggaaatgctttcatgactctccacaagttcctccacgttcccaccggggggaagatgttgtgtaaccctcagtgatgagaaagtgagatttcccccagctagattcctcctcctttgattcattttggtggcaagagaagttgaagctttgacactctctttatttgcctcagtgctagaaggctttaattgcacttaaaaataattccagtccgattttcaaatgccttccggagtgattcagc

SEQ ID NO: 84141 - DNA, 601 bp, Human; identical to SEQ ID NO: 21890

SEQ ID NO: 84142 - DNA, 601 bp, Human; identical to SEQ ID NO: 21891

SEQ ID NO: 84143 - DNA, 601 bp, Human; identical to SEQ ID NO: 21892

SEQ ID NO: 84144 - DNA, 601 bp, Human; identical to SEQ ID NO: 21893

SEQ ID NO: 84145 - DNA, 601 bp, Human; identical to SEQ ID NO: 21894

SEQ ID NO: 84146 - DNA, 601 bp, Human; identical to SEQ ID NO: 21895

SEQ ID NO: 84147 - DNA, 601 bp, Human; identical to SEQ ID NO: 21896

SEQ ID NO: 84148 - DNA, 601 bp, Human; identical to SEQ ID NO: 21897

SEQ ID NO: 84149 - DNA, 601 bp, Human; identical to SEQ ID NO: 21898

SEQ ID NO: 84150 - DNA, 601 bp, Human; identical to SEQ ID NO: 21899

SEQ ID NO: 84151 - DNA, 601 bp, Human; identical to SEQ ID NO: 21900

SEQ ID NO: 84152 - DNA, 601 bp, Human; identical to SEQ ID NO: 21901

SEQ ID NO: 84153 - DNA, 601 bp, Human; identical to SEQ ID NO: 21902

SEQ ID NO: 84154 - DNA, 601 bp, Human; identical to SEQ ID NO: 21903

SEQ ID NO: 84155 - DNA, 601 bp, Human; identical to SEQ ID NO: 21904

SEQ ID NO: 84156 - DNA, 601 bp, Human; identical to SEQ ID NO: 21905

SEQ ID NO: 84157 - DNA, 601 bp, Human; identical to SEQ ID NO: 21906

SEQ ID NO: 84158 - DNA, 601 bp, Human; identical to SEQ ID NO: 21907

SEQ ID NO: 84159 - DNA, 601 bp, Human; identical to SEQ ID NO: 21908

SEQ ID NO: 84160 - DNA, 601 bp, Human
tgatgtgggcgaatgtgtagagtggacatgtgtgtggcacattggtgcagggttggccccacctgcttctccatccacgagcttctgggatggggatggtcggctgctgcctaactcctctgccataagcccagttacctcaccttattagtcacgtcagcaggggcttaagttttttttatagcttttatagcagatgtgcaaaccctactggagtagggggaagatattagggggatttgtttttacaacactttagtgttttgaacccgtgatagagcttatgttttaaaggttgctrtgtcttttggagtagagctgtcaatatgctactgtttatggaatatgaaataatatatatgtccaggtgtattttactcttacaattggagtagagaggagacctgctggattcagaagaaaaacctgctattttactcaggattaaactgcaccaaaccattactggaattttaaaagcatgtgttacaaattggcttttctaacgttgcccggagtttctgctcttgtgctcgtgctcttcagccgcagtggcgggcatttcattagaacgttctttcccttacacctccccaagagc

SEQ ID NO: 84161 - DNA, 601 bp, Human
gatagagcttatgttttaaaggttgctgtgtcttttggagtagagctgtcaatatgctactgtttatggaatatgaaataatatatatgtccaggtgtattttactcttacaattggagtagagaggagacctgctggattcagaagaaaaacctgctattttactcaggattaaactgcaccaaaccattactggaattttaaaagcatgtgttacaaattggcttttctaacgttgcccggagtttctgctcttgtgctcgtgctcttcagccgcagtggcgggcatttcattagaacrttctttcccttacacctccccaagagcctactcctttcctgtctccacttgtgcaagaaagagcacaaatgttccttcggaataggctcagccttgcccttatcctgcttctccagggtccatgtgttgaatgggctctcttggtggcgggatggggtggcatggagttatcctttcatgggccatgtcctccttgtggcctgggactctctgtccagcgctgcagtgagtgccttaggtcagcttgacagcactcgctctggggaggtggcgatgaagctccacaaaaggctccaggct

SEQ ID NO: 84162 - DNA, 601 bp, Human
actgtcagccaccccctccatcactgggcactcttgtgccacttccctgccctgtccatactcaaggccactgtggacatctggggcctcctatctcataggcatctgtctggccaagctcctgccagaacatggcccttcacaggggaagttccattagcatcagagaccttccgtctggaggccttggcagagcttcatcaccacctccccagagccagctctgtcaagctgacctaaggcactcactgcagctcctcaacaaaaacccatttcttatttcttctgcctcttttgtctstgggtgctccagctgtctgtggtcatcctggctcttccagcactttctatgaatcttttatgatccggatgccccagccattctcctaaatcatcctcccctgctgcttcttcctgtcctggtgcctaagggcacattctctgccccctttccttacagctggccaactcctcgagacaccaccacagctgcgttcatcccaccccctcgccctgtgcccaccccaatccagagagtagcatgcttacccctaaactcaggactctaggaatctccatttgtttgaaaggagaggtccta

SEQ ID NO: 84163 - DNA, 601 bp, Human
ctggaggccttggcagagcttcatcaccacctccccagagccagctctgtcaagctgacctaaggcactcactgcagctcctcaacaaaaacccatttcttatttcttctgcctcttttgtctctgggtgctccagctgtctgtggtcatcctggctcttccagcactttctatgaatcttttatgatccggatgccccagccattctcctaaatcatcctcccctgctgcttcttcctgtcctggtgcctaagggcacattctctgccccctttccttacagctggccaactcctcgagrcaccaccacagctgcgttcatcccaccccctcgccctgtgcccaccccaatccagagagtagcatgcttacccctaaactcaggactctaggaatctccatttgtttgaaaggagaggtcctacttgggaagatttcaggactgataagctggcaggggaaatgtggagaggcattggggtcttcgcgccccttatcccatccacctggatgagcctgcccttggtcacaggagatgagccctctcctggccttaagctgactctccctgcctcaccaagaaccctgccctcccgtggac

SEQ ID NO: 84164 - DNA, 601 bp, Human
tagacataaggagccgctgcacctgtctcaggcatcagcaaggtgtcatggcctgcgatgcagccatgcatccccagccaggcagctccaagtgagtggctctgggtcctccaggctcatgagtgtttcacaggagctccaaggtcagcaagccccttgcttgacggacgtaggaggatgtggaggtttttgaatgtgggatgaagtgccaccgattaattagtgtgtaattaagtttccagagcagttaggcaagaggaatgctctatacataaagatatgaatgtgtctgagcacaggkactcaaggctgagtgatggatcgggagggaccagtcacttgtaggatgtcagcatgggcgcctagagccccaagggttgtgcggtgtcacacttctctctgctgaaccttgcctgtttcatcttcttaaccatgttttccacccagatacagtccagcaactttctcccacccacctccccctgcacatgctcagggggtaaggtgtggttgcgcagtttcatcagattggccccgacccagggagagaaggcagagagagtctgattccttggtgccctctgcctgcagtatcttctga

SEQ ID NO: 84165 - DNA, 601 bp, Human
gctcttgataacctcggagccctccatcaaggcggtgagtggtctgtgcaaacctttccaccctggcccagcctcctgctgcgctcccacagaaccctagagctcttctggtatataaagcatggtcctggatgtctggcaagtgcaggctgattttatacattacagatgtataaaattatagatgcattagagtaagaatagtaaatctcacccaaaacaaaaattatgcgttccaaaccaaatataattggcttttggattagctactactgggatccttctctccatgatctttcarataggtgccaatagcctatggttagctgtggcagtgagtggtaaaagcagtgtttcctttttaagttaattgaattaacaagacgtcaatatcgcttcgagcacagccccctgactccgtcacgtcaatttaacagcaactttccgaaaggccttctattcataagtgttctcttgtttcatgttctcagagggctgctggtatcagacactgagagactctctgttcagtattttcagttggacaccctgtgaatatttttggagcaatattagtgattcagaaaagagaagaaaatat

SEQ ID NO: 84166 - DNA, 601 bp, Human
agttggacaccctgtgaatatttttggagcaatattagtgattcagaaaagagaagaaaatataatggttttgcttattacgtgagtgagcctctgccaccttttgagcaacacagtaaacccttgctaattttatcccagccatagagaaccttgttgcaaatcaccagacaatgtgcatttatgaggaagataataagcatgattttgataaaaccagctctgctctatcagcaaatgtactatctccaatttagtgggacaggatcatttaattctgattatagtaacagttcatagmacactagcgaatcaattcgagtgtattctataaaaatgaacgaggatcctggaattagaggctagctgtggatctctggtactgaatccttgctaataaacagatcagggtggccaggtgtttgtgtaaattacttagtttggactagggttagtaaaattagaatcagctgtgttgtgatttacttaccactcatccacctttgttggaaatcattaagttcatcagtcagaatttgatcagcagcatacctaggtagctgtagcttcctcattgcctgtgtttgtgacagctagattt

SEQ ID NO: 84167 - DNA, 601 bp, Human
ggttttgcttattacgtgagtgagcctctgccaccttttgagcaacacagtaaacccttgctaattttatcccagccatagagaaccttgttgcaaatcaccagacaatgtgcatttatgaggaagataataagcatgattttgataaaaccagctctgctctatcagcaaatgtactatctccaatttagtgggacaggatcatttaattctgattatagtaacagttcatagcacactagcgaatcaattcgagtgtattctataaaaatgaacgaggatcctggaattagaggctagytgtggatctctggtactgaatccttgctaataaacagatcagggtggccaggtgtttgtgtaaattacttagtttggactagggttagtaaaattagaatcagctgtgttgtgatttacttaccactcatccacctttgttggaaatcattaagttcatcagtcagaatttgatcagcagcatacctaggtagctgtagcttcctcattgcctgtgtttgtgacagctagatttacatggaagcagagaaaacatgccgttttcataacctacactctgtgttcagatccctttggcttg

SEQ ID NO: 84168 - DNA, 601 bp, Human; identical to SEQ ID NO: 21909

SEQ ID NO: 84169 - DNA, 601 bp, Human; identical to SEQ ID NO: 21910

SEQ ID NO: 84170 - DNA, 601 bp, Human; identical to SEQ ID NO: 21911

SEQ ID NO: 84171 - DNA, 601 bp, Human; identical to SEQ ID NO: 21912

SEQ ID NO: 84172 - DNA, 601 bp, Human; identical to SEQ ID NO: 21913

SEQ ID NO: 84173 - DNA, 601 bp, Human; identical to SEQ ID NO: 21914

SEQ ID NO: 84174 - DNA, 601 bp, Human; identical to SEQ ID NO: 21915

SEQ ID NO: 84175 - DNA, 601 bp, Human; identical to SEQ ID NO: 21916

SEQ ID NO: 84176 - DNA, 601 bp, Human; identical to SEQ ID NO: 21917

SEQ ID NO: 84177 - DNA, 601 bp, Human; identical to SEQ ID NO: 21918

SEQ ID NO: 84178 - DNA, 601 bp, Human; identical to SEQ ID NO: 21919

SEQ ID NO: 84179 - DNA, 601 bp, Human; identical to SEQ ID NO: 21920

SEQ ID NO: 84180 - DNA, 601 bp, Human; identical to SEQ ID NO: 21921

SEQ ID NO: 84181 - DNA, 601 bp, Human
tcctttgcgtgtgttgctggtggtctctggcactggtcatctgtaaccacatcgctccaagcccttcctccgtcatcacaggccttctcctcatgcgagtttctgtctcagtctccttctccttaggaggtaccagcggttagacgagggcccactctcctccagcaggtcctcatcttcccttgattacatccaaataccctgtttccaaataaggtcagattcagaaatatcaggggttaggactttaaatatttctggggacacagtcctacccacaattgtactgatgcccgggagkgatgatggctgcccctttttgtggctgttgacgtaaaccaaaccccattgaaaacaatgactcgacagagtccccgtggtcacgagcttgggattctgctcacatttggagtaagcgatgcggcatcctttatttgtccctgccattcttgacacagggagaaagtctgacgttttcagaatggcatgtgggctcccaaaggctggttggaaataaggattggaaatgttctgtgaattacacccagtcctgtagtttaggggtccccaaaccccaggtcctcagcctctggtacaggtc

SEQ ID NO: 84182 - DNA, 601 bp, Human
cttcctccgtcatcacaggccttctcctcatgcgagtttctgtctcagtctccttctccttaggaggtaccagcggttagacgagggcccactctcctccagcaggtcctcatcttcccttgattacatccaaataccctgtttccaaataaggtcagattcagaaatatcaggggttaggactttaaatatttctggggacacagtcctacccacaattgtactgatgcccgggagtgatgatggctgcccctttttgtggctgttgacgtaaaccaaaccccattgaaaacaatgactygacagagtccccgtggtcacgagcttgggattctgctcacatttggagtaagcgatgcggcatcctttatttgtccctgccattcttgacacagggagaaagtctgacgttttcagaatggcatgtgggctcccaaaggctggttggaaataaggattggaaatgttctgtgaattacacccagtcctgtagtttaggggtccccaaaccccaggtcctcagcctctggtacaggtcgtggcctgttaggaaccaggctgcacagcagcaggtgagcaacgggtgagcaagcaaagcttc

SEQ ID NO: 84183 - DNA, 601 bp, Human
ttacatccaaataccctgtttccaaataaggtcagattcagaaatatcaggggttaggactttaaatatttctggggacacagtcctacccacaattgtactgatgcccgggagtgatgatggctgcccctttttgtggctgttgacgtaaaccaaaccccattgaaaacaatgactcgacagagtccccgtggtcacgagcttgggattctgctcacatttggagtaagcgatgcggcatcctttatttgtccctgccattcttgacacagggagaaagtctgacgttttcagaatggcrtgtgggctcccaaaggctggttggaaataaggattggaaatgttctgtgaattacacccagtcctgtagtttaggggtccccaaaccccaggtcctcagcctctggtacaggtcgtggcctgttaggaaccaggctgcacagcagcaggtgagcaacgggtgagcaagcaaagcttcatctgtgtttacagccgttccccatcgcccgcattaccacctgagctccacctcctgccagatcagcagcaccattagattctcacaggagaatgatacctattgtgaactgtgcgtgtgagg

SEQ ID NO: 84184 - DNA, 601 bp, Human
tccaaataaggtcagattcagaaatatcaggggttaggactttaaatatttctggggacacagtcctacccacaattgtactgatgcccgggagtgatgatggctgcccctttttgtggctgttgacgtaaaccaaaccccattgaaaacaatgactcgacagagtccccgtggtcacgagcttgggattctgctcacatttggagtaagcgatgcggcatcctttatttgtccctgccattcttgacacagggagaaagtctgacgttttcagaatggcatgtgggctcccaaaggctgsttggaaataaggattggaaatgttctgtgaattacacccagtcctgtagtttaggggtccccaaaccccaggtcctcagcctctggtacaggtcgtggcctgttaggaaccaggctgcacagcagcaggtgagcaacgggtgagcaagcaaagcttcatctgtgtttacagccgttccccatcgcccgcattaccacctgagctccacctcctgccagatcagcagcaccattagattctcacaggagaatgatacctattgtgaactgtgcgtgtgagggatctaggtgccatactcct

SEQ ID NO: 84185 - DNA, 601 bp, Human
attctgctcacatttggagtaagcgatgcggcatcctttatttgtccctgccattcttgacacagggagaaagtctgacgttttcagaatggcatgtgggctcccaaaggctggttggaaataaggattggaaatgttctgtgaattacacccagtcctgtagtttaggggtccccaaaccccaggtcctcagcctctggtacaggtcgtggcctgttaggaaccaggctgcacagcagcaggtgagcaacgggtgagcaagcaaagcttcatctgtgtttacagccgttccccatcgccygcattaccacctgagctccacctcctgccagatcagcagcaccattagattctcacaggagaatgatacctattgtgaactgtgcgtgtgagggatctaggtgccatactcctcatgagaacctaatgcctgatgatctgtcactgtctcccatcttcccctgatgggatcatctagttgcaagaaaacaagttcaggctcccactgattctacatgatggtgagttgtataattatttcgttatgtattacaatgtaataataatagaaataaagtacacgatcaatgtaatgcccgtg

SEQ ID NO: 84186 - DNA, 601 bp, Human
cagggagaaagtctgacgttttcagaatggcatgtgggctcccaaaggctggttggaaataaggattggaaatgttctgtgaattacacccagtcctgtagtttaggggtccccaaaccccaggtcctcagcctctggtacaggtcgtggcctgttaggaaccaggctgcacagcagcaggtgagcaacgggtgagcaagcaaagcttcatctgtgtttacagccgttccccatcgcccgcattaccacctgagctccacctcctgccagatcagcagcaccattagattctcacaggagmatgatacctattgtgaactgtgcgtgtgagggatctaggtgccatactcctcatgagaacctaatgcctgatgatctgtcactgtctcccatcttcccctgatgggatcatctagttgcaagaaaacaagttcaggctcccactgattctacatgatggtgagttgtataattatttcgttatgtattacaatgtaataataatagaaataaagtacacgatcaatgtaatgcccgtgaatcatcctgaaaccatcccccaccccggtccatggaaaaattttcctccctgaaaccagtc

SEQ ID NO: 84187 - DNA, 601 bp, Human
gaaagtctgacgttttcagaatggcatgtgggctcccaaaggctggttggaaataaggattggaaatgttctgtgaattacacccagtcctgtagtttaggggtccccaaaccccaggtcctcagcctctggtacaggtcgtggcctgttaggaaccaggctgcacagcagcaggtgagcaacgggtgagcaagcaaagcttcatctgtgtttacagccgttccccatcgcccgcattaccacctgagctccacctcctgccagatcagcagcaccattagattctcacaggagaatgatmcctattgtgaactgtgcgtgtgagggatctaggtgccatactcctcatgagaacctaatgcctgatgatctgtcactgtctcccatcttcccctgatgggatcatctagttgcaagaaaacaagttcaggctcccactgattctacatgatggtgagttgtataattatttcgttatgtattacaatgtaataataatagaaataaagtacacgatcaatgtaatgcccgtgaatcatcctgaaaccatcccccaccccggtccatggaaaaattttcctccctgaaaccagtccctggt

SEQ ID NO: 84188 - DNA, 601 bp, Human
aaggctggttggaaataaggattggaaatgttctgtgaattacacccagtcctgtagtttaggggtccccaaaccccaggtcctcagcctctggtacaggtcgtggcctgttaggaaccaggctgcacagcagcaggtgagcaacgggtgagcaagcaaagcttcatctgtgtttacagccgttccccatcgcccgcattaccacctgagctccacctcctgccagatcagcagcaccattagattctcacaggagaatgatacctattgtgaactgtgcgtgtgagggatctaggtgccrtactcctcatgagaacctaatgcctgatgatctgtcactgtctcccatcttcccctgatgggatcatctagttgcaagaaaacaagttcaggctcccactgattctacatgatggtgagttgtataattatttcgttatgtattacaatgtaataataatagaaataaagtacacgatcaatgtaatgcccgtgaatcatcctgaaaccatcccccaccccggtccatggaaaaattttcctccctgaaaccagtccctggtgccaaaaaggttggggaccgctgctgtagtggaacagg

SEQ ID NO: 84189 - DNA, 601 bp, Human
gagggatctaggtgccatactcctcatgagaacctaatgcctgatgatctgtcactgtctcccatcttcccctgatgggatcatctagttgcaagaaaacaagttcaggctcccactgattctacatgatggtgagttgtataattatttcgttatgtattacaatgtaataataatagaaataaagtacacgatcaatgtaatgcccgtgaatcatcctgaaaccatcccccaccccggtccatggaaaaattttcctccctgaaaccagtccctggtgccaaaaaggttggggaccgcygctgtagtggaacaggatatatttttgttctctggaatgagaagctttgaggattagggccaattactataattgtactaggttagccaggagaatcctgtttctcagcaaactggtaaagaaatggagcaaatgcagccatcccttcccggcagtggcttcttggctccagggtgagcagtgctacagaatgggcagggcagggcagggcaggaggcagggaccctggggtggccgggaggcccgagggccagaggtcacgggactgaaggaatgtgcgcatttgttgatggctgttgc

SEQ ID NO: 84190 - DNA, 601 bp, Human
cctgatgggatcatctagttgcaagaaaacaagttcaggctcccactgattctacatgatggtgagttgtataattatttcgttatgtattacaatgtaataataatagaaataaagtacacgatcaatgtaatgcccgtgaatcatcctgaaaccatcccccaccccggtccatggaaaaattttcctccctgaaaccagtccctggtgccaaaaaggttggggaccgctgctgtagtggaacaggatatatttttgttctctggaatgagaagctttgaggattagggccaattactawaattgtactaggttagccaggagaatcctgtttctcagcaaactggtaaagaaatggagcaaatgcagccatcccttcccggcagtggcttcttggctccagggtgagcagtgctacagaatgggcagggcagggcagggcaggaggcagggaccctggggtggccgggaggcccgagggccagaggtcacgggactgaaggaatgtgcgcatttgttgatggctgttgccgggctctctttgtggcagcacatcctctgaccagcgttggctcccgcgacctctccaccctcattccct

SEQ ID NO: 84191 - DNA, 601 bp, Human
gatgggatcatctagttgcaagaaaacaagttcaggctcccactgattctacatgatggtgagttgtataattatttcgttatgtattacaatgtaataataatagaaataaagtacacgatcaatgtaatgcccgtgaatcatcctgaaaccatcccccaccccggtccatggaaaaattttcctccctgaaaccagtccctggtgccaaaaaggttggggaccgctgctgtagtggaacaggatatatttttgttctctggaatgagaagctttgaggattagggccaattactataaytgtactaggttagccaggagaatcctgtttctcagcaaactggtaaagaaatggagcaaatgcagccatcccttcccggcagtggcttcttggctccagggtgagcagtgctacagaatgggcagggcagggcagggcaggaggcagggaccctggggtggccgggaggcccgagggccagaggtcacgggactgaaggaatgtgcgcatttgttgatggctgttgccgggctctctttgtggcagcacatcctctgaccagcgttggctcccgcgacctctccaccctcattccctccc

SEQ ID NO: 84192 - DNA, 601 bp, Human
cagcacatcctctgaccagcgttggctcccgcgacctctccaccctcattccctcccttgccctctgcattccagccacactggcccttctgcgtcctgaaatgcaccagccctctctgccactgcccagcgggtttctgctgcactgccttgaggacgttgcttgagtcagttttccttttgctgcctgtaccattttgtcacttgaattagctttttctaagccaggctttctcaatctgggcatgattggcattctgggctacctgttactttgtggtagaggaccacgcgtgcatgrtggactcaaggaatgtctccctgcagtgccctgggcatactccttcctgtctcagcttaaatgtcacctgttctccagccacggaaacatcctcttttctcctttatggcacccactatcatttgcaatgatagatttgcttgtgtgtttctttaatgagttccccagtaggctctgagctctgtgaagatagaacctcacgcgtcaattccccaccatgcatctaatgctcggaacagtgcctggcacacagcacatgctcattacattatggacgtgtgtggaaagaatgaacaaatg

SEQ ID NO: 84193 - DNA, 601 bp, Human
tccagccacactggcccttctgcgtcctgaaatgcaccagccctctctgccactgcccagcgggtttctgctgcactgccttgaggacgttgcttgagtcagttttccttttgctgcctgtaccattttgtcacttgaattagctttttctaagccaggctttctcaatctgggcatgattggcattctgggctacctgttactttgtggtagaggaccacgcgtgcatggtggactcaaggaatgtctccctgcagtgccctgggcatactccttcctgtctcagcttaaatgtcacctsttctccagccacggaaacatcctcttttctcctttatggcacccactatcatttgcaatgatagatttgcttgtgtgtttctttaatgagttccccagtaggctctgagctctgtgaagatagaacctcacgcgtcaattccccaccatgcatctaatgctcggaacagtgcctggcacacagcacatgctcattacattatggacgtgtgtggaaagaatgaacaaatgaatgaaaagtcagcatttaacagtgcttcctgacagatgagaaatgctcatgtatggcaggacaggtggc

SEQ ID NO: 84194 - DNA, 601 bp, Human
catgattggcattctgggctacctgttactttgtggtagaggaccacgcgtgcatggtggactcaaggaatgtctccctgcagtgccctgggcatactccttcctgtctcagcttaaatgtcacctgttctccagccacggaaacatcctcttttctcctttatggcacccactatcatttgcaatgatagatttgcttgtgtgtttctttaatgagttccccagtaggctctgagctctgtgaagatagaacctcacgcgtcaattccccaccatgcatctaatgctcggaacagtgccyggcacacagcacatgctcattacattatggacgtgtgtggaaagaatgaacaaatgaatgaaaagtcagcatttaacagtgcttcctgacagatgagaaatgctcatgtatggcaggacaggtggccttcaataaatgataaatcaaaaaacagagtctttttttttttttagcaaaggtagccaaatatcttttcctacattgtgatagttcatcaaaaaaatcatatggaggggcaaaacgaatgtgttcggttcagtacagtggttctcaactgagatctgcaggaggcattgtggg

SEQ ID NO: 84195 - DNA, 601 bp, Human
gtggtagaggaccacgcgtgcatggtggactcaaggaatgtctccctgcagtgccctgggcatactccttcctgtctcagcttaaatgtcacctgttctccagccacggaaacatcctcttttctcctttatggcacccactatcatttgcaatgatagatttgcttgtgtgtttctttaatgagttccccagtaggctctgagctctgtgaagatagaacctcacgcgtcaattccccaccatgcatctaatgctcggaacagtgcctggcacacagcacatgctcattacattatggaygtgtgtggaaagaatgaacaaatgaatgaaaagtcagcatttaacagtgcttcctgacagatgagaaatgctcatgtatggcaggacaggtggccttcaataaatgataaatcaaaaaacagagtctttttttttttttagcaaaggtagccaaatatcttttcctacattgtgatagttcatcaaaaaaatcatatggaggggcaaaacgaatgtgttcggttcagtacagtggttctcaactgagatctgcaggaggcattgtgggttctcctgactgggggaagagaaggtgctgtt

SEQ ID NO: 84196 - DNA, 601 bp, Human
tttatggcacccactatcatttgcaatgatagatttgcttgtgtgtttctttaatgagttccccagtaggctctgagctctgtgaagatagaacctcacgcgtcaattccccaccatgcatctaatgctcggaacagtgcctggcacacagcacatgctcattacattatggacgtgtgtggaaagaatgaacaaatgaatgaaaagtcagcatttaacagtgcttcctgacagatgagaaatgctcatgtatggcaggacaggtggccttcaataaatgataaatcaaaaaacagagtctttttttttttttagcaaaggtagccaaatatcttttcctacattgtgatagttcatcaaaaaaatcatatggaggggcaaaacgaatgtgttcggttcagtacagtggttctcaactgagatctgcaggaggcattgtgggttctcctgactgggggaagagaaggtgctgttaaccctccagcagtgcacacatggcccccacaccacaaagaaatagcccagaatccctgtcgtgtccaggttgagaaagccctccttagaaaaaatgaattcaagtgatgaaatggaatgggcagct

SEQ ID NO: 84197 - DNA, 601 bp, Human
agttccccagtaggctctgagctctgtgaagatagaacctcacgcgtcaattccccaccatgcatctaatgctcggaacagtgcctggcacacagcacatgctcattacattatggacgtgtgtggaaagaatgaacaaatgaatgaaaagtcagcatttaacagtgcttcctgacagatgagaaatgctcatgtatggcaggacaggtggccttcaataaatgataaatcaaaaaacagagtctttttttttttttagcaaaggtagccaaatatcttttcctacattgtgatagttcaycaaaaaaatcatatggaggggcaaaacgaatgtgttcggttcagtacagtggttctcaactgagatctgcaggaggcattgtgggttctcctgactgggggaagagaaggtgctgttaaccctccagcagtgcacacatggcccccacaccacaaagaaatagcccagaatccctgtcgtgtccaggttgagaaagccctccttagaaaaaatgaattcaagtgatgaaatggaatgggcagctaaagcaaaacagactcaaggaatgtcctcagatgtccctgtgttttggtggagaca

SEQ ID NO: 84198 - DNA, 601 bp, Human
aaggaacaaagcctccttatccctctaaaactaaagtaagatgaagaacaggtgctggaaagaatttgataaaatgaaatttgaagtatctgagtgatcagctgcaaggcaaaaaattcattttaacatcaacaagcattacattttctgggagaaagagcagtaggaaataattcatcttccgtaacaatctggatggcctgcactagagtttgaacctctccgaatctccatggctccaaacagcacaggtgtgtttctcacacatgctccgaatcctccttttggctcggaacccagrtgaacagaggttccgccacagaggaacacagccggagaggacagcaaagagtcccccgccctggggcttctgccccaaaatgacagtgttcatgtcattggctgaaggagatcacatgatcaccccagacttcaaggggtggagaagtgcacttaggggcaggtgagtgtgagcggcacccacgtgcaccacacagcttgttagacaggtgagtctaacaatcaagggcaccatccaatctagattaacaaaagttcatctagaaatcccctaagtatgcatgtattctgagaaagacga

SEQ ID NO: 84199 - DNA, 601 bp, Human
cctctccgaatctccatggctccaaacagcacaggtgtgtttctcacacatgctccgaatcctccttttggctcggaacccaggtgaacagaggttccgccacagaggaacacagccggagaggacagcaaagagtcccccgccctggggcttctgccccaaaatgacagtgttcatgtcattggctgaaggagatcacatgatcaccccagacttcaaggggtggagaagtgcacttaggggcaggtgagtgtgagcggcacccacgtgcaccacacagcttgttagacaggtgagtctwacaatcaagggcaccatccaatctagattaacaaaagttcatctagaaatcccctaagtatgcatgtattctgagaaagacgacgtccacactagtctcccaaataactcggcttccccacaactagagatgtgagaataacatctcataaaacttgttgggcctcaatcctcgtttctctgtcgtggagtttccttcttccgttaaagagggggcttaggtaggcagaaccctgcaggagaagcagcctgagagaatgggctcctgacccccgtgactgcgatgtggggaatcccacca

SEQ ID NO: 84200 - DNA, 601 bp, Human
ctctccgaatctccatggctccaaacagcacaggtgtgtttctcacacatgctccgaatcctccttttggctcggaacccaggtgaacagaggttccgccacagaggaacacagccggagaggacagcaaagagtcccccgccctggggcttctgccccaaaatgacagtgttcatgtcattggctgaaggagatcacatgatcaccccagacttcaaggggtggagaagtgcacttaggggcaggtgagtgtgagcggcacccacgtgcaccacacagcttgttagacaggtgagtctamcaatcaagggcaccatccaatctagattaacaaaagttcatctagaaatcccctaagtatgcatgtattctgagaaagacgacgtccacactagtctcccaaataactcggcttccccacaactagagatgtgagaataacatctcataaaacttgttgggcctcaatcctcgtttctctgtcgtggagtttccttcttccgttaaagagggggcttaggtaggcagaaccctgcaggagaagcagcctgagagaatgggctcctgacccccgtgactgcgatgtggggaatcccaccag

SEQ ID NO: 84201 - DNA, 601 bp, Human
aaacttgttgggcctcaatcctcgtttctctgtcgtggagtttccttcttccgttaaagagggggcttaggtaggcagaaccctgcaggagaagcagcctgagagaatgggctcctgacccccgtgactgcgatgtggggaatcccaccaggtggccagtgcaggaggaagggggcacacagtagaagctcgaagtgtgatgttttgtgccggacttagaatcacttttgtttaagaaacaaggctgaggcctgagtatccccggctgctttggggatgtgccatcatttgagaaataacrtcctcctgcctttcctaaatgcagtggaatgacaaaggccacggctgaaggttgagaagcttgaagttgggagggcccagggcacacctttccacactccattcccagactgtaattatcttgggggaaaaatactttttaaatggtccacaggtcatcacaggccttagtgggcaggtgacacagcccaaggaaacttgaaggagggccttgattggtgtggagccctgatatggtttcgatctgggtccctgcccaaatctgaagtcgttgtaatctccaatgttggaggtggggcct

SEQ ID NO: 84202 - DNA, 601 bp, Human
ttccttcttccgttaaagagggggcttaggtaggcagaaccctgcaggagaagcagcctgagagaatgggctcctgacccccgtgactgcgatgtggggaatcccaccaggtggccagtgcaggaggaagggggcacacagtagaagctcgaagtgtgatgttttgtgccggacttagaatcacttttgtttaagaaacaaggctgaggcctgagtatccccggctgctttggggatgtgccatcatttgagaaataacgtcctcctgcctttcctaaatgcagtggaatgacaaaggccrcggctgaaggttgagaagcttgaagttgggagggcccagggcacacctttccacactccattcccagactgtaattatcttgggggaaaaatactttttaaatggtccacaggtcatcacaggccttagtgggcaggtgacacagcccaaggaaacttgaaggagggccttgattggtgtggagccctgatatggtttcgatctgggtccctgcccaaatctgaagtcgttgtaatctccaatgttggaggtggggcctggtgggaggtgattgggtcataagggtggatttcctccttg

SEQ ID NO: 84203 - DNA, 601 bp, Human
tccttcttccgttaaagagggggcttaggtaggcagaaccctgcaggagaagcagcctgagagaatgggctcctgacccccgtgactgcgatgtggggaatcccaccaggtggccagtgcaggaggaagggggcacacagtagaagctcgaagtgtgatgttttgtgccggacttagaatcacttttgtttaagaaacaaggctgaggcctgagtatccccggctgctttggggatgtgccatcatttgagaaataacgtcctcctgcctttcctaaatgcagtggaatgacaaaggccayggctgaaggttgagaagcttgaagttgggagggcccagggcacacctttccacactccattcccagactgtaattatcttgggggaaaaatactttttaaatggtccacaggtcatcacaggccttagtgggcaggtgacacagcccaaggaaacttgaaggagggccttgattggtgtggagccctgatatggtttcgatctgggtccctgcccaaatctgaagtcgttgtaatctccaatgttggaggtggggcctggtgggaggtgattgggtcataagggtggatttcctccttgg

SEQ ID NO: 84204 - DNA, 601 bp, Human
gccgtgagtataagctccctgacgcctccccagaagtggctgctgccatgcttcctgtacagcctatggaactgtgagctgattaaacctcttttctttatacattactcagtctcagatatttctttaagccctctgagcagctgagcaccagagaaaccaactctcaattaattggtaggactctaaccctcactgttgtccagtactgagtcctgagccacatgcggccattgggcccacgtgaaccatctttctaagaccaagtacaaaaaaacaaatgttcttatgggctgagttscatccccccaaaattcctatgttgaaatcctaaccttcagtatttcaaaatatggctatatttggagatagggtctttaaagaggtaattaaggtaaaatgaggtcattagggtgggccctaatcgaatctgactggtgtccttataagaagggggattaggatacagacacacacagggaagaccatattgaggatacagcaagaaggcagccatctacaagccaacgagagaggactcagaggaaaccagccctgcagacactttgatcgcagaatcctggcctccagaacagtgagg

SEQ ID NO: 84205 - DNA, 601 bp, Human
tcctgtacagcctatggaactgtgagctgattaaacctcttttctttatacattactcagtctcagatatttctttaagccctctgagcagctgagcaccagagaaaccaactctcaattaattggtaggactctaaccctcactgttgtccagtactgagtcctgagccacatgcggccattgggcccacgtgaaccatctttctaagaccaagtacaaaaaaacaaatgttcttatgggctgagttgcatccccccaaaattcctatgttgaaatcctaaccttcagtatttcaaaatrtggctatatttggagatagggtctttaaagaggtaattaaggtaaaatgaggtcattagggtgggccctaatcgaatctgactggtgtccttataagaagggggattaggatacagacacacacagggaagaccatattgaggatacagcaagaaggcagccatctacaagccaacgagagaggactcagaggaaaccagccctgcagacactttgatcgcagaatcctggcctccagaacagtgaggaagtgaatgaatgtgacttgacgcccccagcacctactcagtgcttcattat

SEQ ID NO: 84206 - DNA, 601 bp, Human
gaatgtgacttgacgcccccagcacctactcagtgcttcattatggcagccctggcaaactaataccaataccaggtgtctcattcatttgtttgtatagatttcatgttgaaatagtaatattttagatagagtcaatattactacaattaattttactctttaaaaggtagcagctaggaaatgcaacattcacggatgtggctcctattggacggtggttcctgttggacggtgctgctctgagtcaaagactttgctcttgttgagcgccaagaacatcgtcagaccagcactgccrcccacatgcggctgggaagcggaagctgcccactgtcctgtggggcctcacaggcagtagaattgcctgcctgcctgttggtatctactccttagactacaggaatatttaaacagcgaaaatatttctgaaagagttacaaaatggggactcaagtctggaaagaataaaatgtatgtcgaaatggcaaggaaaaaagcatgatcacaagcaccaagatatgatgtttttttcctgtgactcaatttcatttctgtagtggtgaaacagctgtcaagactacggcagttaccagcggga

SEQ ID NO: 84207 - DNA, 601 bp, Human
tcaaagactttgctcttgttgagcgccaagaacatcgtcagaccagcactgccgcccacatgcggctgggaagcggaagctgcccactgtcctgtggggcctcacaggcagtagaattgcctgcctgcctgttggtatctactccttagactacaggaatatttaaacagcgaaaatatttctgaaagagttacaaaatggggactcaagtctggaaagaataaaatgtatgtcgaaatggcaaggaaaaaagcatgatcacaagcaccaagatatgatgtttttttcctgtgactcaatktcatttctgtagtggtgaaacagctgtcaagactacggcagttaccagcgggaacctggagggaagggtgacttgggagttctcacatggcccttaaggaaatacagatgaggcaaataggagagaggtagaaacaggcagctgccaagataaggtgtaagaaatcaagaaaaagcagcatcttcttgttggagcaagacagagttttccgatacctattttattattaaaatttagaattatgcgcctcggtgatgttgttttcatttgtgctttggataaatcccattataatctcat

SEQ ID NO: 84208 - DNA, 601 bp, Human
aagatgcccaaacctcagggattctcccatctcctctgcaggcgatccaggcctctcacctggcatgaggccccttagagtaggaatcgagcctccagatgtaccctctcatcacccacagcatctggccttctgaacatgccctctgttccccaagcccttgcaccttcccatggtctgccccggcgtggaccggctgcttcttgctgctgtctcgtgtgacggctgccatgacagctgccttcctgccttctgggcatatttcactgctctcaaactttcgtggcttttggagttcacyggggaatcttgttaaaatccagattttgattcagctggtctggggtgggcctcgaggctctgcatttctgagaagctcccaggtgatgtcccagctgctccagggaccatccctgagtccccagggcctgtgctgacttaagctcctgagagcagaggcagtggctgtggctgccacctctggatctccctctgagggagctgtaccgtggcctgggctccactccatttttttaaatagctttttaagagtggttttaggctcacagcaacatggaacagtgagtacagccaggtccca

SEQ ID NO: 84209 - DNA, 601 bp, Human
atgcccaaacctcagggattctcccatctcctctgcaggcgatccaggcctctcacctggcatgaggccccttagagtaggaatcgagcctccagatgtaccctctcatcacccacagcatctggccttctgaacatgccctctgttccccaagcccttgcaccttcccatggtctgccccggcgtggaccggctgcttcttgctgctgtctcgtgtgacggctgccatgacagctgccttcctgccttctgggcatatttcactgctctcaaactttcgtggcttttggagttcaccggsgaatcttgttaaaatccagattttgattcagctggtctggggtgggcctcgaggctctgcatttctgagaagctcccaggtgatgtcccagctgctccagggaccatccctgagtccccagggcctgtgctgacttaagctcctgagagcagaggcagtggctgtggctgccacctctggatctccctctgagggagctgtaccgtggcctgggctccactccatttttttaaatagctttttaagagtggttttaggctcacagcaacatggaacagtgagtacagccaggtcccagac

SEQ ID NO: 84210 - DNA, 601 bp, Human
cgatccaggcctctcacctggcatgaggccccttagagtaggaatcgagcctccagatgtaccctctcatcacccacagcatctggccttctgaacatgccctctgttccccaagcccttgcaccttcccatggtctgccccggcgtggaccggctgcttcttgctgctgtctcgtgtgacggctgccatgacagctgccttcctgccttctgggcatatttcactgctctcaaactttcgtggcttttggagttcaccggggaatcttgttaaaatccagattttgattcagctggtctggggtgggcctcgaggctctgcatttctgagaagctcccaggtgatgtcccagctgctccagggaccatccctgagtccccagggcctgtgctgacttaagctcctgagagcagaggcagtggctgtggctgccacctctggatctccctctgagggagctgtaccgtggcctgggctccactccatttttttaaatagctttttaagagtggttttaggctcacagcaacatggaacagtgagtacagccaggtcccagacaccccctgcccacacacatacacaggcacggggctttca

SEQ ID NO: 84211 - DNA, 601 bp, Human
ctctcacctggcatgaggccccttagagtaggaatcgagcctccagatgtaccctctcatcacccacagcatctggccttctgaacatgccctctgttccccaagcccttgcaccttcccatggtctgccccggcgtggaccggctgcttcttgctgctgtctcgtgtgacggctgccatgacagctgccttcctgccttctgggcatatttcactgctctcaaactttcgtggcttttggagttcaccggggaatcttgttaaaatccagattttgattcagctggtctggggtgggccycgaggctctgcatttctgagaagctcccaggtgatgtcccagctgctccagggaccatccctgagtccccagggcctgtgctgacttaagctcctgagagcagaggcagtggctgtggctgccacctctggatctccctctgagggagctgtaccgtggcctgggctccactccatttttttaaatagctttttaagagtggttttaggctcacagcaacatggaacagtgagtacagccaggtcccagacaccccctgcccacacacatacacaggcacggggctttcagggtggtcat

SEQ ID NO: 84212 - DNA, 601 bp, Human
gctgctgtctcgtgtgacggctgccatgacagctgccttcctgccttctgggcatatttcactgctctcaaactttcgtggcttttggagttcaccggggaatcttgttaaaatccagattttgattcagctggtctggggtgggcctcgaggctctgcatttctgagaagctcccaggtgatgtcccagctgctccagggaccatccctgagtccccagggcctgtgctgacttaagctcctgagagcagaggcagtggctgtggctgccacctctggatctccctctgagggagctgtrccgtggcctgggctccactccatttttttaaatagctttttaagagtggttttaggctcacagcaacatggaacagtgagtacagccaggtcccagacaccccctgcccacacacatacacaggcacggggctttcagggtggtcatttgttagtgagttgagcacattctggccagcacttgagcaaacagcacacaatcaagaaggtggccgtcacccagactttccacaaagttccttatttggggcatattttgtttgttaacggatcttgcatcctgactcagactgagcccctg

SEQ ID NO: 84213 - DNA, 601 bp, Human
ttctgggcatatttcactgctctcaaactttcgtggcttttggagttcaccggggaatcttgttaaaatccagattttgattcagctggtctggggtgggcctcgaggctctgcatttctgagaagctcccaggtgatgtcccagctgctccagggaccatccctgagtccccagggcctgtgctgacttaagctcctgagagcagaggcagtggctgtggctgccacctctggatctccctctgagggagctgtaccgtggcctgggctccactccatttttttaaatagctttttaagrgtggttttaggctcacagcaacatggaacagtgagtacagccaggtcccagacaccccctgcccacacacatacacaggcacggggctttcagggtggtcatttgttagtgagttgagcacattctggccagcacttgagcaaacagcacacaatcaagaaggtggccgtcacccagactttccacaaagttccttatttggggcatattttgtttgttaacggatcttgcatcctgactcagactgagcccctgggagagcgaaaggccatgcctcccacctccccacccccagcgccg

SEQ ID NO: 84214 - DNA, 601 bp, Human
cagctggtctggggtgggcctcgaggctctgcatttctgagaagctcccaggtgatgtcccagctgctccagggaccatccctgagtccccagggcctgtgctgacttaagctcctgagagcagaggcagtggctgtggctgccacctctggatctccctctgagggagctgtaccgtggcctgggctccactccatttttttaaatagctttttaagagtggttttaggctcacagcaacatggaacagtgagtacagccaggtcccagacaccccctgcccacacacatacacaggcayggggctttcagggtggtcatttgttagtgagttgagcacattctggccagcacttgagcaaacagcacacaatcaagaaggtggccgtcacccagactttccacaaagttccttatttggggcatattttgtttgttaacggatcttgcatcctgactcagactgagcccctgggagagcgaaaggccatgcctcccacctccccacccccagcgccgggtcgggggcagatcccaccccactctgccacgtgccgcatcacagttgggttttgtcagtgtgctcctttcccaaggctaa

SEQ ID NO: 84215 - DNA, 601 bp, Human
gggaccatccctgagtccccagggcctgtgctgacttaagctcctgagagcagaggcagtggctgtggctgccacctctggatctccctctgagggagctgtaccgtggcctgggctccactccatttttttaaatagctttttaagagtggttttaggctcacagcaacatggaacagtgagtacagccaggtcccagacaccccctgcccacacacatacacaggcacggggctttcagggtggtcatttgttagtgagttgagcacattctggccagcacttgagcaaacagcacacratcaagaaggtggccgtcacccagactttccacaaagttccttatttggggcatattttgtttgttaacggatcttgcatcctgactcagactgagcccctgggagagcgaaaggccatgcctcccacctccccacccccagcgccgggtcgggggcagatcccaccccactctgccacgtgccgcatcacagttgggttttgtcagtgtgctcctttcccaaggctaacactaacttgactttagcacgacattcactgcaaaggttatggatcagacggagacaaattcttgcaagag

SEQ ID NO: 84216 - DNA, 601 bp, Human
cctgagtccccagggcctgtgctgacttaagctcctgagagcagaggcagtggctgtggctgccacctctggatctccctctgagggagctgtaccgtggcctgggctccactccatttttttaaatagctttttaagagtggttttaggctcacagcaacatggaacagtgagtacagccaggtcccagacaccccctgcccacacacatacacaggcacggggctttcagggtggtcatttgttagtgagttgagcacattctggccagcacttgagcaaacagcacacaatcaagaargtggccgtcacccagactttccacaaagttccttatttggggcatattttgtttgttaacggatcttgcatcctgactcagactgagcccctgggagagcgaaaggccatgcctcccacctccccacccccagcgccgggtcgggggcagatcccaccccactctgccacgtgccgcatcacagttgggttttgtcagtgtgctcctttcccaaggctaacactaacttgactttagcacgacattcactgcaaaggttatggatcagacggagacaaattcttgcaagagcagggctgg

SEQ ID NO: 84217 - DNA, 601 bp, Human
ttagtgagttgagcacattctggccagcacttgagcaaacagcacacaatcaagaaggtggccgtcacccagactttccacaaagttccttatttggggcatattttgtttgttaacggatcttgcatcctgactcagactgagcccctgggagagcgaaaggccatgcctcccacctccccacccccagcgccgggtcgggggcagatcccaccccactctgccacgtgccgcatcacagttgggttttgtcagtgtgctcctttcccaaggctaacactaacttgactttagcacgacrttcactgcaaaggttatggatcagacggagacaaattcttgcaagagcagggctggattttcctgtctagaatcttgtatgttaaaaataacaatcttccgtccaaatgactacagcagtttattaagtgaccgaacgggcagacaagcatgcagggagggccgtcagcatccacagaacttaccgacctgactgagagcgccacgtgcaccaggctcacgtcctgagcgtgtgcccacagcccttggagtgtttacaagaatttccttggttcgatcttacatgtatttcattttaggg

SEQ ID NO: 84218 - DNA, 601 bp, Human
tcctgactcagactgagcccctgggagagcgaaaggccatgcctcccacctccccacccccagcgccgggtcgggggcagatcccaccccactctgccacgtgccgcatcacagttgggttttgtcagtgtgctcctttcccaaggctaacactaacttgactttagcacgacattcactgcaaaggttatggatcagacggagacaaattcttgcaagagcagggctggattttcctgtctagaatcttgtatgttaaaaataacaatcttccgtccaaatgactacagcagtttattamgtgaccgaacgggcagacaagcatgcagggagggccgtcagcatccacagaacttaccgacctgactgagagcgccacgtgcaccaggctcacgtcctgagcgtgtgcccacagcccttggagtgtttacaagaatttccttggttcgatcttacatgtatttcattttaggggaaacaacgcaattccagttttacaaatgtattggggtaaggagacttaagacctcagttaagcttggagaccagtgattaccggggcttgcaagatgataaaatggaagccaggtgggacgtcagt

SEQ ID NO: 84219 - DNA, 601 bp, Human
gggcagatcccaccccactctgccacgtgccgcatcacagttgggttttgtcagtgtgctcctttcccaaggctaacactaacttgactttagcacgacattcactgcaaaggttatggatcagacggagacaaattcttgcaagagcagggctggattttcctgtctagaatcttgtatgttaaaaataacaatcttccgtccaaatgactacagcagtttattaagtgaccgaacgggcagacaagcatgcagggagggccgtcagcatccacagaacttaccgacctgactgagagcrccacgtgcaccaggctcacgtcctgagcgtgtgcccacagcccttggagtgtttacaagaatttccttggttcgatcttacatgtatttcattttaggggaaacaacgcaattccagttttacaaatgtattggggtaaggagacttaagacctcagttaagcttggagaccagtgattaccggggcttgcaagatgataaaatggaagccaggtgggacgtcagtctggcaaaaccatgacccggctacagctccactgatccagcctgtctcctcgtggcccatttccatatgcaatt

SEQ ID NO: 84220 - DNA, 601 bp, Human
taaaaataacaatcttccgtccaaatgactacagcagtttattaagtgaccgaacgggcagacaagcatgcagggagggccgtcagcatccacagaacttaccgacctgactgagagcgccacgtgcaccaggctcacgtcctgagcgtgtgcccacagcccttggagtgtttacaagaatttccttggttcgatcttacatgtatttcattttaggggaaacaacgcaattccagttttacaaatgtattggggtaaggagacttaagacctcagttaagcttggagaccagtgattacyggggcttgcaagatgataaaatggaagccaggtgggacgtcagtctggcaaaaccatgacccggctacagctccactgatccagcctgtctcctcgtggcccatttccatatgcaattaaggaaatcttcattacgtacttactctgtgggaaggatatacaccctagagctcattcactgtttgaaatgtctacagcttcctacgggaaataggggcttccagaatccaggacaagcttgcctctggacaaggctgagcaggctgttaagggagcaggggtccccatcccaggccccct

SEQ ID NO: 84221 - DNA, 601 bp, Human
agggccgtcagcatccacagaacttaccgacctgactgagagcgccacgtgcaccaggctcacgtcctgagcgtgtgcccacagcccttggagtgtttacaagaatttccttggttcgatcttacatgtatttcattttaggggaaacaacgcaattccagttttacaaatgtattggggtaaggagacttaagacctcagttaagcttggagaccagtgattaccggggcttgcaagatgataaaatggaagccaggtgggacgtcagtctggcaaaaccatgacccggctacagctccmctgatccagcctgtctcctcgtggcccatttccatatgcaattaaggaaatcttcattacgtacttactctgtgggaaggatatacaccctagagctcattcactgtttgaaatgtctacagcttcctacgggaaataggggcttccagaatccaggacaagcttgcctctggacaaggctgagcaggctgttaagggagcaggggtccccatcccaggccccctgcgatggcatctctctgtgctccccgggagagcgggcgggggcagggagagacgggaatcgggtgatattaaagt

SEQ ID NO: 84222 - DNA, 601 bp, Human
cgtcagcatccacagaacttaccgacctgactgagagcgccacgtgcaccaggctcacgtcctgagcgtgtgcccacagcccttggagtgtttacaagaatttccttggttcgatcttacatgtatttcattttaggggaaacaacgcaattccagttttacaaatgtattggggtaaggagacttaagacctcagttaagcttggagaccagtgattaccggggcttgcaagatgataaaatggaagccaggtgggacgtcagtctggcaaaaccatgacccggctacagctccactgayccagcctgtctcctcgtggcccatttccatatgcaattaaggaaatcttcattacgtacttactctgtgggaaggatatacaccctagagctcattcactgtttgaaatgtctacagcttcctacgggaaataggggcttccagaatccaggacaagcttgcctctggacaaggctgagcaggctgttaagggagcaggggtccccatcccaggccccctgcgatggcatctctctgtgctccccgggagagcgggcgggggcagggagagacgggaatcgggtgatattaaagtttctc

SEQ ID NO: 84223 - DNA, 601 bp, Human
acgtcctgagcgtgtgcccacagcccttggagtgtttacaagaatttccttggttcgatcttacatgtatttcattttaggggaaacaacgcaattccagttttacaaatgtattggggtaaggagacttaagacctcagttaagcttggagaccagtgattaccggggcttgcaagatgataaaatggaagccaggtgggacgtcagtctggcaaaaccatgacccggctacagctccactgatccagcctgtctcctcgtggcccatttccatatgcaattaaggaaatcttcattacrtacttactctgtgggaaggatatacaccctagagctcattcactgtttgaaatgtctacagcttcctacgggaaataggggcttccagaatccaggacaagcttgcctctggacaaggctgagcaggctgttaagggagcaggggtccccatcccaggccccctgcgatggcatctctctgtgctccccgggagagcgggcgggggcagggagagacgggaatcgggtgatattaaagtttctctgcctttgtgcttggaaaccagcaaggcaaaatggatttgctgctgttttatattg

SEQ ID NO: 84224 - DNA, 601 bp, Human
gagtgtgccccaaaagccttctgtttggttttatcatggcagaccagtgttcttttctgaagatgctctgaattgtctgtcttattgtgtttggttgaggcctagtaattttcgataaagcccttaatccaagtacttgactgaaaattaccaggcttctctgtggaggatgagggtcaaaaatagaagtccttctatgaggaagatgcagtcagagtgagacagtcagtattagccaacaccagccacctctgaaatcaagaaacagcctggcaggttgacaaatgcgatacataatttrtagcccaagtgatatatgaagccctgtgactattttcagctggagctctgttgtattttcccttaaaataaccttcccttgacaaagttcacactttgccttgcaccaatgtaaaaaaaaaaaaaaaaaagcgttttacatcattgtgtaaactaaaaataggagtttggagcaaatttccatttttggtcaaatgtttgcatctcttttccaagtatttggggtgaaattttcacatcttctaagtttccctttggaaacacagttgttattaagagggactgcaggtcaacataatga

SEQ ID NO: 84225 - DNA, 601 bp, Human
gataaagcccttaatccaagtacttgactgaaaattaccaggcttctctgtggaggatgagggtcaaaaatagaagtccttctatgaggaagatgcagtcagagtgagacagtcagtattagccaacaccagccacctctgaaatcaagaaacagcctggcaggttgacaaatgcgatacataatttgtagcccaagtgatatatgaagccctgtgactattttcagctggagctctgttgtattttcccttaaaataaccttcccttgacaaagttcacactttgccttgcaccaatgtaaaaaaaaaaaaaaaaaagcgttttacatcattgtgtaaactaaaaataggagtttggagcaaatttccatttttggtcaaatgtttgcatctcttttccaagtatttggggtgaaattttcacatcttctaagtttccctttggaaacacagttgttattaagagggactgcaggtcaacataatgaagccctcatatgggtttcttgttggcatttctagaatttttgaaaatgtgatattagcagaacctattcagccagaatttggcctgaatattcaaagagatcatatgttcatt

SEQ ID NO: 84226 - DNA, 601 bp, Human
gactgaaaattaccaggcttctctgtggaggatgagggtcaaaaatagaagtccttctatgaggaagatgcagtcagagtgagacagtcagtattagccaacaccagccacctctgaaatcaagaaacagcctggcaggttgacaaatgcgatacataatttgtagcccaagtgatatatgaagccctgtgactattttcagctggagctctgttgtattttcccttaaaataaccttcccttgacaaagttcacactttgccttgcaccaatgtaaaaaaaaaaaaaaaaaagcgttttrcatcattgtgtaaactaaaaataggagtttggagcaaatttccatttttggtcaaatgtttgcatctcttttccaagtatttggggtgaaattttcacatcttctaagtttccctttggaaacacagttgttattaagagggactgcaggtcaacataatgaagccctcatatgggtttcttgttggcatttctagaatttttgaaaatgtgatattagcagaacctattcagccagaatttggcctgaatattcaaagagatcatatgttcattatgatttgctcctatgcagtaattg

SEQ ID NO: 84227 - DNA, 601 bp, Human
ctgaaaattaccaggcttctctgtggaggatgagggtcaaaaatagaagtccttctatgaggaagatgcagtcagagtgagacagtcagtattagccaacaccagccacctctgaaatcaagaaacagcctggcaggttgacaaatgcgatacataatttgtagcccaagtgatatatgaagccctgtgactattttcagctggagctctgttgtattttcccttaaaataaccttcccttgacaaagttcacactttgccttgcaccaatgtaaaaaaaaaaaaaaaaaagcgttttacwtcattgtgtaaactaaaaataggagtttggagcaaatttccatttttggtcaaatgtttgcatctcttttccaagtatttggggtgaaattttcacatcttctaagtttccctttggaaacacagttgttattaagagggactgcaggtcaacataatgaagccctcatatgggtttcttgttggcatttctagaatttttgaaaatgtgatattagcagaacctattcagccagaatttggcctgaatattcaaagagatcatatgttcattatgatttgctcctatgcagtaattgat

SEQ ID NO: 84228 - DNA, 601 bp, Human
tcattgtgtaaactaaaaataggagtttggagcaaatttccatttttggtcaaatgtttgcatctcttttccaagtatttggggtgaaattttcacatcttctaagtttccctttggaaacacagttgttattaagagggactgcaggtcaacataatgaagccctcatatgggtttcttgttggcatttctagaatttttgaaaatgtgatattagcagaacctattcagccagaatttggcctgaatattcaaagagatcatatgttcattatgatttgctcctatgcagtaattgatsatcaaagcatgagaaagtccattttcgagtcagtaacaacaatgctcccttagcttatgtgggatcactaacaagcttttccacccaaagcccacagtgtgcccagtgccgtcctgcgccgtgaaataccgagatggagccaggcccacctcgaggcgattctagcatcagggctctcatatgagcagataaataacaaaacccaccttccgcccatcacacaggtgggcgctgggtctccctatcccacaggtgcaggagtgatgccttcttttggagagctagagaagacttcacaga

SEQ ID NO: 84229 - DNA, 601 bp, Human
tttttggtcaaatgtttgcatctcttttccaagtatttggggtgaaattttcacatcttctaagtttccctttggaaacacagttgttattaagagggactgcaggtcaacataatgaagccctcatatgggtttcttgttggcatttctagaatttttgaaaatgtgatattagcagaacctattcagccagaatttggcctgaatattcaaagagatcatatgttcattatgatttgctcctatgcagtaattgatcatcaaagcatgagaaagtccattttcgagtcagtaacaacamtgctcccttagcttatgtgggatcactaacaagcttttccacccaaagcccacagtgtgcccagtgccgtcctgcgccgtgaaataccgagatggagccaggcccacctcgaggcgattctagcatcagggctctcatatgagcagataaataacaaaacccaccttccgcccatcacacaggtgggcgctgggtctccctatcccacaggtgcaggagtgatgccttcttttggagagctagagaagacttcacagaggtggttacatttcgtgcttcttgaagagtaaaattaagttt

SEQ ID NO: 84230 - DNA, 601 bp, Human
cagtaacaacaatgctcccttagcttatgtgggatcactaacaagcttttccacccaaagcccacagtgtgcccagtgccgtcctgcgccgtgaaataccgagatggagccaggcccacctcgaggcgattctagcatcagggctctcatatgagcagataaataacaaaacccaccttccgcccatcacacaggtgggcgctgggtctccctatcccacaggtgcaggagtgatgccttcttttggagagctagagaagacttcacagaggtggttacatttcgtgcttcttgaagagtraaattaagtttgccagatgatggctgggaggaacaggaatttcagagtgtgagaatagcgccagaaggggaagagctcctgatgacatctcgcttttccggggaagtagagccattctgggagatagcagtgcaggggactgtcttcgtcccttcatgctcctataacaaaatgccacagactgggtggtttataaaccacagattcatttctcaccattctggacctgggaattcctagatcaaggcactcacagatttggtgtctggagagggccctctgcctgctccacataagtag

SEQ ID NO: 84231 - DNA, 601 bp, Human
cactaacaagcttttccacccaaagcccacagtgtgcccagtgccgtcctgcgccgtgaaataccgagatggagccaggcccacctcgaggcgattctagcatcagggctctcatatgagcagataaataacaaaacccaccttccgcccatcacacaggtgggcgctgggtctccctatcccacaggtgcaggagtgatgccttcttttggagagctagagaagacttcacagaggtggttacatttcgtgcttcttgaagagtaaaattaagtttgccagatgatggctgggaggaacrggaatttcagagtgtgagaatagcgccagaaggggaagagctcctgatgacatctcgcttttccggggaagtagagccattctgggagatagcagtgcaggggactgtcttcgtcccttcatgctcctataacaaaatgccacagactgggtggtttataaaccacagattcatttctcaccattctggacctgggaattcctagatcaaggcactcacagatttggtgtctggagagggccctctgcctgctccacataagtagtgccttctctgagtagtcatgtcctggcaggtgtg

SEQ ID NO: 84232 - DNA, 601 bp, Human
cccacctcgaggcgattctagcatcagggctctcatatgagcagataaataacaaaacccaccttccgcccatcacacaggtgggcgctgggtctccctatcccacaggtgcaggagtgatgccttcttttggagagctagagaagacttcacagaggtggttacatttcgtgcttcttgaagagtaaaattaagtttgccagatgatggctgggaggaacaggaatttcagagtgtgagaatagcgccagaaggggaagagctcctgatgacatctcgcttttccggggaagtagagccrttctgggagatagcagtgcaggggactgtcttcgtcccttcatgctcctataacaaaatgccacagactgggtggtttataaaccacagattcatttctcaccattctggacctgggaattcctagatcaaggcactcacagatttggtgtctggagagggccctctgcctgctccacataagtagtgccttctctgagtagtcatgtcctggcaggtgtggcggcgctcttccgggcctctgttttgaggccactcatcccattcatgagggctccaccgtcatgacctaatcaccttc

SEQ ID NO: 84233 - DNA, 601 bp, Human
gggtctccctatcccacaggtgcaggagtgatgccttcttttggagagctagagaagacttcacagaggtggttacatttcgtgcttcttgaagagtaaaattaagtttgccagatgatggctgggaggaacaggaatttcagagtgtgagaatagcgccagaaggggaagagctcctgatgacatctcgcttttccggggaagtagagccattctgggagatagcagtgcaggggactgtcttcgtcccttcatgctcctataacaaaatgccacagactgggtggtttataaaccacarattcatttctcaccattctggacctgggaattcctagatcaaggcactcacagatttggtgtctggagagggccctctgcctgctccacataagtagtgccttctctgagtagtcatgtcctggcaggtgtggcggcgctcttccgggcctctgttttgaggccactcatcccattcatgagggctccaccgtcatgacctaatcaccttcgaaggcctcatctcctaatgccaacaccttgaaggtgaggatttcaacccgtgaatttgagggagacacaaatattcagagcatagcaa

SEQ ID NO: 84234 - DNA, 601 bp, Human
aatttcagagtgtgagaatagcgccagaaggggaagagctcctgatgacatctcgcttttccggggaagtagagccattctgggagatagcagtgcaggggactgtcttcgtcccttcatgctcctataacaaaatgccacagactgggtggtttataaaccacagattcatttctcaccattctggacctgggaattcctagatcaaggcactcacagatttggtgtctggagagggccctctgcctgctccacataagtagtgccttctctgagtagtcatgtcctggcaggtgtggcrgcgctcttccgggcctctgttttgaggccactcatcccattcatgagggctccaccgtcatgacctaatcaccttcgaaggcctcatctcctaatgccaacaccttgaaggtgaggatttcaacccgtgaatttgagggagacacaaatattcagagcatagcaaagacattggagctagtttgtcagtggccctgtattgtctcctgaagatttggcttacaaggacccaatggaaatttcgtgaaagtagaaaataatgatttcattttcctcttttcagggggtaattctggcaaca

SEQ ID NO: 84235 - DNA, 601 bp, Human
gtgagaatagcgccagaaggggaagagctcctgatgacatctcgcttttccggggaagtagagccattctgggagatagcagtgcaggggactgtcttcgtcccttcatgctcctataacaaaatgccacagactgggtggtttataaaccacagattcatttctcaccattctggacctgggaattcctagatcaaggcactcacagatttggtgtctggagagggccctctgcctgctccacataagtagtgccttctctgagtagtcatgtcctggcaggtgtggcggcgctcttccrggcctctgttttgaggccactcatcccattcatgagggctccaccgtcatgacctaatcaccttcgaaggcctcatctcctaatgccaacaccttgaaggtgaggatttcaacccgtgaatttgagggagacacaaatattcagagcatagcaaagacattggagctagtttgtcagtggccctgtattgtctcctgaagatttggcttacaaggacccaatggaaatttcgtgaaagtagaaaataatgatttcattttcctcttttcagggggtaattctggcaacatggtggcagca

SEQ ID NO: 84236 - DNA, 601 bp, Human
gatgacatctcgcttttccggggaagtagagccattctgggagatagcagtgcaggggactgtcttcgtcccttcatgctcctataacaaaatgccacagactgggtggtttataaaccacagattcatttctcaccattctggacctgggaattcctagatcaaggcactcacagatttggtgtctggagagggccctctgcctgctccacataagtagtgccttctctgagtagtcatgtcctggcaggtgtggcggcgctcttccgggcctctgttttgaggccactcatcccattcrtgagggctccaccgtcatgacctaatcaccttcgaaggcctcatctcctaatgccaacaccttgaaggtgaggatttcaacccgtgaatttgagggagacacaaatattcagagcatagcaaagacattggagctagtttgtcagtggccctgtattgtctcctgaagatttggcttacaaggacccaatggaaatttcgtgaaagtagaaaataatgatttcattttcctcttttcagggggtaattctggcaacatggtggcagcagacttagaggagggagggtgggagccagagac

SEQ ID NO: 84237 - DNA, 601 bp, Human
tttccggggaagtagagccattctgggagatagcagtgcaggggactgtcttcgtcccttcatgctcctataacaaaatgccacagactgggtggtttataaaccacagattcatttctcaccattctggacctgggaattcctagatcaaggcactcacagatttggtgtctggagagggccctctgcctgctccacataagtagtgccttctctgagtagtcatgtcctggcaggtgtggcggcgctcttccgggcctctgttttgaggccactcatcccattcatgagggctccaccrtcatgacctaatcaccttcgaaggcctcatctcctaatgccaacaccttgaaggtgaggatttcaacccgtgaatttgagggagacacaaatattcagagcatagcaaagacattggagctagtttgtcagtggccctgtattgtctcctgaagatttggcttacaaggacccaatggaaatttcgtgaaagtagaaaataatgatttcattttcctcttttcagggggtaattctggcaacatggtggcagcagacttagaggagggagggtgggagccagagacgagacgaggggtgg

SEQ ID NO: 84238 - DNA, 601 bp, Human
gctccaccgtcatgacctaatcaccttcgaaggcctcatctcctaatgccaacaccttgaaggtgaggatttcaacccgtgaatttgagggagacacaaatattcagagcatagcaaagacattggagctagtttgtcagtggccctgtattgtctcctgaagatttggcttacaaggacccaatggaaatttcgtgaaagtagaaaataatgatttcattttcctcttttcagggggtaattctggcaacatggtggcagcagacttagaggagggagggtgggagccagagacgagackaggggtggggcattgggccaggcctgagccccataaagccagtggcagatggaagtgatgtcatgagacttcaagttagcagattccacagtgtcaaagacccttgaacagggttaaagccagaaaagcaagtgccaggggtggctggggcacccactggcctagaagccaagagttcttgccgggaggaagatgtaggaagggaatgcttcacttgctgcagagagcagatggaggtcctttcatcctttcagcattgagcaaggcagcgagggtgcacactgagcagtcctgtgcagg

SEQ ID NO: 84239 - DNA, 601 bp, Human
atgtgagccggggctctggcagaggacatacgaaagacttagagcagcagactgagatattccaggaatgggaggcaactttaaaccttcagcaggatgggggagacagacagatggggactctgggaagggaccaggtagcagagcagggaccgtaggcaggatgtcttgggccacctcctaccctccctggacactggtcccagctctgaaacctttgtcttctttgggcttacttttattttgttattcaaagtattaaaatgcagctctgattgtagaataacttttactctcatcaaaaaaaaaaaaaagcagatggtttctttacgtcgtggctatgacaagagtactttgggagcatttaagtaaaacagtgttcttaagtttattgggtggctctgaagtgagtgaggacttcagtggggtcatcctggaaaggaaaggcaaaggccagtgagcgggtgggggctcagtgccatgggtgacccaggtctggggcttggcagtctgcctcccctgtgggaacctgcagttcaaggccagcctggactcttttcaaatccatcctggcaggaggtggggaagcagcttggaagtg

SEQ ID NO: 84240 - DNA, 601 bp, Human
caggagcaaggactttcaaaaaggccacgctgggtcaagcccaccgcttatctgctgtgtgtccttggcaagctacttaccagtctgatccctagattccttatctgcaaaatgggtataatgcagatgcccacctgacaaggtgattggaggccttaaaccggagagcacaggtggctggacatagagtaagctgggaaaagccaaaatcacctttgcaaaaaaaattaacagtgaggaaatgatggcagtaaaagagatctgatctaaatcctcacccacctcccacccccagtcatgsctctcctgtaatcattcctgggctttggctaagccaactttgggagacctctagtttaaggtttaaatgataataggccttccctaaaactcagctgccttgataaagctaatgaaaggccatcaggctaggaagaggggagaaacctgaattctgctaaggtgtagactgctcacaaaatatacaacttcactatcgtagatgagccttttgagatcttttcaggttttttgcatgtctgacacctggctctacccagaccaccagccccactcctatggcccacctagaagcaactca

SEQ ID NO: 84241 - DNA, 601 bp, Human
gtttaaatgataataggccttccctaaaactcagctgccttgataaagctaatgaaaggccatcaggctaggaagaggggagaaacctgaattctgctaaggtgtagactgctcacaaaatatacaacttcactatcgtagatgagccttttgagatcttttcaggttttttgcatgtctgacacctggctctacccagaccaccagccccactcctatggcccacctagaagcaactcagctcaagaggacagctctgaccccctgtgatttcatcagcagcaagcatccattacctggycgccaccaccccttctcccaaactgcctttgaaaagcccctcccctaggaacctttggggagattgatttgagtaatgacaccgtctcccacgtggcggtgttactggccgcaaatctgtatagctctgcagcaacctcagttctcaccttgtcagaagaaggaattcgattgaggggcataacgcagaagaagagaccgaggcaagtttcagagcaggagtgaaagtttattaaaaagttttagagcaggaatgaaaagaaagtacacttggaagagggccaagcagacatcttggagg

SEQ ID NO: 84242 - DNA, 601 bp, Human
caggcgggtgggggctcagtgccaagggtagtctagattcgcggcctagaaagcctggcctgttgggtggttccaaagctgcgtggttcccctcaggactggcgctaccgtcttgtgggaatgatggaagttgaatgcagcatataggaagctttcctgattgtaactcagcatcctgcagttctgttcactaaaccttgttaagcaggccctggattaaggtccagaggttttacaggttgataaagctgagcccctgtcctcaagggcttatattctctgaggaggaatgacaaagggkcatgctagtttcagtaccttaccaaaagttttgaggcagcaggatcctgggtctttgtgggagcacagaggaggagagtgggcggcagctaggaaggcttcctggaagaggtggttcctcttacttttccatggttttctccagtaatccgctttgtttttcccaagaaaaataagggaaattcaggccaactatctatcaaaaaattattccacatgtgtcaaaagcttatcaacattttaatcacttatttggaaagttacttaccttacaaagttcccccttttcaaaatgataaca

SEQ ID NO: 84243 - DNA, 601 bp, Human; identical to SEQ ID NO: 21922

SEQ ID NO: 84244 - DNA, 601 bp, Human; identical to SEQ ID NO: 21923

SEQ ID NO: 84245 - DNA, 601 bp, Human; identical to SEQ ID NO: 21924

SEQ ID NO: 84246 - DNA, 601 bp, Human; identical to SEQ ID NO: 21925

SEQ ID NO: 84247 - DNA, 601 bp, Human; identical to SEQ ID NO: 21926

SEQ ID NO: 84248 - DNA, 601 bp, Human; identical to SEQ ID NO: 21927

SEQ ID NO: 84249 - DNA, 601 bp, Human; identical to SEQ ID NO: 21928

SEQ ID NO: 84250 - DNA, 601 bp, Human; identical to SEQ ID NO: 21929

SEQ ID NO: 84251 - DNA, 601 bp, Human; identical to SEQ ID NO: 21930

SEQ ID NO: 84252 - DNA, 601 bp, Human; identical to SEQ ID NO: 21931

SEQ ID NO: 84253 - DNA, 601 bp, Human; identical to SEQ ID NO: 21932

SEQ ID NO: 84254 - DNA, 601 bp, Human; identical to SEQ ID NO: 21933

SEQ ID NO: 84255 - DNA, 601 bp, Human; identical to SEQ ID NO: 21934

SEQ ID NO: 84256 - DNA, 601 bp, Human; identical to SEQ ID NO: 21935

SEQ ID NO: 84257 - DNA, 601 bp, Human; identical to SEQ ID NO: 21936

SEQ ID NO: 84258 - DNA, 601 bp, Human; identical to SEQ ID NO: 21937

SEQ ID NO: 84259 - DNA, 601 bp, Human; identical to SEQ ID NO: 21938

SEQ ID NO: 84260 - DNA, 601 bp, Human; identical to SEQ ID NO: 21939

SEQ ID NO: 84261 - DNA, 601 bp, Human; identical to SEQ ID NO: 21940

SEQ ID NO: 84262 - DNA, 601 bp, Human; identical to SEQ ID NO: 21941

SEQ ID NO: 84263 - DNA, 601 bp, Human; identical to SEQ ID NO: 21942

SEQ ID NO: 84264 - DNA, 601 bp, Human; identical to SEQ ID NO: 21943

SEQ ID NO: 84265 - DNA, 601 bp, Human; identical to SEQ ID NO: 21944

SEQ ID NO: 84266 - DNA, 601 bp, Human; identical to SEQ ID NO: 21945

SEQ ID NO: 84267 - DNA, 601 bp, Human; identical to SEQ ID NO: 21946

SEQ ID NO: 84268 - DNA, 601 bp, Human; identical to SEQ ID NO: 21947

SEQ ID NO: 84269 - DNA, 601 bp, Human; identical to SEQ ID NO: 21948

SEQ ID NO: 84270 - DNA, 601 bp, Human; identical to SEQ ID NO: 21949

SEQ ID NO: 84271 - DNA, 601 bp, Human; identical to SEQ ID NO: 21950

SEQ ID NO: 84272 - DNA, 601 bp, Human; identical to SEQ ID NO: 21951

SEQ ID NO: 84273 - DNA, 601 bp, Human; identical to SEQ ID NO: 21952

SEQ ID NO: 84274 - DNA, 601 bp, Human; identical to SEQ ID NO: 21953

SEQ ID NO: 84275 - DNA, 601 bp, Human; identical to SEQ ID NO: 21954

SEQ ID NO: 84276 - DNA, 601 bp, Human; identical to SEQ ID NO: 21955

SEQ ID NO: 84277 - DNA, 601 bp, Human; identical to SEQ ID NO: 21956

SEQ ID NO: 84278 - DNA, 601 bp, Human; identical to SEQ ID NO: 21957

SEQ ID NO: 84279 - DNA, 601 bp, Human; identical to SEQ ID NO: 21958

SEQ ID NO: 84280 - DNA, 601 bp, Human; identical to SEQ ID NO: 21959

SEQ ID NO: 84281 - DNA, 601 bp, Human; identical to SEQ ID NO: 21960

SEQ ID NO: 84282 - DNA, 601 bp, Human; identical to SEQ ID NO: 21961

SEQ ID NO: 84283 - DNA, 601 bp, Human; identical to SEQ ID NO: 21962

SEQ ID NO: 84284 - DNA, 601 bp, Human; identical to SEQ ID NO: 21963

SEQ ID NO: 84285 - DNA, 601 bp, Human; identical to SEQ ID NO: 21964

SEQ ID NO: 84286 - DNA, 601 bp, Human; identical to SEQ ID NO: 21965

SEQ ID NO: 84287 - DNA, 601 bp, Human; identical to SEQ ID NO: 21966

SEQ ID NO: 84288 - DNA, 601 bp, Human; identical to SEQ ID NO: 21967

SEQ ID NO: 84289 - DNA, 601 bp, Human; identical to SEQ ID NO: 21968

SEQ ID NO: 84290 - DNA, 601 bp, Human; identical to SEQ ID NO: 21969

SEQ ID NO: 84291 - DNA, 601 bp, Human; identical to SEQ ID NO: 21970

SEQ ID NO: 84292 - DNA, 601 bp, Human; identical to SEQ ID NO: 21971

SEQ ID NO: 84293 - DNA, 601 bp, Human; identical to SEQ ID NO: 21972

SEQ ID NO: 84294 - DNA, 601 bp, Human; identical to SEQ ID NO: 21973

SEQ ID NO: 84295 - DNA, 601 bp, Human; identical to SEQ ID NO: 21974

SEQ ID NO: 84296 - DNA, 601 bp, Human; identical to SEQ ID NO: 21975

SEQ ID NO: 84297 - DNA, 601 bp, Human; identical to SEQ ID NO: 21976

SEQ ID NO: 84298 - DNA, 601 bp, Human; identical to SEQ ID NO: 21977

SEQ ID NO: 84299 - DNA, 601 bp, Human; identical to SEQ ID NO: 21978

SEQ ID NO: 84300 - DNA, 601 bp, Human; identical to SEQ ID NO: 21979

SEQ ID NO: 84301 - DNA, 601 bp, Human; identical to SEQ ID NO: 21980

SEQ ID NO: 84302 - DNA, 601 bp, Human; identical to SEQ ID NO: 21981

SEQ ID NO: 84303 - DNA, 601 bp, Human; identical to SEQ ID NO: 21982

SEQ ID NO: 84304 - DNA, 601 bp, Human; identical to SEQ ID NO: 21983

SEQ ID NO: 84305 - DNA, 601 bp, Human; identical to SEQ ID NO: 21984

SEQ ID NO: 84306 - DNA, 601 bp, Human; identical to SEQ ID NO: 21985

SEQ ID NO: 84307 - DNA, 601 bp, Human; identical to SEQ ID NO: 21986

SEQ ID NO: 84308 - DNA, 601 bp, Human; identical to SEQ ID NO: 21987

SEQ ID NO: 84309 - DNA, 601 bp, Human; identical to SEQ ID NO: 21988

SEQ ID NO: 84310 - DNA, 601 bp, Human; identical to SEQ ID NO: 21989

SEQ ID NO: 84311 - DNA, 601 bp, Human; identical to SEQ ID NO: 21990

SEQ ID NO: 84312 - DNA, 601 bp, Human; identical to SEQ ID NO: 21991

SEQ ID NO: 84313 - DNA, 601 bp, Human; identical to SEQ ID NO: 21992

SEQ ID NO: 84314 - DNA, 601 bp, Human; identical to SEQ ID NO: 21993

SEQ ID NO: 84315 - DNA, 601 bp, Human; identical to SEQ ID NO: 21994

SEQ ID NO: 84316 - DNA, 601 bp, Human; identical to SEQ ID NO: 21995

SEQ ID NO: 84317 - DNA, 601 bp, Human; identical to SEQ ID NO: 21996

SEQ ID NO: 84318 - DNA, 601 bp, Human; identical to SEQ ID NO: 21997

SEQ ID NO: 84319 - DNA, 601 bp, Human; identical to SEQ ID NO: 21998

SEQ ID NO: 84320 - DNA, 601 bp, Human; identical to SEQ ID NO: 21999

SEQ ID NO: 84321 - DNA, 601 bp, Human; identical to SEQ ID NO: 22000

SEQ ID NO: 84322 - DNA, 601 bp, Human; identical to SEQ ID NO: 22001

SEQ ID NO: 84323 - DNA, 601 bp, Human; identical to SEQ ID NO: 22002

SEQ ID NO: 84324 - DNA, 601 bp, Human; identical to SEQ ID NO: 22003

SEQ ID NO: 84325 - DNA, 601 bp, Human; identical to SEQ ID NO: 22004

SEQ ID NO: 84326 - DNA, 601 bp, Human; identical to SEQ ID NO: 22005

SEQ ID NO: 84327 - DNA, 601 bp, Human; identical to SEQ ID NO: 22006

SEQ ID NO: 84328 - DNA, 601 bp, Human; identical to SEQ ID NO: 22007

SEQ ID NO: 84329 - DNA, 601 bp, Human; identical to SEQ ID NO: 22008

SEQ ID NO: 84330 - DNA, 601 bp, Human; identical to SEQ ID NO: 22009

SEQ ID NO: 84331 - DNA, 601 bp, Human; identical to SEQ ID NO: 22010

SEQ ID NO: 84332 - DNA, 601 bp, Human; identical to SEQ ID NO: 22011

SEQ ID NO: 84333 - DNA, 601 bp, Human; identical to SEQ ID NO: 22012

SEQ ID NO: 84334 - DNA, 601 bp, Human; identical to SEQ ID NO: 22013

SEQ ID NO: 84335 - DNA, 601 bp, Human; identical to SEQ ID NO: 22014

SEQ ID NO: 84336 - DNA, 601 bp, Human; identical to SEQ ID NO: 22015

SEQ ID NO: 84337 - DNA, 601 bp, Human; identical to SEQ ID NO: 22016

SEQ ID NO: 84338 - DNA, 601 bp, Human; identical to SEQ ID NO: 22017

SEQ ID NO: 84339 - DNA, 601 bp, Human; identical to SEQ ID NO: 22018

SEQ ID NO: 84340 - DNA, 601 bp, Human; identical to SEQ ID NO: 22019

SEQ ID NO: 84341 - DNA, 601 bp, Human; identical to SEQ ID NO: 22020

SEQ ID NO: 84342 - DNA, 601 bp, Human; identical to SEQ ID NO: 22021

SEQ ID NO: 84343 - DNA, 601 bp, Human; identical to SEQ ID NO: 22022

SEQ ID NO: 84344 - DNA, 601 bp, Human; identical to SEQ ID NO: 22023

SEQ ID NO: 84345 - DNA, 601 bp, Human; identical to SEQ ID NO: 22024

SEQ ID NO: 84346 - DNA, 601 bp, Human; identical to SEQ ID NO: 22025

SEQ ID NO: 84347 - DNA, 601 bp, Human; identical to SEQ ID NO: 22026

SEQ ID NO: 84348 - DNA, 601 bp, Human
cccgagaagtgctcagacggtcctgaaggtgaaaccgggatgaaatcccccttgtggcctttcagtggcaggatgaagatccgaaatctgcaagagggactgttactgcccctctggatctggggacagtgcccccagttggggaattgtggtccctaaataggagggtttgggggccccgggcccccgcgaaggatccacgattaatgctgagctgggacatcagggtgaactagggttgggcagatagggcacaggtgtgttctagcagaggggcttcttagctctgtggcagtggctycaaagcacacccttggggaacggactcatccaccccatatcttgactctgatacagagaggctagtggtaatcagtttcgtcatagttctgccttgttggcagaactgctgcaggagttggtgtttgctccccgggtagatgaaaaaagcgcgcctccccctcccccaccccactctgctgacagcactgtagcacagaaatcaacccagggagactcctccagcccagggcctgattctggcctgtctgactgttgacaggcaaagggtcaccctgatgctgtcttgttcctcatttct

SEQ ID NO: 84349 - DNA, 601 bp, Human
agtggtaatcagtttcgtcatagttctgccttgttggcagaactgctgcaggagttggtgtttgctccccgggtagatgaaaaaagcgcgcctccccctcccccaccccactctgctgacagcactgtagcacagaaatcaacccagggagactcctccagcccagggcctgattctggcctgtctgactgttgacaggcaaagggtcaccctgatgctgtcttgttcctcatttctactttgcagtgcgactacagggtgctaccgttttctttaggagcgagaatagatattttaacaygtggctttttcgttttgaatttggtcccaggatgctctctactaccacaactaaactgaactgatcatgtgtgtgttctcctcctgccacctctctctccttccatcttgtgtgacatctttcccatttttcagggactaggttcacgtgtttcttttgaaactgttcatcctgagttaccccggtagatgtgctgtatcactgtctgtgtgttttgcctggcatggaaggtgtgagggtactttccatatgcccccagggtagggactgcctcagtcccttctgtatgccctactgcat

SEQ ID NO: 84350 - DNA, 601 bp, Human
aaccttgacgtgactagaattgtgatggcagagaaggcgctacagcacatgagaccatcaggagaaaaggcccagagggtgaaagcatttagggaaagacatagaacatgttaggagggaggctaaacagggcaagagggagaatggggctgggaggcagagccttgccagcagcttgaacttccttcttggggttaggggagagaggagaacattgaggcttctgaggaagctggatgaaacacccaacctgtgtcttaggcaggccctagaggagttaggaatttctagtcttggtgaratgctcagggagacagggagatcacaggtgatggaggtgagaaatagagaggcactaaagacagggtagaggtagaattaatgggacttggccatgtaggcaggtgactgtagatttgggccactctgaatgtatttatttacttatatattttctttatttattttgagacagagtctcgctctgttacccaggccaggctggagtgcagtggcatggtctcagctcactgcaacctccacctcccgggttcaagtgattctcctacctcagcctcccgagtagctgggattacaggca

SEQ ID NO: 84351 - DNA, 601 bp, Human
ttctattagacacctccctgggggagcatatgctcctggaaaacagactttgtctttgctcatgcccttttcccagggccaggaatggtacttggtacacaccatagtagtcactcagtaaatgttgaaggagtgctgagtgctggaagttggtgatggaaagtggctgatggatgggcagctaacagtgtctgttgtccttggctggtagagttgatgtactgcaaataaacttcttgttcatcctggctggctctttctagtggaatctgctggcaattccaatgatgaggggaaacaytctgcccaagccttacccaaggagttcatttacatgattctgtcttctagagccttccattttaggaaaggaagtggatgaaacagatagcaaatggttttaaaacactcctggcaaaaagaaaacccatttagattaacatttgttgctcctaaaagcattgtctgcctcgatgcattaacaaacctagggtaggccaattccctgggaggctaccctggcaaaagccactgtggtgaagaccagacagaagggacagcaggccttatttgaggtccagggatagacctacgttggagc

SEQ ID NO: 84352 - DNA, 601 bp, Human
tagcaaatggttttaaaacactcctggcaaaaagaaaacccatttagattaacatttgttgctcctaaaagcattgtctgcctcgatgcattaacaaacctagggtaggccaattccctgggaggctaccctggcaaaagccactgtggtgaagaccagacagaagggacagcaggccttatttgaggtccagggatagacctacgttggagcagactccaggtctgctgcatcctctaacagaaggtctcacatggaaaaaacagttgataaattcactgctgttttaagagctgaaaatgtgtgtgtgtgtgtgtgtgtgtgtgtgtgtgtgtgtgtgtatgcatgtgtgtgagtcagtgtgtgtatgttttcagctcttaaaacagcagtgaaccaagcagcatgccaggctcttgaggagcagcctgttatgcatcctggccagtgagactgggatgggatctgctgggggtttcctgtgtaagtggaaaagaggagatgtgggaggggagcttcctggtgagacacatagcggaatcacaaacaagatcctgtgaattggagaaacagcagacttagagatgaggaatgctgaggc

SEQ ID NO: 84353 - DNA, 601 bp, Human
catttagattaacatttgttgctcctaaaagcattgtctgcctcgatgcattaacaaacctagggtaggccaattccctgggaggctaccctggcaaaagccactgtggtgaagaccagacagaagggacagcaggccttatttgaggtccagggatagacctacgttggagcagactccaggtctgctgcatcctctaacagaaggtctcacatggaaaaaacagttgataaattcactgctgttttaagagctgaaaatgtgtgtgtgtgtgtgtgtgtgtgtgtgtgtgtgtgtgtggatgcatgtgtgtgagtcagtgtgtgtatgttttcagctcttaaaacagcagtgaaccaagcagcatgccaggctcttgaggagcagcctgttatgcatcctggccagtgagactgggatgggatctgctgggggtttcctgtgtaagtggaaaagaggagatgtgggaggggagcttcctggtgagacacatagcggaatcacaaacaagatcctgtgaattggagaaacagcagacttagagatgaggaatgctgaggcagaggcgggggatagacgggtttaagtgggacgctttggc

SEQ ID NO: 84354 - DNA, 601 bp, Human
ctgctgtgcatttttcacttaaatagtattgtaggtttgttgtcttcttaattgtggttattgttgagctagcagatttttcccactatggaaatgtagcttttaattttctaatggaagtaggtggaagggactagatttataggagtacattttgcagataactttttgttgttaaatttaagggatgtaagtgcagttttgttacatggatatattgcttagtgatgaagtctgggcttttagtgcaaccatcacctgaataatatacattgtacccttgcagataacttttttttttaaagacaaggtcttactttgtcgctcagaatggagtacagtggcatgaccatagttcactgcagccttgagctcctgggctcaagcaatcctcctgtgcagatactttttagggaatacctctgttttgcaaaatgaggggggaaagaagtattaagaaacagaaatgcctttcgtcaaaacttttttgttttttggggttttgtttgtttgtttgttttttgttttggtttggtttttttttttttttttttgagacagttttttttgttgcccaggctgcagtgcagtggcgtgatca

SEQ ID NO: 84355 - DNA, 601 bp, Human
ccgaattgtatgaaatactgagaaggtacttctggacttagtccagtttctcccaatgttaacattttgcaaaactatagttgacattgacatatgctacctattttttaaaatttatttccccagttttgtttgtacttatttgtgcgtgtgtatgtttagttctatacaattttgtcacctgtgcaggttcatgtatctaccactgcagtcgagatgctgaacagttccaacaatttttatatattttttatttttatttttttgagacagagtctcgctctgttgcccaggctggaatgtggtggcgcgatctcggctcactgcaagctccgcctcccaggttcatgccattctcctgcctcagcctcccaagtagctgggactacaggcgcctgccaccaccatgcctggcaattttttttttttgtatttttaatagagacggggtttcaccgtgttagtcaggatggtctcaatctcctgacctcatgatccacccgcctcagcctcccaaagtgttgggattacaggtgtgagccaccgcaccccgccaacaatttttataattacacccacctccctcctacactcctccatt

SEQ ID NO: 84356 - DNA, 601 bp, Human
cgaattgtatgaaatactgagaaggtacttctggacttagtccagtttctcccaatgttaacattttgcaaaactatagttgacattgacatatgctacctattttttaaaatttatttccccagttttgtttgtacttatttgtgcgtgtgtatgtttagttctatacaattttgtcacctgtgcaggttcatgtatctaccactgcagtcgagatgctgaacagttccaacaatttttatatattttttatttttatttttttgagacagagtctcgctctgttgcccaggctggaatstggtggcgcgatctcggctcactgcaagctccgcctcccaggttcatgccattctcctgcctcagcctcccaagtagctgggactacaggcgcctgccaccaccatgcctggcaattttttttttttgtatttttaatagagacggggtttcaccgtgttagtcaggatggtctcaatctcctgacctcatgatccacccgcctcagcctcccaaagtgttgggattacaggtgtgagccaccgcaccccgccaacaatttttataattacacccacctccctcctacactcctccattt

SEQ ID NO: 84357 - DNA, 601 bp, Human
gaattgtatgaaatactgagaaggtacttctggacttagtccagtttctcccaatgttaacattttgcaaaactatagttgacattgacatatgctacctattttttaaaatttatttccccagttttgtttgtacttatttgtgcgtgtgtatgtttagttctatacaattttgtcacctgtgcaggttcatgtatctaccactgcagtcgagatgctgaacagttccaacaatttttatatattttttatttttatttttttgagacagagtctcgctctgttgcccaggctggaatgwggtggcgcgatctcggctcactgcaagctccgcctcccaggttcatgccattctcctgcctcagcctcccaagtagctgggactacaggcgcctgccaccaccatgcctggcaattttttttttttgtatttttaatagagacggggtttcaccgtgttagtcaggatggtctcaatctcctgacctcatgatccacccgcctcagcctcccaaagtgttgggattacaggtgtgagccaccgcaccccgccaacaatttttataattacacccacctccctcctacactcctccatttt

SEQ ID NO: 84358 - DNA, 601 bp, Human
tacccctgtaatcccagcactttgggaggctgaggtggtcggatcatgaggtcaggagatcgagaccatcctggctaacatggtgaaaccctgtttctactaaaaatacaaaaattagctgggcgtggtagcaggcacctgtagtcccagctattcaggaggctgaggcaggagaatggcgtgaacctgggagacggagcttgcagtgagtggagatcacgccactgcactctagcctgggcgacagagcgaaactctgtctataaataaataaataaataaataaataaataaataaatagtttcattcccactaatggaatgtgagtgactgctttccttgggatggaaaggcctagtgctgtaaggaggcggggagccagcactgcgctggtatctgtgtaggtcccctaccatatttcatctaatctgcatagcactaggaaaggaaacctggtgccaatgaaccaggcacgccttctcaaaataataaaaataaaataaaataaaatctcaaggctttgtagctgggtaagtggcagggctaaagattcagcccatgatgtttaatgccaaaacccaaacttgttgccagcctcca

SEQ ID NO: 84359 - DNA, 601 bp, Human
ttctcattgcttagcctaatgcctggcacatagtagaaatctgcaaacagagactgagtgagaaaacatgcagttgatgctgtgagtgggcatgatctaaagcgcatgggctgtaattggttacttgtgcagctgagccctcagcacagcctggctcagcctgtacgtgctcttgggtagtcaggggaactgtgacttgcaggtaagggtttctggtgtgcttcttgaggggactgatgtaatacaatgtctcacagacttatggaactgaaaagcactccaaggggaggggaatgttccrccctgattgcccgtcaagaccaaagctgtcagctagaacattttttgttaaaatgacaaatgcccagctcaagctggcttaagcagaaaagcaaatgaattggcattttggtttatctcttatatgacaaacccctaaatttgctggcttaaaccaataacagttttattatttgctcataattctgcagcttgtcaggacttagcaggttcagctcatcttggctctatggaatctgctgggatggctcgaatagcttggggatagaacacctcaccaggcctgtgtctgtgaccttga

SEQ ID NO: 84360 - DNA, 601 bp, Human
aagggatactcaacctatactacatagtgaccagtaagaaggaaagtgtattttatctcaagttcatgcttgatttgactacatggctgcggctctccacagctgggtgctgcctgggtcccatgctgggcagtgccttttgggcaccagcatttaattttcacacttgcatgggagccctggcaggacttcacagttctcagacagccactgcctgcccacacactcctgatcccagtacttgctgagtgattctagggctggtgactctggtactgtgtccacattgcctcctcttggrtgacagagacagaacatgttcaattaagagactcttggcaacagcccatctatatcagcaattgttgatgctcagatcattgtcatgtatctcctttgtcaatgaacaaatattactgcgctactgtacactgggtactgtgctagaggctgaagatgtgatgaactcaacagcaactgacatgccacttgtagctcttaaacctttgtcctagaagcagggagctggacaaatgcccaccaggcgtgagtgccttctatggtctgctgggtttcaagctcctacagtgcttttgccggt

SEQ ID NO: 84361 - DNA, 601 bp, Human
cagctagcttcatgggatcctagtgcaagcctaggcccatactgggctctttggggcttctaagaactaatagccacagtcctttctcctggaggaattgaacagctaatttaacatagagtacaaactgtgaaggaggttcagccagaggagatgctgagatggcagacggtatgggaacttcacagcacaaacaaaagagggctgtttggaagcagaagtatgacaagcgaagcaatgctccttggttgcagccagcgctggtcctgctcagctgtcagccagaaaagacaaatagcastccttctgtctaggctgccagtcaagtgcagatccatgcaatagggagatgtctggagttacagctgtgtgcccttttcactaagtacctgagactcagaacttcaatcatgaacagctcatagccattacaaacacacatccctacaagatggcagacaaatgcccaggcatcctatgggctcagccattctcagtgatggaatgctttctcccactgttggactttcagttgtctgatgtttggagaatcttctagcagtttagactttaactgaatctgttgagtttgatacacttc

SEQ ID NO: 84362 - DNA, 601 bp, Human
gccaaactctacataaagcaaatgggcatgactactggattttcatcaccttatttttttttcttcccagcatgtgtgaactgtgtgcggtggtcaaacagtgggatgtatttagcttctgggggagatgacaaactgattatggtgtggaagcgggctacgtaagcatcattttcctttcttcacattttatttttagaagctgctttgctggtctttatcaaagtcacctttccctaccctgtcactgaagttcccatagccctgacctcataagtagtggaaagtgcatgtaggtcakgagcaggtggagcctgaccaggaattcaggagacctggtcagctgccccctcacaggactgcaggctctcacctgaaaaggaaagtctgatctcttctagtgccgatgtgggtggggcttcgttgcttttgttttttcaagtgaaatttcacatggaagcccaatatacaaaatggttaaaagtcagggtgctctggttcttgcccaggatctggggcaggggatccagagtccagcctctttgccattactttattctctgttggtccccacctggggcagcctctgctctactctcaa

SEQ ID NO: 84363 - DNA, 601 bp, Human
gcctgaccaggaattcaggagacctggtcagctgccccctcacaggactgcaggctctcacctgaaaaggaaagtctgatctcttctagtgccgatgtgggtggggcttcgttgcttttgttttttcaagtgaaatttcacatggaagcccaatatacaaaatggttaaaagtcagggtgctctggttcttgcccaggatctggggcaggggatccagagtccagcctctttgccattactttattctctgttggtccccacctggggcagcctctgctctactctcaaaaggagctaacyatcacctggaaaactattgctcccaggtctctgggccagtcagtctggggcaccagaccctgcaccattgctcaccaagagtggccctgtggctgtggcttcaagagcagaggcagaggctgtctcttcagcctacttggctatctcagcacactctttctgtggatttgtgatgagctctacaagagcaaaaggtgttatcagaggctctgatcatcggtgtgtcagcactgcctccaccaggccccaggtgattgatgctcctctggctcctgtggtgggggctagtacctatagatc

SEQ ID NO: 84364 - DNA, 601 bp, Human
ggactgcagtgttacgatctcagctcactgcaacctccacctcccgggttccagctattctcctgcctcagcctcctgagtagctgggactacaggcacgtgccaccacacccggccaatttttttttgtatttttagtagagacagggtttcactgtgttagccaggatggtcttgatctcctgacctcgtgatctgcctgtcctggcctcccgaagtgctgggattacaggcatgagtcaccatgaccggccagaaaatagtaatttattatgattaaatgtgacttgtaagtgtagtrcaagggaatctattaatataactttacatactaggaagttagatgggaaaagctacagtcatcttaggtgttttaaaaggaacattagacaattcaacatcagttcctattaaaaatgctttttttaaaatgcccataggaagatatttctttttctttttctttttttttttttttttgagactgtgtctcactatgtcacccaggcaaaatgcagtggtgcaattacggctcactgcagccttgaactcctgggctcaggtgatcctcttgcctcagcctcctgagtagctaggacta

SEQ ID NO: 84365 - DNA, 601 bp, Human
atttcctggtgcattgaatatgggatgtgagataagcagaggagtcaggatggcttcccggactatggtccaaacagtggaaaggatgcagtggctgtaacctgaagcaggaagtctgcaggtgggacagaaatgtttgttaagggaagtgttttcagagtttggttttggatatgttaagtttgccagtgtaaatggacatactgtgtagacatttggaaatatgaatcttggaaatatgaggttctgggtatgagcagagtccaaggatgagcctagggattggagagctgaaaccagmaaaagaagctagaaggagaggccagttaagacagtgaaaagaagcgaggcatgaggatcacttgaggccagtagctcaacagcctgggcatcatagcgagaccctgtctcagcaacaacaacaaaacggacagtgaagagagtatttgaaggagaggggaacaggcagcgtattgcttattgctgaggggcaaagtgaagaccaaggatagactgctgggcttgacagcatggagggtgctgggggcctaggcaagtgcaatattcatgtggtgtcattgggccaaaggtgtcattggag

SEQ ID NO: 84366 - DNA, 601 bp, Human
agtctgcaggtgggacagaaatgtttgttaagggaagtgttttcagagtttggttttggatatgttaagtttgccagtgtaaatggacatactgtgtagacatttggaaatatgaatcttggaaatatgaggttctgggtatgagcagagtccaaggatgagcctagggattggagagctgaaaccagaaaaagaagctagaaggagaggccagttaagacagtgaaaagaagcgaggcatgaggatcacttgaggccagtagctcaacagcctgggcatcatagcgagaccctgtctcakcaacaacaacaaaacggacagtgaagagagtatttgaaggagaggggaacaggcagcgtattgcttattgctgaggggcaaagtgaagaccaaggatagactgctgggcttgacagcatggagggtgctgggggcctaggcaagtgcaatattcatgtggtgtcattgggccaaaggtgtcattggagagtactcaaaaaacactaggagaggagctgagctttgtcaggcgtgtaggaagatggaggagaagaaaagggggagtggtggtgggctctcagctggaggagagaggtaagg

SEQ ID NO: 84367 - DNA, 601 bp, Human
gttaagggaagtgttttcagagtttggttttggatatgttaagtttgccagtgtaaatggacatactgtgtagacatttggaaatatgaatcttggaaatatgaggttctgggtatgagcagagtccaaggatgagcctagggattggagagctgaaaccagaaaaagaagctagaaggagaggccagttaagacagtgaaaagaagcgaggcatgaggatcacttgaggccagtagctcaacagcctgggcatcatagcgagaccctgtctcagcaacaacaacaaaacggacagtgaakagagtatttgaaggagaggggaacaggcagcgtattgcttattgctgaggggcaaagtgaagaccaaggatagactgctgggcttgacagcatggagggtgctgggggcctaggcaagtgcaatattcatgtggtgtcattgggccaaaggtgtcattggagagtactcaaaaaacactaggagaggagctgagctttgtcaggcgtgtaggaagatggaggagaagaaaagggggagtggtggtgggctctcagctggaggagagaggtaaggaccaggtggttggcaagtggtgaggg

SEQ ID NO: 84368 - DNA, 601 bp, Human
cgtgaaagtgctgttggagctgagggtgagctaggagcacggggctgatggttggcctgtgggaaggttggaattgagacagattgcagtgatttgtcatggaaggcctctggacatgaccgtggggtgaaagtagtggaagccacggtcatcagaagggaaggaggaatttaaggaaccaagagcctggagtgttagaagaatcatcctcttggagtcaccaagaatgatggtgagaacagtggccagaaatgtaaatctacaagtgaggggagggtctcctgtgtgtgtagatgcaccrtaaaaaggaggtgctatatagtctgaagacagaaactccaaactgggagtttaggagaaaattatgtcatgtatgtggatttactcagcagtgattctaaaggattgtatctggaaggataagaatgttacggatgaaaacattcaaagttccagtgatagaaacatcatgggtttgagggtaaactcgtaacactgaaagaggctacagtatacctaagaagttggtgtgttgtgaaaggaggcatcgcttatcaaaatggattcttcctcacatggagcatagtaactgttaagcagt

SEQ ID NO: 84369 - DNA, 601 bp, Human
cctctggacatgaccgtggggtgaaagtagtggaagccacggtcatcagaagggaaggaggaatttaaggaaccaagagcctggagtgttagaagaatcatcctcttggagtcaccaagaatgatggtgagaacagtggccagaaatgtaaatctacaagtgaggggagggtctcctgtgtgtgtagatgcaccataaaaaggaggtgctatatagtctgaagacagaaactccaaactgggagtttaggagaaaattatgtcatgtatgtggatttactcagcagtgattctaaaggatygtatctggaaggataagaatgttacggatgaaaacattcaaagttccagtgatagaaacatcatgggtttgagggtaaactcgtaacactgaaagaggctacagtatacctaagaagttggtgtgttgtgaaaggaggcatcgcttatcaaaatggattcttcctcacatggagcatagtaactgttaagcagttagtgaggagaaattaatttcaatcctcaccaaatacagcacacaccaaaccagatactaaagagagaaacattctaaataactacacaaggaaaaaatagaattg

SEQ ID NO: 84370 - DNA, 601 bp, Human
tttgccatgttgcctaggctggtattgtacctctgggctcaagcgatctgcccacctcagcctcccaaaatgctgagattacagacgtgagtccctgcacctggcctagattttgttttttaatctgcacttaacaaatgataaaatggagtcacaaagaagtgaatgtgaataattctgtttggaggctccatagtgaaggggtactcctgtcagggtctgggagatgagacccagtccatgaaccagacgagggcctcaagatgacttgtgttcagttgtcagcagccctggagttctractgtgccaggcattctgccatgtgctttacccactgtgtctcatgctcagaaggctctcggaggaaggccctgttatgattggcaaagcaagtcagcagggctgaggagcatgctccaggccacagacccacgaagtagcaggctctcatgcatgggtgtggtgccatatggtgcccaagctctgaaccacgccctcagttgcttcgtctgtaaaaggagtgaggcactggggtcggttagatgctttaaatttatgaccaattgaaaaattctggggggagttttttcaggttggtta

SEQ ID NO: 84371 - DNA, 601 bp, Human
tatggggtaccgtcgtacacacctttgtcttcagccataacttataaaagactcagccacagtcaggccctttgagctagtaggcctcctccttatcagggagctaccagggaggctaacgtcagaagtgctggtgtcacagcccaggaagggcagccataggcagggccgctagatacagataagacctggatcagaactagccccttggtgcctgcctccttgatgctgtcatttcttcaattggcttttgccttggtggagatcaaatgaggaggcccttctgcttctgtctggtgtsggggctggccatggcagactgctgagtcccctctcttgcatatccatcccatggcccatggattgcaggtcatgtttccctcagacaacacctctccacattccttttttcttcacagaaattctagctactctgagaggtcattctggcttggtcaaagggttgacatgggaccctgttggtaaatacatagcttctcaagctgatgaccgcagcctaaaggtgtggaggacgctggactggcagttggagaccagcatcaccaagccttttgatgaggtaagtggggacagctcaggg

SEQ ID NO: 84372 - DNA, 601 bp, Human
ttgcccactggtcaggatggctgcaaaagtaaagtgatagtcatatgttcagttcttcccgcacaacaccagctcctgggctaggtatatgagtactggtttttaccttacttagtcttgccctaaggagcttttgctccttctggagttcctcagggctctgactgccaggcagtggggtcccatgaggtggactcctagggacggctttaggagtgtcttgagtaccagcaggaggtggtagtactcttcagcctctactgggtgggcccatccttccaggtagggggtggttctgtcrcctaggctgagagctgaggtgggtgatttcactatactcaggctctggtttgtcatgtcctgctctagagctgtgaggtcatgatcttaacccttaagtctttagagctgccctgggcccaccttgagcttcaaggagctggctctggacccatgtcatctctttttgcaggagggataatgtggagggatgctctgcctcagcccccagtccagactgggggagcagtgcctttctactgttccttttatagtttataaggatgttacaaacctcttctcccttgcgggtgtcctcacc

SEQ ID NO: 84373 - DNA, 601 bp, Human
gttctgtcacctaggctgagagctgaggtgggtgatttcactatactcaggctctggtttgtcatgtcctgctctagagctgtgaggtcatgatcttaacccttaagtctttagagctgccctgggcccaccttgagcttcaaggagctggctctggacccatgtcatctctttttgcaggagggataatgtggagggatgctctgcctcagcccccagtccagactgggggagcagtgcctttctactgttccttttatagtttataaggatgttacaaacctcttctcccttgcgggtrtcctcaccaccctttgggtgaggcaacaggctcaagagagtaggtggtgcctcacagtcatcagctacattacagacacaggcttctgccaggctcctgggttaaaaagggctttttctccaccagagtatatcttgaggatgctgtgcagatgccatgctgtgggttaacaggtgctacacagaagaattgggtcagtggccagagagatttggcccatgcagaggctatggttcaaacaggtagccttcctgcagatctcctcagggcatacacttctgtactatatttctttgttca

SEQ ID NO: 84374 - DNA, 601 bp, Human
caccagagtatatcttgaggatgctgtgcagatgccatgctgtgggttaacaggtgctacacagaagaattgggtcagtggccagagagatttggcccatgcagaggctatggttcaaacaggtagccttcctgcagatctcctcagggcatacacttctgtactatatttctttgttcagctcctctgggggagtgtaggatgctgcagtttccaaattcatttcacagagccctttttggttgggccatctggtgagacagaagctgtcagtgtagccagaagcttggggtgcatgctycaccatcacacatttataaattgaagtttaactttatcctcgaggccagagttttggtcacaaaggtggccttgagctcctttcaagtgcagatgcttctttcagtgtggaggaacgacccatgtgttgcggctcagctggtcacctgatgggcattacctggtgtctgcccatgccatgaacaactcaggccccactgcccagatcatcgaacgggagggatggaagaccaacatggactttgttgggcaccggaaagctgtgactgtcgtggtgagtgcccagggaactaaagggaga

SEQ ID NO: 84375 - DNA, 601 bp, Human
cccaagcacggtgccaccctcacctggctccagtgaatacaggtacaattctggtatacccaccaagcactgtgcttgtccccacacctggcagcatcaaccacaggtgcaaggccatgccatggatcactgagttgggagctgctgccagatcttgctgcggcaggtgaagagctcagaggcgtgaactgctgtcagtccttaggcatgagagttgtctggccactcgtcttatgcttctccatgactttaattaaatagtgtcctgacagagcccaaggcaagctgttaagtagttgcraataatctgtgagaaccaggattttctcaacactgggcagccaaataaaataaacagattggtggactaaggttgataaaagtgaaggatcatccaagaccctgatgaaaatagactcacttttgcccgtgtttaaatagataataagtatcggccggacacggtggctcatgcctgtaatcccagcactttgggaggctgtggtgggcggatcatgaggtcaggaggtcaagaccagcctgaccaacatgatgaaaccccgtctctactgaaaatacaaaaattagctgggcatggtgt

SEQ ID NO: 84376 - DNA, 601 bp, Human
gtactccagcctgggcgacagagcgagactccgtctcaaaaataaaaataaaaaaagataataagtatcatatattgtaccttaaaacacaaattttatatgaataaaatattacttattaaatttttttgttttggagttcatgtagggttttgtttgaaccagagctttgttgctaaagtctttggaaatcagtgcttcatggttagtgctctacgtgattctcccatgcagtcctcacaaccactttattagcagctctgggagatcacgacgcctgcctatggctcacagagctccyaaggccctgcagcctcattggtgttagagacagcaagcccagggacacgcctctgagttccatcttctccagtctctgtgcaccccggccattcctgcctgccctctggaattaaaacatctctaggctacctgacaccaggctttcaggaaccctccttcttctgccctcagttgtcctaggttggggattcccagagcgcccacccctttaaatccaggagggtgtctgggagctcagtgagtgctttcatcctttgcagaaacaaagacaagttactctcggggtagttccctggac

SEQ ID NO: 84377 - DNA, 601 bp, Human
cctccttggaagctcacaggctctcctgctctcccagaaggaagtgctgaagactgggtctgtgcccagccaggagaggccaccttgacccccacctagaccagctcttgtgtccagactcaggcagcaccctcagtggtcaatgccatgagcagcatgttgggcttgcttcctattagaaaaatctttatatggctgggcgcggtggctcacgcctgtaatcccagcactttaggaggccgaggtgggcggatcacaaggtcaggagttcgagaccatcctggctaacacagtgaaaccycgtctctactaaaaatacaaaaaattagctgggcgtggtggtgggcgcctgtagtcccagctactcgggaggctgagacggagaatggcgtgaacctgggaggcagagcttgcagtgagctgagaccgcgccactgcactccagcctgggcaacagagcgagactccgtctcaaaaaaaaaaaaaaaagaaaaagaaaaatctttatataaagtgtattcacctgaaaggtacagtttggtgagttgtcatacatgtttacacaccagtgtcatcactgcctagagcactcctttttgtc

SEQ ID NO: 84378 - DNA, 601 bp, Human
caaaaaaaaaaaaaaaagaaaaagaaaaatctttatataaagtgtattcacctgaaaggtacagtttggtgagttgtcatacatgtttacacaccagtgtcatcactgcctagagcactcctttttgtccctttgtccctccccagtcaagacctccctcaccaccaaagcaaccactctaatggcctctgttacactgatgagttttgcctgctcttgaacttcatataaatgcaattgtgtggtacttgcttctttgtgtcttcatttcttttgcttggcacagtgtttttgagattcrtgtatgttgctgcacttaacagtattttattccttataatttcggtgtagcattccactgtatgaatacaccacaatttgtttatacagtctcctgttgatggacattaagattgttccagttttgagatattatgactaaagctgatatgaacattcttgtataagtctttatgtggatgtacgttttcatttatgagtacatacctatgagtagagttctaaaattaaaaaaaaaaacaaaaaaatagtaccaagtgtcagcaaggacatgataagctggaactgatacattgctgac

SEQ ID NO: 84379 - DNA, 601 bp, Human
gctggatcccctgagatgaggcgatgtcttcagcttcttttttttttttttttttttttttttgagacagagtctccctctattgcccagcaggctggagtgcagtggtgcaatcttggcttcttgagtcactgcaacctctgcctcctgggttcgagcgagattctcctgcctcagcctcctgaatagctgggattacaggccaccacacccggttaatttttttgtaattttagtaaagatggggtttcaccatgttgtccaggctggtcacaaactcctgacctcaggtgatccgccygccttggcctcccaaagtactgggattacaggtgtgagccaccacacccagcccgatgtgtcttcagtttcattgttcccctcaccttcctaactcagtgccctctacagagcaggttctcagcagatatactcaatggtagttggcgagtgagaacccaagggtaagaactgtggcggtttctaagtgagggctcctgaagggttaagtttctcactgccaggggctggtgtgctgtgacctgactgtgtggtaagagacacctccgcatgcagtgcagggagcagtcttggtgctgag

SEQ ID NO: 84380 - DNA, 601 bp, Human
tctacagagcaggttctcagcagatatactcaatggtagttggcgagtgagaacccaagggtaagaactgtggcggtttctaagtgagggctcctgaagggttaagtttctcactgccaggggctggtgtgctgtgacctgactgtgtggtaagagacacctccgcatgcagtgcagggagcagtcttggtgctgagcatcaaggtgccaatatatttaaagtttgataaagcaaagtgcacacacattaattttttttttttttcattttgtaaaaaagtgtccctataagcagagcaarttggaagttctgggtttgaaggttatcctctggctgcatttattagtttggtatagagaaatatattactgtgtgcgttgtgatttttttttttttttttaggccaagtattcacttaacacccattctggaacctgaaccacagtaccacagattgccgttcaggggaccttccctgtttcctcccagccagaggccctgtttgtggcgctgcaaccaaaacatcactgactgtgatgcccatatttcttagaatgctcaggttaggcagtcacacggcctgtagatttctgaggggtc

SEQ ID NO: 84381 - DNA, 601 bp, Human
aaaggcctaccatagttgtgggaacgtggagtcagagtgtatgccagcaattgagtgactcgatagagaatatgcacagtgcatgctatgcagtcatccagaagagacttttacaggatatttaatgacatacttattgtgtgttaaatgaaaaaacagacacaactatgaagaataaaataaattcttactttgaagaataaaataaatatttgcacaaaatagaagataataattcatcaaagtattaatagtcggtaactaggcccagattaagggcccaggtgtgtatttctgtacyacctacacatagtgtagaatgagccttggataaatgtgtaccagagtcccttgggcccagggaagatgtgttgtgttctctctcagggtgcctcatcccctgtctaggctttggcatcgtgtctcctgctccatagaccctctcagaggtccaccctggggctgtccctctcctccgaccatagcccttcagaaacccactcccactctgccttctctgttgctagttatctgtgtataaagctatttcccctgtcagaccacagcaagccctggaggcagggtccactctaggtagcat

SEQ ID NO: 84382 - DNA, 601 bp, Human
ggtagcatgcacatttttggcaggctttggttcccacagtttgggatctctgcagctgcagtttgaatagagttgaagatgccttaaatatcagcagccactttgacccaggcttctaggttggttatgttaactgagctgaatacagaaggggatttcagtaatttcattaaccttgactgtgtctttccttccagctcacatgtctgaaacggccgctggtggtcatccatgaactgtttgacaaatccatcatggatatttcctggtaaggtggattctacttacaggaataggttaagaaaggagaagccacacattggaacatgaggccttctgggtgtgactagggtcaggtggccagtggcccctccccaggtgtcatagtagcgcagaccaagagtgctgtttgcacgtgatttgggaactggcagcggtgtacctgctgctgcgagaatgtcctgcctgtgtagaatttgccactggaaaatgccttttcaggatttgtctaagacgaggagaatgacgtgatcctagtatgttccactttactccgtcagtgcatgaaccaaagtcagaagcacactttctgcttctcagt

SEQ ID NO: 84383 - DNA, 601 bp, Human
gggactccatgttggaggaacactagggaaaccctggccaaacactgaattctgcttcgagattccaggggatagactcaggagagaagggcaggagccaagatggcaagaaaaggaggttcctggccacattcaagccctgcaggagcaggtcccaaggcacctctcttggaacgctgcctctcaacccatgctctgctgtaaagcagatgtcctgttaaccacagtccctgttcttgagcagaatcccacattggacatttgcacatcccatggaagtgtgttcctcatgcactttcaygtacagcagtcactacagtgtgctggggacaccatctctgctctcatgaggctcctgtctagcttgttagggcacaagactatgagggcctagaaggaggggagtatgatgacatactaggaggggtgggagtaaaggaggctccccagccctgctgtgccaggccttcccatactcttagagacactaagcaggccaatggggacttccaaccacagggcttatggctgcagatgagctgtgaaagtagacttttgttctaggatctgattcccaaaatcatttgggtcctaggagtga

SEQ ID NO: 84384 - DNA, 601 bp, Human
gtttgtttagagtggtacgggatctgtgggttagccagcctcgggcctgttggccccttgcccactgctgcatgatgcagtaatggggcctggatcctctttatcaaaggcctccttatccccaggagcccagaggaggtcatctcttgtaagaacttacgaattttatccttctggtctttctaaaaatcctagatgctaacaacagtggatttcaggctctgcccttaggagacttctatgggctcccccttcttcatctggaagccatgtttgatgggaaggggttggaaatggggcrggaaaagggtagggaacgttattgcctggggagtataaaccatctccaggagcctgtgtaggctgacaaacctcctccaggcaattcagatataaagtatgagagaaaacccctagttacaagctttctgtggaaggaaggattctattttgaaagtcagtttgaaaatctctacctcaggccaggcgcagtggctcacccctgtaatcccagcactttgggaggctgaggcaggcggatcacttgaggtcaggagttccgaccagcctggccaacatggtgaaaccttgtctctactta

SEQ ID NO: 84385 - DNA, 601 bp, Human
gctaagagggtggatcttatgcttagtgttcttatcaccaggaaaaaaagagactttattttttaatatttggaaatagttggccaaaacttttgcattcatttatgtaactctgctttgccagaatcttttgaagaaacaagttgagactcggacagcagatggccggagaagaatcacgcctctctgcatagcacagctggacactgggtactggttcattcccctttcatggtcttatctggcgagatcttcctgtcttctttcagcggttaacactttcacagtgaggatcttcacrggtccttcacaacctgactggtagaacatggaagcaaggaagtgaagctcagcttcccgcagtctcaaagcccatactcctcctggagcccttgtgcacacctgaatcatgtgaggggtgggagtgctaaggcggccagcacatctgctgcacttcactgttgccagggcaccagaggacgcacaaggaaagcagtcagtcaggctgattttttttttcttttttttctttcataaagttatttttatgattatgaaaggtatatttacacatggttaaatttagaaaatagtaaaagcc

SEQ ID NO: 84386 - DNA, 601 bp, Human
ggggcctcagcttccacttcactctgctgagcacatcacacagcattcatcttaggcagggttctcctgtgggagggcacagactccccttatactctcagaattatattcactcacagagcctgtgtcctcacccattgttacttggaaaccaaattagaaatcagaaagaaccaggcaagcacaaatgaaagccaggagtgaacgtttgctcagcacctgctctgggttatacaccctgctaggccccaggcatcgcaggggcttaatgggtgggtcctcatcctcagggagtgtgtargctggtgggggagaggtagccacagggttgcaggtggcccctcaggtcccctggatagaaatggctagccatccaaagaggggctggtatctcagggatcagggaggtgcctcagagggtaccctccacaggactcatacaggcctaccaggggatgaggcctggggattaggggcagcagccccccagtcccctgaggaaggccaagaagagggagaaggccaaggtgtctgtgctggatcaggtagtctgggcttttccccagagtggagacgtagaaggctttgagatctccatttt

SEQ ID NO: 84387 - DNA, 601 bp, Human
cccattgttacttggaaaccaaattagaaatcagaaagaaccaggcaagcacaaatgaaagccaggagtgaacgtttgctcagcacctgctctgggttatacaccctgctaggccccaggcatcgcaggggcttaatgggtgggtcctcatcctcagggagtgtgtaggctggtgggggagaggtagccacagggttgcaggtggcccctcaggtcccctggatagaaatggctagccatccaaagaggggctggtatctcagggatcagggaggtgcctcagagggtaccctccacaggrctcatacaggcctaccaggggatgaggcctggggattaggggcagcagccccccagtcccctgaggaaggccaagaagagggagaaggccaaggtgtctgtgctggatcaggtagtctgggcttttccccagagtggagacgtagaaggctttgagatctccattttaggaaagtgactctgttaggcggtggtgccccaaataggccactccctggcacatacagctgataccgtcagagcgattctccattggtggaatggagtcttgtgttactgcagccccctgcttctgggatac

SEQ ID NO: 84388 - DNA, 601 bp, Human
caaaggcacaaggattggtcagtgcagaggctgaactgagaataatggtgtttggatggagcccagagtttgcacggaagagagcatgagattagttggagaggtggaagactctgatattgatacatcatggaagtgacggccttccactcagaaactgaccagaggtagagagctgcaataaaaatgatgtaagtgaggtctttgtcaagtcagattggcttctgagctcttgtggacactatgctgcttatccattctctgggtctcccctcaaacacagctgtgacatcacgcaggytgtagttctttatttcttggagttttgcagtagtgcatcctcctgaggtggccagagcgaatgtctgcagcctctgccattggcactgaagttctctgcctcctgagagggcccctccctccaagcctagcttgacaaggagctaagttcacatcccagtgagtcagagcctaggagaggagaggcagatgtgggctggactttgggggcttaagagctgtcccttaagagttgcaccccactgcgaggtttatagggctcagcagccctgggcagacacaccctagcctgtgccaccat

SEQ ID NO: 84389 - DNA, 601 bp, Human
acatttataacctaactctactttcaaataatattataccacttcatgggtagtagaaagagttccccactctttccttccatgccctatgacattggtaccacttatttcactcattcataaactatagtaattcaagacatggtggctgttatttgtttgaacagaaagttgtctctcagatcagttgggaatatgaaatacaaaagattctattttatgttcattgttttttttctctaacatcactcttcctttcttcatgcagatgtgagtttctggcctgcatcatttatcttcyctctgaaagacttttaacatttcttgcaaggcaggtcttctggcaacagattccggtgtctctttgtttatttttgtctgacaaagtcattatttctcctttacttttgaggcataatttcactggacacagaattctaggttggcaagaggtttgtttaagcactttaaatatttcacttcactctttcttgcatgaatggtttctgaagggaagtgtgatgtaatgtttttgtgcaggttaaaagagcagaaccttgtgaaagagctgaggccccgagacctcctggagagcagcagt

SEQ ID NO: 84390 - DNA, 601 bp, Human
ttatttcactcattcataaactatagtaattcaagacatggtggctgttatttgtttgaacagaaagttgtctctcagatcagttgggaatatgaaatacaaaagattctattttatgttcattgttttttttctctaacatcactcttcctttcttcatgcagatgtgagtttctggcctgcatcatttatcttctctctgaaagacttttaacatttcttgcaaggcaggtcttctggcaacagattccggtgtctctttgtttatttttgtctgacaaagtcattatttctcctttasttttgaggcataatttcactggacacagaattctaggttggcaagaggtttgtttaagcactttaaatatttcacttcactctttcttgcatgaatggtttctgaagggaagtgtgatgtaatgtttttgtgcaggttaaaagagcagaaccttgtgaaagagctgaggccccgagacctcctggagagcagcagtgacagcgatgagaaagtccctttggctaaggcttcctcactgtccaagcgaaaacttgagcttgaggtagagacagtagagaagaagaagaaagggcggcctcg

SEQ ID NO: 84391 - DNA, 601 bp, Human
ctctcttggccagccagtctgcctctgtatcctgctgctgccttggggccccaggctacagagccttggagcatgtcacctgggctgcggcccttgtctgagcagacccgtgtgtttacttcatccaggtcagctccgatccttccatgtacattgaggtggagaatgaagtgacagtggtggggggcgtgaagctgagccgcctgaagtgcaaccgggaagggaaggagtgggagacggtactcaccagccggatcctcactgctgcgggcagctggtaagggtgggcaggtccttagcyggcccaggtgacacaggcacacatgccatcattctgggcctgggcctgtctaggggaggtgcatgaccctgggagcaccagctcccacagagactcacaccaggcttcactccaggccaagcatatgtgcttgtcatctcagtccctgcagcacccagcaaggtcagcatcagtatccccgtgttacagatggggaaactgagcccttgagggttacccaggccaagctttgaacctgatggcctgattcccttgtccagccagatccccaaagtctcgaattccacactgaggtgtgcc

SEQ ID NO: 84392 - DNA, 601 bp, Human
cagtcacagcactgcagagagctccttgttgcccgtgctgcttagagtgttctctgattcatactctccaagtaaacatttgtaaacaaaagcatctcacttgcctctccctttttggagccagtagcaatagtggctcattaggaaggcagttggcagagctccttccttaactgacctccttgagcctgctggagtgactggctcaccaggatagaagtgacacaaagcggggctctgggtggcctactgtggccaggatctcactgtactggctgtacatctgctacccctgcctgcktctgagctccagcctcaccctgggcctgtggctgtgccttagggggctctgtctgggaaggcagcagcctgctcgtgcagggcccacccaggggcctggtggtcactcgggagaagctggacagtgtccagactgttctgtaacgcactccttgtttgggagcgacacacatctcccacgccagccagacagccccctggacacagaggtgcatgctgtcatccccatacttctcttagcctgccttgttagagaccttctcaggactggtctgactagttgcagccaggagactgtcct

SEQ ID NO: 84393 - DNA, 601 bp, Human
gaagctggacagtgtccagactgttctgtaacgcactccttgtttgggagcgacacacatctcccacgccagccagacagccccctggacacagaggtgcatgctgtcatccccatacttctcttagcctgccttgttagagaccttctcaggactggtctgactagttgcagccaggagactgtcctgtgggtactatgtggccttatctgatgagcaaggcatgtttcctgggtgatcatcagaggcattggctctccaaagcccccacaccccttggtcagcatcagcatgagctcargaaagcgcaggcagcctgtggaaataggacagaagcctctttcatccaagatctcagggaggctccaacagccccaccagccctaccctgacccaatccaccttcccttctggctgtacctgctcaggggaggcccttgttgggcccaggcagagggaaggcccacacttccagggctactgtcttggctgcagcactcagcccccatgacacctgcccccactctgccttctcagtgacgtggtgtgtgtcgcctgtgaaaaaaggatgctgtcagtgttctccacctgtggtcgccgt

SEQ ID NO: 84394 - DNA, 601 bp, Human
acctggcaggagctgggccctggacatcaggagccacggagtgctccgccacgtgcctgtgctgagggaggctgcctgcaggggctctgggcttggttgtgaagacaaaagacggaaggtacttccctgccttcgtggagctcggtctggtagggatgcacacataaacagggaggcagttaggtcaacaaaatattttcagactagattcagactaagaaggaagtaagcagggtcttcagatgagagtgcctgggaaggagtgaccaggaaggccttgtgagaggacactgcggatgamacccaaggagaagagtgagacagccatacagagacctggagaaagtgtttcctagtagaagtgagagtaaaagcaaggagtgcttgatctgtttggagccactgtggctggcacatagaaggcaaaaggagagggtggtgtgaaatgaggcaggaggtggaccacagagacctttacaggagctagcgttttcttcttggcagagttggcgcagaggtgtcatgaactaaaatagaaaaacagtcagggagtatcttctgtaacagtcccaggaagagatgaaggtgacttggatcagtg

SEQ ID NO: 84395 - DNA, 601 bp, Human
cgcgccattgcacaccagcccaggcgacagggtgagactctgtctcaaaaaaaaaaaaatcagctgtatcatttttcatgctttcaattcttcaccagatttttaatttaggcttttatctactttagcataataatcttagttattttaaagttttatgtctgataattctagtatcaggagcctttgcagatctatttccgttgcctataaatatttctgctgtttctcattcagattgtcttatctccttatgtacctggttattttttactatctggtggacatagtatttgaaaartttattgtagaaatagtttgaggcctaagatgatgttatcttcttctacagaacacttctatttgcttctgccaacttcttgggagtagcactgtagggactccatgatcccgttcagggactgaggttttctaggctgcctggaactcaaagctgggtgccagctgttatagaggctagtttacttccagttgacgcttattctaggttgcgtacctttggaataccaggacaaaggaggggtaagttaacagggccctagcccctgctatggtccccctaggccctcaagttgtttgt

SEQ ID NO: 84396 - DNA, 601 bp, Human
atgttatcttcttctacagaacacttctatttgcttctgccaacttcttgggagtagcactgtagggactccatgatcccgttcagggactgaggttttctaggctgcctggaactcaaagctgggtgccagctgttatagaggctagtttacttccagttgacgcttattctaggttgcgtacctttggaataccaggacaaaggaggggtaagttaacagggccctagcccctgctatggtccccctaggccctcaagttgtttgtttgttttgtttgtttattttgagacggagtctygctctgtcacccgggctggagtacagtggcacaatatcagctcactgtaacctctgcctcctgggttcaagcaattctcctgcctcagcctcccaagtagctggaattacaggcacacaccactacacccagctaatttttatttttttagtagaggcggggtttcaccatgttgaccaggctggtctcaaactcctgacctcaggtgatctacccacctcagcctcccgaagtgctgggattatagacatgagccaccgctcccaacccaggccctcaagtttggtagaagttctgcct

SEQ ID NO: 84397 - DNA, 601 bp, Human
tcccgaagtgctgggattatagacatgagccaccgctcccaacccaggccctcaagtttggtagaagttctgcctagcttcttcctcatggataaatatttccaaagcaaaggcatccctctttggatctctgtcttccccacagcatggctcagtcatttatcattaacacattagctctcagaagtttgctgctatttgtccacctttttttctttgttgtcagtgaggaaggctgttctgaattgcatggtctattaatggaaggaaaggcttgtgatatcttctcagatatcagctrcagatgctaacattttctaaaataatttgttccctgaattatctggcttttctgggttcaatctttgatttgttcattgcggtctttacttgaggacattttaccctatctggaaatccttggttatcaggttgtagttacaagtgaagaacccagattgatagtggcctcaggtttccttttcaagagtacagctgttcgcttagcacagcttagcacatctcacctccaggacaggccgatgagccatctactagagtgggaggcaggcagaaacctgcccagtgagtccccctcatg

SEQ ID NO: 84398 - DNA, 601 bp, Human
aggaaaatgagaagcagaaggttggggcactaagcaaacacctttcaggttcctgggctttgttctggctccagcctccccagccaggccctgttcttaggaagcctccctttgctgtggtcttcagtgtaagacaggggtccccaacctctgggccacagaccagtcagcagcaacattaaattctcataggagcacaaaccctattgtgaacttcacatatgagagatctaggttgtgtgctccttatgagaatctaatgcctgatgatctgaggtggaacagttttatcctgaaaccrtcttcccctcccccactggtccataaaaaaaaaccagtcctgggtgccgaaaaggttggggactgctgctgtaagacctgtggcagtggccagagaggtggtgattaagttgtgtgttgcaggctgtacaaagagctatacatcgcatcctgaaagagtggaaaaaccatcctttactgagagccgaagggtgaggaaatatcaataatacttggctgctctttacattgccttcaggccagagggcaagtcctcttgcagcttcttcctagtaccacaggcaggcagaatgttttgctt

SEQ ID NO: 84399 - DNA, 601 bp, Human
tgtcagggtaatgctgtcctcatagaatgaaataggaagtgttcctacctattttggaaggaggattggtgttaattctctaagtgtttggtagaatacatcagagaagctatatgatcctaggcttttctttatgagagggtttgttttattgattcagttttcttgctcattagagatccgtccagatttttaatttctttatgagccagtcttggtaagttgtttccattttatgtaggttatcagatttattgtcatatagttgttcatgctgttctcttatttataatcttttttrtttttgtggcattggttgtaatgtccctgctttcatttttgattttcattatttggatcttgtctctctttttattatgtagtctagctaaaagtttgtcaattttgttcatcttttcaaagaatcaacttttggtttcattgattatctctattattttccatttatcttgtcccattatctttattattttcttctgctagctttgggtatagttctttttctagttccttaaggtgtaatgttagattattgatttgagatcagctttcactgcatactgtaagttttggtatgttg

SEQ ID NO: 84400 - DNA, 601 bp, Human
ttaatggggttatttgtttttatcttgctgatttgtttgagttccttgtagattccagatattagtcctttgtcagatgcatagtttgcaaatattttctcccactctgtgggttgtctgtttactctgctgattatttcttttgctgtgcagaagcttttaagtttaattaggtgccatctctttatccttgtttttgttgcatttgcttttgggttcgtagtcatgaactatttgcctaagccaatgtctagaagagtttttccgatgttatcttctagaattgttgtggtttcagatygtagatttaagtctttgatccatcttgaattgatatttgtataagatgagagatgaggatccagcttcattcttctatatgtggcttgccagttatcccagcaccacttgttgaatagggtgtttgttccccactctgtatttttgtttgctttgttgaagatctgttggctgtaagtatttggctttatttctgggttctctattctgttccattggtctgtttgcctatttttataccagtaccatgctgttttggtggtaactatatccttgtagtatagtttgatgtcgggtaatg

SEQ ID NO: 84401 - DNA, 601 bp, Human
ttttgctggatactaaattcttggctggcagttagtttgtttgaggaagctaaaaataggaacccaaacccttctggcttgtagggtatctgctgagaaatctgctgttaatctgataggtattctggccaggcgcagtggctcattcgtgtaatcccaacacttagggaggccaaggtgggtggatcatttaaggtcaggagttcaagaccagcctggccaacacggtgaaaccccacctctaataaaaatacaaaaattatccaggcctggtggcaggggcctgtagtcccagctactwgggaggctgaggcaggagaattgcgtgaaccagggcggcagagattgcagtgagccaagattgcaccactgcactccagcctggatgacaaagcaagactctgtctcaaaaaaaaaaatccgataggcttttgtgtataggttacctgatgcttttgccttacagctcttaagattctttcctttgtcttgactttagataacctgatgactgtgtacctgggtgatgatctttttgtgataaatttcccaggtgttctttgagcttcttgtatttggatgtctagatctctagcaaggt

SEQ ID NO: 84402 - DNA, 601 bp, Human
gcgcagtggctcattcgtgtaatcccaacacttagggaggccaaggtgggtggatcatttaaggtcaggagttcaagaccagcctggccaacacggtgaaaccccacctctaataaaaatacaaaaattatccaggcctggtggcaggggcctgtagtcccagctacttgggaggctgaggcaggagaattgcgtgaaccagggcggcagagattgcagtgagccaagattgcaccactgcactccagcctggatgacaaagcaagactctgtctcaaaaaaaaaaatccgataggctttygtgtataggttacctgatgcttttgccttacagctcttaagattctttcctttgtcttgactttagataacctgatgactgtgtacctgggtgatgatctttttgtgataaatttcccaggtgttctttgagcttcttgtatttggatgtctagatctctagcaaggtcagggaagctttcctcaactatccccacaaatacgtttttcagacttttagatttctcttcttaggaacaccatttattcttactcttaggtttggccatttaacataatcccaaatttcttggaggctttg

SEQ ID NO: 84403 - DNA, 601 bp, Human
tgaaaacaggtcatttgaaattatcaagtatgaggagcaaaaagaaaatagaatgaagaaaagcaaacagagtctaagagacttaccagacaccatccaagtatacccatgaatccataatgggagttctagaagtgtaagagagagaaaggagtagagagcttatttgaagaaatactggcggaaattttccaaatttgaggaaagacgggggtctactaatacaagagcctcagtgaactctaagtaggaaaatcccaaaggaacctgcactgagacacattagtcaaactgtgggaarggaaagacaaagaaaatctcatccttgatgtcagttttaaaatagtattcctgatgttttctttatggtaataattaacttttcctttctatttctttttgagctagttttgataaattatatttttctaggaatttctccattttctctaaatgttcaaatttcttagcataaagttgatagtaatcatatctttttctttcttctatatctgtagttatgtctctttttatttctaatattatttctttaagctttctctctctttcttgattaatcctgccagacgtttgtccatta

SEQ ID NO: 84404 - DNA, 601 bp, Human
gacttaccagacaccatccaagtatacccatgaatccataatgggagttctagaagtgtaagagagagaaaggagtagagagcttatttgaagaaatactggcggaaattttccaaatttgaggaaagacgggggtctactaatacaagagcctcagtgaactctaagtaggaaaatcccaaaggaacctgcactgagacacattagtcaaactgtgggaaaggaaagacaaagaaaatctcatccttgatgtcagttttaaaatagtattcctgatgttttctttatggtaataattaasttttcctttctatttctttttgagctagttttgataaattatatttttctaggaatttctccattttctctaaatgttcaaatttcttagcataaagttgatagtaatcatatctttttctttcttctatatctgtagttatgtctctttttatttctaatattatttctttaagctttctctctctttcttgattaatcctgccagacgtttgtccattagtcttttcaagaaatgacttttgccaggcatagtggctcacgcctttaatcccagcactttgggagaacaaggcaggaa

SEQ ID NO: 84405 - DNA, 601 bp, Human
cgggggtctactaatacaagagcctcagtgaactctaagtaggaaaatcccaaaggaacctgcactgagacacattagtcaaactgtgggaaaggaaagacaaagaaaatctcatccttgatgtcagttttaaaatagtattcctgatgttttctttatggtaataattaacttttcctttctatttctttttgagctagttttgataaattatatttttctaggaatttctccattttctctaaatgttcaaatttcttagcataaagttgatagtaatcatatctttttctttcttctrtatctgtagttatgtctctttttatttctaatattatttctttaagctttctctctctttcttgattaatcctgccagacgtttgtccattagtcttttcaagaaatgacttttgccaggcatagtggctcacgcctttaatcccagcactttgggagaacaaggcaggaagatcacttgagctcaggagtttgagatcagcctggccaacaaggtgaaaccccgctctactaaatatataaaaattagccagacatggtggcacacacctatagtcccagctactcgggtaactgaggc

SEQ ID NO: 84406 - DNA, 601 bp, Human
gaactggagaaggatatggagaggtatttgatcatcatcaggctggcgtgctagcggaagtctccgggcattatttaatatttaatctttctattcctgacatcacgggggctcaaatgtcatcaaaagacaggctggcattaaacccggcagggtgacgcacataacatcttaccatatggattttcatcagtccagaccgacaagcacctcaaagcctgcccagtgaaggaagaagggtggcccaggccgtcagctctcccacccttggcgcgcagttcggtatagcactcggggtttkgaggctgcaagaccaccggaccggacgccccagggtcggctcgggcctccggagctgtgcactcgcgcacggcccgaggaggtcgcccgtgcggccgctgacaccaggcgtcaagtccccgcccgagcagccccagcctaggaggcggaccccgccactgctcctctactgagccgagcgtgtcggccagggactcagacagtcggcacaaaccccctcccggggtctaagcccgcctagtacagtacctgaaggggcagcgccacctccgcccgattgtgctggctgccccagtggcgg

SEQ ID NO: 84407 - DNA, 601 bp, Human
ggtgggtcacgcctgtaatcccagcactctgggaggccgaagtgggcggatcacgaggtcaggagtccgagaccagcctggccgacacggtgagaccccccccaccgccccgccgtctctactaaaaatacaaaatttagctgggcgtggtggcgggcgcctgtaatcccagatactcgggaggctgaggcaggagaatcgtttgaaactggaaggcagaggttgcagtgagccgagatcgcgccactgcactccagcctgggcaacaagagcgaaaccctctctcaaaaaaaaaaaaaawatatgaattaaaataataccctcaccatctccatcttctgctatatgacctgaactcagaaaataaaagtaaaccattcacactggatgtgtgtgataaatatcccctgagacgtgtgggacccaatatgattctaatcttaaaagatacgatgcagtaatagcgatatttcaagcactatcctgtagattggaggagacaaatctaaaattcatagtactatatagttagctattctaactacaagaatgcccaactgtgtttttcaataaaagtagagcagaacagtgcaaacttcac

SEQ ID NO: 84408 - DNA, 601 bp, Human
atcctcccacctcagcctcctgagtaattgggactacaggtacacaccaccaagtcaggctaatttttgtatttttagtagagacggggtttcaccatgttgggccagactggtctcaaactcctgacctcaggtgatccactctcctcgaccttccaaagtgctgggattacaggcatgagccaccacacccagccaatatgtacttgtttctaaaatactttttctttatcgtaaatattctatatatcaacctaacttgaagttaatctcaagggtcagatcctctcatagccagagrtaacttccccagaaggaaaaatctaaactccattatttctttggctcaaagactaatgctttaaacatgaaatgtatttctcagaggacctgagatttcacattcaatgtagtctcattgttcatgaaataacttaaagatccatttgagaatattaaaaacaatagctacttcctattgtcaaactagactgatgaccattcttacacttatagaagtgagattaaaacaaatcaaaaccaaaattaaaagctcaaccacagaagtacactgcagtttcaggacatttgatgcaacaga

SEQ ID NO: 84409 - DNA, 601 bp, Human
tgagggcagagtaggggtggggatggtgcaagaactggaatgttaaatagggtggttagggaaggcctccttgaagtcctgaaaacagttctgaagaatgaatgagtagttttccatcttttttgtacctgaacacaactgagatttagttctatggatgaaacacctagagataagctaagctaaatattaaaaagatcaactgtcaggtcgggtacagttccagattagcctggccaacatggtgcaaacctcatctccactaaaaatacaaaaaaaaaaaaaaaaaaaaaactagccrggcatggtggtgggcacctgtagtcccagctacttgggaggctgaggcagaagaatggcttgaatccaggaggcagagattaaagtgagccaagattgtgccactgcactccagcctgggtgacagagcaagactctgtcaaccaaattgaattcacatctaaaatatcaaaatgaaactgataaaaaaagatccttaagaagcaaatatctgtaactcatgaaaagtaggttgagccttcagagagtaattcaaattatctaggtaaaagggactggaaagtgaagacattccaaaagg

SEQ ID NO: 84410 - DNA, 601 bp, Human
ctcacgcctgtaatcccagcactccaggccgaggtgggcggatcacgaggtcaggagatcgagaccatcctggctaacacagtgaaactctgtctctacaaaaaaacacaaaaaattagccgggcgattagccgggcgtggtggtgggcgcctgtagttccagctacttcggacgctgaggcagtagaatggcgtgaacccgggaggcggagcttgcagtgagccgagatggcgccactgcactccagcctgggcgacagagcgagactccgtctcaaaaaaaaacaaacaaaaaaaaaaacccacaagataataaacagagtggtggcaaggggacagactgagtagggcttacagatcctaagactccttttaaaaagcgttttagctttacactctgagaactaaaagtcacagaagcgttttgagaaaaggaataaaagatcactctggctacctactgggacagcattgtgggggagcaaaggcagaatcaagaagttcatttgcatggctactatgataatccaggtgagacatgatggtggtttggactagaatggtggcagtgaagacagtgagaaatggacagattatacac

SEQ ID NO: 84411 - DNA, 601 bp, Human
gataagccgggcgcggtggctcacgcctgtaatcccagcactccaggccgaggtgggcggatcacgaggtcaggagatcgagaccatcctggctaacacagtgaaactctgtctctacaaaaaaacacaaaaaattagccgggcgattagccgggcgtggtggtgggcgcctgtagttccagctacttcggacgctgaggcagtagaatggcgtgaacccgggaggcggagcttgcagtgagccgagatggcgccactgcactccagcctgggcgacagagcgagactccgtctcaaaaamaaacaaacaaaaaaaaaaacccacaagataataaacagagtggtggcaaggggacagactgagtagggcttacagatcctaagactccttttaaaaagcgttttagctttacactctgagaactaaaagtcacagaagcgttttgagaaaaggaataaaagatcactctggctacctactgggacagcattgtgggggagcaaaggcagaatcaagaagttcatttgcatggctactatgataatccaggtgagacatgatggtggtttggactagaatggtggcagtgaagacagtgag

SEQ ID NO: 84412 - DNA, 601 bp, Human
ttaaacacaagataagccgggcgcggtggctcacgcctgtaatcccagcactccaggccgaggtgggcggatcacgaggtcaggagatcgagaccatcctggctaacacagtgaaactctgtctctacaaaaaaacacaaaaaattagccgggcgattagccgggcgtggtggtgggcgcctgtagttccagctacttcggacgctgaggcagtagaatggcgtgaacccgggaggcggagcttgcagtgagccgagatggcgccactgcactccagcctgggcgacagagcgagactccrtctcaaaaaaaaacaaacaaaaaaaaaaacccacaagataataaacagagtggtggcaaggggacagactgagtagggcttacagatcctaagactccttttaaaaagcgttttagctttacactctgagaactaaaagtcacagaagcgttttgagaaaaggaataaaagatcactctggctacctactgggacagcattgtgggggagcaaaggcagaatcaagaagttcatttgcatggctactatgataatccaggtgagacatgatggtggtttggactagaatggtggcagtga

SEQ ID NO: 84413 - DNA, 601 bp, Human
tatatacagttaactggaggaagagcatttaagaaatagtagctataaagctgagatcagagctctacctctgagaaacagcaaggaggcctgtgtggatcgcctagcaggagagaggaggaaaagattaaacacaagataagccgggcgcggtggctcacgcctgtaatcccagcactccaggccgaggtgggcggatcacgaggtcaggagatcgagaccatcctggctaacacagtgaaactctgtctctacaaaaaaacacaaaaaattagccgggcgattagccgggcgtggtggygggcgcctgtagttccagctacttcggacgctgaggcagtagaatggcgtgaacccgggaggcggagcttgcagtgagccgagatggcgccactgcactccagcctgggcgacagagcgagactccgtctcaaaaaaaaacaaacaaaaaaaaaaacccacaagataataaacagagtggtggcaaggggacagactgagtagggcttacagatcctaagactccttttaaaaagcgttttagctttacactctgagaactaaaagtcacagaagcgttttgagaaaaggaataaaagat

SEQ ID NO: 84414 - DNA, 601 bp, Human
attatatacagttaactggaggaagagcatttaagaaatagtagctataaagctgagatcagagctctacctctgagaaacagcaaggaggcctgtgtggatcgcctagcaggagagaggaggaaaagattaaacacaagataagccgggcgcggtggctcacgcctgtaatcccagcactccaggccgaggtgggcggatcacgaggtcaggagatcgagaccatcctggctaacacagtgaaactctgtctctacaaaaaaacacaaaaaattagccgggcgattagccgggcgtggtrgtgggcgcctgtagttccagctacttcggacgctgaggcagtagaatggcgtgaacccgggaggcggagcttgcagtgagccgagatggcgccactgcactccagcctgggcgacagagcgagactccgtctcaaaaaaaaacaaacaaaaaaaaaaacccacaagataataaacagagtggtggcaaggggacagactgagtagggcttacagatcctaagactccttttaaaaagcgttttagctttacactctgagaactaaaagtcacagaagcgttttgagaaaaggaataaaag

SEQ ID NO: 84415 - DNA, 601 bp, Human
atcataagggcaggagttcaacaccagcctggcaaagatgatgaaaccctgtctctactaaaaatacaaaaaattagccgggcatggtggcaagcacctgtaatcccagctactcgagaggctgaggcaggagaattgcttgaacccaggaggcggatgttgcggtgagccaagatggcgccattgcactccagcctgggcaacaagagggaaactccgtctcaaaataaataaattaattaattaaattaaatagcatatattaagatggcagggccaagagtggcggcttgcacctgtracagcactttcggaggctgaggtgggaggatcacttgaggccaggcgttcaagaccaggctgggcaacatagtgagactccccatctctaccaaaaaaaattttttaatcagcaggacacggtggcccacacctgttgtcctagctacttgggaagccgaggcaggaggatcatttgagctcaggagttcaaagttgcagtgagctatgactgcatgactgcactccagcctgggtaacagagcaagaccctgtctcaaaaaaatgttttttttcaagatagggaagcaactcaacaacc

SEQ ID NO: 84416 - DNA, 601 bp, Human
ccaaggcgggtagatcataagggcaggagttcaacaccagcctggcaaagatgatgaaaccctgtctctactaaaaatacaaaaaattagccgggcatggtggcaagcacctgtaatcccagctactcgagaggctgaggcaggagaattgcttgaacccaggaggcggatgttgcggtgagccaagatggcgccattgcactccagcctgggcaacaagagggaaactccgtctcaaaataaataaattaattaattaaattaaatagcatatattaagatggcagggccaagagtggcrgcttgcacctgtgacagcactttcggaggctgaggtgggaggatcacttgaggccaggcgttcaagaccaggctgggcaacatagtgagactccccatctctaccaaaaaaaattttttaatcagcaggacacggtggcccacacctgttgtcctagctacttgggaagccgaggcaggaggatcatttgagctcaggagttcaaagttgcagtgagctatgactgcatgactgcactccagcctgggtaacagagcaagaccctgtctcaaaaaaatgttttttttcaagatagggaag

SEQ ID NO: 84417 - DNA, 601 bp, Human
tgcgccaccatgcctaatatttgtattttttgtaaagacagggttttgccatgttgcccaggttggtttcacactcctgagctcaagtgatccacctttcttggcctctcaaagtactaggatgacaggcataagcggttgtatctggtcagatttggccaggtgcaatggctcacgcctataatcccagcactttgggaggccaaggcgggtagatcataagggcaggagttcaacaccagcctggcaaagatgatgaaaccctgtctctactaaaaatacaaaaaattagccgggcatrgtggcaagcacctgtaatcccagctactcgagaggctgaggcaggagaattgcttgaacccaggaggcggatgttgcggtgagccaagatggcgccattgcactccagcctgggcaacaagagggaaactccgtctcaaaataaataaattaattaattaaattaaatagcatatattaagatggcagggccaagagtggcggcttgcacctgtgacagcactttcggaggctgaggtgggaggatcacttgaggccaggcgttcaagaccaggctgggcaacatagtgagactccccat

SEQ ID NO: 84418 - DNA, 601 bp, Human
tattaatcccagctacctgggagactgaggaaggaagatcccttgaggccaggagttcaaggctgttaagagccataatgatcatgcctgtgaactgccattgcactccagactgggtaatacagtgaaaccttgactctttaaaaaaaaaaaaaaagggggggggggggctaggtgtggtagctcacgtctgtaaccccaacacggagaggccaagacggaaggaccgctcaagtccaagagttcaagatcagcctgggcaacattgcaaaaaacaaacaaaacgatttctgattcctaraaaaaaaaaaaaaaaatcaaaagatctgatgacaaggaaagatgtcccagtgaaaaaggaaaaagcatcacacaggaaaaacaaaggcagaaaaatgtaaaagaatatgaaagttctttaaaaaaataaaaaataaaaaagacaatctagtacaaatatagtttaaaagatcagatttgattttttttttttttttttgagacggagtctcactctgtcaccaggctggagtgcagtggcgtcatctcggctcaccacaacctctgactccctggttcaagcgattctcctgcctcagcc

SEQ ID NO: 84419 - DNA, 601 bp, Human
ctattaatcccagctacctgggagactgaggaaggaagatcccttgaggccaggagttcaaggctgttaagagccataatgatcatgcctgtgaactgccattgcactccagactgggtaatacagtgaaaccttgactctttaaaaaaaaaaaaaaagggggggggggggctaggtgtggtagctcacgtctgtaaccccaacacggagaggccaagacggaaggaccgctcaagtccaagagttcaagatcagcctgggcaacattgcaaaaaacaaacaaaacgatttctgattcctraaaaaaaaaaaaaaaaatcaaaagatctgatgacaaggaaagatgtcccagtgaaaaaggaaaaagcatcacacaggaaaaacaaaggcagaaaaatgtaaaagaatatgaaagttctttaaaaaaataaaaaataaaaaagacaatctagtacaaatatagtttaaaagatcagatttgattttttttttttttttttgagacggagtctcactctgtcaccaggctggagtgcagtggcgtcatctcggctcaccacaacctctgactccctggttcaagcgattctcctgcctcagc

SEQ ID NO: 84420 - DNA, 601 bp, Human
aattatgcaatagcaggctcatcatatagcttgagaacaccatcagatcccttgacaactctcagaattagatcagaccactgcattctcctagtgggctgcagaagctgagaagcccatctttgccccctcaataaccacagaaaaaagagctcacttctctcacgagttccatggttctattcgagcacaactctgtagtgtggaagcccaaaaaagactcactgaactttttaggttatgtacgtaataaacttcaacagctgtatcttgtactgaatgtatctgaaggtgtccccamaaatttctacgctggaatgtaatcgccaatgtgatagtactaagaagtgggacctttaggaggtgactgagttataagggatcctcccctaggaatatgattaaggtctttataaaacaggcttcatgcagcatccagcctttttttgcccatctcctcttaaagatgtagcaacaaaatgccatttggaaacaagacagcatgtcatcagcaaacactgaacttgtccacactttgatcttaaacttcccagcctctataattgtgagaaataaatttctgtttgttataaatcaccca

SEQ ID NO: 84421 - DNA, 601 bp, Human
ttcaaaatcttggaaaagctttcccagtaaaaattatttagaataatcaatgccatcccttacatgcctttctacataagatagccaaaaacaaaaaccaaacaacataaacaaaaacacgggttttcaactcatcaacataaagccaaaacataaagcatttcaaatgtgatacacaagaatctgttaatcatactatttggtgctttgagagcctatctctgtttttttatttaatcctcctcgccttatagtttacactcttagaacaatccttcattcgcatagcctcaagtttcaytgctggccaggagcagtggctcacacctgtaatcccagcactttgggaggccgaggcgggcagatcacctgaggtcaggagttcgagatcagcctggccaacatggcgaaaccccttctctactaaaaatacaaaaattagccgggcatggtagtgcacctatagtcccagctacttgggaggctgaggcaggagaatcacttgaacctgggaggtggaggttgcagtgagctgagatcctgccactatactccagactgggagacagagcaaaactctgtctcaaaagaaacaaaattt

SEQ ID NO: 84422 - DNA, 601 bp, Human
cacttgaacccagaggcagaggctgcattgagccaaggtcgcaccactggactccagcctgggcgacagagtgagactccgtctcaaaaaaaaagaaaaaaaaaaaaaaaaagacttcgagaccagcctggccaacatggcaaaaccccgtctctactacaaatataaaaaaattagccaggcatggtggcgggcgcctgttatcccagttactccggaggctgaggtaggagaattgctagaaccctgggagtggagtttgcattgagctgagattgtgccactgcactccagcctgggygacagagtgggactccgtctccaaaaaacaaaggagagagtcaatgggtgaggctcctaaatgaaaaagtaaagtaacaccaatagaataccttcctcttctcacccaaaaggcatttaaaagctttgaattgataagataatcaacatatataaacagtatcaatcataataaagagcaaagtataagaacaaagatgacaaactctcaattcatgtgaatcacagaagcaacaatgaaagttacaaagtatgatacttacatgaaacctcaaagtagaaataatgaacacttattatt

SEQ ID NO: 84423 - DNA, 601 bp, Human
tggcaggcgcctgtagtcccagctactcaggaggctgaggcaggagaatcacttgaacccagaggcagaggctgcattgagccaaggtcgcaccactggactccagcctgggcgacagagtgagactccgtctcaaaaaaaaagaaaaaaaaaaaaaaaaagacttcgagaccagcctggccaacatggcaaaaccccgtctctactacaaatataaaaaaattagccaggcatggtggcgggcgcctgttatcccagttactccggaggctgaggtaggagaattgctagaaccctgggrgtggagtttgcattgagctgagattgtgccactgcactccagcctgggcgacagagtgggactccgtctccaaaaaacaaaggagagagtcaatgggtgaggctcctaaatgaaaaagtaaagtaacaccaatagaataccttcctcttctcacccaaaaggcatttaaaagctttgaattgataagataatcaacatatataaacagtatcaatcataataaagagcaaagtataagaacaaagatgacaaactctcaattcatgtgaatcacagaagcaacaatgaaagttacaaagt

SEQ ID NO: 84424 - DNA, 601 bp, Human
aagtaaggccaagtaggctagttcttaaaaacatttatttacatacacccaggaacatttaagcagttcactatcttttgtattaaaacacacaggccagcccatatggctctaaccaagagaacaatttatgtaatgttcttatcttactatattgaaggcactcagctttgttgttttggggttatcttttaagtacaaaaagtgtttcagcctcccttatacagagaaatgaacaaaccctggtattttttcacaggtcgtaagtcaataaggaaaaatgaaaattttttttttttttaatattttgccttaaggatacaacaaagcccaaaaagtacagcacagaaaataattggctaatggtgattgtgcaccattctcaaggccaaatttgttaagaattctgcaatggttaaatctgtactggagtagcactgtccttatcccaacagtgataaaagaattggacaggcacagtagctcacgcctgtaatcccagcactttgggaggccaaagcagatggatcacctgaggtcaggagttcgagaccagcctgaccaacatggagaaaccctgtctctactaaaaatacaatat

SEQ ID NO: 84425 - DNA, 601 bp, Human
taaaacaattttaaatgttttctccattaatctatgatctgaacactgataaaagatattaaatatctgaattacaatcctagtatatccatataaaaataaaggagtctgtattagtttttttgtcctatagaaagaaaaaatagacaataactctactggcaaaaaagggaaacactcaaaagataacaaagaaaagaaatgtgacaataaaataatgagatgtgtttccattatttttcctcctttcctataaaaatcagtccctccccgctggctttatcactcagcagaaatacayacacatctctcacaaacaaagcaaaacaaaagtctcaactttttcttacagcaaaagctcacaacacctacaccgctttccttaatgtctatgatcaggcttccgtcactacttcactggaagtccatactgtcatcccctggccgcccagtttccaagccaagaaaacattttccgcacatcaactttttaaaaagcatgacacatttattccttttacttgagatggcttttggattttcaaggtaccactccccactcttgtccttagccttccctacaaccccatggatgttggtg

SEQ ID NO: 84426 - DNA, 601 bp, Human
gtgtcactctgtcacccaggctggagtgcagtggcatgatcttggcttactgcaagctccacatcccaggttcatgccactctcctgcctcagcctcccgagtagctgggactacagtcacccgccaccacgcctggctaattttttgtatttttagtagagacagggtttcactgtgttagccaggatggtctcgatctcctgaccttgtgatccgcccgcctcagcctcccgaagtgctgggattacaggcgtgagccacagcgcctggcccataatgacgtttttctttacctgtttrtgggtggggagaaagaaacaaaatctccttgtggactatacatttgttcatgcctttatttaaatccaaccttaatatccccaattaaacttcctagcttttatccttcacaaacatatcctccagagaagtggtttccaaacctggttgattatcagactcaaagccactgaatcagaatctctagaagatgagcccaaggatctatatttttaccaagttgtagtggttattctaagaggcagcacccttgggagtcttggcttgacctttttttaatgtttaaatttaaaaaatttt

SEQ ID NO: 84427 - DNA, 601 bp, Human
tcactgtgttagccaggatggtctcgatctcctgaccttgtgatccgcccgcctcagcctcccgaagtgctgggattacaggcgtgagccacagcgcctggcccataatgacgtttttctttacctgtttatgggtggggagaaagaaacaaaatctccttgtggactatacatttgttcatgcctttatttaaatccaaccttaatatccccaattaaacttcctagcttttatccttcacaaacatatcctccagagaagtggtttccaaacctggttgattatcagactcaaagccaytgaatcagaatctctagaagatgagcccaaggatctatatttttaccaagttgtagtggttattctaagaggcagcacccttgggagtcttggcttgacctttttttaatgtttaaatttaaaaaatttttagagtcaggttcttgctctgtcacccaggctggagtgcagtgacacaatcatagctcactggagccttgaactcctgagagccttggctttagagcaatgcagaattagaggaaaagctaattgtgtcttcccaagtaaaagtgaagctagaatgacacaaagttctag

SEQ ID NO: 84428 - DNA, 601 bp, Human
ttaaaaaatttttagagtcaggttcttgctctgtcacccaggctggagtgcagtgacacaatcatagctcactggagccttgaactcctgagagccttggctttagagcaatgcagaattagaggaaaagctaattgtgtcttcccaagtaaaagtgaagctagaatgacacaaagttctagctatagctttgcattgggttacataaaaagatggtgggcaattagggcttggatatccgcctgtcatttatccattcaattgacattttctgagcaccttctatgtgctagacatgggrcacctcagtgtggaggacaccgtccctgtcctgagagagtctagagtccagcagagaggattgagtaataaaccagaaataatacaaatgattcattataattgccataagtgctatgaagaagaaatgtaagaccatatgagtgcatattatgacacgactgacctggggctcattttcaatggggaagatgaggttcaaggaaggctttcctgaggaggtgctatttaagctgagacagcgagatgatgaaccggaatggaagtatgacagatgaaatgtggggcttcactgcctcat

SEQ ID NO: 84429 - DNA, 601 bp, Human
gtgacacaatcatagctcactggagccttgaactcctgagagccttggctttagagcaatgcagaattagaggaaaagctaattgtgtcttcccaagtaaaagtgaagctagaatgacacaaagttctagctatagctttgcattgggttacataaaaagatggtgggcaattagggcttggatatccgcctgtcatttatccattcaattgacattttctgagcaccttctatgtgctagacatggggcacctcagtgtggaggacaccgtccctgtcctgagagagtctagagtccagsagagaggattgagtaataaaccagaaataatacaaatgattcattataattgccataagtgctatgaagaagaaatgtaagaccatatgagtgcatattatgacacgactgacctggggctcattttcaatggggaagatgaggttcaaggaaggctttcctgaggaggtgctatttaagctgagacagcgagatgatgaaccggaatggaagtatgacagatgaaatgtggggcttcactgcctcatggtgccccatgaaaaggacaacactggacaagggaaaccatcaaaatggtct

SEQ ID NO: 84430 - DNA, 601 bp, Human
ctcctcaataatgagtccaagctgggcacagtggctcatgcctgtaatctttgggaggccaaggagggcagatcacctgaggtcaggagttcaagaccagcctgaccaacatggtgaaaccccatctctactaaaaatacaaagaaattagccaggcatggaggcacacacctataatcccagctgcttgagaggctaaggcatgagaatggcttacacccgggaggtggaggttgcagtgagctgagatcatgccactgcactccagcctgggcaacagagtgaggctccatctccaagaaaaaaaaaaaaaaagtccctcccaggtctgcacaggttcaagaagaaaaccatccacctgttccatccccagcctggccatccctgctgtcccctccctggcagaagcagcagcagtccattctgagaaacaggggtatagcatggaaaccaagggaaagaaaagccccccacccacccccagagcccagctgccactttagcctgttgactggggctggtagacacctccaccatgccctcagtggctgggggaggaagtcctttttactactgggagaatctctcactcaaacaaagt

SEQ ID NO: 84431 - DNA, 601 bp, Human
gccatccctgctgtcccctccctggcagaagcagcagcagtccattctgagaaacaggggtatagcatggaaaccaagggaaagaaaagccccccacccacccccagagcccagctgccactttagcctgttgactggggctggtagacacctccaccatgccctcagtggctgggggaggaagtcctttttactactgggagaatctctcactcaaacaaagtcttacccagaaatgtacacaatggaaacagaaatgcaggatgaatgtagctgagcctgggaaaccagcctgcttacygcccaccccgctgtgatgggccctaaaacagggtgcagacagaacagaatttgcaaacctctaagctgtggcaagacaggcaatctttctgagaaggtgacttgggattactggctgggacaagagttaccactgaaatgtgagaacaatggtctgatagccaccttgtctgggaatagcttggctggactgaccaccttacagatgagaagtgattatactggttggaaggtctcaaggttgcaagaaggtgggagctggctctctaaccccagaagctgtgggggctttgataaaggc

SEQ ID NO: 84432 - DNA, 601 bp, Human
accactgaaatgtgagaacaatggtctgatagccaccttgtctgggaatagcttggctggactgaccaccttacagatgagaagtgattatactggttggaaggtctcaaggttgcaagaaggtgggagctggctctctaaccccagaagctgtgggggctttgataaaggccctcctcttgtcacctcccttcccctcaggctctgctgccatctgggctttcccccttagcactgtttataccttaaagaatgagcttgctgggtgcagcgccccatacctataatcctagcactttgrgaggctgaggtgggaagattacctgagcccaggaggtcaaggctgccatgagccatgattgcaccattgcactccagcctgggtgacagatcgagaccctgtctcagagagagagggtggtgagctaaggactcctatacaattgtctccttcccccaagatcttcagaaagaagcagaaagaatctggtttgatataaatgggctccgtgtcccacacatatacccctatacctacacatacatgcccacatccactcacacacatccacacatacctatgtgtgcacacacatacaca

SEQ ID NO: 84433 - DNA, 601 bp, Human
agtgcgggcaccctgggaaagaggggaggccagacagccactttcccctttgtttgcttctgttgtttaaacagttttaaatgagcatcgtcaattgccctggaggtacttgcagctaattgagggagactaatgggtcagcagatgaaatgcaatacaaacagaaagggattataccagttgagatggctagtttccacctgcctcaaacctcttaattccttccccctctacccgttttcattctttcttcaaagagaaaataattttcttccctcccacaaatctgccattctttttstctttacccccatctccccaaccaaaaaaataaaaacaattatacatgggcacgtggatgcacacagcacacaaacacacagttgtaataaactggtcactatttatcttccattgagttgctgaccttagaagatgttatcctcccacccccatttttgcttgtttggcttggctggattatttatttgcagtgacaaatattaagctagagcaaaatttagtaatccacaataaaacatcattgaagccaggtgcagtggcaggagcctgtggtcccagctactcagagaggctgagg

SEQ ID NO: 84434 - DNA, 551 bp, Human
ttatcttccattgagttgctgaccttagaagatgttatcctcccacccccatttttgcttgtttggcttggctggattatttatttgcagtgacaaatattaagctagagcaaaatttagtaatccacaataaaacatcattgaagccaggtgcagtggcaggagcctgtggtcccagctactcagagaggctgaggcaggaaggtccattgagcccgggaggtagaggctgtagtgacccttgattgtgccactgcactccaccctgggtgacagagtgagaccctcatctctaaaaaamaaaagcaaaaaaaattattgaataaggattttgaattttgagtgacaatgctgtttacctcctctcatgatcagggtagcattctactctgttgagctttccttagcttttttctaagaaagtcaacatccttcaagtcaacttctgggaccagaaaacaaggcaatgggtccttcacctgagcgagaatcccaagcactcacagtccctgctcccgcttccttttctctcccttcccttcccttccctt

SEQ ID NO: 84435 - DNA, 601 bp, Human
caggagacaaagttatatctaggctggggtgtggcttgcaccaggaactctggtgaggatccctggggttcatccagagacctcaagaacaaatgatgccggctggttccagtcctctgcagttcgtctgtaaccagagcttaattgatacaccgaggtttccgtggaactcaatgtacagctgagacagacccacctcctaagtaggccttggcaagggaggaacaggaaagaagcggtctgggagagacactggctgaagggtcaagagcatggcttccgggcctgctggtgcccctckctggatgatggccttgggccagctgggttcccctcagcaaccacaaggggaggtgggattggatcaggggctgctaatttgcagctcccagtcgccttccaggtggcatacctggtttttcaagagcctggatggtgttcgaaagtcaaggaatttcacaagaaaatccagattcccagcctctcgaaaaaatgaaacgatacggcaacattgagcccatatttcctgcaggataaacagtgggtgtagctaccccaataaatgaagcaggtgttctctggctcccacagttttcactac

SEQ ID NO: 84436 - DNA, 601 bp, Human
acaaaggtaggaagatcacttgagcccaggagtttgagaccagcctgggcaacatagcaagaccttgcctctaaaaaaaaaaaatttgttttaattacctgggcatactggtgcacacctgtaatctcagctataagggaggctgaggagggaggatcccttgagcctaaatgttcaagcctgcagtgagccatgatcacacgactgtacttcagcctgggtgagagaacaagaccctgtctttaaaaataaaaaaagtgagctcatcagaaagatacttctggatgacatttagtgagarctaccatgcacacacacaccttacatgtatcaattcatttcatgctcacaacttcatgaagttgatattattataaagaaagcaaagcatctgagaggttaagtaacttgcatgatgccaaacagcagaaaaatagcaaagattggatttgacctgagtagcctgccttcaggaactctgccattagcttttatgctataagctccatggatattgtggtagcttatgatccatgaagatccaacatggaggggttgggcttgagaataggaacacagggactgtgtttatttctctctg

SEQ ID NO: 84437 - DNA, 601 bp, Human
gaggagggaggatcccttgagcctaaatgttcaagcctgcagtgagccatgatcacacgactgtacttcagcctgggtgagagaacaagaccctgtctttaaaaataaaaaaagtgagctcatcagaaagatacttctggatgacatttagtgagaactaccatgcacacacacaccttacatgtatcaattcatttcatgctcacaacttcatgaagttgatattattataaagaaagcaaagcatctgagaggttaagtaacttgcatgatgccaaacagcagaaaaatagcaaagatkggatttgacctgagtagcctgccttcaggaactctgccattagcttttatgctataagctccatggatattgtggtagcttatgatccatgaagatccaacatggaggggttgggcttgagaataggaacacagggactgtgtttatttctctctgtttcttgacaactcctctaattttcccacttatctttgtgttggcacccacatgatggaaaatgaccacccaactactgcagccccagctcagccccatctccatatctcagttagtctaaattcttaatacatcggccaggtg

SEQ ID NO: 84438 - DNA, 601 bp, Human
gatcccttgagcctaaatgttcaagcctgcagtgagccatgatcacacgactgtacttcagcctgggtgagagaacaagaccctgtctttaaaaataaaaaaagtgagctcatcagaaagatacttctggatgacatttagtgagaactaccatgcacacacacaccttacatgtatcaattcatttcatgctcacaacttcatgaagttgatattattataaagaaagcaaagcatctgagaggttaagtaacttgcatgatgccaaacagcagaaaaatagcaaagattggatttgacytgagtagcctgccttcaggaactctgccattagcttttatgctataagctccatggatattgtggtagcttatgatccatgaagatccaacatggaggggttgggcttgagaataggaacacagggactgtgtttatttctctctgtttcttgacaactcctctaattttcccacttatctttgtgttggcacccacatgatggaaaatgaccacccaactactgcagccccagctcagccccatctccatatctcagttagtctaaattcttaatacatcggccaggtgtggctcatgc

SEQ ID NO: 84439 - DNA, 601 bp, Human
acttcagcctgggtgagagaacaagaccctgtctttaaaaataaaaaaagtgagctcatcagaaagatacttctggatgacatttagtgagaactaccatgcacacacacaccttacatgtatcaattcatttcatgctcacaacttcatgaagttgatattattataaagaaagcaaagcatctgagaggttaagtaacttgcatgatgccaaacagcagaaaaatagcaaagattggatttgacctgagtagcctgccttcaggaactctgccattagcttttatgctataagctccayggatattgtggtagcttatgatccatgaagatccaacatggaggggttgggcttgagaataggaacacagggactgtgtttatttctctctgtttcttgacaactcctctaattttcccacttatctttgtgttggcacccacatgatggaaaatgaccacccaactactgcagccccagctcagccccatctccatatctcagttagtctaaattcttaatacatcggccaggtgtggctcatgcctataatcccagcattttggaaagccaaggtgggaggatcacttgaggtcagga

SEQ ID NO: 84440 - DNA, 601 bp, Human
gagctcatcagaaagatacttctggatgacatttagtgagaactaccatgcacacacacaccttacatgtatcaattcatttcatgctcacaacttcatgaagttgatattattataaagaaagcaaagcatctgagaggttaagtaacttgcatgatgccaaacagcagaaaaatagcaaagattggatttgacctgagtagcctgccttcaggaactctgccattagcttttatgctataagctccatggatattgtggtagcttatgatccatgaagatccaacatggaggggttggrcttgagaataggaacacagggactgtgtttatttctctctgtttcttgacaactcctctaattttcccacttatctttgtgttggcacccacatgatggaaaatgaccacccaactactgcagccccagctcagccccatctccatatctcagttagtctaaattcttaatacatcggccaggtgtggctcatgcctataatcccagcattttggaaagccaaggtgggaggatcacttgaggtcaggagtttgagaccagcctggccaacatggtgaaaccctgtctctaccaaaaata

SEQ ID NO: 84441 - DNA, 601 bp, Human
cctgaaaattcaaaagttctggcaagaacgaccctccactgttttgtagcaccaaacagctgagtaatacttgctcttttggctgagtcatggtccagttcaccatcgtcctatcaagaggcagtttagtgcaatggttaagagcatggactttgaagctagatctaaatgagttggagtactggctcagccaattattgacagcatagtcttggacaagttccttaaccaatctgcatctcagtttccacatctgcgaaatgaggatgatgaaaatatacatacctgcctcatagggctgttggtagaattcaatgagttagttcacataaagttcttacgacagtgcttggcaacacaggaagtgccccataaatgcttgttgccattgtgcctattatcatattacctcaactaccctgctcatgtacattacctgtacatacttgagattgcaatcaatcaattacaaatgtcaatgtttaatgaagaacagggtacaatggcagtatggctgggtcgactgacttaatctggaagttggggagcagttcttgagtgaatgaatgacctgtggaccagatccaggctggagatatgc

SEQ ID NO: 84442 - DNA, 601 bp, Human
ttcagattccccacgcctgtctgcaggcagcatctccaaggaagcgccaccacggacacctggctgtccgcaccgcggtggggtcccggcgcgttggtgccaagtttcctgtaccccgccttcctacccacctctcgggaggcccggatactgagcccctcactgcactggtgaactagaacaggcctctggactcagcatctctacgctgagacctcaggatcaggtccaccgcagccccaggttctcgacccggaagctgagccttcccacgctccacacccacggctagaaccacccsgggggaagccgctctcctcccccacttacgcgcctcgggcagcgcgcggtgcacacagggagctcgatctaggctatggacaaggggaagagatcttagatggaggccgcgcagaggagaatgggaagggtgcgcgagcgtctctgggaagaaggtccgaacccacgcccagcgccggaggggaaaaaaaaaaacacagaccagagaaggaaccgtaaatcaagtcggaggggaaaagagccgcaaagccttctgcggcagccgtaaagcaacctggaggcgcggtgctggcttttacgt

SEQ ID NO: 84443 - DNA, 601 bp, Human
tttaaaaaacactcccagaggggcgcagtggctcacgcctgtaatcccaacactttgggaggccaaggcgggaggatcacctgaggtagggagttcgagaccagcgtaaccaacatggagaaaccccttctctactaaaaatacaaaattagccgggtgtggtggtgcacacctgtaatcccagctactcgggaggctgaggcaggagaatcgcttgaatccaggaggcagaagtggcagtgagtcaagatctcgccactgcagtccagcctgggcaacaagagcgaaactctgtccccccaaaaaacaacagacaaacaaaaaaacaaaactcccgcccaggtgtggtggctcacacctgtaatcccagcactttgggaggccgaggcgggtggatcacctgaggtcaggagtttgagaccagcattgccaacacggtgaaaccctgtctctactaaaaataccaaaaattagcccggcatagtggcatgcgcctgtaagcccagttaccgaggaggctgagagaaactctgtccccccaaaaaacaacagacaaacaaaaaaacaaaactcccacccaggcgcggtggctcacacctgt

SEQ ID NO: 84444 - DNA, 601 bp, Human
aagatttgagcaggcacttcacaaaggaagatgcacattgtcatgggcacaggaaaaagtgctaaacaccattagtgactgaggactaaaattaagaccatgacacaccacacccatcagaataactcaaaagactgacaacaccaaatgctggcaaggatgtaaagcaactggaactctcatacactgttggcaggaaacaggctgataaaaccactcagctgttaatgcacactactcttcatgaaaaccaaaggccgactccaaggacggagccacacgtccagggagtagagcagcrgaggcccaatcccaggcctggagccctactggttttttgagacgaagtcttgttcagtcgcccaggctggagtgcagtggcacaatctcggctcactgcaacctccatcttcctgactgaagcaattctccagcctcagcctcccgagtaactgggactacaggcacgtgccatcacgcccagctaattctaattcttgtatttttagtagagatggggtttcactatattgctcaggctggtctcgaactcctgagctcaagtgatccccccgcctcggcctcccaaagtgccaggatt

SEQ ID NO: 84445 - DNA, 601 bp, Human
caccattcacctaaactagaaatgggtgataggcttaaacataaaactaaaactataaaatttataggccgggcacggtggctcacgcctataatcccagcatgttgggagaccgaggcgggtggatcacaaggtcaagagttcaagaccaacctggccaacctggtgaaaccctgtctctaataaaaatacaaaaattagttgggcatggtggcgcatgtctgtaatcccagctactcgggaggctggggcaggagaatcgcttgaacctgggaggcagaggttgcagtgagcggagatygccatcaccgcactccagcctggacgacagagcaagactctgtctcaaaaaaaaaaaaaacttacagaagaaaacatgaaagattatcttcacagcctgaaggtagccaagatttcctaggactcagaaagcagtaactataaaagaaaatataagagaaaactgattacatcaaaatgtaaaacttctgttcatcagacaactctaagaaaatgaataggcaaccagacagaggacaggtaaccaggatataaaggttatataaataactgctacaactcaataataaaaagacacaca

SEQ ID NO: 84446 - DNA, 601 bp, Human
caaattgatccatagattcaatgcaatcccaatcacaactttaccagacttttctgtaaaactggtaaagataattctgatatttatatggaaatgcagaggatttagaatattcacatcaagcttgaaaacaacaaaattggaagacctacaactacatgacttcaagacttactaaaaagctacagtaattaaaagtgtggtactaacacaaggattgaacaatggaacagaaaagggagtgcagacatcaattaccatttgtacagtcatcttaatttccaaaacgcaatacaatagyattttcaacaaatggtgctggaatgactggatatctatatggaaaagaaattaatatttaattatatctcacaccattcacctaaactagaaatgggtgataggcttaaacataaaactaaaactataaaatttataggccgggcacggtggctcacgcctataatcccagcatgttgggagaccgaggcgggtggatcacaaggtcaagagttcaagaccaacctggccaacctggtgaaaccctgtctctaataaaaatacaaaaattagttgggcatggtggcgcatgtctgtaatc

SEQ ID NO: 84447 - DNA, 601 bp, Human
tcttgaactaggaatctcaaaaatcatcctgaatgactgtcactcctgctcacgaaatgcaaacttcgagaaaaaaaaaagattgaaaagaatgaaagaacctcaggatcctgtgggctaatatcaaaatgtctaactcacatacaattgaagtgaaattgaactcacatacagaagaagtgaaagagaatggaacagaagaaatatttttaaaactaatagctccaaatttcccaaattggccgacagacataaatttacagatttaagaagctctgcaaatctcaagaataaatctccrgataaatacaaataaaatgacacctagatacaccacagacaaactgctaaaaaacaaaaataaagagaaaatcttgaaagcaggtagagaatgataacacattacatacagagtaatgaatgatgcaaatgatggctccattttacaataaaggtaagaaacatatctagaaatcaatttaacaaaatatgtataagacttctgaactgaaaaccataaaacagaactaaaagaattttttttttttgagacagagtttcactcttgttgcccaggctggagtgcaatggcaccatctcg

SEQ ID NO: 84448 - DNA, 601 bp, Human
agaatattattaggacaatgggagaaatctgatgatgggatgaatatgagactgcagccacaacctcctgggctcaggtgatccttctgcctcagcctcccgagtagcttagactacaggtgtgcaccaccacagctggttagtgtgataattatatcgtgattctgtaggacaatggcctatcactagatgtatgattttgtatgatgcaatattggagtaaagtgtcatgttttctgcaacttactctcaattcattcaactaattgtgtgtgtgtgtgtgtgtgtgtgtgtgtgtgtggagagagagaaaaaggcaagtagataaagcaaaagtacaaatttatgaacctaggtgaaggatatgcagacattaattgtaaattttttttttgagacagtctcgctgtgccacccagtgcagtgaggcgatcatggctcaccgtaccctcaaactccttggctcgtgatcttcccacctcagcctcctaagtagctgggactacagttgtataacgccacacacggcatattttttattttttgtagagacacgggtctcactatgttgtccaggctggtctcaaactcctgggctcaa

SEQ ID NO: 84449 - DNA, 601 bp, Human
aggcttgaaaactcaccctttgttgtcaaactttcctttcctgtctcccttccccgctcctctactgtgtaaaggactaatctccaaataaactacttgggaataaaaaggagggcggcaaaagatgcctttacaatgtagaaacctgggagttaccaccttaattattaaggaatcaaacttaatgtcaccaattacagtcacatcatgtgcttcctgatggacgcactaagaaggtcccatcattgaggtagtatttctaccaacctaatcatcaggaaacaatcaaacaagttgaaawctacaaagcaactggcctggactctccaaagcatcagtgtctcaaaaagcaaaacaaaatagaatggctggtgaactcttttatgttaaaagaggcttaaggctgggtgtggtggcccacgcctgtaatcccagcactttgggaggccaaggcgggtggatcatctgagctcaggagttcaagaccagcctggccaacatggtacaattcccgtctctactaaaaatataaaaagtagctgggcatggtggcacacacctgtagtcccagcaacacgggaggctgaagcaggataatcac

SEQ ID NO: 84450 - DNA, 601 bp, Human
ggaaacaagagtgaaactccgtctcaaaaaaataaataaataaataaataaataaataaataaataactagagacggggtttcaccatgttggccagcctgatctcgaactcctgacctcaagtgatccacccgcctcaggtgtgagccaccatgccagaacacttctcacatttaaagagcaacttgtggccgggcacggtggctcacacttgtaatcccagcactttgggaggcccaggcaggtggataacctgaggtcaggagttcaagacgagcctggtcaacatggtgaaaccccrtctctactaaaaatacaaaacttagccagatgcagtggcgcgtgcctgtagtcccagctactcggggggctgaggctggagaattgcttgtacccgggaggcggaggttgcagtgagccgagaccacaccactgcattccagcctgggcaatggagcaagactctttctcaaaaaacaaaacaaaacaaacaaaaaaaattcagtcttttattgaaggacaatcttatctttgtccataaagtaaatgtgaaatattttttgccttttttgctcttttactttgaaaaagatgtcttact

SEQ ID NO: 84451 - DNA, 601 bp, Human
aattctttatgggaaagcaaacaaaaaatgtactataggtggaacattgctaatccaaaaatccaaaattcaaaatgctccaaaatccaaaacgttttgagtgccaacatgatgtgttatagtcaaaacacaggtaatggccaggcatggtggctcaaacctataatcctaccaccttgggaggccaaggcagaaggactgcttgagcccaggagtttgagactagcctagacaacaaaaccccatcactacaaaaaatttaaaaattagccaggcgtggtgctatgctacttaggaggcygatgtgggaggatcgcttgagctcaggagtttgaggctgcagtgagctatgaccaccccatcgcactccagcctgggtgacagagtgtctgactctgtctcaaaaaaaaaaaaaaacaaaaaaaaaggcaggcacacaacacacagtttattcagcttctccaagagaaaaattcaattatcagccagacgcagtcactgacacctataatcccagcactttgggaggctgaggcgggcggatcacctgaggtcaggagttcgagaccagcctggccaacatggtgaaatgtctttataa

SEQ ID NO: 84452 - DNA, 601 bp, Human; identical to SEQ ID NO: 26178

SEQ ID NO: 84453 - DNA, 601 bp, Human; identical to SEQ ID NO: 26179

SEQ ID NO: 84454 - DNA, 601 bp, Human; identical to SEQ ID NO: 26180

SEQ ID NO: 84455 - DNA, 601 bp, Human; identical to SEQ ID NO: 26181

SEQ ID NO: 84456 - DNA, 601 bp, Human; identical to SEQ ID NO: 26182

SEQ ID NO: 84457 - DNA, 601 bp, Human; identical to SEQ ID NO: 26183

SEQ ID NO: 84458 - DNA, 601 bp, Human; identical to SEQ ID NO: 26184

SEQ ID NO: 84459 - DNA, 601 bp, Human; identical to SEQ ID NO: 26185

SEQ ID NO: 84460 - DNA, 601 bp, Human; identical to SEQ ID NO: 26186

SEQ ID NO: 84461 - DNA, 601 bp, Human; identical to SEQ ID NO: 26187

SEQ ID NO: 84462 - DNA, 601 bp, Human; identical to SEQ ID NO: 26188

SEQ ID NO: 84463 - DNA, 601 bp, Human; identical to SEQ ID NO: 26189

SEQ ID NO: 84464 - DNA, 601 bp, Human; identical to SEQ ID NO: 26190

SEQ ID NO: 84465 - DNA, 601 bp, Human; identical to SEQ ID NO: 26191

SEQ ID NO: 84466 - DNA, 601 bp, Human; identical to SEQ ID NO: 26192

SEQ ID NO: 84467 - DNA, 601 bp, Human; identical to SEQ ID NO: 26193

SEQ ID NO: 84468 - DNA, 601 bp, Human; identical to SEQ ID NO: 26194

SEQ ID NO: 84469 - DNA, 601 bp, Human; identical to SEQ ID NO: 26195

SEQ ID NO: 84470 - DNA, 601 bp, Human; identical to SEQ ID NO: 26196

SEQ ID NO: 84471 - DNA, 601 bp, Human; identical to SEQ ID NO: 26197

SEQ ID NO: 84472 - DNA, 601 bp, Human; identical to SEQ ID NO: 26198

SEQ ID NO: 84473 - DNA, 601 bp, Human; identical to SEQ ID NO: 26199

SEQ ID NO: 84474 - DNA, 601 bp, Human; identical to SEQ ID NO: 26200

SEQ ID NO: 84475 - DNA, 601 bp, Human; identical to SEQ ID NO: 26201

SEQ ID NO: 84476 - DNA, 601 bp, Human; identical to SEQ ID NO: 26202

SEQ ID NO: 84477 - DNA, 601 bp, Human; identical to SEQ ID NO: 26203

SEQ ID NO: 84478 - DNA, 601 bp, Human; identical to SEQ ID NO: 26204

SEQ ID NO: 84479 - DNA, 601 bp, Human; identical to SEQ ID NO: 26205

SEQ ID NO: 84480 - DNA, 601 bp, Human; identical to SEQ ID NO: 26206

SEQ ID NO: 84481 - DNA, 601 bp, Human; identical to SEQ ID NO: 26207

SEQ ID NO: 84482 - DNA, 601 bp, Human; identical to SEQ ID NO: 26208

SEQ ID NO: 84483 - DNA, 601 bp, Human; identical to SEQ ID NO: 26209

SEQ ID NO: 84484 - DNA, 601 bp, Human; identical to SEQ ID NO: 26210

SEQ ID NO: 84485 - DNA, 601 bp, Human; identical to SEQ ID NO: 31521

SEQ ID NO: 84486 - DNA, 601 bp, Human; identical to SEQ ID NO: 31522

SEQ ID NO: 84487 - DNA, 601 bp, Human; identical to SEQ ID NO: 31523

SEQ ID NO: 84488 - DNA, 601 bp, Human; identical to SEQ ID NO: 31524

SEQ ID NO: 84489 - DNA, 601 bp, Human; identical to SEQ ID NO: 31525

SEQ ID NO: 84490 - DNA, 601 bp, Human; identical to SEQ ID NO: 31526

SEQ ID NO: 84491 - DNA, 601 bp, Human; identical to SEQ ID NO: 31527

SEQ ID NO: 84492 - DNA, 601 bp, Human; identical to SEQ ID NO: 31528

SEQ ID NO: 84493 - DNA, 601 bp, Human; identical to SEQ ID NO: 31529

SEQ ID NO: 84494 - DNA, 601 bp, Human; identical to SEQ ID NO: 31530

SEQ ID NO: 84495 - DNA, 601 bp, Human; identical to SEQ ID NO: 31531

SEQ ID NO: 84496 - DNA, 601 bp, Human; identical to SEQ ID NO: 31532

SEQ ID NO: 84497 - DNA, 601 bp, Human; identical to SEQ ID NO: 31533

SEQ ID NO: 84498 - DNA, 601 bp, Human; identical to SEQ ID NO: 31534

SEQ ID NO: 84499 - DNA, 601 bp, Human; identical to SEQ ID NO: 31535

SEQ ID NO: 84500 - DNA, 601 bp, Human; identical to SEQ ID NO: 31536

SEQ ID NO: 84501 - DNA, 601 bp, Human; identical to SEQ ID NO: 31537

SEQ ID NO: 84502 - DNA, 601 bp, Human; identical to SEQ ID NO: 31538

SEQ ID NO: 84503 - DNA, 601 bp, Human; identical to SEQ ID NO: 31539

SEQ ID NO: 84504 - DNA, 601 bp, Human; identical to SEQ ID NO: 31540

SEQ ID NO: 84505 - DNA, 601 bp, Human; identical to SEQ ID NO: 31541

SEQ ID NO: 84506 - DNA, 601 bp, Human; identical to SEQ ID NO: 31542

SEQ ID NO: 84507 - DNA, 601 bp, Human; identical to SEQ ID NO: 31543

SEQ ID NO: 84508 - DNA, 601 bp, Human; identical to SEQ ID NO: 31544

SEQ ID NO: 84509 - DNA, 601 bp, Human; identical to SEQ ID NO: 31545

SEQ ID NO: 84510 - DNA, 601 bp, Human; identical to SEQ ID NO: 31546

SEQ ID NO: 84511 - DNA, 601 bp, Human; identical to SEQ ID NO: 31547

SEQ ID NO: 84512 - DNA, 601 bp, Human; identical to SEQ ID NO: 31548

SEQ ID NO: 84513 - DNA, 601 bp, Human; identical to SEQ ID NO: 31549

SEQ ID NO: 84514 - DNA, 601 bp, Human; identical to SEQ ID NO: 31550

SEQ ID NO: 84515 - DNA, 601 bp, Human; identical to SEQ ID NO: 31551

SEQ ID NO: 84516 - DNA, 601 bp, Human; identical to SEQ ID NO: 31552

SEQ ID NO: 84517 - DNA, 601 bp, Human; identical to SEQ ID NO: 31553

SEQ ID NO: 84518 - DNA, 601 bp, Human; identical to SEQ ID NO: 31554

SEQ ID NO: 84519 - DNA, 601 bp, Human; identical to SEQ ID NO: 31555

SEQ ID NO: 84520 - DNA, 601 bp, Human; identical to SEQ ID NO: 31556

SEQ ID NO: 84521 - DNA, 601 bp, Human; identical to SEQ ID NO: 31557

SEQ ID NO: 84522 - DNA, 601 bp, Human; identical to SEQ ID NO: 31558

SEQ ID NO: 84523 - DNA, 601 bp, Human; identical to SEQ ID NO: 31559

SEQ ID NO: 84524 - DNA, 601 bp, Human; identical to SEQ ID NO: 31560

SEQ ID NO: 84525 - DNA, 601 bp, Human; identical to SEQ ID NO: 31561

SEQ ID NO: 84526 - DNA, 601 bp, Human; identical to SEQ ID NO: 31562

SEQ ID NO: 84527 - DNA, 601 bp, Human; identical to SEQ ID NO: 31563

SEQ ID NO: 84528 - DNA, 601 bp, Human; identical to SEQ ID NO: 31564

SEQ ID NO: 84529 - DNA, 601 bp, Human; identical to SEQ ID NO: 31565

SEQ ID NO: 84530 - DNA, 601 bp, Human; identical to SEQ ID NO: 31566

SEQ ID NO: 84531 - DNA, 601 bp, Human; identical to SEQ ID NO: 31567

SEQ ID NO: 84532 - DNA, 601 bp, Human; identical to SEQ ID NO: 31568

SEQ ID NO: 84533 - DNA, 601 bp, Human; identical to SEQ ID NO: 31569

SEQ ID NO: 84534 - DNA, 601 bp, Human; identical to SEQ ID NO: 31570

SEQ ID NO: 84535 - DNA, 601 bp, Human; identical to SEQ ID NO: 31571

SEQ ID NO: 84536 - DNA, 601 bp, Human; identical to SEQ ID NO: 31572

SEQ ID NO: 84537 - DNA, 601 bp, Human; identical to SEQ ID NO: 31573

SEQ ID NO: 84538 - DNA, 601 bp, Human; identical to SEQ ID NO: 31574

SEQ ID NO: 84539 - DNA, 601 bp, Human; identical to SEQ ID NO: 31575

SEQ ID NO: 84540 - DNA, 601 bp, Human; identical to SEQ ID NO: 31576

SEQ ID NO: 84541 - DNA, 601 bp, Human; identical to SEQ ID NO: 31577

SEQ ID NO: 84542 - DNA, 601 bp, Human; identical to SEQ ID NO: 31578

SEQ ID NO: 84543 - DNA, 601 bp, Human; identical to SEQ ID NO: 31579

SEQ ID NO: 84544 - DNA, 601 bp, Human; identical to SEQ ID NO: 31580

SEQ ID NO: 84545 - DNA, 601 bp, Human; identical to SEQ ID NO: 31581

SEQ ID NO: 84546 - DNA, 601 bp, Human; identical to SEQ ID NO: 31521

SEQ ID NO: 84547 - DNA, 601 bp, Human; identical to SEQ ID NO: 31522

SEQ ID NO: 84548 - DNA, 601 bp, Human; identical to SEQ ID NO: 31523

SEQ ID NO: 84549 - DNA, 601 bp, Human; identical to SEQ ID NO: 31524

SEQ ID NO: 84550 - DNA, 601 bp, Human; identical to SEQ ID NO: 31525

SEQ ID NO: 84551 - DNA, 601 bp, Human; identical to SEQ ID NO: 31526

SEQ ID NO: 84552 - DNA, 601 bp, Human; identical to SEQ ID NO: 31527

SEQ ID NO: 84553 - DNA, 601 bp, Human; identical to SEQ ID NO: 31528

SEQ ID NO: 84554 - DNA, 601 bp, Human; identical to SEQ ID NO: 31529

SEQ ID NO: 84555 - DNA, 601 bp, Human; identical to SEQ ID NO: 31530

SEQ ID NO: 84556 - DNA, 601 bp, Human; identical to SEQ ID NO: 31531

SEQ ID NO: 84557 - DNA, 601 bp, Human; identical to SEQ ID NO: 31532

SEQ ID NO: 84558 - DNA, 601 bp, Human; identical to SEQ ID NO: 31533

SEQ ID NO: 84559 - DNA, 601 bp, Human; identical to SEQ ID NO: 31534

SEQ ID NO: 84560 - DNA, 601 bp, Human; identical to SEQ ID NO: 31535

SEQ ID NO: 84561 - DNA, 601 bp, Human; identical to SEQ ID NO: 31536

SEQ ID NO: 84562 - DNA, 601 bp, Human; identical to SEQ ID NO: 31537

SEQ ID NO: 84563 - DNA, 601 bp, Human; identical to SEQ ID NO: 31538

SEQ ID NO: 84564 - DNA, 601 bp, Human; identical to SEQ ID NO: 31539

SEQ ID NO: 84565 - DNA, 601 bp, Human; identical to SEQ ID NO: 31540

SEQ ID NO: 84566 - DNA, 601 bp, Human; identical to SEQ ID NO: 31541

SEQ ID NO: 84567 - DNA, 601 bp, Human; identical to SEQ ID NO: 31542

SEQ ID NO: 84568 - DNA, 601 bp, Human; identical to SEQ ID NO: 31543

SEQ ID NO: 84569 - DNA, 601 bp, Human; identical to SEQ ID NO: 31544

SEQ ID NO: 84570 - DNA, 601 bp, Human; identical to SEQ ID NO: 31545

SEQ ID NO: 84571 - DNA, 601 bp, Human; identical to SEQ ID NO: 31546

SEQ ID NO: 84572 - DNA, 601 bp, Human; identical to SEQ ID NO: 31547

SEQ ID NO: 84573 - DNA, 601 bp, Human; identical to SEQ ID NO: 31548

SEQ ID NO: 84574 - DNA, 601 bp, Human; identical to SEQ ID NO: 31549

SEQ ID NO: 84575 - DNA, 601 bp, Human; identical to SEQ ID NO: 31550

SEQ ID NO: 84576 - DNA, 601 bp, Human; identical to SEQ ID NO: 31551

SEQ ID NO: 84577 - DNA, 601 bp, Human; identical to SEQ ID NO: 31552

SEQ ID NO: 84578 - DNA, 601 bp, Human; identical to SEQ ID NO: 31553

SEQ ID NO: 84579 - DNA, 601 bp, Human; identical to SEQ ID NO: 31554

SEQ ID NO: 84580 - DNA, 601 bp, Human; identical to SEQ ID NO: 31555

SEQ ID NO: 84581 - DNA, 601 bp, Human; identical to SEQ ID NO: 31556

SEQ ID NO: 84582 - DNA, 601 bp, Human; identical to SEQ ID NO: 31557

SEQ ID NO: 84583 - DNA, 601 bp, Human; identical to SEQ ID NO: 31558

SEQ ID NO: 84584 - DNA, 601 bp, Human; identical to SEQ ID NO: 31559

SEQ ID NO: 84585 - DNA, 601 bp, Human; identical to SEQ ID NO: 31560

SEQ ID NO: 84586 - DNA, 601 bp, Human; identical to SEQ ID NO: 31561

SEQ ID NO: 84587 - DNA, 601 bp, Human; identical to SEQ ID NO: 31562

SEQ ID NO: 84588 - DNA, 601 bp, Human; identical to SEQ ID NO: 31563

SEQ ID NO: 84589 - DNA, 601 bp, Human; identical to SEQ ID NO: 31564

SEQ ID NO: 84590 - DNA, 601 bp, Human; identical to SEQ ID NO: 31565

SEQ ID NO: 84591 - DNA, 601 bp, Human; identical to SEQ ID NO: 31566

SEQ ID NO: 84592 - DNA, 601 bp, Human; identical to SEQ ID NO: 31567

SEQ ID NO: 84593 - DNA, 601 bp, Human; identical to SEQ ID NO: 31568

SEQ ID NO: 84594 - DNA, 601 bp, Human; identical to SEQ ID NO: 31569

SEQ ID NO: 84595 - DNA, 601 bp, Human; identical to SEQ ID NO: 31570

SEQ ID NO: 84596 - DNA, 601 bp, Human; identical to SEQ ID NO: 31571

SEQ ID NO: 84597 - DNA, 601 bp, Human; identical to SEQ ID NO: 31572

SEQ ID NO: 84598 - DNA, 601 bp, Human; identical to SEQ ID NO: 31573

SEQ ID NO: 84599 - DNA, 601 bp, Human; identical to SEQ ID NO: 31574

SEQ ID NO: 84600 - DNA, 601 bp, Human; identical to SEQ ID NO: 31575

SEQ ID NO: 84601 - DNA, 601 bp, Human; identical to SEQ ID NO: 31576

SEQ ID NO: 84602 - DNA, 601 bp, Human; identical to SEQ ID NO: 31577

SEQ ID NO: 84603 - DNA, 601 bp, Human; identical to SEQ ID NO: 31578

SEQ ID NO: 84604 - DNA, 601 bp, Human; identical to SEQ ID NO: 31579

SEQ ID NO: 84605 - DNA, 601 bp, Human; identical to SEQ ID NO: 31580

SEQ ID NO: 84606 - DNA, 601 bp, Human; identical to SEQ ID NO: 31581

SEQ ID NO: 84607 - DNA, 601 bp, Human
acatcaagaattcttagtacatgatgcaccagcatttttgaacaagtcatagatttggccacaaatcaaatttcaggatgggaggagtgtctcccctttaaaatagaagagagtgagtagtctatgaggagggacctacaaagactggaaactattcttagctccgtcactgactccaagttcatcccctctgtctttcagtttgggtaagcatcaattacttatctaaaatttgtaataagaaaagtcttcataattcatgattgtgtttatctttatgttagtaaatttctatgttggktctattcttccccttatattttaagaaaagaagtaagaaagtaaatgattatttttctgaaagaaaaaattaatgtatttattattattcatagaccttcaactactcttagaaagcctttggtgactcctgggaacaagctgagtcaggaacaaaagtttgagggtttggggttgagaataggacaattacttggctaatgctttagtctagttctgattttgctactccttagttgctttgtgatgactacttgcacatgtgtctgtttgtgagttatttttgtgagcatgctgctac

SEQ ID NO: 84608 - DNA, 601 bp, Human
gacaattacttggctaatgctttagtctagttctgattttgctactccttagttgctttgtgatgactacttgcacatgtgtctgtttgtgagttatttttgtgagcatgctgctaccagcctgtgtggatgtctgtggtttcacatgatacattttattttctaaagtctactgaattttatggtttttttttcaaaaatagaaactcatattctttccttcttaatttagtttctttcaggacattctcatgagactggtgaaatataactgcgaagtagcatgataactgtgaaatarcatgatcattgtgaaagctatatgacccaaaacttccataggaataagtgcaatgcttgcatatctgaaacctgctgttacatctctttgcacttaataaatatgtgttgactgattcattctcctgggtggtgctgagaaagtaaaaatcatggctgataaaaattctgtttatggttttgtctaacttatttttcagttgagatataggctactcttcccaactcagtcttgaagagtatcaccaactgcctcatgtgtggtgaccttcactgtcgtatgccagtgactcatctggag

SEQ ID NO: 84609 - DNA, 601 bp, Human; identical to SEQ ID NO: 28896

SEQ ID NO: 84610 - DNA, 601 bp, Human; identical to SEQ ID NO: 28897

SEQ ID NO: 84611 - DNA, 601 bp, Human; identical to SEQ ID NO: 28898

SEQ ID NO: 84612 - DNA, 601 bp, Human; identical to SEQ ID NO: 28899

SEQ ID NO: 84613 - DNA, 601 bp, Human; identical to SEQ ID NO: 28900

SEQ ID NO: 84614 - DNA, 601 bp, Human; identical to SEQ ID NO: 28901

SEQ ID NO: 84615 - DNA, 601 bp, Human; identical to SEQ ID NO: 28902

SEQ ID NO: 84616 - DNA, 601 bp, Human; identical to SEQ ID NO: 28903

SEQ ID NO: 84617 - DNA, 601 bp, Human
tgccataaaatgtgcttctcttcttcgggatgttgtttgctgtctgatctttgtagactgttcctgtttgctgggagcttctctgctgcttaaattgttcgtcctcccccactccctcctatcgttggtttgtctagaacactcagctgcttctttggtcatccttgttttctaactttatgaactccctctgtgtcactgtatgtgaaaggaaatgcaccaacaaccgtaaactgaacgtgttcttttgtgctcttttataacttgcattacatgttgtaagcatggtccgttctatacstttttctggtcataatgaacactcattttgttagcgagggtggtaaagtgaacaaaaaggggaagtatcaaactactgccatttcagtgagaaaatcctaggtgctactttataataagacatttgttaggccattcttgcattgatataaagaaatacctgagactgggtgatttatatgaaaagaggtttaattggctcacggctctgcaggctgtatgggaagcatggcggcatctgcttctggggacacctcaggagctttactcatggcagaaggcaaagcaaaggcaggcactt

SEQ ID NO: 84618 - DNA, 601 bp, Human
agctccatgagggcagggacatcatctcttccatctttgggtccttagtgcaatacctggcagctagccagtgctcagctaaatatttgttgactgaataaatgaatgcacaaccaaattattgataccaaatgttttttttgtgtacatttctacttctctagctataagtcttaattatacaacaaaatactatttttatatttatgtttggtaaattcaataactttcctcatcatttggaaagtcaaattgtttattgcttccctacagttttttctgaatctagcaggattttaaygatatcattataatttgacacaataaaaggacaacatgaaactgatgaatctttattgggttaatttcagacactatataatcttttaaaaatgtaacattcttttttatatataaataattggtggcatcacaaatagccaaagcagggtggagagagtgatccttcctgggtgcaggcaagaaggggatatgttttctacagagttttcaaaacagtgataaagctgtctacaagtcattgtgctttttatcatcactatgcccagacaatgtgaaacatcagagatgaagtgctctt

SEQ ID NO: 84619 - DNA, 601 bp, Human
gcccagacaatgtgaaacatcagagatgaagtgctcttcccacagaggtggactgatccttctccccactcccttggtgtgtctctgaatgcaatgttgtcttggaaaacagctttccaagcatttcactcctgagcacttgccagtttcctcacttgttcttcacatatccaggcaaagacatcctgtttgctatatgaagcattgtatcccgtataaaaggaaggaaagagagaaatatatttttacactcatcactcctcaggggctgtacaatcatgtagaaattgtttaatgtgcytgtcaaatagccaaagagtgttaaaccctgagttcccacccatgtgtgtggtatggttaggattcatccagatacacagagagaggcacaacaggaggagaaaggataggggtgtggggacagcgggcccccaatatggtgtaatcgtggcaggtctctgcctgaagtgctatgtggggtttttcttgttttaattttgactttaacccctgatttgtaagtttttcataaaataaacagaatcataactcatgtagatggctataagtgccgtagtgttctgtgggtctctggtgtctg

SEQ ID NO: 84620 - DNA, 601 bp, Human
ctcaatacttcaaagtaaaagacaaagaaagttgaataacttgcgaaatactacagttatggagcaaggattcaaacacagccagcattttcctagctatatgtgtatacagaaagtaatgttttgtcatcacatacctgaattacttatacttttataaaataattcacacttacgaagacttcctctgatgtcttggatcaacttctttcctctacttggaagcgtccagccaatggcatggttacttcccagcaatccccacaggaagtacacattcctctgtgcatccagctggggwttttagagagagagtgacctggaaaggaatcctgttgaaatgatttacttacggagttttcattatttaacctgatgacagtaagctctttgtcaattttcactttttccccccaattttgtgtcacatcaccttgataattcttgattccatactgctggtcattgagagaactgataaactattagaggttgtggaggaattcgtgaatatgggccagtgatttttctaccttaaaactgggagcccatgcatggagacttaagacggaaaagaaccgtatcagcaaatctcatttga

SEQ ID NO: 84621 - DNA, 601 bp, Human
ccctgacagcaccttgtccgttcctttctcattattgcatgagttacaaccctctgcatcttgcaacccaagtaccacactccattcttctctgagtgcccatagtttctttccacagaaacaaactttctgctaccatcagattaatctcttgggaaaaccactcaagtctccagtgctcctgtgaccttcagaataaggcaatctgccttagttggggtttcaagtctggacagaacctggccctgaccaaactttctaatcatatcttccaccaattccccaaactgggttattccayttcctcagaaaacacacttcctctctgcacttaggcttatggtattctctctgcccaggtgggcatttccttttttgcatctccctgaatcctactcatctttcagaggcctcctcctcctccaggaaggctccctttcccagtcctgcatggagcaagctctccttctaaactcctctgccagcaaaaatcatgcttttgcctcccatcttagttaagttgacaagtgtctctctgcctcttttgcctttgagaatgccctataatgcttagcctgatgtgttgtagaggctcaataaa

SEQ ID NO: 84622 - DNA, 601 bp, Human
actgaagtaggagctcattgtttgatctgtggaaaattcagatcccttaaaaaattctatgcccttgctactattagctttaaattttttcacttccccaggggagtatggggaaaccaaagatgaaaccaaagtctattcagcacagaaggcccccttagtcatagattattaatcaaaattgatgagatggacaggttcttgtccacttttttgttatttagtctgtgacagtaaaaaggagaaacactttgggatgaagactgttatttcctgatagtgttttgtggcagtggtttgmcgtcaacatctcttgagtctagaatattttggaggatgacatacattcaccaacagccataaaacttggagaggaatgtcttcaaagagtccagtgagaatttttagaatcaagtaagaagttgtacttcttgttttcattttcagatggaaagctctatgatgcttatgttgtctacccacggaactacaaatccagtacagatggggccagtcgtgtagagcactttgttcaccagattctgcctgatgttcttgaaaataaatgtggctataccttatgcatttatgggagagatat

SEQ ID NO: 84623 - DNA, 601 bp, Human
ccacggaactacaaatccagtacagatggggccagtcgtgtagagcactttgttcaccagattctgcctgatgttcttgaaaataaatgtggctataccttatgcatttatgggagagatatgctacctggagaaggtaaagctattgacatacattagggacagaaattcatgcttattaaaggctgtgaactaggtggccttatccctgcattggataatgaattgcatttactaccacaggccttaagaccagaactttaaatatttatccagaagcagacacttatccttcaatcgyccctctcccatcattgtcctggtgatgagatcttcacagtaatgttggtggtgtgaattcagagttagaagtcctttgcttcaaggacttagcaaaccatcatccctactttattcccttggtcccccaccaggataactctgccacttcttaattctgtccataagatttgaaagaggacttaaaaattgatgagttttgttctggtagccataggcactagctgaaataccttaaaagtactcagagagtcttcatgactttctttatgttggtgaaacatttgcaaatttatattct

SEQ ID NO: 84624 - DNA, 601 bp, Human
gtggccttatccctgcattggataatgaattgcatttactaccacaggccttaagaccagaactttaaatatttatccagaagcagacacttatccttcaatcgcccctctcccatcattgtcctggtgatgagatcttcacagtaatgttggtggtgtgaattcagagttagaagtcctttgcttcaaggacttagcaaaccatcatccctactttattcccttggtcccccaccaggataactctgccacttcttaattctgtccataagatttgaaagaggacttaaaaattgatgarttttgttctggtagccataggcactagctgaaataccttaaaagtactcagagagtcttcatgactttctttatgttggtgaaacatttgcaaatttatattctcaccagaacaaaaagaactatagcttctgttccttaatattcctacccaattttatatacttttgacagttttatcacaactcctgtgtttgcagtagttatttttcccttcccttcatacatttatgtccagtacctgtggaccctccttgtgaactcttctctaatttctcacagaccaggaagggtttggaat

SEQ ID NO: 84625 - DNA, 601 bp, Human
ctctgccacttcttaattctgtccataagatttgaaagaggacttaaaaattgatgagttttgttctggtagccataggcactagctgaaataccttaaaagtactcagagagtcttcatgactttctttatgttggtgaaacatttgcaaatttatattctcaccagaacaaaaagaactatagcttctgttccttaatattcctacccaattttatatacttttgacagttttatcacaactcctgtgtttgcagtagttatttttcccttcccttcatacatttatgtccagtacctrtggaccctccttgtgaactcttctctaatttctcacagaccaggaagggtttggaatataactggggctcagctatcaagggcctaagcataataaagtaaatgttcagttttacattttaaactcattttactaagaagaggaattcacatgcctatagatgtaaaggtatgaacaacaggtgactttggtttaccctggaatatctgggaatgctaatagcctcaataacggctcaagagacttgtgaaagatacaatttaggagaatctaatgcatttcttctctcaaggctctctt

SEQ ID NO: 84626 - DNA, 601 bp, Human
gaacaacaggtgactttggtttaccctggaatatctgggaatgctaatagcctcaataacggctcaagagacttgtgaaagatacaatttaggagaatctaatgcatttcttctctcaaggctctcttcttcccccattttcccactggccacccatgcaggtagaagtaatgagtaatgctctcaaacactcttttcatattacaaatgtactcaagaacctgcagggactcctgttgtttgtgagctcaacaatgtgccacatctggccacaagctcttcacctcttctttttcagtcyatccacctaagttctagttacacttctcctcagccaaacccagatgctagctctctcacactcaagcttgtgctgccttcaatgtgtgacaacatactaatctggaatggttttctacttccctctgtcaatgcatgtcctctgacctttcctcaaccaaaataaatgaaacccaacaacaccaaacttcactcttcacttaggaaagttcatgactgactaaggtactgtctatagtctcatgcaacttaccttgcatttgccccatcaaaatcctctctgcaccaccattccatccag

SEQ ID NO: 84627 - DNA, 601 bp, Human
tgtatgactagatgtagtcactgcagtggaaaccaacatacgaaagagcaggcggcacattttcatcctgacccctcagatcactcacaataaggagtttgcctacgagcaggaggttgccctgcactgtgccctcatccagaacgacgccaaggtgatacttattgagatggaggctctgagcgagctggacatgctgcaggctgaggcgcttcaggactccctccagcatcttatgaaagtacaggggaccatcaagtggagggaggaccacattgccaataaaaggtccctgaattcyaaattctggaagcacgtgaggtaccaaatgcctgtgccaagcaaaattcccagaaaggcctctagtttgactcccttggctgcccagaagcaatagtgcctgctgtgatgtgcaaaggcatctgagtttgaagctttcctgacttctcctagctggcttatgcccctgcactgaagtgtgaggagcaggaatattaaagggattcaggcctcaggtttcatctggtaactttccttccatttccctgcttctgggtggatgcaaaatggccagaaatttttctcctcaatcctccaccat

SEQ ID NO: 84628 - DNA, 601 bp, Human
cccctcagatcactcacaataaggagtttgcctacgagcaggaggttgccctgcactgtgccctcatccagaacgacgccaaggtgatacttattgagatggaggctctgagcgagctggacatgctgcaggctgaggcgcttcaggactccctccagcatcttatgaaagtacaggggaccatcaagtggagggaggaccacattgccaataaaaggtccctgaattctaaattctggaagcacgtgaggtaccaaatgcctgtgccaagcaaaattcccagaaaggcctctagtttgaytcccttggctgcccagaagcaatagtgcctgctgtgatgtgcaaaggcatctgagtttgaagctttcctgacttctcctagctggcttatgcccctgcactgaagtgtgaggagcaggaatattaaagggattcaggcctcaggtttcatctggtaactttccttccatttccctgcttctgggtggatgcaaaatggccagaaatttttctcctcaatcctccaccatcctccagccaccattttcttcccttttcccttttgcttgcctgtcttcactgtggtgtgggatgttttcac

SEQ ID NO: 84629 - DNA, 601 bp, Human
agatcactcacaataaggagtttgcctacgagcaggaggttgccctgcactgtgccctcatccagaacgacgccaaggtgatacttattgagatggaggctctgagcgagctggacatgctgcaggctgaggcgcttcaggactccctccagcatcttatgaaagtacaggggaccatcaagtggagggaggaccacattgccaataaaaggtccctgaattctaaattctggaagcacgtgaggtaccaaatgcctgtgccaagcaaaattcccagaaaggcctctagtttgactccctyggctgcccagaagcaatagtgcctgctgtgatgtgcaaaggcatctgagtttgaagctttcctgacttctcctagctggcttatgcccctgcactgaagtgtgaggagcaggaatattaaagggattcaggcctcaggtttcatctggtaactttccttccatttccctgcttctgggtggatgcaaaatggccagaaatttttctcctcaatcctccaccatcctccagccaccattttcttcccttttcccttttgcttgcctgtcttcactgtggtgtgggatgttttcactactct

SEQ ID NO: 84630 - DNA, 601 bp, Human; identical to SEQ ID NO: 29298

SEQ ID NO: 84631 - DNA, 601 bp, Human; identical to SEQ ID NO: 29299

SEQ ID NO: 84632 - DNA, 601 bp, Human; identical to SEQ ID NO: 29300

SEQ ID NO: 84633 - DNA, 601 bp, Human; identical to SEQ ID NO: 29301

SEQ ID NO: 84634 - DNA, 601 bp, Human; identical to SEQ ID NO: 29302

SEQ ID NO: 84635 - DNA, 601 bp, Human; identical to SEQ ID NO: 29303

SEQ ID NO: 84636 - DNA, 601 bp, Human; identical to SEQ ID NO: 29304

SEQ ID NO: 84637 - DNA, 601 bp, Human; identical to SEQ ID NO: 29305

SEQ ID NO: 84638 - DNA, 601 bp, Human; identical to SEQ ID NO: 29306

SEQ ID NO: 84639 - DNA, 601 bp, Human; identical to SEQ ID NO: 29307

SEQ ID NO: 84640 - DNA, 601 bp, Human; identical to SEQ ID NO: 29308

SEQ ID NO: 84641 - DNA, 601 bp, Human; identical to SEQ ID NO: 29309

SEQ ID NO: 84642 - DNA, 601 bp, Human; identical to SEQ ID NO: 29310

SEQ ID NO: 84643 - DNA, 601 bp, Human; identical to SEQ ID NO: 29311

SEQ ID NO: 84644 - DNA, 601 bp, Human; identical to SEQ ID NO: 29312

SEQ ID NO: 84645 - DNA, 601 bp, Human; identical to SEQ ID NO: 19982

SEQ ID NO: 84646 - DNA, 601 bp, Human; identical to SEQ ID NO: 19983

SEQ ID NO: 84647 - DNA, 601 bp, Human; identical to SEQ ID NO: 19984

SEQ ID NO: 84648 - DNA, 601 bp, Human
tcagtggaataattaatgtagctgcatgtgtaagccaattaatattctgaatttttcccagggaaattcagggcactgatataggcactgtcagaccatttggatttctcagctaagaagtcaggaaataaaatacaggaaatggattaatctttcccttttgcaccccttctccagtgaatcttttcttgactattcttaagctttgaacttttttttttttttgtggggggggatttggcagtgtgttaatttggtgggcctttctaaaagccaacgtatattcctttgacctcttcayatagtattctgaaactcatggcattcaactttgtgtcttgctttcacttgggtggtcacatggccagatgaatttttactctgcttgactctttaaatacttcctttcccactgtgggaagggaagatctttgtggatttccttctgactctaagcaaggtcccatgccatgttggtcctcccatgagggagctggttttttgtttttttttttttaaatacatttgacccaatttgtactagagtgattgctctatttttgggattggtttagaggcagctgaacgaaacttatttttc

SEQ ID NO: 84649 - DNA, 601 bp, Human
ttgaaattaaaaatgtccagaatggagatcttcatctgccaagtcagaccttctttgatccctactgatggctgcactcacctctaagccatctctgaaccagcactaagcgcccggaggcaaaggcccatggcccatgtctctctatccccttatctagcaaagtgcctgatgtaccaggtgctttttatttgtttatttgtttttttttttttttttttttgaggctctgttgcccaggctggagtgctgtggtgcaatttcggctcactgcaagctccgcctctggggttcatacctytctcctgcctcagcctcctgagtagctgggactacagacgagcgccaacatgcctggctaatatttttgtatttttagtagagatggggtttcaccgtgttagccaggatggtctcaatctcctgaccttgtgatctgcccgcctcggcctcccaaagtgctggaattacaggcttgagccaccgcgcctggcctatatgcacatctttatcctctggagcgtcttcaaaatacagttaatagtgaagcattctgaatccccagccatgcctgatgcagtggtaggggtatacagtagat

SEQ ID NO: 84650 - DNA, 601 bp, Human
cactctagcctgggtgacagagcaagactctatctcaaaaaaaaaaaaaaaaaaaaacaaaaaaatgtggtagaaggggagagagcctcaaaatgaccagagtagatggactcgtgtagtaaaactttacccaaagttggtttcctaatgatataatgtgaaacagtctatgtgctatacaaataattatatctcttttgttaagccttacgtcattttgacaaaggctttacttgattgagtattgacggcttttccaaaataaaatccagctcttaattgagatttgtggctgggcatrgtagctcatgcttgtaatcccagcactttgggacacttagcagggaggattgctggaggccaggagttcaaaaccagaatgggcaacatagtgagattccatgtctccccccgccaaaaaaaaaaaaaaaattagctgggtgtggtggcgtgcacctgtggtcccagctactcaggaggctgaggtggggggattgcttgtgcctgggaggtcaagactatagtgagctgtgattatgttactgtactctagcctgggtgacagaatgagaccctgtctcaaaaataaaggaaaaaaaga

SEQ ID NO: 84651 - DNA, 601 bp, Human
ccaggagtagatgttagcatccccaccatgcagctacaggatgtggtcctcaagtcctgtctgctcatgtgatggaaataaggagagtggtggaggcgggggccttccttttttaattcaggtgagattggtattctcccagctggggttcctgtgggctgtaagggtgtttggctgggcaggcaaagccggaaatgggtggtatggaggaagaaacagaatagctgaagatgggatgaaggaggaactgcctgaactgatcagtgagctccacagccccctctgtgtgtgtgtgtgtgtttttgagagagtaagagagagctcatgctcatgagtgtgtgagttaggggaaaggtggaggtgggcattgttgacacaggccttgcaggacgaagccttcctttggtggctttaattaagcagggccccagacactgcctgggctggagaaaatgactttcttctccagaacttcaaagcaattatttttgctaattttttccttcctccctgttaggtgagtggtagttttagaaatcacaggacatctgttgaaattattgaatgagtgaacgcgaggtgaggctggagggaatcaggg

SEQ ID NO: 84652 - DNA, 601 bp, Human
tcttattatctgttttattttcacacacagtaaaatctcgctattattatggtgtttagggtttgtgcccttcttatttccgaaatctctgaggtggtttagaaaatagaatttgatgaaagtgggacaatggggaatggaagcaaagtctacttgccagggtgctcgaggggaactgattgctgacacctggacatggaattggcctcaaggtttcccagcagcggcggcgaaaaagagtacatcctgacacacagggtttttatcctttcgacaaagggaagcagccacgctcattcasagcagcactttctaggaagcacatccaaggaggaatctccagcgcaggtccttgtgtaaggtacattgttggagcacaatgagccatgtcttcgccgtgcttttgtcggggtcagaaatgccgcgcaagcagatggtccctgcattcatgtttttcaggggtcagggtacgacattaaactgtggtataatgaaaatggaagtacttctcatttctataaaaacgctgctttttgattatataaattagtataggatgaaagctgggaagatgaaaaaagagtagtttaacatagccatt

SEQ ID NO: 84653 - DNA, 601 bp, Human
gaatttgatgaaagtgggacaatggggaatggaagcaaagtctacttgccagggtgctcgaggggaactgattgctgacacctggacatggaattggcctcaaggtttcccagcagcggcggcgaaaaagagtacatcctgacacacagggtttttatcctttcgacaaagggaagcagccacgctcattcacagcagcactttctaggaagcacatccaaggaggaatctccagcgcaggtccttgtgtaaggtacattgttggagcacaatgagccatgtcttcgccgtgcttttgtcrgggtcagaaatgccgcgcaagcagatggtccctgcattcatgtttttcaggggtcagggtacgacattaaactgtggtataatgaaaatggaagtacttctcatttctataaaaacgctgctttttgattatataaattagtataggatgaaagctgggaagatgaaaaaagagtagtttaacatagccattatttaatcattcataaagtactttttaaagcatttattacgggtaaaatatagtcccattagacacattccctctttgtgctaacttggtttaactcaaaatacaaag

SEQ ID NO: 84654 - DNA, 601 bp, Human
ttcgttgtgaccctcactttcttcattggtcataaagcaggaggtaaaaatttaaatgagatctgtgtgaaagcgttttataatctacgaagctatatacacatgggcggcatcatccttatggctgtctgttgagagagggcctcgaggagaggacttggcttcatcttgccttctaatccctcactgcaaggccctgaatcctaatccctcactgcaaggccctgaatcctaattccactccatctctccatgatgccagtgccacatctgggacctacgcagaagagtcatacctgccagcacagctatggtgattgtgcttgggaagaagttgaagttgcagaaggaaggtggtagagagggactgaaagagccaaccaggccagagctcgacaggaccctccctccttccctacccttcagacaggagctgcatcaccattttcttttccttttctttctttctttttttttttttttagacagagtctcactctgtcacccaggctggagtgcagtggcagtatcttggctcactgcaacctctgcctcccaggttcaagcgattcttctgcctcagcctcctgagtagctgggg

SEQ ID NO: 84655 - DNA, 601 bp, Human
ccaggttcaagcgattcttctgcctcagcctcctgagtagctggggctacaggcgtgcgccaccacacccagctaatttttgtatttttagtagagacggggtttcaccatattggccaggctggtctcaaactcctgaccttgtgatccacccatctcagcctcccaaagtgctgggattacaggcatgagccaccgtgcccggccatgcatcacgattttcaaaggccagcttcctgactgttccttgaactccttgagataggtatttactgtgcttgtgacatgcaaactgcaaatrattcttgcctcataatggataggcctgtaacccagccagccctctaggcaagcaaatgttatttcctagttttaagtgtgagcttaatatgtgaattaatttcacatcttcatcctcttcctaaatctgtctttgttttgtctgatgaataactgaagtaatggatttggtcacaccactagctgggtagccacctgaggctggagttctgatatgtgggtcttgcctgctttctctgcactgtggctttgcacgtcgggtgctgaagctggggagctggaatcagctggtgtgttctct

SEQ ID NO: 84656 - DNA, 601 bp, Human
tgaagctgtgcgagacgacaaagactgttgtagaaagaggcctcttgcttataattgaagcatctttgacctgagtcagtgttctgcagccaggatcagataatcagcactggtcactggcacctggcattgggacctggaggcaaagaataacagaattaattggtttccagtaagtagcagggatcatggcatgttcatactttttaaaagaagccttattgagattgagatataattcacacaccctatacttaactaatttaaatcatacaattcagtgttttttactatattcacygttaagcaaccatcatcaaaatcaactttagaacattttcatcacccaaagaaaccccatacctattagctgtcaccccattttccattctattccccctccctagccccagccctaggcaattgctaatctgctttctgtctgtggatttacctattctgaatatttcatataaacgggatcatacaatatgtgtcctttttgcctggcttagcataatgttttcaaggttgattcatactatcgtgtgtatcactacttcattcctttttatggtagaataatcgtccactaaaggga

SEQ ID NO: 84657 - DNA, 601 bp, Human
agcagggatcatggcatgttcatactttttaaaagaagccttattgagattgagatataattcacacaccctatacttaactaatttaaatcatacaattcagtgttttttactatattcactgttaagcaaccatcatcaaaatcaactttagaacattttcatcacccaaagaaaccccatacctattagctgtcaccccattttccattctattccccctccctagccccagccctaggcaattgctaatctgctttctgtctgtggatttacctattctgaatatttcatataaackggatcatacaatatgtgtcctttttgcctggcttagcataatgttttcaaggttgattcatactatcgtgtgtatcactacttcattcctttttatggtagaataatcgtccactaaagggacataccacatttatttatctcttcatcaactgatgaacatttgagtgttttcccctttttggctattatgaataatgttgctgtgaacattcatgtgcaagtattttgtgaacttaagttttcaattctcttggctatattcctgggagtggaattgctaggtcatatggtaactttc

SEQ ID NO: 84658 - DNA, 601 bp, Human
ataaggaagagtcatgttagaaattttgtcctttcttccagaaggtacactatatagcctggagccacactgtccaaaatggtagtcactggccacatgtcattataagaacttaaactaattaaaattaaatgaaatttaagattctcagtcataaagctgtattttggctaagcattgtgacttatgcccataatcccagtattttgagaggctgaggcaggattgcttgaggccatgagttggagaacagcctggaaaacatagtgagaccccatctctaccaaaaaaaaaaaaaaaagaaattagccaggcatggtggtgtgtgcttgtagtcctagctagctacccaggaggctgaggtaggaggattgcttcagcccaggagttcaaagttgcagtgatttgtgatcatgccactgcactctagcctgagtgacagagcgagaagctgggggaaaaaaaaccacatttccattgttccttatttatatatggccaccgtattagacgacatatgggttgtttccatgattgcagccagtcctgttgggcagcactggctatacccactggcattctgtccactcctgacccagtg

SEQ ID NO: 84659 - DNA, 601 bp, Human
ggcaggattgcttgaggccatgagttggagaacagcctggaaaacatagtgagaccccatctctaccaaaaaaaaaaaaaaaagaaattagccaggcatggtggtgtgtgcttgtagtcctagctagctacccaggaggctgaggtaggaggattgcttcagcccaggagttcaaagttgcagtgatttgtgatcatgccactgcactctagcctgagtgacagagcgagaagctgggggaaaaaaaaccacatttccattgttccttatttatatatggccaccgtattagacgacataygggttgtttccatgattgcagccagtcctgttgggcagcactggctatacccactggcattctgtccactcctgacccagtggtgccctagacacccagctgtgatctgtcttctgtgggtccctcatctacctgctgctcaggcttcttctttatgtagttgcctctgggcttcctagcaagccccctacccagactagatggtctgtgggccctgcaggcagagacacttcttctgcatagtttttggatgtggttgccagtataaaggctagtgcctttcctcacctcagccaatag

SEQ ID NO: 84660 - DNA, 601 bp, Human
cttttaccatgggcctaagtttctctggttggagcagagtaagttttcaggctgaatttcttggatcattgcctttgttttctttttcacatagcctgtggatgtctggccttttcagccaaggaaagaaaatggaaatggttttaaacactcactcacttgagccatgaatttcaaccatatattaattttgcttatttttggattttcaaatcttctgagaagcaatgaaatgacacaggggcaggccactagggtgctttggaggttctgcgtggcctggagcagtggggagaggctygggagagtggaactgtgccctcccactcgtgctacccacacagcagcctcctccctcactctctccttcatgtatgtgtgtttgaggttctgcttagcactttatttggggaaaataagttttctgaaaacttattttgtaggcaatagaggagagattggtgtatgtcttatccttactcgagttggcaaggactctgggccgaatatttagggcttggctcttgctccctctacctaggtggattatgcagtgagatctcacttgcctttaactcatagttattgcttagctcttagg

SEQ ID NO: 84661 - DNA, 601 bp, Human
gtacttcataattcaccaagtactttcgtgtccattctctcattcaatcctagaacaatctatgatgaaacaaagcaggtatcacaattcctgttttatagatcagaaaacttagggcttagagagatcaaatgacttacccaagggcatagtggctggaaggttgcagggcaaggcctattgccagaatcttctcagatatcccatgtctgttggagcattcttctactccagtgtggatttgcctttctgatggctttgactggagaactgtattgggtagttcatcaaaataagaagscttgagttcatatagtgaaaaataagatcaccttttccctttgttcattggcttgatttattaggattgtattctcaaacctttcctgctattaaaggaaatgaccttagtttgtgttgcatgaaatagcattaagtcaagtttacaacatttcaaagttatggtcagtagcattccaattagaacctaaaaagcttacctagctgaggtttaagtcgttgatcttggaaaaggtaaagacttctcagggaggttgggctgctgtgtatgacagctagaccctcagttcttggtctgtta

SEQ ID NO: 84662 - DNA, 601 bp, Human
cttgagttcatatagtgaaaaataagatcaccttttccctttgttcattggcttgatttattaggattgtattctcaaacctttcctgctattaaaggaaatgaccttagtttgtgttgcatgaaatagcattaagtcaagtttacaacatttcaaagttatggtcagtagcattccaattagaacctaaaaagcttacctagctgaggtttaagtcgttgatcttggaaaaggtaaagacttctcagggaggttgggctgctgtgtatgacagctagaccctcagttcttggtctgttarcatgtggcccatttcttcctatccatgcccctccataaagctttgtgcgctggtagtatttacagtactggatgataattatggcattaattatttgagataaatggagtgtgcccagtagccaatagactattgttagagtattattagtatttttataggtcttttggatagcattctatttcaagacatttgaaaatgtagaccagattagtcaaaagcattgtacatgatctgtccatgagtgtaggctctcattagaacttctggaatcattctgaaatatacccagctagataa

SEQ ID NO: 84663 - DNA, 601 bp, Human
tcttttctatggtatgaggttggggttaagaggttaattccagccacctcccttgtgggtatccagttgctccagcaacatatgttgaaaatgctttcctgtcctcatttaattgctttggtacctttattgaaaatcaatggatcacataaatttggttctgtttctagggtctctgttctgttccattgacacatttgtctttatgctatctctgtactgttattattactgatgctttgttttaagtctaaacattggattatataagttcttccatttttgttctccacccctcacyacaagattgtattggctattctaggtcctttgcatttctatctaaattttagaattaacttgtcaagttctataaaacagccctctggggttttgattgagatgacgtcgaatctataggtcaatttggggagaaggatagcttaagaacattgagtcttctaatcactgagtgtgatgtatctctttagatcttctctaatttttctcagcaatgttattagtatagaggtcttacatgtattttatttatccctaatttttatattatttttgattttattgcacatagaattttaaa

SEQ ID NO: 84664 - DNA, 601 bp, Human
tgctccagcaacatatgttgaaaatgctttcctgtcctcatttaattgctttggtacctttattgaaaatcaatggatcacataaatttggttctgtttctagggtctctgttctgttccattgacacatttgtctttatgctatctctgtactgttattattactgatgctttgttttaagtctaaacattggattatataagttcttccatttttgttctccacccctcactacaagattgtattggctattctaggtcctttgcatttctatctaaattttagaattaacttgtcaakttctataaaacagccctctggggttttgattgagatgacgtcgaatctataggtcaatttggggagaaggatagcttaagaacattgagtcttctaatcactgagtgtgatgtatctctttagatcttctctaatttttctcagcaatgttattagtatagaggtcttacatgtattttatttatccctaatttttatattatttttgattttattgcacatagaattttaaaaagaatcttctagttgtttattactagtatatggaaacatgcttgatttttgtatatgttgccttgt

SEQ ID NO: 84665 - DNA, 601 bp, Human
gttgaaaatgctttcctgtcctcatttaattgctttggtacctttattgaaaatcaatggatcacataaatttggttctgtttctagggtctctgttctgttccattgacacatttgtctttatgctatctctgtactgttattattactgatgctttgttttaagtctaaacattggattatataagttcttccatttttgttctccacccctcactacaagattgtattggctattctaggtcctttgcatttctatctaaattttagaattaacttgtcaagttctataaaacagccytctggggttttgattgagatgacgtcgaatctataggtcaatttggggagaaggatagcttaagaacattgagtcttctaatcactgagtgtgatgtatctctttagatcttctctaatttttctcagcaatgttattagtatagaggtcttacatgtattttatttatccctaatttttatattatttttgattttattgcacatagaattttaaaaagaatcttctagttgtttattactagtatatggaaacatgcttgatttttgtatatgttgccttgtacatgccaccttgtca

SEQ ID NO: 84666 - DNA, 601 bp, Human
tgagtattacctataattgtctccccacacccacagttgtcttttaaatgtcatagtttattttactctctttgaattaggatacaggtaggtttcacacagtgtgacttggttgttgtcctttaagtctattttaatctgtctgttccctctgtacacactcttttatcctccttgctacttattttttaaagaaatgaggttacttgttagaggttttacatccccatagtattgtttaatatgttcctctctcctctgaatttcctgtgaatttggtagttggacctacaggctcatracattcaagttttgttttattttattactattttttagctaggctacttcactggtgacattgagtccttccaagaggaggcacttagtatctgattgtccttttttgtgatgttagtactcattgatgtttaatgtgtagatcaagtcattccttatgggttgtaaaatgctggatactcttagttctatgatttctgtgacatttattggcttaaatgtttgatttttctccatatttaccagtttttgaagttttttttttttttttttttttttttgacagagtctcgttctatct

SEQ ID NO: 84667 - DNA, 601 bp, Human
ggtagttggacctacaggctcataacattcaagttttgttttattttattactattttttagctaggctacttcactggtgacattgagtccttccaagaggaggcacttagtatctgattgtccttttttgtgatgttagtactcattgatgtttaatgtgtagatcaagtcattccttatgggttgtaaaatgctggatactcttagttctatgatttctgtgacatttattggcttaaatgtttgatttttctccatatttaccagtttttgaagttttttttttttttttttttttwtttgacagagtctcgttctatctcccaggctggagtgcagtggggtgatcttggctcactgcaacctctgcctccacagttcaagcgtttctcgtgccttagcttactgagtacctgggactacaggcgcacgccaccatgcgtgccatgtctggctaatttttgtatttttaatagagatggggtttcactgtgttgcccaggctggtctcaaactcctcacctcaagtgatccgtccccatcggcctcccaaagtgctgggattacaggcgtgagccacagcgcctggcctgtttttg

SEQ ID NO: 84668 - DNA, 601 bp, Human
cgccaccatgcgtgccatgtctggctaatttttgtatttttaatagagatggggtttcactgtgttgcccaggctggtctcaaactcctcacctcaagtgatccgtccccatcggcctcccaaagtgctgggattacaggcgtgagccacagcgcctggcctgtttttgaagttttgacttaacttattagtaccctttaacagtgactggtttgttttttggtttttgtaatttttaaaagtatgatatattttagcatatttactgtgttctgctgaagttactgaccctcagatcatyccccttgtggtagtgtgaaccttctcacattggtccctgtgtctgtttggcatgacctagtagtctctgatagctttctctctttctggtacaacaagatgttttggattcatcttacacatttcttgccctggatctggaatcagccattttcttcaaggagtcagtcctgctgctttttagtgggagatagtatttcagaactaaattttgggttcagaggtacatatccataaacaaacagctttttatagtaaaaacacatacagaaaatgcatacagtacaacaccaatgtagcc

SEQ ID NO: 84669 - DNA, 601 bp, Human
gtgttctgctgaagttactgaccctcagatcatcccccttgtggtagtgtgaaccttctcacattggtccctgtgtctgtttggcatgacctagtagtctctgatagctttctctctttctggtacaacaagatgttttggattcatcttacacatttcttgccctggatctggaatcagccattttcttcaaggagtcagtcctgctgctttttagtgggagatagtatttcagaactaaattttgggttcagaggtacatatccataaacaaacagctttttatagtaaaaacacatasagaaaatgcatacagtacaacaccaatgtagcctcaaaaaagaacacagcagagcaccgcaggggatccctttctgaacacagtcttctcccacttccctcagtcaccactcagtgtttatggtaatgacttcctcgattttctttcctgtttgatcatttaagacaaaatacgtccctaagcagtatcacttggttttgtctgttttgaattttatttaaatggatcatgcttcctgaatttttttttttgttgttgttgttcgagacagagtcctgctctgtcgcccaggctggagtg

SEQ ID NO: 84670 - DNA, 601 bp, Human
acctccgcctcccgggttcaagcacttcttctgcctcagcctccctagtagctgggattacagatgcccaacaccatgcctgactaatttttgtatttttagtagagacaggttttcaccatgttagccaggctggccttgaactcctgacctcgtgatctgcccgcctccgcctcccaaagtgctgggattaccagcatgagccaccgtgccaagcctcctggattcttttatatcttgcttctttcattcaacatgagattcatttgttttcattttctttgcaatatgatactccatyggatgagtagaccacaatctatccattctgctattgatgtacagtcaagttgtttctagttttgtgctgttaaagaattgctgctaaccttgtatctgtctctggttgcacatgtgcatatgtttttgaagggtatatacatagaagtcgaattgctgggttagatgctatgcatgtcttctttccaatgtgtcatgccagctgatatgctcaccaacagcgtgtgagcattcctgttgcttcacattcttgcccacacctggaattgtcagactttaacatttctgttagtttgttgat

SEQ ID NO: 84671 - DNA, 601 bp, Human
tgcccggctaatttttttttttttttctaatggtagagacagggtttcaccatgttggccagcctggtctcgaactcctgacctcaagcaatctgcccaccttggcctcccaaagtgctgggattacaggcgtgagccaccacgcctggccacaagtacttttaaaattttattgtaggacgtcttcctccactttgttgggatatgtggtatatagtaaagatttcaaatatagtaattattattatatactatttagtattatatgcaacttatatatgatcttttaaaaaaagtcttrtatctttgcctttctatttaaatttcctttaaaaaaaattgacaccaaagaaataatagtgtcacattgtttgcaccttactttttcacatacaattttattctggagctctttctacattatccatatgccagtcggcttcattctttgtcatggtggcatgatatatgtatatatttttttgagatggagttttgcttttgtcacccatgctggagtgcaatggcgtgatctcggctcactgctacctccgcctcctgggttcaagcgattctctggcctcagcctcccaagtatttg

SEQ ID NO: 84672 - DNA, 601 bp, Human
ggtggattgcttgagcccaggagtttgtgaccagcctgggcaacatatggagactttgtctctacaaaaataaaataattagcagagcatggtggtggtgtggctgtagcactagctactcaagaggctgaggtgggatgatcacttgagcccaggagttcaaggctgcagtgaggtttgactgtgccactacattccagcctgggcaacagagcaagaccctgttgcttaaataaataaataaataaataaacaaataaatattcaagaattctcaggtctggatgtagggttagatgcmagttagatataagtgaaatagccggtttacttaccaatagacaggaaagtagtcttttgtgattcccttctccactaaatacaaatcagtgctactcaggggctctttaaagaaggagttggccaggtgtggtgactcacgcctgtaatcttagcactttgggaggttgaggcgggtggatcacctgaggtcaggagttcgagaccattcctgaccaacatggagaaaccctgtctctaaaaatacaaaatcagctgggcgtggtggcgcatgcctgtaatcccagctacttgggaggct

SEQ ID NO: 84673 - DNA, 601 bp, Human
ctgaggtcaggagttcgagaccattcctgaccaacatggagaaaccctgtctctaaaaatacaaaatcagctgggcgtggtggcgcatgcctgtaatcccagctacttgggaggctgaggcaggagaatcgcttgaacccgggaggcggaggttgtagtgagccgagattgtgccattgcactccagcctgggcaacaagagcgaaactccgactacatgtaccctaaaacttaaagtataataataataaaattaaaaaaaaaaaaaagaacagcagcagtaaaaaataaataaagaaakaaataaataaataaatgaagaagtcaatcggtaccataagaaaggacaaaaaccaaaacaaacccaaagcaaaaccaaaaactccccacaaaccagcctcccctaacccttttaactcaaagcttcgtaatgtctctgaatttataattacgattttaaagagcactgtttctcatgccccatcccccaacccatttcgggagtaaaccttttctgtcagggtgaggagaaagtgggtaaaggacttcagcatttacagttgagttagtatttgttgttctccaaatgtgcaggattcag

SEQ ID NO: 84674 - DNA, 601 bp, Human
gagcatcttaatgaatacaaagtacttgccagaatattttcttttttgattctccccacaacagtaatgggccgatgatgattcctgccattttcccagaccaggcagcagagctggcagacatttaatgactctccctcacaaggccatggagctcgtgagagagcataaggccaggttccctttacacacatgtggtgtgtaaaacggatgtacctcgattgggcttttgcccttgtcatggaactgagcccgaaggaggttcttagaggagcggggtgaggatttcaggagaggtgaytcccaggggagcttcaggccaggactgtcatagtagagcagtaatttatgggcttctgacagcttgaaaaggtcatggtgttcttctttacttataaatgaaaacaaagtaatttgggggtcagggaaagacgaaagggcttgtgcagactgacctcaaaatccctggtggttatcatgtaaaaattcgatttgtttgatgcaattagccaaacctggacactttcttctccttctcaaagcaattgggattcagggcacaggataaaacagagttggggcagggggcagggaggaggcg

SEQ ID NO: 84675 - DNA, 601 bp, Human
gaaaacaaagtaatttgggggtcagggaaagacgaaagggcttgtgcagactgacctcaaaatccctggtggttatcatgtaaaaattcgatttgtttgatgcaattagccaaacctggacactttcttctccttctcaaagcaattgggattcagggcacaggataaaacagagttggggcagggggcagggaggaggcgctctggcaacagtgggaagtccagattgtttctattgtgcgtgctgatgtaattctttttctgcaagccctctgtggtttatcactttgccttcatgcamccttcttataaagcaattacagaatcacgggaaaataggcagtagcagtgtgaatcagtgccttttggaatggagaactgatacaaactgggcttcagtttgcagagggttgaggaatgtctaaggctcgtggatgggggaaggagaagtgacaagggatcacagatattgtatattgggcctctttggccaggccctccagtccccgaggcccttctatgctgcttactggctgcatgagggctgtggctgtggccgtcgccgtgtcagctgagcttgtaatttagatgttaccactgc

SEQ ID NO: 84676 - DNA, 601 bp, Human
aggtgatttgcaaatttctctgtggtttggtttacttctttctcttggtcctttgattctttccgccttcgtctttcctttttctttctctttgcacctttctcccctgaaagatcacttggcagaatggttagaaagtactacctttgtggcttagttgatggtgcacaaaataactgaagaagaaaacataccttggctttgcagattgtatccttctggagagctgaattttccagagtgctaaagctgaattgtatccattgtaagcaacaaagctttttttttttttttttttttwaaattatctttaaagaatccattttaaaaggaaattctctgaaaatacattacacatttaactaccttcagaagcagccggctgagaacttaacccgacattctctccatcatgccgggtcactgttaggaacatccaagattctgctgtgctcgagtgatggtgccttcaggttgcttgcccctgcaggtggtggctccagagtcttagacttctctggttcttctttcttttcctgtcccatctggatcccccaaaccctgacccctcagactgttaggtattatttctgcttgtatt

SEQ ID NO: 84677 - DNA, 601 bp, Human
gccttactgccaattagtggagcatgttagtgaagtttgtaataaagtcctaatttccgtgactaatgaagctttacttgtgttcaacacaatccctgctctcagttatgaagttataaaaaaatgtgtttatgctgttgctgccgctgcccgtctgtctgcctccctgcctgcctgcacagtctttaagagcactgttgctctcctcctgttcctcacgcatttcaagcacaaatccctaccattcatcaaaggcatttgctggtggtggcaggggaaatgtcacagcactgctgccacyactgccaggtatctttttaaaatgtaatgtgtgtgtatgggtatgtgtgtgtgtatgacttccaccatttctacgggaatgttttttgattagaaaaagaaatagttgttacatttgcaatttgtaaccagaaccattttctttccaatgcagttgtaacagtgtaatgataagtagggtctttatccaaccctatgacaagtcacatgtacacacgccagacataggctccagattctgtaatatttagccctatacagtcaacagatttgattccctggcagtcagtctttgcattgg

SEQ ID NO: 84678 - DNA, 601 bp, Human
cttggctcactgcaacttctgcctcctgggttcaagtgattctcctgcctcagcctcctgagtagctggggctacaggcatgtaccaccatgtctggctaatttttgtatttttagtagagatggggttttaccatgttggccaagctggtcttgaactcctgaccttaagtgatcagctcaccttggcctcccaaagtgctgggattacaggcatgagccaccatgcccagctgtctttctgttctctaagtgtgttttgcagagcaaaagttttaaattttgatgacatccagttactyggtttttccttttatgagttatacttttgatgtcgtatctaagaaatcttcgcccaactacagatcataaagattttctccagtttttttcctagaagttttatagttttacattaagatctgtggtctatggccaggcgtggtggctcaccgctgtaatcccagcacttgggagtccgaggagggcgggtcacctgaggtcgggagtttgagaccagcctgaccaacatggagaaaccccatctctacaaaaaatacaaaattagccgggtgtggtggtgcatgcttgtaatcccagct

SEQ ID NO: 84679 - DNA, 601 bp, Human
attaatcaaatcctgcatagagtgggatttaccaagcctggtttcttgagatcctaggatgtattcataatatgtatcatggaattctcaaataatgcttatgataaaataagcttaaattttccttactttaaagcagaggctggcaaatgttttctgcacaggaccaaatagtaaatattttagtcttgtggtctcatagtctctgtcataacttcttaactctgctgtcatagtgtaaaagcaaccacgaacaatacataactagtaaagatagctatggtccaattaaactattgawtgacactgaaatttgaatttcttatacttttcatgtgtcatgaattattatttttttgatttcttacaaccgtttagtaggtagtgggccagatttcgcccatgggccaaaatttactgaccactaatttatgtcatggatggctctatggccctgatcaacaactcctcttgattgaaattttctgtctgttctggagaaacaaagataggaaagcaagagaagttctagaaatcctatggaatgcttatggatacaacctgtaagccaaagtagcttctcagtcttcttttgaactcc

SEQ ID NO: 84680 - DNA, 601 bp, Human
attgctttttttgttcattctataatttttttatcccttttacattgcatgtcttgattacatagttgatttgatattctctgaaatgtgatggaaaagaaaatgtaaacacaaaattaaaaagcagaggaatgaagacacattttgtgtgctgcttcgtgccagatagttttgtacatatccttgtacaaagtagtggtctcatttttaccacagtgagtaagcccctggtctctacctttaaggaacttagagtttgataggcttagtggttctcaactggcattaccctctcttgagrgtatttagaaatctgtggagcagctgcaattgtcacaaatattgagggatgctgttggaatttagtgtgtgggattttatcacaatgaagaattatcccaccaaaaatgtttatagatctccttttgggaaacactgtgctgagtaaaatagtagtaatgataataaaaacacttgcatattgagcactgccattgtgttcagagaactctacagatacagtccatattctctgatatgtagctctaaattcagaaatctctaaaattgaagtgggttttttattaatccatttggtaaa

SEQ ID NO: 84681 - DNA, 601 bp, Human
gatgctgttggaatttagtgtgtgggattttatcacaatgaagaattatcccaccaaaaatgtttatagatctccttttgggaaacactgtgctgagtaaaatagtagtaatgataataaaaacacttgcatattgagcactgccattgtgttcagagaactctacagatacagtccatattctctgatatgtagctctaaattcagaaatctctaaaattgaagtgggttttttattaatccatttggtaaaatgtgacctgaattgatgtgagaacttttatttttttaaagctgagarctgtattttttatagctgtattgaagtatagtttacatatcaaaaaattcacctgttttaagtgtacaatttggtgatttttagtaaatttaaaaagctatatgtaactcttaccacaatccagttttataacattttcataaatgcctccccccccaaattctcttgaacctgtgtgagatgatttccagatgtttcactgaagaaatatggaagtgtttgattatggagtgctgctccagatccttcctgaatgctaggtattcattcattttgaattccaaatatacccggctgcag

SEQ ID NO: 84682 - DNA, 601 bp, Human
taccatgatctatctatactttgactgttggtggacatttgtgatgttttctttttttctaaaaagagataattcaaatggtgctatattgaatagtcctcctgaatttttcttgatacatatgtgctaaggattatgtaggcatgaaatttcagggtcctattgtgggtacatcttcagctttattggatgatgcctagttgttttccaaggggttatataaatttatactccctccaataatttatagatgctaaaatttttccaatctaatggttctaaaatgatatatcattctgayttgaatatgtatttctgtgatgactaatgagattgagcatcttttaatatagccatttagttttccctttttgtgaagtgtccgttgagtcttatgtccatttttctactggtttgtctttttttttgagacagtcttgctctgttgccgaggctggagtgcaatggcataatctcagctcatttcaaccactgcctcctgggttcaaatgattctcctgcctcagcctcctgagtagctgggattacaggtagttgccaccatacctggctaatttttgtatttttagtagatacaggg

SEQ ID NO: 84683 - DNA, 601 bp, Human
cttgagctctatttatctgcatggccaaaatctcaaacacacatgatgtagtggcttgtagaaagcttttgattcttgttaaatggagaggagggagaaaggaaaggaaaatcagtctggtagattactagtgtcttctgtttaagttcagttgcgctgataattccagaaaatatactgaggaacttcaaaaggcatgtggaaccttgtgtagtatgatttatactaatcatagtatgtgtgtatgattgtataaggtgaaaaacaagataatgcatcttctatgattaagttgccttayttatcaagtaagaggtaactgtaccccgttggtcttaaatagctgatatgtggtttggtacttaatactgtctattggaggaattgaaatagaatacccagagatacccagagtctccactgggaatacttctgctccccaaatgtgatatcagagtaatatcaagtagaatgtggagtacacccacctatcgaggcacaaactgccctctcccatgaccctttctctgtagaaagtattacttatactgtaaatagcagtcaaatttcaagtaacatcagttctctacatcttagcctt

SEQ ID NO: 84684 - DNA, 601 bp, Human
aggcatgtggaaccttgtgtagtatgatttatactaatcatagtatgtgtgtatgattgtataaggtgaaaaacaagataatgcatcttctatgattaagttgccttacttatcaagtaagaggtaactgtaccccgttggtcttaaatagctgatatgtggtttggtacttaatactgtctattggaggaattgaaatagaatacccagagatacccagagtctccactgggaatacttctgctccccaaatgtgatatcagagtaatatcaagtagaatgtggagtacacccacctatygaggcacaaactgccctctcccatgaccctttctctgtagaaagtattacttatactgtaaatagcagtcaaatttcaagtaacatcagttctctacatcttagccttttccaatctgggtggccaaagtgaagaatgattaggtactgaaaatttataaatgccgtgtctgagaatttctagacaatgggaagacacctccctaaggaaacctgtcagtctgaagtcttcccagctttcagagcatagcaagttcttaccatagcctggagaatatgtgatctgccagtgcctgctccc

SEQ ID NO: 84685 - DNA, 601 bp, Human
atcgaggcacaaactgccctctcccatgaccctttctctgtagaaagtattacttatactgtaaatagcagtcaaatttcaagtaacatcagttctctacatcttagccttttccaatctgggtggccaaagtgaagaatgattaggtactgaaaatttataaatgccgtgtctgagaatttctagacaatgggaagacacctccctaaggaaacctgtcagtctgaagtcttcccagctttcagagcatagcaagttcttaccatagcctggagaatatgtgatctgccagtgcctgctsccccttcacctcttactgacatcccccttctctctgcaagagtgactgccttgctgttcttcagaatgccaggcaccctttcaccccaagcatttgctctcctcttccttctgcctgtatgtgcttccctggatgggtgtttggtttactcctgattacctgggtctctgctcgaatgtcatcttctcagagaggtcctccctgaccaccctctcccataatagcacccacattcatctctgccagccctccctgagttcctacatggcacctgacacatattcactgtctgccctccct

SEQ ID NO: 84686 - DNA, 601 bp, Human
gtgttccccccacctcactgttgcttcctttcagtcttctttcctgattcttcctggccatttgttgtcttgttggagtgcctggaggagtctttaggccttctcctcctatttctatcagcactcgctccctcaatgatcttacccagtctggagtttcaaatccatccagaagctaacatctcatgcatctccagttgaggcctcccttccacactgcaagttctcacatccctctgcccttggagaggcacgccctgtcctacttaccctcccaagtgcttaccactgctcactggcwtaggcgtacgtgttggccaggggttgtcatctctgtgctctccactagaatgtgggctccacaatggaggactccgtttactgttgtatccatagcacttagaagagtgcctggcacatagtaggtacttattcaatattttgttaaaggagtgaatgtgttaggtctccatatacagtggagattctagtaattcgctgtctcaggtcctgtctcaactctccctactagtattagggcgccctagcctttcagagatggtctttgtcttggaactcttactaaatctatttgataaaa

SEQ ID NO: 84687 - DNA, 601 bp, Human
gagtgcctggaggagtctttaggccttctcctcctatttctatcagcactcgctccctcaatgatcttacccagtctggagtttcaaatccatccagaagctaacatctcatgcatctccagttgaggcctcccttccacactgcaagttctcacatccctctgcccttggagaggcacgccctgtcctacttaccctcccaagtgcttaccactgctcactggcttaggcgtacgtgttggccaggggttgtcatctctgtgctctccactagaatgtgggctccacaatggaggactcygtttactgttgtatccatagcacttagaagagtgcctggcacatagtaggtacttattcaatattttgttaaaggagtgaatgtgttaggtctccatatacagtggagattctagtaattcgctgtctcaggtcctgtctcaactctccctactagtattagggcgccctagcctttcagagatggtctttgtcttggaactcttactaaatctatttgataaaatatgattgtttctctagaactctgttgaattgataccaggcattcaactatgcagtattaaatgtattctttatc

SEQ ID NO: 84688 - DNA, 601 bp, Human
ccttggagaggcacgccctgtcctacttaccctcccaagtgcttaccactgctcactggcttaggcgtacgtgttggccaggggttgtcatctctgtgctctccactagaatgtgggctccacaatggaggactccgtttactgttgtatccatagcacttagaagagtgcctggcacatagtaggtacttattcaatattttgttaaaggagtgaatgtgttaggtctccatatacagtggagattctagtaattcgctgtctcaggtcctgtctcaactctccctactagtattagggygccctagcctttcagagatggtctttgtcttggaactcttactaaatctatttgataaaatatgattgtttctctagaactctgttgaattgataccaggcattcaactatgcagtattaaatgtattctttatcattgatttggggaggctatttgggatagtagaaagatctttgactttagagccagatacttctgagtttaaattcttgctctgctgctaaatagctacagagccttagtggaaacatacagtcttaggccttagttttctcatttgtaaagtgaaagatttggtt

SEQ ID NO: 84689 - DNA, 601 bp, Human
taggaatggaatgctctggaaggattgtcttctaattaatgagaaaggagcttattttgtgggggaggttctaaaatgcctttatatgtgcactgagcataattccaaagttatacagtaaacactccatgaatacttggttacttgtttttgctccagagatacttaactgaactcctctattgattgccctgaggtatagctatggaaagtagaggtgatgctactaaatacaaattcaacataggcttacaaatatcttagaggagcttttctggctttgaactgtaaacgtcaacgkagctatattcatgataattatatcttgattgtatcttcttagggaaaggattgtcaatggtcctagctcaaaggaaattgaacaaagaagttaagatagcacatgcaaacatacacatccgtgtgtgcccaaacatacggactctctcacactgttaaataatgcatgagcaaaatattaagtgcaaggtacagtctaacgcatatcactctgcagtatgtggtaagtgccaaatgaacaggataaatttaagtactgtaatttcaaagaacgagtcattagcaaaggctaaaaatggtc

SEQ ID NO: 84690 - DNA, 601 bp, Human
gagcttttctggctttgaactgtaaacgtcaacggagctatattcatgataattatatcttgattgtatcttcttagggaaaggattgtcaatggtcctagctcaaaggaaattgaacaaagaagttaagatagcacatgcaaacatacacatccgtgtgtgcccaaacatacggactctctcacactgttaaataatgcatgagcaaaatattaagtgcaaggtacagtctaacgcatatcactctgcagtatgtggtaagtgccaaatgaacaggataaatttaagtactgtaatttcraagaacgagtcattagcaaaggctaaaaatggtcaaggaaggcttcctggaaaaagtgagcttggagctgggcattgacagatgagtcacactgtgcctcatgatgcagtgtgcagaactggtccagccagggtcaagtggatggctctcaggccagtccacaccctcctctgggggaactagggcaagtctgctggctgcctcagtccttccctgtgaatgcagcccattattcctgaatcacatccttgtctgccattggtgattttgggtgcttcgtgggctttgggtcaaggcagg

SEQ ID NO: 84691 - DNA, 601 bp, Human
ttctctctttacatgctgttaatttgttgtggactgccagatttacatctcttcccctgacctgttgctattctagacttgtatgtttcaaaagcatctcaagcttgccatgtgcaaaatggaatccagctctttctccaagcctggccactcccagcccttccagtcccagtggatggtgtcaagtccacctagggtgctgaccccacaagttgagcctgagaatgtcttggatttctttttatccctctaccatcgaaatcatcaacttttttggccctctctgcctctggtttgtttrtttatttatttatttatttatttatttatttatttatttatgttttagagattgggtctcattctgtcacccaggctggaatgcagtggcacgatcttggctcactgcagtctcgacctcctaggctcaagcgattctcccacctcagcctcctgagtagctgggactacaggcatgtgccaccatgcccagctaattttcgtattttttatagagacaaggcttcaccgtgttgcccaggctggtctcgaactcataagctgaagtgatccacccgcactggcctctcaaagtgctggg

SEQ ID NO: 84692 - DNA, 601 bp, Human
ctctttacatgctgttaatttgttgtggactgccagatttacatctcttcccctgacctgttgctattctagacttgtatgtttcaaaagcatctcaagcttgccatgtgcaaaatggaatccagctctttctccaagcctggccactcccagcccttccagtcccagtggatggtgtcaagtccacctagggtgctgaccccacaagttgagcctgagaatgtcttggatttctttttatccctctaccatcgaaatcatcaacttttttggccctctctgcctctggtttgtttatttrtttatttatttatttatttatttatttatttatttatgttttagagattgggtctcattctgtcacccaggctggaatgcagtggcacgatcttggctcactgcagtctcgacctcctaggctcaagcgattctcccacctcagcctcctgagtagctgggactacaggcatgtgccaccatgcccagctaattttcgtattttttatagagacaaggcttcaccgtgttgcccaggctggtctcgaactcataagctgaagtgatccacccgcactggcctctcaaagtgctgggatta

SEQ ID NO: 84693 - DNA, 601 bp, Human
ttacatgctgttaatttgttgtggactgccagatttacatctcttcccctgacctgttgctattctagacttgtatgtttcaaaagcatctcaagcttgccatgtgcaaaatggaatccagctctttctccaagcctggccactcccagcccttccagtcccagtggatggtgtcaagtccacctagggtgctgaccccacaagttgagcctgagaatgtcttggatttctttttatccctctaccatcgaaatcatcaacttttttggccctctctgcctctggtttgtttatttatttrtttatttatttatttatttatttatttatttatgttttagagattgggtctcattctgtcacccaggctggaatgcagtggcacgatcttggctcactgcagtctcgacctcctaggctcaagcgattctcccacctcagcctcctgagtagctgggactacaggcatgtgccaccatgcccagctaattttcgtattttttatagagacaaggcttcaccgtgttgcccaggctggtctcgaactcataagctgaagtgatccacccgcactggcctctcaaagtgctgggattacagg

SEQ ID NO: 84694 - DNA, 601 bp, Human
gaccccacaagttgagcctgagaatgtcttggatttctttttatccctctaccatcgaaatcatcaacttttttggccctctctgcctctggtttgtttatttatttatttatttatttatttatttatttatttatttatgttttagagattgggtctcattctgtcacccaggctggaatgcagtggcacgatcttggctcactgcagtctcgacctcctaggctcaagcgattctcccacctcagcctcctgagtagctgggactacaggcatgtgccaccatgcccagctaattttygtattttttatagagacaaggcttcaccgtgttgcccaggctggtctcgaactcataagctgaagtgatccacccgcactggcctctcaaagtgctgggattacaggcgtgagccacagtgcccagccttctggatttattttgaacctctccacttatttctctttgtctctgctaccacctccctgatctaaaccaccaccatcctttgtgcctccagtctcttctccacacagtctccagagtggccttttaaaaacaaagctgagcatgttccccgtctcaacacccgtttataga

SEQ ID NO: 84695 - DNA, 601 bp, Human
tctctgcctctggtttgtttatttatttatttatttatttatttatttatttatttatttatgttttagagattgggtctcattctgtcacccaggctggaatgcagtggcacgatcttggctcactgcagtctcgacctcctaggctcaagcgattctcccacctcagcctcctgagtagctgggactacaggcatgtgccaccatgcccagctaattttcgtattttttatagagacaaggcttcaccgtgttgcccaggctggtctcgaactcataagctgaagtgatccacccgcaytggcctctcaaagtgctgggattacaggcgtgagccacagtgcccagccttctggatttattttgaacctctccacttatttctctttgtctctgctaccacctccctgatctaaaccaccaccatcctttgtgcctccagtctcttctccacacagtctccagagtggccttttaaaaacaaagctgagcatgttccccgtctcaacacccgtttatagaccatctttatatgaacagaactcaggctttgtgctggcgtccacaggctgtgtgtggtccctgtctctctcctgcaacc

SEQ ID NO: 84696 - DNA, 601 bp, Human
tttatttatttatttatttatttatttatttatgttttagagattgggtctcattctgtcacccaggctggaatgcagtggcacgatcttggctcactgcagtctcgacctcctaggctcaagcgattctcccacctcagcctcctgagtagctgggactacaggcatgtgccaccatgcccagctaattttcgtattttttatagagacaaggcttcaccgtgttgcccaggctggtctcgaactcataagctgaagtgatccacccgcactggcctctcaaagtgctgggattacaggygtgagccacagtgcccagccttctggatttattttgaacctctccacttatttctctttgtctctgctaccacctccctgatctaaaccaccaccatcctttgtgcctccagtctcttctccacacagtctccagagtggccttttaaaaacaaagctgagcatgttccccgtctcaacacccgtttatagaccatctttatatgaacagaactcaggctttgtgctggcgtccacaggctgtgtgtggtccctgtctctctcctgcaaccctgtccatcttccctcttgcccatggcac

SEQ ID NO: 84697 - DNA, 601 bp, Human
gagggactcttggcaaagcagttgtacagtgtcgatctcttgacttggaggcccagggggtcctttccattgcactgtgctctggaggaggaagggcaagaagatgagtctgagccccatctcagggtgctcgatgcatgcagcaaggaagctcagtgtttccacacgtttcaggttgcctctgttctaaatgacgagggtgctgccctgtctccccttccttctgccgtgcacacacctgctcacacaggcaccatgtgtacacatcccttcctctgcactggaggaagcacctttgcartatttccagctcatgggatggtgtgaaagggatatgctcattctcctttgaacccttctcaccggatctccatcatgaggggactctctctgcctcccttggtgttctcatcagcacctcgtcaggtgagtattccattgatggcagggaagtgtttatttttaattctaaagtaaatcagattacatagaacacaaaatgttgtgttggatcaaaaccattgactatgaaattctcccagatggatgaaaggcgggggcttgttttcagcccttaaccacttcttctcacaagctggtt

SEQ ID NO: 84698 - DNA, 601 bp, Human
tcaggggagagttcagagaggcacttgccaacctgaaggtgtggagatgctgccgtgcatgggcaggaaggggagtggtggggcagagaagtcagggtgtggggtgggggcatggttccaggaagcttcctattttgtcttgtcagcagtagataggaactggattgaatcgggattatgctcacttctattgttagctctgatcatttgttgtttgacttcctgctttcccactagagatacgagtacatggcaagagatttctgaattcccacaccacaggtgtggccatggtgcacarcattgcaaggtccagggtcagtcgtcattttgctggtaaggaaggcataaactaacagcccagtagacaaatagcagtgtcccttcatgcggttgttactttgtgagagtaaagacatacaccaattggtttaatgtattcgggtagattttctactagtcgtgtccgtttaaaaaaatcaccagtcagttctctttatcggaaaaggtactagacacctgtagttgagcatgtgctgagatctggtgttttgttaattgcagtatttgatgatactggcaaaagtcactaagagaatcc

SEQ ID NO: 84699 - DNA, 601 bp, Human
tgtttgacttcctgctttcccactagagatacgagtacatggcaagagatttctgaattcccacaccacaggtgtggccatggtgcacagcattgcaaggtccagggtcagtcgtcattttgctggtaaggaaggcataaactaacagcccagtagacaaatagcagtgtcccttcatgcggttgttactttgtgagagtaaagacatacaccaattggtttaatgtattcgggtagattttctactagtcgtgtccgtttaaaaaaatcaccagtcagttctctttatcggaaaaggtaytagacacctgtagttgagcatgtgctgagatctggtgttttgttaattgcagtatttgatgatactggcaaaagtcactaagagaatcctcaaaacatcttgttagaaatgggaagaatattccttgactggcaaattttttttctgttcttaaaattaagcttataaatggctggaaaaattagttattttttccaggctttagttgggaagagatttttgtgtctggtgggaacgttccctctctccgttgatgcttgagaaagctacaagacgctgatggtgttggtggcagctttg

SEQ ID NO: 84700 - DNA, 601 bp, Human
tcatatatgacatctgaaccaaaaaaccttatcatttaggacatgatatcctttctgaggtttgagaagtggctattttgtctcttacaaagatttgtagggaatttactgagggaattgttgagggactagtgagcaattcttgttcacatagaaatgaacaaaactgcatttacccagtgattttcaaaaacatactcccagtaaatcaaggttgctctgaactgaacttagggtctcaaccagctgcagaccagttacatcttagcaagcagggctttgagtggtgcagtgggcagartgtgtggctctgacctatcaggtgtgatcccctcctactgtgcactgtttcctgtctggcacagacacaggcaaagcacttttgctgaaaggacagaaagactcaaggtgaaggcagtgccatgcaggccccggatgctgtgctgagtgtcttggaactgaggaagccgctgatggccagtggggccagggcagggcttgcgaaaagattcaaggcttcattccagtcacatggacagactggtactgcttttcacattcttatcaaaaagggctgcaggcaggtacaaagaccactgca

SEQ ID NO: 84701 - DNA, 601 bp, Human
gctgaaaaaatgagagtgctttcttttgagggagttgtggaggaatacatgatgtcctatatgggaggcccataaggttagtgaggtaaaaaaaagaatcaagagtttttcttgctctgctcattcacccatagtgatggagagatttgatttcatctggatgctcgtgttccactgacagtgagtactgctcagccagtgctcgccgccaggtagttaggtgtgtcttttacaatgtttagcacagcgaatagagaaagtgcctggcagatgcttggccatctcctctgcatctcccatmgtaccaagtatcttgccttgtgcacagtaggtgcttgtctgtggggcaaatagatacatttgcagttgaagtaatcctgtttctctgcctgaagtaagagacattcaccatctgtagagtgggaattgtgacttcctctagatgcagggacagttttgtaataaagcatcctcataacctcacttggccctttttggcacaaagacctgtgaaggcggagaccatgacctattttgctcagcatttatttcccagtgcaaatactcagtatttgttgaatgaataaacaaatgggataca

SEQ ID NO: 84702 - DNA, 601 bp, Human
tgatgtgcagcgcttgtcaaagttaagccttgtacatgtgtgaggactttgttcttgtcaccgatatatgctcggatccccatgtttgatgtgtggctaatgtgtatgcaccttctccctagtccaccctgagagctgagggtgtcattttacctaaataaagaaatacattgttaatgtagaaaatttagaattcacagaaaattgtaagtaacaacaattacctgcagactgtagcccagagataaccactgttaatcttgtgggatgtttctttttgtacctctcctaggcaggtacwttcacatcacacacacacaaagacacggtattacttcagtcacataaccattatttttgtatcaaatttacccaagtagataacccattccaggaaaagaaagagacttaactttgttgttctgttactttctcagggcctagtgcactatgagaccgagcaggtatttgttaaatacttaatggctttctggaacatcagggctgacaagattctgagttataatctaatgttctcagttgaagtgcaggagaatgaaggcctatggagagaagcaggcccagggtcctagggctggat

SEQ ID NO: 84703 - DNA, 601 bp, Human
agagataaccactgttaatcttgtgggatgtttctttttgtacctctcctaggcaggtactttcacatcacacacacacaaagacacggtattacttcagtcacataaccattatttttgtatcaaatttacccaagtagataacccattccaggaaaagaaagagacttaactttgttgttctgttactttctcagggcctagtgcactatgagaccgagcaggtatttgttaaatacttaatggctttctggaacatcagggctgacaagattctgagttataatctaatgttctcagytgaagtgcaggagaatgaaggcctatggagagaagcaggcccagggtcctagggctggatgtagctgagctagaactcagaaatgtgctgttgtcttgcccacgtctactctctactaataagttaagaggcacatacaagaaggcccatctggttggtgcttctagcagagaagctgattcatgcttaattttgaccacatctctaggtttgtggttactgctcagaatcaggatagcatctgggtatctcgaagctgctgtctccagtggaggctttggactgatctcacaaagttat

SEQ ID NO: 84704 - DNA, 601 bp, Human
tagataacccattccaggaaaagaaagagacttaactttgttgttctgttactttctcagggcctagtgcactatgagaccgagcaggtatttgttaaatacttaatggctttctggaacatcagggctgacaagattctgagttataatctaatgttctcagttgaagtgcaggagaatgaaggcctatggagagaagcaggcccagggtcctagggctggatgtagctgagctagaactcagaaatgtgctgttgtcttgcccacgtctactctctactaataagttaagaggcacatrcaagaaggcccatctggttggtgcttctagcagagaagctgattcatgcttaattttgaccacatctctaggtttgtggttactgctcagaatcaggatagcatctgggtatctcgaagctgctgtctccagtggaggctttggactgatctcacaaagttatgctgatttctacatcagcctacatctggggtccttctcctggttatcattgtttgtactgtatgcacagataccacgcccttacttaataatccagccttggtggaagtatattctcctgtgtttttgttggaatat

SEQ ID NO: 84705 - DNA, 601 bp, Human
agaactcagaaatgtgctgttgtcttgcccacgtctactctctactaataagttaagaggcacatacaagaaggcccatctggttggtgcttctagcagagaagctgattcatgcttaattttgaccacatctctaggtttgtggttactgctcagaatcaggatagcatctgggtatctcgaagctgctgtctccagtggaggctttggactgatctcacaaagttatgctgatttctacatcagcctacatctggggtccttctcctggttatcattgtttgtactgtatgcacagatmccacgcccttacttaataatccagccttggtggaagtatattctcctgtgtttttgttggaatataccaaccctgtattgccctgccctgcctttcgagcatcgtgaaaagaagtccttctttctcttggtggttcttgcctcatgctctcaccctccctttttgtggtgtcttactgagccagttgttcattccccagcaaacatttcatgtttacagtcctcaactaggctatactgtggaagattcagcagatgtgcaagcccaacctttcaggatctgagtcgagagagagagggg

SEQ ID NO: 84706 - DNA, 601 bp, Human
tggttatcattgtttgtactgtatgcacagataccacgcccttacttaataatccagccttggtggaagtatattctcctgtgtttttgttggaatataccaaccctgtattgccctgccctgcctttcgagcatcgtgaaaagaagtccttctttctcttggtggttcttgcctcatgctctcaccctccctttttgtggtgtcttactgagccagttgttcattccccagcaaacatttcatgtttacagtcctcaactaggctatactgtggaagattcagcagatgtgcaagcccarcctttcaggatctgagtcgagagagagaggggacattatatagagaaattatagctcagtttataaagtggccagtgacccaggagagcggcagagcacaggctgtggatcctgggtggcaggaggcctttgtcatggttattgggggtatagggagctgggcaggcagggatttgaaaagaggggcattagagcttgacttggaaagggggactgggatgtgaacatttggagattgcaggagaaagcattcctggcagaggaacaagtagtagatgagaagggtcacaggtggatccc

SEQ ID NO: 84707 - DNA, 601 bp, Human
aagtgtaggaggaagagggtcggcatgtggattaattttaaaaccatatttaaaaaactctcaaatcatgtgaagtttgtagtggaaagctccattcagtttgaaagccttcaccattctcaggcacagctcactgatctccttagtctgtgcacccctgatgggcaagattatgtctcatccctgcccagaacttggcctcagaatcttatttgtgatgtttgttcagggaataaaatagctttgatgtggatataaatttgcatgtgtgctgacttgcaatagagtggattttttttttaattgctacctctaggatcctaaggctgactttatgtggaggagacatttccaatgtccgtcttcctgcctggtccctacctgaccctccttattaagcacagggataagccttggcatgtcctgccagcaagctgagggctggggctgtctggcctgtacttgccaaatgtagtctgagctgtcttctctctaaaggactcttcagccccatgacccccaagtatagagccagacccaaatgtgcctcttcacatgttccaaggtgggcatgcttgggaacctcatccagcccctcctt

SEQ ID NO: 84708 - DNA, 601 bp, Human
tgacctgaggggtctgcagcagcagcccatgctcatcttaggcagtataaggactcctgtggctgcagaaccacgaggtgggactctcctcaggggctgcttcttggtgaatctgcactctatttataatcaaaagctctgccagatggacgtgaggtgcccagcagagggtaggaacactggcagctgccttggcattttgttaagtaggtatgcaagttgctggcccatcagagagctgtaaggtgctggaatgacagagccatttgttttcccttgtgacatggtctgttttataacrtggtgggtgagatcaagggagaagagtgggccccttcatagtttttcaaagtccttttttccttttttagaaaagttcaaagaggacattgactttctacagtcacaagcatcagcctgtcttggagagacagcagctgtggcatgtagtattttaaggtgatgagccaagtcagacaagtcctgatataggtggggtctggacatcctgagtgatcattctcatctaccactcctctatctgggccattctcattcattcagtagctcatggattgtctctctatctgggccgttctct

SEQ ID NO: 84709 - DNA, 601 bp, Human
ttgctgcagctgtcgtcttgggtgtatgtgcttaacaaaaggcttaagagtgtgtgtctgcagggcacaccagccttgctgtttgcagtgctgcacagatgactctattagagtcttttggttctgatttggaaatctagagtggtgggagggtgggaagggaggtggggaaaaatacaatgtctcaatagaccaagttcccaaaagtgtatctgcacttgaggctttcctgaagaatgaaaagcttaattcgtgccttttctttatgctacttgttcttttgtcttttttttttttttttaaggaaaagatgtgtcaatttcagttgcctaattcatttttaatatgggtcagagctgccatattcacacgctttgtctcatcacacctaggcttctgttgaaatgcttgcttcacaaatgaagtttaattaatagaaatagggaagtgaacacagggctgatgaatctggggagacatgacttggtgcctgcccagagaggtccctgggtcagattcctcccgagcctgttgtcagaggcagattcttacttagggagccaggatactgggagtcaggctggggcattcatcaacaatg

SEQ ID NO: 84710 - DNA, 601 bp, Human
tctgttttaaggagggacacttgcctaattcctctttgagtaaggcctaatctgtcagagtcgtggttggactgtgttctgaactgtagcatcccagggcctgaccctagttctgtttttttttttttagatggagttttgctcttgttgcccaggctggagtgcaatggcacaacctcagctcactgcaacctccgcctcctgggttcaagcgattctcctgcctcagcctcccaggtgcctgccaccacgcccagctaattttttgtatttttagtagagacggggttttgccatgttcgcccggttggtcttgaactcctgacctcaggtgatctgtccgcctcagcctctcaaagtgctgggattacaggtgtgagccactgcgcctggccaatcctagttcttttactctcttgcttttgctcagcctgtaagtaggagtaggaagtttcaaaagttacaataattaacatattcacgcctttttcacggtctgggggagctaaagcaggtgcaggataaatgaaggaactgaaccagctaggaccaaaatcagtaatttgaaccaaacttgatagctactgttttgaaactgtca

SEQ ID NO: 84711 - DNA, 601 bp, Human
tcacccataagtgtgaagtctggttcgtcttagcgacaaaagttagaaaaccactttcagacaataattgtattattttacagcattcgaagcaacctgagttggtctcaaaggtggctccctcaggccttacctgaggatggggacagagttgctcaaatgctttgggattactgagactagagtcaggataagctcgatcccaggttcctcaggccatgcttttccactagccaattcagtcccttcagcaagtgtttgtcgagcacttactagatagcaggtactgctcttggcacttagagatatttggtgaaaaggtcagcctggagcttccattctactcaggagacaaatgagtaaatacaggaggtgatttagagagcacctgcctcctgtaggaaagaaagggaggttatgcaacagcacctggtaagggtggtcagggaaggccatgtggggctctgggacagaattttccaggcggaaggaagatacagaggcttcaaggcagaaagaaacatcattgtggagtaatggcaggtggctgatcccactctctgcatgcagaaaagagcagcagccttcttgaagccttctt

SEQ ID NO: 84712 - DNA, 601 bp, Human
aaccaaggagtagaggaaaacatggcacctttcccccatcccacccctggaactttcacccacagtatagggttgccttgaagctctggattaccatggagctttcaatgagtaggaggagacatccatttgtcctctgtctccagctggccccgggaactattcaacatctgggattgcttcctgcggtgccccctgacccaactcaccagagtctaccgactctagacccactgttgtcctgggcccctgcctgactcttttacccactccaggatgaccctggtttctactgacacckgcctgacctaactcggtttgtctagaatgcagttgaagttgcagcaagggagatgaggaagggtaagaattggtgaaaaaaattacaaaggtttttcatggttcctaccctcgatgagtttacagtctagtcttcatgaggacatgtgctcatttgatcataaggcattttgtgacatgtgcctggaggtgattcagacagatgggcagggcaggagggaatgctggggtgtgtatagcaaaatgtgttattaaattatggcatctgttgtcaacaaccggtttagaccttcttgatctc

SEQ ID NO: 84713 - DNA, 601 bp, Human
gggagagtctgccaggagataggtgccctgagtagtggtcttctcttgggcacttaccgactgtgtcattttggaaaatggccccccccaaaagatttccacatcctaatctcttgaacctgtgagtatgttaccttacatggcaaaagggatgttgcagatgtgattaacttcagaatcttgagatggaaagattactctggatttagatgggcctacccaatccttacaagagggaggcaagagttagccggagaaggagctgcagtgatggaagcgcagaagtcaagagtgatgtaaycacgagccaaggaatgtgggcagccttagaagctggaaaaggcaaggaaacaggttcagccctagagcctccagaggagcacagtcctgctgacatcctaattttagttcagcaagacccatttctgccatctgaccttcagaactgtaagatactaagtttgtgttgttttaagctactaaattatagtaacttgttatagaagcaatgggaaacatacatcaattattcctctggatattagttgcttcagctctaaaatggggacacaaaatgttttctgcctgaaggctgagaact

SEQ ID NO: 84714 - DNA, 601 bp, Human
ggcagccttagaagctggaaaaggcaaggaaacaggttcagccctagagcctccagaggagcacagtcctgctgacatcctaattttagttcagcaagacccatttctgccatctgaccttcagaactgtaagatactaagtttgtgttgttttaagctactaaattatagtaacttgttatagaagcaatgggaaacatacatcaattattcctctggatattagttgcttcagctctaaaatggggacacaaaatgttttctgcctgaaggctgagaactggaccatgtgacttttggmattccttcaagttctagatttcatgagagagaaaatcgacctgaaaatgcattaaatgtttaaaaacatagggaagaaagaaatatacaattatttaatgtctgtgtatgtcatttaattcttacaaccacctgagagagattttataattattattttcttttagtcattcaagtatttgagtgcctatatgtgccagatggtgttctaggtgttagaaataaagcagtgaacaagaccaataaaaatctcctgtctttttgaagcttatctttagggagacagatgagaaaccataag

SEQ ID NO: 84715 - DNA, 601 bp, Human
tcatctcacaactcaagttgcttttgctgcagctgaggcctgaatgtgcatttgtaactctggggaaaagggtgttcagttatcaacaattactattaggttggtgcaaaagtaactgcagattttgccactacaagtaactgtaaaaactgcaattacttttgcgcctacctgatatttttatgttgcatggccttttcctggcagtttgatgtttatcatttcctgtcattgaggaatgtgtttttctaggacagtatgaaggctttcaggatctttagagggaagctctaaaatgtgmttctctctccattaggttggctcatcagtcagattctgatttgaaaatgaagggtgcttggcagtaagaatagtggaagtaaattttcaatattatacattaacaagtcataactaataacttttatgggttcttcccatctcagatttcagagaatatttttgggttgtgttctattgatgagggcttaaagaaatgccttgttctggctgggcatggtggctcaggcttgtaatcccagcactttaggaggcccaggagggcagatcacttgaggccaggagcttgagaccagcctaa

SEQ ID NO: 84716 - DNA, 601 bp, Human
tagctggcaaagcgggatgtgcccatgcctgggtgttgagagactgggtcttgacatggctctgcaactgtccatgtcatcttggaagatctttctgagttgggacagctgagaaacttcatgccatttgacagttttcttgaggtcatgagcaaattaaccaatcaaggaagtaaataagtaagttttggtggaacaaatttgtatgttattggtgtgcctttttttttttaataccataggtgtgttcctgatgaaaagggtgtgaataaatggaatttaaaatagttttccaatgaayggaatctttcacatgttaatatatcagggtcttctgcagtgacagctttgcctgaatttcatttttcacattagcttaaaaatattttaaagtaaaacatgttaattttgaaacatataggaaccagataaaggcaatatgttttttataaaatggaatcatatcctatcattggacttttggctgttttcctcttttaaccactataaaccatgttgcattgagcatcttggggtagcaaaatcacagattcctgattatttctttagaataaactcttagccttgaaattgctgcatt

SEQ ID NO: 84717 - DNA, 601 bp, Human
tttgagtcctggctccaccataacaagctgtgagaccctgacaatttacttcccatctctaagcctcagttttctcatttataaaatgggcataatatccttaaactcactgtgagcattaattgaatgacacgatataagtaaaacaccataccgtacatgaattctctatatgggaattcttactaatttgtacctgaacctctccttattcactagaagagtgtgaaaacttagtttcctctctgctccacccacggctttctagcagtcactgtaggcccaaggaaacccaccaccrtcttggtgcactgtaaccagggttgaggtgtctgtcctaattttgaaagcctgccttcagacatttatatgttcagacaaactaatcaggctgaaatttctcatgcttatttgcagctagatgaagcaatccatttagttgctttggaattacccaagcatggaagaaattggtttctcagccttgagatattctgcagatactgaagtacagatggcaccagggccagcttggtaaaaccagaaacaaggggcctgagtttggccctttgtcagggcctctgtccttgggaactggtgg

SEQ ID NO: 84718 - DNA, 601 bp, Human
ctgtaaccagggttgaggtgtctgtcctaattttgaaagcctgccttcagacatttatatgttcagacaaactaatcaggctgaaatttctcatgcttatttgcagctagatgaagcaatccatttagttgctttggaattacccaagcatggaagaaattggtttctcagccttgagatattctgcagatactgaagtacagatggcaccagggccagcttggtaaaaccagaaacaaggggcctgagtttggccctttgtcagggcctctgtccttgggaactggtggttccacctggrccccaacataagcctcagcttttcatttggccagcatgtatcatgaagttacttcttatttcaccctttgggggactctcagctgctcagagcttttgtgttttctcttttcagcttcctcctcaattgatacggatgaagtatttgctgaatctgtttctctttcctgaatcagaggcccagaggcattcatatagttgctttctggtaaaaccttgctgatctggtatttgggctgtcattagactgtagtgcaaaaagacgaggtgaattttgggactccagatttcagagtgtata

SEQ ID NO: 84719 - DNA, 601 bp, Human
gagtttggccctttgtcagggcctctgtccttgggaactggtggttccacctgggccccaacataagcctcagcttttcatttggccagcatgtatcatgaagttacttcttatttcaccctttgggggactctcagctgctcagagcttttgtgttttctcttttcagcttcctcctcaattgatacggatgaagtatttgctgaatctgtttctctttcctgaatcagaggcccagaggcattcatatagttgctttctggtaaaaccttgctgatctggtatttgggctgtcattagrctgtagtgcaaaaagacgaggtgaattttgggactccagatttcagagtgtataatatctcttgtagttaatattcacaacccatgagataggaacagacagggaaactgagataccaaaagtaatgtgcccaaagacgtgcagctagtaaatggcagaactgggatttgaattcttgctgactatggttccatttcaactattactcaataccaccttttaatctgcttattataatgtatttcataactttctatgctgtggtattgatcattcattcatcagttacacaattattgc

SEQ ID NO: 84720 - DNA, 601 bp, Human
ccctttgtcagggcctctgtccttgggaactggtggttccacctgggccccaacataagcctcagcttttcatttggccagcatgtatcatgaagttacttcttatttcaccctttgggggactctcagctgctcagagcttttgtgttttctcttttcagcttcctcctcaattgatacggatgaagtatttgctgaatctgtttctctttcctgaatcagaggcccagaggcattcatatagttgctttctggtaaaaccttgctgatctggtatttgggctgtcattagactgtagtrcaaaaagacgaggtgaattttgggactccagatttcagagtgtataatatctcttgtagttaatattcacaacccatgagataggaacagacagggaaactgagataccaaaagtaatgtgcccaaagacgtgcagctagtaaatggcagaactgggatttgaattcttgctgactatggttccatttcaactattactcaataccaccttttaatctgcttattataatgtatttcataactttctatgctgtggtattgatcattcattcatcagttacacaattattgcatggaagg

SEQ ID NO: 84721 - DNA, 601 bp, Human
cctgcacagcacactctttttctgttccctgccttttaaggtcatgccctcttgtcatgaatataagaatgcctgtgcccccttcggagaccggtgccactttcaggctgtgtgcatgctcactgcccctccatcctccttgagaaccatcgatgtgcacagagggttgtactgtttctctgtacatcccatcagcatggcttactcaagctttgcttcctgtcatatgtactaaggttttcaatgtgaaaatatgaaattacattctcatactaaataggctcctttaatccacactccyctctgagaaccaatccactttaccaagatctacccctcttggggctgtgctccctggttaagaacagctggtttagtagcaagggagaaggcaggagatgatttaaaacagaccctgggattctaaaagtcctgggattttataattcctgggattctaaaattagctgggaagattttgagtagcggaaaagagcctgccaactttagccatcctggataataccattctgttttagcttgatcactaatttttctgaccccatgtagaaaacgtatgtaaatcatggtggtggtagca

SEQ ID NO: 84722 - DNA, 601 bp, Human
aatgcctgtgcccccttcggagaccggtgccactttcaggctgtgtgcatgctcactgcccctccatcctccttgagaaccatcgatgtgcacagagggttgtactgtttctctgtacatcccatcagcatggcttactcaagctttgcttcctgtcatatgtactaaggttttcaatgtgaaaatatgaaattacattctcatactaaataggctcctttaatccacactcctctctgagaaccaatccactttaccaagatctacccctcttggggctgtgctccctggttaagaacarctggtttagtagcaagggagaaggcaggagatgatttaaaacagaccctgggattctaaaagtcctgggattttataattcctgggattctaaaattagctgggaagattttgagtagcggaaaagagcctgccaactttagccatcctggataataccattctgttttagcttgatcactaatttttctgaccccatgtagaaaacgtatgtaaatcatggtggtggtagcagcagtagtagtaacaacaataatgataataatcatggcagtagctcccctttttttattttttattt

SEQ ID NO: 84723 - DNA, 601 bp, Human
aatattccattgtgtatatatgccacactttcattatctcttcatccattgatgggcacttaacttgattctgtatttgactcttgtgaataatgctgcaataaacatgggaatttagatatctctttgatatattgatttcctttctgttggctgtatactcagttgtggaattgctggatcatatgatagttctatttttagttttttggggaacccccatacagttttccatagtgctgtattaatttatatgcccactaacagtgtgtgagggttcccctttctccatatccttacyagcatctgttattccctgtatttttgataaaagtcattttaactggggtgaggtggtatctcatggttttgatttgcatttctctgatgattagtgatgctgagcatttcttcatataacctgttggccgtttgtcttcttttgagaaacatctatacagatcttttgcccattttttaaattgggcttttttttccccctattgagttgtctgagctccttatatattctggttattaatcccttgtcagatggatactttgcaaatgttttctcccattctgtgcattacctattcac

SEQ ID NO: 84724 - DNA, 601 bp, Human
aacccactcaagatgcagaacactgctatcaccataagggtcccttgtgccctatctagtcagtcctcacccccaattcctgacccaggcaaacactgatctgctttttactactatagattagattcatctttttactattacaagttatattcacgtttcataagtgaaatgatatagaatgtaatcttctgtgtgcatcacaagtttgtcctttttatggctgtatagtagtccattgtatggatataccacaatttgtttatccctgtacctgctgttggacattagagtctaaacrttggaaacattgttttggctatgaaaaataaccaggttttggctattacaaataaagtggctatgaacattttatataggtgtttgtgtacacacatatatgcttttattacccttgggaaaaatagcaaagactgcagttgctgggccatattgtatgtaggtggggttttggccctcattatttttgatgctccctggtgatacacctgtgaacgtattatgttacagggcaaaagggactgactgtgcagatggaattaagcttgctgatcaactgactttaagataggaaaattac

SEQ ID NO: 84725 - DNA, 601 bp, Human
tctattctttcctattggactgtatgtctcttcatacaccaatcccactatgtcttgattaatgtagctttatggtgtatctggaaatcaggtagtataagttctccagttttacattaggttctttgtatttccatataaatttaataattggcttgtcaatttctataaaaatagccctgtttagattttgattgggattacactgaatctatatctcaatgtagggagaattgacattttaatatcaagtcttctgtccatgaacatgtatatttctcataatttatttagatttgayttaatttttttcaataatgttttgtggttttcagtttcaaatgttttgcataattttctaaatgcatccctatatcatttgtttctgatgttattgtaaatggtatttatttcaattttcatttgtttattgctaggatatagaattaaaagcagcttttgtatattgactctgtatcccataaccttgtaaactcatttcttagttactttttcggtgaattcattaggattttagacatatagatcatgtcatttgtgaacaaagatagttttccttctcccgttataatcggtaagc

SEQ ID NO: 84726 - DNA, 601 bp, Human
ccaatttcatctaaggcatcaaatttattggcataaaattattcataatatttcctgattatattttcaaagtctataggtattctagtaattgtctttcttttatttctgataccagtaattcatttcctccttttctgcgatcagtctagctggaaatttctaagagtcgttgatgttgaaaaaaccacctttttcttcccttgatttttctctattgtttgcctattttcagtttcatttacttttgcgcttgccgttgttttttccttctttctactattttggatttaatttggtmatcttttctgtggtagaaggttgcacaattgattctagatcttttctaatatcggaatattggctatacatttccctctaagtactgagttacctatgctcagtttttttggtatgttgcatattatttcactcaaatgttgaaaatattttatttatcttctttgacccttggattatttagaaatgtgtttgtaaatttctacatatttgggttttgaccaacatcaaaaggtcaatcattgacttttaattccattatgatcagggaatgttctttgtattcttttaaacattttca

SEQ ID NO: 84727 - DNA, 601 bp, Human
agtgtaaggtgtttttgaggtcactgtgaatttcctcactgagactcaacctaacaatggaaatgtcttcttgtcccactaaacgctcctgcagaaatacccagcttctgcttggattgagaactgtcactttctgacacttcttccttatattgtattgatacaaggtttcgggcagtttctgctttttgtgatagctgtgctgttggatctcacacttgctctatcaatctgtatctgtaaccaggagacagaaatcacgtagtaatttgaataactaaagttcaatataagaaattaytaaccatagtggaattggagtaatgaaggattggctagtaagaagtagaactctaaagaagataggaatagataataagatacagctaggtgtgctggcgcatacctgtagtgccagctactaggaggccaaggtgggagggtcacttgagcctaggagttcaagaccagcctaggcaacatagtgaagcccccaactcaaaaaaaaaaaaaaaaagagagacaagaaagtacccttagggctgagatagagcacttgaggaagacatcgtcccggggctgagatccagatcttgttgca

SEQ ID NO: 84728 - DNA, 601 bp, Human
cctgctctcagccccatcacctgctgttcaggcttcttcacctggtagagggacccaaaccttccttcctcaggggttcaaatcttcagttctcctgcctggttttggttgctgtaattctctattaacctttactagaagccatggaaataataagagatgcaccagaggatcacccgggttccagacctggcctctttgcctagattgggtagaagcaacccggttgccctgtgctaatcataagcaatcacaacagacagtagattaacccaccctttcctgcctgttggtttggtgrcataatgggaccaaagtgtccaggtgctcatcccgtgtttaaattcggtggaaccactgctttatagcctggtggaagaatccccatttcctcccttggggaccaagatctccaaaccagtgggcttaaagttgctgagacaggaatgaaatattctgtgcattgtttattagcgagaggagccaccctcactttcaccctttgaattctggacccacatattgtagctgtgagagaggctgcaccatatatgggtttctggtccaaagcatatgctgcattctatgaaacagaattcta

SEQ ID NO: 84729 - DNA, 601 bp, Human
tattaacctttactagaagccatggaaataataagagatgcaccagaggatcacccgggttccagacctggcctctttgcctagattgggtagaagcaacccggttgccctgtgctaatcataagcaatcacaacagacagtagattaacccaccctttcctgcctgttggtttggtgacataatgggaccaaagtgtccaggtgctcatcccgtgtttaaattcggtggaaccactgctttatagcctggtggaagaatccccatttcctcccttggggaccaagatctccaaaccagtrggcttaaagttgctgagacaggaatgaaatattctgtgcattgtttattagcgagaggagccaccctcactttcaccctttgaattctggacccacatattgtagctgtgagagaggctgcaccatatatgggtttctggtccaaagcatatgctgcattctatgaaacagaattctactcttcaggttattttgttccaactggcgctgtaacttgggtcttttggaagcctttctacttttcagttagggcagccacttctgggtgacaaggaaatgtcaaactcctccttggcagtt

SEQ ID NO: 84730 - DNA, 601 bp, Human
ggcctctttgcctagattgggtagaagcaacccggttgccctgtgctaatcataagcaatcacaacagacagtagattaacccaccctttcctgcctgttggtttggtgacataatgggaccaaagtgtccaggtgctcatcccgtgtttaaattcggtggaaccactgctttatagcctggtggaagaatccccatttcctcccttggggaccaagatctccaaaccagtgggcttaaagttgctgagacaggaatgaaatattctgtgcattgtttattagcgagaggagccaccctcrctttcaccctttgaattctggacccacatattgtagctgtgagagaggctgcaccatatatgggtttctggtccaaagcatatgctgcattctatgaaacagaattctactcttcaggttattttgttccaactggcgctgtaacttgggtcttttggaagcctttctacttttcagttagggcagccacttctgggtgacaaggaaatgtcaaactcctccttggcagttcttttttgacactgtatcgatagcaggtttgctgcagtttctgtatttttgttacagctggcctgtcag

SEQ ID NO: 84731 - DNA, 601 bp, Human
attgtgaatgctaagggctgtgcacgtagcagggttgaggtatgatgtgttcttctcactatcagtggttgtgatcagcgttcgactttgaacctacctggagctgaagaaagggtaccggccccccggttcatatcatcatgtctctgtttcaggacccctagaggcagtgctcattctgtggaggtgggggaagggacaacattgtggagagaaggctagaaaaggaatgaggaagaggttgacattcccagtctgtgtcttcctgtcccctctttctctgctctccctcacagaggcwcacacgcacattctgtctctctgccatccaaacagatgcagctgctctggagtcaaccagacttaacgaggagacaactcttctgctttcttccgtcttcttcctacccaccccctgacctaatgctgtgcttgcctgttacagcaggcctaggaggaaatgcactatgccttccctgtttttgttttgtgtgtgttttgagatgcagacctaaaaatattctgctgtataatcggttatccaatcagccatgcgaataatcactgtgccagagcctataggaaatgaggcaggagcctg

SEQ ID NO: 84732 - DNA, 601 bp, Human
tctgtgtcttcctgtcccctctttctctgctctccctcacagaggctcacacgcacattctgtctctctgccatccaaacagatgcagctgctctggagtcaaccagacttaacgaggagacaactcttctgctttcttccgtcttcttcctacccaccccctgacctaatgctgtgcttgcctgttacagcaggcctaggaggaaatgcactatgccttccctgtttttgttttgtgtgtgttttgagatgcagacctaaaaatattctgctgtataatcggttatccaatcagccatgygaataatcactgtgccagagcctataggaaatgaggcaggagcctgaaactcagaagcatgccagctttgccttgcctttttttctttttttttttaaatgtgctcccttgggatctgggtttgagggttgagataggaggatatgctgggtgggtttccatggaggcaggtgcaggacactgatggtatgtctccctggtgggttgaggggaaagaatggttggtgtcacagtaggagttttgcacgtagttgaggcagtttgacttatgcctcttgaacctctattccctcctctggg

SEQ ID NO: 84733 - DNA, 601 bp, Human
gcagacctaaaaatattctgctgtataatcggttatccaatcagccatgcgaataatcactgtgccagagcctataggaaatgaggcaggagcctgaaactcagaagcatgccagctttgccttgcctttttttctttttttttttaaatgtgctcccttgggatctgggtttgagggttgagataggaggatatgctgggtgggtttccatggaggcaggtgcaggacactgatggtatgtctccctggtgggttgaggggaaagaatggttggtgtcacagtaggagttttgcacgtarttgaggcagtttgacttatgcctcttgaacctctattccctcctctgggccttgcttccagatgctgcctccctcccccagcacacctgcctggaatgttctctctcctcctctctgcttttccaagtcctgccgatcccctgaggtctagccctctatgttgtcagcaggaccaaccattcatagcggctgttgtctcacgatactcactgttgatagcagaagcatccagctcccatacctctgtgtagggcttgtgtttccagagtcactgtgtgctctcctctccactgtctcccc

SEQ ID NO: 84734 - DNA, 601 bp, Human
cacagactgagattgaaattctggccctgctgctccctagctgtgtgacctcgggcaagtcacttcacctctttgacctcaatatcattattggtgaaatggggttaataactcttaggtcctagggttttgtgggatgatgcacttgtacccctttgcaggcagcccttacccggcagcccccactgccaacgtctctgttgtgttcaagtctgtttcatgagccagtgtaacctccctccatgcagaaacaacgctgtaaagtattagcataacagtaggtccattgggcagaaaccayaccaataaaacgggcacaccccacagtggctctgatttccacacccttcccaaccccgcactcccaagccttgcccagggctttccatggactgagcctcagtagaaagaggttgaattagattttgaattttctcatgcctcctgtctcctggccctcagaaaattaaaatccagcattggaattagtcatggaaaaatccccattttctttcctttcattcctctgtgaagatcataggttcaggttatttctttgaattaattggctaagcctcagtgaaacatgggtaatttacct

SEQ ID NO: 84735 - DNA, 601 bp, Human
ctctaaggtgaatgtcctttccctaacatgtctgaccttctccttcctcggcattgggaccctgggtaggagggccagtagaagatccctcagcagaacttaactggccaccagtccagagtggaaggctgctgcttgtttaaaattttaatccctttctttaagtgtgaagaatactgggcaagtgtaaaagaagggaagacatggtctcttccaaccagaaatgtataaactcgctgcagtgcctaggacacatgcgtctttattgaacaaatagttattgaatgtccgcttggtgccyggccctgtgctaagcattggtaatatggtggcaaaatagaaaagatacctcttaggcttctggccatgggcacagacagttaacaaggataatcaagttacagattgttacaagtgctatgaagaaaatttatgaaaaattaaatagcaatgtaagtaggacacactaaaataatacactaagtatcatgtatcagctctggctgcctccctctctttaaagcagagaagtccaggctctcaggggtgcgacagagccaggacaggtgtctagtgagcggcctttccatgggcagtgtgt

SEQ ID NO: 84736 - DNA, 601 bp, Human
agagccaggacaggtgtctagtgagcggcctttccatgggcagtgtgtatggaggggcctggaggtgtgggagtggccattttagaagggtgttgagattaatttctaccgttagaacccagttctcgtccatctctcttttcttcttctttgtttttgagacagggtcttactctgtccaggctggagtgcagtggtgtgatcatagcttattgcagccttgaattcctgggctcaagtaatcctcctgcctcagcctgcccagtagctaggactacaggcacaccaacacacctggctrtatattttttctgtttttgtagagatggggtctcacagtgttgcccagactggtctcaaactcttgcgctcaaaggatttcccctcttggcttcccaaagtgctgggattacaggcgtgagccatgattccccacctggtccctctgttaaagcagaactcacagaagaaagcccaaaggaacaaaatttgtactttcatgatgtgggaacatctcttccagttgagaactctctaaagcatttgcaatcatagatttgtgtaagaacttgatttgcaccctaaattttgggatgtattt

SEQ ID NO: 84737 - DNA, 601 bp, Human
caggcgtgagccatgattccccacctggtccctctgttaaagcagaactcacagaagaaagcccaaaggaacaaaatttgtactttcatgatgtgggaacatctcttccagttgagaactctctaaagcatttgcaatcatagatttgtgtaagaacttgatttgcaccctaaattttgggatgtatttattacataagcagatatacctggatttgcataacagaaaggactattttggggtgacttatgacagatctgctatgtgaaagcctccaggaacttttagcatcagttgagayctgggggaaacagagaggaaggagcgtgcaggcactgaggccagaggaagaagggatgtgcctgtcctcagtggctagccatgacactgccagaggagcactgagaagggagcaagaagagcacttcctaagtggcgagaatacccagctgcaaacaaaacctcagacacagcctgaagctctgtgtccttttgtgcagccccttccttaccccattgagtagcagcttggagaagagctttttattacagatgacacctatgaatgcaagtgagggaaaagaaccgactaagccagagc

SEQ ID NO: 84738 - DNA, 601 bp, Human
ataaaagtctgatacagtaacttcatcaaaatcaaaacttgtgttcatcaaaagatgctgttaagaaaaagtaagtaagccactaattgggagaaaatatttgcaaaacatctatctgatgaaacatttgtacgcaggacaaataaagcatccatgcaacacaataataaacaagcgagcgatttttttaaatgggcagaaaatttaacagatatttttaatagaagatataatggccaagaggctcataaaaagatgttcaacattattgttttcagaaaaatgcaagttaaaaccatargacatgctactacacacctaccaaagtgactaaaatgaaaaagctaataaaactaatgttggtgaggatgtagaacaactggagactcttaacgcatcatcggaggggctgtacaatggtccagacactttgggtaaactttttttttttttctttttttgagacagagtctcactctgtcacccaggctggagtgcagtgacacgataatctcagctcacggcaacctctatctcctgggttcaggtgaatctcctgcctcagcctcagcagtagctgggatcacaggcgtaagccacc

SEQ ID NO: 84739 - DNA, 601 bp, Human
ttataaggcctgtgacccagcaattttattcgtaggtatttgcccaagggaaataaaaacatgtccacaaaaatatttatacacaaattattatagcaactttattcataataagaaaaataatgcggccattaaaaagaacaagatcatgccctttgcagggacatggatggagctagaggccattatccttagcaaactaacccaggaacagaaaaccaaatactgcatgttctcacttataagtgggagctaaatgatgagaacacatggacacagagggcaacaacacacactgggkccttttggaggttggagggtagggggcgggagaggatcaggaaaaacaactaatgtgtactaggcttgatacctgggtgatgaaataatctgtacaagtttacctgtaacaaatctgcactcgtacccctgaacttaaaaaaaggtagaaacagcatagatgtccgtcgggagaatggataaacaaattatgatatattcatacaatggaatgctactcagcaagaaaaaggcatgaactgtgatagagggaggtaacataattatgttcaatgaaagaagcctttttttttttttgaga

SEQ ID NO: 84740 - DNA, 601 bp, Human
tggatggagctagaggccattatccttagcaaactaacccaggaacagaaaaccaaatactgcatgttctcacttataagtgggagctaaatgatgagaacacatggacacagagggcaacaacacacactgggtccttttggaggttggagggtagggggcgggagaggatcaggaaaaacaactaatgtgtactaggcttgatacctgggtgatgaaataatctgtacaagtttacctgtaacaaatctgcactcgtacccctgaacttaaaaaaaggtagaaacagcatagatgtccrtcgggagaatggataaacaaattatgatatattcatacaatggaatgctactcagcaagaaaaaggcatgaactgtgatagagggaggtaacataattatgttcaatgaaagaagcctttttttttttttgagacggagtcttgctctgtcacccaggctgcagtgcaatggctcgatctccgctcactgcaagctctctgcctcccgggttcaagccattctcctgcctcagcctcctgcatagctggcactacaggcgctcgccaacacgtttggctaattttttgtatttttactag

SEQ ID NO: 84741 - DNA, 601 bp, Human
tgcactcgtacccctgaacttaaaaaaaggtagaaacagcatagatgtccgtcgggagaatggataaacaaattatgatatattcatacaatggaatgctactcagcaagaaaaaggcatgaactgtgatagagggaggtaacataattatgttcaatgaaagaagcctttttttttttttgagacggagtcttgctctgtcacccaggctgcagtgcaatggctcgatctccgctcactgcaagctctctgcctcccgggttcaagccattctcctgcctcagcctcctgcatagctggsactacaggcgctcgccaacacgtttggctaattttttgtatttttactagggacggggtttcaccgtgttaaccaggatggtctggatctgacctcgtgatcagccggtcttggccttccgaagtgctgggattacaggcgtgagccaccgcgcccggccgaaagaagccttaaaagagaaagcgcggtgtatcaaaactcactaaatgccacatctaagatttatgcatttctcaatgtgtatattttactttaaaatactcataaccaaatattaaactctagatggtgatatacatg

SEQ ID NO: 84742 - DNA, 601 bp, Human
ccaccacaggagcctttgcaatgtagctgatttatcaaattcagaagaatacttccagcgtctctgactcatttgatcacctggatacctttgagttaatcttccagccacagctctgattctccccttttgactgtgatcatcctgaaggtgtttccctcaatgctgagtgcttggagccgctttagaattgctttcactctctgttaatttggagaacaaagaatcaataagtagaaggagattgggaaattagtgatcggggacggtgcagagttcataaataatttaaaatatacaragttctggcttttcaacagagattttaataaaagatgaacaaggtcatcttcttccttctgatgaaagttacccatctgtagtgccatggcggatgctgtgtacaagagctgaaatggtggttcctgttaactttgagagctttggacaaaaatgccagatacatccttctagatagcaatatcaggcgagcctttgagtggggaggggaagttataaaccactgtagagaatcacagagtgaaccgaggacagagattggatcaacactccattccttttctgttttcttggaatgaag

SEQ ID NO: 84743 - DNA, 601 bp, Human
ttggagccgctttagaattgctttcactctctgttaatttggagaacaaagaatcaataagtagaaggagattgggaaattagtgatcggggacggtgcagagttcataaataatttaaaatatacagagttctggcttttcaacagagattttaataaaagatgaacaaggtcatcttcttccttctgatgaaagttacccatctgtagtgccatggcggatgctgtgtacaagagctgaaatggtggttcctgttaactttgagagctttggacaaaaatgccagatacatccttctasatagcaatatcaggcgagcctttgagtggggaggggaagttataaaccactgtagagaatcacagagtgaaccgaggacagagattggatcaacactccattccttttctgttttcttggaatgaagtcagagcaacattgttttcatttttgtttgcagtgaacctaatttttgaactgatctatgtagtaataagcacaggaaaggaaaagtggaagaaaggagattcagcacattagctagtgaggtcttgcgtgataacgaagacaacacaagcctgagccctcctggctagtgag

SEQ ID NO: 84744 - DNA, 601 bp, Human
tataaaccactgtagagaatcacagagtgaaccgaggacagagattggatcaacactccattccttttctgttttcttggaatgaagtcagagcaacattgttttcatttttgtttgcagtgaacctaatttttgaactgatctatgtagtaataagcacaggaaaggaaaagtggaagaaaggagattcagcacattagctagtgaggtcttgcgtgataacgaagacaacacaagcctgagccctcctggctagtgaggttggctctgcctgcctttgcccatcccaccaccttctccygtgctgagcctttcccagccagacagtgttttgaggggcctttactacccctctccctgccagccccagcctagctgtaatcacccatctggaaggcgtgttttcctggcatttacctcccattatatggcacttcacttgggaagtgctccaacagaggcactctgctgtatcccaagaagccctcaatggcattaccgtaattctgtttatatgacgcacccccaaattcttgagctgtggctgtgacagaatcagtaattggaaatagaatttctgtgatagtcactgagttccccc

SEQ ID NO: 84745 - DNA, 601 bp, Human
atggcattaccgtaattctgtttatatgacgcacccccaaattcttgagctgtggctgtgacagaatcagtaattggaaatagaatttctgtgatagtcactgagttcccccaagtattaggcctgggagtggacttgtccaggtggtatccgtgggattgtgtaggggcaaacagcgatggataccctgttgatatactgagagatgctaagaaatccaaagcattccagtgacagcgaacattgcattgatagaatagggatgtaagaaggctgattaattgccacatttgataaaggsttggagaggggatgaagggggaagaacgtgtgtgtgtgcatgcacgctaaggagtaccacgatagtttgtgtgtttcttccattgttttcagccctggataaagagggcccacctgtctccaaatccctggtagcaggcagagctcagtacagtaggctatattgggtatagggcatctatgaggcaaagaccatatctcactcacatccgggtcttgaggtcctgacattgagagtgtgccctggaaagagcaccgaaggttagtgagggcagctgcgtctgagcactggtgctgatgc

SEQ ID NO: 84746 - DNA, 601 bp, Human
ttgccgaaactataatccataaccacccagatttctattagaccttcatgttcatttacagataggacttaattttcttaatcagttaccaattgttgggtgactggttccctgttaatgtatggttgggtgagtgggccagctgggtatacagaggttcagggtattcaatgcagaaaggacctgaagatccatggaggtcatgtggtccaactttctgccttcagaggaggagtgtgtgtggggtgcacatctgagaaaatttacagactaggctggggtggggataaaggagagtctyatctgtaggtctgctgctttgggtttctttagattagcttagaagctggaaactggccaacgaaatgcacagaattgctggaattctggagaagagtttgcaccttactctgtactttctaattaaaagggggacccctcagaggtgattccgattctggactcccactggtgtagtgtggcaggttgagtttgccgccccgggcacatcccctcatggtcagagggatgaagaggagggggtgaatgtcaggttccagaaaagcctgctctaaagtcatttcctggtcatgctgatctg

SEQ ID NO: 84747 - DNA, 601 bp, Human
agtttgcaccttactctgtactttctaattaaaagggggacccctcagaggtgattccgattctggactcccactggtgtagtgtggcaggttgagtttgccgccccgggcacatcccctcatggtcagagggatgaagaggagggggtgaatgtcaggttccagaaaagcctgctctaaagtcatttcctggtcatgctgatctggaaatagctgagaactgtgattgagacccaagttttgcccccaaagctagctttatatatggttgtagcagtcaggacctaccagatggaggggrcctgtgggatagggataacaggtgccgtgtgcattggcacacaggagggcaagaggggagagagggaaaggctgcgaggggaaatggagagagaaaggaggctcttaggaaaatccctggaggagggaagacttctaacctgagccgaggccctgagccagttcctctgattttttttttaaagtcaaacatggataaagtcacactcaggtgtcactgtgaggggaaaggtggagaaaagtgactgtggtttcagtttcagctttagccaccatcttggcttatgatgttagatcagtt

SEQ ID NO: 84748 - DNA, 601 bp, Human
agtcatttcctggtcatgctgatctggaaatagctgagaactgtgattgagacccaagttttgcccccaaagctagctttatatatggttgtagcagtcaggacctaccagatggaggggacctgtgggatagggataacaggtgccgtgtgcattggcacacaggagggcaagaggggagagagggaaaggctgcgaggggaaatggagagagaaaggaggctcttaggaaaatccctggaggagggaagacttctaacctgagccgaggccctgagccagttcctctgattttttttttaaagtcaaacatggataaagtcacactcaggtgtcactgtgaggggaaaggtggagaaaagtgactgtggtttcagtttcagctttagccaccatcttggcttatgatgttagatcagttcttgcctctctctgagcctcaatttacctatctatattttattagttgaggaatcctgaattgtaacatgaaatggttgtatgtttccaatctctgcttttacctgtgccttgttggatctccctctccccttcctagatgacctcttgggcagacttcccattttcagttaacgaaacg

SEQ ID NO: 84749 - DNA, 601 bp, Human
gttggtttttgcagcttctctagctgaaactggccaggcagcagcacccttggtctgacaggcatctacgtgcagattcctgctgaaattctgtggagacctctccacctcacaggtcccaatagggatttgtggctctggttcagccactctgatccctgctgcacagcctctggttgctagagtaaccttgcatggtggccagttcccctgggtgagatcccagagagagctcaagcctagccaccctgtggggcccacttaacttgcaggaagctcatgggtctctgccaggtcaaarggtagcatggcgactgtcctagcacaggcgagcggagcagcggttcaggactgtagccaaagctgagagttccctggggtctgaggtgctagtttatccatcttgcaaacgtgattgtcttgatgattctcttaagtccccgtttcttagatctaggaaggggacctccctctagctgttatcctcttccacaaggctgccaacatgctgatgctgtgttccctctcaagcctcactagcctgtggctgtggatgggtggggggtgggggatggtggaaaagggatggttgattataaag

SEQ ID NO: 84750 - DNA, 601 bp, Human
tgttccctctcaagcctcactagcctgtggctgtggatgggtggggggtgggggatggtggaaaagggatggttgattataaagggctggcttagtgagccctgggctggggagatgtctagttccatctgttggtttcttagaaaatgaggtattcaggccgggtgtggtgactcatgtctgtaatcccagcactttgggaggccgaggtgggcagatcacctgaggtcaggagttcgagaccagcctggccaacatggtgaaaccccatctctactaaaaatacaaaaattagcccagygtggtggtaggcatctgtaatcccagctactcaggaggcagaggctgaggtaggagaatcgcttgaacctgggaggcggaggttgtggtggccctgagatcacaccattgcattccagcctgggtgacagagcgagactccatctcaaaaaaaataaataaataaaataaaataaaatgaggtattcagttcttgttttcagcagggagccctgtcttctctaatacctgggtaacaggaagcagtcacccaactctcctttatgtacagaatgaagaattttatcataacccacactac

SEQ ID NO: 84751 - DNA, 601 bp, Human
gtattcaggccgggtgtggtgactcatgtctgtaatcccagcactttgggaggccgaggtgggcagatcacctgaggtcaggagttcgagaccagcctggccaacatggtgaaaccccatctctactaaaaatacaaaaattagcccagtgtggtggtaggcatctgtaatcccagctactcaggaggcagaggctgaggtaggagaatcgcttgaacctgggaggcggaggttgtggtggccctgagatcacaccattgcattccagcctgggtgacagagcgagactccatctcaaaawaaataaataaataaaataaaataaaatgaggtattcagttcttgttttcagcagggagccctgtcttctctaatacctgggtaacaggaagcagtcacccaactctcctttatgtacagaatgaagaattttatcataacccacactactataccttagatacacacataagcacaagtgtcagatgcagaccctgtgccttttatttgtgttgtctttctgtgcttttgctgttctctctgtggttatttgtcaaagtatgagggtaacttcttgtggaaggacagatgttaagtattc

SEQ ID NO: 84752 - DNA, 601 bp, Human
tcacctgaggtcaggagttcgagaccagcctggccaacatggtgaaaccccatctctactaaaaatacaaaaattagcccagtgtggtggtaggcatctgtaatcccagctactcaggaggcagaggctgaggtaggagaatcgcttgaacctgggaggcggaggttgtggtggccctgagatcacaccattgcattccagcctgggtgacagagcgagactccatctcaaaaaaaataaataaataaaataaaataaaatgaggtattcagttcttgttttcagcagggagccctgtcttctctaatacctgggtaacaggaagcagtcacccaactctcctttatgtacagaatgaagaattttatcataacccacactactataccttagatacacacataagcacaagtgtcagatgcagaccctgtgccttttatttgtgttgtctttctgtgcttttgctgttctctctgtggttatttgtcaaagtatgagggtaacttcttgtggaaggacagatgttaagtattctttaaggccattgtaagctccccatcttccaaaccttagagagtcaacacacactgttctgagtctg

SEQ ID NO: 84753 - DNA, 601 bp, Human
gcccagtgtggtggtaggcatctgtaatcccagctactcaggaggcagaggctgaggtaggagaatcgcttgaacctgggaggcggaggttgtggtggccctgagatcacaccattgcattccagcctgggtgacagagcgagactccatctcaaaaaaaataaataaataaaataaaataaaatgaggtattcagttcttgttttcagcagggagccctgtcttctctaatacctgggtaacaggaagcagtcacccaactctcctttatgtacagaatgaagaattttatcataacccrcactactataccttagatacacacataagcacaagtgtcagatgcagaccctgtgccttttatttgtgttgtctttctgtgcttttgctgttctctctgtggttatttgtcaaagtatgagggtaacttcttgtggaaggacagatgttaagtattctttaaggccattgtaagctccccatcttccaaaccttagagagtcaacacacactgttctgagtctgctgtgtgcttacatcagtgctgacagaccaaattatagtactccctaacccaattctaaaggatgaatgccatggc

SEQ ID NO: 84754 - DNA, 601 bp, Human
aggttgtggtggccctgagatcacaccattgcattccagcctgggtgacagagcgagactccatctcaaaaaaaataaataaataaaataaaataaaatgaggtattcagttcttgttttcagcagggagccctgtcttctctaatacctgggtaacaggaagcagtcacccaactctcctttatgtacagaatgaagaattttatcataacccacactactataccttagatacacacataagcacaagtgtcagatgcagaccctgtgccttttatttgtgttgtctttctgtgctttygctgttctctctgtggttatttgtcaaagtatgagggtaacttcttgtggaaggacagatgttaagtattctttaaggccattgtaagctccccatcttccaaaccttagagagtcaacacacactgttctgagtctgctgtgtgcttacatcagtgctgacagaccaaattatagtactccctaacccaattctaaaggatgaatgccatggcacttaaagtattttgcagaaactattattttaacttattttcacagtggctatgggttttttatagtcttgtaggaactttggtta

SEQ ID NO: 84755 - DNA, 601 bp, Human
gttctctctgtggttatttgtcaaagtatgagggtaacttcttgtggaaggacagatgttaagtattctttaaggccattgtaagctccccatcttccaaaccttagagagtcaacacacactgttctgagtctgctgtgtgcttacatcagtgctgacagaccaaattatagtactccctaacccaattctaaaggatgaatgccatggcacttaaagtattttgcagaaactattattttaacttattttcacagtggctatgggttttttatagtcttgtaggaactttggttaaatrcagagtaaaaactgaagctgctatgggaataatgagggatcaggtccttcaaggtcttaaaaaaaatctctaagtagcagtttcttttgtgcctgcaattctgaattgcagtgtgtccctccagacaaagctgagcgccatatgtgactgtgcctgtttgtgttttcgaaagcctcagcggtcactgccatttcagtgcctgcaagtcttgacaggaagcagtggtaaaagactgtcagaacctgtttgtaaaaatgtttgtgtttgcaaagatttttgctagtattccatgcatatctt

SEQ ID NO: 84756 - DNA, 601 bp, Human
tatagtactccctaacccaattctaaaggatgaatgccatggcacttaaagtattttgcagaaactattattttaacttattttcacagtggctatgggttttttatagtcttgtaggaactttggttaaatacagagtaaaaactgaagctgctatgggaataatgagggatcaggtccttcaaggtcttaaaaaaaatctctaagtagcagtttcttttgtgcctgcaattctgaattgcagtgtgtccctccagacaaagctgagcgccatatgtgactgtgcctgtttgtgttttcraaagcctcagcggtcactgccatttcagtgcctgcaagtcttgacaggaagcagtggtaaaagactgtcagaacctgtttgtaaaaatgtttgtgtttgcaaagatttttgctagtattccatgcatatcttagctattaagcaaaaatattataccattcatcttagaagaaggaacaaggctaggtaatcactagcattctcttttctttttctggcagagaactgaaagccaagagcattctatctcatgagcactacaggtctagggcaggggtgagcaaaccttttctgtaaaga

SEQ ID NO: 84757 - DNA, 601 bp, Human
atatcttagctattaagcaaaaatattataccattcatcttagaagaaggaacaaggctaggtaatcactagcattctcttttctttttctggcagagaactgaaagccaagagcattctatctcatgagcactacaggtctagggcaggggtgagcaaaccttttctgtaaagaattgaatagtaaatattctaggctttgtgggccgtgtggtttctgtcacggctactcaggtctgctgccacagagcaaaagcagccttagacaagaaaacaaacgagcgtggttgtgtggcagtaragctttatttacgaaaacctggctggtggaccagaggccataatttgccaacccctggtttagtgaaaagaacaagtttcgagttgtcaccgatggttgaatttagcccaagatggtagctttgcttgtctgattaccttcatgccaacccacattttctctggctgacactaaccaggacagaagcctaggctggtcttccattttctcttaagaaagtgatcagtttatgggattgtatgcactttacctcacccacagcagatgttcaggaactgagtatccaacataggataaaat

SEQ ID NO: 84758 - DNA, 601 bp, Human
ttaagcaaaaatattataccattcatcttagaagaaggaacaaggctaggtaatcactagcattctcttttctttttctggcagagaactgaaagccaagagcattctatctcatgagcactacaggtctagggcaggggtgagcaaaccttttctgtaaagaattgaatagtaaatattctaggctttgtgggccgtgtggtttctgtcacggctactcaggtctgctgccacagagcaaaagcagccttagacaagaaaacaaacgagcgtggttgtgtggcagtaaagctttatttaygaaaacctggctggtggaccagaggccataatttgccaacccctggtttagtgaaaagaacaagtttcgagttgtcaccgatggttgaatttagcccaagatggtagctttgcttgtctgattaccttcatgccaacccacattttctctggctgacactaaccaggacagaagcctaggctggtcttccattttctcttaagaaagtgatcagtttatgggattgtatgcactttacctcacccacagcagatgttcaggaactgagtatccaacataggataaaatacagaatgaaag

SEQ ID NO: 84759 - DNA, 601 bp, Human
ggtaatcactagcattctcttttctttttctggcagagaactgaaagccaagagcattctatctcatgagcactacaggtctagggcaggggtgagcaaaccttttctgtaaagaattgaatagtaaatattctaggctttgtgggccgtgtggtttctgtcacggctactcaggtctgctgccacagagcaaaagcagccttagacaagaaaacaaacgagcgtggttgtgtggcagtaaagctttatttacgaaaacctggctggtggaccagaggccataatttgccaacccctggtytagtgaaaagaacaagtttcgagttgtcaccgatggttgaatttagcccaagatggtagctttgcttgtctgattaccttcatgccaacccacattttctctggctgacactaaccaggacagaagcctaggctggtcttccattttctcttaagaaagtgatcagtttatgggattgtatgcactttacctcacccacagcagatgttcaggaactgagtatccaacataggataaaatacagaatgaaagcatcctttaacattgagatgaggttgtggtgaaggggaggagttagca

SEQ ID NO: 84760 - DNA, 601 bp, Human
cattctatctcatgagcactacaggtctagggcaggggtgagcaaaccttttctgtaaagaattgaatagtaaatattctaggctttgtgggccgtgtggtttctgtcacggctactcaggtctgctgccacagagcaaaagcagccttagacaagaaaacaaacgagcgtggttgtgtggcagtaaagctttatttacgaaaacctggctggtggaccagaggccataatttgccaacccctggtttagtgaaaagaacaagtttcgagttgtcaccgatggttgaatttagcccaagayggtagctttgcttgtctgattaccttcatgccaacccacattttctctggctgacactaaccaggacagaagcctaggctggtcttccattttctcttaagaaagtgatcagtttatgggattgtatgcactttacctcacccacagcagatgttcaggaactgagtatccaacataggataaaatacagaatgaaagcatcctttaacattgagatgaggttgtggtgaaggggaggagttagcagtctgtcactggggtgactttctggggagctctaatcagtcatgtgtttctgct

SEQ ID NO: 84761 - DNA, 601 bp, Human
actaaccaggacagaagcctaggctggtcttccattttctcttaagaaagtgatcagtttatgggattgtatgcactttacctcacccacagcagatgttcaggaactgagtatccaacataggataaaatacagaatgaaagcatcctttaacattgagatgaggttgtggtgaaggggaggagttagcagtctgtcactggggtgactttctggggagctctaatcagtcatgtgtttctgctagcagcagcatcccctcctcattcctcatgtggcatacattgcaggtcttcctggygcagatgctttctttgctcacacacattccctcccttctttcgtttttctccccccagcacacaatgctgctgctgccacacaccatttcaccccatgctggcccacaaagaagacagaggttgatgacatagcatgcaacttcagaaagttcaccactttgagccccgatgtataaatggtagcagttggtactaactctgccagtgcgttcaaaagtcatcataaggacaatgtgatatttatttaaatacatattgcattgctgactgacagtgtatttgcagtcattatccatttc

SEQ ID NO: 84762 - DNA, 601 bp, Human
agcagtctgtcactggggtgactttctggggagctctaatcagtcatgtgtttctgctagcagcagcatcccctcctcattcctcatgtggcatacattgcaggtcttcctggcgcagatgctttctttgctcacacacattccctcccttctttcgtttttctccccccagcacacaatgctgctgctgccacacaccatttcaccccatgctggcccacaaagaagacagaggttgatgacatagcatgcaacttcagaaagttcaccactttgagccccgatgtataaatggtagcasttggtactaactctgccagtgcgttcaaaagtcatcataaggacaatgtgatatttatttaaatacatattgcattgctgactgacagtgtatttgcagtcattatccatttctagagacaagttcatggcaagcatggtaaaaagctggacctcaggagggaactgaggacaaagtaagccctgatgactctcactggcctcctgctgcacctgtccttatatttgacctgttaggttggttactttaaaaagccagttacggggaggctcatttaaaaagacataacacctgtgaaag

SEQ ID NO: 84763 - DNA, 601 bp, Human
aactgaggacaaagtaagccctgatgactctcactggcctcctgctgcacctgtccttatatttgacctgttaggttggttactttaaaaagccagttacggggaggctcatttaaaaagacataacacctgtgaaagattattttaacgtggaatatatgactggacaattatttgccaatctgatgaagtagggccacaggttttgttttcattattctgtatctactgatcagcatatccacttgcttgcacaggctacacctataatgtccacaacttccagttgcctcttatgtamcaatagaacaagaacataaagatacagaggaaagctgagagcaattctaaatgtctatggttttttctttatctcttgttgttatacatccatatctgattcaacaataaaacatgtaacattgcttatccagtacttccaatggattcagcctggtgttttggaagaaacaactctttcttttgcactcgtatctcattatttgagacagtacttaattaatttaggtagttactaatccaactgacataaacttgggaaccaaccaccaactcctgataagcaaacagctcaactctt

SEQ ID NO: 84764 - DNA, 601 bp, Human
ttggttaaaaggaaatctgacagcttctagagtgttggaaaagaggtcaagacctgagcttctaccctcaatggctcaaacaggcataccttggagatatggttggtttggttccagactaccacaataaagcaaatatttgcagtaaagtgagtcacacaaatgtttttgtttcccggtgcatatgaaagttatgtctatactatactgtagtctgttaagtgtccaatagcattatgtctaaaaaatgcacataccttaattaaaaatactttattactaaaaatgctaatgatcatcygagccttcagcaggtcataatctttttggtggtgaggggctttgccttgatgttgatggctgctgaccgatcacagtagtggttgccgaagaaggctggggtggccgtggcaatttcttaaaacaaggaagtttgccacatgatagattcttcctttcatgaaagatttctctgtagcatgggatgctgtttgaccgcattttacccacagtagaacttctctcaaaattggagtcaatcctctcaaaccctgccactgctttatcaactatgtttatgtgatattctaaaccctctgtt

SEQ ID NO: 84765 - DNA, 601 bp, Human
ttggaaaagaggtcaagacctgagcttctaccctcaatggctcaaacaggcataccttggagatatggttggtttggttccagactaccacaataaagcaaatatttgcagtaaagtgagtcacacaaatgtttttgtttcccggtgcatatgaaagttatgtctatactatactgtagtctgttaagtgtccaatagcattatgtctaaaaaatgcacataccttaattaaaaatactttattactaaaaatgctaatgatcatctgagccttcagcaggtcataatctttttggtggtraggggctttgccttgatgttgatggctgctgaccgatcacagtagtggttgccgaagaaggctggggtggccgtggcaatttcttaaaacaaggaagtttgccacatgatagattcttcctttcatgaaagatttctctgtagcatgggatgctgtttgaccgcattttacccacagtagaacttctctcaaaattggagtcaatcctctcaaaccctgccactgctttatcaactatgtttatgtgatattctaaaccctctgtttcatttcaacagtgttcaccaggagtagattcca

SEQ ID NO: 84766 - DNA, 601 bp, Human
accacatttcttaaaaaaatattagcctgtgtggtggcatgtacttacggtcccggctgctcgggaggcggaggttgtaatgagctgagattgcaccattacactccaccctggggaacagagactctgtcttaaaaaacaaaaacaaaaacaaaaaggctgagttagagaagagcaaagtgcttgcccaaggttatatagcttagaccgagtggggattttgaactcagactgcttgactccatatttactgtgctctccagcttagggcaaactggtagccgggaagtcatccagctcratttcagcttgcctcctcctgatttcctggatgtctggtttttaaaaagttaatagcaaactagtatagtgttggctccacagacgtgcttttcagaacccacctatttgccctttactggtaatcaggggtaatcctgtcccatatctgtaccctgatatgtctgggttgtaaaaagtgtaagactggatggtacagttaagctatttgttctggatttgggttttttaagtttggcatttgagcagaatcacaagttgtagaaagtagtaatttccagacatttgagatctgattcac

SEQ ID NO: 84767 - DNA, 601 bp, Human
aaaaagttaatagcaaactagtatagtgttggctccacagacgtgcttttcagaacccacctatttgccctttactggtaatcaggggtaatcctgtcccatatctgtaccctgatatgtctgggttgtaaaaagtgtaagactggatggtacagttaagctatttgttctggatttgggttttttaagtttggcatttgagcagaatcacaagttgtagaaagtagtaatttccagacatttgagatctgattcaccaacattactgtaattaaagaaaaacctatatttgtttgctccrttttgtctcactaggatgttttataaataataaacctagacatttagaaaatagcatctattcagctggttaagctttcgtggcccttcatgttcagatgtctcaaggtgatatgagtgtgcctcaatttatagggagtgactatggatggtgaactatattgacatataaaggcagctttaaaatacagactacagaaatcaagtggcttgacaattcccttagaacatatgtttatgaagtatagagctcaaatgtaatgatttcagttggttacagagtattaatgaattttgaatt

SEQ ID NO: 84768 - DNA, 601 bp, Human
gtacagttaagctatttgttctggatttgggttttttaagtttggcatttgagcagaatcacaagttgtagaaagtagtaatttccagacatttgagatctgattcaccaacattactgtaattaaagaaaaacctatatttgtttgctccgttttgtctcactaggatgttttataaataataaacctagacatttagaaaatagcatctattcagctggttaagctttcgtggcccttcatgttcagatgtctcaaggtgatatgagtgtgcctcaatttatagggagtgactatggayggtgaactatattgacatataaaggcagctttaaaatacagactacagaaatcaagtggcttgacaattcccttagaacatatgtttatgaagtatagagctcaaatgtaatgatttcagttggttacagagtattaatgaattttgaattgaggcaattgtgatcaagcttgttgccttttctaacatgaatcattattaaaatgatgattgtcctccatagttatgaaagcattaaaaaagcatctacctatgcctgaattaacgggacagatgtggttttcagctttcacctggcca

SEQ ID NO: 84769 - DNA, 601 bp, Human
gtggttttcagctttcacctggccaacaggacttccatggttgtgatttcaaggtgcttgtttatgtatatggttttgctggtattttctgagtcttcaataccatttcttgtaatagggtgtgaatgggtgtgtgtgtgcttgctagtatgtccccttggtccttagcattgtgggaatgtaaagtgaagctgagtaggatgtctcaatgtcctagaatcctccagcctttggtttttaagaggtacccctgtgcgagagctcgtggaggcccttctgtgtaacattcacaacacaaccrccacattcagtgacagcaggtgctgagtgcaaaccgtgtgccaggcatttcccaccatcagtatcaatcctcaattccagaaagttggtactgttgtgaccattgagaggatgaggagaccgttgcttggagactttcagtgccttgcctagggccacacgatggaaaagagcagaaccaggaattggactgctcttcaccatcctcatggctgcctggagggcaggcagtcttgggcttccttaaaagatttttgttttgggagggctcttcactgtctcaagaaagctgagggaagaa

SEQ ID NO: 84770 - DNA, 601 bp, Human
atttcttgtaatagggtgtgaatgggtgtgtgtgtgcttgctagtatgtccccttggtccttagcattgtgggaatgtaaagtgaagctgagtaggatgtctcaatgtcctagaatcctccagcctttggtttttaagaggtacccctgtgcgagagctcgtggaggcccttctgtgtaacattcacaacacaaccaccacattcagtgacagcaggtgctgagtgcaaaccgtgtgccaggcatttcccaccatcagtatcaatcctcaattccagaaagttggtactgttgtgaccatygagaggatgaggagaccgttgcttggagactttcagtgccttgcctagggccacacgatggaaaagagcagaaccaggaattggactgctcttcaccatcctcatggctgcctggagggcaggcagtcttgggcttccttaaaagatttttgttttgggagggctcttcactgtctcaagaaagctgagggaagaattcgtctcatttagtggatgaggatacaaaaacatatgttaaaaattacagcctcgggctctgtggaccctgttcaggtgccagagggcttttctcctatattg

SEQ ID NO: 84771 - DNA, 601 bp, Human
tgtgggggctgccctttctctatctgggtttcagcctctccagctcctgcaagacagtgctgttggatctctgtagtgcctcttggtttggccactctgggatttgtgagtcatagtcttcagtttggtgctttttcctactccatcctgccttctgctattcatgccccattgcaagaacaggcattcttccttcccgtataaacttgcaacctggttccacccattctcctctcttcttctccagatagtcgtagagatcgctgcctcccaaaatagccccatttgattccttaggacmggcaggaaactcgctgcccgaccctgcctgagtctccgtttccttagctggagagactgtccttgctctagaaaccaaccaccggaaattcacctccatccctatcacttcctggggtagttctttctgaccattgggtttgcttcttgggtgtctggctctgcatacagttagaagctctttaaataccttttaacttcagggtttttgtggatgtgtatatggtggagggagagagtgtataccagtgagcatgagagcaagagttactatttatcacaactggtgtccaggggtggc

SEQ ID NO: 84772 - DNA, 601 bp, Human
ccggaaattcacctccatccctatcacttcctggggtagttctttctgaccattgggtttgcttcttgggtgtctggctctgcatacagttagaagctctttaaataccttttaacttcagggtttttgtggatgtgtatatggtggagggagagagtgtataccagtgagcatgagagcaagagttactatttatcacaactggtgtccaggggtggctaaagattatcgacttctagagttgtgtttttcaactttttttttaaatcttagtgagcagtaataaatacattgtaactcycaagcacacataaatgtcatctgaaacacgtttgaaaaatatatgcgatttatttgttttttgagatggagtcttgtgctgtcacccagggtgcagtgcagtggtgcaatctcggctcactgcaaccacggcctcctgggttcaaacaattctcctgcctcagcctcctgagtagttgggactacaggtgtgcgccaccacgcccggctaatttttttgtatttttagtagagaaggggtttcaccctgttggccaagctggtctcaaactcctgacctcaagcagtccggcctgccttg

SEQ ID NO: 84773 - DNA, 601 bp, Human
tatggcagggaatggggcaacggggaatctggacagtaagcaaggaagggcatcctcgtagctctgagcgtggcatttcatgtagctgtatgaagggcatgggggaagaaggcatgggggcatgggatgagcctggctaagaacaggactggtctgaagtctagagggggcatgagtatagaggttggagatgagctaggctttctaaattaaattataaacacactgatgctggctaactctcaaaacacacacacacacacacacacacacacacacacaattcgttcactagactgtyataatggtgttctgaggagcaaagggagctttggagggcaagtgtttagaaatgacaggaaccacaacagccctgtccttggaaggaagccctgttatatgaccagtgaagagtggagaatgggggcaaagactgggatgcatggccatggctgcatggtggtcaagagggaggatacctgtggcacgacaaagggatgttctgcctggcacggccggtgacagaggggaagcgattctggcagcagacagccggagcccaggggcagcacaggcaaggcttccatttaaatgcacaagg

SEQ ID NO: 84774 - DNA, 601 bp, Human
cagtgaagagtggagaatgggggcaaagactgggatgcatggccatggctgcatggtggtcaagagggaggatacctgtggcacgacaaagggatgttctgcctggcacggccggtgacagaggggaagcgattctggcagcagacagccggagcccaggggcagcacaggcaaggcttccatttaaatgcacaagggtgttggggatactgcaagcaaacatttaataggtgacggttcctcaaagggtcaggcttatgggaatcatcctaaaatttgtgtttttaaaaatgtttctgartataaagtgttctcttcagaaacataaaatttattttcaaatacacatttgcctattgcataaaaatatataatagtgataatatatagcaaagtgctttttttccccctggaatccgttgtgaaaaggcaggggtggcctgatgggagggctgaagatagagaatcgctcttgtcagttactacttttgtgactcttgagaaattctctgtgtgtacattcaaaacttccccctccacacacctcccccccacaccaacagactaaatgacaggtaccatagtggggacatttttctgg

SEQ ID NO: 84775 - DNA, 601 bp, Human
ccatttctctaaggtattggtaacttttcgggtcccactgatattagtataggactctatagttcatattggaaagttacagttgctgatgatactttgttatttaagtagcttcatgccgaggaatgcctcttgcaaagttaattacacacatctctgttggtccatgtttctattgaaactgaagctgtataaagaaaacatttgtaaaagaggaaggagtcaaagtttttagacttgctgattggtatgttttccacagctcatggagttgcatgggttggaactggaaaggttctaygagtcatttagcccgtgagcagcacctgtgaggtctgtggcagtcagatgggcatggctgctgggatggatactagaggaaaggtcagaggctctgcctaggtttcctgggaaagtgcatgatgacctgtcacaagttcagccgggagaggcggcatgccaataagcaggcagggtgtttgccatcctgaatttacttcccttattgtgtggatgcaaaaacttatatccagaggaggagaaggacttgtccaaggttaccttgctactcagtgacaaagctgactgtgacttcgaactc

SEQ ID NO: 84776 - DNA, 601 bp, Human; identical to SEQ ID NO: 19985

SEQ ID NO: 84777 - DNA, 601 bp, Human; identical to SEQ ID NO: 19986

SEQ ID NO: 84778 - DNA, 601 bp, Human; identical to SEQ ID NO: 19987

SEQ ID NO: 84779 - DNA, 601 bp, Human; identical to SEQ ID NO: 19988

SEQ ID NO: 84780 - DNA, 601 bp, Human; identical to SEQ ID NO: 19989

SEQ ID NO: 84781 - DNA, 601 bp, Human; identical to SEQ ID NO: 19990

SEQ ID NO: 84782 - DNA, 601 bp, Human; identical to SEQ ID NO: 19991

SEQ ID NO: 84783 - DNA, 601 bp, Human; identical to SEQ ID NO: 19992

SEQ ID NO: 84784 - DNA, 601 bp, Human; identical to SEQ ID NO: 19993

SEQ ID NO: 84785 - DNA, 601 bp, Human; identical to SEQ ID NO: 19994

SEQ ID NO: 84786 - DNA, 601 bp, Human; identical to SEQ ID NO: 19995

SEQ ID NO: 84787 - DNA, 601 bp, Human; identical to SEQ ID NO: 19996

SEQ ID NO: 84788 - DNA, 601 bp, Human; identical to SEQ ID NO: 19997

SEQ ID NO: 84789 - DNA, 601 bp, Human; identical to SEQ ID NO: 19998

SEQ ID NO: 84790 - DNA, 601 bp, Human; identical to SEQ ID NO: 19999

SEQ ID NO: 84791 - DNA, 601 bp, Human; identical to SEQ ID NO: 20000

SEQ ID NO: 84792 - DNA, 601 bp, Human
tgccgggttgtggggggcaggcaggataccaggaggccaagaggggcccacgtctcccagaggagcctctgtcactgcgctgcgcccaggcaccctcaggaagtagtgttgatggatttgattccaggcaagtttatctcctcctcactcactttatcttgctctttccgaggctgtatctcggggaagtgatgtcttcatgtatgctgagttagtgaaaggctttaatcgcatttttggaaacactgccttttccagagcagaaagcagagtgcgtttatccatctcggcttcctttctscatcttcccctaaacctgccctggattgaatgtagtcagttccacaccagggacgcatactgtcacaggaagtccctatgtagagttggcccaggggccagtgcccgccagagagaggagtgggggctgagcctgggatggggccacataaccctcccctgcctgagccgcctcctgtagatgagtggctcctcaagcctccggcccttccacctcaacgtgagaagtgtctctctcctagtaaacctcagtggccttaggctagggttggacatgtgagggtggtgtctattcctggag

SEQ ID NO: 84793 - DNA, 601 bp, Human
ggctagggttggacatgtgagggtggtgtctattcctggagaaataacatcgcatttgattttgccacaggagctttctatacaaggttaacagcaatcctgttgtgaattccttggcgcctcatgtctcctaaacccagctaaactgacggaggccatggaaaccactaattttaacagtgccggtgacatcccttatcttttagctttcccaggcaggaaccgttgccccagcagacatgatgaagtagaggcaggagccagatcgtgaggtgcttaaaaaaagaaaagagaaaaagaygggcgggggggcttcccactatcacaaatggggattaaacctgcaactccgtgggaggtacccaaagctggaggataaaaaaggtacactccttcatggaacaaccagtttactgaaatatattttggggggaaataatttttttaaaaaatattttttcatcaaaacaaaacttagatccctgatggaggagactggaaatgacacatgaaattataaaagaaaacccgagacttctctgcgatttttaactgtcagtgcgggctgtgctcaaacccctagaggctgcacatgacctcc

SEQ ID NO: 84794 - DNA, 601 bp, Human
tcccaggcaggaaccgttgccccagcagacatgatgaagtagaggcaggagccagatcgtgaggtgcttaaaaaaagaaaagagaaaaagatgggcgggggggcttcccactatcacaaatggggattaaacctgcaactccgtgggaggtacccaaagctggaggataaaaaaggtacactccttcatggaacaaccagtttactgaaatatattttggggggaaataatttttttaaaaaatattttttcatcaaaacaaaacttagatccctgatggaggagactggaaatgacacaygaaattataaaagaaaacccgagacttctctgcgatttttaactgtcagtgcgggctgtgctcaaacccctagaggctgcacatgacctcctctctactcccccagaaggcctccggtagggctggtttgggtaaaggcagaaccatgtctgcaaagcacagcctcgcagctttgttcctgatttggccagtatttcctgagatcctgtagagtgcccggctctggtccagaggcgaggggtgccaggatgtctcagacacagacagcggccttgtgcttaggcgttcattatctcatgg

SEQ ID NO: 84795 - DNA, 601 bp, Human
gatatcccccactcccctcactgggttaggtgggaagggtgcagggtactctttggaaattctggagtgtagcattttctggatttcccagcaggtggccacactttacacacacatcaacgttgtactcaatgtcacccaagaggtggctctggagaatgtggaagcactgtgtcagctgcaaagtattacgcaggtctaagtcattgttattatatatttgacaatgtttttttgcacaaattgaggggaacggcatttctattacatagtggttaagcacaccagctttagaatcagrcaaccaagtcttgaatgtttgttctaccttttccagttgtgagatttggggcaagttacttacctctttgagccttactttcctcatctgtgaaatggagctcatcacagtagcagcttcgtgaagttcagtgaggactcagtgagctgaagaatgtagagggcttggcctattgaaattatgacagttcaggaagggtgcatctcttcctggatttgatgcaagaaaagaatcgaatcaattcagtcctttcaaactaattaataatagctggccaagataggtctgtgttagtgaaaa

SEQ ID NO: 84796 - DNA, 601 bp, Human
gcatttctattacatagtggttaagcacaccagctttagaatcagacaaccaagtcttgaatgtttgttctaccttttccagttgtgagatttggggcaagttacttacctctttgagccttactttcctcatctgtgaaatggagctcatcacagtagcagcttcgtgaagttcagtgaggactcagtgagctgaagaatgtagagggcttggcctattgaaattatgacagttcaggaagggtgcatctcttcctggatttgatgcaagaaaagaatcgaatcaattcagtcctttcaractaattaataatagctggccaagataggtctgtgttagtgaaaagcccaagttatatttttaaaatgttttattatatatataatgacataagctactgctgactaaaggatattactacataaaccccctcctgggcttgctttaaagaatagatcaaaatcatttataattcgcttatgaattcaaacctttggttttggcaacaacttatgaaaaatatttgaaatactttgttaagtagatcttgtatgttgttagacaataaatattgttattaaacccactcttatgacataa

SEQ ID NO: 84797 - DNA, 601 bp, Human
ttatgtttttgaatctcgcctcctacatcccattctggctaattggataccaggggcctagacaaagactcaggcatggctacttttaggaagctttggtttcctaaggcaaagattcatgggatggagaatgtgaagagggaaggtggtgctggtgccggtgtactgtggactgactataccagaattttacatagtggaatcaggtttggtccatttaaattcatactagtaatagccagacaatctctgatttcttctacttgaatggtggctcaagaggcaaaacacaccaatagakagtagttgtattacttgtgaatattttctaagtggagacatatcctctgggaataggcattcttatacatttttcatgactgagattagatttttctctcatttggccaggcacagtggctcacgcctataatcccagcactttcggaggccgaggcagctggaccacccgagatcaggagtttgagaccagcctgactaaggcagtgaaaccctgtctctactaaaaatacaaaaattagccaggcatggtggcgcatgcctgtaatcccagctacttgggaggctgaggcaggagaat

SEQ ID NO: 84798 - DNA, 601 bp, Human
ggtgccggaaagattcagggtccttcggtaccctcacatggcttggctttggtagaacaagaaactaagctctgatttggctttaaatgagagtgctaaatttcctttttctaataaagaacctagctaaacatttatatatacttttgaacactgaactttcttgttgcagagttaacagctgttgggggtagctgacagctggatcctggtgctgttggtaccatggtacctgaagtgcacaggctggtagccacacctgacattaacaagtgagtggtaacctctctgccgctggctyacagctactgtttccatagaaatggctgtcgggatcagtggaaacgaggtaagtgaaagttttcgctgatccttgtttccatcaagctgacgtctgtttccctggcaacagcagtggacagcagccaggcgctagcaacagattcagtagagctctcacttgtcagctgtggctatcatctgttcctgaccaagttctttttttttttttaataatgtacagaaagacctctgaggacccaggaggcacctctggccacatgtgccctcctggatgctcgttttgcagatggagagctgt

SEQ ID NO: 84799 - DNA, 601 bp, Human
ggtgctgttggtaccatggtacctgaagtgcacaggctggtagccacacctgacattaacaagtgagtggtaacctctctgccgctggcttacagctactgtttccatagaaatggctgtcgggatcagtggaaacgaggtaagtgaaagttttcgctgatccttgtttccatcaagctgacgtctgtttccctggcaacagcagtggacagcagccaggcgctagcaacagattcagtagagctctcacttgtcagctgtggctatcatctgttcctgaccaagttctttttttttttttaataatgtacagaaagacctctgaggacccaggaggcacctctggccacatgtgccctcctggatgctcgttttgcagatggagagctgtgtgctgagttgacttctctgtccgcagttccccctccacctgtgctctgggttgttgatgtgcaggttagaagagggaggttgttgagggtattagtgttgcaggggaggctgttgaatctgttgatcccaaatcctaggggaagagaattcattacagtgctttcatgcacagacccagctctttataaagctgttgctaccttaatag

SEQ ID NO: 84800 - DNA, 601 bp, Human
gttttcgctgatccttgtttccatcaagctgacgtctgtttccctggcaacagcagtggacagcagccaggcgctagcaacagattcagtagagctctcacttgtcagctgtggctatcatctgttcctgaccaagttctttttttttttttaataatgtacagaaagacctctgaggacccaggaggcacctctggccacatgtgccctcctggatgctcgttttgcagatggagagctgtgtgctgagttgacttctctgtccgcagttccccctccacctgtgctctgggttgttgaygtgcaggttagaagagggaggttgttgagggtattagtgttgcaggggaggctgttgaatctgttgatcccaaatcctaggggaagagaattcattacagtgctttcatgcacagacccagctctttataaagctgttgctaccttaatagttgaaattaaagccataattttcctgtggtccctattcaattggaggcattaacaattgccattacttttacaatgaaaaggatatttaggagtttaataatttggcttgtgagaaacaaattgatgattgtctctaagatgctactgt

SEQ ID NO: 84801 - DNA, 601 bp, Human
ctgacgtctgtttccctggcaacagcagtggacagcagccaggcgctagcaacagattcagtagagctctcacttgtcagctgtggctatcatctgttcctgaccaagttctttttttttttttaataatgtacagaaagacctctgaggacccaggaggcacctctggccacatgtgccctcctggatgctcgttttgcagatggagagctgtgtgctgagttgacttctctgtccgcagttccccctccacctgtgctctgggttgttgatgtgcaggttagaagagggaggttgttgwgggtattagtgttgcaggggaggctgttgaatctgttgatcccaaatcctaggggaagagaattcattacagtgctttcatgcacagacccagctctttataaagctgttgctaccttaatagttgaaattaaagccataattttcctgtggtccctattcaattggaggcattaacaattgccattacttttacaatgaaaaggatatttaggagtttaataatttggcttgtgagaaacaaattgatgattgtctctaagatgctactgtcaacattatgctttttttctcttttgtg

SEQ ID NO: 84802 - DNA, 601 bp, Human
ggacagcagccaggcgctagcaacagattcagtagagctctcacttgtcagctgtggctatcatctgttcctgaccaagttctttttttttttttaataatgtacagaaagacctctgaggacccaggaggcacctctggccacatgtgccctcctggatgctcgttttgcagatggagagctgtgtgctgagttgacttctctgtccgcagttccccctccacctgtgctctgggttgttgatgtgcaggttagaagagggaggttgttgagggtattagtgttgcaggggaggctgttraatctgttgatcccaaatcctaggggaagagaattcattacagtgctttcatgcacagacccagctctttataaagctgttgctaccttaatagttgaaattaaagccataattttcctgtggtccctattcaattggaggcattaacaattgccattacttttacaatgaaaaggatatttaggagtttaataatttggcttgtgagaaacaaattgatgattgtctctaagatgctactgtcaacattatgctttttttctcttttgtgtaatattcttttacaggatggtaaaattg

SEQ ID NO: 84803 - DNA, 601 bp, Human
taggagtttaataatttggcttgtgagaaacaaattgatgattgtctctaagatgctactgtcaacattatgctttttttctcttttgtgtaatattcttttacaggatggtaaaattgcttttacagagatcaaatattggtattgcagggcagcttggtatacaaagaccagtagatctatagtgtagggaactcttccttgttaaagttcaacagctccttttctggatttcattttaatgtttcaacagatggatgcacccaagccctagccctaagtattctccacccatatgagrcagcattgatggtgccacagagcaaaggagagccactgttcctgccctggtgtgtgagatgagaggcatggaatgaggtgttggttttaagcccttactgataccatttattaaagagattttctctggaaaaaacaaaacagctttgatattcagagctgtatttttgagactcaaatgaacataaagatccacggtcttatgagaacttagatcggctgctagaagagcattggagaaccatggagttttgtctttggagggctttccggatgacattgttccacagctctctggaaa

SEQ ID NO: 84804 - DNA, 601 bp, Human
gtgcctatagtcccagctactcaggaggctgagacaggaggatcgcttgagcctaggagtttgaggttgcagtgagctatgatcatgcttctgcactccagcctggggagcagagtgagaccctgtcttaaaaaaaaaaaagaagaagaagaaaaggtagcaggtgttaattatggaatctaggtgaggtaggcatatgggtgttcattgtataattgtttctacttttatggatgtttgaaattcttcctaataaaatgttgggaaaatctgcatatgaaaatcactgtggctgcagtartatgaatagattggatggatacacaaatggatgtagagagaccaacttaaggctcatataatctgcttccagccacaacatactagtgctaccagactggacctttcaccataaacaactacaaaagactgggcaaaaaataggaagcaactattttcagaaaatggaaataggatatacaggattgcaatccctacgagaagggaaacacatgaggtaaactccgcaattgtcctggctttctgcctggagacagttttagaattatggcagagagggagagcccagcagagaacgatg

SEQ ID NO: 84805 - DNA, 601 bp, Human
tagcaggtgttaattatggaatctaggtgaggtaggcatatgggtgttcattgtataattgtttctacttttatggatgtttgaaattcttcctaataaaatgttgggaaaatctgcatatgaaaatcactgtggctgcagtaatatgaatagattggatggatacacaaatggatgtagagagaccaacttaaggctcatataatctgcttccagccacaacatactagtgctaccagactggacctttcaccataaacaactacaaaagactgggcaaaaaataggaagcaactatttycagaaaatggaaataggatatacaggattgcaatccctacgagaagggaaacacatgaggtaaactccgcaattgtcctggctttctgcctggagacagttttagaattatggcagagagggagagcccagcagagaacgatggtctatttgctgaggggtcaaagaacagtgttcagggctgctaagatagctgggattttcagggcagagtatgggtgagaagtatgcagagaaggggctccagtactcagagtggaggttctttgaaatctgaccatatactaagctgcttctgtgc

SEQ ID NO: 84806 - DNA, 601 bp, Human
atggatgtttgaaattcttcctaataaaatgttgggaaaatctgcatatgaaaatcactgtggctgcagtaatatgaatagattggatggatacacaaatggatgtagagagaccaacttaaggctcatataatctgcttccagccacaacatactagtgctaccagactggacctttcaccataaacaactacaaaagactgggcaaaaaataggaagcaactattttcagaaaatggaaataggatatacaggattgcaatccctacgagaagggaaacacatgaggtaaactccgcarttgtcctggctttctgcctggagacagttttagaattatggcagagagggagagcccagcagagaacgatggtctatttgctgaggggtcaaagaacagtgttcagggctgctaagatagctgggattttcagggcagagtatgggtgagaagtatgcagagaaggggctccagtactcagagtggaggttctttgaaatctgaccatatactaagctgcttctgtgccaggtgatacttattgaagccaggcagagaacagctagtagaatgctgtaagtggttggaaatctctccatg

SEQ ID NO: 84807 - DNA, 601 bp, Human
caattgtcctggctttctgcctggagacagttttagaattatggcagagagggagagcccagcagagaacgatggtctatttgctgaggggtcaaagaacagtgttcagggctgctaagatagctgggattttcagggcagagtatgggtgagaagtatgcagagaaggggctccagtactcagagtggaggttctttgaaatctgaccatatactaagctgcttctgtgccaggtgatacttattgaagccaggcagagaacagctagtagaatgctgtaagtggttggaaatctctccrtgctgggaggtatatggttctgctcagctgtagtggaaggacctaattgaatacattgggtactgagacttcagaaacgccaggctttagggttggagctactttagcccttgagtaagcctactgtagacctgacttaaaaagcatagaaacaagcttcaaaaggatcagggaaatggccaataaattaaacacctgtcaaaaagacaaaaatcaacactcgttaaaggaagagaccaaaactcagatgttcccagaatgtttttcctcatgacccaaaactataagacatgaaaagaa

SEQ ID NO: 84808 - DNA, 601 bp, Human
ataagaatatgcatttacttgtttgcagatatagtgcaagttgtagggcaatgggtgacatcttcaaagaggtaaaaggaaaaacgattctgtatgaagcaagaatacccttcacaaaagaaggaagtagaaaaactttcaggtaaacaaaatctaagaattggtcaccaacaaatttgcactctaagaaatgttaaaggaggttcttcaggctagaagaaaataataccagatagaaacgttaaatgtccgctttaaaaacgaggagcatggccgggcacggtggcttacacctctaatyccagcactttgggaggctgaggcaggcagatcacctgaggtggggagtttgagactagcctgaccaacatggagaaaccccgtctctactaaaaatacaaaaaattagctgagagtggtggcgcatgcctgtggtcccagctactctggaggctgaggcaggagaatcgcttgaacctgggaggtggaggtcgtggtgagctgaggtcacgccactgcactccagcctgggcaacaagagtgaaactctgtcaaaaaaaaaaaaaaaaaaaaaaagcatcaaaatggcaaacaaagataa

SEQ ID NO: 84809 - DNA, 601 bp, Human
gggcacggtggcttacacctctaatcccagcactttgggaggctgaggcaggcagatcacctgaggtggggagtttgagactagcctgaccaacatggagaaaccccgtctctactaaaaatacaaaaaattagctgagagtggtggcgcatgcctgtggtcccagctactctggaggctgaggcaggagaatcgcttgaacctgggaggtggaggtcgtggtgagctgaggtcacgccactgcactccagcctgggcaacaagagtgaaactctgtcaaaaaaaaaaaaaaaaaaaaaaagcatcaaaatggcaaacaaagataaaagattttttctcatttctaaattttctaaaagataatttaaagtaagcacaaggtattatgggaactgtaacaggtcaaagtaaattataggataaccatacacagaagatagaaggaagttaaatggagcttcactgtgataaagttactacattttgaaataatatgaattcatggtagactgagaacttaaggatgcatatgataatctccagagtaatgacttaaaaggggtactaaaaagctaaaagaagagataaaatggaatattaa

SEQ ID NO: 84810 - DNA, 601 bp, Human
aggatgaaaggaataatatctcatggccaagtgggatttatgccagaaataagttgattcaccattggaaaatcaaataatttaccatattaatagaatgaaagaggaaatcatacgatcacctcagtaaatgcagacattactaacaatattctataatgatttctaataactctcagcaaactaagaatatgcaaaaacttcctcagcctgaaaaaaaaactatagctgacaacatacttattggtgaaagactcaatcttttcttcttaagattaggaacaaagtaaccatttttctrtcttcttttattcaatgttttattgaaagtctgaaggtaagacaaagagataaaaggcagaaagattggaaagaaagaaaaaactatttctatttacagacataattgtctacatagaaagtcccaataattgaaccaaaaacctgctagaattaataaatgagtatagcagggtgacaggatacaaagtcagtatacaaaattccattttattcctgtatacaagctgcaggtgttgaaaatgaaattttaaaaaattaccatcaaaaattatttacaatagcattcctaataggaatg

SEQ ID NO: 84811 - DNA, 601 bp, Human
ggaagacctctacactgaaaactacaaaacactgattagtaaaattacaatgatctaaataaatgaagatataccatgcccatggattgaaagactcaatattgttaagatgtccatttttctctatgcattgaatgttgtcccatttataaatctcaatagcctttcttttagaaactgacaagcttattctaaaactaatatataattgcaaatgacctctaatgaaaacaatcataaaaaataaagaaggagggcttatactgctgatttcaaaatttactgtaaagctgtaataaayacaatgtttgacataaagatagatgactagaataactgaatggaataacaaattcagaaattcctttatatgttcaattgctttttgataaaggtgctagataattcagtggagaaaggatactctttttagttaaaaaaaaaaaaataagctggagaaactgggtatctgcaaaaagtgtgatgctcaggtcataccagacacaaacattaaacttgaaatcgatcatagatctaattaaaaagctaaacatataaatattttctaaatagatttctgctcttcaaagactagaaattt

SEQ ID NO: 84812 - DNA, 601 bp, Human
gctccacactggcctggttgtgtcctcctcctcggaggtcatttctgtgagctggaaaagtcatctcatttgcagtctggatgtttatctgcacttctctccagggcctcacatccttccaagacctggagcggcacttggcgcattagcctgatttctctaagtctgactgtcatgagtttggttttgggttcagggataaaacattaatccacagtgaacccatcattccttcgaatttctgctttaaaataaatcttggtttaagttgcctgctggcagttttgggcctctgagtctyggagacccttgctgtgtctgaaggattttaagtcagtgggtgagagtacaccacctgctgagaggtgtactgtccccagaggcccacctgtccttaaatcatggactattacttacaaacaggcccacagacacatgccaagaattccagggcccagtgtagattccagcagctgcactctgtccccctttggctatcagtcaaggatgtttcagcgtcaaacctgtacctatcagtatgccctaggagcacagcagagggttggcaagtcagagggcctcacccaaggaagctgggctc

SEQ ID NO: 84813 - DNA, 601 bp, Human
gcacatgccctgcggttgctggtgccttcaaaagtgttcattttaggtggttctgccaccctcccaagccagacttcatgtgcacatcttccttattttttcttgaaaaactggaatctgacaagtctagcagagtgtgtttatgaagtgacttcttaagtagcagtatttgaaacctgtcatgaagatatgtgatgatattggtttggctcatgtgattaagtgatctgtttcgttcagagagagtgatggcagaaaagagagcccatggttttgaagaatacctctttttttttttttkggggggagatggagtcttgctcttggagtacaatggcgcgatctcagctcactgcaacttccgcctcctgggttcaagagattctcctgcctcagcctcccaagtagttgggattacaggtgcacaccactacgcctggctaatttttgtatttttagtagaaatggggtttccctatgttggccaggctggtgttgagctcctgacctcaggtgatctgcccgtctcggcctcccaattgaagaatacctcttaaaacatgtttaagttttaaaaagattgaaacaaagtctgtaactt

SEQ ID NO: 84814 - DNA, 601 bp, Human
tcatgactgctgctggagaatgctgtcccaggccagctgtcttccccccacagacattacctgcaaaggagcaggtcttatttatggggtgctgtattcctaatccctccccaccccactctgcctattggtctcatgcagagagaacatcctttggctatcaccagcttttcatggttgagggaaaaatggaacaaatacaatgcttttgatgaactatgagctgagccagtgccaatgattaaaaattttttaaattgtgaaacatcacacattgctgttattttttttttttttttttacaaaattcctagtttccttgaacagaaactgaacctttatgctttccaagaagttatatttaaacaaaaaagttctttgaatcaaactacatttgcattctgtttcatttccttcatgtctatgtagaggaaataatttaggtctaaagaaggctggactcccctgataaaaatcagtgggttacttcttcaacttcccccttctctttgcctttataagtgttgcctttgtttttttctgaatttctgagccttctgttttactaaaaatctgagtccctagtgattttcgtggcagt

SEQ ID NO: 84815 - DNA, 601 bp, Human
acacaagaaaaaaaaatcctgtatctaaatcaagatgacttccagtggcccatttattttatgggacgtttaagaaataaaagttcccacagcaaactgcgtgtcctcttgcatctgcggcagtcccattccacctgcacctctgtttgtgtgtgatggctggctgcagcctgggcgtgctgtctccagtagtgttggctgagccaggggtccaggagatcaggatgtcagggcctgtaaatcctggggcatgtgagtgtctggtggcctctctgcagaacatgaggcgtgtgcccagccygtgggggctccactggggctccttagatggaggctggctgggtctggggcaaggggttctctccctggagtggtgcttactgagtgggagtgagggacagcaggtggagagatgagcggaaagggggctgtcacctttctctgtcctgagttggggctcttggggaaaatcagagtgcagtagtgagcagagctgggctttatgccctgtcctccctccctggtcctgattcatgacctccccgtgagccacagccccacggaagggacgtaggatttggagcctggttagtaacgctgt

SEQ ID NO: 84816 - DNA, 601 bp, Human
cctcctgcctcagcctcctgagtagctgagaccacaggtgcatgccattgcacttggctaacttaaaaaaaattattttgtagagatggggtctcactctgttgcccatgctggtctcgaactcctggcctcaagcaatcctcccaccatcacctcccaaaatgttggtatttcaggcgtgagcctctgtgtctggccttgtagcctggttttgatcctcatcctcctggtgtctaccttctccttcctctgctcctgcttttccttccaggcatcgtgttgaggtgcttagggtagattyagcagctgcatggccttgtgtgcccacgtgctgtgagcctcagtgtctatacaagagggtgatagcagcccctgcctccccatagtcactcaccagcggggatggggtaaggtgttgctctgggctctggttaggttgcaaggctgagggggccacccagggtaggggacacatgtattcatgttttggtgctcaatgagtagagttttctggtgaattagaggcaggcagaatgcatttggatggggtaagccagagaatgtgtcaccaaaagcatgagacttgagcttggtcttgaaa

SEQ ID NO: 84817 - DNA, 601 bp, Human
agagtatgtcgtcaaatattcatgagctatttgaattagttttgtctttctccttcagtctggttatggtattcatttgaattacagatttgtttgtttcaaatcactttcagtttaggggtattttcccttcatctcatccttactgacttaatttttaaaaatttaaggtgaagaacattaacatggttcccaaagtcaaaactatagaaaaaggtatacttaagagtgtcactccaaccttgattcctttggcctaattcattcccatcccttgttttctgctctttcttttagatamacctgagagaaatatgctccttttatttcccagtttttcgtgtgtaaagggtagcacactttattgctttttttttttttttcatccaggcacttcttatttatcttttgatcagacacaccataaccaaaattctggtttggaacaagaagactcctagcatataacagttgttggatttttagtcacttgcaaaagtctgttggtttctaccaatagctttattaaataagctttgtaaaacaatctcttagtaataggattcttagaatatgatgaattcttatgcaaagtggagta

SEQ ID NO: 84818 - DNA, 601 bp, Human
tataatgtatgtaattatacattataaaatgtatataattatataatttaaaaataaaatataattatataattataatacattataaaatgtatataatgtatgtaattatgcattataaaatgaatgtccttaagcttctcagggtaactcttttactatcttcataatttttttcccaagaacccatatatgatatggacccaaagtaagaataccttgtttgtatgtaaccatctgaatttagtattctaagttcggaatcaaaacatgcaaacagatttgtactaggatacttttytggtgaataatagaactgaaggtccacttttctttgagatgtatttaagaaaacagattatataattcattttcctgcagatacatgacatgccaagccctcttactgttgctcagggatgtgattctggattgagttgtgattttttcagagttcagagaatcatttggtgaatttacctagagctgagttatgtatttcccatgtgtcaggaaaccccggaggcctagaaaccccaaaccattctcagggtgtggtacatgtgaatggcgagacactggagtccttacttctttgaga

SEQ ID NO: 84819 - DNA, 601 bp, Human
ctttgaccacagcttggcccatttgggtccctcctctttgaggaggctctggggaaagtggggcgtctctgagttcaggccccttgttggggggtgtcagaggcctgccatgacagcacatggtgttttgggcctaggccccttgagatcgctgtcatcgaggggagttcattttctaagaaatgatgcatgtgtgttggtgtgggctctgcgactctgacccccatagtcttgctttggaagacactgtcttctgtcctgtccaagtgtgtggctccattgctgtgctcatgtgactatwctcagtgctgtgtgtcctgcccacaagactgttgtgcagtagggcagtggctcaggatgcaggtccccaaggatgtcctgatatgtgcttgtcctctttgcctccttcagagaattctcaaaggaaagagagaaggcaaaagcacggggagatttccagaagctccgggagaagcagcagctggaggaggatctaaagggctacttggattggatcacccaagctgaggacatcgatccggagaatgaggaagaaggaggagaggaaggcaaacgaaatagtatgtagcgcctttcctgc

SEQ ID NO: 84820 - DNA, 601 bp, Human
ccaaggaaggtcaaacggacccactgttggcctgggaaattcagtaagcgcatttctgtgcgggcacaggggtgatgagacacatattcttgtaccacaggagaagaagctgtggtttccctcacctcagagtgaacagtgttattggacaagaatttgaagtgcagggttcctcttgactcttactcttaggccacctgacatggctcctacatgtgctattcatatgaagccatatgcttagcccatcaggggctgggaggaaaccggctcaccattctaggcaggtgttaaggggcaygtgagtcagtgacagctgctttgctgtcacccatcgacaccccacactgtgacactaagcaccctagagcaccttctgcaggaggcaaggcctgagaactcagtccatcactgacattaattgccattgtcaaccacggtgtctctttcactgcatacttttcccacagatgcgctcttattctctctggggccctttgtgcctcgggtcagagtggaaactggaatccagcaatgcatttgactgagatgtctgtgacttgcttcaaatctagaagagttggataggaaggaccaagaa

SEQ ID NO: 84821 - DNA, 601 bp, Human
gtatgaaggtcggggtgagctgccataggaagggtgggtgaggtgcaattgtgcctcttctggaggttgtggagtgtgtaagtgggggctgagagacccctggtggagaggcttcttgactgagagggcccttacctttcttcaagcctgggctctgtgcctccatggggagggagtgtgttccgtgatctcagatgccctggctggtgcaaaccagtgtgctgactgggagtgggcagggtcaggcctctcttctctccctccctgcttcttgccaggctcaggaaggggccaggacttyagcacctgaggatcagaagactgagggagggtttctagagctaactgtttgctgaatgcaagttcagagtttataaatagacattcatgtgagtctcagactcagcgatgtgcctatgaagtgatcagatgtaagagtgtctgcctgtcctctgcacagctctccccttggcagttgagccaacgtgaaccccatggctttcgtggagcttctgcacctgcagtatggcaacaggccatgtaggtgcagcttggagatgcctgcaccgctcttttccccttcacttgcaaactgtaactc

SEQ ID NO: 84822 - DNA, 601 bp, Human
tgctgaatgcaagttcagagtttataaatagacattcatgtgagtctcagactcagcgatgtgcctatgaagtgatcagatgtaagagtgtctgcctgtcctctgcacagctctccccttggcagttgagccaacgtgaaccccatggctttcgtggagcttctgcacctgcagtatggcaacaggccatgtaggtgcagcttggagatgcctgcaccgctcttttccccttcacttgcaaactgtaactcagatgctgacctgccccatctcccctaaacccaacatgttatttgtaaaygagaggaggtatggcccctttttctcagcagagtgtctttctttgctagtttagctgtgtcccccagggagctgagtgaggccttcttacaggccagtggcctttcctctgtttatttctcctcctctagaagtagacaaggtttcgtgttctagtgttgctaacattagtcgtggtagagttgtttatagggcctatgatttgaggattaagggttttcattggatttaaggtgatatcttgagggttaaccattttatctcagcccagcatttcctatgacctatcactgtaaaaacc

SEQ ID NO: 84823 - DNA, 601 bp, Human
ggaacatcagcagtattgtttctgctatgcaccgtgatgtgtgactcaaaatgattaactagcttaacgtttgatccagaatagcaaatatttctgtggtgcgcccttgttctttatggagctcgttttgccaggtgctggggtttcctgtggagtgaggctcacagtgcttcccgagtcatcagatttccagagccttgctgatgagggttttaaataaagacagaaatcttggctgtggaggccatgatgggatttagctgacttgagagcaccaagtctcctcctcctctgaggagaraacctctctgatcacagacctcagcagcccagaccctctggaggagacagcactgttgaggtttccctggggcctcctgtggctgccagccattttcttcctgtcacagccagaaaaccacacaaggagagggtttcagtgaggcccacatggtcctcctcaccaaataaacagtcctggattcaccacatgcacatgccaggtctggggctgtctctgtgcatctgattagcaggcagtagaaatgtgggtgttgccagtgttacggtgtctgcatcctccctgggggtgtgagatcac

SEQ ID NO: 84824 - DNA, 601 bp, Human
atcttgatgccccttctccggatgtggctgcaatggagttttgtgacttggaatttggactttagtattaggcaaattactcaacctctctggaccccactttccttgtctgcaagaaggggataaagatatatctccccatggggctgttgtgacaattgaacgttctgtgactgctaggagtagtcatagttgtagtatgtgctgctgctgttttcatcagacaccagtaaaagttgacctcaacagaattttaggggtataaatttagggggtacaaataccgttctgtgacatggayatattacatagcggtgaagtctgggcttttagtgtaaccatcacccgaaaagtgtacattatacccagtaagtaatttctcatccctcatgcctcttccaccctcccacccttctgtgtctccaatgcctattattccatccacaccctatgtccatgtgtacacattatttagcttctgcttatcagtgagaatatgcagtatttgactttcctaaacataatatttttgaaggttctcctagaccgctaaccagcctcagggtggggcctccctcttaggaccattgccctgtgcttt

SEQ ID NO: 84825 - DNA, 601 bp, Human
cggatgtggctgcaatggagttttgtgacttggaatttggactttagtattaggcaaattactcaacctctctggaccccactttccttgtctgcaagaaggggataaagatatatctccccatggggctgttgtgacaattgaacgttctgtgactgctaggagtagtcatagttgtagtatgtgctgctgctgttttcatcagacaccagtaaaagttgacctcaacagaattttaggggtataaatttagggggtacaaataccgttctgtgacatggacatattacatagcggtgargtctgggcttttagtgtaaccatcacccgaaaagtgtacattatacccagtaagtaatttctcatccctcatgcctcttccaccctcccacccttctgtgtctccaatgcctattattccatccacaccctatgtccatgtgtacacattatttagcttctgcttatcagtgagaatatgcagtatttgactttcctaaacataatatttttgaaggttctcctagaccgctaaccagcctcagggtggggcctccctcttaggaccattgccctgtgcttttctgttcagaaactataa

SEQ ID NO: 84826 - DNA, 601 bp, Human
tttggactttagtattaggcaaattactcaacctctctggaccccactttccttgtctgcaagaaggggataaagatatatctccccatggggctgttgtgacaattgaacgttctgtgactgctaggagtagtcatagttgtagtatgtgctgctgctgttttcatcagacaccagtaaaagttgacctcaacagaattttaggggtataaatttagggggtacaaataccgttctgtgacatggacatattacatagcggtgaagtctgggcttttagtgtaaccatcacccgaaaagygtacattatacccagtaagtaatttctcatccctcatgcctcttccaccctcccacccttctgtgtctccaatgcctattattccatccacaccctatgtccatgtgtacacattatttagcttctgcttatcagtgagaatatgcagtatttgactttcctaaacataatatttttgaaggttctcctagaccgctaaccagcctcagggtggggcctccctcttaggaccattgccctgtgcttttctgttcagaaactataaagttctgaagtattgatggaaaacaaatctgttaa

SEQ ID NO: 84827 - DNA, 601 bp, Human
tattccatccacaccctatgtccatgtgtacacattatttagcttctgcttatcagtgagaatatgcagtatttgactttcctaaacataatatttttgaaggttctcctagaccgctaaccagcctcagggtggggcctccctcttaggaccattgccctgtgcttttctgttcagaaactataaagttctgaagtattgatggaaaacaaatctgttaactaggtcactttcgagatagggcagcacagctttcaggctcttgaagtccatttctagtttggcggtgcttgctgtcagrgaacagatgtcaaatcaagtacttggagatgcgctcacattatcttttctctctgatctgctaaatgtcactgcatgcgtctgcgatgcccaacactggctgtacgttataatcacctggggagcttggatgcttcttgatgccatactccaccctctaagactcttgattaatcttggggtgggagccaggggtggctctttttcattaaggttccctggggattctaatgtgaagctagggttcagaactcctgagtccaggatgctatcagtggctgaatatcacactgttccaggc

SEQ ID NO: 84828 - DNA, 601 bp, Human
tcattttaaagggagctcattctaaaattctggccagaaaagcagggcaattttattgtaggaactattaatgattaataattcctctaagtaaagatatttgatgcccaaagaaagggaggggcatacctgaaacttcatctctgaccacaagggcagcctctctgtcttctgcttcttcagtggtcctggaggctatgggcactgcccctgcctgcccggggactctgccaccctggggcttggtggagcaggttgccctagctgcctctcttttgcatgtgctacctagttgcctctkactgcaatgtttgctttgggggtggacagaaaaccaggacgttatagctggttgcaagcataaggcatagcaatttgctggtcctgttttgaaagactgtgttttgaaattttgatttacaaaactgctttcatcaccattgaactacctcaaggcacaagttcaaaatggaagatactcaattaaaagctgtaaagcaaacagcagcagttagagtggcatacggtaaatatgcgtccaggtcaagagccctcactggagaggcagctggaagtgctttcactgggaagtgggagggct

SEQ ID NO: 84829 - DNA, 601 bp, Human
ttgccctagctgcctctcttttgcatgtgctacctagttgcctcttactgcaatgtttgctttgggggtggacagaaaaccaggacgttatagctggttgcaagcataaggcatagcaatttgctggtcctgttttgaaagactgtgttttgaaattttgatttacaaaactgctttcatcaccattgaactacctcaaggcacaagttcaaaatggaagatactcaattaaaagctgtaaagcaaacagcagcagttagagtggcatacggtaaatatgcgtccaggtcaagagccctcwctggagaggcagctggaagtgctttcactgggaagtgggagggctgactcaggggctggccctagggtcagtggctggacactgtctccattggggtggcactgggagtagttgtctggacaggcagactctctccacaggggtgatagaaagcagtggtaatttctaaaagtgcctgcatgtctgccatcaccttcagcctcctaagagctgatgggagctggactcagggactgttgccccactgtggagacaaggagtgggtactccagccaagtttgcagtctcaaatcagggttg

SEQ ID NO: 84830 - DNA, 601 bp, Human
tggcactgggagtagttgtctggacaggcagactctctccacaggggtgatagaaagcagtggtaatttctaaaagtgcctgcatgtctgccatcaccttcagcctcctaagagctgatgggagctggactcagggactgttgccccactgtggagacaaggagtgggtactccagccaagtttgcagtctcaaatcagggttgttttatttgtttttaatacattttaattatggaagtaatatttgcctacataaaaaattcatgtaatttcaaagtatataaagtaagaaaaaaattmtctcttccttctccttaaagagaggcagacttagaagtttggggcctctacttccccacctcactgcacataatacatgacacagaccgcatgcatatagcttccaccctaagatgcccaacacaggtatttttcactgaaccatgtaccacagatatttcccatgtttttaaagcaaaatgttggctcttttcaataaattgccattataaaaactgctacaatggactatgcactctacagcacgtggacctctactttatagaggtctctccaccatgagaccatcagctccatggg

SEQ ID NO: 84831 - DNA, 601 bp, Human
gaactcccacctgtcctgtcccatatggtagtgctgtttggaatcacatatccagtctgtacagggctcctgactccccctaaagtgccttttccttaataccctacttagatgggaagccaaaccctggaaacctttatctagcatgggttagctggttgttgatttagaacaggttcttaaagacaggtgtttgtgtaatagctgtggaaagggcacttcctctccgctgttctgatgctgagctggattcctagcaggaggggtctggggcaggcgggcgtccattgcgtgaggcaasctggctggcagggctggccgcgtggggccctggtttggctgctgttgctgccctctgctgcttcataatgaaattgcctgtgttcaacctgaaggggtcacagtggccgacttgcttaaagaggataagaagaaaaagaagttttgctgctttcggcaacgcagggctaaagatcatggtaaattgctgagactgagctttctttttccgcaacatctctgataccttttccttgcacataggcattgtgtgaagtgcatgtgccgtgtggtgtgttcagaagatgcctatattttaatt

SEQ ID NO: 84832 - DNA, 601 bp, Human
gcttaaagaggataagaagaaaaagaagttttgctgctttcggcaacgcagggctaaagatcatggtaaattgctgagactgagctttctttttccgcaacatctctgataccttttccttgcacataggcattgtgtgaagtgcatgtgccgtgtggtgtgttcagaagatgcctatattttaattgcttgatttctttcttcttgtctttttccaaaataatgtgcccttaccaagatagcattgcagttttctttttgtttgaactgtaccttataaagaagcagctgaaccaactcaaaaaatgtacttgattcggcatgaatattcttagactggaaggcagacttttaaaatacttttccccaaatgatttttttaaatttaaaccgtttagaaattccaataatgttatttgattgatttttttttctccaggctacatgtttcaaattgcttctctgtcttttagtctctggctactttgcccaggactatgccaaagctagtagtggcagctttaagaatgaaattagctggatgcagtggctcacacctgtaattccagcactttaggaagccgaggcaggaggatcactt

SEQ ID NO: 84833 - DNA, 601 bp, Human
gcattgcagttttctttttgtttgaactgtaccttataaagaagcagctgaaccaactcaaaaaatgtacttgattcggcatgaatattcttagactggaaggcagacttttaaaatacttttccccaaatgatttttttaaatttaaaccgtttagaaattccaataatgttatttgattgatttttttttctccaggctacatgtttcaaattgcttctctgtcttttagtctctggctactttgcccaggactatgccaaagctagtagtggcagctttaagaatgaaattagctggrtgcagtggctcacacctgtaattccagcactttaggaagccgaggcaggaggatcacttgaagccaggagtttgagactagcctgggcaacaaagtgagaccctgtgtctaccaaaaattgtaaacaaagaagcaaacaaaaaaatcaggtgtggtggtgcatgcctatagtccccagctacttgggaggctgaggcaagaggattgcataagcccaggagttcgaggctgcagtcagcgatattgcgccattacactccagcctgggtaacagagtgcgatctctgtctcttaaaaaat

SEQ ID NO: 84834 - DNA, 601 bp, Human
tgatttttttaaatttaaaccgtttagaaattccaataatgttatttgattgatttttttttctccaggctacatgtttcaaattgcttctctgtcttttagtctctggctactttgcccaggactatgccaaagctagtagtggcagctttaagaatgaaattagctggatgcagtggctcacacctgtaattccagcactttaggaagccgaggcaggaggatcacttgaagccaggagtttgagactagcctgggcaacaaagtgagaccctgtgtctaccaaaaattgtaaacaaasaagcaaacaaaaaaatcaggtgtggtggtgcatgcctatagtccccagctacttgggaggctgaggcaagaggattgcataagcccaggagttcgaggctgcagtcagcgatattgcgccattacactccagcctgggtaacagagtgcgatctctgtctcttaaaaaataaaaataaataaaaatagacttcagggatgcaaagatttgggggcacttgcctttgaaagtgagaatgggctcgtgtgggaaagttatatttccagatatgtcctaaaatgatgctaaacatacccttcc

SEQ ID NO: 84835 - DNA, 601 bp, Human
ggcacttgcctttgaaagtgagaatgggctcgtgtgggaaagttatatttccagatatgtcctaaaatgatgctaaacatacccttcctcagaatccctggagtagctgtcaggcccatccccaggcagacagttaggtgagcagctggctccctgccttgctctgcccaagtcatggcagtggttcgacagcagcacaaagctttgcctatgcacaccagcacagtcgacccagttctgccaccaggatcggccctggtcacctgactctggggaaagtctgtttaaggagattcagacmgcagggacgtgaagccaacaactaagggaacagaggggacacactgtactcttttctttgaagtggcctctggccccatgggaatgctgagctgagaggttatgggacgcagatgggaacaacccgtggatatctgaagagggttatattagagtctaggtctcatcagaaggcctaaaagtgaaaaggaattaagagattatcagatataagcccttgtcattcagcacgttgtggaccccaaaggagggagaagaggaggtggaacttgcctgaggtgggacagtgagttaggggcag

SEQ ID NO: 84836 - DNA, 601 bp, Human
ccaagaagagcctggcttctttacagcagcaagaggctgttactctgtggtggcctaatgtgtctctactagcatgtgcatgtgcctttagggggtgtgtgggcttcttctggatttggcaggcctgtacgtcatggtactgctcatgtttgtcatgaaaataagatgaaaacatgaggtctaggtgtcaggtaccctgtcccctaggaaggcagccacaactcagccactgctcagttgtccagcctcaccccctacccttacctttgaaaagaatgagaagctttaggctgcttggagktggaaggaaatgctaaaataaattcctgagtgtgcaaaaaagtctgtcctgtggagaacagaggagtgaggctctgaggccaaagacatctgtgaatgaggctactaatgggacaggttctagacgaggctggagggctctgggctcagtttgatgtgtggcaagccttcccttcggggtgccttgactggaggactgaggctctcctgtgacgccctgaggcctctggggagctactgcttcctgtgctgcaccccattctctgggacattctacatgcagagcacttggactcagttc

SEQ ID NO: 84837 - DNA, 601 bp, Human
aaggaaatgctaaaataaattcctgagtgtgcaaaaaagtctgtcctgtggagaacagaggagtgaggctctgaggccaaagacatctgtgaatgaggctactaatgggacaggttctagacgaggctggagggctctgggctcagtttgatgtgtggcaagccttcccttcggggtgccttgactggaggactgaggctctcctgtgacgccctgaggcctctggggagctactgcttcctgtgctgcaccccattctctgggacattctacatgcagagcacttggactcagttctccwgtgcaggctgctggctggacccctggcttccctcctgagggtggtgggcaggggctcacttcttgtgccctcccctccttgcagagctgggggaatgcaagggaaaccccctggttgttggtagtaaaaccagccagcatgtgggcgtttctgccttcctgcagttatagcaggtcagaggtaaatggatcttagagatgatactgtcctacaactcatcttacagatctggtagccaagcataggggaaaagaggcacttgtcccattgtcacctgatgataagaaccaggctttcctg

SEQ ID NO: 84838 - DNA, 601 bp, Human
ctgtggagaacagaggagtgaggctctgaggccaaagacatctgtgaatgaggctactaatgggacaggttctagacgaggctggagggctctgggctcagtttgatgtgtggcaagccttcccttcggggtgccttgactggaggactgaggctctcctgtgacgccctgaggcctctggggagctactgcttcctgtgctgcaccccattctctgggacattctacatgcagagcacttggactcagttctccagtgcaggctgctggctggacccctggcttccctcctgagggtggygggcaggggctcacttcttgtgccctcccctccttgcagagctgggggaatgcaagggaaaccccctggttgttggtagtaaaaccagccagcatgtgggcgtttctgccttcctgcagttatagcaggtcagaggtaaatggatcttagagatgatactgtcctacaactcatcttacagatctggtagccaagcataggggaaaagaggcacttgtcccattgtcacctgatgataagaaccaggctttcctgacatttcttccatcatttttgacctcatcagcctccatcactgaa

SEQ ID NO: 84839 - DNA, 601 bp, Human
atgaatgtcgtccttcagcatgagagtagatggataaatgtctacaccttggtgaaaatgctagttgtgcttacctgagaagcagcagatttccctggtttactgtgtgtggcattgcccatgataacatctggcccagtgcaagatcttaaagagaagcaccatgacccacatccacagagtgctccaagtaggggcctggcccggctgcccatgctgcaaaggccttggaaactctaattacagtctgggacatgcagggctgctgtctgccaccatcctctcacccccagtggcaccsaggccccccgccaccaatctcagtgcaccacactgtaagcctaagggtctgccctggagctcttcccagagatcccaatgcctggaatagattgcaaaatataggccttgagcttctccagattttcagcaggcaaattgcagtgccagcatcctctcacaggtcacaggctttcctaatgcttggtttttcccagactcactgaaagtagtttttaaatttatataaaaaataaacttctctaacaaagctctaacattccagtttcctgaaatgtgtcagggaagaggcttcacagct

SEQ ID NO: 84840 - DNA, 601 bp, Human
cccatgataacatctggcccagtgcaagatcttaaagagaagcaccatgacccacatccacagagtgctccaagtaggggcctggcccggctgcccatgctgcaaaggccttggaaactctaattacagtctgggacatgcagggctgctgtctgccaccatcctctcacccccagtggcacccaggccccccgccaccaatctcagtgcaccacactgtaagcctaagggtctgccctggagctcttcccagagatcccaatgcctggaatagattgcaaaatataggccttgagcttcyccagattttcagcaggcaaattgcagtgccagcatcctctcacaggtcacaggctttcctaatgcttggtttttcccagactcactgaaagtagtttttaaatttatataaaaaataaacttctctaacaaagctctaacattccagtttcctgaaatgtgtcagggaagaggcttcacagcttgttcatgtgcagatggcccctggtgcttatttctacagtaggggactggcacttgtcggcaatgtggggaggtctgaggggtctgcctgcacctctaataaggcctagccacttgt

SEQ ID NO: 84841 - DNA, 601 bp, Human
caagggctgtttccaggaccaaatgaggtctccaatttctagcgtaggcactgtcctctttctttccgtctgcctctgctcatcctcagccctggcaacatctttttgggatatatttatttattatgtgcctgtggctctttaggtgtcaaacaactatgacaggagaagttgctatgcctacagtaggcaaagttagacaataactcagctaaagacagagaaaatacaaaccaagaatgatggccaaagctgattcagaggtatggaagatggctcacactagatgcgtctgtgcaaygatgaaagtggccagggcaaaatgacactggattggtcgctttgcttccagggagctccaggagagcttttctgagatgatggagttaacatgtgtgggcctcactgatcatccagccctggggacccagcactccgcatgcctcatctcattcttacccttttacaggtgaggcaatggagatgtacagaagtcaggtcacaaacgcggggttaaacttagatctggccaacctctgcacctgctctcagccactatcccaacccagctgaaggacagaatcagctcagagagcaggag

SEQ ID NO: 84842 - DNA, 601 bp, Human
ctcagagagcaggaggaccctgcctcaccctcagtggagccctggcacagtgctgtgagactatcttcccctctttgttgctgtttggggagttcggttttacttcttgtctttccccacagttagtctagggagcaactagaacatttcatacactaatagttggcagggggccagaaatgctaactgatgaccccattcccatagaaaatatgtaatttatctgtttcaatcagattgtttttaaaatgaagctttagaattgaaatgctgcaactgtaccgatatcagcatgagacaygactccagagattaaaaagccacaaagacttagtcttttcagaagtttgctcttttgaaaataatgactaatgttcctacatgattaatattagaactatgagatagcaaactgttaaagatggaaatgaccctcaagattgtggagttcacaccaccattttagagacaggaaagtgaagcctggagagaggtgatccattgcccaggagactcagaaaacaggaccaggcctgtgggttccccacatcatactgccctcaactcctggtcccctcagtcactgcagtaaccaccacgg

SEQ ID NO: 84843 - DNA, 601 bp, Human
ttgacacccttgcctcagtgttcctgggcatggcgtggaggctcccatgcaggcaggctcagtttctcgggcactcacaagcggaacggatcagggatcttctttggtatcctcaagaaacttctcagaccactgggttccttgagccaggttccacctctatccctgctgttacctttatgaagtctgctatgagcaaggcgggccgaacacagccccctacgcgagctgcctgatccagctcctttccccctgagcctgggctgggcctcagaatcttcgccatagcgcttccagcccrctaccagtatttgcagatgaaacttgaggcatccttgctaaggggagccacacgggcagagcccatgggccaagctttcctgaagacatcgtaaggtctgtaaaaacagtcactacagttcaaagccatgcctcaggaaaaaggaagtacacgtggattctcttccgtgacttcctcttttacctctgcaccccggcagaattaatccttctttactctggaacctcctgcacagacccctgaggtagctctcttcacagctgatggaagtgagctgggggctgcctgtccctcacccct

SEQ ID NO: 84844 - DNA, 601 bp, Human; identical to SEQ ID NO: 20001

SEQ ID NO: 84845 - DNA, 601 bp, Human; identical to SEQ ID NO: 20002

SEQ ID NO: 84846 - DNA, 601 bp, Human; identical to SEQ ID NO: 20003

SEQ ID NO: 84847 - DNA, 601 bp, Human; identical to SEQ ID NO: 20004

SEQ ID NO: 84848 - DNA, 601 bp, Human; identical to SEQ ID NO: 20005

SEQ ID NO: 84849 - DNA, 601 bp, Human; identical to SEQ ID NO: 20006

SEQ ID NO: 84850 - DNA, 601 bp, Human; identical to SEQ ID NO: 20007

SEQ ID NO: 84851 - DNA, 601 bp, Human; identical to SEQ ID NO: 20008

SEQ ID NO: 84852 - DNA, 601 bp, Human; identical to SEQ ID NO: 20009

SEQ ID NO: 84853 - DNA, 601 bp, Human; identical to SEQ ID NO: 20010

SEQ ID NO: 84854 - DNA, 601 bp, Human; identical to SEQ ID NO: 20011

SEQ ID NO: 84855 - DNA, 601 bp, Human; identical to SEQ ID NO: 20012

SEQ ID NO: 84856 - DNA, 601 bp, Human; identical to SEQ ID NO: 20013

SEQ ID NO: 84857 - DNA, 601 bp, Human; identical to SEQ ID NO: 20014

SEQ ID NO: 84858 - DNA, 601 bp, Human; identical to SEQ ID NO: 20015

SEQ ID NO: 84859 - DNA, 601 bp, Human; identical to SEQ ID NO: 20016

SEQ ID NO: 84860 - DNA, 601 bp, Human; identical to SEQ ID NO: 20017

SEQ ID NO: 84861 - DNA, 601 bp, Human; identical to SEQ ID NO: 20018

SEQ ID NO: 84862 - DNA, 601 bp, Human; identical to SEQ ID NO: 20019

SEQ ID NO: 84863 - DNA, 601 bp, Human; identical to SEQ ID NO: 20020

SEQ ID NO: 84864 - DNA, 601 bp, Human; identical to SEQ ID NO: 20021

SEQ ID NO: 84865 - DNA, 601 bp, Human; identical to SEQ ID NO: 20022

SEQ ID NO: 84866 - DNA, 601 bp, Human; identical to SEQ ID NO: 20023

SEQ ID NO: 84867 - DNA, 601 bp, Human; identical to SEQ ID NO: 20024

SEQ ID NO: 84868 - DNA, 601 bp, Human; identical to SEQ ID NO: 20025

SEQ ID NO: 84869 - DNA, 601 bp, Human; identical to SEQ ID NO: 20026

SEQ ID NO: 84870 - DNA, 601 bp, Human; identical to SEQ ID NO: 20027

SEQ ID NO: 84871 - DNA, 601 bp, Human; identical to SEQ ID NO: 20028

SEQ ID NO: 84872 - DNA, 601 bp, Human; identical to SEQ ID NO: 20029

SEQ ID NO: 84873 - DNA, 601 bp, Human; identical to SEQ ID NO: 20030

SEQ ID NO: 84874 - DNA, 601 bp, Human; identical to SEQ ID NO: 20031

SEQ ID NO: 84875 - DNA, 601 bp, Human; identical to SEQ ID NO: 20032

SEQ ID NO: 84876 - DNA, 601 bp, Human; identical to SEQ ID NO: 20033

SEQ ID NO: 84877 - DNA, 601 bp, Human; identical to SEQ ID NO: 20034

SEQ ID NO: 84878 - DNA, 601 bp, Human; identical to SEQ ID NO: 20035

SEQ ID NO: 84879 - DNA, 601 bp, Human; identical to SEQ ID NO: 20036

SEQ ID NO: 84880 - DNA, 601 bp, Human; identical to SEQ ID NO: 20037

SEQ ID NO: 84881 - DNA, 601 bp, Human; identical to SEQ ID NO: 20038

SEQ ID NO: 84882 - DNA, 601 bp, Human; identical to SEQ ID NO: 20039

SEQ ID NO: 84883 - DNA, 601 bp, Human; identical to SEQ ID NO: 20040

SEQ ID NO: 84884 - DNA, 601 bp, Human; identical to SEQ ID NO: 20041

SEQ ID NO: 84885 - DNA, 601 bp, Human; identical to SEQ ID NO: 20042

SEQ ID NO: 84886 - DNA, 601 bp, Human; identical to SEQ ID NO: 20043

SEQ ID NO: 84887 - DNA, 601 bp, Human; identical to SEQ ID NO: 20044

SEQ ID NO: 84888 - DNA, 601 bp, Human; identical to SEQ ID NO: 20045

SEQ ID NO: 84889 - DNA, 601 bp, Human; identical to SEQ ID NO: 20046

SEQ ID NO: 84890 - DNA, 601 bp, Human; identical to SEQ ID NO: 20047

SEQ ID NO: 84891 - DNA, 601 bp, Human; identical to SEQ ID NO: 20048

SEQ ID NO: 84892 - DNA, 601 bp, Human; identical to SEQ ID NO: 20049

SEQ ID NO: 84893 - DNA, 601 bp, Human; identical to SEQ ID NO: 20050

SEQ ID NO: 84894 - DNA, 601 bp, Human; identical to SEQ ID NO: 20051

SEQ ID NO: 84895 - DNA, 601 bp, Human; identical to SEQ ID NO: 20052

SEQ ID NO: 84896 - DNA, 601 bp, Human; identical to SEQ ID NO: 20053

SEQ ID NO: 84897 - DNA, 601 bp, Human; identical to SEQ ID NO: 20054

SEQ ID NO: 84898 - DNA, 601 bp, Human; identical to SEQ ID NO: 20055

SEQ ID NO: 84899 - DNA, 601 bp, Human; identical to SEQ ID NO: 20056

SEQ ID NO: 84900 - DNA, 601 bp, Human; identical to SEQ ID NO: 20057

SEQ ID NO: 84901 - DNA, 601 bp, Human; identical to SEQ ID NO: 20058

SEQ ID NO: 84902 - DNA, 601 bp, Human; identical to SEQ ID NO: 20059

SEQ ID NO: 84903 - DNA, 601 bp, Human; identical to SEQ ID NO: 20060

SEQ ID NO: 84904 - DNA, 601 bp, Human; identical to SEQ ID NO: 20061

SEQ ID NO: 84905 - DNA, 601 bp, Human; identical to SEQ ID NO: 20062

SEQ ID NO: 84906 - DNA, 601 bp, Human; identical to SEQ ID NO: 20063

SEQ ID NO: 84907 - DNA, 601 bp, Human; identical to SEQ ID NO: 20064

SEQ ID NO: 84908 - DNA, 601 bp, Human; identical to SEQ ID NO: 20065

SEQ ID NO: 84909 - DNA, 601 bp, Human; identical to SEQ ID NO: 20066

SEQ ID NO: 84910 - DNA, 601 bp, Human; identical to SEQ ID NO: 20067

SEQ ID NO: 84911 - DNA, 601 bp, Human; identical to SEQ ID NO: 20068

SEQ ID NO: 84912 - DNA, 601 bp, Human; identical to SEQ ID NO: 20069

SEQ ID NO: 84913 - DNA, 601 bp, Human; identical to SEQ ID NO: 20070

SEQ ID NO: 84914 - DNA, 601 bp, Human; identical to SEQ ID NO: 20071

SEQ ID NO: 84915 - DNA, 601 bp, Human
gaaattcaagaaacggaaagaacaaggactggtgggaaagtaccctgcgaagaacaccacaattgccctacaggtgaattgttgtctcattttgttttctcttttgactaacgattttacaagcttatttgaaatactagagagctgcctattcatggttgagcagtaccacaaggattttgtttaaactgagatactacacactcccccaaatgtggactagccatttctgggccacaaggtaagtgcttccctccccgatgcctaccccatagagccctgcacctgccactacccacgyggcagggctgccaggacggagaggagcgagcgctaccctcgcaccccagcccctccaggcagcatcctccaagcaggcacccaccttccccacagccctgggctccagggttctggctgcccagtgaatgaacagctttccatctgaacgcaagtgctttgttttgtttccgtttgtttcttaccccactgcttgttggtttttggtccatttcagtaacatccatcacctcctagtatgtattctgtgtgtgtgtgtgtgtgtgtgtgtgtgtatgtatgtatgtgtggtgtgtctgtc

SEQ ID NO: 84916 - DNA, 601 bp, Human
caccacaattgccctacaggtgaattgttgtctcattttgttttctcttttgactaacgattttacaagcttatttgaaatactagagagctgcctattcatggttgagcagtaccacaaggattttgtttaaactgagatactacacactcccccaaatgtggactagccatttctgggccacaaggtaagtgcttccctccccgatgcctaccccatagagccctgcacctgccactacccacgcggcagggctgccaggacggagaggagcgagcgctaccctcgcaccccagcccckccaggcagcatcctccaagcaggcacccaccttccccacagccctgggctccagggttctggctgcccagtgaatgaacagctttccatctgaacgcaagtgctttgttttgtttccgtttgtttcttaccccactgcttgttggtttttggtccatttcagtaacatccatcacctcctagtatgtattctgtgtgtgtgtgtgtgtgtgtgtgtgtgtatgtatgtatgtgtggtgtgtctgtctctgtatgttgtctcctgatggccaggaggccagctgtgcacatgctatgctct

SEQ ID NO: 84917 - DNA, 601 bp, Human
agccctgcacctgccactacccacgcggcagggctgccaggacggagaggagcgagcgctaccctcgcaccccagcccctccaggcagcatcctccaagcaggcacccaccttccccacagccctgggctccagggttctggctgcccagtgaatgaacagctttccatctgaacgcaagtgctttgttttgtttccgtttgtttcttaccccactgcttgttggtttttggtccatttcagtaacatccatcacctcctagtatgtattctgtgtgtgtgtgtgtgtgtgtgtgtgtgtrtgtatgtatgtgtggtgtgtctgtctctgtatgttgtctcctgatggccaggaggccagctgtgcacatgctatgctctcatgccccagccagcctctggtccctctccctcctccacctgggccctgctgcaggctcctagagtgtggatgtggctttcaggaacctctggtaccagccagggtccttgcatgcgaggaatgtagaaacctaggaaagcccaaagctctgggatgggaagcaggtatgtggaggggcaaggaaggcaccatgaggaccagcaggaagaggggctaggaa

SEQ ID NO: 84918 - DNA, 601 bp, Human
cagggttctggctgcccagtgaatgaacagctttccatctgaacgcaagtgctttgttttgtttccgtttgtttcttaccccactgcttgttggtttttggtccatttcagtaacatccatcacctcctagtatgtattctgtgtgtgtgtgtgtgtgtgtgtgtgtgtatgtatgtatgtgtggtgtgtctgtctctgtatgttgtctcctgatggccaggaggccagctgtgcacatgctatgctctcatgccccagccagcctctggtccctctccctcctccacctgggccctgctscaggctcctagagtgtggatgtggctttcaggaacctctggtaccagccagggtccttgcatgcgaggaatgtagaaacctaggaaagcccaaagctctgggatgggaagcaggtatgtggaggggcaaggaaggcaccatgaggaccagcaggaagaggggctaggaaggtggtctgtgagtgccgtggatgaaggaggcagggcaaagagggagaagatgctaaggacagggaagagggaaccacagaggctggcaaatcatctgaaacaactgacctctgctgcccagagtgctcat

SEQ ID NO: 84919 - DNA, 601 bp, Human
ccaaccaatccagtttgtaaaagtgacagcccccctcctggattgcagttcacagctagcctccgaaagacaaagcaaactgcagagatatgtttgcagattagaagaagtctctggtccatccatccttgagggcagcgtggccaggttgggtgccaggagagggagtgatgaacatgcttctgcaggcttgtccttaaaggagtcccctgcccagaagatgaggctggttagatggtttagttccatttcccagtgccctctgcttgtagggaactgcttattgttctgggagcctaaytgggaccagaacttgataacttttctggagggaggaacatagtctgtcatcgatggttgatgtcctaatttacagccagcaggttagctaggtaccatgagaatcttgcattttctgtgagaggcatggcggccacttggatgcagggtcatttatactttttctgaacccccaagacttcccaattagacaatttcagcactttctctagtggctggaaatagtgttttgatgttttaagatatgcacaaacaacacacagctaagtcattaccaggtttcacgtatggggtttactga

SEQ ID NO: 84920 - DNA, 601 bp, Human
agggcagcgtggccaggttgggtgccaggagagggagtgatgaacatgcttctgcaggcttgtccttaaaggagtcccctgcccagaagatgaggctggttagatggtttagttccatttcccagtgccctctgcttgtagggaactgcttattgttctgggagcctaattgggaccagaacttgataacttttctggagggaggaacatagtctgtcatcgatggttgatgtcctaatttacagccagcaggttagctaggtaccatgagaatcttgcattttctgtgagaggcatggcrgccacttggatgcagggtcatttatactttttctgaacccccaagacttcccaattagacaatttcagcactttctctagtggctggaaatagtgttttgatgttttaagatatgcacaaacaacacacagctaagtcattaccaggtttcacgtatggggtttactgagtcttaagttgaagggtcaaatggcatgaatgatacagcggcaggttgtgggttaaaagactctttttgtgttgcaataatgttgagggtttctcctaaacgtttttcattttattgtttatagagtttca

SEQ ID NO: 84921 - DNA, 601 bp, Human
aacatagtctgtcatcgatggttgatgtcctaatttacagccagcaggttagctaggtaccatgagaatcttgcattttctgtgagaggcatggcggccacttggatgcagggtcatttatactttttctgaacccccaagacttcccaattagacaatttcagcactttctctagtggctggaaatagtgttttgatgttttaagatatgcacaaacaacacacagctaagtcattaccaggtttcacgtatggggtttactgagtcttaagttgaagggtcaaatggcatgaatgatayagcggcaggttgtgggttaaaagactctttttgtgttgcaataatgttgagggtttctcctaaacgtttttcattttattgtttatagagtttcattttattgatgaaatgcaaacatttccagttagatgataccaacatattttcgcatggctccattgggagctgaagcatcgtctgtaatttatgttgagaatgcagcctggaaaattaagttgtgttcataatcttaatagagaaactgaaaatgtacttgattctgaaacattaaacatagacattttttttgtctccttgaag

SEQ ID NO: 84922 - DNA, 601 bp, Human
aatgttttttcaaggacacatatacgcactgtggttttgaaccctgtgggctccatctgatctccctgtgttcagaccaactgcaatgctgcctcccacatgaaggggaatggcttgagctcctggatccatgtgtgggaaggagctcggcatccggtgtcttctggcctctgtggtctgaatgagtgtgcagtttccatccttccatccatcttcatcattaaaaccaaccttctctccagcccctctacagagggaaccagagagaagctgcatcaggccttttttaatttcctcttgygcatctcctacatgccatgttcactttgggttgactcagcatttgctcgtcatccattgttgctacatccgagtgacccacgagtttccacgaggggcaaataaataaaggaacacagccatgcagccatgaaaattctcagtcctcctcccagcagacagcaatgcatgctgaatgtcccatcagaccttctagatgaggacatctgtgcaagttacagacactcattagtccagtgtcttgtggataagaaaaagaccccaaagtgggaaaagttttgttcatttctctttcttttaa

SEQ ID NO: 84923 - DNA, 601 bp, Human
ttagtccagtgtcttgtggataagaaaaagaccccaaagtgggaaaagttttgttcatttctctttcttttaacattcaagaatttcctttctgcaaaagacatgcactccggtggaatccgaggacactatgtcccccactcatcccagatgggagcctttccatctccattgtaggaaagctttggagggatagtccttttgcctgtttggaagtttggtttaaggaggagaccattatttctagctataaagaattaggttgttaggttgaataattgtaaagcctgtgcccgagccrccagttggcgatgcaggtggttgaggggagatgtgggtggtatataagaagcaaaggactctcagcccctgatgtgccccgcgtggtcttcttagggaggctcaatgcataaagacagaagaaaatgggatcctccacagagatttaatctgtagaagatcaaacacctgttgcctggtcaccttagtctaaaaagtagtggagttttgttttgttatttttttaaagcatgattctacctgaagccatcaaaagcctctttttaaatttttttctttttttaatctaagaggagaacag

SEQ ID NO: 84924 - DNA, 601 bp, Human
taagaacttaatctcattctgttttctaatggaactagtctaaaaaggtcccctctcattgggtatagactgaatcctgctaaagggttaaccagaacttgtcaccagcgagacgactgtgtgcagggccagcctaggctgagtgcagcctgcctgtgatggggaacaggctctgccaggcagggttctttggctggagtctcaaagcctggcgcttgtatcctgaagatgaatggcctggcccagtcccgactagagacatgcatctcttatctccactgctacagcgtaggtccagggyggggctctgggcacttgtgcatgcttgctgtggcgctgtgagggctggcagatggctggtgtgtctgatggagctagcttagggacacaggcagcaaaagcattgcaaatgcatctaggcaggagaaacttaaccctaaaagtgggcaggagaaagaaaggtaaatgggtgttcatatttgatgtcaaaatgtcatcatattatgctattcagaagtgttttgagacattttagttttttttggtaacttaatcattcaatagaatatctatgaaattccaactaaatggtgtctaaaat

SEQ ID NO: 84925 - DNA, 601 bp, Human
gctgtggcgctgtgagggctggcagatggctggtgtgtctgatggagctagcttagggacacaggcagcaaaagcattgcaaatgcatctaggcaggagaaacttaaccctaaaagtgggcaggagaaagaaaggtaaatgggtgttcatatttgatgtcaaaatgtcatcatattatgctattcagaagtgttttgagacattttagttttttttggtaacttaatcattcaatagaatatctatgaaattccaactaaatggtgtctaaaattttaagcagcagtctacaggcaaagcrccaacatttcttttctaaaaattatttatgataacatctagcattttaaaatcaaccagaaactaggcttgattctgtttaatattttataagattggacatcttaaaataagtcaataatgtttatattttatagcaactctgtgtttcttcaaaaccatatttctgctgtgatgttaatggaatgactttatatggctttaattgtgttggtttaagtgctaatgaccacttttcaaattaaaatagtattttgctgatagaggtagacacagatatgagatatgaaagaatagataa

SEQ ID NO: 84926 - DNA, 601 bp, Human
tttcttcccagttgatccaaaatcagaagtgaaccccttgcttagctcaccatcccttgatgatgtaccctaggaagctctgaatgaatgaaatgcggctgtttagtactgccgggtatgacctttcttcacgttcctgcagctgtgctgtgtaagagcttttaccaacatagcattacagttgccttcttgatgtttccatgagaatggcaggtgggtccacctcagaaccaaatgacttcccaggctcagatgtgctgaactcgtggatcctgagagagggaaagtgtgtgtatgtgtgcgtgtgtgtgtgtgtgtgtgcgtgtgtgtgcgtgtgtgtgtgcacgtgcacgcacgtgtatgcacaagcatacccacatgtgcatatgtgtacacacatgcatcctgagcctgtgatcagagggacaggagagcaagaagcagcctccctgaccaccccaagaactgtcttggtttgacccgggacatgactgtctgtcccctataagatctcagcattcctagtcaggaagcttaaagctttcattcccagctcttccttcaccttcagaattcactaaatggaaagatctgctgctct

SEQ ID NO: 84927 - DNA, 601 bp, Human
atgtgcatatgtgtacacacatgcatcctgagcctgtgatcagagggacaggagagcaagaagcagcctccctgaccaccccaagaactgtcttggtttgacccgggacatgactgtctgtcccctataagatctcagcattcctagtcaggaagcttaaagctttcattcccagctcttccttcaccttcagaattcactaaatggaaagatctgctgctctatcttcacagaatggttcaaaccaaacccaacctggcaccatttttagcagaattgtctcaaaggcttggtgcttttrtgcaccaggctatttttataagggcctcttgggaagttcctgtgtgactttacattctaaattatcatcaccagcactggcattggcaactgcaggagaccagttttgagcatccccagaccagtgggacccagccctgatggatctggccagactgcagccaccatcccctcctcctccctgaaccacttctgggcatctgttctaccccatgcttgtctcagggatggtcatcatgcctatctgtccttgccacagctgcccacatgctaagaggtgttgtggaggaaggacagggaa

SEQ ID NO: 84928 - DNA, 601 bp, Human
tgtcttagctgttctccaggcctttagggctacagagctgtggacagactgccagtgagtgaggaggggctgcctggatacaggaccgtagacccagggcagagaggacatgccttcttcagatgcaggactttctgtggaaaagaataaagttgccatacagtccctattagtctttaactcagcatactgttttccttcaaactggtggtcaaaacatcatcattctctcagagctggagcagtaccttcctccatgcaccgtgcataagcatcttggaatgcttccctaatgaagtcrtgaacaatggaagggcttatcctgggccctgtctcaacatagcagggaccacagtgaggaaggcagctgtgagggcgccaggggagatgcagagtatctgtgacgggcccagagggatctaccaggggtgtcttctggtgggtcttgcactgcctgcaaaggctgataagccactttcagtttgttgtgatcttcaaaaagcggaccccctgttggtgagttctcagcctgcacacaggctacaggccagggtatcctgatgaccacggtggccgggtcggtgtgcgtgtcagtctgctc

SEQ ID NO: 84929 - DNA, 601 bp, Human; identical to SEQ ID NO: 20072

SEQ ID NO: 84930 - DNA, 601 bp, Human; identical to SEQ ID NO: 20073

SEQ ID NO: 84931 - DNA, 601 bp, Human; identical to SEQ ID NO: 20074

SEQ ID NO: 84932 - DNA, 601 bp, Human; identical to SEQ ID NO: 20075

SEQ ID NO: 84933 - DNA, 601 bp, Human; identical to SEQ ID NO: 20076

SEQ ID NO: 84934 - DNA, 601 bp, Human; identical to SEQ ID NO: 20077

SEQ ID NO: 84935 - DNA, 601 bp, Human; identical to SEQ ID NO: 20078

SEQ ID NO: 84936 - DNA, 601 bp, Human; identical to SEQ ID NO: 20079

SEQ ID NO: 84937 - DNA, 601 bp, Human
attgttatacaaccatgacactgtctccagaactttttcatcttctcaaactgaaactctgtcccataattccccatcctcctttttcttcccccagtttctggcactcaccattctacttcctgtctctatgtattctattctggggacctcatgtacgtggaattttacagtatttgtcttttttgtgtctgccttatttcacttagcatagtttcttcaagattcgtccatattgaagcagatatcagcatttccttccttttaaagctgaatactactccactgtgcagatagtctrcattttggttatctattcatctgttgatgggttacgtctaccttttggctactgtaatagtgctcctgtgaacatggttgtacaaatatcttctggttcctgcttttaattcttttgggtagacagactgtttttcaccctgttttgttcaatgttataatcccaacacctaaaatcagtgtcttgctcatagtaggcactttatatttgaaagaatgaaacattcatgaatgttatgtcttaatttatcttacatggttttcatctctttatcagcccttttccttgctgattctctca

SEQ ID NO: 84938 - DNA, 601 bp, Human
tgatcctcctacctcaccctcctgagtagttggaccacaggtgtgcaccactatatgcccagttaattttttattttttgtaggacagggtcttgctgtgttgcccaggctggtctcaaacccctgggctcaaacgatcctcccacctctgcctcctgaagtgctcgagttacaggtatgagctaccatgcccagcctacaaagattttttgaagtgcccacagcagtattgaacctcatgcttttgcttgggaagaggcctgtgcaagttgtcagagtcctagctgttttgttttgagayagggtcttggtatgttgcacaggctgttcacgaactcctgacctcaaacgatgttcctgcatcagagctggctttttctttctcctccaactgaaaaacaaaccaaacaaaaaaatctggcttttattcctagccatgtcccttggttttgttaaaacttgagtaactcaacctgaattttgactcttcctctggagagtggggtcaataaatgtaaacctgggttgctgtgcagtaatctggtagctgttctgaaagtatgtcaggcctgatggggtggctcacatctgtaatcccagc

SEQ ID NO: 84939 - DNA, 601 bp, Human
caggtctggtcgctggttgtgttcattgctctgggagacagagtttgcaagggaaactctgtgcagtaggtctccaagcagtgctgagcccttgctccaagtggagctcttgggtccatttttgattctccaacacttggcctgcagcaccccatgatgagaatgagacagtgagtggtgagtgtcgttgttttggaaggacagggatgtgaagaagagatagctcctgccgtggagtgggctgagcatgggtcctgtgaagccagtacttttatatttttctatcctctattcctatcctttttttttttcttttcctggagatggagtcttgctcactcgtccaggctggagtacagtggtatgatctcggctcactgcaacctccatttcccaggttcaagcgattctcctgtctcagcctcccgagtagctgggattacaggtgcacaccactatgcccagctaatttttgtatttttagtagagctggggtttcaccatgttggccaggctggtctcaacctcctgaccttgtgatccgcccaactcggcctcccaaagtgctgtgattacaggcgtgagtcaccgcgcccggcac

SEQ ID NO: 84940 - DNA, 601 bp, Human
gaaagcgctgcaggccagttgcgtgggaggtctgcactggacgtggtgctgggaccactgtgatttatgaacttggccagcatgggagaggagctttgtcaccatgggagagggaaggatttcttaaataagccaaactaataacaggctataaaggctataaaactatgtatgttaaaatgaaaatctaggccaggcatggtgactcacgcctgtaatcccagtactttgggaggctgaagcgggaggattgcttgagccactgcaccacttcagcctgggtgacagagaccctggctcaaaaaaaaaaaaaaaaaaaaaattcttatgtgtcaaggacaccatcgacacagtgaaaggacaaattctgtaaagagccgaaacaattctgaaggagaagggcaagtttcttggagagccagtaagtgcatgaagagatgctgctcaactgcggccatgcccaggaagctgtatgttacgatcctggtgggatggtccttcacagtcatccttcacagtcatcaggtgagcagacatcaaactcagaacagccagggattgagaagatgagcaacagtgggactcctcatacaatgctggt

SEQ ID NO: 84941 - DNA, 601 bp, Human
gagggatagagtcaggtggaacttccttgctgctttctgtgccttccttttctagggtccctagatgtaaggctgacttcaggactttttgttgctacttgctgactctttagaggtcattttctttttctttctttttttttttttttttttttttttttgagatggagttttgctttgtcacccaggctggagtgcgaaggcgccacctcggcccactgcaacctcctccccccgggttcaagcgattctcctgcctcagcctcccgagttgctgagaccacaggcacatgccaccacrtccggctaatttttgtatttttagtagagatggggtttcattatgttggccaggctggtcttgaactcctgacctcaggtgatccacccgccttggcctcccaaagtcctgggattacaggcctgagccactgcacccagcctagaggtcactttctagcttcctttctccgtactagtgaagaaatgtacttctttttatatatctatatatatatatttttttgtttgtttgtttgtttgtttgtttttgtttttgtttttgagacagggtcttactctgtcgcccaggctggagtgc

SEQ ID NO: 84942 - DNA, 601 bp, Human
gatagagtcaggtggaacttccttgctgctttctgtgccttccttttctagggtccctagatgtaaggctgacttcaggactttttgttgctacttgctgactctttagaggtcattttctttttctttctttttttttttttttttttttttttttgagatggagttttgctttgtcacccaggctggagtgcgaaggcgccacctcggcccactgcaacctcctccccccgggttcaagcgattctcctgcctcagcctcccgagttgctgagaccacaggcacatgccaccacatccrgctaatttttgtatttttagtagagatggggtttcattatgttggccaggctggtcttgaactcctgacctcaggtgatccacccgccttggcctcccaaagtcctgggattacaggcctgagccactgcacccagcctagaggtcactttctagcttcctttctccgtactagtgaagaaatgtacttctttttatatatctatatatatatatttttttgtttgtttgtttgtttgtttgtttttgtttttgtttttgagacagggtcttactctgtcgcccaggctggagtgcagtg

SEQ ID NO: 84943 - DNA, 601 bp, Human
cgaaacttttcagcaacctgtgttcattcacatgaggagattttttttcctttcttttccttttgttgttctttttctttttttttcctttttttcttttcttttttttttctttctttttttttttttttttttttttttaaataatagagagacacaatcactgacaaaacggccagaacaagctcttacaaggccatggaggcagcctcctcgctcaagagccaggcaggtaatgtggtcagcgccctttccttcttggcttctgggtgcccaggctgggctgggtgggtgggctgaragtgtgaaaggggaaggctggggctggtgaaggggaacagggcaggggaggaatccacaattaagctaggagtgaaaaagaaggaaaggaggttctcctgtggttgaaaactaaactgttttaatgtgtatgttattttgaagggtttggctaaattttattgaagttactttttacttggctctattatttgcaatttaaaattttactagaaaagtgatttcaaccagaagttttcaggtttcttacttgatggtgccagttgctactgtaaattctgtcacccttcagtaccctgac

SEQ ID NO: 84944 - DNA, 601 bp, Human
atccaaaaagtctgagcgaggagtgactgccaaaaaggagtatgtgtgccaggtgaggagaaggcagcatccgctatgtccgtgctggtgtctgactggggccccggtacgcagagcgaatttgtagtgtcttttcccttcccaccagaccccttccccaatctcaccgtcactcactcatctctgttttgaaggggtcagactgactctcagtggaatcctgggattgagttgtctccattaacatccataattcacatgtaggatgagatttgtatacacatcatgtatccacacacayacacacacacacacacacacacacacacacacacacacacacacacacacacacacacacacaaagttcctgttggaaaaggtgaggtgctaggcctgttttagcttcactgatgacatgcacactggacaggccaggctgtgggctgagggggccatcactagacctgtgtgtgcccacaggaccccagccaggccacctacactctgtgcttcagtcccgccccatctgtcagctggagatggcatgggagcttccatgccaggcagtcgatgcatgggaagtgtgaatactgcctgc

SEQ ID NO: 84945 - DNA, 601 bp, Human
tccaaaaagtctgagcgaggagtgactgccaaaaaggagtatgtgtgccaggtgaggagaaggcagcatccgctatgtccgtgctggtgtctgactggggccccggtacgcagagcgaatttgtagtgtcttttcccttcccaccagaccccttccccaatctcaccgtcactcactcatctctgttttgaaggggtcagactgactctcagtggaatcctgggattgagttgtctccattaacatccataattcacatgtaggatgagatttgtatacacatcatgtatccacacacacacacacacacacacacacacacacacacacacacacacacacacacacacacacacacacacaaagttcctgttggaaaaggtgaggtgctaggcctgttttagcttcactgatgacatgcacactggacaggccaggctgtgggctgagggggccatcactagacctgtgtgtgcccacaggaccccagccaggccacctacactctgtgcttcagtcccgccccatctgtcagctggagatggcatgggagcttccatgccaggcagtcgatgcatgggaagtgtgaatactgcctgcc

SEQ ID NO: 84946 - DNA, 601 bp, Human
caaaaagtctgagcgaggagtgactgccaaaaaggagtatgtgtgccaggtgaggagaaggcagcatccgctatgtccgtgctggtgtctgactggggccccggtacgcagagcgaatttgtagtgtcttttcccttcccaccagaccccttccccaatctcaccgtcactcactcatctctgttttgaaggggtcagactgactctcagtggaatcctgggattgagttgtctccattaacatccataattcacatgtaggatgagatttgtatacacatcatgtatccacacacacacacacacacacacacacacacacacacacacacacacacacacacacacacacacacacacaaagttcctgttggaaaaggtgaggtgctaggcctgttttagcttcactgatgacatgcacactggacaggccaggctgtgggctgagggggccatcactagacctgtgtgtgcccacaggaccccagccaggccacctacactctgtgcttcagtcccgccccatctgtcagctggagatggcatgggagcttccatgccaggcagtcgatgcatgggaagtgtgaatactgcctgccgt

SEQ ID NO: 84947 - DNA, 601 bp, Human
cggcaagccgcatccccaggagcctcgtggccgttcctgacgagtgtttgtgataagtgtgtgccggaggtcaggtgctctgcctttgcttgtaaaatgtgggctgcagtcaatatctttgtatgtaaagaaagtgctctgtattcatctttatataatattttctttgggatggattcccagaaacagaatcacagggtcagagagtatgaaatgtttagattcttggggaatattcccagattgttctccaaaatgtacagtttgtcataccacagcagtgaaaagagtgtctttcgcyacctcttccctaagattatgcatttctaccccagctgattttcagctgtctctactgctttgttatttggttgcttgtctttcactaatagtaaaccacaaggtcatgagagcagaggctatgccctcctgcctagcactgctcctcctggggtggactcccatgtggcttgctgctggtgcttggtaaaggaagagtcagagagatgggtcgggaagctgctcagaagagctcttaccagcgtttgctggacaccctgcagtgtactaagcaatcaacacgctttttctctcttcatct

SEQ ID NO: 84948 - DNA, 601 bp, Human
accctgatgtattttggcatgacccaggtccataccagggctgacccagcacagagagttcataagcctggtgccagttccagcaacagcacaaaaggttgcttagaaacacctccccagcacccttgttcctcgcctgcctgactgctgattcacccagactcttgctttacatcctgtcagatactttgtagccattttctctgttgtggggatcaccgtgtaaagtgggttatgtagaagcttggttatcagacagcgctcctgagacaaggtcgtgtaggaagcaagggttggcatrttgccacttcgtgaatacttaatacatttttcattggcaacctttacatacagatatgtctgagatcctttgaatttaatttatggagactttgtacacgccctccacggaggtatgctgatgtgtgtggtgcccgttctaagtgatcatgatggggagtcttgagccccgacactgaggattggtcagcacgctttttgtcatggccacatgcttgtgatttccagggagaatttgttaacgagtacgttggggagctgatcgacgaggaggagtgcatggcgagaatcaagcacgcac

SEQ ID NO: 84949 - DNA, 601 bp, Human
ctcatgtattactagttttactcatgaattactggcttgtgttttagggcactcaatacataaagatgtgattttgtgatatgagcaactgaaaaggatggggacagagctgtaaaggggcagggtttttatgttattgaagttaaacttaatataatcaagttataacattatatagagaattggaaaactggagaaaatcaatgaaaccaaaagtttgttttttaaaaagatcaataaaattgacaaacctttaactagatggactaggaaaaaaagagaaaagactcacataactaawatcagaactgggtgtgtgaagacattattactgcttctacagaaataaaaaaggattataagacagtactgtgaacaactgtactccagtaaattggataactgagatgaaatagacaaattcctagaaacacaaactaccaagactaaatcatgaaaaaaatggaaaatctgaatagacttataactagtagagagattgactcagtaattaaaaatctcctgagaggccgggcacggtggctcatgcctgtaatcccagcactttgggaggccgaggccggcagatcacaaggtcagg

SEQ ID NO: 84950 - DNA, 601 bp, Human
ggaaggcagagagaaagggacctgaggctctgagggcccacagagacttgggttctgtggtgaggagacctccatcaagccgacagcagtgagacaaacctgggacccagccagtacccgctccaagaaatccgacttcttcagaaaacaatgaaaaggttatgtaagaaaaccccagccaggtgcaatggcgtgtgcctataatcccagcactttgggaggccgaggcaggagaaccgcttgagcccagcctggagtttgagaccagcctgggcaacacagcaaggccttgtctctactaaaaaaaaaaaaaaaaatagctgggcacagtggcatgtgcctgttgtcccagctactcaggaggctgaggtgggagtatcgcttgagcccaggaggccaaggcgcgcagtaagccaaggtcctgtacaattgtgctccagcctgggcaacagattctgtctctaaaacaaacaaaaacaaaatcctgacccaaaacagcagaacttccttacagatggagaaaagccacttagaaaaatttttatcacaaagtagataaaagttatactctaatattcacagattttttgaatatgaggat

SEQ ID NO: 84951 - DNA, 601 bp, Human
cagcactttgggaggctgaggcgggtggattgcttgagctctggagttcgagaccagcctgggcaacatagggagaccctgtctcaattaaaaaaaaattgtggccaaaggtatgccaaggtgaagtcgaagaaaggagttgttctcagacaaggcagaattcaggccctaccactttcagtgacacagaagaaggcttttttgacaccagagccaccactggggatgagatgcaccctaaatttagggccttcccactggcctatgggatccaggagaaaggccagtgaatacagctgayggtgagttcacctcttaattgaaggcagagatcctggacagatgatgagcatgaattcagcactgtcgaaaagaaggacagaatacactggaggaagtgtttagagaccaagcagagacttagagaacagaaacaatagaaataaataaatctcttcttacgagcccacaatagtgccgtgtacttttcagaggcacatgtactgaggcgtgaggtccgagccagggcgtggacctgtatgtgaacatgggaggaggggacctgggacctgtgagggtgtgtgccagccggtggggtgca

SEQ ID NO: 84952 - DNA, 601 bp, Human; identical to SEQ ID NO: 55123

SEQ ID NO: 84953 - DNA, 601 bp, Human; identical to SEQ ID NO: 55124

SEQ ID NO: 84954 - DNA, 601 bp, Human; identical to SEQ ID NO: 55125

SEQ ID NO: 84955 - DNA, 601 bp, Human; identical to SEQ ID NO: 55126

SEQ ID NO: 84956 - DNA, 601 bp, Human; identical to SEQ ID NO: 55127

SEQ ID NO: 84957 - DNA, 601 bp, Human; identical to SEQ ID NO: 55128

SEQ ID NO: 84958 - DNA, 601 bp, Human; identical to SEQ ID NO: 55129

SEQ ID NO: 84959 - DNA, 601 bp, Human; identical to SEQ ID NO: 55130

SEQ ID NO: 84960 - DNA, 601 bp, Human; identical to SEQ ID NO: 55131

SEQ ID NO: 84961 - DNA, 601 bp, Human; identical to SEQ ID NO: 55132

SEQ ID NO: 84962 - DNA, 601 bp, Human; identical to SEQ ID NO: 55133

SEQ ID NO: 84963 - DNA, 601 bp, Human; identical to SEQ ID NO: 55134

SEQ ID NO: 84964 - DNA, 601 bp, Human; identical to SEQ ID NO: 55135

SEQ ID NO: 84965 - DNA, 601 bp, Human; identical to SEQ ID NO: 55136

SEQ ID NO: 84966 - DNA, 601 bp, Human; identical to SEQ ID NO: 55137

SEQ ID NO: 84967 - DNA, 601 bp, Human; identical to SEQ ID NO: 55138

SEQ ID NO: 84968 - DNA, 601 bp, Human; identical to SEQ ID NO: 55139

SEQ ID NO: 84969 - DNA, 601 bp, Human; identical to SEQ ID NO: 55140

SEQ ID NO: 84970 - DNA, 601 bp, Human; identical to SEQ ID NO: 55141

SEQ ID NO: 84971 - DNA, 601 bp, Human; identical to SEQ ID NO: 55142

SEQ ID NO: 84972 - DNA, 601 bp, Human
ttatatgcctcaactaccacggctatccatttcttccgaagccacagtcaaacactcctgcttttccgcctggaaacaaactaattggaaataataattagtaatgattttccccctaaaactttttactcgggcttccgcactctggaaatctcccgggagagaacctctaaacggcgaggtttagagaacctctaaacggcgagaggggcacggcaatgtccaaacgagaagaaagagctgattttgtaaagcgtccttcctaaacatccagcgcccgcccggggagacccgataggaygggcggcggcgaaccgggtcctggctggagaaaaggctgggagcgcacagcggagagacccgctcctgtgtttttgttctgttttctttttaaactaatggaaggcctcaacctgtcactgagggatcatttggcttctgagggtaggtagcctagggtgtcacagagaagtcattagaaatatgtgcgactttttttttttaaattactcttcctgtgatcgtttgagtccctggcgcgtgaggaaggggagaggaggcagggagggggtgggtgggctggcagcctgcgatccgggag

SEQ ID NO: 84973 - DNA, 601 bp, Human
tagcgaatgcaagtaaaacaggcggctgaggacgcgcggcggattagaacaatatttgcccaacatgacgcagaatactgaggagagccgagtgccggtcgctaaagaggctcttgaatataaagttgggcgctcgagagctcttgagcgctaatggcatatcccgccacggagaccgagtgactccgactttgcgacgcacgatttctgattaaatccgagagtggcttcagacaccgacttttacaaagagaggtggggggaccgggagagcgagggagggggcggtaggaacggcccmgcagcggagcctcttctcgcctcctccctttcaattacagtcagctccctccactcccgcggctgtgaaatcgttctaatcttccagatctccgcagccgctgagtccccaaattggggggatcgaggccggattagtgcgctgggtgtccccccaatcttctgtgaggaaattgtgtagactttgcattaaggcaaccaggcgttctcccctccccagcacacaccagtgatgcctgtcttcccggttcccaaagtcacccccacccggggggactgtgtcccatctgcctaccagcct

SEQ ID NO: 84974 - DNA, 601 bp, Human
gcctcctccctttcaattacagtcagctccctccactcccgcggctgtgaaatcgttctaatcttccagatctccgcagccgctgagtccccaaattggggggatcgaggccggattagtgcgctgggtgtccccccaatcttctgtgaggaaattgtgtagactttgcattaaggcaaccaggcgttctcccctccccagcacacaccagtgatgcctgtcttcccggttcccaaagtcacccccacccggggggactgtgtcccatctgcctaccagcctcgcagagcctgcaggcacrgttcatggatttgtgaggccaagtcgactatttaatttaggagctttggggcagtagtgtcctaaaattgtcccaaaacgaaattaggacttcgagggtggttagaagcaaggagagtcacccaagggacaaccaggtgcccttggaggcagcagccaacagcatatgtcacccgtccctcggctgtgcctcagctgttccctgggacagttccacggctctagccagagctgtaaatgtagtaatcagccaggcctttctagcccccaacaaactggatcattcatgactaccaggagc

SEQ ID NO: 84975 - DNA, 601 bp, Human
agaatggaataagatggaaagaaggaatagggaaagaaaaaaagttaagaaaggagagagaaataagaaagggaggaagaaggaaggaaggaaggtaggaaggaaggaaggaaagaaggaaggaaggaaggaaagcaggcaggcaggtgggcaggcaggaatgggcaaaaagttaacctagaaagctggatgataagagagcccccctggaggctttttcggagaaaatggcttcaatagatggatctgtcctaggagggtggatgcccatgggcttccctagaccaccgtctcagagttwtgatttctgctgtcgccaacaccagccatttgagtcctaaatttggaggtcccaaaccatactgcctgtgagagagaaagtgatctgttgtgtgtgtgtgtgtatgtgtgtgtgtgtgtgtacatgtgcattcaggcacgcagggccagaatgcacacctgagtgtgggagtggcagcaggagctggagagactccagagaggccctgggacctctcgggggtgtgggtggaagtgcacctaggcaggtgttagtgtaaggcacgaatgcatgcaagcatctgcatagaaatgcacagtc

SEQ ID NO: 84976 - DNA, 601 bp, Human
cggcttccgcgggcaggctggagtctgagtcctgcgccatgctttttctcaggatcagctaaggagggcgtttagttttcaagcgcccggaagcccgggaaaggggattgtgcttttgtttcttgacgggaggaagtttcgagagaaggaagggaaagtttttcctcattaccccctccccttcctcattgccctcataattcccctcctaagtctctttgagacttggtaagtgcacgttaaggggcgacagggagagaaacagaaatggaagacccagagtcacaaagactgacagttaaagaaaaggccccaaacacatacgcggagaggcggcaggctgagggaatcggaaagacagtggccatgggaacccgcagactgatggctttggaaaaagtggcgagtgccctggaacctgaaagcttgcaaaaagccagtgttgtttcagtctcccttcagaggtttctcccagcacccctctcctcacgacccaagcactcctagcccaggtctctctccagttctcagaagaccctcccaaccttgaagatgaacttcacagacaaagccggcttactaagacaactcccatctacgc

SEQ ID NO: 84977 - DNA, 601 bp, Human
tcgagagaaggaagggaaagtttttcctcattaccccctccccttcctcattgccctcataattcccctcctaagtctctttgagacttggtaagtgcacgttaaggggcgacagggagagaaacagaaatggaagacccagagtcacaaagactgacagttaaagaaaaggccccaaacacatacgcggagaggcggcaggctgagggaatcggaaagacagtggccatgggaacccgcagactgatggctttggaaaaagtggcgagtgccctggaacctgaaagcttgcaaaaagccwgtgttgtttcagtctcccttcagaggtttctcccagcacccctctcctcacgacccaagcactcctagcccaggtctctctccagttctcagaagaccctcccaaccttgaagatgaacttcacagacaaagccggcttactaagacaactcccatctacgcccagcccccacaggcgtggtccgaggaggaaggatgggtggccgggcagccccgtgtgacagcggcctggagcgaagggaaggggcggccattgacagacagggcccctagtgatgccgcagtcccgcccgggacaaa

SEQ ID NO: 84978 - DNA, 601 bp, Human
aaggaagaggatggaaagatcgtgcggtttggaggattcctctgattccagggaatgcggggcgttccatgctggcctgtgctcaccacaccagctaacaagccactttgctggatagaggttttccctgcagcagaaccaggaagaaccacgtctccaagggtttaaagtggagcctgtgccagatgggggaggctgaggacacaggtgctaagtctagaggagctgaagaaatgaaatgatcttatgcagtgagcctggtctccagaaagtcccgcagtttttgcgtgacagtgggtgygctgggtgcgctgattgtgctttgaatggctgtgtaagcgcaagcatctcttagtgtgactgtttacccacgggccttctgatctgaatgctgtaggccatatatctgtgcaaatgggattcagcatagatgtgcagggagtgtgtagatgggtgtgaatgggcaatatgatggtgcagatgagagagggccatctatccatctgtgagcaaattgtatccgtttcctatttgagttcctgggctggtcggcaggcacccctgtgaacccctcatctctcttccaggccccagacatcag

SEQ ID NO: 84979 - DNA, 601 bp, Human
gcgctgattgtgctttgaatggctgtgtaagcgcaagcatctcttagtgtgactgtttacccacgggccttctgatctgaatgctgtaggccatatatctgtgcaaatgggattcagcatagatgtgcagggagtgtgtagatgggtgtgaatgggcaatatgatggtgcagatgagagagggccatctatccatctgtgagcaaattgtatccgtttcctatttgagttcctgggctggtcggcaggcacccctgtgaacccctcatctctcttccaggccccagacatcagtttcatgkccaagttaaaggtgaaaagaccttccaatctccatccgagtaatccaggtagggagaggcagagatgccccatggccagagcagggggagttgtgcacacccacaactttgttttggcttcttgctcttgaaaaatgctttctctgggggagttgcccctctcatggcagggagccaccaaagaaggggtttaagagctctcctctttaagcactaaagagagatccctccctgagtccgttttttcctatcgtccgcttggcatttaataatgttaagacttattagagctggtaatga

SEQ ID NO: 84980 - DNA, 601 bp, Human
agcttccaggcatggtaagaaactatttatccgcaatcagttctcactctcagagtttgaagcacaaacgttaagttgaagggttttaaagcagattaaattgagcttttatttctgtgcactttcatctctgaacagctcactcctgctccccttgggctgatattcatgaggctgttcatatttttttttttgctcttatccttgttaagactgagttattaggattgttggtggtgagtattctcagaccgttgccgataggtgcttgccccagtcaagcttggctcacctggaaagkgaagtggacagttccttgcccccatgcacttagactccctcctcttcacccctttctccgaggatcaggggatagacaggccggggacccaacagggaggggatttgaggagagaagagaaaggaaaagattttcatagaatctgagctcagagagattcttgtggggaatttgataggggtttgcaatgggtcaaaccgttcctcagtgggagctgagggagtgagtgtgaagaaataagcaatagtataaaaaacaataacagcagtgacaaacaataagaacaccaaagccgcatgc

SEQ ID NO: 84981 - DNA, 601 bp, Human
gattcttgtggggaatttgataggggtttgcaatgggtcaaaccgttcctcagtgggagctgagggagtgagtgtgaagaaataagcaatagtataaaaaacaataacagcagtgacaaacaataagaacaccaaagccgcatgcatctgacagtgcaccagtttaagccaaaactgaccggatcagaccaggggctccgctttgttctctaggatggaaaggccaatgaggttacaattaatatgaaatatagggaaaagttacaagattagaaaaaagaagtagtagtagtggaggtarcatttttctccaggggacggggcgggggggaaatcctgggggtgtcaaagtccaggtggagaatttgcagacttcctgggtgtgaaagaccatctgaggtggggggaggattggcgaggacggcgagtgaggcagatttgtttctctttgtatttttcctttatttatttttaaggcagcaaacttacaggtgtggagtgggaaatgacggggaaggatcggaaaggaggggagagcccggagtgtcggttttagacacttgtaaaaggaggtgggaaacaatttaatttggcagcagcg

SEQ ID NO: 84982 - DNA, 601 bp, Human
tgccacaaacttggcctgctgaagggttagtctgtccaccatccggggaactgtcctttcaacagcaagggaaaataaagcccagagggaaaagaatcacagattgtggttagggttggaattcagatcctcatgtaaatggccccatgcagaggccctagcctgagcactaactgctgtgtcattctggaagagccgcttcatgtctctggcccctggtccttttgtctgaacaatggcaaggcaggatccacctagtggttttcaaactgtgttccatggagtcctgggattctcagcytcaggggccatcctttgagctgtaatactctgggcgtgtgtttagtggaggggaagcagtgaaaaaacagcctgtttccccatggatagaggaaactccggggaggcagggctttgtcctgggaagagcaaggaccacttcccatccaaggctactctggaggagggtgaggggaagaagctctgtatactcctggaatcagagccctcaggctgtggttattggtcttcagagataaggtgataactgcttatctggtgacaaatgattatcctcctcttctattcctctgattaggga

SEQ ID NO: 84983 - DNA, 601 bp, Human
agggaaaataaagcccagagggaaaagaatcacagattgtggttagggttggaattcagatcctcatgtaaatggccccatgcagaggccctagcctgagcactaactgctgtgtcattctggaagagccgcttcatgtctctggcccctggtccttttgtctgaacaatggcaaggcaggatccacctagtggttttcaaactgtgttccatggagtcctgggattctcagcctcaggggccatcctttgagctgtaatactctgggcgtgtgtttagtggaggggaagcagtgaaaaamcagcctgtttccccatggatagaggaaactccggggaggcagggctttgtcctgggaagagcaaggaccacttcccatccaaggctactctggaggagggtgaggggaagaagctctgtatactcctggaatcagagccctcaggctgtggttattggtcttcagagataaggtgataactgcttatctggtgacaaatgattatcctcctcttctattcctctgattagggaactttctctcctggctgggaggtctctttggaaaaagggcagggctggtcaagagacactgacatct

SEQ ID NO: 84984 - DNA, 601 bp, Human
tctcccctccccgccccccccaccccaccgcctcttcatgcacctgctgaggcttccggcctctgctgcttcaaagaggcaggctgggctttacctgcctgccttggagaaaagcagcctggtttgaaaggggaagtggcatttcaggcacttaattagacccgggacaagaatggaagttggctctcaggtcaggccaggggggattgttgggggattaacactcaggtaaacccatcaaggctcaccggccccctggcaggaggcagcaagagaatcccgggcagcagcggaaaggctrggccggctgggcccacagcctgggaatcacattccagagtggggtagtgggggtgtgcagagccggtagagggtgggaggggaagggtgggccactggctgcctccacccttaacctcaactggcccccttctcttccccgcccccccattgccccaggaaggtagagttagaactaccattttattcctgcagcaaaatgtattgagaacccactatgtgccaggcgctattcctaggagcacagccagcaatagcgcaaggtcccggctgcacagagctcacacactgggggaagagc

SEQ ID NO: 84985 - DNA, 601 bp, Human
tttattaatagttgggctatcagggaggcctgccaccagaagaggtgatatttgacctgaaacctggatggaaggaaagaggtaaccatttatggaaaacatctactacttaggacaatggccagttgagagctgactgcatatgtgttaagtgctttacattaatgaattcatcagatcctcccaagaatacctcaaaggagagattattaattaagaagcccattagtagatacagaaattgaggcatacagagaggtgcctcagctctttgggtccagatgggcagggccatctcacyggacacctgtgccctccccctgcccacctcttgctatgtgccagaaactgagccaggtgctctatacacctcccttaactccccagccatgccccgtgggtatctgttttcccagttttgtagatgaaagcacagctcagagaggtttactcagttgcctggagtcacacagtcaacaagtggagagccagtcattgaatctggtaccacaaactcttcctgctgcaacagctgtgcttttgcaggcactgactttggaataccctcagctgattcacagggtcctttgtcctggggaat

SEQ ID NO: 84986 - DNA, 601 bp, Human
cagggaggcctgccaccagaagaggtgatatttgacctgaaacctggatggaaggaaagaggtaaccatttatggaaaacatctactacttaggacaatggccagttgagagctgactgcatatgtgttaagtgctttacattaatgaattcatcagatcctcccaagaatacctcaaaggagagattattaattaagaagcccattagtagatacagaaattgaggcatacagagaggtgcctcagctctttgggtccagatgggcagggccatctcactggacacctgtgccctccccytgcccacctcttgctatgtgccagaaactgagccaggtgctctatacacctcccttaactccccagccatgccccgtgggtatctgttttcccagttttgtagatgaaagcacagctcagagaggtttactcagttgcctggagtcacacagtcaacaagtggagagccagtcattgaatctggtaccacaaactcttcctgctgcaacagctgtgcttttgcaggcactgactttggaataccctcagctgattcacagggtcctttgtcctggggaatggccttccctgtctccttca

SEQ ID NO: 84987 - DNA, 601 bp, Human
ttcacagggtcctttgtcctggggaatggccttccctgtctccttcagggaaagggtttcatccttcagggaagattcattgaatcaggatttgctgggtttttttcatttttttttttcatttcttttttttttacacgaatgggcttcctggcccgcattttgatttgcgcttgggtttatgaattgaggaatcacagtcagccttgggaattagttgcaagataaatattgcaatcctggttaaggacttaagaattgtcacttgtgtgtgtatattgttgttgttgttgcaacggtkctgtgtacgcacggttacagtggatcaaatttggggagttaggaagtggcgttggtttgtggttagacttgggggaggtgtcgctttcggttgttggtgtgctggtggctgtgttcctgtgatatggaatgtactgtctgagaatgtgttcaggggtctgtggttatgtggatatgggtgtgtagctgctgatgacatggatggagggatgtatctgggtgtgtttctgcagaacaagtgatacctgtaccatgtgactttgtcagttccaccatgtccaggcacaggtcgggggggttg

SEQ ID NO: 84988 - DNA, 601 bp, Human
ttctgcagaacaagtgatacctgtaccatgtgactttgtcagttccaccatgtccaggcacaggtcgggggggttgtccatggttctgaacgtatctgcccccattttacagataggaaaccaagacttagagaggccaagtcatctgcttgaagtcatctagctgagaagcggctgagcctgaagggaaaccagggctgccttcagagtccagcctcttttccctgctccccaggaaaggttttagtaacaataaaaggtttaaatgccagcaaaaggtctaaacgccagcgtcggtcayggggcctggcagacgtgtgtgcggtcacatgcatgtccccattctcgttctggtgtctcagctcctgcccattctatgggcccccagcccagccctgtcgcaggagagcctttctttctcgggactgcaaatacgccaaagatgaacgccgcccgcagctggctggctgcagccctgaacaatggcaagacctaggaagtgaagaaattgcccgaggagcacagcagcccagtccagagaggcagttcacagagtctgcctgctggctctggctcgaatgcagtgagccctccccccacc

SEQ ID NO: 84989 - DNA, 601 bp, Human
cctatcacccctggggtggcaagggaggagccgatcaaaggaagaactaatcttgcttggcacgtgcctacaatgccaccgtgatattagttcctgggccagaaccatatatgcattcctttaatttgggcatcattgttatcatttaattttaactctgctattttgtctggagctagtcaggtttcacaaactccttcccaattcatctcattactgcaaaaaataaagactgttattttcaatgaagacaatgtgactcctttccaggggccagaagctggtctccctggattccagkttccacggtcagaaacaagggctgcggccggtcccagcccatgactacagagcttagaaatgcaggtggcacgtcccctccgtagatgaagccacttaattaccatgcaatcaatatgcaaacaagtgccaaactgggtttgaatcaaatttctcattggggactcagtgggggaggaaagtccagccgaagggggccaaccgggatgagctggcagggagggggctgcaggatgaagagatgggcttcagctgggacccaggcacctgagggttgctcagacaccctccacagtcccca

SEQ ID NO: 84990 - DNA, 601 bp, Human
ccaggccctgggagacccatctcctaggctttgcaggggcagaagtcacattcgtttgttcatctacttccttccttcctgcatctgtgtttcatcaaaggcggaacagcttgggggtttgcagcatcagacttgagctggaatcggcctttaccctcctggcactccaatgcagccctctccttagccttgccagtgtatcagtttaacccatctgcgatatgggtattgtcataacggacccatttcactgggctgttgggaaaataatgcatctaatgcgcttataacaatgcctggtgcattttaagagtgcaatgactggtagctattattcttgttgctgtgattgatgatctaaaatgtaagaggcaagtccgggcgcagtggctcacgcctgtaatcccagcactttgggaggccgaggcaggtggatcacttgaggtcaggagttcgagaccagcctggacaacatggtgaagccctgtctctattaaaaatacaaaaaacaaattagccaggtgaggtggtgcacacctgtaatcccagctactcgggaggctgaggcacgagaatcactcgaacctgggagggcagaggt

SEQ ID NO: 84991 - DNA, 601 bp, Human
gattgcctgagcctgggaggtcgaggttgcagtgagccgtgatcacaccactgcactgcagccttgacaacagagcaaaaccctgtctcaaaaaataaataaagaaaaaataggatcatgtcaagaagtgagttaacacatatggaatcaaaactagtatggtgtctgttgctgtaggaatatcaggaatgtccttttttctttatttccctccctattcaacccacgaccccaccttaccaggcagcgcacaatcagggggacaggttgagatcccattgctttggcatggagcatgggrgtgataagaggctacaccttcttatgacctaatccaaaagtgaggcagatatgggctcccaggagaggggctggggattgaaactccacccccagcctaagggtggaggtccctctgatctgagaagcagaagcctcatgtggagaggaaaaagtgctcagaggaggaaaaactggccccatcgcctccaccttccatgaaaaaaaaaaagcctgcagtttttaaaaactgcctgatggcaaagagaccaaatgaccccagatctagaaagagaaaccagaggaagggttcctggctgct

SEQ ID NO: 84992 - DNA, 601 bp, Human
ggctctctctctcctctctctctccccttccccttcttattgagaatgccccctaaaaaaaaagacgccagccttctgctatttttcttctctctctgaaaatgagaacatcagctattgaagcggattgatgaactcttcccaaaagtttattaagggaaggttagacaaaggccccagggcccgcaggcgactgagcagtcagtatatatactgggcccttttgtccccccagggccgacgcatgaatacctctcaatggccctctttagagtgacaagatcaagccagacaacagctkgttaaaaggaactgcgagctgtttctctttttccagcccaaagctccgtccatcacttctcctgcattaatgtacatctgcagcgggaggaataatcggctggaattctgtcggttttgtgtgggtttttcttttttcttaaatacacccttctcctcctcttccctgcccccacctgcccctcctcgctcctgccctccccctccccccacaaaggtcctggagccatatgttactgagcccatcctggctgtgtcttcgagggaccccagggtgggtatttctggaagacagcaagag

SEQ ID NO: 84993 - DNA, 601 bp, Human
atactgggcccttttgtccccccagggccgacgcatgaatacctctcaatggccctctttagagtgacaagatcaagccagacaacagcttgttaaaaggaactgcgagctgtttctctttttccagcccaaagctccgtccatcacttctcctgcattaatgtacatctgcagcgggaggaataatcggctggaattctgtcggttttgtgtgggtttttcttttttcttaaatacacccttctcctcctcttccctgcccccacctgcccctcctcgctcctgccctccccctcccccsacaaaggtcctggagccatatgttactgagcccatcctggctgtgtcttcgagggaccccagggtgggtatttctggaagacagcaagagaagggggttctgaagcttctgttccttccagtgcatgcttataataatcaccccgtttccgaacacttactgtgtagcaggggctggactagggacccaggtgtaccatcgcctctgcagactttttcatcaaggtaggtgttattggccccacatgatggaagggaaagtgaggcaagagagaagtaactttctcagggaatcatctgg

SEQ ID NO: 84994 - DNA, 601 bp, Human
aggaactgcgagctgtttctctttttccagcccaaagctccgtccatcacttctcctgcattaatgtacatctgcagcgggaggaataatcggctggaattctgtcggttttgtgtgggtttttcttttttcttaaatacacccttctcctcctcttccctgcccccacctgcccctcctcgctcctgccctccccctccccccacaaaggtcctggagccatatgttactgagcccatcctggctgtgtcttcgagggaccccagggtgggtatttctggaagacagcaagagaaggggkttctgaagcttctgttccttccagtgcatgcttataataatcaccccgtttccgaacacttactgtgtagcaggggctggactagggacccaggtgtaccatcgcctctgcagactttttcatcaaggtaggtgttattggccccacatgatggaagggaaagtgaggcaagagagaagtaactttctcagggaatcatctgggatgcaactctaggcctggcccactcttgggggctcaccctgattttcagctgctgcatgcaggacaggggttaaagccaaaagcaaatcttagccc

SEQ ID NO: 84995 - DNA, 601 bp, Human
agctggctggggttgacatttcataaacatgaagttgccttgggagaaacctttcttcattatcaatgctaagggaacccttgctcaaacaagccagggttatgcaaaactccaaaatttccttcatttgagctggagagtgtgtgtgcatatgtgtgtgtgcatgcacgtatatgtgtgtgtgtacacatatgtatgtgtgtgttgtgtgtgcatgcatgtgtaatgtgtgcatgcctgtatgtatatgtgtgtgcatatgtatttgtgtgcatgcatgtgactgtgtgcacataagcaygtgtgtgacatgtgtgtgtatgtgtgtgtctgtgtgtgtactgcagattcactgtcctagtgagttttgttctgtgttttcagctcctgcaccagattaggaccttctttgagagcaaggaccagtcaactacattttattctgctttgatctcacctatttagtgccagtgcaataccatatgcagaacaggtgctcaataaatgctccctaacttgagaacttctctgagacacctgagcaggaaaggggagggggcagccaggcctctgctgagaattgaaggcaaggctttccctc

SEQ ID NO: 84996 - DNA, 601 bp, Human
tatttcatggatgattcaagtctaacttccccctaggaagggctgtgacccctgacccctgcaacctgtatttaccacgttcaaaagcccctactagccccagagagctgacctgagctgggaccaaggcaccaggactggcagggctataaacaagcctgcctccttgggctcaggaatcctgagtgaaaaaacagaagggggctcagaggtggggcccagtcctggcctgtgagccagcggctaaagggaggggagagaggactcacgggggtgggggacctggaggatgagttagggkagaaatgggcacataaggagctatttcctccccttgaccctcggttttcttggctgtaaaatggagcaaaagctactttgctcgttagggttttgtaaggctgaagtgaaatagtgagtgtaagggcttcagagtgctagaggggaaagtaaaaagcacacacgcatgctagagcagggggcatagaatagggagggggccaaagcatggaggattagacagttgacacgtggttgttagatgatcagtaaatctctgttgagaaataaatacccagagcttggctgaaacagaacaacg

SEQ ID NO: 84997 - DNA, 601 bp, Human
gtggttgttagatgatcagtaaatctctgttgagaaataaatacccagagcttggctgaaacagaacaacgtgggtccatccctgccctcagaggcccccttgcttggtggggtagacaggcaaacagatatccctcccttcagtgtaagggttgccatgaggagtagggggcataggggctgtgggagagtcccgctttggggtccatgaggtggaaatgaattcgtctttattttttcaaactcacatttcctgtgcctctttgcagaaactttctgatctctcctcccaccccaaacytgcctttggtgtgtccacgtctcttggattagactttaatcctcctccagctccttgatgggcatgcagaggctgagaggatcgaactggcctttcccagcacttgctctgggactatctggaagcctgcacgctaactcagcccactgccccgccctgtaactgcagacaagaaatgacctccatgagcctcagtgttctcatctgtaaaatagggctaacaacacccacctcacagtgtcggacaaagccacgtgtggtgcctggcacacagtaggtgctcagagtatgggcctggag

SEQ ID NO: 84998 - DNA, 601 bp, Human
ggctgaagtgcagtggcacaatctaagctcgctgcagcctccgcctcctgagttcaaccagttctcctgcctcagcctcccgagtagctggggttacagggacacgccatcatgctcagttaaatttttttgtacttttagtagagatggggtttcaccatgttggccaggatggtctaaatgtctgacctcaggtgatcctcctgccttggactcccaaagtcctgggattacaggcatgagccaccacacccagcctgtaagttctttatattgaaggaatcacatattattgtgaagaaaaaaaaaaaacctcaaacactaaaagaatatagaaagtaaaaaagcttgtcagcctctgcttcctactctccagagttaaatacaatgaataacttgggagtctgatcttctagatgtttctccacagagaaacggcacatctatacatatgtttattttgacaaagtgggattgtgcaacagacactgctctggacttaatcagttaataatgtgtccaggacatcattttccggaggctggttccttctcgacacctcgccagtgatgggttttacccattgttttatcaccttcaa

SEQ ID NO: 84999 - DNA, 601 bp, Human
ccaggatggtctaaatgtctgacctcaggtgatcctcctgccttggactcccaaagtcctgggattacaggcatgagccaccacacccagcctgtaagttctttatattgaaggaatcacatattattgtgaagaaaaaaaaaaaacctcaaacactaaaagaatatagaaagtaaaaaagcttgtcagcctctgcttcctactctccagagttaaatacaatgaataacttgggagtctgatcttctagatgtttctccacagagaaacggcacatctatacatatgtttattttgacawagtgggattgtgcaacagacactgctctggacttaatcagttaataatgtgtccaggacatcattttccggaggctggttccttctcgacacctcgccagtgatgggttttacccattgttttatcaccttcaacctgatggtagctgagccctgggctcatcacttccacctgttaactgaggagccattgctgtccccattgtacagatgataagactgagggccagagaagctggatgatttcttcaggtctcctgctagaaagcagatgaactggaatttgtggggtttgttttgt

SEQ ID NO: 85000 - DNA, 601 bp, Human
cctcaaacactaaaagaatatagaaagtaaaaaagcttgtcagcctctgcttcctactctccagagttaaatacaatgaataacttgggagtctgatcttctagatgtttctccacagagaaacggcacatctatacatatgtttattttgacaaagtgggattgtgcaacagacactgctctggacttaatcagttaataatgtgtccaggacatcattttccggaggctggttccttctcgacacctcgccagtgatgggttttacccattgttttatcaccttcaacctgatggtagmtgagccctgggctcatcacttccacctgttaactgaggagccattgctgtccccattgtacagatgataagactgagggccagagaagctggatgatttcttcaggtctcctgctagaaagcagatgaactggaatttgtggggtttgttttgttttgttctgttttgtttttgagacagagtcttgctctgttacccaggctggagtgcagtggcatgatctcagctcattgcaacctctgcctcccatgttcaaacgattcttgtgcctcagcctctcgagtagctgggattacagcc

SEQ ID NO: 85001 - DNA, 601 bp, Human
tgttacccaggctggagtgcagtggcatgatctcagctcattgcaacctctgcctcccatgttcaaacgattcttgtgcctcagcctctcgagtagctgggattacagccatgtgccaccatgcccagctaatttttatattttcaatagaggtggggtttcgccatgttggccagctggtctgaaactcctggcttcaagtgatccacccgtctcggcctcccaaagtgctgggcttacaggcgtgagccaccacagccagcctgagctggaatttgaatttgggttttctgactctcartcctctaggataatttggggtacgtggaggaactggccgtatcctaagttcagaagacagactccagacaagaagtataacagcctgtggtgaaagatacgtggtattgacatcttcccacaggtcaggaacagttatcactttaacatagccttgaagttcaggccagctgctaccagcccatgccagatggcttcttagtgccacagtcttcccttttccctcccagtgagaaagcacagaggtgaaatgggggcttagaaagcccccaccccacccactggccttaataaagtggga

SEQ ID NO: 85002 - DNA, 601 bp, Human
ccaggctggagtgcagtggcatgatctcagctcattgcaacctctgcctcccatgttcaaacgattcttgtgcctcagcctctcgagtagctgggattacagccatgtgccaccatgcccagctaatttttatattttcaatagaggtggggtttcgccatgttggccagctggtctgaaactcctggcttcaagtgatccacccgtctcggcctcccaaagtgctgggcttacaggcgtgagccaccacagccagcctgagctggaatttgaatttgggttttctgactctcaatcctcyaggataatttggggtacgtggaggaactggccgtatcctaagttcagaagacagactccagacaagaagtataacagcctgtggtgaaagatacgtggtattgacatcttcccacaggtcaggaacagttatcactttaacatagccttgaagttcaggccagctgctaccagcccatgccagatggcttcttagtgccacagtcttcccttttccctcccagtgagaaagcacagaggtgaaatgggggcttagaaagcccccaccccacccactggccttaataaagtgggattccag

SEQ ID NO: 85003 - DNA, 601 bp, Human
ctggccttaataaagtgggattccagggctgcaattcacttttccaatccaggatcttgaaactcacagctctcccagatcgttgtaccaagattgggacctggagctgaaagagcttctccagcagacactcctcagatgtcagctctggaagcatccagtctgaccctctcactttcacagatggatgggcagaggccccaggaaggttaagtgacttgcccaaggtcacacagctaatcagtggcagagctgggacagattcccttttgttggaaagatgatctcgtgcctctgaggyggtagtgacctctctcctggcccctgtcagcctatggccacatctgagtttttccttcccaactgttgaaagtcttccaaacctcggggaggccgggaggcgtaacaaatggggagctggtgacctggaagagggaacaccatgcctggggaaggggagggaggagggcgaggcagccacacgaaagtccagttaccaggctgtcacagcactctcatttggtcagcactttacagtttatgaagcttgtcccaagctgtgatcctcacagccctctatgaactagccttgtcatcccta

SEQ ID NO: 85004 - DNA, 601 bp, Human
cggcaggggctgcaggccatggagacgacagcccgggcccgtgcgagtccctccacctggctccttgtcccatcaggcaccacttaagaggatgtaccgttacatgtagagggcaaaggcagggctggagacgccttcagaaatggaaatgggacccatttgtttataatttactctctgacacttaacaggaacctgatgggaccaataaaggctcagaactcacccaactcctgcctcaaaagtgctggagccggtccagttctctagaggcaaacacatctcaaagcctggcaaaccrcttggctcccagcaccccataccccctcgctccctccctcctcgctaaacttttgaaagacccctcactgttccctagctcagtgggcctgccagcctttccaagctgtggggcaggaaggcagcaggacttgcttttgaggtagagaggggcctagaaggcaattcgggagaggactagaatattctgggcacaaggtaggcaaagagagggggccagtgatggaggaggaatccagttttcaattttcctcaacagaaaaatgagtgcatgagagacagaataattttccagtgtgca

SEQ ID NO: 85005 - DNA, 601 bp, Human
gagggcaaaggcagggctggagacgccttcagaaatggaaatgggacccatttgtttataatttactctctgacacttaacaggaacctgatgggaccaataaaggctcagaactcacccaactcctgcctcaaaagtgctggagccggtccagttctctagaggcaaacacatctcaaagcctggcaaaccgcttggctcccagcaccccataccccctcgctccctccctcctcgctaaacttttgaaagacccctcactgttccctagctcagtgggcctgccagcctttccaagctktggggcaggaaggcagcaggacttgcttttgaggtagagaggggcctagaaggcaattcgggagaggactagaatattctgggcacaaggtaggcaaagagagggggccagtgatggaggaggaatccagttttcaattttcctcaacagaaaaatgagtgcatgagagacagaataattttccagtgtgcaggccctaagtgaaacctccttgagacattgtgagtcattaaagaggaggaaagaaaagaaatggtaaaatcagtttgcctttagcagaactgtacaatgcactcttat

SEQ ID NO: 85006 - DNA, 601 bp, Human
tcagaactcacccaactcctgcctcaaaagtgctggagccggtccagttctctagaggcaaacacatctcaaagcctggcaaaccgcttggctcccagcaccccataccccctcgctccctccctcctcgctaaacttttgaaagacccctcactgttccctagctcagtgggcctgccagcctttccaagctgtggggcaggaaggcagcaggacttgcttttgaggtagagaggggcctagaaggcaattcgggagaggactagaatattctgggcacaaggtaggcaaagagaggggrccagtgatggaggaggaatccagttttcaattttcctcaacagaaaaatgagtgcatgagagacagaataattttccagtgtgcaggccctaagtgaaacctccttgagacattgtgagtcattaaagaggaggaaagaaaagaaatggtaaaatcagtttgcctttagcagaactgtacaatgcactcttatttccaggggaatctaattagagggcagacagccgagcctggaaggggaagaaagccagaggttggggctgggaggccccagtgggccaggtgggaggagggtgtgat

SEQ ID NO: 85007 - DNA, 601 bp, Human
attgtaccaccccctgctagtttaatgtaactaacctatggttggccacatttttggaaaataacattgtttatttgatcaagattcagtaaactgggctcagagcaataattgtcccagggtgcgagtaacagattttatttttattgatcaaaaaaaagtttttatctaaaacacatcaaacttttaaaaggcgtcaacagcaggatcaaattggattttaactcctttaaaaagtggctccttcaggaacccattccaaagatgtccgaccctttgcagtgagatactcaaaccccagggtggatgagggattccacgggcaagggaggttattttggagccataatgaagacactgcatttgcatttgggggccctctgagcagctgagacatctggaagcagaagggggaattcgacggaatatctgtgtgttggtttagagtgtcagtcctcgacctcttggaactgttcagctggctagctggggcttccagcgtggggccaggtgtctggtgttgcataaatacatctctaatgaaattattgtacaaaacaatcctaacacactcaccaacaatcacgttggcttgaagagc

SEQ ID NO: 85008 - DNA, 601 bp, Human
catctggaagcagaagggggaattcgacggaatatctgtgtgttggtttagagtgtcagtcctcgacctcttggaactgttcagctggctagctggggcttccagcgtggggccaggtgtctggtgttgcataaatacatctctaatgaaattattgtacaaaacaatcctaacacactcaccaacaatcacgttggcttgaagagcaaactatttggaacattgcaccttattgcacagatctggccatataggaggacgcaattctttgactccttcaacaaatgtctgttgagcaatyaccatgggccaggccctcttctgggcattgaggataaagcaatgaataaaacagataaaatccttatcttcttggagcggaaacagggttcctccaaataattcaagaggggaggctggaagacagctcatggaggaggtaggtgtccggtgtggttcctgacttcagtcttttaaaggccactctcctgatactatgacggctctttctccttgcaaacaccagtgacacacctgattgctgaacacaaaggaaaagatggtgaggagaaacgggacttagggaaagagccagggtgga

SEQ ID NO: 85009 - DNA, 601 bp, Human
aggggaggggaggggaagttgggggaggagaggggaaaggaaggataagtcttccccacccccttctcctaagaggaaaagagggggattgggggatcctgggaggcagggcaggccccaggcagaatgggagggtgatgaaattggtccttcccctcccccacaggaagcagatgatctcagggtgtcctgtagctcatgctgcacacgcaacttaggatcatagtcccttctgaaactcctcaccacccccaccagtcaatgatcctttctccagcaacaggcattgttgagagccagccccgctgtatgcctggcactgtcctgaaccctgaaggtggagtttatccatcagatacagcccagaccccttctcagggggctgttctttgagatccaggaagaccccttggttttaggggtagggaaaatgcagctcagagaggggtttagaggtgaagtcagggacaaacttcagggtttcaaccccaagccccctcgtctttacagccagcccacgggctcctgggggatgcccctctgggcaaggtgaagagtcctctcatctaaatggggcatgctagctgactgtaggtgattt

SEQ ID NO: 85010 - DNA, 601 bp, Human
aggggaggggaagttgggggaggagaggggaaaggaaggataagtcttccccacccccttctcctaagaggaaaagagggggattgggggatcctgggaggcagggcaggccccaggcagaatgggagggtgatgaaattggtccttcccctcccccacaggaagcagatgatctcagggtgtcctgtagctcatgctgcacacgcaacttaggatcatagtcccttctgaaactcctcaccacccccaccagtcaatgatcctttctccagcaacaggcattgttgagagccagccccgctgtatgcctggcactgtcctgaaccctgaaggtggagtttatccatcagatacagcccagaccccttctcagggggctgttctttgagatccaggaagaccccttggttttaggggtagggaaaatgcagctcagagaggggtttagaggtgaagtcagggacaaacttcagggtttcaaccccaagccccctcgtctttacagccagcccacgggctcctgggggatgcccctctgggcaaggtgaagagtcctctcatctaaatggggcatgctagctgactgtaggtgatttggggg

SEQ ID NO: 85011 - DNA, 601 bp, Human
gatttgggggacacttccgccctgacaactcgtgttttaatctggcattcctggaggcagtagcaggggaaataaccaagttgatggctttggtgttggtgtctccagagggtgaagtctgtttcatagggtgggcttctcaggtggagatcttgtttctaaggggggcggcatggcctccattacagcaactgccccagtggtgggggtgtcaggcttatgtttccagtgatcctgcttgactttctcatcagcactccaggaccggcgcacagcagacccatctttcggagagtgggtmtctttcatggtggcatgatcctgagacccctagttcctgttgcaatgaacattcactgctgtagcttttgttagtgtggtttgtgaggcaccagtgggtgcttggtgaacacctgttgggcacatgcttctctgtacaccttgttaggtgcacagaatgttaggtttcagagttttcctgggaggcctatttgaaggaagatagaaatgtggggatagacgggaagctggaagcatagaaataactctggagggaaaagaaactggcacagagtcctgggagagaagctgtgactctggg

SEQ ID NO: 85012 - DNA, 601 bp, Human
actgtgattaaaagcattctagccaggcgcagtggctcacggctgtaatctcagcactttgggaggctgaggtgggcagatcacaaagtcaggagttcaagaccagcctgaccaatatggtgcaaccctgtctctactaagcatacaaaaattagccgggcgtggtggcattctcctgtagtcccagctactccggaggctgaggcaggagaaatgcttcaacccaggaggtggaggttacactgagccaagatcgtgccactgcactccagcctgggtgacagagcgagactccgtctgaaaaaaaaaaaaaagaaaaagaaaagaaagaaagaaaagaagcatttagccgggcgcagtggctcacgcctgtaatcccagcactttgggaggccgaagcaggtggattacctgaggttgggaattcgtgaccagcctgaccaacatggagaaaccctgtttctactaaaaatacaaaattagctgagcatggtggtgcatgcctactcaagaggctgagacaggagaatcgcttgaacccaggaggcggaggttgcagtgagccgagattgtgccattgcactccagcttggacaacaag

SEQ ID NO: 85013 - DNA, 601 bp, Human
aagaaagaaagaaaagaagcatttagccgggcgcagtggctcacgcctgtaatcccagcactttgggaggccgaagcaggtggattacctgaggttgggaattcgtgaccagcctgaccaacatggagaaaccctgtttctactaaaaatacaaaattagctgagcatggtggtgcatgcctactcaagaggctgagacaggagaatcgcttgaacccaggaggcggaggttgcagtgagccgagattgtgccattgcactccagcttggacaacaagagcaaaactctatctcaaaaataaaaaaaaaagtgttctagaatgataggaactacagagctgttcttagttaccctgccctcgagtaatgcccgatataagaaaaaatagagtttccatcctcgaggaactccctgtcttattgtaaaggcaccatctctaccctgagctgtcctcagtttgatggggagatggactttccacacatatccactaaaagctaatgattagtctccagcaggagttgataccaagggctgagaagatggcacaggcagcaagtgccacagggattcaagcagagttctctggatgtggtagtc

SEQ ID NO: 85014 - DNA, 601 bp, Human
gcacgctcagaagtgcccatcgcgatggttaagagggctctgggactggctgcctggccgtcacggtcactctgccattgagttacttaacccctttgagcctcagttttcacacctgtaaaatggggctaatagaaatactgatgagcattgtagtgaggtgttgtgatttgctacaggaaaggtgcttcgtaaggtcaaagcacaccagcagcggtttgaacgcttcttctctgtggccttcacacccagccccactgggggatgctgcatgggttcacagagccccatcttcagggtrgagtgagccccaggtttaagtccttcttcatggctgagcccggaagcagggagttacatggacagagggacgaggcccaaagccattttccatctccacctccaaacaactttccaactggacacagcccctgtgtctcccagggctccagcactgaggaggggtgagggcgtggggagggggagaaggagggtcccgcaggcttggcctctcaggcatatggtcctttcacagccgctttgtggggcgcggatgggtggtcaggctgccttttcctttccatgccgggcagcttcatct

SEQ ID NO: 85015 - DNA, 601 bp, Human
ggagaaggagggtcccgcaggcttggcctctcaggcatatggtcctttcacagccgctttgtggggcgcggatgggtggtcaggctgccttttcctttccatgccgggcagcttcatctggccactggagccccagctgctgctctttcccctctgctgattttgagacctctccttaggcctcccctgctccagcttcctgggcgtctgtcttcctctggccccttagtgcctctagcatttatgctacagctgaatcacttacctgagaccacctggccccctcttctctgtaggtacrttttgcatccaggacagatttctgggaaaaggatgggatgggatggacgtggggtctgtaggcatggcttggggatctgcaaagcctccaccgtggaagaataaggaaaggatgacaaaggcatgttcattcattcagtcagttgttcattcattcaggcatttgttcattcattcatccatgcattcattccttgcctttgtgttttgcgccaggcaactgtgcttgcctctgagggatacagaagtaaaataggtccacactacatggaggggccaataataacaatagcagcaataa

SEQ ID NO: 85016 - DNA, 601 bp, Human
ggtccacactacatggaggggccaataataacaatagcagcaataataatcgctaacatggattgggtgcttactgagtacctggaactgttcttgccttgcagtaattcctttcatctttgtgcatgacaactctgtggggttggtactattcttgtcctcattttacagatgaggaaattgaggcccagagggatgaagttactttcctaggttagtggggggctgggacagttgtatcaagggtacctctgtctgtgtatttctcaaggttcccacccctggagctgcatcagtaccytagggaataggcaggatggcagctcttattcccagggggatggataagcaaatagagattccaagaggacaagtgacaagtgacatgctcagggtcacacagcaggtcatggatgagcccagagtgccaactccccacctgccaggcttctgttctgaaggagaggagagactgggtctgggattggtggctggcaggctggccagcccaggagcgcctgtcacacacaaggctgggagctcagcctccatctagttttcctcacctcccctcctcctttctgtctcccatcactctcac

SEQ ID NO: 85017 - DNA, 601 bp, Human
ctctccctgctgcttaaataacttggatgagtaaatgattgaaataacccatgagagaagtgaatgagaactagtgagtaatttcaagatggacttaaagtcacaggaagagtgtaaaagattttgagccgggcgcggtggctcacgcctgtaatcccagcactttgggaggctttgggaggctaaggtgggcagatcacctgagctcaggagttcaagaccagcctgaccaacatggagaaacccactctctactaaaaatacaaagttagccaggcatggtggcacatgcctgtaatcmcagctactcggaaggctgaggcaggagaatcgcttgaacctgggaggcggaggttgcggtgagctgagattgtaccattgcactccagcctgggcaacaagagcaaaactccgtaaaaaaaaaaaaaaaaaaaaaaaaagattttgagctgagctcctcatagagtgggcctgcccctgcccccaaggtgccctcttaaaatgtcccacctcatcctcctcactaattcacagctgccaccccttccaaaactccatattagctgcacaggacaccagcatgttaaagagaccaagttag

SEQ ID NO: 85018 - DNA, 601 bp, Human
gcctgtttggtattcagagacgcctggcccacactcgccagctctcagctctgcccgaattacttgattaaaacgcatatcaactattatgtgattcgtttctctgccgcagctcaacaccggggcctatgttaaactgtaagaaaagctgggttgggaggctgcgggagaggggagcgcagaagcaggggtgggagggtttccggagggtgtgagggaggctgagagaaggaccccaaacctcagggccactgccggcctccactgatccgggatgggtgatttagaaatgggtcagctyctggtcctctgtgagctgggtagattcagagattgtggccaccttatttcaaggcttttcctctggcaaaagagggaggagggaaaggttggggatggaagagaagccacgttggttttcaggaccagaaatggaattttccatcacccgggaacttgctgtagccatattggccttctccgggctgggagtcctgagtcctgggtttactttgcagccccactgccctgagactccactgaacatctgtagaatggggataacactgcctgccttcccctccctttattgggagaaact

SEQ ID NO: 85019 - DNA, 601 bp, Human
agaggggagcgcagaagcaggggtgggagggtttccggagggtgtgagggaggctgagagaaggaccccaaacctcagggccactgccggcctccactgatccgggatgggtgatttagaaatgggtcagctcctggtcctctgtgagctgggtagattcagagattgtggccaccttatttcaaggcttttcctctggcaaaagagggaggagggaaaggttggggatggaagagaagccacgttggttttcaggaccagaaatggaattttccatcacccgggaacttgctgtagccawattggccttctccgggctgggagtcctgagtcctgggtttactttgcagccccactgccctgagactccactgaacatctgtagaatggggataacactgcctgccttcccctccctttattgggagaaactgttgggacaacaaaagggcttgtaaactgtagagtgttgtgtgcaagttcggggggtgactgctgcagtgtgtcagagtttaagagagactttgccaagctctgtcaagctctattcattcaagaggcctttattgagcacatgctgtgtcctaggcatagtccctgc

SEQ ID NO: 85020 - DNA, 601 bp, Human
agaaatgggtcagctcctggtcctctgtgagctgggtagattcagagattgtggccaccttatttcaaggcttttcctctggcaaaagagggaggagggaaaggttggggatggaagagaagccacgttggttttcaggaccagaaatggaattttccatcacccgggaacttgctgtagccatattggccttctccgggctgggagtcctgagtcctgggtttactttgcagccccactgccctgagactccactgaacatctgtagaatggggataacactgcctgccttcccctcccyttattgggagaaactgttgggacaacaaaagggcttgtaaactgtagagtgttgtgtgcaagttcggggggtgactgctgcagtgtgtcagagtttaagagagactttgccaagctctgtcaagctctattcattcaagaggcctttattgagcacatgctgtgtcctaggcatagtccctgccgcactcaaggatctcccagaccagtgagacccacagacccataaacagtctagttcagtgtctcctgatgagctttgagaacgccaagaaagggaactgaaatcaccttggatggg

SEQ ID NO: 85021 - DNA, 601 bp, Human
cacagaagccatgagtggctggacagggaactgtatgggatggcaaggtgagtggggacacatgggcaaggcccatagtggttgaggccttgctggcgtggctgaggcttcctggcacatgctggcagtcagtgatggcttccagaggtcagtagctgtgaaaggaggctttgaagggagaggcaaaggctgggggagagatgatgggagctgcccccagcaaccttccatccatcaccatcaccatcaccatcaccatcaccatcaccaccatcacctcagcctgggccggactttgccyggccaacttgctcctgcccaccccaaagctttgacaacgcaaatggctcccagcaccttccgcccctcattctgtcctaaggctctgctgctttaacgagccacaagctgccttgatgttttacgtctgtcctgtgccccggttcatctggcagtgtttcctccactggactggaaaatccccaggacaaggtgatacctcctccatctgactgggagcttcctaaaacagaggctgtttctcccccatgagattgggaggtctctcaggtaggagctgcaattctcctttgctcagtat

SEQ ID NO: 85022 - DNA, 601 bp, Human
caccccaaagctttgacaacgcaaatggctcccagcaccttccgcccctcattctgtcctaaggctctgctgctttaacgagccacaagctgccttgatgttttacgtctgtcctgtgccccggttcatctggcagtgtttcctccactggactggaaaatccccaggacaaggtgatacctcctccatctgactgggagcttcctaaaacagaggctgtttctcccccatgagattgggaggtctctcaggtaggagctgcaattctcctttgctcagtatggactgctccacatccctractagagacaggatccaggaactcagagaaagcatctctccctgtatccttctcttttggggcaatctccagaccagcaccccctgggaccatcccattccttagctgtttgatagtgcgagggcaggagcccaggctggccatgaggctgctcccctactgcgtaccccgaatctggctgccgtttaatgaatgcgttcccatgttcactccccccacgtccccctcctcgaaccagctgcccaggcttcaccaaggtacctgcttttggtacacagaagactcagccccaaccagcag

SEQ ID NO: 85023 - DNA, 601 bp, Human
cgagggcaggagcccaggctggccatgaggctgctcccctactgcgtaccccgaatctggctgccgtttaatgaatgcgttcccatgttcactccccccacgtccccctcctcgaaccagctgcccaggcttcaccaaggtacctgcttttggtacacagaagactcagccccaaccagcagggcctctgtggccaattccacctaatcctgttgattaatttaactctgaggctaaaggatttccaggggtggggagagagaagggcaccccaagagagtgggggtgcaggaagctgaartgaggttgatgtggtggcattggggctctttgtgtcttctcacactgctttgaccctgtactccccgccccgtttccttttctgtcatcaccaccgtcattgtcctcatcatcaacaatagtaatagccttcatgggtccttgaagttgcaaattactcctatcatctttattttattttattattattattatttttttttgagacagagtcttgctctgttgccctgggggacatgcagtggcgtgatctcagctcactgcaacctccacctcccagatagaagtgattctcctgcct

SEQ ID NO: 85024 - DNA, 601 bp, Human
tgtggccaattccacctaatcctgttgattaatttaactctgaggctaaaggatttccaggggtggggagagagaagggcaccccaagagagtgggggtgcaggaagctgaagtgaggttgatgtggtggcattggggctctttgtgtcttctcacactgctttgaccctgtactccccgccccgtttccttttctgtcatcaccaccgtcattgtcctcatcatcaacaatagtaatagccttcatgggtccttgaagttgcaaattactcctatcatctttattttattttattattattattatttttttttgagacagagtcttgctctgttgccctgggggacatgcagtggcgtgatctcagctcactgcaacctccacctcccagatagaagtgattctcctgcctcagcctctcaagtagctgggattacaggcgcataccaccatgcccagctaatttttgtatttttagtagagacggggtttcaccatgttgcccagggtggtcttgaactcctgacctcaggtgatccacccgcctcagcctcccaaagtgctgggattatagacatgagccaccacaccaggccccat

SEQ ID NO: 85025 - DNA, 601 bp, Human
ccaattccacctaatcctgttgattaatttaactctgaggctaaaggatttccaggggtggggagagagaagggcaccccaagagagtgggggtgcaggaagctgaagtgaggttgatgtggtggcattggggctctttgtgtcttctcacactgctttgaccctgtactccccgccccgtttccttttctgtcatcaccaccgtcattgtcctcatcatcaacaatagtaatagccttcatgggtccttgaagttgcaaattactcctatcatctttattttattttattattattattwtttttttttgagacagagtcttgctctgttgccctgggggacatgcagtggcgtgatctcagctcactgcaacctccacctcccagatagaagtgattctcctgcctcagcctctcaagtagctgggattacaggcgcataccaccatgcccagctaatttttgtatttttagtagagacggggtttcaccatgttgcccagggtggtcttgaactcctgacctcaggtgatccacccgcctcagcctcccaaagtgctgggattatagacatgagccaccacaccaggccccatcatct

SEQ ID NO: 85026 - DNA, 601 bp, Human
caattccacctaatcctgttgattaatttaactctgaggctaaaggatttccaggggtggggagagagaagggcaccccaagagagtgggggtgcaggaagctgaagtgaggttgatgtggtggcattggggctctttgtgtcttctcacactgctttgaccctgtactccccgccccgtttccttttctgtcatcaccaccgtcattgtcctcatcatcaacaatagtaatagccttcatgggtccttgaagttgcaaattactcctatcatctttattttattttattattattattatttttttttgagacagagtcttgctctgttgccctgggggacatgcagtggcgtgatctcagctcactgcaacctccacctcccagatagaagtgattctcctgcctcagcctctcaagtagctgggattacaggcgcataccaccatgcccagctaatttttgtatttttagtagagacggggtttcaccatgttgcccagggtggtcttgaactcctgacctcaggtgatccacccgcctcagcctcccaaagtgctgggattatagacatgagccaccacaccaggccccatcatctt

SEQ ID NO: 85027 - DNA, 601 bp, Human
attccacctaatcctgttgattaatttaactctgaggctaaaggatttccaggggtggggagagagaagggcaccccaagagagtgggggtgcaggaagctgaagtgaggttgatgtggtggcattggggctctttgtgtcttctcacactgctttgaccctgtactccccgccccgtttccttttctgtcatcaccaccgtcattgtcctcatcatcaacaatagtaatagccttcatgggtccttgaagttgcaaattactcctatcatctttattttattttattattattattattwttttttgagacagagtcttgctctgttgccctgggggacatgcagtggcgtgatctcagctcactgcaacctccacctcccagatagaagtgattctcctgcctcagcctctcaagtagctgggattacaggcgcataccaccatgcccagctaatttttgtatttttagtagagacggggtttcaccatgttgcccagggtggtcttgaactcctgacctcaggtgatccacccgcctcagcctcccaaagtgctgggattatagacatgagccaccacaccaggccccatcatcttta

SEQ ID NO: 85028 - DNA, 601 bp, Human
agttgcaaattactcctatcatctttattttattttattattattattatttttttttgagacagagtcttgctctgttgccctgggggacatgcagtggcgtgatctcagctcactgcaacctccacctcccagatagaagtgattctcctgcctcagcctctcaagtagctgggattacaggcgcataccaccatgcccagctaatttttgtatttttagtagagacggggtttcaccatgttgcccagggtggtcttgaactcctgacctcaggtgatccacccgcctcagcctcccmaagtgctgggattatagacatgagccaccacaccaggccccatcatctttatctcattccattctcaaagccatccagggagggaggcatacaagggtgtattgttatcttcatttttatagcggagaaaaccaaggtcctgagaaggggagcgacttgtccaagaccacacagctagggaaagacagagcccacaagccaggtctcaggctgccgagaccaggattcctgattagaccggggctgtcccagaggaccctcaaactccttcccaatctgtcccttcccgccaatccctct

SEQ ID NO: 85029 - DNA, 601 bp, Human
tcctattatttccttaatattttactatatctaaaagcacctttaaaaaactaattcaaggatactaatgctcttataaatggaaaatgagtatcatttcctgtaaatagatgggaaccataaaaaccataaatagcataaaaacaaggaacgttgttaaattctacctagagactagcacacgggaagttgtgagcgtggggcctgccctctctttgttaagaagagacaacaactgtgttaatgactgtatcggattgtgctggcctcagtggtggccaccagccacgtgtgactatgyaaatttgaattacaattaaatacaatgaaagacgaagttcttcagttgcagtagggaagtttcaggtgctcaaaaccccatgtagctagtactgccacattgaacactgcgaatctagaacgtttccgtcatcgcagaaacttctattggacagcactgctctagaactgaatggagactcagtcagattagtatttccaggccaggcatggtggctcatgcctgtaatcccagcaatttgggaggccgaagcaggcggatcacctgaggtcaggagttcaagaccagagttcgagacta

SEQ ID NO: 85030 - DNA, 601 bp, Human
taaattctacctagagactagcacacgggaagttgtgagcgtggggcctgccctctctttgttaagaagagacaacaactgtgttaatgactgtatcggattgtgctggcctcagtggtggccaccagccacgtgtgactatgcaaatttgaattacaattaaatacaatgaaagacgaagttcttcagttgcagtagggaagtttcaggtgctcaaaaccccatgtagctagtactgccacattgaacactgcgaatctagaacgtttccgtcatcgcagaaacttctattggacagcastgctctagaactgaatggagactcagtcagattagtatttccaggccaggcatggtggctcatgcctgtaatcccagcaatttgggaggccgaagcaggcggatcacctgaggtcaggagttcaagaccagagttcgagactagcctggccaacatggcaaaaccctgtctctactagaaatacaaaaattagctggccatggtggtgtgtgcctgtagtcccagctactcgggagggtgaggcacgacaaccatttgaacccgggagatggaggctgcagtgagcagagatggcgccac

SEQ ID NO: 85031 - DNA, 601 bp, Human
gagactcagtcagattagtatttccaggccaggcatggtggctcatgcctgtaatcccagcaatttgggaggccgaagcaggcggatcacctgaggtcaggagttcaagaccagagttcgagactagcctggccaacatggcaaaaccctgtctctactagaaatacaaaaattagctggccatggtggtgtgtgcctgtagtcccagctactcgggagggtgaggcacgacaaccatttgaacccgggagatggaggctgcagtgagcagagatggcgccactgcactctagcctgggcracagaacaaaactccatctcaaaaatataaaaataaaaaataaataagaaagactaggatttcccccaggacaaggctgtgcctcctccatcagactggggctttctgagggtagggcctgtgtctgccctcatctctgacctcacagctctgaggacagtctctgcccagagactgcactccctacaactctagtccccatccccctcagctcctgtctgagctcaagtgtcctcactgaagaactgaatctggtgccccactccccatccacgggctggcctcgctgcctgccagaca

SEQ ID NO: 85032 - DNA, 601 bp, Human
aaataagaaagactaggatttcccccaggacaaggctgtgcctcctccatcagactggggctttctgagggtagggcctgtgtctgccctcatctctgacctcacagctctgaggacagtctctgcccagagactgcactccctacaactctagtccccatccccctcagctcctgtctgagctcaagtgtcctcactgaagaactgaatctggtgccccactccccatccacgggctggcctcgctgcctgccagacaaatgcctgcttccttcttctgaagccccaagggctggctttygttgtcaccgtcagaacactgaggttatgcactgcatttcaggaattgaatccttggcattagttgtatttggctctgagccccagaaatggtggggaaggggccccaggatggcagctgtgcccactgtggtctccccacagtgactggggggctgggtaactggaagccctggcaggaaaggccagggcagagccctggcaggaaaagcaagggcaggggttagatctgactccaggtctctgcccttggggatgaggcaggccatgatgaaggcaggactcccttgcaatccattcc

SEQ ID NO: 85033 - DNA, 601 bp, Human
atgcctgcttccttcttctgaagccccaagggctggcttttgttgtcaccgtcagaacactgaggttatgcactgcatttcaggaattgaatccttggcattagttgtatttggctctgagccccagaaatggtggggaaggggccccaggatggcagctgtgcccactgtggtctccccacagtgactggggggctgggtaactggaagccctggcaggaaaggccagggcagagccctggcaggaaaagcaagggcaggggttagatctgactccaggtctctgcccttggggatgagscaggccatgatgaaggcaggactcccttgcaatccattccttcgctgtgtggcatggcgtcaccatcagagaccacctggcactggccaaaaaaaaagcaaggataactttccaacggacaagatagcaggatggaaggaagtgggcccagggcagagaggcattgccaagatggatgaccctccaggcgcatgacctctcacacatccgggccatacccaccagcttcctggctatgaatgtggcaccatgattaaattacccagcatgccttttgacacaccaggcgtttgcatgtgc

SEQ ID NO: 85034 - DNA, 601 bp, Human
ggggaatcactcagagaccctgggacatcccagagagagcttgtcagtggaagtcgcctaatccaaacccttcatgtcacaaatggggaaagtgaggcccgaggaggggaggtggccttcccagggtcaccagcatttaggagcagagccaggcctggaatctaagcttcttgatgggcagctctggacacgtgcactttttcttttgatgagacagggtcttgctctgttgtccaggctgaagtgtggtggtgtgattggcttactataacctggaactccagggctcaagcgattctcycacctcagcctcttgagtatctgggactacaggcatgcacttccacactcagctaattttcttacttttttctggaggttggttcttactgtgttgtccaggctggtcttgaactcctgggctcaagcaatcctcctgcctcagcctcccaaaatgctgggattacaggcatgagccaccatacatggaggcctttttcttaaagtcaggattattgaggtatagttaatatacagtaaaattctgtccttttaactgagaatacagctctatggattttgtcaagtgtatctcaccacg

SEQ ID NO: 85035 - DNA, 601 bp, Human
tggaactccagggctcaagcgattctctcacctcagcctcttgagtatctgggactacaggcatgcacttccacactcagctaattttcttacttttttctggaggttggttcttactgtgttgtccaggctggtcttgaactcctgggctcaagcaatcctcctgcctcagcctcccaaaatgctgggattacaggcatgagccaccatacatggaggcctttttcttaaagtcaggattattgaggtatagttaatatacagtaaaattctgtccttttaactgagaatacagctctayggattttgtcaagtgtatctcaccacgaaaccatcccttgagtcttatgtcatggacatccttgcatgtcagtggaaataaacaaaatgcccaaccagaggggactgttttgttgttgtttgtttgtttgtttttccctaaagggaaaggttttacaagaaagtatttaagcaatactctagggttgggcatggaggttgcttcccatccttcacattgataaacaatgctagggtgagcatccttctatcttgtgcttgggaggagtctgatcgcagtgcagtcatgggtcctaggtgg

SEQ ID NO: 85036 - DNA, 601 bp, Human
cttttaactgagaatacagctctatggattttgtcaagtgtatctcaccacgaaaccatcccttgagtcttatgtcatggacatccttgcatgtcagtggaaataaacaaaatgcccaaccagaggggactgttttgttgttgtttgtttgtttgtttttccctaaagggaaaggttttacaagaaagtatttaagcaatactctagggttgggcatggaggttgcttcccatccttcacattgataaacaatgctagggtgagcatccttctatcttgtgcttgggaggagtctgatcgmagtgcagtcatgggtcctaggtgggcacgagtgtgccttgtgctctcctcccagaccccggcacccttccatctctctaagcccctgccttctccctccctctcctccggctgtagggaaccggctggacgagggctcggatgtggagtcggaacctgacctcccactgaagcgcaagcagcgacgcagtcggaccacattcacggccgagcagctggaggagctggagaaggcctttgagaggacccactacccagacatatacacccgcgaggagctggcgcagaggaccaagctgac

SEQ ID NO: 85037 - DNA, 601 bp, Human
tcttgtgcttgggaggagtctgatcgcagtgcagtcatgggtcctaggtgggcacgagtgtgccttgtgctctcctcccagaccccggcacccttccatctctctaagcccctgccttctccctccctctcctccggctgtagggaaccggctggacgagggctcggatgtggagtcggaacctgacctcccactgaagcgcaagcagcgacgcagtcggaccacattcacggccgagcagctggaggagctggagaaggcctttgagaggacccactacccagacatatacacccgcgargagctggcgcagaggaccaagctgacagaggcgcgtgtgcaggtgaggaggcacctgcggtgtcggtgctgcagatatactccagagattcagaagtttgggatggccaaggtcagtgggtttaatgggacccctcggggggtttacaacaggttcagggggttgtgtaggcaagtaatgccaccagcatttgatgcagagttagttggcagcaaatgttggttgactgagagctggacagcccaaggaggagggaagaatgaagggagagatagagggaaggggggaagaaaaggaaga

SEQ ID NO: 85038 - DNA, 601 bp, Human
agtgcagtcatgggtcctaggtgggcacgagtgtgccttgtgctctcctcccagaccccggcacccttccatctctctaagcccctgccttctccctccctctcctccggctgtagggaaccggctggacgagggctcggatgtggagtcggaacctgacctcccactgaagcgcaagcagcgacgcagtcggaccacattcacggccgagcagctggaggagctggagaaggcctttgagaggacccactacccagacatatacacccgcgaggagctggcgcagaggaccaagctgacmgaggcgcgtgtgcaggtgaggaggcacctgcggtgtcggtgctgcagatatactccagagattcagaagtttgggatggccaaggtcagtgggtttaatgggacccctcggggggtttacaacaggttcagggggttgtgtaggcaagtaatgccaccagcatttgatgcagagttagttggcagcaaatgttggttgactgagagctggacagcccaaggaggagggaagaatgaagggagagatagagggaaggggggaagaaaaggaagaaggtggaagggaaagaaggacaaaaga

SEQ ID NO: 85039 - DNA, 601 bp, Human
agcgacgcagtcggaccacattcacggccgagcagctggaggagctggagaaggcctttgagaggacccactacccagacatatacacccgcgaggagctggcgcagaggaccaagctgacagaggcgcgtgtgcaggtgaggaggcacctgcggtgtcggtgctgcagatatactccagagattcagaagtttgggatggccaaggtcagtgggtttaatgggacccctcggggggtttacaacaggttcagggggttgtgtaggcaagtaatgccaccagcatttgatgcagagttagktggcagcaaatgttggttgactgagagctggacagcccaaggaggagggaagaatgaagggagagatagagggaaggggggaagaaaaggaagaaggtggaagggaaagaaggacaaaagaaggaatgaaagaagggagggaggccaggtgtggtggctcacacctgaaatcccagcacttcgggaggccgaggtgggcggatcacatgaggtcagcagttcaagacctgcctggccaacatggtgaaaccccatctctactaaaaacacaaaaattagctgggcttggtgacgggcacc

SEQ ID NO: 85040 - DNA, 601 bp, Human
agagcctcccaatggctcgaggactgccccgcctgctctctgtcagtgggttgaggggcaaaggcctgctgtagggggcctggggacattgcctcacctccccaggccaaactctcggattccaggaggcctacagttgttctccaagtgcaggagcctctctggggatctggctggaaagggctgaggctggagggttggggatggaggaggaagagccgggacaagtcgtgatgaacggctcttgtgggaatccattccctggctgtcttctgcatggattgggaggcatagagagagrggaaagatccccattaccagaatctaagcagtgctcagggagtcagagcggcctgcagaggggccaccccaaactgctgacggcgggcacttccatccaagaggagccagcctttgcccggcacccacttggtgccagtggcattgctggggctgcttctcaaacgtgacctagtggaagctcagaccaccttgtcgggtcagcgtggtcaccccctgcaagccacgggtgcagaaactggaagttcagagaagcaacatgcccaggggcacaagctggatgggggctgagccaggccca

SEQ ID NO: 85041 - DNA, 601 bp, Human
ggatggaggaggaagagccgggacaagtcgtgatgaacggctcttgtgggaatccattccctggctgtcttctgcatggattgggaggcatagagagaggggaaagatccccattaccagaatctaagcagtgctcagggagtcagagcggcctgcagaggggccaccccaaactgctgacggcgggcacttccatccaagaggagccagcctttgcccggcacccacttggtgccagtggcattgctggggctgcttctcaaacgtgacctagtggaagctcagaccaccttgtcgggtsagcgtggtcaccccctgcaagccacgggtgcagaaactggaagttcagagaagcaacatgcccaggggcacaagctggatgggggctgagccaggcccagctgctggcaaaaaccacgtcctttccatccagggaaatgaacaagctgagtcacaagctgaaatttgaaagcaactgggacaatcctagaagcaagggacgtttcagcactccaggacccagcggacacccctccgccccctgtcctcactcccagattaggggtccttcgcttcctttgagggagaccccaaggggaaa

SEQ ID NO: 85042 - DNA, 601 bp, Human
ggagtcagagcggcctgcagaggggccaccccaaactgctgacggcgggcacttccatccaagaggagccagcctttgcccggcacccacttggtgccagtggcattgctggggctgcttctcaaacgtgacctagtggaagctcagaccaccttgtcgggtcagcgtggtcaccccctgcaagccacgggtgcagaaactggaagttcagagaagcaacatgcccaggggcacaagctggatgggggctgagccaggcccagctgctggcaaaaaccacgtcctttccatccagggaaaygaacaagctgagtcacaagctgaaatttgaaagcaactgggacaatcctagaagcaagggacgtttcagcactccaggacccagcggacacccctccgccccctgtcctcactcccagattaggggtccttcgcttcctttgagggagaccccaaggggaaagaggcgggaggcagcagccagctcatctctttccctcccctcctgaccgaggtgatatccgagctggctccaggcctccctcccgctctgatcctcctgcagctgttctcctgggcacattcctgggcgctttctcgt

SEQ ID NO: 85043 - DNA, 601 bp, Human
gtgacctagtggaagctcagaccaccttgtcgggtcagcgtggtcaccccctgcaagccacgggtgcagaaactggaagttcagagaagcaacatgcccaggggcacaagctggatgggggctgagccaggcccagctgctggcaaaaaccacgtcctttccatccagggaaatgaacaagctgagtcacaagctgaaatttgaaagcaactgggacaatcctagaagcaagggacgtttcagcactccaggacccagcggacacccctccgccccctgtcctcactcccagattaggggyccttcgcttcctttgagggagaccccaaggggaaagaggcgggaggcagcagccagctcatctctttccctcccctcctgaccgaggtgatatccgagctggctccaggcctccctcccgctctgatcctcctgcagctgttctcctgggcacattcctgggcgctttctcgttcccacgtctggcggccacggcggcttcccaccaccttgaagcctgactgctccttgtaaaatttcctggctgtcagagcagtgcttttattggcccaggggactcagaaacaggtgtcactcaagg

SEQ ID NO: 85044 - DNA, 601 bp, Human
gctgagccaggcccagctgctggcaaaaaccacgtcctttccatccagggaaatgaacaagctgagtcacaagctgaaatttgaaagcaactgggacaatcctagaagcaagggacgtttcagcactccaggacccagcggacacccctccgccccctgtcctcactcccagattaggggtccttcgcttcctttgagggagaccccaaggggaaagaggcgggaggcagcagccagctcatctctttccctcccctcctgaccgaggtgatatccgagctggctccaggcctccctcccrctctgatcctcctgcagctgttctcctgggcacattcctgggcgctttctcgttcccacgtctggcggccacggcggcttcccaccaccttgaagcctgactgctccttgtaaaatttcctggctgtcagagcagtgcttttattggcccaggggactcagaaacaggtgtcactcaaggtccacggagggagggggtctgggaatggagaggcagccggagcccaggcaaagccatcctgagggggcggggcccgcctcctgcgtcttattgacttcctatcatactctgggcttcccc

SEQ ID NO: 85045 - DNA, 601 bp, Human
aaataaggggatggaactcaacaattactaagacccttacatttctgggatccctatttactgacaatcagggatgctttgtgaggtgatgagattcccattaccagaagtgttcaaacaaaagcacaatgtccagtcaatcagggaccctgaggtctttgagttatgacctcaaagccccctgagtactgcttacattgtatggcttcatacattttaggtcttggtctttgattctaaaggtctgtggttctgggattttccaatcgtataatatctcatctcagtggacctggcagaygggtgggttagtggattggttcagggtaggcttggagccaaatacctagatgtggattccagctccatgtcttaccctttccaccctccacccatctctcacaggcaagatgatgataatgatgtctaccttgctctgaggattaaatgattacatgtaaaaaaaaaaagaaaaaaaaagaggaagtacctgcacacagaagtgccataaatgggggttgttcttactaaaactctgcccgttcttggcagctccaattctagccacctttgcagctccaggtacattcacccagcagtc

SEQ ID NO: 85046 - DNA, 601 bp, Human
tcaaagccccctgagtactgcttacattgtatggcttcatacattttaggtcttggtctttgattctaaaggtctgtggttctgggattttccaatcgtataatatctcatctcagtggacctggcagatgggtgggttagtggattggttcagggtaggcttggagccaaatacctagatgtggattccagctccatgtcttaccctttccaccctccacccatctctcacaggcaagatgatgataatgatgtctaccttgctctgaggattaaatgattacatgtaaaaaaaaaaagaaaaaaaaagaggaagtacctgcacacagaagtgccataaatgggggttgttcttactaaaactctgcccgttcttggcagctccaattctagccacctttgcagctccaggtacattcacccagcagtcatttacagagtacttgctgtgtgccaggcgctgttctaggcattggggattcactgggcaaaaagctctgctgtcttgaagctggcattctcataaatacgtgcacaggtaaacatgatgtcaggtggggatctggtcaccaaagagtggcctgttatcccctctggctcc

SEQ ID NO: 85047 - DNA, 601 bp, Human
cttggtctttgattctaaaggtctgtggttctgggattttccaatcgtataatatctcatctcagtggacctggcagatgggtgggttagtggattggttcagggtaggcttggagccaaatacctagatgtggattccagctccatgtcttaccctttccaccctccacccatctctcacaggcaagatgatgataatgatgtctaccttgctctgaggattaaatgattacatgtaaaaaaaaaaagaaaaaaaaagaggaagtacctgcacacagaagtgccataaatgggggttgtycttactaaaactctgcccgttcttggcagctccaattctagccacctttgcagctccaggtacattcacccagcagtcatttacagagtacttgctgtgtgccaggcgctgttctaggcattggggattcactgggcaaaaagctctgctgtcttgaagctggcattctcataaatacgtgcacaggtaaacatgatgtcaggtggggatctggtcaccaaagagtggcctgttatcccctctggctccctcaagctctgccttcctgcaggggccaggagcctctgcttgaagcctgct

SEQ ID NO: 85048 - DNA, 601 bp, Human
aagccagagccacatgaagggcagccaagggggtgtcaggcaggagaacccatgcctggggacccatgactcctttctctggagtgatacatatatcttccttagaggtgaacagacccattttttcctgggtgccacaaccctgagcctgtgaatttcttctagaaatagaggctgcagggctaataggtcccaaggtcaccccatggcctctcccatgactgcctctgatgacttccccatccttcagatgatcagcaccaggaaactagggcagtgtacaacgcctctttactttacsgtccttggaaccctgctctgtgcttggggtaggggtgggatgttctgaacggaaatcccattgtggaagcactacagagattcactaattaacaacttacactgaatctcttaataacactaggtagcattcatggtgcatttcttttctttttttttttttttttttgagacagagtttcactcatcgcccaggctggagtgcaatggcgcagtctcagctcactgcaacctccgcctcccggtttcaaacgattctcctgcctcagcctcccgagtagctgggattacaggtgcccac

SEQ ID NO: 85049 - DNA, 601 bp, Human
gtcccaaggtcaccccatggcctctcccatgactgcctctgatgacttccccatccttcagatgatcagcaccaggaaactagggcagtgtacaacgcctctttactttacggtccttggaaccctgctctgtgcttggggtaggggtgggatgttctgaacggaaatcccattgtggaagcactacagagattcactaattaacaacttacactgaatctcttaataacactaggtagcattcatggtgcatttcttttctttttttttttttttttttgagacagagtttcactcatcrcccaggctggagtgcaatggcgcagtctcagctcactgcaacctccgcctcccggtttcaaacgattctcctgcctcagcctcccgagtagctgggattacaggtgcccaccaccatgcctggctaattttttgtatttttaatagagacagggttttgccatgttggccaggctggtcttgaactcctgacctcaggtgatctgctggtcttggcctcccaaagtgctgggattacaggcgtgagccactgcacccaggcatgtgcagtggtgcattttttatgtgccaggcatgatgg

SEQ ID NO: 85050 - DNA, 601 bp, Human
agtgtacaacgcctctttactttacggtccttggaaccctgctctgtgcttggggtaggggtgggatgttctgaacggaaatcccattgtggaagcactacagagattcactaattaacaacttacactgaatctcttaataacactaggtagcattcatggtgcatttcttttctttttttttttttttttttgagacagagtttcactcatcgcccaggctggagtgcaatggcgcagtctcagctcactgcaacctccgcctcccggtttcaaacgattctcctgcctcagcctcccragtagctgggattacaggtgcccaccaccatgcctggctaattttttgtatttttaatagagacagggttttgccatgttggccaggctggtcttgaactcctgacctcaggtgatctgctggtcttggcctcccaaagtgctgggattacaggcgtgagccactgcacccaggcatgtgcagtggtgcattttttatgtgccaggcatgatggctcaccagtctacgtgtgttatgtttattaattctcaccatgaccctgcggggtatgtgtgattcttctctccattttgcagatga

SEQ ID NO: 85051 - DNA, 601 bp, Human
ttcatggtgcatttcttttctttttttttttttttttttgagacagagtttcactcatcgcccaggctggagtgcaatggcgcagtctcagctcactgcaacctccgcctcccggtttcaaacgattctcctgcctcagcctcccgagtagctgggattacaggtgcccaccaccatgcctggctaattttttgtatttttaatagagacagggttttgccatgttggccaggctggtcttgaactcctgacctcaggtgatctgctggtcttggcctcccaaagtgctgggattacaggygtgagccactgcacccaggcatgtgcagtggtgcattttttatgtgccaggcatgatggctcaccagtctacgtgtgttatgtttattaattctcaccatgaccctgcggggtatgtgtgattcttctctccattttgcagatgagaaaactgagatgtagctaaggaaagtaacttcctaaagcacagctatacatatacacagtggagtactattcagccataaaaaagaatgagatcctgtcgtttgcaacaacatggatggaactggaggtcattatgttaagtgaaataagccag

SEQ ID NO: 85052 - DNA, 601 bp, Human
tcatggtgcatttcttttctttttttttttttttttttgagacagagtttcactcatcgcccaggctggagtgcaatggcgcagtctcagctcactgcaacctccgcctcccggtttcaaacgattctcctgcctcagcctcccgagtagctgggattacaggtgcccaccaccatgcctggctaattttttgtatttttaatagagacagggttttgccatgttggccaggctggtcttgaactcctgacctcaggtgatctgctggtcttggcctcccaaagtgctgggattacaggcrtgagccactgcacccaggcatgtgcagtggtgcattttttatgtgccaggcatgatggctcaccagtctacgtgtgttatgtttattaattctcaccatgaccctgcggggtatgtgtgattcttctctccattttgcagatgagaaaactgagatgtagctaaggaaagtaacttcctaaagcacagctatacatatacacagtggagtactattcagccataaaaaagaatgagatcctgtcgtttgcaacaacatggatggaactggaggtcattatgttaagtgaaataagccagg

SEQ ID NO: 85053 - DNA, 601 bp, Human
tctttttttttttttttttttgagacagagtttcactcatcgcccaggctggagtgcaatggcgcagtctcagctcactgcaacctccgcctcccggtttcaaacgattctcctgcctcagcctcccgagtagctgggattacaggtgcccaccaccatgcctggctaattttttgtatttttaatagagacagggttttgccatgttggccaggctggtcttgaactcctgacctcaggtgatctgctggtcttggcctcccaaagtgctgggattacaggcgtgagccactgcacccaggcatgtgcagtggtgcattttttatgtgccaggcatgatggctcaccagtctacgtgtgttatgtttattaattctcaccatgaccctgcggggtatgtgtgattcttctctccattttgcagatgagaaaactgagatgtagctaaggaaagtaacttcctaaagcacagctatacatatacacagtggagtactattcagccataaaaaagaatgagatcctgtcgtttgcaacaacatggatggaactggaggtcattatgttaagtgaaataagccaggcacagaaagacaaactt

SEQ ID NO: 85054 - DNA, 601 bp, Human
ttttttttttttttttttgagacagagtttcactcatcgcccaggctggagtgcaatggcgcagtctcagctcactgcaacctccgcctcccggtttcaaacgattctcctgcctcagcctcccgagtagctgggattacaggtgcccaccaccatgcctggctaattttttgtatttttaatagagacagggttttgccatgttggccaggctggtcttgaactcctgacctcaggtgatctgctggtcttggcctcccaaagtgctgggattacaggcgtgagccactgcacccaggcmtgtgcagtggtgcattttttatgtgccaggcatgatggctcaccagtctacgtgtgttatgtttattaattctcaccatgaccctgcggggtatgtgtgattcttctctccattttgcagatgagaaaactgagatgtagctaaggaaagtaacttcctaaagcacagctatacatatacacagtggagtactattcagccataaaaaagaatgagatcctgtcgtttgcaacaacatggatggaactggaggtcattatgttaagtgaaataagccaggcacagaaagacaaacttcac

SEQ ID NO: 85055 - DNA, 601 bp, Human
ttttttttttttttttgagacagagtttcactcatcgcccaggctggagtgcaatggcgcagtctcagctcactgcaacctccgcctcccggtttcaaacgattctcctgcctcagcctcccgagtagctgggattacaggtgcccaccaccatgcctggctaattttttgtatttttaatagagacagggttttgccatgttggccaggctggtcttgaactcctgacctcaggtgatctgctggtcttggcctcccaaagtgctgggattacaggcgtgagccactgcacccaggcatgtgcagtggtgcattttttatgtgccaggcatgatggctcaccagtctacgtgtgttatgtttattaattctcaccatgaccctgcggggtatgtgtgattcttctctccattttgcagatgagaaaactgagatgtagctaaggaaagtaacttcctaaagcacagctatacatatacacagtggagtactattcagccataaaaaagaatgagatcctgtcgtttgcaacaacatggatggaactggaggtcattatgttaagtgaaataagccaggcacagaaagacaaacttcacat

SEQ ID NO: 85056 - DNA, 601 bp, Human
ttttttttttttttgagacagagtttcactcatcgcccaggctggagtgcaatggcgcagtctcagctcactgcaacctccgcctcccggtttcaaacgattctcctgcctcagcctcccgagtagctgggattacaggtgcccaccaccatgcctggctaattttttgtatttttaatagagacagggttttgccatgttggccaggctggtcttgaactcctgacctcaggtgatctgctggtcttggcctcccaaagtgctgggattacaggcgtgagccactgcacccaggcatgtgcagtggtgcattttttatgtgccaggcatgatggctcaccagtctacgtgtgttatgtttattaattctcaccatgaccctgcggggtatgtgtgattcttctctccattttgcagatgagaaaactgagatgtagctaaggaaagtaacttcctaaagcacagctatacatatacacagtggagtactattcagccataaaaaagaatgagatcctgtcgtttgcaacaacatggatggaactggaggtcattatgttaagtgaaataagccaggcacagaaagacaaacttcacatgt

SEQ ID NO: 85057 - DNA, 601 bp, Human
tttttttttttgagacagagtttcactcatcgcccaggctggagtgcaatggcgcagtctcagctcactgcaacctccgcctcccggtttcaaacgattctcctgcctcagcctcccgagtagctgggattacaggtgcccaccaccatgcctggctaattttttgtatttttaatagagacagggttttgccatgttggccaggctggtcttgaactcctgacctcaggtgatctgctggtcttggcctcccaaagtgctgggattacaggcgtgagccactgcacccaggcatgtgcagtggtgcattttttatgtgccaggcatgatggctcaccagtctacgtgtgttatgtttattaattctcaccatgaccctgcggggtatgtgtgattcttctctccattttgcagatgagaaaactgagatgtagctaaggaaagtaacttcctaaagcacagctatacatatacacagtggagtactattcagccataaaaaagaatgagatcctgtcgtttgcaacaacatggatggaactggaggtcattatgttaagtgaaataagccaggcacagaaagacaaacttcacatgttct

SEQ ID NO: 85058 - DNA, 601 bp, Human
aatggcgcagtctcagctcactgcaacctccgcctcccggtttcaaacgattctcctgcctcagcctcccgagtagctgggattacaggtgcccaccaccatgcctggctaattttttgtatttttaatagagacagggttttgccatgttggccaggctggtcttgaactcctgacctcaggtgatctgctggtcttggcctcccaaagtgctgggattacaggcgtgagccactgcacccaggcatgtgcagtggtgcattttttatgtgccaggcatgatggctcaccagtctacgtrtgttatgtttattaattctcaccatgaccctgcggggtatgtgtgattcttctctccattttgcagatgagaaaactgagatgtagctaaggaaagtaacttcctaaagcacagctatacatatacacagtggagtactattcagccataaaaaagaatgagatcctgtcgtttgcaacaacatggatggaactggaggtcattatgttaagtgaaataagccaggcacagaaagacaaacttcacatgttctcatttatttgtgagagctaaaaattaaggcaattgagctcatggaga

SEQ ID NO: 85059 - DNA, 601 bp, Human
ccactgcacccaggcatgtgcagtggtgcattttttatgtgccaggcatgatggctcaccagtctacgtgtgttatgtttattaattctcaccatgaccctgcggggtatgtgtgattcttctctccattttgcagatgagaaaactgagatgtagctaaggaaagtaacttcctaaagcacagctatacatatacacagtggagtactattcagccataaaaaagaatgagatcctgtcgtttgcaacaacatggatggaactggaggtcattatgttaagtgaaataagccaggcacaraaagacaaacttcacatgttctcatttatttgtgagagctaaaaattaaggcaattgagctcatggagatagagagtagaaggatggttaccagaggctggggcgggtagtgggaggtgaggggagaagtggggatggttaacgggttcaaaaaaggaataaggataaagaagatgtatttgtatttgataacacaatagggtgactatagtcaataataagttaattgtacctttaaaaataactaaaagaatataattggactgtttgtaacacaaagggtaaatgcttgaggtgatg

SEQ ID NO: 85060 - DNA, 601 bp, Human
atgttaagtgaaataagccaggcacagaaagacaaacttcacatgttctcatttatttgtgagagctaaaaattaaggcaattgagctcatggagatagagagtagaaggatggttaccagaggctggggcgggtagtgggaggtgaggggagaagtggggatggttaacgggttcaaaaaaggaataaggataaagaagatgtatttgtatttgataacacaatagggtgactatagtcaataataagttaattgtacctttaaaaataactaaaagaatataattggactgtttgtaayacaaagggtaaatgcttgaggtgatggataccccatttaccccgatgtgattattatacattatatgtctatatcaaagatcccctctatcctataaatatgcatgcctactatgtagccacaaaaactaaaacttaaaaaaaagatacagttcaaagtgactgtgctgggacttgaacccaagtctatctgctcaggttcgtttcctctgtgctacatgaagagaagggccagatggaatattggacacagtacacagatggcatcaactgtaccctactcccagcgcagggtattgag

SEQ ID NO: 85061 - DNA, 601 bp, Human
agaagatgtatttgtatttgataacacaatagggtgactatagtcaataataagttaattgtacctttaaaaataactaaaagaatataattggactgtttgtaacacaaagggtaaatgcttgaggtgatggataccccatttaccccgatgtgattattatacattatatgtctatatcaaagatcccctctatcctataaatatgcatgcctactatgtagccacaaaaactaaaacttaaaaaaaagatacagttcaaagtgactgtgctgggacttgaacccaagtctatctgctyaggttcgtttcctctgtgctacatgaagagaagggccagatggaatattggacacagtacacagatggcatcaactgtaccctactcccagcgcagggtattgagagaaggatcagaaatgaagaataaaacccagcgcctgctttcaaagaactcagtcctgaccagagattctgggtagggtgctggggctgtcactgtcccttttagagcgtttatttccctctctgtaaacgggcagctcatacgagacgctggcagagacccttccagctcagctatctcagagggtctccagca

SEQ ID NO: 85062 - DNA, 601 bp, Human
tggactgtttgtaacacaaagggtaaatgcttgaggtgatggataccccatttaccccgatgtgattattatacattatatgtctatatcaaagatcccctctatcctataaatatgcatgcctactatgtagccacaaaaactaaaacttaaaaaaaagatacagttcaaagtgactgtgctgggacttgaacccaagtctatctgctcaggttcgtttcctctgtgctacatgaagagaagggccagatggaatattggacacagtacacagatggcatcaactgtaccctactcccarcgcagggtattgagagaaggatcagaaatgaagaataaaacccagcgcctgctttcaaagaactcagtcctgaccagagattctgggtagggtgctggggctgtcactgtcccttttagagcgtttatttccctctctgtaaacgggcagctcatacgagacgctggcagagacccttccagctcagctatctcagagggtctccagcagaatgatacttacctgtggctggcgctgttctaagcatgttgcctgtgctagctcatttgaggtccagaaccacctaggaggtggctgtta

SEQ ID NO: 85063 - DNA, 601 bp, Human
ggactgtttgtaacacaaagggtaaatgcttgaggtgatggataccccatttaccccgatgtgattattatacattatatgtctatatcaaagatcccctctatcctataaatatgcatgcctactatgtagccacaaaaactaaaacttaaaaaaaagatacagttcaaagtgactgtgctgggacttgaacccaagtctatctgctcaggttcgtttcctctgtgctacatgaagagaagggccagatggaatattggacacagtacacagatggcatcaactgtaccctactcccagygcagggtattgagagaaggatcagaaatgaagaataaaacccagcgcctgctttcaaagaactcagtcctgaccagagattctgggtagggtgctggggctgtcactgtcccttttagagcgtttatttccctctctgtaaacgggcagctcatacgagacgctggcagagacccttccagctcagctatctcagagggtctccagcagaatgatacttacctgtggctggcgctgttctaagcatgttgcctgtgctagctcatttgaggtccagaaccacctaggaggtggctgttat

SEQ ID NO: 85064 - DNA, 601 bp, Human
aaaacttaaaaaaaagatacagttcaaagtgactgtgctgggacttgaacccaagtctatctgctcaggttcgtttcctctgtgctacatgaagagaagggccagatggaatattggacacagtacacagatggcatcaactgtaccctactcccagcgcagggtattgagagaaggatcagaaatgaagaataaaacccagcgcctgctttcaaagaactcagtcctgaccagagattctgggtagggtgctggggctgtcactgtcccttttagagcgtttatttccctctctgtaaaygggcagctcatacgagacgctggcagagacccttccagctcagctatctcagagggtctccagcagaatgatacttacctgtggctggcgctgttctaagcatgttgcctgtgctagctcatttgaggtccagaaccacctaggaggtggctgttattagccccattttatgaagaaactgggataacaaaaattttcccatcttaggagttagaggcagaattccatcccaggcagttgactccagcatccctgctgtcaaccatcctgttacacttagtgagaagggaggtgcctact

SEQ ID NO: 85065 - DNA, 601 bp, Human
tgtcactgtcccttttagagcgtttatttccctctctgtaaacgggcagctcatacgagacgctggcagagacccttccagctcagctatctcagagggtctccagcagaatgatacttacctgtggctggcgctgttctaagcatgttgcctgtgctagctcatttgaggtccagaaccacctaggaggtggctgttattagccccattttatgaagaaactgggataacaaaaattttcccatcttaggagttagaggcagaattccatcccaggcagttgactccagcatccctgctstcaaccatcctgttacacttagtgagaagggaggtgcctactgggaaggaggtgaacctagggacataggacaatgaaggaagaagagatgacagaattggcaacaaaggcatgccctctcctccaggaagtcctcctggattctgagaggcaaagttggaagcccctcctctgagctccttacccaaccttgcatgtcaccccatctgagcttattgcactgaaaagcagctgctctttgactcgtgcccaggcaaagggcagtttgagggctaggagtgggtcctgtccatctctcta

SEQ ID NO: 85066 - DNA, 601 bp, Human
gggactacaggcgcccaccaccatgcccggctaatttttttgtatttttagtagagacagggtttcaccttattagccaggatggtctcaatctcctgacctcgtgatccgcccgcctcggcctcccaaagtgctgggattacaggtgtgagccgctgcgcccggccagactgattttaagtttgaacctcagctccaacacagactagctgtgtggacttgggcaagcaacttgacctctgtgagccttggtttccccttctgtaaaatgggaataggagaatacgtctcatgggtctaygtatggattgatacgtgaagtgccagcacaggaaggggagacaaaaatgttgggttattatcccactaatgtttgataaatccgtgtgtgtgtgtgtgtgtgtgtgtgtgtgtgtgtgtgtgtttcctatttcaaggaggcccagggtgtgtaagcaaagtagggcctcagtctccagagaaagaacccggcttgcacatctgggtctgaagtgcaggtctcattcaggtgggttgcagatgcgtggcttcctcctggggggcttcctggaggaggtggtcaagcagggcaccagcatcc

SEQ ID NO: 85067 - DNA, 601 bp, Human
gtgtcttggccccgtcctgccatctcagtggtgccccttcccttctttctttactttcacttacaaaggctcttcttttttttatgaccatttcttactttcatgtaagcaggctattgagagcaaaaagatgcaatcctgcccttgaaattcttggccctgacacagagcagccaggtgggatccccaaggcagcccctgtgcacctgtttagaactgagcttctcaaatggtaccagggatctcccaggaatgttactaaaatgctggtctgggtgaggcctgagattctgcacttctaaaaatccccctgggaatgcccaagctggtggagcatggaccaggctttgagcagcgaggatttggaggagaggacactgggctgacctgctttggagggaaaggaacggattctgcagggactttgggaccatgcatagtcacagtctttgagtttttaaagtgagagagtgacatgagtacaaatgtgcgtgtgagtgcgtgcatgagtgtgtgcgtgtgagtgcatgagtgtgtgcgtatgagtgagtgaatgagtgtgtgtgggtgtgtgcatgagtgtgtgcgtatgagtgagtga

SEQ ID NO: 85068 - DNA, 601 bp, Human
gattatgttggtctccaacctatgacaaaaaaaaaatttacaaaggggcttaaataatttgctgggacctcattttcttgcctctctctggaaagatccattttcagagatggaataaaggtcagggtctcctttgaggacctgagaaagctccctatgagggattccccccactctggggtgaacagccctaggccaggctgggctgagaggggtcagagccctcaggtcctcctgggaaggaggcctcacttgagcccagttctcccagtggcttgaagtataagattcccttctagcsctggaaagggataggcagagggaagaaggtgagtgggtgagagaggataggggatcagggggccttgggagaggaaaggaaagtctgggtcccaggagagaaggtgagccttgtaggggaagaagggttccctccccctacctcaccggaacttgctctcattctgtcaccccagaagccctgtcccagcacacaccaggaataccactacttgatattggcctcatgggctgggcgcagtggctcacaactgcaatcccagcactttgggaggctgaggcgggcggatctcttgaggcc

SEQ ID NO: 85069 - DNA, 601 bp, Human
attatgttggtctccaacctatgacaaaaaaaaaatttacaaaggggcttaaataatttgctgggacctcattttcttgcctctctctggaaagatccattttcagagatggaataaaggtcagggtctcctttgaggacctgagaaagctccctatgagggattccccccactctggggtgaacagccctaggccaggctgggctgagaggggtcagagccctcaggtcctcctgggaaggaggcctcacttgagcccagttctcccagtggcttgaagtataagattcccttctagcgytggaaagggataggcagagggaagaaggtgagtgggtgagagaggataggggatcagggggccttgggagaggaaaggaaagtctgggtcccaggagagaaggtgagccttgtaggggaagaagggttccctccccctacctcaccggaacttgctctcattctgtcaccccagaagccctgtcccagcacacaccaggaataccactacttgatattggcctcatgggctgggcgcagtggctcacaactgcaatcccagcactttgggaggctgaggcgggcggatctcttgaggcca

SEQ ID NO: 85070 - DNA, 601 bp, Human
cagggggccttgggagaggaaaggaaagtctgggtcccaggagagaaggtgagccttgtaggggaagaagggttccctccccctacctcaccggaacttgctctcattctgtcaccccagaagccctgtcccagcacacaccaggaataccactacttgatattggcctcatgggctgggcgcagtggctcacaactgcaatcccagcactttgggaggctgaggcgggcggatctcttgaggccaggagttggagaccagcctggccaacatgtgaaactccatctctactaaaaatacaaaaaaaaaaaaattatctgggcatggtggcgtgcatctgtaatcccagctactcaggaggctgaggcaggggaatcgcttgaacccgggaggcggaggttgcacggagcccagatcgcgccactgcactccagcctgggcgacagagtgagactccatctcaaaaaaaaaattaaattttaaaaaagatagctacctcataaagcctcctcttaaatgactggcaggctggagttctggaggccaaggaaagagtcaaagagccccctccagcaccactgtgacttggtaagataaattg

SEQ ID NO: 85071 - DNA, 601 bp, Human
ggaggctgaggcaggggaatcgcttgaacccgggaggcggaggttgcacggagcccagatcgcgccactgcactccagcctgggcgacagagtgagactccatctcaaaaaaaaaattaaattttaaaaaagatagctacctcataaagcctcctcttaaatgactggcaggctggagttctggaggccaaggaaagagtcaaagagccccctccagcaccactgtgacttggtaagataaattgaaccagtgttgagggtcccagcctctgcaaagctgcacagaagggcccagagagcrcagaataacagcctagcagcaaagaacagagatggctccagagttaggccattcaaatcctggtcccatcactcactagcctggtcatcttgtgtgagtgccccaagcccaccaagccttggtttcttcatctgtaaaatgggatttacagtcttgcttcatacccttaggcagcgtttgtaaaagcacctggcaagtggttgacgctcacaaaacaaaacagactgggtagattaacagagtccccatcaaggtctggttttcagcccagctgacatttattgagcacctactgtgtgc

SEQ ID NO: 85072 - DNA, 601 bp, Human
cccagatcgcgccactgcactccagcctgggcgacagagtgagactccatctcaaaaaaaaaattaaattttaaaaaagatagctacctcataaagcctcctcttaaatgactggcaggctggagttctggaggccaaggaaagagtcaaagagccccctccagcaccactgtgacttggtaagataaattgaaccagtgttgagggtcccagcctctgcaaagctgcacagaagggcccagagagcgcagaataacagcctagcagcaaagaacagagatggctccagagttaggccatwcaaatcctggtcccatcactcactagcctggtcatcttgtgtgagtgccccaagcccaccaagccttggtttcttcatctgtaaaatgggatttacagtcttgcttcatacccttaggcagcgtttgtaaaagcacctggcaagtggttgacgctcacaaaacaaaacagactgggtagattaacagagtccccatcaaggtctggttttcagcccagctgacatttattgagcacctactgtgtgccaagcactgaggaacagtggctggtgtgcacctgtctaggggttgtctagaat

SEQ ID NO: 85073 - DNA, 601 bp, Human
tccggcggcgccctccaaccacatgaacccggtcagcaacggcctgtctcctcaggtaggtggtctcagcccagcacccaggatcccaccgccacgaaagtcagacatctgcagacagcacgtgggtggaagccttgcgctctttcctgtagcaggctgactgcggttggggtttttgttctagaatcaggaatcctccctggactctgtcctgtgctcttggcttttcaccaggagtgaccaattcctgaaaggcaggaccatgtcctattggtggagagaattgtggatggggttctgrgccggtaactctaccctgattggtcaatggaattctgtttgctcctgtgtgattggttaagtcattcattgcctcggggtgctgttagaagtcacaggacctgctttggatgaagtcagagagataatgtgggcgctgatggtggttattggtgagtttggggaacaggacttgataatgccggaagtcccaatgaacttgaggaactgatgggctcatttttttgtagcttcagcaggctcccaaatatccgtgggggaagggatgaagtgccccctgccacatgtctgtggtgagaat

SEQ ID NO: 85074 - DNA, 601 bp, Human
agtcattcattgcctcggggtgctgttagaagtcacaggacctgctttggatgaagtcagagagataatgtgggcgctgatggtggttattggtgagtttggggaacaggacttgataatgccggaagtcccaatgaacttgaggaactgatgggctcatttttttgtagcttcagcaggctcccaaatatccgtgggggaagggatgaagtgccccctgccacatgtctgtggtgagaatccactgcacatgatccaaactgatctgaagagccatagtgtggcagaacagtgaagcctrtggaatgggtctaaatcccagctctactgctcaggggtctctgaggcaagtcagcatctgtgagcctcagtttatcccctattaaacaaagagagtctgtaactaacgtctcaacaagaggtgcttgccacattcaatatgctaacaggtcagagcacctagcccagagcctggcacgaaatcagtgccaagtaaatattagttctctggccctcccagtgtcaggacaatgtaattaatatgggaaacccattacctaaaaggagaatagaaagaattcaaagaaggccagcaagctac

SEQ ID NO: 85075 - DNA, 601 bp, Human
tgaggtcaagagttcgagaccagcctggccagtacggtgaaactttgtctctacagcaatacaaaaattagccaggcatgatggcaggtgcctgtaatttcagctacttgggaggctgaggcgagagaatcgcttgaacctgggagacagaggttgcagtgagccaagattgcaccattgcactccagcctgggtgacagagtgagactccatctcaaaaagataaataaataaataaaaagagagaccatgtggtccacaaagcctaaaatatttactatcaggcccttacagtaaattaaaaaaaaaaacaaacctttgtctgaaacattcccaagaatgttaattttctgcttgtctggattcatttctgtttgcctccattaatttgtgtagttgagggttaattgcctttcagctgcatcgtttatttatgggaaaacccttgagtaagtcccttcccctttctatgcctcaattttctcatctatgaaatggagataagcccagtacttgcctcccaaggttgctggggattgaatgagatgatctgtggaaggcagtcagctcaggtctggcacagagtgagtgcccagtacct

SEQ ID NO: 85076 - DNA, 601 bp, Human
tctggattcatttctgtttgcctccattaatttgtgtagttgagggttaattgcctttcagctgcatcgtttatttatgggaaaacccttgagtaagtcccttcccctttctatgcctcaattttctcatctatgaaatggagataagcccagtacttgcctcccaaggttgctggggattgaatgagatgatctgtggaaggcagtcagctcaggtctggcacagagtgagtgcccagtacctgtaggcagctgcctgcggagctcctaatggtgacgtatcaagccctctcagggtccrcagtatgaagggtgatgccacttacttggctgaccttgtcagcccctgcactagtcctcaccaggccaccccactctcttgctgggatcccaggtgagctaaaccctgcacatggaatacagcctgtcggccagaatgtcttccctggggaccccagttggcttctttgaggttcaaggtcatggcctccatctcactagtgctaaccttccagagcccttgagatgagtcacaacaggatccctgaactggctgggggaggacactgccgagatccaagctttccacacccaagaatag

SEQ ID NO: 85077 - DNA, 601 bp, Human
tacacattggccaggccagggttgacaatccggcgcacctgactccatgaccactgcttttcctagcccgccctgtctcactgtgggctgaggtttatccccaacacaggactctgtcacaggacaaaagagagacttagcaaagaaggggccccaggcctccagagtgtgggtcggggatgggaaaccaacccactggtgtgagcagtggatcaaggggaagtatctcccccatggcaaggagacttcagggttggatgacgtgttttccatcctctcctggaagttcctaagttggacscccagccctccacccagcccagaattttactgaagctaaaagcgagaggcctccagcccattcctcagggctgggaggctgacatgatgaatcggagaagctcagaggctcccatcaaaggtgtgaagacagatggagggtctgaccggggcagaggggaccaggaggtgaacagctgctggaggagggcgggtgcaggggcagcagggcaggccgtgtgtgcttctgtgcatgtaaaccgcagaggttaacctgcgagcacttcctgaaggacgggtgcagcgagcagggcgggagttt

SEQ ID NO: 85078 - DNA, 601 bp, Human
taggcacactgtccctttccccaggatggcaggtccctgacacattgcccagatagatgtggacctcaaaactggaaggaatttttttcttttcttttctctctctctctctttttttttttttttttttgagacagagtctaagtctgttgcccaggctggagtgcagtggcgcgatcttggctgattgcaacctccgcctcctgggttcaagcaattctcctgtcttcgcctccaattctcctgtcttcgcctcctgagcagctgggattacaggcccctgccgccactcccaactaattttgtatatttagtagagacagggttttgccatgttggccagactggtcttgaactcctgacctcaggtgatccacccaccttggcctcccaaagtgctggtattacaggcgtgagccactgcgtctggccggaatttttgttcttacagaagccaaaggggcttacactggaggatgaatttgtggctctaccgagaacctggacagacccgggttaagctagctgtgcatcacgctggccagcttgctactaccgtggggaagacatgcctcctccagtggcttgacccaagtccctt

SEQ ID NO: 85079 - DNA, 601 bp, Human
actatgtgccaggcactgttctaggcacttgggataaatcagtgaacatgagaggaagacccttatattgtcctagtggaggtgacagtacaacagggtcagacagacaaaaaatataattttaaaaggcatacagtatgtttaataccagtgttgacaaggacagctgaattttctggagcccttctgactttcagatcctgctctgggtgttttacttatattaatccacttaaagggtagagccaggattcaaacccatgtctttagagcctgaaatcttttccttttctttcctttwctttttttcttttttttttttttttttttttgagatagggtttcactctgttacccaggctggagtgcagtggcgcgatctcagctcattgcaacctctgcctcctcccaggttcaagcaattttcctgcctcagcctccagagtagctgggactacaggcatgcgccaccatgcccagctaatttttttgtatttttagtagaggcggaatttcaccatgttggccaggctggtcttgaactcctgacctcaagtgatccacccacctcagcctcccaaagtgttaggattacaggcgt

SEQ ID NO: 85080 - DNA, 601 bp, Human
gcgcctggcctagagcctgaatcttagttacttgttctgtcttcctgcctctcagaaatgccctcacttgcactctttttagagattggctggtgcaagaagaaaccatctagggaagccaccccccatctatggaagccacccccttcagtttggtggaggaaatagctcattcgactcatgtggtggatgagaaaactgaggccaatgactcaggttagggaccaataggcagagctgagttatatgggcaaatgcttttcaggaggtttagatacccttgaggcttggttccctgatygtctcccctacccacccaagccccagcctaataggattagggattaggcactcagcacatgcatgtccctggctttgtgcactgggtccttctgaagagatgtagggaaaaggaatcctgctcatgagacctcattcctgataacgttcatctggggttaggatcatagactacccgcaacccccagcccactctctcccctctgctccgggctgagggccagttacttggacaacgactgtaagaaaacaacttagaggtggggtgccgtggctcacatctgtagtcccagcactttgg

SEQ ID NO: 85081 - DNA, 601 bp, Human
ggcaggctgagatcccaagcaaagaaccaggagaaaagttctgccagtttcgagggtcccttgggttgaaggctgcaggcagggtgccttgtgctggaggcttcctcagggcccaggtggtgtgtgccaggtggggctgggaggtgtggttagctggaacttcctcatctcccaacctttttaagatgccaactatatcagagtaggaagtggaaactgaggcccagagagggcccaatctcccccgagattttctgaaaatcacacggttgggttagcggcatccttggctggggtctgsagggctcctgccacgacctcgtggaaggggcgtctgtctccccagcaccgctcctggtgctcttttgtaatgtcccatactcatcgtctcctttgttcctttctggagcttaaaacgaaggaagccataaagggatttacatatttacaatttccccacacaccgacctaatgaagaatattctctaagtgtgcagttaaccacacaaccacgatcacggccaaccagcctttctgtcctttcctgcttcttgatacccttctctccggtccagcctgtgcctttagtaattacggcgac

SEQ ID NO: 85082 - DNA, 601 bp, Human
aggctttacctttatttatttgtgaatggggtctcctgggtgcgtcttaacagcacatgcccagtactgccctcctggcattgtctgaggcctctgggcagccagttcagcaagaaaagacattccatcaatggcacacctactggacgccagatcccatgtaagcactttgcctatctgaagtcattccagccccacagcaaccctactcttggggaaataggctcagagaggtcaagtcacttgctgaaggtcacagagcaggtgagtgatggagatggggttctaattcaggtctgcyggacccaggaacctcaccaccacttgactctcagcaagacacgaccaagacagtcctcttgccctagggaactgagcagtgccactcacacagtggacactggagattcctacctctctctcctatcacttcctcttcatgcccccaccccttcattggcgacactgcgtttataataggcatttaaaatgagtcttgctggaccagggacgaggaaggaggagggagcgagagatttgtaggcaggaagatggggagggggattgtggggtgttaaatagcccagaatttaaaaaaaaa

SEQ ID NO: 85083 - DNA, 601 bp, Human
agcagattggggacatcctggcattaccagggcgtcaggaggaggtgtggaggattgcctgccccgctgaaaggagacccttctctcgcacattttccgaggttgggttttggagggatcagaattcatttctccggcttagcaggttgtaggaacatggggctttaaccccagctgcgcgctcctctgcgccccgcccagcccttccttctcctcccttcctgggcgagtctcctgctgcccgcttcctccctttgccttctcagggtctctttcaggcctccgctttctcgggaggcckctccctcaggccccatgggtagaaggaagcctggagcgagagaaactgtgccacctgtgccaacaagcagccgtgagttggagctctggttctgccatttactaaattgctgtgtggccctggcacagcttgcttaacctctctgggcttccttttcctcatcggaaaacaggggtaatcattgctacctctcaggggttgctgtgagaactaagggaaaattcaaattaggtgcctggtgcaagtaggagctcactaaatgtgccctcgtcacacccccctcacctgtgccctggcctc

SEQ ID NO: 85084 - DNA, 601 bp, Human
cctgggcagagcctcttctcctgtgaaaatagactcgtgtttatgtctctgcctttcctacccctttttcctgggtggagggaaatgagggggcaggggagaaggaggaaacccctcccggaaagaaaggctaaaccaggattaggaactttccagactgctgctgaggggagtggagcatgcctatgagtaggctctgctaggaactgggaggcctggcggattgcctggctttcagggtgacattagagcccttggatcattgaaggagaagtgggagagcaaccctgaccttgcctcytttcttagagaactgggtagaattctgggaagatatcgggtcttcagcccacctatctgagtccgaacaagaggtgggtggagggtggccttcaaggaccactctggggccgggtgtggtggctcacgcctgtaatcccagcactttgggaggctgaggcgggcggatcgcttgaggtcaggagactgagaccagcctgggcaacatggtgaaaccccccctctactaaaaatacaaaaattaactgggcgtggtggtgcatgcctgtaatcccagctacttgggaggctgaggggggag

SEQ ID NO: 85085 - DNA, 601 bp, Human
ggtagaattctgggaagatatcgggtcttcagcccacctatctgagtccgaacaagaggtgggtggagggtggccttcaaggaccactctggggccgggtgtggtggctcacgcctgtaatcccagcactttgggaggctgaggcgggcggatcgcttgaggtcaggagactgagaccagcctgggcaacatggtgaaaccccccctctactaaaaatacaaaaattaactgggcgtggtggtgcatgcctgtaatcccagctacttgggaggctgaggggggaggatcgtttgaatccargaggcggaggttgcaatgagctgagataacgctactgccttcaagccggggcaacagatcaagactccatctcaagaaaaaaaaggggaggggcactctgggcctcttttatgcccaccagcaaaacatcttccatccaaactccacacctccagagggtgtgggcaggagctgacctctgcccctttacacagatggagtagaggcctggtataaacaagtggggaaggggaaagtagcctgcttggaagctctagatgtttccacacaccactgttgtcagggaccatggtcttcagt

SEQ ID NO: 85086 - DNA, 601 bp, Human
gatttctagtcagacaggaagaccagaggaagtctagaggagggagggcatagtcagagaaggcttcctggaagaggagttccagagggaagactggatttgcacagggataaaggaaggggtaggaggttggtgccgaccagacagcagcaaatgacatggcagatgtgaaaacagtcactaatttaggcacatcgtggacacagtggaatgaacatacagaccagggctcaaatgctcacgtgctcagccgggcacagtggctcatgcctgtaatcccagcactttgggaggccaaggmgggtggatcacttgaggccgggagttcgagactaacctggccagcatggtgaaaccccgtctctactaaaaatacaaaaattagccgggcatggtggtgcgtgcctgtagtcccagctactcggctgaggcaggagaattgcttggaccccggaggcgggggctgcagtgagccgagatctagtcactgcacttcagcctgggtgacagaatgaggctccgtctcaaataaataaataaataaataaataaataaataaataaatatacaaaaacaaattctagctcctctacttatttg

SEQ ID NO: 85087 - DNA, 601 bp, Human
cagcagcaaatgacatggcagatgtgaaaacagtcactaatttaggcacatcgtggacacagtggaatgaacatacagaccagggctcaaatgctcacgtgctcagccgggcacagtggctcatgcctgtaatcccagcactttgggaggccaaggcgggtggatcacttgaggccgggagttcgagactaacctggccagcatggtgaaaccccgtctctactaaaaatacaaaaattagccgggcatggtggtgcgtgcctgtagtcccagctactcggctgaggcaggagaattgctwggaccccggaggcgggggctgcagtgagccgagatctagtcactgcacttcagcctgggtgacagaatgaggctccgtctcaaataaataaataaataaataaataaataaataaataaatatacaaaaacaaattctagctcctctacttatttgctgtgtgatcacaggcaagttatatgagcgctcagagcctcattttactcatctgtgaaatggggcctctgccactcaccttgcaggcttatgagaattaaatgcgattgttcatgtgaaacccttagttccacacccggcatc

SEQ ID NO: 85088 - DNA, 601 bp, Human
ctagcaggcccgggtttagccttccagagctgcatggcttggtgggaaagaatgcaaatagtggatctgtccttctttctgattagcacagggactggggacgagacagtacagcagacagaaggaaagaaaatgagggagattaggaattaatacagcaggcagacttagagtttctcaggcctgtccctggggtcccctgcaggaggaaggccgctgggatggttgggcaatcgggcctgggaggccaggcaagatcgcaggtaggagagacggggggtgactttgagggtccccaaargagacttgtgctctcctctgcctccaagcctttgtacctgctgctcccttggccgggaacaccttctccaccaccccattgtcatctcaagcccacccgtacttcttttttaagacttggctcccttccatgaagctttccttcaggacaccccccacacggtgggttagctgtgctttccctgtgcagttaccacattttatcagtacattaaatgtatatattgatataagtaatacagtatgtctgtattgctacacaaatattattaaatagtaataagtaaaatgttttagcatt

SEQ ID NO: 85089 - DNA, 601 bp, Human
catcagagacctgggtcgggtcccccaggacattgttggaggcctttggaaggatgggcctgggtgcgccctaattcctgcgcacctcggccttgtcactcccccactctgtggctctgtcgccttctgagtgataagggcctgcactttcttgagagggtggacagcctcccccacccctcagcccagccaggcctgcctttcactttctcctccagccattcgtgcctccctgtcccctgccacagcccagaactttctcttgggctcagttgatgggaaatccacgtctgtttgttgttttttgtttgtttttttttcacacactctctgcttcctatttctttcctttccccacttcctcttttcgcccttcgcgccccatttcccttcgccccctgtgccaccacccccttgctcaccgtctccctgatcgcgtcataaccctgagaatacctccagcctgggtcctctctccacccactccattctctcaaaccctcatttccctctttgcctgcctcctcccatagctggcctcgcctctacccattctcttccccctaatctctctcattctcctctcctctctcattccgca

SEQ ID NO: 85090 - DNA, 601 bp, Human
ctgggtcgggtcccccaggacattgttggaggcctttggaaggatgggcctgggtgcgccctaattcctgcgcacctcggccttgtcactcccccactctgtggctctgtcgccttctgagtgataagggcctgcactttcttgagagggtggacagcctcccccacccctcagcccagccaggcctgcctttcactttctcctccagccattcgtgcctccctgtcccctgccacagcccagaactttctcttgggctcagttgatgggaaatccacgtctgtttgttgttttttgtttktttttttttcacacactctctgcttcctatttctttcctttccccacttcctcttttcgcccttcgcgccccatttcccttcgccccctgtgccaccacccccttgctcaccgtctccctgatcgcgtcataaccctgagaatacctccagcctgggtcctctctccacccactccattctctcaaaccctcatttccctctttgcctgcctcctcccatagctggcctcgcctctacccattctcttccccctaatctctctcattctcctctcctctctcattccgcacccaacaaac

SEQ ID NO: 85091 - DNA, 601 bp, Human
tgggtcgggtcccccaggacattgttggaggcctttggaaggatgggcctgggtgcgccctaattcctgcgcacctcggccttgtcactcccccactctgtggctctgtcgccttctgagtgataagggcctgcactttcttgagagggtggacagcctcccccacccctcagcccagccaggcctgcctttcactttctcctccagccattcgtgcctccctgtcccctgccacagcccagaactttctcttgggctcagttgatgggaaatccacgtctgtttgttgttttttgtttgtttttttttcacacactctctgcttcctatttctttcctttccccacttcctcttttcgcccttcgcgccccatttcccttcgccccctgtgccaccacccccttgctcaccgtctccctgatcgcgtcataaccctgagaatacctccagcctgggtcctctctccacccactccattctctcaaaccctcatttccctctttgcctgcctcctcccatagctggcctcgcctctacccattctcttccccctaatctctctcattctcctctcctctctcattccgcacccaacaaaca

SEQ ID NO: 85092 - DNA, 601 bp, Human
gggtcgggtcccccaggacattgttggaggcctttggaaggatgggcctgggtgcgccctaattcctgcgcacctcggccttgtcactcccccactctgtggctctgtcgccttctgagtgataagggcctgcactttcttgagagggtggacagcctcccccacccctcagcccagccaggcctgcctttcactttctcctccagccattcgtgcctccctgtcccctgccacagcccagaactttctcttgggctcagttgatgggaaatccacgtctgtttgttgttttttgtttgtgtttttttcacacactctctgcttcctatttctttcctttccccacttcctcttttcgcccttcgcgccccatttcccttcgccccctgtgccaccacccccttgctcaccgtctccctgatcgcgtcataaccctgagaatacctccagcctgggtcctctctccacccactccattctctcaaaccctcatttccctctttgcctgcctcctcccatagctggcctcgcctctacccattctcttccccctaatctctctcattctcctctcctctctcattccgcacccaacaaacac

SEQ ID NO: 85093 - DNA, 601 bp, Human
tcgggtcccccaggacattgttggaggcctttggaaggatgggcctgggtgcgccctaattcctgcgcacctcggccttgtcactcccccactctgtggctctgtcgccttctgagtgataagggcctgcactttcttgagagggtggacagcctcccccacccctcagcccagccaggcctgcctttcactttctcctccagccattcgtgcctccctgtcccctgccacagcccagaactttctcttgggctcagttgatgggaaatccacgtctgtttgttgttttttgtttgttttgttttcacacactctctgcttcctatttctttcctttccccacttcctcttttcgcccttcgcgccccatttcccttcgccccctgtgccaccacccccttgctcaccgtctccctgatcgcgtcataaccctgagaatacctccagcctgggtcctctctccacccactccattctctcaaaccctcatttccctctttgcctgcctcctcccatagctggcctcgcctctacccattctcttccccctaatctctctcattctcctctcctctctcattccgcacccaacaaacacctc

SEQ ID NO: 85094 - DNA, 601 bp, Human
cctaattcctgcgcacctcggccttgtcactcccccactctgtggctctgtcgccttctgagtgataagggcctgcactttcttgagagggtggacagcctcccccacccctcagcccagccaggcctgcctttcactttctcctccagccattcgtgcctccctgtcccctgccacagcccagaactttctcttgggctcagttgatgggaaatccacgtctgtttgttgttttttgtttgtttttttttcacacactctctgcttcctatttctttcctttccccacttcctcttttckcccttcgcgccccatttcccttcgccccctgtgccaccacccccttgctcaccgtctccctgatcgcgtcataaccctgagaatacctccagcctgggtcctctctccacccactccattctctcaaaccctcatttccctctttgcctgcctcctcccatagctggcctcgcctctacccattctcttccccctaatctctctcattctcctctcctctctcattccgcacccaacaaacacctcttccccctccatcttcagcccctgcgcgccccccttgcccttgccctctccccc

SEQ ID NO: 85095 - DNA, 601 bp, Human
cgctgcccgggcctgggatcccgagcagccgcgcgcctggccgccccccggactgcggagccgccgctcgctcgtccagtcttggtcgcggggcctcggccgtctcgggacggggcaggcggcgaagggacgggcagccggtaagcaagacccttgctgcctgctggagagagaggctccctcgggagcgccccgttccccacccgttcattagttcattagggccttctccaccaatgcacttgcccttccctccacctagaaccttcttgcccctcctctcctcgcttagccagctctsctcatctctctggtctcagctcagaggttgtttgctccagaagtttgccctgacctggctgtggtggccaggccccctcccatgccccttgtattcccctgggtagcagctttgcctctggtttctaactttttggataccgctctctccctctaatgcaaggaccctaggctcttggcgtgtgtccccagcacaaagcctggcacgaagtaggtgcccaataaacagctgcaaacatgccctgggctctcctgagggtctattttgtgccccattctgtgcacagaggatgccaggtgg

SEQ ID NO: 85096 - DNA, 601 bp, Human
cttgcccctcctctcctcgcttagccagctctgctcatctctctggtctcagctcagaggttgtttgctccagaagtttgccctgacctggctgtggtggccaggccccctcccatgccccttgtattcccctgggtagcagctttgcctctggtttctaactttttggataccgctctctccctctaatgcaaggaccctaggctcttggcgtgtgtccccagcacaaagcctggcacgaagtaggtgcccaataaacagctgcaaacatgccctgggctctcctgagggtctattttgygccccattctgtgcacagaggatgccaggtgggctaaacctggcctctgccctcaagaaccttccagttagtccacccacagacaagcaagtgacaaaccatgagccagaagcctccagagaggagggaggcctagggagggtctgcagccccctcttagggggagaaataccgtcttgacggccagctggcctgactcgctggatagaccacctagagccccgactctgctgtctgaccaccctccttaacaagctatggttcaacaatgtgtagattccagagggacaggagatgaga

SEQ ID NO: 85097 - DNA, 601 bp, Human
cagagccctgggaaatcttttcaagcatccacaaaagaggtaacccgtgtgggcgaatgagtgctggatgaggagacaggagacctgggtggggcttttgagggagatccgcccctgccctgttcctgtccctccatcctgctgcgtgagggctggggctttggggaataggagacagtgtgcgctctcggaacccagcccctaggccctgaggactgccagtggaactggcctgaggccaaatgaatgtgaccctctcaccagaccaggggtctctgaccagcggcatcgaaggattaargtcccgtgagggccctggcaagtgtcttatcacaaaggggacatgtccaggctgaaattgagacatactgcccaggggcagaagttccggagcctccccggcaaggggctcccttcccttcttgggcatagataatgacctctgccggccctggaactccatagcatccttccctgagccccctggactgtggctccaaccccaaccaacttcattctccttgtctaggtctctggggtgaaacagctgtcccaactggggtcatattctgcttttacccccaaagaagtgaagttggta

SEQ ID NO: 85098 - DNA, 601 bp, Human
tgagggctggggctttggggaataggagacagtgtgcgctctcggaacccagcccctaggccctgaggactgccagtggaactggcctgaggccaaatgaatgtgaccctctcaccagaccaggggtctctgaccagcggcatcgaaggattaaagtcccgtgagggccctggcaagtgtcttatcacaaaggggacatgtccaggctgaaattgagacatactgcccaggggcagaagttccggagcctccccggcaaggggctcccttcccttcttgggcatagataatgacctctgcyggccctggaactccatagcatccttccctgagccccctggactgtggctccaaccccaaccaacttcattctccttgtctaggtctctggggtgaaacagctgtcccaactggggtcatattctgcttttacccccaaagaagtgaagttggtatcccagcatggttactgatcatagtagcagtcatgccacaccacattggtttggcagttggcaaaggcacctctactcctattagtatttggccctccctgagccctaagggcttggaatcattgtacccattttgcagactcaga

SEQ ID NO: 85099 - DNA, 601 bp, Human
agagctggagggaggaaggtgcagagagagggcttgagggctcggaggagagggacacagacagctctgccatcagaggaacccgaatttgaattccaggcccaccacctgctcccccatgttggtccacgggagcagcagcagcaggcaggtccctttctctcccagcctagtgacctgccagagccagcttctctccacactccctccagcctcttctcccactcccagtccaggtgtctgtggcgaggaccttttcccatgcacagggggctgcccgggcctgaaccccagatgcccyggcctcccagtgcagcggtggtgggtcccagagccctcagagcccagggtgagaagtcctgcccttttgccaagtgttttcctttagttccagatgccaccctgacaggtgctaccctgtgattaatgtccccacccccaaggcctgggaccagcccctcctccccaagccagaggtggcggtgggtgtgcagcgcagggactgagcttcccgaatcccttcctggttcctccctctccctcgaccccctccagccaccaggagcagagagcagacccctcctcaaagacactctcagat

SEQ ID NO: 85100 - DNA, 601 bp, Human
tcagaggaacccgaatttgaattccaggcccaccacctgctcccccatgttggtccacgggagcagcagcagcaggcaggtccctttctctcccagcctagtgacctgccagagccagcttctctccacactccctccagcctcttctcccactcccagtccaggtgtctgtggcgaggaccttttcccatgcacagggggctgcccgggcctgaaccccagatgccctggcctcccagtgcagcggtggtgggtcccagagccctcagagcccagggtgagaagtcctgcccttttgccragtgttttcctttagttccagatgccaccctgacaggtgctaccctgtgattaatgtccccacccccaaggcctgggaccagcccctcctccccaagccagaggtggcggtgggtgtgcagcgcagggactgagcttcccgaatcccttcctggttcctccctctccctcgaccccctccagccaccaggagcagagagcagacccctcctcaaagacactctcagataagccacatggccgtgactgagtttccctttaagcctcagtttccctggctctctgaaggtggcaatagtcc

SEQ ID NO: 85101 - DNA, 601 bp, Human
aaggtgtgggacgcggggggctgctccggagaagatatttgttttgtaaagaatggagcctgcgttccctgccctgtgtgggtgaggcggcagggcgtcgacatagctggaagggctgtctctgttccttctcccagggccccagaagccctaactcgtgggaactttctacagtgccagcagggagcaggagggaggctggatctctggagaaagagctcctgggtccatctcgtgaggggagagtgaaactccaaatcagacctgggtaaataggtataccggggctcattttgagttrtgtcacctccttgggttgcagctttttcctctccatcttctgtcttcatccacctttcctttccttcctacccttcacctcctttatttgtctcctttcctcatccctcaaacccctccaagggccttttgctaagaactgcacattcaggcaccaataagacattgtttctgctcttgcagacttcatagtccagttggacaaaaccaagacaacaaattaatgggcccccaaatgtggcagcaagaggcgaatctggttggaaaccctagaatgcttccagctgcttccttagccttg

SEQ ID NO: 85102 - DNA, 601 bp, Human
gacatagctggaagggctgtctctgttccttctcccagggccccagaagccctaactcgtgggaactttctacagtgccagcagggagcaggagggaggctggatctctggagaaagagctcctgggtccatctcgtgaggggagagtgaaactccaaatcagacctgggtaaataggtataccggggctcattttgagttgtgtcacctccttgggttgcagctttttcctctccatcttctgtcttcatccacctttcctttccttcctacccttcacctcctttatttgtctcctttyctcatccctcaaacccctccaagggccttttgctaagaactgcacattcaggcaccaataagacattgtttctgctcttgcagacttcatagtccagttggacaaaaccaagacaacaaattaatgggcccccaaatgtggcagcaagaggcgaatctggttggaaaccctagaatgcttccagctgcttccttagccttgatgctctctaaggaatggccatctgctgctcacagggcttctcaagcttctcaagcttctcttcaaacacccgggataatagttgagtatgttcccccc

SEQ ID NO: 85103 - DNA, 601 bp, Human
tgcagctttttcctctccatcttctgtcttcatccacctttcctttccttcctacccttcacctcctttatttgtctcctttcctcatccctcaaacccctccaagggccttttgctaagaactgcacattcaggcaccaataagacattgtttctgctcttgcagacttcatagtccagttggacaaaaccaagacaacaaattaatgggcccccaaatgtggcagcaagaggcgaatctggttggaaaccctagaatgcttccagctgcttccttagccttgatgctctctaaggaatrgccatctgctgctcacagggcttctcaagcttctcaagcttctcttcaaacacccgggataatagttgagtatgttccccccgaggccctgggggtggggtgtaatatagagtttaatgtattctctttgagatgcattctttgccactacggagccatatatgttgggtcataataatggaataagttggcatcgtgtcaagttgactcctctccaggaagttgcgccatgtttagcttgtggctttccatggcacatgaaggacagccgaatatgggcactgagagggaaatcgaaga

SEQ ID NO: 85104 - DNA, 601 bp, Human
atcttctgtcttcatccacctttcctttccttcctacccttcacctcctttatttgtctcctttcctcatccctcaaacccctccaagggccttttgctaagaactgcacattcaggcaccaataagacattgtttctgctcttgcagacttcatagtccagttggacaaaaccaagacaacaaattaatgggcccccaaatgtggcagcaagaggcgaatctggttggaaaccctagaatgcttccagctgcttccttagccttgatgctctctaaggaatggccatctgctgctcacagggcttctcaagcttctcaagcttctcttcaaacacccgggataatagttgagtatgttccccccgaggccctgggggtggggtgtaatatagagtttaatgtattctctttgagatgcattctttgccactacggagccatatatgttgggtcataataatggaataagttggcatcgtgtcaagttgactcctctccaggaagttgcgccatgtttagcttgtggctttccatggcacatgaaggacagccgaatatgggcactgagagggaaatcgaagatgattgggatgtctgaag

SEQ ID NO: 85105 - DNA, 601 bp, Human
atagtccagttggacaaaaccaagacaacaaattaatgggcccccaaatgtggcagcaagaggcgaatctggttggaaaccctagaatgcttccagctgcttccttagccttgatgctctctaaggaatggccatctgctgctcacagggcttctcaagcttctcaagcttctcttcaaacacccgggataatagttgagtatgttccccccgaggccctgggggtggggtgtaatatagagtttaatgtattctctttgagatgcattctttgccactacggagccatatatgttgggtmataataatggaataagttggcatcgtgtcaagttgactcctctccaggaagttgcgccatgtttagcttgtggctttccatggcacatgaaggacagccgaatatgggcactgagagggaaatcgaagatgattgggatgtctgaagtctgagtgaccaagaaggtgaggtatcgtagacagaaacagggaatgcaggaggaggacctgggtcagagctagctctttgtaggtcaagaccaggagatagccacaaacgtgtccaggacagaggttggggcaaagatgtggatttcagaga

SEQ ID NO: 85106 - DNA, 601 bp, Human
ctaaggaatggccatctgctgctcacagggcttctcaagcttctcaagcttctcttcaaacacccgggataatagttgagtatgttccccccgaggccctgggggtggggtgtaatatagagtttaatgtattctctttgagatgcattctttgccactacggagccatatatgttgggtcataataatggaataagttggcatcgtgtcaagttgactcctctccaggaagttgcgccatgtttagcttgtggctttccatggcacatgaaggacagccgaatatgggcactgagagggraatcgaagatgattgggatgtctgaagtctgagtgaccaagaaggtgaggtatcgtagacagaaacagggaatgcaggaggaggacctgggtcagagctagctctttgtaggtcaagaccaggagatagccacaaacgtgtccaggacagaggttggggcaaagatgtggatttcagagacatctctctgcagagacctggaggtggaataagatgcacagggagagaagagagaaaggctgggaggtttcattgcacccatggcggggggacccaaatgctttctttttcccttccatt

SEQ ID NO: 85107 - DNA, 601 bp, Human
cacatagtaggtgcttaaggctatgatcctttgcccatgtgagcttctctataaccaggggccattttacaaatggggaaactgaggcttatttattaattcattccactgaagggattttgttcctgggagggggcaagccgggcctgagctatcacggccctgagtccttaacacgttgtgatatgtgccagcttgtctgcccaggtactaacaaggcctccctgccaccgctcagtccctgccagagccaatctgcatcctcgtctccaccaattacagaggtggagacgcccccccscccccaaccaacaccgccaggccaggggggcctgagagcccagacgtcctccttttccaacctgggcgggggaccagagtcaaggaggccctcctccctcccctctccttcctcccgcctgcccctcctcccctcagctcggccaattaggcccctgacacctggagccgctgacaaactgtttctgtcacttgctctctgtctttcattagggccgcagaagagggggagcagggaagggagggggaggagatgggatctttcatgcttagtaaggccagatacattaattacaaaacg

SEQ ID NO: 85108 - DNA, 601 bp, Human
atagtaggtgcttaaggctatgatcctttgcccatgtgagcttctctataaccaggggccattttacaaatggggaaactgaggcttatttattaattcattccactgaagggattttgttcctgggagggggcaagccgggcctgagctatcacggccctgagtccttaacacgttgtgatatgtgccagcttgtctgcccaggtactaacaaggcctccctgccaccgctcagtccctgccagagccaatctgcatcctcgtctccaccaattacagaggtggagacgcccccccgccgccaaccaacaccgccaggccaggggggcctgagagcccagacgtcctccttttccaacctgggcgggggaccagagtcaaggaggccctcctccctcccctctccttcctcccgcctgcccctcctcccctcagctcggccaattaggcccctgacacctggagccgctgacaaactgtttctgtcacttgctctctgtctttcattagggccgcagaagagggggagcagggaagggagggggaggagatgggatctttcatgcttagtaaggccagatacattaattacaaaacggcc

SEQ ID NO: 85109 - DNA, 601 bp, Human
gtaggtgcttaaggctatgatcctttgcccatgtgagcttctctataaccaggggccattttacaaatggggaaactgaggcttatttattaattcattccactgaagggattttgttcctgggagggggcaagccgggcctgagctatcacggccctgagtccttaacacgttgtgatatgtgccagcttgtctgcccaggtactaacaaggcctccctgccaccgctcagtccctgccagagccaatctgcatcctcgtctccaccaattacagaggtggagacgcccccccgcccccmaccaacaccgccaggccaggggggcctgagagcccagacgtcctccttttccaacctgggcgggggaccagagtcaaggaggccctcctccctcccctctccttcctcccgcctgcccctcctcccctcagctcggccaattaggcccctgacacctggagccgctgacaaactgtttctgtcacttgctctctgtctttcattagggccgcagaagagggggagcagggaagggagggggaggagatgggatctttcatgcttagtaaggccagatacattaattacaaaacggccatt

SEQ ID NO: 85110 - DNA, 601 bp, Human
tgcacacactctctcatcctctctctctctctctctctctcatacacacacacacacacacacacacacacacacacagagttaacactcaggtaataaatgaccctgagccacctatggtaaatgaaggccacagccaggcacaaggcgatcaccttctagcatcagaccagaagtcgagagtcaagggtccttgccccagtcctgtcactcatcccccaggtgattctgggtgagccgctaagcctcagttttctcatctgaaaaatggggtcacagtacttcctagagtcatgatgargcttaaagggaaatacttcacaaactgtaaagtgctgtgcttgtgcaagagaatgccatcagccaggcttagaaaagcgttcatggagggcttcgagggtgacaaatgagagggaaccaggagtcagggggctgggtcgggagagggaagggaaccttcttgcccacacggcaggtgcagggcttcggtgtgggatgctggtagtggagggggttgggtgtggaggccataagcagagatggaaactgaagtgggggacagggagacctgcaggaaatcttgtttggaagctccaagtca

SEQ ID NO: 85111 - DNA, 601 bp, Human
cccagtcctgtcactcatcccccaggtgattctgggtgagccgctaagcctcagttttctcatctgaaaaatggggtcacagtacttcctagagtcatgatgaggcttaaagggaaatacttcacaaactgtaaagtgctgtgcttgtgcaagagaatgccatcagccaggcttagaaaagcgttcatggagggcttcgagggtgacaaatgagagggaaccaggagtcagggggctgggtcgggagagggaagggaaccttcttgcccacacggcaggtgcagggcttcggtgtgggatrctggtagtggagggggttgggtgtggaggccataagcagagatggaaactgaagtgggggacagggagacctgcaggaaatcttgtttggaagctccaagtcagcacccgaagcctattaccgctgtccacagggggaaaggagggggagggtccagatcctcttagtggagtattgagaggaagagggggtgagggtgggcagctgcccgggtgggtaatttctggcttgcactaatcccagtgtggggctgggaacaggcagccgccagtaggggcatgcgtgtgtctgggtgtcccc

SEQ ID NO: 85112 - DNA, 601 bp, Human
gcttagaaaagcgttcatggagggcttcgagggtgacaaatgagagggaaccaggagtcagggggctgggtcgggagagggaagggaaccttcttgcccacacggcaggtgcagggcttcggtgtgggatgctggtagtggagggggttgggtgtggaggccataagcagagatggaaactgaagtgggggacagggagacctgcaggaaatcttgtttggaagctccaagtcagcacccgaagcctattaccgctgtccacagggggaaaggagggggagggtccagatcctcttagtgkagtattgagaggaagagggggtgagggtgggcagctgcccgggtgggtaatttctggcttgcactaatcccagtgtggggctgggaacaggcagccgccagtaggggcatgcgtgtgtctgggtgtcccctgggggctggaggagggtgaagggcgcacaggtttgcgtgagtgagctgacgaaggcggagttgtggggtggcagtgtgtgggtgcgtgagggtctgtgtacctctttgtgtgcacatcggggaggccggtggatctgtggccagcgggatgggtgcctgcgggttttca

SEQ ID NO: 85113 - DNA, 601 bp, Human
tgggtgttttttgtgtgcatcccatatcttcgcctgtatgagtatggatgtgtcatggtattacgtgtgtgtagcaattcacagtgatgtcttgagactagtggccgtcaaacttggctgctcattagaatcacccgggagctttaaaaactcctgacctgaccgggcgtcgtggctcacgcctgtagtcccagcactttgggaggccaaggcagccagatcacctgaggtcaggagttcgagaccagcgtgaccaacatagagaaaccccattctactaaaaaaaaaaaaaaaaaattasccgggcttggtggtgcatgcctgtaatcccagctactcaggaggctgagccaggagaattgcttgaacctgggaggcagaggttgcggtgagccgagatcacaccattgcactccagcctgggcaacaagagtgaaactccgtctcaaaaaaaaaaacaaaaaactcctgacccccagacccccaagtgattccagtggacagtcaagacggagaaccagtgatggagcagacagacccaggggagaggcccatctctcttgcccagtcctcagcctgctctgacaggatctgcctggag

SEQ ID NO: 85114 - DNA, 601 bp, Human
cagtgccctcggggaaactgttgtccctcttagagcctcagggtccctctcaggcagtgtagaggtggggctctgtgtcctgccgatggtccctgcagccttgacctgattcctgacccccacccctatcctgaccttcagtctctaggccctgtgcctccctcttcctctgcaccctgctgcggcccccacccacccaccacaaaccctgccacagagccccaatgatggcgattgccccttctaattgcagccacactcccaaagccacgttcagttatcacagagggtgcagatctcrcagctcagcctcctcagtcccaggccctcggggccagctcaggaacggagggaactaattacatttttcccatccccttcttttaaagtaggggagcgcgccggcatgtcccaggggagggggcggtgagcagaggctgtggaaggggggcccccacccccaaaccagcaagcctctccccagcagacggaagggagggtgaggctggcctcttattgatttagtctggtcgaggctgggactgatttggagtagagggagaggaaggggttgggggtggggtaggggccgtggcgggtg

SEQ ID NO: 85115 - DNA, 601 bp, Human
gggaaatggaggaggaagggagaggaagggacggctgtctgtcagcctgacggacagccctgagatttgccttcagataaaaccttacagatgtggaggtcggtattgattttgagttagtaacggtaacctaccaagaagtaatacattagtgaaagcaaggtcaccaggaaaaaagtaaaatctacccggggagaggccttagcattcttgagaggggtggattactgcatcagacctgaacttcctcaagttgaaaagtttgcaggctccggacctcagctggattcctaactgtggrccaatgcttcctgcttctgcaggccaagagggagccctaaaggtccccgggaagccagaggccagcgaggggcatttaggcccatagggctctgtgcagtgaggttgccaaacctctccctgtgtgctctccagcacagctggtggcagggaaagagcacagctagggacccgggagacctgggtgcaaatcccagctctgccacttaccggctgtgtggttgtgggtgagcccttttgcttcctcgtgtctcaatttccccatctgcataatgggagtaatgataccccatctgcttga

SEQ ID NO: 85116 - DNA, 601 bp, Human
tgagaggggtggattactgcatcagacctgaacttcctcaagttgaaaagtttgcaggctccggacctcagctggattcctaactgtgggccaatgcttcctgcttctgcaggccaagagggagccctaaaggtccccgggaagccagaggccagcgaggggcatttaggcccatagggctctgtgcagtgaggttgccaaacctctccctgtgtgctctccagcacagctggtggcagggaaagagcacagctagggacccgggagacctgggtgcaaatcccagctctgccacttaccrgctgtgtggttgtgggtgagcccttttgcttcctcgtgtctcaatttccccatctgcataatgggagtaatgataccccatctgcttgaggagtccatgaactggccaatatatgactcaggccttgtggtcttcatcagtgagtgttctcccctcccgccgctctccagttgggtcctgtcccattagcttagacgctgccctgcctggagacagggggttggatgaaatggaagccctttgatccacagacccccaggggctctgggagagagtaagcagtggcagcacatcctccat

SEQ ID NO: 85117 - DNA, 601 bp, Human
agtccagccctagctccagactggcacatagtagcaccctatgaaatgcttgttggacgaatacgtgaatgaatgaaggatatcttcaagaaataccacattgtttgggatagctggaaggtaaagtgcagggtagaaaggggtgaaaggagttgggacaggcagctagaggtctggtcactaggagcttttgctgagagataatggggagccattcataattcttgagtgatactgtcagattgggcagcagttctgtgcaggtctctgtcttagaggatgagtagtgggactacacatrgctctcagcctgtctcaaaacatcctcgtcctcttcctaaccatcccccgactcctcccctcccatcatcccatccgggcttggcatcctggggatgggcaggagggaaggatcaaactggagtctcacgggagctgacaaaccctcccagtagtctcccagcccccgtcaactgtccttctgaaagaagtgatctggagcctgagtgttttttctgagcctctaagtctattcttggagtccaggcctcctttgagcagggagcagggtccgtgtttgtgttgggtgagaaaggagatg

SEQ ID NO: 85118 - DNA, 601 bp, Human
ttgttggacgaatacgtgaatgaatgaaggatatcttcaagaaataccacattgtttgggatagctggaaggtaaagtgcagggtagaaaggggtgaaaggagttgggacaggcagctagaggtctggtcactaggagcttttgctgagagataatggggagccattcataattcttgagtgatactgtcagattgggcagcagttctgtgcaggtctctgtcttagaggatgagtagtgggactacacatagctctcagcctgtctcaaaacatcctcgtcctcttcctaaccatccccygactcctcccctcccatcatcccatccgggcttggcatcctggggatgggcaggagggaaggatcaaactggagtctcacgggagctgacaaaccctcccagtagtctcccagcccccgtcaactgtccttctgaaagaagtgatctggagcctgagtgttttttctgagcctctaagtctattcttggagtccaggcctcctttgagcagggagcagggtccgtgtttgtgttgggtgagaaaggagatgggtgggaaaaggtctagactgagaaccccagggtagactcagattcctg

SEQ ID NO: 85119 - DNA, 601 bp, Human
gaatgaatgaaggatatcttcaagaaataccacattgtttgggatagctggaaggtaaagtgcagggtagaaaggggtgaaaggagttgggacaggcagctagaggtctggtcactaggagcttttgctgagagataatggggagccattcataattcttgagtgatactgtcagattgggcagcagttctgtgcaggtctctgtcttagaggatgagtagtgggactacacatagctctcagcctgtctcaaaacatcctcgtcctcttcctaaccatcccccgactcctcccctcccawcatcccatccgggcttggcatcctggggatgggcaggagggaaggatcaaactggagtctcacgggagctgacaaaccctcccagtagtctcccagcccccgtcaactgtccttctgaaagaagtgatctggagcctgagtgttttttctgagcctctaagtctattcttggagtccaggcctcctttgagcagggagcagggtccgtgtttgtgttgggtgagaaaggagatgggtgggaaaaggtctagactgagaaccccagggtagactcagattcctgagtctgccctgggacct

SEQ ID NO: 85120 - DNA, 601 bp, Human
atggggagccattcataattcttgagtgatactgtcagattgggcagcagttctgtgcaggtctctgtcttagaggatgagtagtgggactacacatagctctcagcctgtctcaaaacatcctcgtcctcttcctaaccatcccccgactcctcccctcccatcatcccatccgggcttggcatcctggggatgggcaggagggaaggatcaaactggagtctcacgggagctgacaaaccctcccagtagtctcccagcccccgtcaactgtccttctgaaagaagtgatctggagccygagtgttttttctgagcctctaagtctattcttggagtccaggcctcctttgagcagggagcagggtccgtgtttgtgttgggtgagaaaggagatgggtgggaaaaggtctagactgagaaccccagggtagactcagattcctgagtctgccctgggaccttgctctcctccccaagcccctagcacattcttcaagctaaggagatcccatcttgacagacagaaagcaacaaacacagtcccacagtgtcagacaccctcacataccactaccccagcaccctactgttgacccga

SEQ ID NO: 85121 - DNA, 601 bp, Human
ggggagccattcataattcttgagtgatactgtcagattgggcagcagttctgtgcaggtctctgtcttagaggatgagtagtgggactacacatagctctcagcctgtctcaaaacatcctcgtcctcttcctaaccatcccccgactcctcccctcccatcatcccatccgggcttggcatcctggggatgggcaggagggaaggatcaaactggagtctcacgggagctgacaaaccctcccagtagtctcccagcccccgtcaactgtccttctgaaagaagtgatctggagcctgwgtgttttttctgagcctctaagtctattcttggagtccaggcctcctttgagcagggagcagggtccgtgtttgtgttgggtgagaaaggagatgggtgggaaaaggtctagactgagaaccccagggtagactcagattcctgagtctgccctgggaccttgctctcctccccaagcccctagcacattcttcaagctaaggagatcccatcttgacagacagaaagcaacaaacacagtcccacagtgtcagacaccctcacataccactaccccagcaccctactgttgacccgacc

SEQ ID NO: 85122 - DNA, 601 bp, Human
gccatcccagtctgatgggggaggcacagttctctgagcttggagaactccctgactgatgggagaggcctcattagccagttcgttcattcatgcattcattcatgcatttattcattcaatagacaggcccagagtgacccttagggccagaccctggagctagagaggcgagtaaggccctgctgagttctcagtggaaggaggatccctgggtcaggaccctccttcaagagaaacaccgaagaccagcagccatcccatgcatgagggcacgcaaatcaggtaaactgaggacctygaagctacagagacttcaagggaacaactctggcaaagagtgttccagggccagcctggcattgtgcccagtgtgctcgtgtctctggggtctgtccggtgagcctggcactaatggccttttccccacaggtgatgagcatcttgggcaaccccagtgcggtgcccccgcagccacaggctgacttctccatctccccgctgcatggcggcctggactcggccacctccatctcagccagctgcagccagcgggccgactccatcaagccaggagacagcctgcccacctcccaggcct

SEQ ID NO: 85123 - DNA, 601 bp, Human; identical to SEQ ID NO: 84972

SEQ ID NO: 85124 - DNA, 601 bp, Human; identical to SEQ ID NO: 84973

SEQ ID NO: 85125 - DNA, 601 bp, Human; identical to SEQ ID NO: 84974

SEQ ID NO: 85126 - DNA, 601 bp, Human; identical to SEQ ID NO: 84975

SEQ ID NO: 85127 - DNA, 601 bp, Human; identical to SEQ ID NO: 84976

SEQ ID NO: 85128 - DNA, 601 bp, Human; identical to SEQ ID NO: 84977

SEQ ID NO: 85129 - DNA, 601 bp, Human; identical to SEQ ID NO: 84978

SEQ ID NO: 85130 - DNA, 601 bp, Human; identical to SEQ ID NO: 84979

SEQ ID NO: 85131 - DNA, 601 bp, Human; identical to SEQ ID NO: 84980

SEQ ID NO: 85132 - DNA, 601 bp, Human; identical to SEQ ID NO: 84981

SEQ ID NO: 85133 - DNA, 601 bp, Human; identical to SEQ ID NO: 84982

SEQ ID NO: 85134 - DNA, 601 bp, Human; identical to SEQ ID NO: 84983

SEQ ID NO: 85135 - DNA, 601 bp, Human; identical to SEQ ID NO: 84984

SEQ ID NO: 85136 - DNA, 601 bp, Human; identical to SEQ ID NO: 84985

SEQ ID NO: 85137 - DNA, 601 bp, Human; identical to SEQ ID NO: 84986

SEQ ID NO: 85138 - DNA, 601 bp, Human; identical to SEQ ID NO: 84987

SEQ ID NO: 85139 - DNA, 601 bp, Human; identical to SEQ ID NO: 84988

SEQ ID NO: 85140 - DNA, 601 bp, Human; identical to SEQ ID NO: 84989

SEQ ID NO: 85141 - DNA, 601 bp, Human; identical to SEQ ID NO: 84990

SEQ ID NO: 85142 - DNA, 601 bp, Human; identical to SEQ ID NO: 84991

SEQ ID NO: 85143 - DNA, 601 bp, Human; identical to SEQ ID NO: 84992

SEQ ID NO: 85144 - DNA, 601 bp, Human; identical to SEQ ID NO: 84993

SEQ ID NO: 85145 - DNA, 601 bp, Human; identical to SEQ ID NO: 84994

SEQ ID NO: 85146 - DNA, 601 bp, Human; identical to SEQ ID NO: 84995

SEQ ID NO: 85147 - DNA, 601 bp, Human; identical to SEQ ID NO: 84996

SEQ ID NO: 85148 - DNA, 601 bp, Human; identical to SEQ ID NO: 84997

SEQ ID NO: 85149 - DNA, 601 bp, Human; identical to SEQ ID NO: 84998

SEQ ID NO: 85150 - DNA, 601 bp, Human; identical to SEQ ID NO: 84999

SEQ ID NO: 85151 - DNA, 601 bp, Human; identical to SEQ ID NO: 85000

SEQ ID NO: 85152 - DNA, 601 bp, Human; identical to SEQ ID NO: 85001

SEQ ID NO: 85153 - DNA, 601 bp, Human; identical to SEQ ID NO: 85002

SEQ ID NO: 85154 - DNA, 601 bp, Human; identical to SEQ ID NO: 85003

SEQ ID NO: 85155 - DNA, 601 bp, Human; identical to SEQ ID NO: 85004

SEQ ID NO: 85156 - DNA, 601 bp, Human; identical to SEQ ID NO: 85005

SEQ ID NO: 85157 - DNA, 601 bp, Human; identical to SEQ ID NO: 85006

SEQ ID NO: 85158 - DNA, 601 bp, Human; identical to SEQ ID NO: 85007

SEQ ID NO: 85159 - DNA, 601 bp, Human; identical to SEQ ID NO: 85008

SEQ ID NO: 85160 - DNA, 601 bp, Human; identical to SEQ ID NO: 85009

SEQ ID NO: 85161 - DNA, 601 bp, Human; identical to SEQ ID NO: 85010

SEQ ID NO: 85162 - DNA, 601 bp, Human; identical to SEQ ID NO: 85011

SEQ ID NO: 85163 - DNA, 601 bp, Human; identical to SEQ ID NO: 85012

SEQ ID NO: 85164 - DNA, 601 bp, Human; identical to SEQ ID NO: 85013

SEQ ID NO: 85165 - DNA, 601 bp, Human; identical to SEQ ID NO: 85014

SEQ ID NO: 85166 - DNA, 601 bp, Human; identical to SEQ ID NO: 85015

SEQ ID NO: 85167 - DNA, 601 bp, Human; identical to SEQ ID NO: 85016

SEQ ID NO: 85168 - DNA, 601 bp, Human; identical to SEQ ID NO: 85017

SEQ ID NO: 85169 - DNA, 601 bp, Human; identical to SEQ ID NO: 85018

SEQ ID NO: 85170 - DNA, 601 bp, Human; identical to SEQ ID NO: 85019

SEQ ID NO: 85171 - DNA, 601 bp, Human; identical to SEQ ID NO: 85020

SEQ ID NO: 85172 - DNA, 601 bp, Human; identical to SEQ ID NO: 85021

SEQ ID NO: 85173 - DNA, 601 bp, Human; identical to SEQ ID NO: 85022

SEQ ID NO: 85174 - DNA, 601 bp, Human; identical to SEQ ID NO: 85023

SEQ ID NO: 85175 - DNA, 601 bp, Human; identical to SEQ ID NO: 85024

SEQ ID NO: 85176 - DNA, 601 bp, Human; identical to SEQ ID NO: 85025

SEQ ID NO: 85177 - DNA, 601 bp, Human; identical to SEQ ID NO: 85026

SEQ ID NO: 85178 - DNA, 601 bp, Human; identical to SEQ ID NO: 85027

SEQ ID NO: 85179 - DNA, 601 bp, Human; identical to SEQ ID NO: 85028

SEQ ID NO: 85180 - DNA, 601 bp, Human; identical to SEQ ID NO: 85029

SEQ ID NO: 85181 - DNA, 601 bp, Human; identical to SEQ ID NO: 85030

SEQ ID NO: 85182 - DNA, 601 bp, Human; identical to SEQ ID NO: 85031

SEQ ID NO: 85183 - DNA, 601 bp, Human; identical to SEQ ID NO: 85032

SEQ ID NO: 85184 - DNA, 601 bp, Human; identical to SEQ ID NO: 85033

SEQ ID NO: 85185 - DNA, 601 bp, Human; identical to SEQ ID NO: 85034

SEQ ID NO: 85186 - DNA, 601 bp, Human; identical to SEQ ID NO: 85035

SEQ ID NO: 85187 - DNA, 601 bp, Human; identical to SEQ ID NO: 85036

SEQ ID NO: 85188 - DNA, 601 bp, Human; identical to SEQ ID NO: 85037

SEQ ID NO: 85189 - DNA, 601 bp, Human; identical to SEQ ID NO: 85038

SEQ ID NO: 85190 - DNA, 601 bp, Human; identical to SEQ ID NO: 85039

SEQ ID NO: 85191 - DNA, 601 bp, Human; identical to SEQ ID NO: 85040

SEQ ID NO: 85192 - DNA, 601 bp, Human; identical to SEQ ID NO: 85041

SEQ ID NO: 85193 - DNA, 601 bp, Human; identical to SEQ ID NO: 85042

SEQ ID NO: 85194 - DNA, 601 bp, Human; identical to SEQ ID NO: 85043

SEQ ID NO: 85195 - DNA, 601 bp, Human; identical to SEQ ID NO: 85044

SEQ ID NO: 85196 - DNA, 601 bp, Human; identical to SEQ ID NO: 85045

SEQ ID NO: 85197 - DNA, 601 bp, Human; identical to SEQ ID NO: 85046

SEQ ID NO: 85198 - DNA, 601 bp, Human; identical to SEQ ID NO: 85047

SEQ ID NO: 85199 - DNA, 601 bp, Human; identical to SEQ ID NO: 85048

SEQ ID NO: 85200 - DNA, 601 bp, Human; identical to SEQ ID NO: 85049

SEQ ID NO: 85201 - DNA, 601 bp, Human; identical to SEQ ID NO: 85050

SEQ ID NO: 85202 - DNA, 601 bp, Human; identical to SEQ ID NO: 85051

SEQ ID NO: 85203 - DNA, 601 bp, Human; identical to SEQ ID NO: 85052

SEQ ID NO: 85204 - DNA, 601 bp, Human; identical to SEQ ID NO: 85053

SEQ ID NO: 85205 - DNA, 601 bp, Human; identical to SEQ ID NO: 85054

SEQ ID NO: 85206 - DNA, 601 bp, Human; identical to SEQ ID NO: 85055

SEQ ID NO: 85207 - DNA, 601 bp, Human; identical to SEQ ID NO: 85056

SEQ ID NO: 85208 - DNA, 601 bp, Human; identical to SEQ ID NO: 85057

SEQ ID NO: 85209 - DNA, 601 bp, Human; identical to SEQ ID NO: 85058

SEQ ID NO: 85210 - DNA, 601 bp, Human; identical to SEQ ID NO: 85059

SEQ ID NO: 85211 - DNA, 601 bp, Human; identical to SEQ ID NO: 85060

SEQ ID NO: 85212 - DNA, 601 bp, Human; identical to SEQ ID NO: 85061

SEQ ID NO: 85213 - DNA, 601 bp, Human; identical to SEQ ID NO: 85062

SEQ ID NO: 85214 - DNA, 601 bp, Human; identical to SEQ ID NO: 85063

SEQ ID NO: 85215 - DNA, 601 bp, Human; identical to SEQ ID NO: 85064

SEQ ID NO: 85216 - DNA, 601 bp, Human; identical to SEQ ID NO: 85065

SEQ ID NO: 85217 - DNA, 601 bp, Human; identical to SEQ ID NO: 85066

SEQ ID NO: 85218 - DNA, 601 bp, Human; identical to SEQ ID NO: 85067

SEQ ID NO: 85219 - DNA, 601 bp, Human; identical to SEQ ID NO: 85068

SEQ ID NO: 85220 - DNA, 601 bp, Human; identical to SEQ ID NO: 85069

SEQ ID NO: 85221 - DNA, 601 bp, Human; identical to SEQ ID NO: 85070

SEQ ID NO: 85222 - DNA, 601 bp, Human; identical to SEQ ID NO: 85071

SEQ ID NO: 85223 - DNA, 601 bp, Human; identical to SEQ ID NO: 85072

SEQ ID NO: 85224 - DNA, 601 bp, Human; identical to SEQ ID NO: 85073

SEQ ID NO: 85225 - DNA, 601 bp, Human; identical to SEQ ID NO: 85074

SEQ ID NO: 85226 - DNA, 601 bp, Human; identical to SEQ ID NO: 85075

SEQ ID NO: 85227 - DNA, 601 bp, Human; identical to SEQ ID NO: 85076

SEQ ID NO: 85228 - DNA, 601 bp, Human; identical to SEQ ID NO: 85077

SEQ ID NO: 85229 - DNA, 601 bp, Human; identical to SEQ ID NO: 85078

SEQ ID NO: 85230 - DNA, 601 bp, Human; identical to SEQ ID NO: 85079

SEQ ID NO: 85231 - DNA, 601 bp, Human; identical to SEQ ID NO: 85080

SEQ ID NO: 85232 - DNA, 601 bp, Human; identical to SEQ ID NO: 85081

SEQ ID NO: 85233 - DNA, 601 bp, Human; identical to SEQ ID NO: 85082

SEQ ID NO: 85234 - DNA, 601 bp, Human; identical to SEQ ID NO: 85083

SEQ ID NO: 85235 - DNA, 601 bp, Human; identical to SEQ ID NO: 85084

SEQ ID NO: 85236 - DNA, 601 bp, Human; identical to SEQ ID NO: 85085

SEQ ID NO: 85237 - DNA, 601 bp, Human; identical to SEQ ID NO: 85086

SEQ ID NO: 85238 - DNA, 601 bp, Human; identical to SEQ ID NO: 85087

SEQ ID NO: 85239 - DNA, 601 bp, Human; identical to SEQ ID NO: 85088

SEQ ID NO: 85240 - DNA, 601 bp, Human; identical to SEQ ID NO: 85089

SEQ ID NO: 85241 - DNA, 601 bp, Human; identical to SEQ ID NO: 85090

SEQ ID NO: 85242 - DNA, 601 bp, Human; identical to SEQ ID NO: 85091

SEQ ID NO: 85243 - DNA, 601 bp, Human; identical to SEQ ID NO: 85092

SEQ ID NO: 85244 - DNA, 601 bp, Human; identical to SEQ ID NO: 85093

SEQ ID NO: 85245 - DNA, 601 bp, Human; identical to SEQ ID NO: 85094

SEQ ID NO: 85246 - DNA, 601 bp, Human; identical to SEQ ID NO: 85095

SEQ ID NO: 85247 - DNA, 601 bp, Human; identical to SEQ ID NO: 85096

SEQ ID NO: 85248 - DNA, 601 bp, Human; identical to SEQ ID NO: 85097

SEQ ID NO: 85249 - DNA, 601 bp, Human; identical to SEQ ID NO: 85098

SEQ ID NO: 85250 - DNA, 601 bp, Human; identical to SEQ ID NO: 85099

SEQ ID NO: 85251 - DNA, 601 bp, Human; identical to SEQ ID NO: 85100

SEQ ID NO: 85252 - DNA, 601 bp, Human; identical to SEQ ID NO: 85101

SEQ ID NO: 85253 - DNA, 601 bp, Human; identical to SEQ ID NO: 85102

SEQ ID NO: 85254 - DNA, 601 bp, Human; identical to SEQ ID NO: 85103

SEQ ID NO: 85255 - DNA, 601 bp, Human; identical to SEQ ID NO: 85104

SEQ ID NO: 85256 - DNA, 601 bp, Human; identical to SEQ ID NO: 85105

SEQ ID NO: 85257 - DNA, 601 bp, Human; identical to SEQ ID NO: 85106

SEQ ID NO: 85258 - DNA, 601 bp, Human; identical to SEQ ID NO: 85107

SEQ ID NO: 85259 - DNA, 601 bp, Human; identical to SEQ ID NO: 85108

SEQ ID NO: 85260 - DNA, 601 bp, Human; identical to SEQ ID NO: 85109

SEQ ID NO: 85261 - DNA, 601 bp, Human; identical to SEQ ID NO: 85110

SEQ ID NO: 85262 - DNA, 601 bp, Human; identical to SEQ ID NO: 85111

SEQ ID NO: 85263 - DNA, 601 bp, Human; identical to SEQ ID NO: 85112

SEQ ID NO: 85264 - DNA, 601 bp, Human; identical to SEQ ID NO: 85113

SEQ ID NO: 85265 - DNA, 601 bp, Human; identical to SEQ ID NO: 85114

SEQ ID NO: 85266 - DNA, 601 bp, Human; identical to SEQ ID NO: 85115

SEQ ID NO: 85267 - DNA, 601 bp, Human; identical to SEQ ID NO: 85116

SEQ ID NO: 85268 - DNA, 601 bp, Human; identical to SEQ ID NO: 85117

SEQ ID NO: 85269 - DNA, 601 bp, Human; identical to SEQ ID NO: 85118

SEQ ID NO: 85270 - DNA, 601 bp, Human; identical to SEQ ID NO: 85119

SEQ ID NO: 85271 - DNA, 601 bp, Human; identical to SEQ ID NO: 85120

SEQ ID NO: 85272 - DNA, 601 bp, Human; identical to SEQ ID NO: 85121

SEQ ID NO: 85273 - DNA, 601 bp, Human; identical to SEQ ID NO: 85122

SEQ ID NO: 85274 - DNA, 601 bp, Human; identical to SEQ ID NO: 20816

SEQ ID NO: 85275 - DNA, 601 bp, Human; identical to SEQ ID NO: 20817

SEQ ID NO: 85276 - DNA, 601 bp, Human; identical to SEQ ID NO: 20818

SEQ ID NO: 85277 - DNA, 601 bp, Human; identical to SEQ ID NO: 20819

SEQ ID NO: 85278 - DNA, 601 bp, Human
gaactcgtgatctcaagtgatccgcctgccttggcatctcaaagtgctaggtaggattacaggcttgtgagccaccgtgcctggccatgactttcaagaagctgtttattctggttacttttttgagcagttacattaaatgtaaaacaaaataaaaatagtaagaataataactaacgttttgtaagtgttaaatgctggcactattccaagtgctttacatttattatctccttgacttgtcacaataactgcaagggaggtagattattacccttattttacagatgaaaaaatgagsctgaaagcttaagtgatttgcccaaggtcactgatagagctagtgagtggtgaagccaagattctgacgagacagtctgacctcagagctctttaccactgggcagtacactggtcaacagtggtggctttttttttttttttgagacagagtctcgctctgtcgcccaggctggagtgcagtggcatgatctcgcctcactgcaagctccgccttccgggttcacgccattctcctgcctcagcctcctgagtagctgggactacaggcgcccaccaccacgcccggctaattttttgt

SEQ ID NO: 85279 - DNA, 601 bp, Human
tcacacttgctcagccctgtttgaacccagacagagagcagctcaaaatatgcaagtattacatactcacagaacctggagacaagagaagcggcttctaggcacatgggctcccatccttgcagcagctggtatagaggttgcatgacaacttgtgaggattctgcagtagcgtgggctcagctacatgacctaaataaaggtctctttcaaccctgagattctgtaagtttctttttctttagacagagtctcactctgtcacccaggctggagtgcagtgacacgatctcggctcagygcaacctctgcctccaaggctcaagtgatccttccacctcagcctcccgagtaggtgggactacagttgtgtaccaccatggctggcaaagttttaaagtttttttgtagtgacagggtctcactatgttacccaggctgattttgaactcctaagctcaagcgatcctcccacctcaggctcctgagtagctgggactacagtcttgtgccaccactcctggctaattaattttttttttttttgtagagagggggttctgctatgttgcccaggctgggtgaactcctgggttcaagt

SEQ ID NO: 85280 - DNA, 601 bp, Human
caagagaagcggcttctaggcacatgggctcccatccttgcagcagctggtatagaggttgcatgacaacttgtgaggattctgcagtagcgtgggctcagctacatgacctaaataaaggtctctttcaaccctgagattctgtaagtttctttttctttagacagagtctcactctgtcacccaggctggagtgcagtgacacgatctcggctcagcgcaacctctgcctccaaggctcaagtgatccttccacctcagcctcccgagtaggtgggactacagttgtgtaccaccatgsctggcaaagttttaaagtttttttgtagtgacagggtctcactatgttacccaggctgattttgaactcctaagctcaagcgatcctcccacctcaggctcctgagtagctgggactacagtcttgtgccaccactcctggctaattaattttttttttttttgtagagagggggttctgctatgttgcccaggctgggtgaactcctgggttcaagtgatcctcccactttggtcttccaaagtgttggggttacaggcatgagccactgtacctgtcttagtttatgttttaaagtca

SEQ ID NO: 85281 - DNA, 601 bp, Human
accctctgttgaaacacaggaatctaaaaccattcattgatactttttgagtgattatactgaaaacaattgcatgttgtctcatgcagaattttcgtgttaaaccctgtgttgcaaggatgccattaaccagcacacagatggcggtggagattgattgattgagatggggtttcgctgtgttgcccaggctggagtgcagtggtgtaatcgtagttcactgtaactttgaactcctggactccagtgatcctcctgtgtcagttttccaagtaactgggactacagtctcatgtcactrtgcctggctaatttttaaaattattttatagagctggggtctcgctatgttgcctaggctcttctcaaactcctggcctcaaagcgatcctcctgcctcagcctcccaaagtgttgggattaccagcgtgaaccaccacacttggctggggatggagttttagacaccagaggcttccttccgaggttgacctagaaagcacccttggtgggtgccatgggatgggggaatacagtcaaaaggaacctgctcttcccgctgcgcctccacctgaggtggatgtgtctgctggggctgctg

SEQ ID NO: 85282 - DNA, 601 bp, Human
catgttggtcaggctggtctcgaattcctgacctcaaatgatctgccatcttcagcctcccaaaatgctgggattacaggcgtgagctacagtgcccagccagttttcaagatttttaatgcatttggagcagcgctatcctaaagaaccttctttgatgatggaaattttctctatctgcaccatccaatatggtctggtaaccaccagccacatgtggctattgagcacttaaaatgtggctgagactgagaaactaaaattttaattttcttgaaaatgtaaattaattaattaattwatttatttatttatttagagacaaggtcttgctctgttacccaggccggagtgcagtggtgcaatcatagttcactgcagcctcgacctcctgggctcaagtgattctcctgccttagccttctgagtagctgggattacaggcatgtaccaccatacctggctaattaaaaaaaaaaaattttgtagatatggggtctctctatgttgcccaagctggtctggactccaggcctcagcctcccaaaggagaaaatgtaaatttatatagtcgcatgtgattagtggttattgtgttgga

SEQ ID NO: 85283 - DNA, 601 bp, Human
tcaggctggtctcgaattcctgacctcaaatgatctgccatcttcagcctcccaaaatgctgggattacaggcgtgagctacagtgcccagccagttttcaagatttttaatgcatttggagcagcgctatcctaaagaaccttctttgatgatggaaattttctctatctgcaccatccaatatggtctggtaaccaccagccacatgtggctattgagcacttaaaatgtggctgagactgagaaactaaaattttaattttcttgaaaatgtaaattaattaattaattaatttattwatttatttagagacaaggtcttgctctgttacccaggccggagtgcagtggtgcaatcatagttcactgcagcctcgacctcctgggctcaagtgattctcctgccttagccttctgagtagctgggattacaggcatgtaccaccatacctggctaattaaaaaaaaaaaattttgtagatatggggtctctctatgttgcccaagctggtctggactccaggcctcagcctcccaaaggagaaaatgtaaatttatatagtcgcatgtgattagtggttattgtgttggacagcacag

SEQ ID NO: 85284 - DNA, 601 bp, Human
agattttttaacatttctgaaatcagcgtatctaacaattggtgacatagtttactaatttaaactcttggtgaagcatagtgcacattacaagtgataagatcttagatttgatgaaggatgatatgtaaatacgtggataaaggactctaagacagacatgggacgagattgaggaagtgtcagtggagactttgtctgtgtcatctatgttgtcaaattttttttacagtgaaattatattccattattgtgtaacgaaaaattttaaaaatacatatttatattttttagacaagayataattttagacaagataaggttgcctggatgtctctgatgtctgatccatttctctacttgggtgattatgcttgatattcagctttgagaactttaaggcctggatggttgatagagcgttcagcttcattaagaagttaagtagctgtgaagattcagtgggagagaattgagaactgaggtccaagagaagggaggagccgaactccagaattcagggccagttgcctcatggggacctttgcatctgtgtaaagaggttgaaattctctccccacaaggtggtgccaggcttttt

SEQ ID NO: 85285 - DNA, 601 bp, Human
aggcaggcaggagatgacctgccataggttggaggcaggctctgcttggatcctgtgtaaacagggcatagtgtgagtgtctccccataagtaaaagctgtgttgtgaagatgaactcacagtttagtagtgactttttgaccaaagatgactcttcaagaagggataaggtgtatggagtatagctcattgccaggactgtgggaggcagaggaaggagaggacacttggccaagatgccatttgagctggtcactgtaggaaagggagaatttggacatgtaattttttttttttttttaagacagagtctcactctgtcacccaggctggagtgcagtggtgtagtcttggctcaccacaacctctgcctcctgagttcaagtgattctcctgcctcagcctccccagtagctgggactacaggcacatgccagctgcctggctcattttgtatttttagtagagatggggtttcgccatgttgcccaggctagtcttgaactcctgacctcaagtgatctggcctggacatgtaatttttaaggagatattcagaagaaaagggaggtgagcccaccatttacaaatgcacacagga

SEQ ID NO: 85286 - DNA, 601 bp, Human
gggtctcactagagagagctggcatgtggactcctgcaaatggtggaagatattttacaggctgcaggactggaccacagaaaagtgggcagacctttccctttcctcacacttgccgcctttcattccttggacccctctctttttcctcactgctgttcttaggggaaaagcttgacattggataaaatgaatttggatttagactaaatagactttttaataactgaaagtttggctttatttaagataatattttctttttaaaacactgtctagaaatcagtgggtttttttttttgttttttgtttttttttaaagacagagtttcgttcttgttgcctaggctggagtgtgatgacgcaatctcagctcactgcaacctccatctctggggttcaagcgattctcctggctcagcctcccgagtagctgggattacaggcatgcaccaccacgcccagctaatttttgtatttttaatagagatggggtttcaccatattggccaggctagtcttgaactcccgatctcaggtgatctgcccacctcagcctcccaaagtgctgggattataggcatgagccaccacgcccagc

SEQ ID NO: 85287 - DNA, 601 bp, Human
attgtgcacctagagtacctgttttctgcctggggaagaatgcacactgctggacctagagcggtggcaaaagtgccctctccactgtgggggccacagtggtaggcacaacccttatccctcagccccattagttaattaagtcattttacctgcattaaactttacgggcagagaaaattcagtaagtcaccactaccaggtgactttcttttttatgttaccccctagcaaggcatgtagtttgcatcctacagaatataaaagatggggccagcatctattctgtgtcttagcagtraacttcatccaatagatacttgatttttaaatactttcaccttgtgtcatgattaaatcactaaacaggaagtttcagcttttctttaaagaagtacatcctattaaaaatttaaatgtcttcataactgcttacgctcagtaaatgaacactaggaatctataaacaggaatctatggctctaaaaattgaaattttgggggctgtttcattctttagaacttgaaaacgccataggcaattagctataattcatttgcagattatttttgccatgttaaattaggaattttagccata

SEQ ID NO: 85288 - DNA, 601 bp, Human
tgaacttaatcacacctttatttctgtgatcctcccccctttagtaactggggaatgggatgaggaggaatttcttcatcttagtttcagaagtcttcacagcagtggcctctatttgtagtttgatggtctaaggagtttagattgttagagaacttctaccttcactagaattttgaagacgtaacttaaaattacacttactagatgtagaaactggggagacaaaatgagttatttgcacagttaaattattagctagtgaagaagggtttttatttcttatttatatcctgccttytctcaatatgatgatgtccagtaaaaggcatagatagtctaaaagtgaagcaattaaaaatttttctattatgggaatttgacagtacaaaaaaacacagatgtccttgcccattaaagtgaacaccaaggagtccaaaatattttcatgaggtagttttttgccattgcctgtcagttgtgagagatcattgcctcaggccacagcgactaggtgtgtggcagagttaacctgcctgctctctagggaaaccgtcaagaaatgggcaataaattaataagtagaaagtgttctctgagc

SEQ ID NO: 85289 - DNA, 601 bp, Human
tttttatttcttatttatatcctgccttctctcaatatgatgatgtccagtaaaaggcatagatagtctaaaagtgaagcaattaaaaatttttctattatgggaatttgacagtacaaaaaaacacagatgtccttgcccattaaagtgaacaccaaggagtccaaaatattttcatgaggtagttttttgccattgcctgtcagttgtgagagatcattgcctcaggccacagcgactaggtgtgtggcagagttaacctgcctgctctctagggaaaccgtcaagaaatgggcaatamattaataagtagaaagtgttctctgagctccaggcagttgttgattgactgatggaaaaggtaggcggtaggctaatagacgatgacatccaaattcagctgttgcctctcagctgaacccaaccctgggcttctgctgccttttgctccttttccctgagtggtggtggcctgcaggttaaacaggtgggcttgggaattgggctgcctagggtaaatcctcattcccccatttaactcagtctgccagactctgttttcttgtctgtaaaatgagggttaaaagagagtctctgtaaa

SEQ ID NO: 85290 - DNA, 601 bp, Human
gtgccattgccctccagcctgggcaacaagagcgaaactccatctcaaaaaataactaaactaatatttctcttttctcaataataatggcatgaaaagaattttttctgtgccttttcaaaatcccaataccccctcgtggcatttcctatgttgaagttttcaacagccttatcaggaggagaaatgagcttaatttttgagttttagtgcttagggactctgtcttggcttctagagataacttcactgtgggcacccacaaataatatgtttaattttttttctaaaccttttgctsatggtcattgcaatattttcttgattttaatttcctgagttttcttctttcacattttttcttttttttttggtgatatttttccatattccattatctgcatccttctcactctccctgatttttcaaacatcatggactacagatctgcaacctccctggtaattcctcttgggtttgagaggaagtttgtcaagtactggaaacttgaacttgtataaaacagatgtcaccactcattttaatggaagaaggcatggagtaaatacagatagcacataacagctatatgcattctct

SEQ ID NO: 85291 - DNA, 601 bp, Human
aaggatatttcataaacactgcttgcattcctctgggatttgtgctcctagatgacagcatatatatgcatgtgattctgtgtgtgtaaacatgctttaaaaaatttattgaacatagttttcagctgtcttcactcactttaaaccttagtctactttctttttcttttttttttttttttgagactaagtattgctctgtagcccaggctggagtgcagtggcgcagtctcaactcactgcaacctcctccaggttcaaacgattctcctgcctcagcttcctgagtagctgggattayagttgcccaccaccatgcctggctaattttttgtatttttagtagagacagggtttcaccatgttggccaggctggtctcaaactcctgacctcaagtgatccgcctgcttcagcctcccaaagtgctgggattacaggtgtgagccactgtgcccagcctttagtctactttctgtttttacaattccatgccatgtttattgaaagcatgttgttggtttcttttgatgcctcccctgtctttcttctcatcatgattttaaaaattaatactttgtaatatttgagatttttatatc

SEQ ID NO: 85292 - DNA, 601 bp, Human
tgagaaatcaaattccatcttattatttaaattaattcttttttaactgaagaattgttatgtgggtagctttcaacataattttttcaatattagatgcttataactaatgtggatttagttaattcgatgtttatcacatttaattcttatttactacaaaggttaaagcaattttatttcttctggaaacttttaggatcttgtgagtgagggacgtcagccaaaattggcaactttttcaagcaactggctcaagaaattaggaatttctctaataatgagccatcgttttttgaaytcaacaatttaaaagggctgcatagttaggatatgattccagtttcccctcagtgcaaattgatatttttttctgttgacacattctactttgttttcgaagactagtttatagtgttcttttaaaagcaaagaaaatatctttaaaaatcccagctttttggctgggtgcggtggcttcatgcctgtgatcctagcactttgggaggctggggtgggaggatcactggaggccaggagtttgagaccagtctgggcaacacaggcactccatctctttaaaataaaaaataaaaaaata

SEQ ID NO: 85293 - DNA, 601 bp, Human
attatttaaattaattcttttttaactgaagaattgttatgtgggtagctttcaacataattttttcaatattagatgcttataactaatgtggatttagttaattcgatgtttatcacatttaattcttatttactacaaaggttaaagcaattttatttcttctggaaacttttaggatcttgtgagtgagggacgtcagccaaaattggcaactttttcaagcaactggctcaagaaattaggaatttctctaataatgagccatcgttttttgaattcaacaatttaaaagggctgyatagttaggatatgattccagtttcccctcagtgcaaattgatatttttttctgttgacacattctactttgttttcgaagactagtttatagtgttcttttaaaagcaaagaaaatatctttaaaaatcccagctttttggctgggtgcggtggcttcatgcctgtgatcctagcactttgggaggctggggtgggaggatcactggaggccaggagtttgagaccagtctgggcaacacaggcactccatctctttaaaataaaaaataaaaaaataaaaatagccaggcttggtggc

SEQ ID NO: 85294 - DNA, 601 bp, Human
gcttataactaatgtggatttagttaattcgatgtttatcacatttaattcttatttactacaaaggttaaagcaattttatttcttctggaaacttttaggatcttgtgagtgagggacgtcagccaaaattggcaactttttcaagcaactggctcaagaaattaggaatttctctaataatgagccatcgttttttgaattcaacaatttaaaagggctgcatagttaggatatgattccagtttcccctcagtgcaaattgatatttttttctgttgacacattctactttgttttygaagactagtttatagtgttcttttaaaagcaaagaaaatatctttaaaaatcccagctttttggctgggtgcggtggcttcatgcctgtgatcctagcactttgggaggctggggtgggaggatcactggaggccaggagtttgagaccagtctgggcaacacaggcactccatctctttaaaataaaaaataaaaaaataaaaatagccaggcttggtggcccacacttgtagtcccagctactcgggatgctgaggcaggaggattgctggagctcagggattcaaggttgtagtga

SEQ ID NO: 85295 - DNA, 601 bp, Human
gacatcactaagggggttgtagctatacctttcttctttttatctttaattaacatgcattgactgcctggtatgttagaaacagacctgcctattacagtctcattcccttccatactcatccttgcttgtgtggctacctcccaagctaggactgcaagacccttatcactcctgcttactattggtttttgtgtccttttggcaattttctagtggctgcttgaactattggttgtcagattgacctgatttgtttcacttgtaaacaaaatgcttaagccactgttgatttttgtgrcagctcagttgcttagagcaaggtgttaatgagacatcggtcataggtccaggctctgggttgactggtaagctttgctctggcccatggccacagaccctgactcccccttgccagctgtcttgcacatgtagctatggctcattatggggacacagcagggggtggagataagacaaggcaaatctgtcatctctgccagaaaagacaactcctactgataggtcagtaaccttttcattggaagaacagcacgttagtattagcttctgtagatgtgtctaactgagtctttttctt

SEQ ID NO: 85296 - DNA, 601 bp, Human
gtgagagcagatgggaggaaggtctcagcacaggtcaggcctctggctttgctgagagtgatggatgcctttgcagggttttgaacagaggaggcacatgatttgacttaacgttttaacaagctgtttcctgctgctgtgttgagaataagctgtaggcggcaccaaggtggcagctgggagggtattgccacaaaacaagcaagagatatgatggtttaggccagtggtaatggtggagagtgtgagaagaggacagattctggatgtattttgaagtagagcccgcagaatttgttgrtgaacttgatgcagagtgttagaaaaagagaagacttcaaggttattggcctgaataactggaaggatggagttatctatcactgagataaacagaggtaacagaagtaaaggggagagatggccatggtagaaggtggattacacctttaaatttttaaaacatatttttatttaaaatagccctcactccctggcccagtgcacacaaaggacctgatttgcttttaccctgagtttgtcactgtagatatcctggaatacttcgttaaaaactataaataaagtggccataatacgg

SEQ ID NO: 85297 - DNA, 601 bp, Human
taatgaatttgaaagtaactatttatcttgaatgaaattagttttttctacctagagctgggagtttcattttctaatcagaatgtctgatttatttatgtgcctgccaaaaaaatcccaaaatactggccgcctgagttctggctaatgtttccaggtgctctgttttgaaaacattccgtttctaccctgtattacagatgctcttgcgtacagtgaaatcttgtgataaatatttttcagtgaacataaagtatttaaaaaataaacgaatggcagtattagtcatacattgaccgartgccaccagtgtattatttatcatcatatacaggacatagtccaagacacaatccttatttagtggttctgtagtctaattatctgtaaaatggtcatgtcaaaaaaaaccaaggaaccatcagttgggcaaattgtttgcaattatgattaataacttgctgtggttaattaatgggaaaatatatatggcttctaacgggctgctagtttcacatatataagcagtgtgtattcaaaagaatttataccaagtaattatttattactacattctaggtttaattcttacttgtgtttt

SEQ ID NO: 85298 - DNA, 601 bp, Human
tttgtaataatgaaagaaaatgatttcattttagttcttttatttgatgtgacaggaattgattggttagtcaagaaagttggttaaaagcagggaataaaaatgtgcatccactctctgtatgtgttaaatatttattaatattttaacttttgaaatatatcatgtatgtgtatttgccacttgtttgatggaggttccaggcttttctttgagcatgggttggagtttccatcttttttctcaataattttcagtctcagtttctttaaaggcatttgtgaagaatctgaatgtagarttcttctagattgtaatttccccctcgaccttttacagtttttttcactgttaatcaaatccatctaaaagcattcagctacgtgtccatagagactgcaagtctttttttgtgcacatagcttattggatgttggataacaatatttaattaaggttcttgattatagtaacaggcataactgacacaaacaggtttgagaacaagcgcaattaagcacagaactcaacagatggaagcagaagtgcctgggtgccctagacaatagcttatttgccactagtgttgaggattttgtgg

SEQ ID NO: 85299 - DNA, 601 bp, Human
aagatctggccttttagaatatgatttgccagccttccatagagtatactattgaagaaagcaagaaatgtgtgtttgcgggattctgttgctcaggctggagtgcagtggctcaagcttggctcactgcaacctccgcctcctgggttcaagcgattcttctacctcagcctccccgagtagctgggattacaggcgcatgccaccacgcctggctaatttttgtatttttagtagagacagagttttgccatgttggccaggctggtctcaaactcccgatctcaagtaatcctcctgygttggcctcccaaagtgctgggattacaggcgtgagccaccacgcccggctgaaagcatgttcttgaatgtatatgtgtgttctctccccatgtgatttgtaaaccctccaaggcttgggtctcacattctcattctttgaatcttttatggcataatggatagagagtctgtgctcttgtccagttgaagtaagtagtgggcgctcaaaaaatgttgattggccaaaatatctacatcaagtacagtaacgactcatagctgctaacatcttttgagcaattaacatgcaccgtacact

SEQ ID NO: 85300 - DNA, 601 bp, Human
caggtctgacaataatagacctcccatagcttcttcctctaacatccaccccaattatactcacctctgcttcccacttccaaaatgacccttgctcttgacttatatctactgacagaatcccttccctgtcctggttactgtttctaatttagagatccacacaggggtgaagaaagcaggttctgagatgaactgcctgagttggattctgagctctgtcacttgcagctattctctttgggcccattattgaacaatttctgtgctgcacaatttctgtgcctcagcaagactcgarcgtaacactgacctcacaggattgttgaaataatttaagcacttaacacagtacatggcatgtagtaaacatgcaataaacatttactgttatttattaattggagagaatgaagagcacacccgatattatacatatgtacatacatttacatacacacacatatatatatacacacatctgtgtactcatatatagctacataatttggaaaagtatttagaattatatcttttttagaaaatgaaaacaatatatctttttttttcattttttttttgagacagagtctcgctatga

SEQ ID NO: 85301 - DNA, 601 bp, Human
tgtgcctcagcaagactcgagcgtaacactgacctcacaggattgttgaaataatttaagcacttaacacagtacatggcatgtagtaaacatgcaataaacatttactgttatttattaattggagagaatgaagagcacacccgatattatacatatgtacatacatttacatacacacacatatatatatacacacatctgtgtactcatatatagctacataatttggaaaagtatttagaattatatcttttttagaaaatgaaaacaatatatctttttttttcattttttttttgagacagagtctcgctatgatgcccagaccagagtgcaatggcatgcgccaccatgcctgactaatttgtaaaactttttgttgagacgagatcttgctatgttgttgctcaggctggtcttgaactcctggcttcaagcagtcctcctgcctcagcctcccaaactgctgggattacaggcatgagccacagagcctggccaaaaatacatctttttaaatgcaaaacataccaagtaaaattgaacaaaatcctggctggtgaggcaagagtttaaacaagggaggagaagcactgta

SEQ ID NO: 85302 - DNA, 601 bp, Human
ccactctcacaccttagttaacaaataaagccaagaggtttaaaacaacatcatcatcataatagtctctgaaagcacagccagccttcattacccaaagctagactgtctgcactgtattgtcaaatattaatttaaaatcttcttgaccttgacctaaactgataagttataatgatctatttatttatccaagctggactttacaggaatgagaaaaagaaggtctttaaataattgcctcctcctgtgtgtcagcttgagaaattatgacctccattactaatattacagtgatggygaacttgatagataactagagacagggtaatgcaatggttctaaagcctgactaccctgggaaagttaacttcagtttctcatgtgtaaatggagataatgttacctctcttcttgcattttaatcattaactaaatgcttaccagaatatctgttcatagtaagtgctcttaaatgtttgcttttgctcttaaattattgctgtcgctgcttctgctattactgctatgataactactactaactactgcaattgctgtcaccagcaaccactacaattactattattccagttcctcc

SEQ ID NO: 85303 - DNA, 601 bp, Human
gttgggaatcactagagaggcactttgttaattttctttttaaaaaggaatgactaaaggtttgtgacacttgaatgtaagttgattttaaaattccatttttctaaatccagagtagggtttatattgctaatatcatgatatgcttgccaaagagaatagtttgtaaatcctaaacagacttcctgtaaccatgtgttgaatttccagctgtgttgaatcagactttggtccctcttcagaagataaatccaatacctgcagtttctaatggcagaagtggaggagagaagtccctgtscagataagaaactgaaggccctggggcaagcaattgtttcatgaatgtcctttccccagccccgcgccccacccctaagaaatttgtaggcttcatctaccaggaaaacaaaacaaaacaaaacaaaaaaaacaagaaaacacacaccacacaaatgagatgctattgttaaatgcagtatgtaggattagatttgtttccttccaatagaatcactttccttaatcagcacttttataaatggcacacctgcctgattagaacaagttctagactacaggatacagtgtgagcatttca

SEQ ID NO: 85304 - DNA, 601 bp, Human
tgacacttgaatgtaagttgattttaaaattccatttttctaaatccagagtagggtttatattgctaatatcatgatatgcttgccaaagagaatagtttgtaaatcctaaacagacttcctgtaaccatgtgttgaatttccagctgtgttgaatcagactttggtccctcttcagaagataaatccaatacctgcagtttctaatggcagaagtggaggagagaagtccctgtccagataagaaactgaaggccctggggcaagcaattgtttcatgaatgtcctttccccagccccrcgccccacccctaagaaatttgtaggcttcatctaccaggaaaacaaaacaaaacaaaacaaaaaaaacaagaaaacacacaccacacaaatgagatgctattgttaaatgcagtatgtaggattagatttgtttccttccaatagaatcactttccttaatcagcacttttataaatggcacacctgcctgattagaacaagttctagactacaggatacagtgtgagcatttcaattaagtccacacaattaaaaactgttgtggttgatgttcttagaaagactttccttctctcgt

SEQ ID NO: 85305 - DNA, 601 bp, Human
atggcattcgtatttgggacttgggaaaagcattgtggtaaacagcaaagcattacctaaacttcacatttcagtacagtgtaacaagggagagcaaactaaagagacacagaagagtctttttttttttttaagatggagtttcattcttgttgcccaggctggagtataatggcgcggtcttggctcactgcaacctccgcctcccgggttcaagtgattcttctgcctcagcctcctgagtagctgggattacaggcaccatgcctggctaattttttttttttttttttttttttgkatttttagtagagccgaggtttcaccatgttggccaggctggtctcgaactcctgacctcaggtgatctgcccacctcggcctcccaaagtgtggggattacaagcgtaagccaccgtgcccagccagtattcatctttgcttgcttttgtagtattattcatttaagattttgtatttgtttatgcttttctttctccaacatctttttcttttcatttagtttgagttttccttttattaaatagttgcaggccttttggctctcagtggaggcattttctactctgttcctgtactc

SEQ ID NO: 85306 - DNA, 601 bp, Human
ctcctgagtagctgggattacaggcaccatgcctggctaattttttttttttttttttttttttgtatttttagtagagccgaggtttcaccatgttggccaggctggtctcgaactcctgacctcaggtgatctgcccacctcggcctcccaaagtgtggggattacaagcgtaagccaccgtgcccagccagtattcatctttgcttgcttttgtagtattattcatttaagattttgtatttgtttatgcttttctttctccaacatctttttcttttcatttagtttgagttttccytttattaaatagttgcaggccttttggctctcagtggaggcattttctactctgttcctgtactccctgattaattcattctttaaaaaaatcctctaagattaatattcatcatgggggctcagaaaatgaaagtcttttatagagtaattctaaactccagaataattcatttgttctgatgcttattaaggacttgaagttgtttgtttgctctttctgtttttatagccaaataaaattttgcaatactcataataatatttgagtagaactttgtagtttacaaaatactttcca

SEQ ID NO: 85307 - DNA, 601 bp, Human
tacaggcaccatgcctggctaattttttttttttttttttttttttgtatttttagtagagccgaggtttcaccatgttggccaggctggtctcgaactcctgacctcaggtgatctgcccacctcggcctcccaaagtgtggggattacaagcgtaagccaccgtgcccagccagtattcatctttgcttgcttttgtagtattattcatttaagattttgtatttgtttatgcttttctttctccaacatctttttcttttcatttagtttgagttttccttttattaaatagttgcargccttttggctctcagtggaggcattttctactctgttcctgtactccctgattaattcattctttaaaaaaatcctctaagattaatattcatcatgggggctcagaaaatgaaagtcttttatagagtaattctaaactccagaataattcatttgttctgatgcttattaaggacttgaagttgtttgtttgctctttctgtttttatagccaaataaaattttgcaatactcataataatatttgagtagaactttgtagtttacaaaatactttccacactcactcacatttgaa

SEQ ID NO: 85308 - DNA, 601 bp, Human
tataaattttgccatttagcttctagattgtgctttctttccttggttaattggggaaatgttggttttgtatgaaaccaaattaaaaaaaaaaaaagaaatttgccatggtgaattattgggtagactttcttctccagttgtcttttatattttttaattaggcctgttacttttatctctgatttctggcattttattttcaagtttttaatagaaatttagcaaaagaaggaaaaatgggagaaagtaagtgggaatgggtagtcttaagagacccttccccaaatttttactttaraacatttgtgactttgaagagaaggccaggcccggtgactcactcctgtaatcccatcactttgggaggccaaggtgggtggatcacctgaggttaggtgtgcaagaccagcctggccaacatggcaaaaccccatctctactaaaaatacaaaaattagccagacgtgataggacatgcctgtaatcccagctactcgggaggctgaggcaggagaatcactggaacccaggaggtggaggttgcagtaagccgagattgcactactgcactccagctcaggtgacagaccaagatccc

SEQ ID NO: 85309 - DNA, 601 bp, Human
agaccttgcaagtgcttctaaacattttcttataaataccagccatgttcattaagatatggaaataaaaaatgttctgatttttaaggtggagaaaaagtcagcagggaagagaggtgtttgtcttttactcaaagtaacagtggaattggtagaaaacaaattaggtcttttgattttcagccgtgctatttactgcatttagaccatatataaatctctgataataactttaaagttacctcttccagaggtggaaatggtaacaactaagtttgaggacttttcagcctcatatgtrtgcagattgtttaaaataataaattcacttctgagtaagatattatatctataccactaaccatatataattggaaataagatagtaaatgtgaattttgaaaaatatgcttggtcccttgacaggatgatatccttattaagttgattttttagggtggtggttccacatctgtaaagctttctttatataggatatttttaaggaaacaaattatttgttcacaaagtaaagggagcacatattatggattatattaaaaaataatgtatggttgtttttacattctgtctttactat

SEQ ID NO: 85310 - DNA, 601 bp, Human
aaaaaatacaaaaattagctggatgtggtggcacacacctgtactcccagctactagggaggctgaggcaggagaatcacttgaacccgggaggtggaggttgcagtgagccgagatggtgccactgcactccagcctgggtgacagagtgagagactctgtctcaaaaaaaaaaaaaaaaaaaaaaaaaaaaaaaagtctgtcgctaggaaccaggtgcttcttgattaccagattgcagtttatctgattattaactgaaaggaggaaaatttaggactttgcacaatcttcatcagcwacatcagatgcaaaaaccacaatgtaaatgcgcttacagaaaaccatgaagaaatatagtgaatctaaatctatattgttaggtattaaaagattaaggtctgattaaagtgtaaaataactgaatagcagttttggactgatttatatgatttattgacattgaagaatatgattcttttaaaagaagaattttgattatttttctctttttagataatatttttagttatttattaattaccctagtcttatctatactttcctgacctaattatccatgaaaccagtaatcccaagg

SEQ ID NO: 85311 - DNA, 601 bp, Human
gtagtatcttatttgtacagcatgatctggcactaaggccttctacataagagaacaatctgggtaacaaatacattatcttcaaatgctatgtcttttttttaaccattttagtgaaaactgttactagaaactaccttgtattattaaactacagaacacattgaaaccttttctcagtggctccaggccaccatgatgaatgctgtccaccaggatgtgagcaggcaaagtagtgctgagggtgtggtttttttcttttctctttcctgtacacctagcattgcccctactggagtgrgttaagaagtgcagtgaaagatttgaataaagttgaagagactggtgttattccctcagagaaggggaaactaggggaagaattttatagcactcaaagaaaatgggaactggtgtaaacccaatagaaattcagtttaaaaccaaaagaatttcttggctataaaagttttaaggaagatagagtaggctgctgaagaaattaatagcaccttctcttggaagttacttaaagtaatagtagataaatatctttccaaaatgattgaaatccagcctttgaaggtagggatgagtcaca

SEQ ID NO: 85312 - DNA, 601 bp, Human
ccacaaacaagcctcagaaatgtgtttggagggaccatgacagcatctcttagggacttgtgttatttagttttctctctctctctctttttagtggcactaaccaaaaaaaaaaaacaacaacaaactaggctaagcaagtgcagagtcatttataaacttgcataggtcttttatatacagtcatttatcatttaaaaactgagattcattttgagaaatgcaccattaggcaacttcattgtcgtgtgaacatcatagtgtatgtacttagacagacctaagtcgaagtctataggttactacacacctaggctatgtggcatagctgattgctcctaggtgaccaacctggacagcagttactgtactggataccgtaggtgttagtggttgtaacataatggtatttttgtatctaaacatatctaaatatagaaaaggtacagtaaaaatatgctgttataatcttatgggactaccattgaatatgtggtccatcgttgacctaaacatcattatgtggtgcatgactgtatttattgttgattgcccatgtctttcaccaaaagtaagcttcatgagagtgtggactttgctc

SEQ ID NO: 85313 - DNA, 601 bp, Human
tgttgcccaggctggtctcaaactcctgaatacaagcgatccacccacctcagcctcccaaagtgctgggattacaggcatgagccaccacgcctggccctaaacaacacaactataacttcagctggttgtaaggtagttttttggttggttggttggttggttgttggttttttgtttgtttgtttttaaatataatttcatattgggtaaaacaaaaggttttccttaacttgtttagaattgtttaggaaaatactagttaggaatctgattttttttctcccccatggatttgtgsttagcatgtttgtactctaatattcatgctacattttcatgtttaccaatataaaaaccttttttgtaattatttatatggagtcctgctttgagttaacatcatagaggaacgctttttttcagcaaaattgttttaaattaatgtttctaaagtgtataaaaatggttgggtggattaaaagcaattcagtttcacatgaaccatttgtccacatggaaataaatatgcagcacaattacacggcagaaggtacgaaaaggtgttgctgaaatcatgagaaaatgtaatacaggcgga

SEQ ID NO: 85314 - DNA, 601 bp, Human
ggtaagttcttgttaccagaattttgtaacttagacatgaaaattttatccaagtttcaacttggggagcaagcctagggggagccaggtatttaaaatgctttcttttagtgaaaactgaagaattaagttgtcttctatttcaattgtgttattttctatttcaaaaactatttctttttttaatgaatctctaatgtagacttttgcctatttataagagaggaaataattttaaaatgccaaattacttcatctttaaatttttaaaaataaatgtgtttttcctaaaatatcctaraatttaaaagtggtttgaactgtggaaaacttaaaaggtcaaagaggaagaccttcctctgcatgcctttctaatttctgtcatgctgaaggccatagcactggggctttctcattacctaactgaaagtgcctctgggtcacaaatcagagcattaacttagtttggtgataggcagtgggcttcgtgaacaatttggttacttcaacaatttggtaagctattcttacatcaacatatttttaaaaattcttgccttccccaattttagtttgggcataaatgatactgacagagtat

SEQ ID NO: 85315 - DNA, 601 bp, Human
ttttttaatgaatctctaatgtagacttttgcctatttataagagaggaaataattttaaaatgccaaattacttcatctttaaatttttaaaaataaatgtgtttttcctaaaatatcctagaatttaaaagtggtttgaactgtggaaaacttaaaaggtcaaagaggaagaccttcctctgcatgcctttctaatttctgtcatgctgaaggccatagcactggggctttctcattacctaactgaaagtgcctctgggtcacaaatcagagcattaacttagtttggtgataggcartgggcttcgtgaacaatttggttacttcaacaatttggtaagctattcttacatcaacatatttttaaaaattcttgccttccccaattttagtttgggcataaatgatactgacagagtataacatctctcattccatgatcattttatctgtgtggcaggtgcctcattttcctaacaaggaaattgaaggatgaatctatatcatagtcagtcaccttattaaaaaatttttattcttctaatccactagaccaggaactcggttgtggtgacacaccatacactcacaaatactcc

SEQ ID NO: 85316 - DNA, 601 bp, Human
caaagcaatctatgaaaatctagcaagctgggtgcagtggctcacgcctgtaatcccagcactttgggaggctgaggtgggaggatcgcttgagcctgagagtttgagaccagcctgggcaacatagggagaccctgtcttcttgaaaaagaaaaagaaagaacaaaataaagagagaaagagagaatctaactggcttctcttaagccagaagttaaagagatttgtaaaacatgtaaaataatgccactcttttcactataaattttatttatattttagaaagtataggattttttttaatttaaaaaaatgttacataatgggtttatcgttatcttttagatgaattaataaatatttgtcaaatttctcagtaaaattaatagatagagcccttaaaagcaaaagctctctgagtgctgaggccaaagcatttgaaaactaccgatttaaagtataaaccattgctattcaagtgtggtccatggcacaggaagttgttagaggtgcagaatctcaagccccacccctgacctactgaaccggagtccatgctgttaaccagaactagtttgtctgcacaatggaagttgagaag

SEQ ID NO: 85317 - DNA, 601 bp, Human
ttctactatggtccatttacactcttgaatactcctagtttaaagggaaggaattttcattttcaatgagcgttaacattacagttattatgctgggaattaaatttaatttgggaatttgggtctgcaaaaacatatcttgaccttgtctagatagttccttccttatcctaatagatctgtctacatgagataactctctaccacttttattttctcccactgggagagagttaaccatttcaaactcagggctagttaacatgagatttgattcttttactgcaagtagttaagcctyaacagaggtgaggcacactcgggttccatgcagtacagcttagaaatgcttactttttatagacagaaatcacattgttcttcctttccctttaagcagacatcttgacaatcctttgaattgattatgtggcctgtatactgaaagtcagatgtcaccttccccaggataagtacttccagtaaagcaaaagaggaagccagcttttgctacgatcaagatagttgatgtggatgaggggtttatgggctaccccgttttcaattacaaggctcccactcacagagtaagtgctgttgg

SEQ ID NO: 85318 - DNA, 601 bp, Human
aatgcagccattttggaaatgtagataaagaagaaaaatgctgaagatttgggtggtttatggagccgtatgattttgtcattgctgccacctactgtatgtggttgatgtttgtttaaacttaggaagttcatgaaggtgaggctgttgaaatagataattagagcaaggtagacatcattagcttatagcatttcttttctaccccataagtggctcttaattactgagacagccgccagctttcattcattaccttcaagtggatttaaagggctggtttctttttttttttttttttccatttttaaagttcctttgccaaggaaccttcacagtaatgctgtaaaatgcgttcaaaagcttaagatgctgggggattttctgagcatacatgcaataggttgttttaaggagtttgttttgttttgtcttaatttgtaggagcaatattctgggattggattgtaaattaatttctatgaaagaggtgaaaatggagctagtggagctgatgggagttgcagcagttgacttgaaagacattcttttattagtcctaaaacaaagcttcagatcaacctgctagttaaatgtaaca

SEQ ID NO: 85319 - DNA, 601 bp, Human
aaaatacaaaaattaatcagatgtagtggtgtgcacctgtagtctcagcacttttggagactgaggcagctggatcacttgagcccaggagtttgagaccagcctgagcgacatggcaaaaccccatctctacaaaagatacaaaaattagtcagcagtggtggtgtgtgcctatagtcccagctacttgggaggctgaggtgggaggatcacctgagctcagggtgagccatgatcgtgccactgcactccagcctgggtgacagaatgagaccctttctcaaaaaaaaaaaaaaaaaaaggaaccatctaaacttacccacacatcaatattagctttgataatattgcataacataaaaatcagtaaactgactttccttttaagttgacagggacacctctaccccatcctctaaaaaatacactgaacaccagtgaatcgtctttaaaagcacccatccttgcctgtcaggttgagaacgtgtgctcccagctgaatcatgagggtttatggtatactctctctattccctggccaagatgactctattcagaacttactttaatctggggaacaggccatctcatttccctggga

SEQ ID NO: 85320 - DNA, 601 bp, Human
cagaggttgcagtgagccgagatcatgccactgcactccagcctgggcaacagagcaagactccgtctcaaaaataaaaagaatgtggaatccgggggcactggcatggctattacctgccattgtgaatagaaatgtcctgagatgactcttaactcgggcatggtactcggcacttctcaaggaaacattctacatcacatatgtgttcttttcagctggtcggtttgaatgtaatacttgcaggtaagtttatctgtaatccttttattacctaaatcagccagtgcttactctgctrtccaccagttggactagaactcactctattctggcagaagggatatctgttttatgatgattgtgagatcttatttttattctccaaaatagagtttctaataagactattgttctatataaagcttttcctttaaattgaccactgattctagaagattggtgtaatctaaagatcttaagaatacttgggtgcttcatgcatatatttattaatatatatttattaatatgtatatagctattcatctgcttgtataaatatgtacatatttacatttatattaacatgtgcatatag

SEQ ID NO: 85321 - DNA, 601 bp, Human
ccatttatttaaaaaaaaaaaaagctgtatgcagcagaaagccttatacaagttgtttttctttttttcctttttcttttttttggtaccttcatttctgttacttttatataaaattctctgcaaaggaaggcctctctttggactacaatttggaggcagccacttgttgtgcctgcttctgttaaacaatgtggatatcaagcccccccaaattatctgttttaatattgaacctagagctttttttttcccttccctgtccactccatgtaaatgcctttagcatttcagttattgyatattttgtttaaggtgacacttcagcatgccgctaatgtctttgttagtgacagtgcattttgtagtactgtacaagtgttgtgctaacagtaagccatttcttaagttttttgccttgattagggtgccctaatttgagggttttaaaaaaaactatatttttgttaattataaaactgtaaagagctataaaagctattcccatttggttagtcaaaagggttttattgctaaatgtttggtgtaaagttgagacccttttccattttggtgacagatttctttggggaaaaaaggc

SEQ ID NO: 85322 - DNA, 601 bp, Human
actgtttcagtgggaaagtgcattctgcattccaagtcaccaagttccagacaggcacagtagcacacacgtgtgaacagaatccatcagtacagtctggggcccaggcctttgcacaccaacaacttaaggttcttggtaatggcccagcgtgcacccatgaggccactgctcttttacacacgcactcagaacacccacagctttaaaacggcaatcttactacaaaaatgacactttgcatttgcacagcactttgttttttgtgtactttacacatttattacctaatgactgtgtwttttgaaatctccaataactctgggtggtggtaagaataggcatccttaagccaccttgccagataaggaaacttatctgtgttcccctccttcttctcaacagccggctgatggaacccaagccctccacaccagcagtggggccagctgcacagagcggccagaagggagaggccccggggccacgcccttctctctactctcagttcctgactcattgtcacatcatggcgagtaacaggacaaccctccccacagaatcatgggggacactaccttcctgaggccaatgtgttcaa

SEQ ID NO: 85323 - DNA, 601 bp, Human
attaatattttgtggaataaatggttgtttaaagcagcccactagagcctgagactccttttgtgacaatcccgctctcctttaatgaaaaatgtctccgcaggctccaggctctgcacaagcgaagggtgagaacaaaggctccagacaatgcattagtgccagattctaggcccagtggtgtaggaagagcctacagccctcaaaatcaatagcaattatagaagcacatctactttgccaggaaaactacttaaatcagaaattagccaggaaactaacggccatgactgcgagcctratgtcaatcaataccatagtttaatagctcaaagacacaagatgctaaatattgagactccagtgcaagactgagctcctaatcaaagtcagtgagtcagcaatatttcctgggcatttaccacaggcagtctagttggcactgcgggaaattacaaaatctaaacggtctccaaatcacaaacctccaattgtaaaaatgcacatagatgtcacatccttccactgcagatgcaagggacatttttggacaaacccttgacctttagataatcgacagacttggaagaagggaagaaat

SEQ ID NO: 85324 - DNA, 601 bp, Human
gggaaaatataaagtttaaaatccaacaattcacttattttgtctcttttccttctctctccgccagatttaaggtctaaagagcagggattttatttttggcgggggtctgttttgttcactgctgtatccctagtgctcataactatgagtggaacacagtaggtaattaatattttgtggaataaatggttgtttaaagcagcccactagagcctgagactccttttgtgacaatcccgctctcctttaatgaaaaatgtctccgcaggctccaggctctgcacaagcgaagggtgakaacaaaggctccagacaatgcattagtgccagattctaggcccagtggtgtaggaagagcctacagccctcaaaatcaatagcaattatagaagcacatctactttgccaggaaaactacttaaatcagaaattagccaggaaactaacggccatgactgcgagcctgatgtcaatcaataccatagtttaatagctcaaagacacaagatgctaaatattgagactccagtgcaagactgagctcctaatcaaagtcagtgagtcagcaatatttcctgggcatttaccacaggcagtc

SEQ ID NO: 85325 - DNA, 601 bp, Human
agatttggaagtcatctggtagaaccacccagaaggacaaatatgggcatctcctgacccctactgctgacctgtccctggagaaagtagatgaggactgcctctggcaacagcagaagaaaaaagataccaggcagtgaatgggtggaaagaatttttttgaaggactggaatttcctctggtgtggcctacaactagaatagggtgtggcaccagggcaagtgaagaggattctcatgtgaaaaaaaagaggaacattccatttctatttaattctcccaattgaatctggaaggcagyttaagacaccataattttaagcaaaacttccccgaggtaggtaaaatgtgaagtttaggtctgtggaacagctggattaaaggggaaatgaactcccaccaagtttagaaactagtattaatttgggaaaatataaagtttaaaatccaacaattcacttattttgtctcttttccttctctctccgccagatttaaggtctaaagagcagggattttatttttggcgggggtctgttttgttcactgctgtatccctagtgctcataactatgagtggaacacagtaggtaattaatat

SEQ ID NO: 85326 - DNA, 601 bp, Human
tcagggtgtaccctagaagggagatttggaagtcatctggtagaaccacccagaaggacaaatatgggcatctcctgacccctactgctgacctgtccctggagaaagtagatgaggactgcctctggcaacagcagaagaaaaaagataccaggcagtgaatgggtggaaagaatttttttgaaggactggaatttcctctggtgtggcctacaactagaatagggtgtggcaccagggcaagtgaagaggattctcatgtgaaaaaaaagaggaacattccatttctatttaattctcmcaattgaatctggaaggcagcttaagacaccataattttaagcaaaacttccccgaggtaggtaaaatgtgaagtttaggtctgtggaacagctggattaaaggggaaatgaactcccaccaagtttagaaactagtattaatttgggaaaatataaagtttaaaatccaacaattcacttattttgtctcttttccttctctctccgccagatttaaggtctaaagagcagggattttatttttggcgggggtctgttttgttcactgctgtatccctagtgctcataactatgagtgg

SEQ ID NO: 85327 - DNA, 601 bp, Human
agagatcgtgcgactacactccaggctgggtgacagagccaggctccatctcaaaagaaaaaaaaaagaaaaacagcttcagggtgtaccctagaagggagatttggaagtcatctggtagaaccacccagaaggacaaatatgggcatctcctgacccctactgctgacctgtccctggagaaagtagatgaggactgcctctggcaacagcagaagaaaaaagataccaggcagtgaatgggtggaaagaatttttttgaaggactggaatttcctctggtgtggcctacaactagaakagggtgtggcaccagggcaagtgaagaggattctcatgtgaaaaaaaagaggaacattccatttctatttaattctcccaattgaatctggaaggcagcttaagacaccataattttaagcaaaacttccccgaggtaggtaaaatgtgaagtttaggtctgtggaacagctggattaaaggggaaatgaactcccaccaagtttagaaactagtattaatttgggaaaatataaagtttaaaatccaacaattcacttattttgtctcttttccttctctctccgccagatttaaggtc

SEQ ID NO: 85328 - DNA, 601 bp, Human
cacagcacttgctccagcttgtctcttctgtggcctgatctgaatcaatatttgtttgctccctactgacttgttgcagcttcatgctctcacagcctctctctgctggtatcctgatctggggttggagtgggtggaaagagaccggcaggaagaatgatgtcacttggcatgaagcactttcagggttgggaaatccaggccttcaagtctgcaactcaatttcagtgttttatggcccacatattgtattttcaacagggcctggccgcctacagaaaaaagtctaatgtcagtattyaagaccttccacactgtggacttacctacctttccttaaatatcttctatacacacacacatgcatacacgcatcctgcacagaagagttaactggactgttaactcttctccaaacacgctcagcactttctaagttccctccaccaggaacctcaatcttaattagctgacatctgaatgagtctttaggatacaggaaatcataaatgccgcctttctcacacacccctccttgccctgtgcttctgcagctttttgtgtgtctgtgcaacattagagttacatgtgtaaagtctgt

SEQ ID NO: 85329 - DNA, 601 bp, Human
gacacacagcacttgctccagcttgtctcttctgtggcctgatctgaatcaatatttgtttgctccctactgacttgttgcagcttcatgctctcacagcctctctctgctggtatcctgatctggggttggagtgggtggaaagagaccggcaggaagaatgatgtcacttggcatgaagcactttcagggttgggaaatccaggccttcaagtctgcaactcaatttcagtgttttatggcccacatattgtattttcaacagggcctggccgcctacagaaaaaagtctaatgtcagyatttaagaccttccacactgtggacttacctacctttccttaaatatcttctatacacacacacatgcatacacgcatcctgcacagaagagttaactggactgttaactcttctccaaacacgctcagcactttctaagttccctccaccaggaacctcaatcttaattagctgacatctgaatgagtctttaggatacaggaaatcataaatgccgcctttctcacacacccctccttgccctgtgcttctgcagctttttgtgtgtctgtgcaacattagagttacatgtgtaaagt

SEQ ID NO: 85330 - DNA, 601 bp, Human
ggcagaattttcttactgaaaacaactactctgacttcagtgtacttactgttttgaatgaaaataaaaaataaagcctacatgctgtatgagacaatttcacctctactcactcctcatcaccgtataaaactcataaatccattaaaaacagaaccactactccttttctggcagacttctctaaagaacatgaaaatggcagtttgcaccactctttccaacacttcaacctcacccagcttgccgactggtttcaactctccaacaagaaaaaaaaaaaaaatcagcaaattcaatmtgttgatgagtacatctacatacacatcagtgccgtgccttccattcccagggagggcagggtcactagacaacatcattaaaatgaccctttatcagagaacgtttttctgtttaaggaaataaactagaggtacagggagactcactgataagagccatacccacctcaaactggtttaaaatcattcactacttgggtaggaaaacaggtcacttggccccaccctaatgaaaagaacagtttcttctgccttgaaaaggctgataaatgagactgtgaatgcctggctaaaaaagc

SEQ ID NO: 85331 - DNA, 601 bp, Human
aataccaggactccctgtatgcccagggaaagcggcgttatgacaagaagcagagtgactatggtgggtagactaaggcaattttctggaaaacgggtaaaattacaaaggaggttgtgctgaggcttgagtgtgctgaccccatctgcagatctaagaaaatgctggctgttaagacatgcaaacattttcaactgggaggagataacaaaagaaagggccaagtgatccagttctaagcatcatcttttgttttattatgaggacaataaaatcttgaggttatgtccaaaaaacaaamcaaaataaaaagaaataaaatacagtgcttgcttcttcactccatcaaatcccctagcaatgcaaagtcattttgcatatgatctattattcgctggaaggaacagttggctttgcgattcactgtttgttaaaacattagtttaatatagcatatttgactaatgagaatgtgtcagtgtgctgctatccttgaaagcaggaaaaggaagtcttggcagtgctactgtaggttacaaacactggtaatacgcaaggaattaatcaacgaacccataccaagcatacgctgagcctgcac

SEQ ID NO: 85332 - DNA, 601 bp, Human
aacagggtcaccacgacccctactctacagaactctatcttgcctttcactgccagggcactttttgataccacttcattcatccattcggcagaatgttttaagtgccctacacgtgccaagtattcaaatggtgaatgcataggtacaattcaaagcagtagaaagtatatggttgacctcatcttccctacatagtcccagtccccctacagatttcagattatctttacataatgcaggtgctaaatcaacttgaaaacaatgagttgctattttgcataacatttatactatgtayaaccattttgcagaaaaaaaaaacaaaacacaaacatcacaataaccacaaagtcacacttaccacaaagcagtatctatgaaatttgacattatcccatgcaggtgccttttgtatccatataaatatttcctacttcatgtgagtttaatggcaaacattttcaccctagaaataaaatatggccactttcctcccatgccgatagcattccggaaaacatggtgaacattcctaaaacccactgggctttctgtaagaagtgtggcaagcaccaaccccacaaaacggcacaatacc

SEQ ID NO: 85333 - DNA, 601 bp, Human
tgttgtcatctgctgtgcagaattctagtctctaccataaacaggcaagaaataaaaaatgccaaacgtaaaacaaaagcaaaaccagggaactagcaagtcagagttgcaaacagagttgtttccacttagagagtatagattaaattccacttgtttatgaaatcagacacctcacattggttccgatgtttagaaaatctcaactagaggcacggtaacttttcattgtgttgttctttcaagttgtctttccagctctgagctttgtagactgctgcctacccgtgtcccacatggkactccccagtactgtgcagatcaaagacaatctgataggcttctttacactctccattcatgttaattcttctcccacagccacaacaccttgaggagactgttaaaagccccacaaatcttcctttcggtttcaccattcataactgtgctgctctttcatcaaatcagtcctgcatgccaccaccaactaaatctccccatttaatcttgtcaaaatcatttgacatcattcaaaatcagtcctccagcagagcccagccttcaaagatgagcatcagaatcctgtaaacagtaaaca

SEQ ID NO: 85334 - DNA, 601 bp, Human
ttgcccaggctggtcttgaattcctgggctcaagcaatccctccgccttagcctaccaaagcactgagattacaggggttagccaccacacctagaccttttttttttttttttttgtctgagacagggtttctctctctgttacccaggctggagtgcagtggtgcaatcatagctcactgcagccttgatctccaggactcaagagatcctcctgcctcagcctcccaagtagctgggactacaggcgtgtgccactacacctggcttttttttttcagtagagataatgtcgcgttaygttgcccaggctgacagtcttcttgacagagcaagaaatctctaacttcaacatggaccaagaaacattctagagggtctcatcagtatccctcagcccgagaattaccgaagcagaggtgaaactcctaggatggacatcaaaccacccaagccctggccttaactatcacccctggactcagtcagaactggaccaggtctgcagcaggggataaactgttgtcatctgctgtgcagaattctagtctctaccataaacaggcaagaaataaaaaatgccaaacgtaaaacaaaagca

SEQ ID NO: 85335 - DNA, 601 bp, Human
gtagagacaaggtcccactgtgttgcccaggctggtcttgaattcctgggctcaagcaatccctccgccttagcctaccaaagcactgagattacaggggttagccaccacacctagaccttttttttttttttttttgtctgagacagggtttctctctctgttacccaggctggagtgcagtggtgcaatcatagctcactgcagccttgatctccaggactcaagagatcctcctgcctcagcctcccaagtagctgggactacaggcgtgtgccactacacctggctttttttttttagtagagataatgtcgcgttacgttgcccaggctgacagtcttcttgacagagcaagaaatctctaacttcaacatggaccaagaaacattctagagggtctcatcagtatccctcagcccgagaattaccgaagcagaggtgaaactcctaggatggacatcaaaccacccaagccctggccttaactatcacccctggactcagtcagaactggaccaggtctgcagcaggggataaactgttgtcatctgctgtgcagaattctagtctctaccataaacaggcaagaaataaaaaa

SEQ ID NO: 85336 - DNA, 601 bp, Human
ctgtgtccagcccaataatttatatattgatcatatattacaattacaactatgatatgttgaatatatcttatttccatttaatttcctttttcctttttccattttttttccttttttttttaatgtttcagtagagacaaggtcccactgtgttgcccaggctggtcttgaattcctgggctcaagcaatccctccgccttagcctaccaaagcactgagattacaggggttagccaccacacctagaccttttttttttttttttttgtctgagacagggtttctctctctgttacscaggctggagtgcagtggtgcaatcatagctcactgcagccttgatctccaggactcaagagatcctcctgcctcagcctcccaagtagctgggactacaggcgtgtgccactacacctggcttttttttttcagtagagataatgtcgcgttacgttgcccaggctgacagtcttcttgacagagcaagaaatctctaacttcaacatggaccaagaaacattctagagggtctcatcagtatccctcagcccgagaattaccgaagcagaggtgaaactcctaggatggacatcaaac

SEQ ID NO: 85337 - DNA, 601 bp, Human
cccagcactgtgggaggccgaggcaggcagatcacgaggtcaggagatagagaccagcctggccaacatggtgaaaccccatctctactaaaaatacaaaaattagctgggcgtgggggcgggcgcctgtaatcccaactactcgggaggctgagacaggagaatagcttgaaaccagaaggcagaggtagcagtgagccaagatcacaccactgcactccagcctgggcaacaagagcaaaactccgtctcaaaaaaaaaaaaagacaatttagaatagtcttgctctgtagcagaaccrtccaatacagtagccaccagcctcatgtggctacaaagcatctgaaatgtggtcagttcaaactgagatgtgctataagtgtaaaggacattctgaattttgaagacatagtatgaaaaaaatatataaaatctctcatttataatttctttcttggtaaaggcagggtcttgctatgttgcccaggctggtctcgaactcctagcctcaagtgatccaagcactgagattacgggcataaaccactgtgtccagcccaataatttatatattgatcatatattacaattacaactatga

SEQ ID NO: 85338 - DNA, 601 bp, Human
ttggaagatattaaagtatttatgagaaagacgatggacagattttctgaccttaactcattccataaaggactgaatctgttgtatttaagatttgaaatggttgaaatgaagtcatcttccagttaatatacttaatggggcagcaaaacaatagcctgatgaattggctttccacctttgcaatcatacagttctcggaattgatacacccaatccctgccaataaggagtgctcaattggtggtaaatttatctcaacagagacaagacaggtcatcaacataatcaccccaagaakaaagaaaacagagtagagctgcgtcctgaaatagacaggaacgacatttaaattgcagtgactcctgctttggtctctttttgcttaatattctttgatcaaggaaactgcacacatgcaaatacagctttctattctcttcactttgtttagtctaaatattttcataaaactggtttggcgagagtatgtgacatagatatttgctaacttataggaacattttggactaagcagatcccaggcctggtgtgggaagaaagtggggaaatgtaagaggagaggattcgcctttagttg

SEQ ID NO: 85339 - DNA, 601 bp, Human
aacatattgagaaggacctgaaagctacgatgtgaatcgaaattagtagcattttcatgttgccctaattcttaattggaatctttattattacccataattactttcttagtccaatgatacttggaagatattaaagtatttatgagaaagacgatggacagattttctgaccttaactcattccataaaggactgaatctgttgtatttaagatttgaaatggttgaaatgaagtcatcttccagttaatatacttaatggggcagcaaaacaatagcctgatgaattggctttccasctttgcaatcatacagttctcggaattgatacacccaatccctgccaataaggagtgctcaattggtggtaaatttatctcaacagagacaagacaggtcatcaacataatcaccccaagaagaaagaaaacagagtagagctgcgtcctgaaatagacaggaacgacatttaaattgcagtgactcctgctttggtctctttttgcttaatattctttgatcaaggaaactgcacacatgcaaatacagctttctattctcttcactttgtttagtctaaatattttcataaaactggt

SEQ ID NO: 85340 - DNA, 601 bp, Human
aaacagatgcaattcccatcttacgactgtaaaaactaaacctcagagatggtctgccttgggttgggatggactactaaactagccagtctttctcttcctctgtgtaaacagaacctggggagactgatgtgtgaatgcaaaaacaaaatgttccccatggctaatgcaacctgttcagacaggataaaactgagtcttctacttctcataaaaggtgatgggcttgccgaaccagccactacttctgtatttctcacaagtaattaaacatattgagaaggacctgaaagctacgatrtgaatcgaaattagtagcattttcatgttgccctaattcttaattggaatctttattattacccataattactttcttagtccaatgatacttggaagatattaaagtatttatgagaaagacgatggacagattttctgaccttaactcattccataaaggactgaatctgttgtatttaagatttgaaatggttgaaatgaagtcatcttccagttaatatacttaatggggcagcaaaacaatagcctgatgaattggctttccacctttgcaatcatacagttctcggaattgata

SEQ ID NO: 85341 - DNA, 601 bp, Human
atttccttcaaattgaactactaggaacagctgaagtattaagaaagaggagaaccaaatgatgactgtctgaattgtccccatcttccttagatgtacaaggatagagagtaatatggttatccagagagatgtccaacttgcaaaaattatataaagtgaaagtgatatacttacatcaccctccaagctgagcttgcacaggatttcgtgaacagtagacattttgaaggaagctggaaaaaaagaacaacaaaaagtctttatgaagaggctcttctttactctgaagcacagcgaytcattatgctaatttctactccttggaccatttcatctgacgatattggagtagtttttgcaaacagatgcaattcccatcttacgactgtaaaaactaaacctcagagatggtctgccttgggttgggatggactactaaactagccagtctttctcttcctctgtgtaaacagaacctggggagactgatgtgtgaatgcaaaaacaaaatgttccccatggctaatgcaacctgttcagacaggataaaactgagtcttctacttctcataaaaggtgatgggcttgccgaaccagc

SEQ ID NO: 85342 - DNA, 601 bp, Human
gatcaaaaccatcctggccaacatggtgaaacccagtctcaactaaaaatacaaaaattagctgggtgtagtggtgcacacctgtagtcccagctactggggaggctgaggcaggagaattgcttgaacccaggaggtggaggttgcagtgagccgagatcacgccactgcactccagcctggcaacagagtgagactccatctcaaaaaatgaataaattaataaataaaataaaagtataagtcttcatctggaataacttcctggacactgtaagaaatccaaaagatgcagaattakttttgatatggctgtggcttatgccaaccagtaataaaatcccaggacatgacattaaaagtcatgtaccatcataacagttattaccaatgacatgctaagtatggcagaataaaattccagccattccagtgtcactaattctgtccaattttaatgtgaggccaagaaaagtttccagtgccatgatatttccttcaaattgaactactaggaacagctgaagtattaagaaagaggagaaccaaatgatgactgtctgaattgtccccatcttccttagatgtacaaggatagaga

SEQ ID NO: 85343 - DNA, 601 bp, Human
ttctaaattccctaatagccacagaaaaaaaggaaacagatgaattacaataatttcattatattcttggttttttaaaagaaatatcctagcttttttagagaaaatattttccaggtgtgaaattttttaaagtataggtcctcgagccaggcatggtggctcccacctgtaatcccagcactttgggaggccaaggcaggcagatcacgaagtcaagagatcaaaaccatcctggccaacatggtgaaacccagtctcaactaaaaatacaaaaattagctgggtgtagtggtgcacrcctgtagtcccagctactggggaggctgaggcaggagaattgcttgaacccaggaggtggaggttgcagtgagccgagatcacgccactgcactccagcctggcaacagagtgagactccatctcaaaaaatgaataaattaataaataaaataaaagtataagtcttcatctggaataacttcctggacactgtaagaaatccaaaagatgcagaattagttttgatatggctgtggcttatgccaaccagtaataaaatcccaggacatgacattaaaagtcatgtaccatcataaca

SEQ ID NO: 85344 - DNA, 601 bp, Human
attcattgcattttaatttcaatcaaagaatattttgaaagatctgtcggatatggctacaaaccagtatcagtgctgagtttgcgtaaaagccatttctgccaggatgacctggaagatgtatagtaccattagctattttacatattcataatttatattccacttgattctaaaagtatttgaaataattttaacttcacatatagcttaaattttttatttgtaaaaaaaagaaacaaatgcaacagaatttctaggttcacatatttcctatgaaagaaaattcagtttagttctmaattccctaatagccacagaaaaaaaggaaacagatgaattacaataatttcattatattcttggttttttaaaagaaatatcctagcttttttagagaaaatattttccaggtgtgaaattttttaaagtataggtcctcgagccaggcatggtggctcccacctgtaatcccagcactttgggaggccaaggcaggcagatcacgaagtcaagagatcaaaaccatcctggccaacatggtgaaacccagtctcaactaaaaatacaaaaattagctgggtgtagtggtgcacacctg

SEQ ID NO: 85345 - DNA, 601 bp, Human
tgtctgacttcaacatgcagtttgtattgttcccaaaaacagcatgcacacgtttcaagaagaaaaaagattttaaaaaaactctataggctttatactccatacaacctgtgctttcacaggctccattaatttgaacattttgatggcaagtaccatgaacaatacagagggtcttgcaccatgtgacccaagtcactgtcaaccctctgttgagtgattcattgcattttaatttcaatcaaagaatattttgaaagatctgtcggatatggctacaaaccagtatcagtgctgagtytgcgtaaaagccatttctgccaggatgacctggaagatgtatagtaccattagctattttacatattcataatttatattccacttgattctaaaagtatttgaaataattttaacttcacatatagcttaaattttttatttgtaaaaaaaagaaacaaatgcaacagaatttctaggttcacatatttcctatgaaagaaaattcagtttagttctaaattccctaatagccacagaaaaaaaggaaacagatgaattacaataatttcattatattcttggttttttaaaagaaata

SEQ ID NO: 85346 - DNA, 601 bp, Human
cattgagccatatcatgtatgactgcatttaccaggagatatgtcgtcttgttccaaaaacaacagtgagggggaaaagttttgtgtcattttatagtgtctctggaaatgaaattaaatcgagaattgaacctattacctataaaatccacttgtctgaaatgaaattagtgagacaaagttatcttttctttccttaaaataatggggaacatgtgacattttctatttctgccccacctctccacacataagaaatatactagagtaacttcagaggctacacaaaaagccctcttayaaaacctgatagcaaatacaatctaagtccattagagaaacaaattatttagcacctgaatttgtctgacttcaacatgcagtttgtattgttcccaaaaacagcatgcacacgtttcaagaagaaaaaagattttaaaaaaactctataggctttatactccatacaacctgtgctttcacaggctccattaatttgaacattttgatggcaagtaccatgaacaatacagagggtcttgcaccatgtgacccaagtcactgtcaaccctctgttgagtgattcattgcattttaattt

SEQ ID NO: 85347 - DNA, 601 bp, Human
gagggaaggaaggaaaggaggcatgggttgagctaggtctggatctactccattaaagctcgatgacaatttcaaatcgccaacgtatggcgatttgagggagaataaagagacaaccaaaaatgtctcagtaagaccctgacaagaagaggacaaatgtatcacctacctttggtcttgatggctgtttcaatgttcaaagcatcccgctcagcatcaaagttagtataggctttgacagacccatatgcacttgggggtgtagagtgctgaggttaaaagataaacatactcaaatgayacacatttaaaatcctcttgttgaaataacaatgcctaatatgttttcctattgtttcttttaacaattcagatcattctcatactaggtaactaggtaggtattaacacaccatcacacttcacgcaagcaatttcattttttctaataagaattcttcaaaggctcagctagtttagaatatgctgtctcaatttcaacttctcatcttacttttagtgagagatcaaaagtagacaatgcaaagctggagacctgaagccagcatttactcaggatggctctgaagaccattaaact

SEQ ID NO: 85348 - DNA, 601 bp, Human
tgaaaggaagtgctttatccaaggggggaaaagtggagaatcacaaaagtcaccacgagagctgcaatatttttcagggattcaggggatgggacaaccccaaggattgcttaattaatataagcccagaaagtctgaacatcctattttgtagacccagaaaacaatataatgaccataagaagctcttgctcaaccctaaccagttagcactttatttgctttatttcaagaggaaggcttttacgcctcctggtcttctcttactcatcctagaacttgaggaaatacactcattctkacagctcttctaattccagctccaggcctaaggagcagcagaacttaccggggtttaaaaaaaacaaaaaaagtctgaatttttcactctctagatcaatctaagagcaatgcagtaagattttcccagcaaatgtaattaaattaaaggggacttggaacaaaaaatgcccttagggaccactatgaccaacttcttccttgcagaagagggactgaagcctcaaagtgaagagctgcacccaaaagcatacccctaggaccagatccggctcccagactgattccttttaaccattac

SEQ ID NO: 85349 - DNA, 601 bp, Human
gtctttcaacgaaccgtatgtgaactatataagtgtgtcagtaagttaaaacgctgtacatagaagagaaaaatgtgacatggctcttcaccaggggcacgaaccagcagcagctctaattgtgctgggtcacgtctgcatcccaatctggcctcatggtgaaaggaagtgctttatccaaggggggaaaagtggagaatcacaaaagtcaccacgagagctgcaatatttttcagggattcaggggatgggacaaccccaaggattgcttaattaatataagcccagaaagtctgaacaycctattttgtagacccagaaaacaatataatgaccataagaagctcttgctcaaccctaaccagttagcactttatttgctttatttcaagaggaaggcttttacgcctcctggtcttctcttactcatcctagaacttgaggaaatacactcattctgacagctcttctaattccagctccaggcctaaggagcagcagaacttaccggggtttaaaaaaaacaaaaaaagtctgaatttttcactctctagatcaatctaagagcaatgcagtaagattttcccagcaaatgtaatta

SEQ ID NO: 85350 - DNA, 601 bp, Human
ctgagtagtaacttttggcaagaatggtcatttaaatgcaccaaaaaaaaaaaaaaaagaaaaaagattgggctgggtgcgacggctcatacctgtactcccagcactttgggaggccaaggcgggcggatcaccagaggtgagggagttcgagaccaggctgaccaacatggagaaaccctgtctctactaaaaacagaaaattagctgggcatggtggtgtgtgcctgtaatcccagctattagggaggctgaggcagaagaatcacttgagcccgggaggtggaggttgcagtgagcygagatgatgcccttgcactccagcctgggcaacaagagtgaaactccatctcaaaaaaaaaaaaaaaaaaaaagattttttttttaaaggtctaatttggatgcttcattattctgccctcagctgtgcagacagtcatctggggggtggtccacagcaactgcagaacataaggcttccccaaggcagatgatgcaaataaatcctcacatcttgttagaaccatagaacgttaagcgggtttttctactctacttcctgtctctggaaacaaggtcaccagattctacatggttttag

SEQ ID NO: 85351 - DNA, 601 bp, Human
tgattaaaagaaatcataggccaggcctatgatttcacacctgtaatcccagcactttcggaggccaagacaggtggatcacatgaggtcaggagttcgagacgagcctggccaacatggttaaaccctgtctctactaaaaatacaaaaattagccaggtgtggtggtgcatgcctgtggtcccagctactcaagaggctgaaacaggagaattgcttgaacccaggagggttctgccaggaggcagaggttgcagtgagtcaagatcatgccactgcaccccagcctgggcaacagagygagactccgcctcaaaaagaaaaaaaaaatggttgtggttgtgatcacatagcatataccatcccatttctatttcttgatgcaactgacacatttaaggtgaatggatgttaaaatgagtgttagggaagttactgtggtgatgactgcacaactctgcaaatacactactaaacacactgaaatgtacactttatataggcaaatcgtatggcagattaactgtatctcaataaagatgttgaaaattattgacaaactttatttttcctatctacattctgcagacattctatgtaa

SEQ ID NO: 85352 - DNA, 601 bp, Human
ggaggtatattcattcagttgagcacagcaattaggaatatattctctcgagggtgccaggaggcagactggctgggaaaagtagcctctctcctctaacagagggctgcaagtgaggagctttagctcacaccaagaagagcaggtgtgactgacagttcgtctgtgagaacagccttcgtgactcctgcagccatgccctggccatggcaagcagtgcccccaaacaggtctctgaccagctctaccctcctcgccatcatcccactccaggcctgctcctgtgcaccatccgtgtacycgacagcagctgattaagcctcctccaaggtggcctgctcccagctcttcttcctgagagcacacagaccacagggaaatcaatggaacattacatggagtgggtagcgtcccggcacactcacacacacgtgtgtacacacggctacccccgtctaggagagaaagagggccagtcatcgtcacatggtcctctggcttttgtttctatcaatacttgaggtttataccgtgtcctttgatgtcaaggaaacaccaactacttagtattgtctcttcccgatgaagggttagaggtggg

SEQ ID NO: 85353 - DNA, 601 bp, Human
ctcaaaaaaaaaaaaagaagacgacgacgacagatgccataacagctcacaggagaggggtgacaagagttaggggaaggggtgaataagagctgcctcccaagcactggaaagtgagccaggacaggtatttttggttttgtctgcacacctggaggtatattcattcagttgagcacagcaattaggaatatattctctcgagggtgccaggaggcagactggctgggaaaagtagcctctctcctctaacagagggctgcaagtgaggagctttagctcacaccaagaagagcaggtrtgactgacagttcgtctgtgagaacagccttcgtgactcctgcagccatgccctggccatggcaagcagtgcccccaaacaggtctctgaccagctctaccctcctcgccatcatcccactccaggcctgctcctgtgcaccatccgtgtactcgacagcagctgattaagcctcctccaaggtggcctgctcccagctcttcttcctgagagcacacagaccacagggaaatcaatggaacattacatggagtgggtagcgtcccggcacactcacacacacgtgtgtacacacggcta

SEQ ID NO: 85354 - DNA, 601 bp, Human
atgccataggccaggcgcagtggctcacacccgtaatcccagcactttgggaggctgaggcaggcggatcacctgaggtcaggagctcaagaccagcctgaccaacatggagaaacaccatctctactaaaaatgcaaaaaaaaattagccgggcatggtggcacatgcctgtaatcccagctactcgggaggctgaggtaggagaatcgcttgaacccgggaggcgaggttgcagtgagccgacattgtgcattgcactccagcctgggcaacaagagcaaaactctgtctcaaaaaaaraaaaagaagacgacgacgacagatgccataacagctcacaggagaggggtgacaagagttaggggaaggggtgaataagagctgcctcccaagcactggaaagtgagccaggacaggtatttttggttttgtctgcacacctggaggtatattcattcagttgagcacagcaattaggaatatattctctcgagggtgccaggaggcagactggctgggaaaagtagcctctctcctctaacagagggctgcaagtgaggagctttagctcacaccaagaagagcaggtgtgactgacag

SEQ ID NO: 85355 - DNA, 601 bp, Human
ctcctcaaagaacaaaggcagaggcatgctctgtagagggccgtgaacagagccagagacgaggctagaaagatactctgtaaaggctgaagcagggaggtcccttagaagacagatgccataggccaggcgcagtggctcacacccgtaatcccagcactttgggaggctgaggcaggcggatcacctgaggtcaggagctcaagaccagcctgaccaacatggagaaacaccatctctactaaaaatgcaaaaaaaaattagccgggcatggtggcacatgcctgtaatcccagctackcgggaggctgaggtaggagaatcgcttgaacccgggaggcgaggttgcagtgagccgacattgtgcattgcactccagcctgggcaacaagagcaaaactctgtctcaaaaaaaaaaaaagaagacgacgacgacagatgccataacagctcacaggagaggggtgacaagagttaggggaaggggtgaataagagctgcctcccaagcactggaaagtgagccaggacaggtatttttggttttgtctgcacacctggaggtatattcattcagttgagcacagcaattaggaatatat

SEQ ID NO: 85356 - DNA, 601 bp, Human
gtacaaccatggctcactgtagcctcgacctcctgggcccaaatgatcctcctgcctcaacctcctgagtagctggaagcacaggcactcaccaccaacacccagctaattattaaaaatatttttagggatgaggtctccctttgttgcccaggccctcccaaagtgctgggattacagacaagagccaccacacccagcctggcccaacaatctcattccaacattcttttctcaacacttaccaacatccagtatctcaaattccctctgaaccagccttacctcagtgcattaaaartttagtatatgtttatcctatgagtcaagtttgtacctttttaaaattatactttgatactttttcataccacactccaccatctagctcctacaaaggatatggtacaataatgtgtcaacacgtgtagagaactgggctgaaatttttacatacaaatgcacttacatttggtaatctgtagataatgatttgccacctggtaataatgcatggccactaaagggataacccagttgaggttttcttcagcagaaagagctagaagactctcttctgaggagagacatgaataactca

SEQ ID NO: 85357 - DNA, 601 bp, Human
agacacttgcagggctgagattcaaaccgggactaaagaccctggctcactgcactaggcaactctgcctcctgtgatagaaaattatgcaaaacttgaaaataaagcaagaggaagacagcatatcctccaggtatgtgctggagcactatctcacaggcccaaagactcctgctcaaggggcctgctcttacctgacgtgctacttactactgatttgggcatacactctgtggggttacatgttaacttgtagattttggtccagtagaaaagataaccccaaaggttgtggcttcaytaccctataggacattaatggtcttgtattcagctcaacaatctttccttttttttttttttttttttaaacagggtctcactctgttgaccaggctggagtacagtggtacaaccatggctcactgtagcctcgacctcctgggcccaaatgatcctcctgcctcaacctcctgagtagctggaagcacaggcactcaccaccaacacccagctaattattaaaaatatttttagggatgaggtctccctttgttgcccaggccctcccaaagtgctgggattacagacaagagccacc

SEQ ID NO: 85358 - DNA, 601 bp, Human
ccaacagccgttctgaacaggatgctgactcacatctgccgagacacactgactgcacaaagaaaatggatttcatttgtgtttgatgaaggtctcgggagagtgggggttgacttggaaaacaaaggaaaactgtccagatcctctccttacctagattatggggaagaccacgacttgacttgactaagattactgagcataccagtatcaaagctgagaagaaatcatctttactaaaagaaggtcagaggcatgccacaaagagaggacaatgccacagagttatgggtgtgtacaygtggacgtagttcatttattataataatagtaaccttttgccgggcgcggtggctcacgcctataatcccagcactttgggaggccaaggtgggcggaccacgaggtcaggagtttgagatcagcctcactaacacggagaaaccccatctctactaaaaatacaaaattagccaggcttggtggcacatgcgtgtaatcccagctactcgggaggctgaggctggagaatcacttgaacctgggagacagaggttgaggtgagccaagattgagccattgcactccagcctgggcaaca

SEQ ID NO: 85359 - DNA, 601 bp, Human
ttttttttcaaaactaacagaagttacagttttccaacattggtgaggaaccaagacacaaatgtatttggctcctgataagaaacagcacaaggaaatctttaagcatttactcgttgaacgaaaatagccaactaatctaattagctaactacaacaatattttcaacacctggatcgtgggcacccccagaggtcagtcactgttccaaatgccagtcagtccgaagcaatagctttgccaagggaatgccacggggaggtgttgctgacagcaaggtgccagtagaaacctgggggycatgggtcccataaatcattcaccatatttttcaagcacagagaatatttgcagtttaaaatgatggctggatccaaaaccacaaaatcagcctcctggagtttcctcctcctctctgcgggtggaaaccccaagtcagctcaagcgcctggcattccatggaaaatgtgtgtctttattgtccatggcaaggcaccaacagccgttctgaacaggatgctgactcacatctgccgagacacactgactgcacaaagaaaatggatttcatttgtgtttgatgaaggtctcgggagagtg

SEQ ID NO: 85360 - DNA, 601 bp, Human
caaatgcaaagtctgtgtttgggtcagaatgtggttcttggccccacctgcattaaaatcacgtgaagcacttattaaaaacacagtcccttaggctgcacctgagaactactaaggaaggctctgtagaacttgggaccgaggaagcagcacttcaacaaactccctagtaattccttatttgagaatcaccaacagaaatggataaccatggtgggaaatggaaatgtctctagaaatctacctatctaaaagacttctatgtcacttctaccaactgcttttgtgaggtacaggatcractacaattttaggaaaagaagtgcttacttttgtccaaacaacccaggtaagaagtaacatctaaagagttcactccacaagccgcaatgcagtcccacactcttagccaacgacacagctttttgcccttctttccatagcagctaagtgtccagccagcactgatagaatttaatccaattatcggagatccccataaagagcctgggtggttaacgtgaatcttacctaggaggcagcaacaaccatagtctaaaggaatcaaaatgtattttacctaaattatttaccaagcaaa

SEQ ID NO: 85361 - DNA, 601 bp, Human
tgtgctctctgaaacatgtgctgcgtccactcagggttaaatggattaagggcggtgcaagatgtgctttgttaaacagatgcttgaaggcagcatgctggttaagagtcatcaccactccctaatcttaagtacccagggacacaaacactgcgggaggccgcagggtcctctgcctaggaaaaccagagacctttgttcacttgtttatctgctgaccttccctccactattgtcctatgaccctgccaaatccccctctgcgagaaacacccaagaatgatcaataaaaaaaaaaataaaataaaataaaataaaataaaataaaaagaaatccaattgctggatatgagattcagcttcaaagatgcttatttcagcattgtatacaatattgaaaagtaaagtagaaaaaacacctgtgtccaataagaggctgattaaatgttcttttttccatgtaatgggatactatgcagtcatttaaaatgatggcatggaagtattaattaatgttggaaaatatccacaatataggtactgttaagtaaaaaaaaaaaaaggttgcaaagcagtatgctctgtatactctcatttttgt

SEQ ID NO: 85362 - DNA, 601 bp, Human
tatccccaaccctgtgctctctgaaacatgtgctgcgtccactcagggttaaatggattaagggcggtgcaagatgtgctttgttaaacagatgcttgaaggcagcatgctggttaagagtcatcaccactccctaatcttaagtacccagggacacaaacactgcgggaggccgcagggtcctctgcctaggaaaaccagagacctttgttcacttgtttatctgctgaccttccctccactattgtcctatgaccctgccaaatccccctctgcgagaaacacccaagaatgatcaataaaaaaaaaaataaaataaaataaaataaaataaaataaaaagaaatccaattgctggatatgagattcagcttcaaagatgcttatttcagcattgtatacaatattgaaaagtaaagtagaaaaaacacctgtgtccaataagaggctgattaaatgttcttttttccatgtaatgggatactatgcagtcatttaaaatgatggcatggaagtattaattaatgttggaaaatatccacaatataggtactgttaagtaaaaaaaaaaaaaggttgcaaagcagtatgctctgtatac

SEQ ID NO: 85363 - DNA, 601 bp, Human
gggagggaggtgggggggacagccccccgcccggccagccgccctatccaggaggtgaggggcgcctctgcccggccgcccctactgggaagtgaggagccgctctgcctggccagccgccccgtccgggagggtggtggggggtcagcccccgcccggccagccgccccatccgggaggtgaggggcgcttctgcccggccgcccctactgggaagtgaggagcccctctgcctggccacgaccccgtctgggaggtgtgcccagcggctcattggggatgggccatgatgacaatggcrgttttgtggaatagaaaggcgggaagggtggggaaaaaattgagaaatcggatggttgccgggtctgtgtggatagaagtagacatgggagacttttcattttgttctgtactaagaaaaattcttctgccttgggatcctgttgatctgtgaccttatccccaaccctgtgctctctgaaacatgtgctgcgtccactcagggttaaatggattaagggcggtgcaagatgtgctttgttaaacagatgcttgaaggcagcatgctggttaagagtcatcaccactccctaatcttaag

SEQ ID NO: 85364 - DNA, 601 bp, Human
tcttttgcgcatgagagccacaattcatgaaaagaaaaagcaatgtctgaggaaacaaaaattcaacaagaaatgccctccatccctggaattgcctgtacctttttggtccttctctggtaggcgaaggcaatatcctgtctctgtgcattgctgcggttggtcaaaatgttgacaatggtgacctcatccacacctatggaaatacaagttgttaatcgttactcagtatactctagtattttgggcttacatagaaggtgtcaagcagactttttcaaactgaaatttatatactgtkttccaaactgaaatacccagacaccaagatttgttctatctctttcgtcagcatcctctacccaatgtgtacactctctttccttttttcttgagagcctcaaacctcaagcttaaatggaccttttaaatacttgtggtttaaaaactattttattcataaattggtttctggaatcaacagtaggaggtgcatatgtggggctttggcagtcagatggaacaacagagatttagtaggattttaaatgaaggtccccaaattgccatttaactcgggatttaatagagagtaactgca

SEQ ID NO: 85365 - DNA, 601 bp, Human
agctattaattaaacttattagcgtttatatgccccgaaaaagtagtttgtataatataagctaagcctcaggttaatggttaattttgaattttattcttcatctaacctttgagccaatggctcttctttctgagtttttaatcatgatttgtagaggttccagcaaagccaaaaattctccccttgttagcaaaaggtccatacagcattctacacaaatgttattaaatgactaccgagtatctttgaatattttgagaggcagttgttcaatctcaaggatgatagaaatatagtstaaaaataacacacagtgggagaaatgttatatcctgacattgtagaattgcaagacaggcagaataatgtaagatgtgtttccttccatcactgatataccagtggtaatatctgagaattccaatagtgtttttatgtctacattcaaaggtgaccttggcaatttccaaagcccggcccaaactctccacagactgtccacaattcctatcacaagggcaaattctactgtaacatatggcagatactgccaccggtactgccagaagtcaaaacagatttttttttaagcatagtt

SEQ ID NO: 85366 - DNA, 601 bp, Human
tttgggaggccaaggcaggcagatcacgaggtcaagagatcaagaccattctggctaacacagtgaaaccccatctctactaaaaatacaaaaaattagctgggcatggtagcgggcgcctgtagtcccagctaccctgggaggctgaggcaggagaatggcgtgaacccgggaggtggagcttgcagtgagccgagatcgcgccactgcactccagcctggacgacagagtaagaccccatctcaaaaaaaaaaaaaagtagtgaataggaagaggcagcaatagaatatgccaaaataytaaaactggcaattgccttttgctgtgggtagataaagtaactttttcttattattatttttcactttctacaataaccactcactattttaacagattagaaatttctttgttaaacaattctcgctaaaataaaggaatacagaaattttatgttgtcacttgcagccagcattgttagagtaagtctttttaccaggcaaaggtatagttaagaaaaaatttttagctgcactctttgaaatgtaaaattgggttaatgttaaaaatttcattcttgtccttccatttttgcttgat

SEQ ID NO: 85367 - DNA, 601 bp, Human
gggcacagtggctcacgcctgtaatcccagcactttgggaggccaaggcaggcagatcacgaggtcaagagatcaagaccattctggctaacacagtgaaaccccatctctactaaaaatacaaaaaattagctgggcatggtagcgggcgcctgtagtcccagctaccctgggaggctgaggcaggagaatggcgtgaacccgggaggtggagcttgcagtgagccgagatcgcgccactgcactccagcctggacgacagagtaagaccccatctcaaaaaaaaaaaaaagtagtgaakaggaagaggcagcaatagaatatgccaaaatattaaaactggcaattgccttttgctgtgggtagataaagtaactttttcttattattatttttcactttctacaataaccactcactattttaacagattagaaatttctttgttaaacaattctcgctaaaataaaggaatacagaaattttatgttgtcacttgcagccagcattgttagagtaagtctttttaccaggcaaaggtatagttaagaaaaaatttttagctgcactctttgaaatgtaaaattgggttaatgttaaa

SEQ ID NO: 85368 - DNA, 601 bp, Human
ctttaaaaaatgcttcaccagagcacaagatggtggaactggcatgttggagttcaactgttaatatggttttttttttaaagtagtgaataggggctgggcacagtggctcacgcctgtaatcccagcactttgggaggccaaggcaggcagatcacgaggtcaagagatcaagaccattctggctaacacagtgaaaccccatctctactaaaaatacaaaaaattagctgggcatggtagcgggcgcctgtagtcccagctaccctgggaggctgaggcaggagaatggcgtgaaccygggaggtggagcttgcagtgagccgagatcgcgccactgcactccagcctggacgacagagtaagaccccatctcaaaaaaaaaaaaaagtagtgaataggaagaggcagcaatagaatatgccaaaatattaaaactggcaattgccttttgctgtgggtagataaagtaactttttcttattattatttttcactttctacaataaccactcactattttaacagattagaaatttctttgttaaacaattctcgctaaaataaaggaatacagaaattttatgttgtcacttgcagc

SEQ ID NO: 85369 - DNA, 601 bp, Human
ggagttgttgcagtaatggagatgtgagtgggccggacgcactatctgtcatttgtcatcagggttcccagggtctctcgtccctcccctggcacataagtattaagctacacgctggccagaactagggattcacaggggaaatgccccttcctccatgttaatgtgttaatattagcaatcagctccacaaagacaactccaccccagacaaaggactatatgggcaaattcttccatgagaagtaaacgcagtgaaaaagaaaccagaaggtcacttcccactgggtcctgcatgacmacagatagaggcaaagtgaccttccctaagtcacacggccaaggctctggcacataaatccaggccaggacttgagagccgcccatcccttctctggctcccaaagtccacttgtccatgaggttttgcaggataagaaatcctattatacaaaattgacaactctgcagtgacagtgcaaacccactttcaaaaatgcagctgaatttctgatgcaggcacaggggatttagttaattcactccaagtataaaatgaggtatgtgacttgccttgggaggaagcaagggcaaagaaaga

SEQ ID NO: 85370 - DNA, 601 bp, Human
gtacccagtcctggcctacacaccttacagaatccctgtccccatcccccacaaaaagctgatgagatttagctctttctcacagagagcttgcaatgcagatggaggaatatgtggaaacaaatgtaaagcagcccgggaacccacagcactagaaagacacaaaatgcgggcggaggaagaactctcagagggcagagtcagcaaagagtgtgaacgatgggcctgggcttaagctgaaacttcaagggtcagtcagatgcagctagccaagcagagcgggagagccagctggcacacragggatggcacagcacgctctcaggtaagtaaggagctgccctgtcagagcagagctgagcgggaaagatgagcaaagaagatgcagggagggtttagaggacctttcacagcagttaggagtttaaatttgatgcagcagaaatggggtttgaacagaggagtaaaatggtgaaagtgtatttcacagagatccgtggatggtggtacatggggcaggtggtagcgaagagaggagagcgagggagaatggcataggagttgttgcagtaatggagatgtgagtgggccggacgcacta

SEQ ID NO: 85371 - DNA, 601 bp, Human
ccagagccaacattggccaagtttgtcgtggaacagccataccacctgtcctgaatggcactgcccaggccacatatttggaccatctctatctcccctgagtggaacccattccatccgaaaaccataggaaacagtacagagcatgcaccaaagtccactacttcaacaaataatggcaagacaaaatgatcatcaaacaagaaggagctgcagaataaagcaccaaatgcagaaactatttgcaagagaaaagaatccagaatgggagagaaaggtgagggaaaatgggtgagcctawgagagtgccaagcggagacagaacctcattctggcagactccatcccaacatggacatccacccagccgccccagccagggccccaaggcactgagactccctcagcacagtgcccacctttctggaggtggggcacgctccgctcggtcatgatgctgatccacttgggaacatcagttcctttcctcttcactccagcgtcatagagatcctacgagtacaaccaaccaggaaaagttaactacacatccaatgtaacgtcaaaaaaaatgtcatgcaaaaaaaacaaaaaaagctac

SEQ ID NO: 85372 - DNA, 601 bp, Human
tcacccacctagttttatgcaccataatttttttaaaaattgaggatgatcacagcatcctaggagcttagaggttaccatggtgaccagagccaacattggccaagtttgtcgtggaacagccataccacctgtcctgaatggcactgcccaggccacatatttggaccatctctatctcccctgagtggaacccattccatccgaaaaccataggaaacagtacagagcatgcaccaaagtccactacttcaacaaataatggcaagacaaaatgatcatcaaacaagaaggagctgcwgaataaagcaccaaatgcagaaactatttgcaagagaaaagaatccagaatgggagagaaaggtgagggaaaatgggtgagcctaagagagtgccaagcggagacagaacctcattctggcagactccatcccaacatggacatccacccagccgccccagccagggccccaaggcactgagactccctcagcacagtgcccacctttctggaggtggggcacgctccgctcggtcatgatgctgatccacttgggaacatcagttcctttcctcttcactccagcgtcatagagatcct

SEQ ID NO: 85373 - DNA, 601 bp, Human
gatcacccacctagttttatgcaccataatttttttaaaaattgaggatgatcacagcatcctaggagcttagaggttaccatggtgaccagagccaacattggccaagtttgtcgtggaacagccataccacctgtcctgaatggcactgcccaggccacatatttggaccatctctatctcccctgagtggaacccattccatccgaaaaccataggaaacagtacagagcatgcaccaaagtccactacttcaacaaataatggcaagacaaaatgatcatcaaacaagaaggagctrcagaataaagcaccaaatgcagaaactatttgcaagagaaaagaatccagaatgggagagaaaggtgagggaaaatgggtgagcctaagagagtgccaagcggagacagaacctcattctggcagactccatcccaacatggacatccacccagccgccccagccagggccccaaggcactgagactccctcagcacagtgcccacctttctggaggtggggcacgctccgctcggtcatgatgctgatccacttgggaacatcagttcctttcctcttcactccagcgtcatagagatc

SEQ ID NO: 85374 - DNA, 601 bp, Human
atggccatctgtcacttctgctctggtagctgatgtctaccaggaatgggggccacattcacttacccaggttcaggaaagcattttccaggtctcctttaacctctttcctgatgctttccaacatgtcataagggctgtaactcttgtacctatcaaatactgaggaaaaacaacaaagagttatcagatccgagccactagtcaaagctgtcaatgatcacccacctagttttatgcaccataatttttttaaaaattgaggatgatcacagcatcctaggagcttagaggttaccayggtgaccagagccaacattggccaagtttgtcgtggaacagccataccacctgtcctgaatggcactgcccaggccacatatttggaccatctctatctcccctgagtggaacccattccatccgaaaaccataggaaacagtacagagcatgcaccaaagtccactacttcaacaaataatggcaagacaaaatgatcatcaaacaagaaggagctgcagaataaagcaccaaatgcagaaactatttgcaagagaaaagaatccagaatgggagagaaaggtgagggaaaatgggtga

SEQ ID NO: 85375 - DNA, 601 bp, Human
ctgaaatctatacaattaagactgtaaaactatccaaagcatgcatagaagccacacctcccaaacacatttggattaagaggatggccatctgtcacttctgctctggtagctgatgtctaccaggaatgggggccacattcacttacccaggttcaggaaagcattttccaggtctcctttaacctctttcctgatgctttccaacatgtcataagggctgtaactcttgtacctatcaaatactgaggaaaaacaacaaagagttatcagatccgagccactagtcaaagctgtcaaygatcacccacctagttttatgcaccataatttttttaaaaattgaggatgatcacagcatcctaggagcttagaggttaccatggtgaccagagccaacattggccaagtttgtcgtggaacagccataccacctgtcctgaatggcactgcccaggccacatatttggaccatctctatctcccctgagtggaacccattccatccgaaaaccataggaaacagtacagagcatgcaccaaagtccactacttcaacaaataatggcaagacaaaatgatcatcaaacaagaaggagct

SEQ ID NO: 85376 - DNA, 601 bp, Human
aatgcaatggaaaagggctgcaaaataggacaggctaagggaaatgtagaaatcctctgcaatactaagttccaccacggttttaaaccaggggtctctgaggcctgcagaacccaagtgcatacgtgagtttccacaacacacccctctctcctcctgttctcttactcctccctggcaacaatctgttaccaagttaggcctttcttcagttttatattctgaaatctatacaattaagactgtaaaactatccaaagcatgcatagaagccacacctcccaaacacatttggattaasaggatggccatctgtcacttctgctctggtagctgatgtctaccaggaatgggggccacattcacttacccaggttcaggaaagcattttccaggtctcctttaacctctttcctgatgctttccaacatgtcataagggctgtaactcttgtacctatcaaatactgaggaaaaacaacaaagagttatcagatccgagccactagtcaaagctgtcaatgatcacccacctagttttatgcaccataatttttttaaaaattgaggatgatcacagcatcctaggagcttagaggtta

SEQ ID NO: 85377 - DNA, 601 bp, Human
taataaaagtaaaatgtggccgggcgcagtggctcacgcctgtcatcccagcactttgggaggccgaggcgggcggatcacgaggtcaggagatcgagaccatcctggctaacacggtgaaaccctgtctctactaaaaatacaaaaaaattagccgggtgtggtggtgggcgcctgtagtcctagctacttgggaggctgaggcaggagaatggtgtgaacccagaagtcggaggttgcagtgagccgagattgtggccactgcactccagcctgggcgagagagcaagactccgtctcaaaaaaaaaaaaaaaagtaaaatgtaactgatcttccaagcctcttcgggatgtcagcaagccttgcaggatcatcgtcatgaacaccgatgatcattgtagagtaacagatgtgaaaaatataaaacatctgcctgattgtacaaagtccaggacaaatcacaaatggtgctttcaaaataaatccctgatagttgatgactagcatctcttccccagagagtcagaaaacagaaaatcgccactctgtcatcattctgccaggccacctgccagggcccggggtgctctggacggcagg

SEQ ID NO: 85378 - DNA, 601 bp, Human
catcacatcaaaacagacagatgctaaactgattggagagatgggagttctgaataactgaaagttgttaggcctatcccagaggatttttcaaggaaccaatgcataataaaagtaaaatgtggccgggcgcagtggctcacgcctgtcatcccagcactttgggaggccgaggcgggcggatcacgaggtcaggagatcgagaccatcctggctaacacggtgaaaccctgtctctactaaaaatacaaaaaaattagccgggtgtggtggtgggcgcctgtagtcctagctacttggraggctgaggcaggagaatggtgtgaacccagaagtcggaggttgcagtgagccgagattgtggccactgcactccagcctgggcgagagagcaagactccgtctcaaaaaaaaaaaaaaaagtaaaatgtaactgatcttccaagcctcttcgggatgtcagcaagccttgcaggatcatcgtcatgaacaccgatgatcattgtagagtaacagatgtgaaaaatataaaacatctgcctgattgtacaaagtccaggacaaatcacaaatggtgctttcaaaataaatccctgatagt

SEQ ID NO: 85379 - DNA, 601 bp, Human
ttatccttgctaaccatgggcatgcctttggacatctgaggaacttctagaaaggggaattgcaagggctgtctgaaatctacacagtggtaccactgtgaatgccatcacttccttactgcaaatgcgacatcacatcaaaacagacagatgctaaactgattggagagatgggagttctgaataactgaaagttgttaggcctatcccagaggatttttcaaggaaccaatgcataataaaagtaaaatgtggccgggcgcagtggctcacgcctgtcatcccagcactttgggaggcygaggcgggcggatcacgaggtcaggagatcgagaccatcctggctaacacggtgaaaccctgtctctactaaaaatacaaaaaaattagccgggtgtggtggtgggcgcctgtagtcctagctacttgggaggctgaggcaggagaatggtgtgaacccagaagtcggaggttgcagtgagccgagattgtggccactgcactccagcctgggcgagagagcaagactccgtctcaaaaaaaaaaaaaaaagtaaaatgtaactgatcttccaagcctcttcgggatgtcagcaagcctt

SEQ ID NO: 85380 - DNA, 601 bp, Human
aaaaagcccagactcctcaataacacagaagtagcctcaacgcacaatgaagcttctcccatgacaaagagaagactctgcaggagacctgccctgatacaaaggcctggaaggccacacccaaaccattgccagggaagcctccaggagtgtggtcggaggaggtgctggggaagacactcaaggctccttaggactgtggggtggagggagtgcaaggtgctgaggattgacataggttagtgaccagggctgttcttactgcagcaaggtcctacaaacaccctaactttcctctctygtcctcgtctttccacagaaaacagggtactttcctagctcactctcctatttcctgcattattaaggtcaagtggaaataagctggtgaggtgaggaacaattactaagagtctaactggtcctttgactttaaacatgtgccctaataaacctggctacaaaaaatccagctctaactttatccttgctaaccatgggcatgcctttggacatctgaggaacttctagaaaggggaattgcaagggctgtctgaaatctacacagtggtaccactgtgaatgccatcacttccttact

SEQ ID NO: 85381 - DNA, 601 bp, Human
ccaccggagcgatggcgtttctccgaagcatgtggggcgtgctgagtgccctgggaaggtctggagcagagctgtgcaccggctgtggaagtcgactgcgctcccccttcaggtaggcccgcttgcctgtgccctaggggcagcagggcccaggacgtcccggggttggaatgtagaccctatccttcactttctgcccctcctaggagttcagagtcaccctggttctttgattcagaccgcgaccttgccaaggggacggtggccttgagaccaggcctttatttactctcttaatacsccgtaccttcttgctaccctccactcgcttctcccatccctcctcactgtccagctttggatcctttccgcctcctctgcgaattcgcgccgagtctccggccatcatctaggcattgaggaggcggggcccaggagctggagtatagacgctttccttcactccctgcccttcctaggaggtaagggctttgagacttcagtcctgcagacgctcccctccgtttaggacagggttttaataagtctctagcattcttgttgaaggcgttggatacatagtatcttgatgacatttctt

SEQ ID NO: 85382 - DNA, 601 bp, Human
cctcctaggagttcagagtcaccctggttctttgattcagaccgcgaccttgccaaggggacggtggccttgagaccaggcctttatttactctcttaatacgccgtaccttcttgctaccctccactcgcttctcccatccctcctcactgtccagctttggatcctttccgcctcctctgcgaattcgcgccgagtctccggccatcatctaggcattgaggaggcggggcccaggagctggagtatagacgctttccttcactccctgcccttcctaggaggtaagggctttgagacwtcagtcctgcagacgctcccctccgtttaggacagggttttaataagtctctagcattcttgttgaaggcgttggatacatagtatcttgatgacatttcttatttgggatctgtgttcatatacatgtgaatattgacagttaaacatctgacactggttattttctttttgtttatatgtagttttgtgtatttaccgaggtggttttcatctgtcttggcaagttgtccaaagaaacctgtaagttcttaccttcgattttctaaagaacaactacccatatttaaagctcagaacc

SEQ ID NO: 85383 - DNA, 601 bp, Human
aaaaataatctgttatctacaaagaaactttatgtcttctcatctgcataaataatgagaatatggatgtatggggtggaggtgaagaagtggcagtagtttgaaaatggaagctgattactaaactctcaccttgattagtatatataaggaaaatgtatgttttaatccatatacatctcatcccagagcacattttccacctggtgataaaatctgtctgtctgaagtcatgcagttgcctttccctggcatgtgctatgttgaatttgccagcaatggtttgttgacttacttgggttttttatttatagatatatcaagatgcttatagggcggagtggcaggtatataaagaagagataagcagatttaaagaacagctaactccaagtcagattatgtctttggaaaaagaaatcatggacaaacatttaaaaaggaaagctatgacaaaaaaaaaagtgagtatcattgaaatacttttttcttatggtaaagaattgagatttatataactatgaatataggtagttttctcttaataggcaaataaaatatggtagaatgtcatcaagtattcttcagttaggcagaagtg

SEQ ID NO: 85384 - DNA, 601 bp, Human
caatggtttgttgacttacttgggttttttatttatagatatatcaagatgcttatagggcggagtggcaggtatataaagaagagataagcagatttaaagaacagctaactccaagtcagattatgtctttggaaaaagaaatcatggacaaacatttaaaaaggaaagctatgacaaaaaaaaaagtgagtatcattgaaatacttttttcttatggtaaagaattgagatttatataactatgaatataggtagttttctcttaataggcaaataaaatatggtagaatgtcatcargtattcttcagttaggcagaagtgggatagttctcttatgaaaagtgagatagccactaggaccacttgccattgagtctgtttggaaatccttgttgctacttgcagatgtatccacatttaaggtgtacagttcgtagaacagtaatggaaactacaggaacagagttatgaaacagtcaaaccaggagtatcaagaatctttgcttctgagtcttctttagaataacgtattaatttgaattattctatagattatggtgagtttgatatggaatattgctgagtagactgcattaa

SEQ ID NO: 85385 - DNA, 601 bp, Human; identical to SEQ ID NO: 85381

SEQ ID NO: 85386 - DNA, 601 bp, Human; identical to SEQ ID NO: 85382

SEQ ID NO: 85387 - DNA, 601 bp, Human; identical to SEQ ID NO: 85383

SEQ ID NO: 85388 - DNA, 601 bp, Human; identical to SEQ ID NO: 85384

SEQ ID NO: 85389 - DNA, 601 bp, Human
agaatattaacctgaggatgaaggcaagtcctggaatcccaacatgaaggggccaaatcttttccaaaagaccacttcagacgctacgggcagaatgcccctaccaaccatccacgccaatgaggagcaggcacaacacagaaaacacaagttctcataatttaagatccccactgcgaggccttttcgtgtttctctcccaattatctttgacagtgcactctatttcctttcaccctcttgaatttacggaggtgaaaggtcaaggggagagaatgcctatgagagacagtatgggccsgccagcccaggctggctgcagcctcttgctcaggagaatggtcacagctcaggaagaagtgtgtaggaaagcttggtggagcctggcctgtgagtaacagcaggtttaaatacaccaaggagacatttaatttgaagaatctaaaaagaactgcttcagttctctgaaaccatggtcatatactactccacgtgtgaacttgcacaagtttttttctcttaggtctacttccatgatcaccgcagcggctgacagtccatattaaattctactgaactgaaaaatgaaaggtcaaatgca

SEQ ID NO: 85390 - DNA, 601 bp, Human
tcagctttctggaagctctctgaaaacccaggcaggcctttcgggtatttcccatcaacaaggaatttcatgctgtttcttttttttcttttttttttttttgagacaaagtctcgctctgttgcccaggctggagtgcagtggcgcgatctctgctccctgcaagctccacctcccgggttcacgccattctcctgccccagcctcccgggtagctgggactacaggtgcacaccaccacacctggcctatttttttgtatttttagtagagtcggggtatcaccatgttcgccaggatrgtctcaatctcctgacctcatgatccacccgcctcagcctcccaaagtgctgggattacaggcgtgaggcactacgcccagcctcatgctgtttcaaaattgtacttaagtgtggttcagtctgaacattcctttgtacaaatgtggaaacacggggctgtagatgctgttaactactgaaggcaaaagtgtgacttcatggtataggtgtgattgattaaattattggctattggtgaccagctcaatcttcagtccctctccactctgggaaaattggagggtggggctgaaaccctc

SEQ ID NO: 85391 - DNA, 601 bp, Human
gccctggatcatggcccagtccaattctgccaggcgcctatgctgtgcccaagggctcttccaacttgagggcaggcactcccaggggcctgggcccttgtgcttcactctctcccatgcatgctaaacagcgaatgactgtgcgatggcacagcaccaagccaagagggcaggacgagtgtccacatcccaaccatctgctagcagtgcgttcccctgtacctcacatggaggccgctggttccagcaatgaccagaggctgagtccacagtgcccatctcagcatggtcagcgcacacrtagcggagctatctgatgtgacaatgctaccctggttttcaggggagtggcaagaacccaggaagagagggtgatactcagttttgccagttcacttcctgaactacacactcaccacagacatgctgggcactgagctactgccaggcactgttctggacgaacataggcccaccattgtgtggggctgggggatccagggccctgaaggcccctttctacaccacttgaaaaaaaaaaggggaactggaacagcacactgctggtgttgctgtcataaactgggagagcaagttgctc

SEQ ID NO: 85392 - DNA, 601 bp, Human
acacagcacccctacccccacctctccctgcaggtgacagctgccgggagagtacttcaaccagccccgtccccagggccaaagaaccagcagtttgaggtcagtttggtgcccacaggggagaccctgtctccacagggcttctgaccagaaccccaactcctaggtgaggtcccaatgccctggatcatggcccagtccaattctgccaggcgcctatgctgtgcccaagggctcttccaacttgagggcaggcactcccaggggcctgggcccttgtgcttcactctctcccatgcaygctaaacagcgaatgactgtgcgatggcacagcaccaagccaagagggcaggacgagtgtccacatcccaaccatctgctagcagtgcgttcccctgtacctcacatggaggccgctggttccagcaatgaccagaggctgagtccacagtgcccatctcagcatggtcagcgcacacgtagcggagctatctgatgtgacaatgctaccctggttttcaggggagtggcaagaacccaggaagagagggtgatactcagttttgccagttcacttcctgaactacacactcaccacaga

SEQ ID NO: 85393 - DNA, 601 bp, Human
cttacacaaggacatggaaggggcagcagagcctggggcctaccagtatttctactctggcaggcagggtgcagttggcctctacctggcccccagtgcagtggctgatggactggccactgggaaaaccaagaccaaaaacgcaaacccacattagcccccaacactgaaactcacaacacaagctgagaataaggaacctgcagggatttaacactgcaacgaggaacagctaagaaacacagcacccctacccccacctctccctgcaggtgacagctgccgggagagtacttcaacmagccccgtccccagggccaaagaaccagcagtttgaggtcagtttggtgcccacaggggagaccctgtctccacagggcttctgaccagaaccccaactcctaggtgaggtcccaatgccctggatcatggcccagtccaattctgccaggcgcctatgctgtgcccaagggctcttccaacttgagggcaggcactcccaggggcctgggcccttgtgcttcactctctcccatgcatgctaaacagcgaatgactgtgcgatggcacagcaccaagccaagagggcaggacgagtgtc

SEQ ID NO: 85394 - DNA, 601 bp, Human
gcccactagctaatgtaaacaccaaagaaccattacctgcttatttgtgtatttcttgcttcttggtatttgtgaagtgttacttcaaagcacctcaccaaacgtaagtccttctgaaatctgcagatgcacagctctaaccacacaccaggtggactcccagggctgctgaaggcagtgtctcatgacctctgaccacagctacaatgaaggacttgcactggctgtgcacatggcatcatggcaaatgctctccagtcctttgtgctgccccagccctgctctctcagtgatgggactstggtctgtcactgagcacaaggccctctagaataaaacccctgtttcctggcctccctgcagctgtgcacaccccgtgagtcagctttgtccatggatgcttacacaaggacatggaaggggcagcagagcctggggcctaccagtatttctactctggcaggcagggtgcagttggcctctacctggcccccagtgcagtggctgatggactggccactgggaaaaccaagaccaaaaacgcaaacccacattagcccccaacactgaaactcacaacacaagctgagaataaggaacc

SEQ ID NO: 85395 - DNA, 601 bp, Human
acattctagaactcttattctgggctgcatctgaaggcgagttccactgggagtctgctgttttttttacacaagtttcaggatgtttttagaggagctcattaggcattacaactcgacacagtgaccccacagccattaggagatgagggctgcgaggcacaagggtcccctctaacacatctgctgctggccttgagttaagggagggcattatctatcaggtctgactttcaggtggggcaatcagtgaaattcagtttagatcactgtttgtcagcttaaaattcaaggtgatatcttaaatcagtttgtgtactgacagccagaaatgaattccatttttgtgattccacctcatggactgagttctgggactatagctaatgtgaacaccaaagaaccgttgcccactagctaatgtaaacaccaaagaaccattacctgcttatttgtgtatttcttgcttcttggtatttgtgaagtgttacttcaaagcacctcaccaaacgtaagtccttctgaaatctgcagatgcacagctctaaccacacaccaggtggactcccagggctgctgaaggcagtgtctcatgacctct

SEQ ID NO: 85396 - DNA, 601 bp, Human
ggagtgcagtggcttgatctcagctcactgcaacctctcaggtgcgatctcggctcactgcaacctctgcctcccaggttcgagattctcttgcctcagcttcccgagtagctgggactacaggcgcgtgccaccacgctgagctaatttttatttttatttttagtagagacggggtttcaccatgttggtcagggctggcctcgaacccctgacctcagatgatcagcccacctcggcctcccaaagtgctgggattacaggagtgagccaccacgcccggatttttttttttttttttaacagaccaaagcgttaagagtccccaaaggagggaagccaccctgcaatggaatggcagaaccaggatgggtgaacctgaagtctcaggtgtcaagacatcggcacacagacagcttggtctctcctaccgacaagcacatctgtggccctgctgcacatatgggcagagggtggctggcacgtcctgcctcggcatgttccagcatccccacaggaccctatacctggcagcccctacatcatttactgcttctgtgacagatggagacccaatagagtttcctaagagggagaaaga

SEQ ID NO: 85397 - DNA, 601 bp, Human
aagcgcaaagccaaggacctagatgagacccaataaaggtgcaaggtggactccagaatgcacaggggcaaatgacacctctgatgccccagagaatggaagactctgaaacactgctttcgaaaccctttaattctatacccagccaaagtatccaacaagtgttaggggagaatgaaaataactcccaaactgcagggcctcagatctctcacatgctccctccctaagaagctcccccagggaaccagggagaggatgcgagcccacagcaacgtggagagagagcagcagcctagcsaaccccacatggagagagagcagcagcctagccaaccccctcagactggagcaggaagtggacacctgcaagaatggggcacgccacctacgtattcttattatggggttgggcaactctaggcaatgcggaaaaactaataatgacaggttcgcatgaaaaacccaagcatgaaatggaacgaaaagagggccttttatgagttactccaggaaaacatatggtggaggatactcagggagtcctgatgttgttattactagggggttggaaagctgaggcgagggtgtgtggtgtcaa

SEQ ID NO: 85398 - DNA, 601 bp, Human
aagccatcctgggccacatgcggcctaagggttggacaagcttggtctaggggagcagctgcagcagggcttaggcctgcgctgagccatgacaacacacttgagccatgaaattccagaataattcctgagagttctatatgccccagcagatccacacacaagcaactggagctccgcccacccccaccccccaccaagagacaggcctgtctgcctttgaaaggccaccaacataagagacccaaatataaaaggaatctgcaaggaggcaaccaagacaggagactgaagacagaakactattttaacaaaggacaaggagagaaacctgatagatacacaaatagctgaaaaggaaaattcaaaatgaaggtgctcagaaggcagaacaaaaacaaacagaatgaaaaaggaagatgaggagtaacttaagatatcaaccaacagaaaccctaaaaagaaagaacgtacgaaattacggggtgaaatttttccctgttccagagtggggacccaggaatctgggcttcggcctcaaagggctgaagcgcaaagccaaggacctagatgagacccaataaaggtgcaaggtggactc

SEQ ID NO: 85399 - DNA, 601 bp, Human; identical to SEQ ID NO: 85394

SEQ ID NO: 85400 - DNA, 601 bp, Human; identical to SEQ ID NO: 85395

SEQ ID NO: 85401 - DNA, 601 bp, Human; identical to SEQ ID NO: 85396

SEQ ID NO: 85402 - DNA, 601 bp, Human; identical to SEQ ID NO: 85397

SEQ ID NO: 85403 - DNA, 601 bp, Human; identical to SEQ ID NO: 85398

SEQ ID NO: 85404 - DNA, 601 bp, Human
tagagttgctttgagtcgtctataaaaattaggaattgaagtttgtcattcaaaataaagaaatagagtagaacttaaaagcttagataatataagcaaaatttaatactcttatcctctaaattcttacctggattctctcttcattgtattttctacaacaaagtcactgtcttaacctgttgggagttcttctaaaaaattgaatagggctgggtgcagtggctcatgcctgtaatcccagcactttgggatgccgaggtgggtggatcacctgaggtcaggtgttaaagaccagccrgactaacatggtgaaaccctgtctctaccaaatacaaaaagttagctgggtgtggtggcacatgcctgtaatcccagctacttgggaggctgaggcagaagaatcagttgaacccaggaggtggaggttgcagtgagcctagattgcgccattgcactccagcctgggcaacaagagcaaaaacgccatctcaaaaaaaaaaaaagaaaaaaattaaataggataaaagaggagctatctggtaaatgtactctaatgtataacaaaaccatactgattgtgaccaagttaatatctgtt

SEQ ID NO: 85405 - DNA, 601 bp, Human
ctttgagtcgtctataaaaattaggaattgaagtttgtcattcaaaataaagaaatagagtagaacttaaaagcttagataatataagcaaaatttaatactcttatcctctaaattcttacctggattctctcttcattgtattttctacaacaaagtcactgtcttaacctgttgggagttcttctaaaaaattgaatagggctgggtgcagtggctcatgcctgtaatcccagcactttgggatgccgaggtgggtggatcacctgaggtcaggtgttaaagaccagccggactaacwtggtgaaaccctgtctctaccaaatacaaaaagttagctgggtgtggtggcacatgcctgtaatcccagctacttgggaggctgaggcagaagaatcagttgaacccaggaggtggaggttgcagtgagcctagattgcgccattgcactccagcctgggcaacaagagcaaaaacgccatctcaaaaaaaaaaaaagaaaaaaattaaataggataaaagaggagctatctggtaaatgtactctaatgtataacaaaaccatactgattgtgaccaagttaatatctgttacattttt

SEQ ID NO: 85406 - DNA, 601 bp, Human
cagggaaacctcagagtaaagcaggcagattagtccctgagtcctgggaaaaagtgactggtaattcttatcaactttatcttacaaggcagtaccatcttacttgtccttcattctttgctgctgtcttctaatatctgttttgggctataataatttcctccagcagtttgcagatagaggactgtccatcccccattgcatgcagtggagatgtatttcattcctggcatctcatagatatgttctcagtttaaggtttaagtgtactaattcttttttttttttttttttttttttwttttgatgtggggtctggctctgttacccagggtggaatgcagtggcacgatctcggctcactgcaaccttctcctcctgggttcaaatgattctccttccttagcctcccgagtagctagaattacaggtatgtgctaaaatccagcctgggtgacagggcaagactccgtctcaaaaaaaaaacaaaaaaaaacaaaaaaacaaaaacgtagtttatcactgacttacctctgtaaccataaagtaagccctctgacctttgttgctttctttggactgtattctgctgactgagtga

SEQ ID NO: 85407 - DNA, 601 bp, Human
ccacagtttaagctgtagtcccaaggagaattaagggctaaaaaaatacacaatgggggctgagatttcagcatgtgcagaggaatagggaatgaatgcatttcacatgtagtacatcagtagatctagtctacttgaataaagcaaggaaccggcatcttattgccctacctgtgaaccaaaatggataaaaaaatatttgatcaactatctagggttatggttagaaattagcaaattgtcatatccaggttgtatgtaaaaaacaaaacaaaacaaacccaaaaaaactaaaaaaaaaggggggaaaaattagcaaattgtcgttaatggaagaaacagagacaactgtgtaactaaaaacttggaggacaaccttcttgatttagggaacagaagtgaaatatctctatgagacaagaaccttaggtgtccagcaaaatatctacttctgaaatggactccaagagccagactgagggaacttccaaaacatctgatgaggagtacatctgtggatggaaaagaaactaaaacaaaacacctcccatcaaaatgagtttcctcagtaaaaaaattataaagctggagagcgaatctt

SEQ ID NO: 85408 - DNA, 601 bp, Human
aggttgcaataagccgagatcttgccactgcactccagccagggtgatggagtgagactctcagaaaaaaattagtgccaggcacaggggctcacacctataatccccgcactttggcaggccaggtgggcaaattgcttgagcccaggagttcgagaccagcctgggcaacatggcgaaaccctgtctaacaaaaaaatacaaaagttagccaggagtggtggcacaagcctgtagtccctgctgctagggagactgtagtgggaggatcacttcagcctgggagaccaaggctgcagtkagtcatgagtgtgccattgcaccccagtgtgggccacagagcgagaccttgtctccaaaaaaaaaaaaaaccagaaaaagaaaaaaaattaggctatgtgctgtggctcatacctgtaatcccagtgctttgggaggccgaggcagaatgatcgatcagcctgcccagcataggagaacttgtctctatttaaaaaaatttaaaaattagccagtcatggttgcctgtgcctgtagtcccagctactcaggaagctgaggcagaaagatcacttgcacccaggagctccaggcagcagtg

SEQ ID NO: 85409 - DNA, 601 bp, Human
tgcatcatttttgccatcttccatttttaatgctacatacgttctgggcttatagtttgtctattcataaattactcttagtaatcttgtgttccacgcttcttgcatattatttgttaacaagatagacagggccattcctatctgttactgtcctcaaaattctactcttattttggattatactatgtataaagattttaaatctgtgaatgtccagtggggtcataacataattactaaccagtctggttagtgttgaactcttacctagttttcctgaatcttaaatacaaattgyttagtagctatacaagggtgttttgaaactaatggatgtttaaaggaccatggaccattcagtctttgtagaacttctaaatgtactcgagtgatgtcattgaatttattacatgactgaatatttctttgctattgctgtggatttgtacattgctatttgtgaccatttaccttccttttcttgttgattgtcattaggcactttaaacaaatactgtaaatcaaaacagggactcctatatggtcttaggaaagtaataataaaattagctcacaaatctaattgcttttgctctga

SEQ ID NO: 85410 - DNA, 601 bp, Human
gaagtatgattacgaataataatgatgaaactgatgaactgggaataacatttttaacatgtagtgttctgtaactagcattataatgttcctaattaagtgcacagtttgcagttatgaaatctgtgttactgattagttcagttatgttagaactttttttttttttaaagaatgtagaaatagctctaaaaggaacttgtaagtgttaaggaacatcaagttttatttcactgaagtatttgttaaattagtcttttacaaagtttgcatgaaacttagaaaattggcttagaaattwtctttttattaatataaacaaaatttaatttgtgttagacattaatacctaccacattgtacaatattcttttattaataagttttaaattttaaatcagccaacaggtacaaaaattatcttcatgtaaaaacttccatttttgtgaaggctatgtgttttgaactatatggcagtaattatattttctttattcaagatgatgtacctgtcttaaatttaaatattatattttcttaagtcaaagtttgtcttaattttcttagttgaaggtaaaataaataaggcaagggtgaatta

SEQ ID NO: 85411 - DNA, 601 bp, Human
ttattactattatttttttcttggccacttcttccaggaaaaaaatgacaaaaaattttaaggctttgtttccattttgcatattcttataggtgaaacaaacatatgtaataattattcctatttgtaactaaatagttaaattatgttatttatgtgatgacagaagctggagaaatttgtattgccaagatggttatatatgttggtggggatgagctgggtagctcatgtagaaatatatctgggcatcttaaactttgctcacttatttaaactagtaatctactaaactgagtcrttcacacttacgaatagtatctttgaatgggatctagtcatatcaaaaattctagagagaaaatattttccaacacttaaaatgcttacatttttctttaagtcctacgtgtttttgactgacttttaatctgggtgcaaatgtaaggttattgccatcactgatgctttgttgatttttttgtatattattactgattatatgtttttttctgagtttttcctttcttgagtgaataatgtttttatttttcaatacaatgaataatagtattgacaatcctataaaatatctgatagt

SEQ ID NO: 85412 - DNA, 601 bp, Human
tagcttcccaaactataaactacttagtagggcatgtaaagacctgcataataagcttcatgtcaacctccccatacaaatcatttatgctactatccccttttgctcactgttttctagttactggcctagaatgcactaaattttcaactgcctcagggcctttgctcactgattttcttttcctgaaatgatttcctttgctgttcacctagctcacctctctactcatctgttagctccaattttacatgtcagttctcaaagagtatttctctaacaccaaatctgaaaaaggtcyctctgtttctcttttatagttgagttttgattttccttaccccaatttgtaattatatcttcaaacatgtacttaccattttaatgcctgtctcgccaactagactggtaggtccatgaggacaagagtcatgaccatctttttcagcactgtttatatacccagttgtttagcacagtgcaatttacatatagtgaaatgcatgaatcttaaggtacatggtttagttttgataaacgtatacatacatgtaacccataccccataaacatataaattatttctgtaaccctagaaggt

SEQ ID NO: 85413 - DNA, 601 bp, Human
gcctctttcattatatatttacataattctatttcctgctgtaggaactgttgaaaaaatgtcatcaatgtgtcgaaaccattgtgaaggctaaagaccagcaagctgcagaagcaaataagaatgcgagtattcttttaaaggaacttgatctggaaaaggtgagtgggaaaaataattttcctttttagaaattattgagggtgggggccgggcacggtggctcacgcctatgatcccagcacttcagaaggccaaggcgggtggattacctgaggtcaggagttcaagaccagccttrctaacaaggtgaaaccctgtctctactaaaaatacaaaaattagccaggtgtggtggcacacccctgtaatcccagctactcgggaggctgaggcaggagaattgcttgagcccgggaggcagaggttgcagtgagtcgagatcgtgccactgcactccagcctggctgacagagcgagactgtctcaaaaaaaaaaaaaaaagaaagaaattattgagggtgggcgtggtggctcacacctgtaatcccagcactttgggaggctgagcctaggagtttgagatcagtttggtcaacat

SEQ ID NO: 85414 - DNA, 601 bp, Human
ttgggaggctgaggagggtggactgcttgagccccagagtttgagaccagcctgggcaacatggcaaaaccccatctctacaaaaaacaaaaaattagccaggcatggtggcaggtgcctgtagtcccagcaacttgggagggtgaggtgggaggatggcctgagcccaggaggcagaggttgcagtgacctgtgattgtgccactgcgctctagcctgggtgacagagtgagaccccatctcagacaaaaagaaaatctgctagagtaaacgtgtcgcctatatgaccaatattcttaayaatatatgattcaaaggaaataggtaatagattcttaaaccaccatcaattttttattctgacctgtcattcaaaaaaatatattttgagcccaaatataagggaaggactagattttgagcaagatcccaatttacggctgggagcggtagctcacacctgtaatcccagcattttgggaggcctaggctagaggatggcttgagctcaggagttcgagaccaggctgggcaacatagtgagaccttgcctctactaaaagtttaaaaaattcaccgggcatagaggtgcacacctgta

SEQ ID NO: 85415 - DNA, 601 bp, Human
gaacattatgactgtcataaaaagaaaccctgcactccatagctatcatattcccattcccccactgcaatccctgtgtcctaggtaactgctaatctactttctgtctctatagatttgtcaattatggacttttcacataaatggaatcatataatatttggtcttttgtgactggctttttcacttagtgaaatgttttcaaaattcatccatgttatagccaaaatcagtactttatttctttttattgccaaatacgaaaacaattctattctgtagacagaccacattttgtttwtctgtttatcagttaatggtcattgggttgcttccacttcttggcaattataaacaatgctcaatgattgtaagcaaccttttcttctctctttagcttactacgtttttttaaactaaaatttgctatcaaaattttagcatctctcaataatcatactttttctctttaattatcaacaaaatattttcatgttaagctatctcttgcattcctagaataactctacttgatcatgatgttttttcttttaataatggaattataaataagtatacagtttttgtatgaaaatgtttt

SEQ ID NO: 85416 - DNA, 601 bp, Human
ctaaaattggtgaaatgaatgaaactactcttgatgaaatatatactagtgagaaataatattaaataaattattcagtgggacaaaaaggtgagttttattctatcttaactgtctacaatacatttgaattgtctggaggagccttaagtccatattctgcaccttgaggacaaccaaatgagaaattttatttcaggtcagtaagtagaatttatgaagagaaaggagataattatgaggaatccctaggaaaattgggaggaaaacaacagttgtatagttgggagtagttctttargatacgctcctcccttccttcttaccagcacttccttcctttctttctgactatttggatcccagtagcctgctcccaacctcatttcacctgctaaatctcttcttcctctgcctgcctcttcctggcactactttactgctattttaccaacctgaacatttggataaaacctagctcaggtaagaacttaattactttcaaaatatacaagggatatgggaggagacagcatggatacagtggagcagtagtcagtagtcagagcctaaattctattttcatttctgccgcttgaag

SEQ ID NO: 85417 - DNA, 601 bp, Human
acaactggctgggcacggtggctcatgcctgtaattcttgtttcggaggatgcctgtttgggaggatcgcttgggcccacaagtttgagaccagcctgggcaacatagtgagaccccgcctttacaaaaaatttaaaaattagccaggtacagtggcatgcacctgtggtcccagctattgaggacactgaagtgggagggtcacctgagcccaggaggttgaggctgcagtgagccatgattgtaccactacactccagcttgggtgacagtgagaccctgtgtcaaaaaaaaaaaaaaatccaaaatctcacccagaccaatactgtatcagaattatcattttaacaatatctccagatgatttatatgcacattaaagtttgagaagctggccaggtgtggtggctcacaccagcactttgggaggccgaggcagataggttacttgagctcaggaattcgagaccagcctgggcaacatggtgaaaccttgtctctataaaaaatccaaaaattagcccggtgtggtggtgggcacctgtggtcccagctactcaggaggctgaggtgggaggatggcctgaacccaggaggcaga

SEQ ID NO: 85418 - DNA, 601 bp, Human
ccagaccaatactgtatcagaattatcattttaacaatatctccagatgatttatatgcacattaaagtttgagaagctggccaggtgtggtggctcacaccagcactttgggaggccgaggcagataggttacttgagctcaggaattcgagaccagcctgggcaacatggtgaaaccttgtctctataaaaaatccaaaaattagcccggtgtggtggtgggcacctgtggtcccagctactcaggaggctgaggtgggaggatggcctgaacccaggaggcagagtttgcattgagckgagattacaccactgcattccagcctaggcagcagagcaaaaccctatctcagaaaataaatagtttgagaagcaatctttttttaaatgagtgaagaaatcagacctaaggagaaatctgatgaagccagagctgagttaatattgataaatggatgcagtcaggtggtctatacttaatttttggtgaggggaagggacagtggaggcagtattgattttgaggaagccaaacaggacagcctgatgaattcaagatttccagcatatatacatcttcaccaatcccaccaccttgct

SEQ ID NO: 85419 - DNA, 601 bp, Human
gaagaagaggagaccaggtggtggggacaactgggaatatctgtgacctttgggattgacctgagcctttatctttcttctctctcatgttttcttttgtcttcttttctaaatagatcccatgcgaggcccaagaaaactagaagtagtggaggtcaaatctcggcaaatcactatccgctgggagccatttggatataatgtaactcgttgccacagttataatctcactgtccactactgttaccaagttggaggacaagaacaagtgcgagaagaagtaagctgggatacagaaaaytcacaccctcaacacacgatcactaacctgtcaccatacaccaatgtcagtgtgaaactgatcctcatgaacccagagggccggaaggaaagccaagaactcatagtgcagacagatgaagaccgtgagtacctttgaatgatatgtttgtgtaaaacatgttctttcaaaaaacaacttttgtttcgagatctttgctgtgcagatggaagaaagaactacttattttgttgaacaacacaaatgtgtatctgtactctgtattcttaagcgctgattgaaagagggaaaagggagtag

SEQ ID NO: 85420 - DNA, 601 bp, Human
gttgaacaacacaaatgtgtatctgtactctgtattcttaagcgctgattgaaagagggaaaagggagtagagatatagaaatgtcattctttattactcatacagttacttttctatatataatcattccatattgctctcaatagttcttcaagttttatttcattgggctgaaaaattgttgttttgggtattagattatttatataaaatcattggactgaaaaattgttgttttgggtattagattatttatataaaatgtttacctaaatatatttaaatggcattctgaaacattttcctagttcagataaaatttcagcactaaatagaggctgcccttgcttttcaacacagtcttgagaaactgtaagttggtggtcatgaaacaggtcatttttctccacaggaacaatgttgaaaccggatgttactttaataaacaactactttacaaataaaccatgcatgtcaccagtaacgcatcaaaaaagcaaatatacaggaaacctccatagtaatttaaaacagtaaaattatgccttgaatctcaatgcgtggatataaatgtttctttacacagatgacacagggaac

SEQ ID NO: 85421 - DNA, 601 bp, Human
acaacacaaatgtgtatctgtactctgtattcttaagcgctgattgaaagagggaaaagggagtagagatatagaaatgtcattctttattactcatacagttacttttctatatataatcattccatattgctctcaatagttcttcaagttttatttcattgggctgaaaaattgttgttttgggtattagattatttatataaaatcattggactgaaaaattgttgttttgggtattagattatttatataaaatgtttacctaaatatatttaaatggcattctgaaacattttcmtagttcagataaaatttcagcactaaatagaggctgcccttgcttttcaacacagtcttgagaaactgtaagttggtggtcatgaaacaggtcatttttctccacaggaacaatgttgaaaccggatgttactttaataaacaactactttacaaataaaccatgcatgtcaccagtaacgcatcaaaaaagcaaatatacaggaaacctccatagtaatttaaaacagtaaaattatgccttgaatctcaatgcgtggatataaatgtttctttacacagatgacacagggaacccttg

SEQ ID NO: 85422 - DNA, 601 bp, Human
cttaagcgctgattgaaagagggaaaagggagtagagatatagaaatgtcattctttattactcatacagttacttttctatatataatcattccatattgctctcaatagttcttcaagttttatttcattgggctgaaaaattgttgttttgggtattagattatttatataaaatcattggactgaaaaattgttgttttgggtattagattatttatataaaatgtttacctaaatatatttaaatggcattctgaaacattttcctagttcagataaaatttcagcactaaatagrggctgcccttgcttttcaacacagtcttgagaaactgtaagttggtggtcatgaaacaggtcatttttctccacaggaacaatgttgaaaccggatgttactttaataaacaactactttacaaataaaccatgcatgtcaccagtaacgcatcaaaaaagcaaatatacaggaaacctccatagtaatttaaaacagtaaaattatgccttgaatctcaatgcgtggatataaatgtttctttacacagatgacacagggaacccttgtgtgtaatgacatattcatatagtacataaa

SEQ ID NO: 85423 - DNA, 601 bp, Human
gagaccagaagctctatttctgtttcttccaactctctctcatctcccagaagaggagaagatggtgtccacattgtcatcaagttatggctggctccttcctgccttacatttctctattgactctggtcctaacatctgttgtttctacttccaaagttttagattgttcttttctgtcaatttccattggctgtattcaaatccttattattttatgctgaaatttctataattgtttctaccttttctttgtggttccagcctttttctattctaatgtccccctactcactcactmactaatcttaaaaatgtattttcatcttggctgtctctctacaaaagtcttgagtggctcttcacttaatcttcattccagtgccttggctgtcaaggtcttctgtattcttggctcatattctaggagtaataacttctccttcacagcatcttgttctgcaaagccatccctgagtgctggtccctgtgcctgctctgtgcatcctgggcttcccatcgttgcctgattgttctccttggccagtcggggcctctcctggccgcttctcaagctcgcctactctgctaccagctgaag

SEQ ID NO: 85424 - DNA, 601 bp, Human
tactctgctaccagctgaagctctcctcacatttcaggtccttcacatagctgtctccagctcttcagtctgtgttattcacatccctctgaccttaattgtacttcataagatccttaactctctgaccctcaatttcctgatctgagaagtgagaataataacaattcttagatacattagggatagaagaaatttatgtggagagctggttgtaggctgtcagaaaggggcctttcttagtattgtaatgattcatagccactcatgattcttctttgctccctcattatgttatttrtatgtatttttttctttttattgtaaactacttgacaagaagtactgtctgtttttcttctatagcaataggcgtgatattgagtaagtaataaacaccccaaaataccttaggtctttaaatgaaataataaagtattgttgataagcatttagttcatgttttaataaacaataatggttacatcaatgagagaaataaaatgcagtcacttccagatatatattgctaaagcatgaacctattgaacactatgggtttcaaattgagaactgtcatgagctaggaattctgttaaat

SEQ ID NO: 85425 - DNA, 601 bp, Human
gaataataacaattcttagatacattagggatagaagaaatttatgtggagagctggttgtaggctgtcagaaaggggcctttcttagtattgtaatgattcatagccactcatgattcttctttgctccctcattatgttatttgtatgtatttttttctttttattgtaaactacttgacaagaagtactgtctgtttttcttctatagcaataggcgtgatattgagtaagtaataaacaccccaaaataccttaggtctttaaatgaaataataaagtattgttgataagcatttarttcatgttttaataaacaataatggttacatcaatgagagaaataaaatgcagtcacttccagatatatattgctaaagcatgaacctattgaacactatgggtttcaaattgagaactgtcatgagctaggaattctgttaaattccatcaaaacatgaggacagaattactttgtttgtttaaattatcttgctagtccctgaagctggagcatgcattacttccaaataaaaatctattgttttcctagcacactagcgtttcattaattagaaaaaactttaatttcaaattatat

SEQ ID NO: 85426 - DNA, 601 bp, Human
aaataccttaggtctttaaatgaaataataaagtattgttgataagcatttagttcatgttttaataaacaataatggttacatcaatgagagaaataaaatgcagtcacttccagatatatattgctaaagcatgaacctattgaacactatgggtttcaaattgagaactgtcatgagctaggaattctgttaaattccatcaaaacatgaggacagaattactttgtttgtttaaattatcttgctagtccctgaagctggagcatgcattacttccaaataaaaatctattgttttyctagcacactagcgtttcattaattagaaaaaactttaatttcaaattatattttgtaacccctccaaaaaaaatacttcagaaaaggcagagagaagaaagaaatagaataattgtcaaacagtatccagtttgaagagaaaagaattggggagtcactttgtttatccatcaacaaaagttataattcattgaacattgtgagttttattatagtataatacttttattgaaatacagtttttttcatcagaaattgtgtgggaaaaaatttacctttcattaatgttagtagaatcc

SEQ ID NO: 85427 - DNA, 601 bp, Human
aataaacaataatggttacatcaatgagagaaataaaatgcagtcacttccagatatatattgctaaagcatgaacctattgaacactatgggtttcaaattgagaactgtcatgagctaggaattctgttaaattccatcaaaacatgaggacagaattactttgtttgtttaaattatcttgctagtccctgaagctggagcatgcattacttccaaataaaaatctattgttttcctagcacactagcgtttcattaattagaaaaaactttaatttcaaattatattttgtaacccytccaaaaaaaatacttcagaaaaggcagagagaagaaagaaatagaataattgtcaaacagtatccagtttgaagagaaaagaattggggagtcactttgtttatccatcaacaaaagttataattcattgaacattgtgagttttattatagtataatacttttattgaaatacagtttttttcatcagaaattgtgtgggaaaaaatttacctttcattaatgttagtagaatcctatacagcccagggataagttgtacaaacttaggtattatggctttatatcccagatcctgaa

SEQ ID NO: 85428 - DNA, 601 bp, Human
tagtcgagttttctcaggcatggcctgttttagttcaacttctaattatgatgaacattttagtctcagagcttggaattccagtgttcttagaactcaccagtgttgtcatttctaatgttttttgttgcttcaatgtagtcgtatataaatttcttcaacataggactaacaattattttcatatttatgtgctatttagggtttcaatgttaaaattaacttggctgggtatagtaactcatgcctataatcccagtactttgggaggccaacacaggaggggaccacttgagcccasgagattgagaccagcctgggaaacatagtgagaccctatcactacaaaaattaaaaataaattagctggcatgctggtgcatacctatggtcccagctactcagaaggttgaggtgagagatcacttaaacctgggaggttgaggctgcagtgtgcaatgctagccccactgcactccagcccggatgacagagcaagaccctatttccaaaaaacaaaaaatcaacttaatccaacttcattttaggaatgaggcaaatgtgacctaaagaggttcaatgatttgtccaaattgcacaa

SEQ ID NO: 85429 - DNA, 601 bp, Human
atgaacattttagtctcagagcttggaattccagtgttcttagaactcaccagtgttgtcatttctaatgttttttgttgcttcaatgtagtcgtatataaatttcttcaacataggactaacaattattttcatatttatgtgctatttagggtttcaatgttaaaattaacttggctgggtatagtaactcatgcctataatcccagtactttgggaggccaacacaggaggggaccacttgagcccaggagattgagaccagcctgggaaacatagtgagaccctatcactacaaaamttaaaaataaattagctggcatgctggtgcatacctatggtcccagctactcagaaggttgaggtgagagatcacttaaacctgggaggttgaggctgcagtgtgcaatgctagccccactgcactccagcccggatgacagagcaagaccctatttccaaaaaacaaaaaatcaacttaatccaacttcattttaggaatgaggcaaatgtgacctaaagaggttcaatgatttgtccaaattgcacaatttaatcatttattagtcttaagtcagaacccgggcctcccatatgaatc

SEQ ID NO: 85430 - DNA, 601 bp, Human
cttttcctgagtacatacctaggagtgaaattgttgggttatgttgtaaatctaccagtgtttaaccaattgaggcactgccggagtgttttcaaagtagcggcatgactttaccttccctccagcagggtatggggtttccgattactcttccttcttgccagcacttgttatcatgtcttttcgttatagtaatgctagtgggtatgaggtgatatctcattatggtttcgatttacagcgcttgctagctaatgatactgagtatcttttcctgtgcttattgactatttgtttgtcktttttggagaactgtttattcaggtcctttgcccatttctaattgtactatttgttatcttattattgggttttaatattgttacttttacagtctagatacaaatctcttatatatatgatatgcagaagccttctcccattctgtgtcttgtcttaatagtgtcctttgatgcccaaaaggttttcattgtgataatgtacattttatctagattttctttcattgcttttgcttttggtgtcatgcctaagaaattgttgcctgatccaaggtcatgaagatttatttatatgtatg

SEQ ID NO: 85431 - DNA, 601 bp, Human
atccaaggtcatgaagatttatttatatgtatgttttctttaagagttttatagttttggttcttacagttaagtctttaaactattcagatttaattgttatatatggtgtgagatagaaatccaacttcattcttgtgcatgtggatatccagttgtgccagtagcattggttgaaaagattaatctgtcctcattaaatgttcccagtactcttactgaaaatcaatgtactgcaactgtaagggtttcttgagtactgggattctcagttcgattccatatctatatctatctatcaatatatatatctttatctatgtaaagatatatatgtctcctatgccaacaccacactgtcttgattactgtagctttgcagtcagttttgaaatcaggatgggtgagttctctccgactgcttattggtcattcacttcatcaccaaaaaatgtgatcatgtgccccaaaatatatgcatatttataaacaggatagctgttttgtaaataagataggcatactagtacactaaattgtctataacatgaagcatactaaaaaactacatttaaaatgatgatgggataaataacatttt

SEQ ID NO: 85432 - DNA, 601 bp, Human
atgttcccagtactcttactgaaaatcaatgtactgcaactgtaagggtttcttgagtactgggattctcagttcgattccatatctatatctatctatctatatatatatctttatctatgtaaagatatatatgtctcctatgccaacaccacactgtcttgattactgtagctttgcagtcagttttgaaatcaggatgggtgagttctctccgactgcttattggtcattcacttcatcaccaaaaaatgtgatcatgtgccccaaaatatatgcatatttataaacaggatagctrttttgtaaataagataggcatactagtacactaaattgtctataacatgaagcatactaaaaaactacatttaaaatgatgatgggataaataacattttataatgatattgaatattattttatagaaaattggcaaatgacatcttcacttttgttagtttttttgcaaacttataagaaggtgttatgtattttaagttttgaaaaatggcatcaaacttcccccaaatcacatatagtattaacaaataaaataatgtttaaagactatattgttatttcatctatatcaacttct

SEQ ID NO: 85433 - DNA, 601 bp, Human
tatgtctcctatgccaacaccacactgtcttgattactgtagctttgcagtcagttttgaaatcaggatgggtgagttctctccgactgcttattggtcattcacttcatcaccaaaaaatgtgatcatgtgccccaaaatatatgcatatttataaacaggatagctgttttgtaaataagataggcatactagtacactaaattgtctataacatgaagcatactaaaaaactacatttaaaatgatgatgggataaataacattttataatgatattgaatattattttatagaaaaytggcaaatgacatcttcacttttgttagtttttttgcaaacttataagaaggtgttatgtattttaagttttgaaaaatggcatcaaacttcccccaaatcacatatagtattaacaaataaaataatgtttaaagactatattgttatttcatctatatcaacttctactttgtatgtattttaatagatatattagtacagtagttcatatatatttttagcatggttttatcattcagtgttatggttataacttgaatccatgtgatatataactgttacttactttcaatctttt

SEQ ID NO: 85434 - DNA, 601 bp, Human
tgaatattatgaaaattcatggctcagcttttatagagctaagtgttataaacaaatcaaacaagttcatattattttttctcagtgatgagaatcttttagtttttatttttggccccattgccatttttaggtctcagttttgggggatttttacctagtaacaggattttaaactaggaaacatgcaatctttgaaatcaactttaatttccaagccgtaagttcacctgtcctaaaagccacatgttgctatctagacagacagaaaatatttaacagattctttctttttaatccyacaagagatatatctctgtgtggtaagtcactttaacatgaaaacaatgggaataataattcaaaggaaaaacccattagtctctctgattctgcagccaggactacccagttgaacactgatctaaatactactacaatggggatgcatgaatgtgtcataaatcagggttttaaaaatcagatatgtgtaagtagaacagattggttcagttttgtagggaccaaaggggaaatatgtgatccaggccaaagtgattaaatacaagctttctggccaacaagtctttctccctttccc

SEQ ID NO: 85435 - DNA, 601 bp, Human
agatatgtgtaagtagaacagattggttcagttttgtagggaccaaaggggaaatatgtgatccaggccaaagtgattaaatacaagctttctggccaacaagtctttctccctttcccatgttttctacaagtaggaaggaagggagtccccagctccctcgaggtaggtcttaggtggagtctcaggaggagctcttcttgagctgaaatgcacctgtgagctacgattcacccagcctatgccagagtttacaacaggcacatacagcttcctcccggagctgaagatacatgttgamccagattcagtacctctctggagaatcacagacttctgagacaaaatcatgctaaggaaatcaaacacttgccccaaaagaagcagggaccatggcaacattgttttctgtcatggagtcacatttgaatactggtaaaaatcagagggtgagataaattgccatggttggaaaaaagtttagtaaccaatgacacaggtgtttctttaaggaaggcagcacacaggataatttttgaaggaaagaagaaagcacagatggaatattgttgatgtttgtattaggccgctcttgtttggc

SEQ ID NO: 85436 - DNA, 601 bp, Human
cacctgtgagctacgattcacccagcctatgccagagtttacaacaggcacatacagcttcctcccggagctgaagatacatgttgaaccagattcagtacctctctggagaatcacagacttctgagacaaaatcatgctaaggaaatcaaacacttgccccaaaagaagcagggaccatggcaacattgttttctgtcatggagtcacatttgaatactggtaaaaatcagagggtgagataaattgccatggttggaaaaaagtttagtaaccaatgacacaggtgtttctttaaggraggcagcacacaggataatttttgaaggaaagaagaaagcacagatggaatattgttgatgtttgtattaggccgctcttgtttggctataaagaaatgccagaggcttggtaacttataaagaaaagaggtttaactggcttatgcttctgcagaccgtacaagcatggcacttgcatctgctccaggcgagggtctcaggaaccttatgaatgtggcagagggtgaagggcagcaggcacgtcacatggcgagagcaggagcaagagagagcaaagtagggggtgccacactctcctg

SEQ ID NO: 85437 - DNA, 601 bp, Human
tttcagcacttacagcagtcaacaggctggtggctataatatatagagacctgctacgtagtaataagaaaaaaacaaaacactcttttaggaaataaaatggacaaagacacttcaaaaaaaaattcacccagcatgtaagtatatggtaaagtacctacccagccttactaatgattgagaaatggagtattacaagtgatacagaagtttaaatttctataatatcaagtgttaatcagtgatgtggagaaatgtgtacatgcatagtctgttgatgggaacacacattttgcagtctttttttttgtaggcaattagggagattctatcaaaatgtaaacatagtatgccaaacctatttctagaagtttattagtaatactccccaatgtacaaggatatttgcccaagtattttcattgtatcctactaactttacatatctctagtgagtaaataccagactcctggtcatgagactaacacatggattgttttaaaagctttagtatgtctgagatattggaaaaagacaaaagtagaaaaggtactgttccttttctgttgaagtaactaccccatcagcaaccaactatag

SEQ ID NO: 85438 - DNA, 601 bp, Human
ataagcatgtattgaatgaacaagtggaaaagtaaagctgaaaccatatggacatttgagtttgagcatgggagtatattttggtgccctttagagcagctgctgaggttggtgaatgtctaccatcagctctgtggcaggcagtggggttgtagagttagagtgcccctgctgccgagaagcttttctcattctgatattcagactccagggctctgtggatgggtctgagatggggaaacccatcacctttgtgacatttggtggacatatacatgcccaacatatttgtttgttaggsgtgagggagaggatctgtaatttttaggagtgcatgaattagtgtatacatgtgttttttagaagtaggaaagagaaggtgtctaatttttaccaaattgtcaaagggctatgactggaagccagctaagaaccccagtgttattttgcagccacaaggctttcagcaagtccaagcccatcagccctgctggaacaacaagtcccttagtaaagcgtttgcttgatagtctctgtgggtggagcaaagatcccacttgtcttgagtgtttacatgagcggatgcacacacccgctctcc

SEQ ID NO: 85439 - DNA, 601 bp, Human
ggtgttttgaaagtattcatttacttactgtatgcctccccagctccatcccaccctgtccagattctcagttatctgaaacagggcgtgtatttacctgctggccatggtgcttgcagagtgtcagtgttcaatcaatgtttgaataaagtaaatgaatctgaataggtagaaaacatggaaacagagctaactgtctcatgttccaggcaggtgaaagcttacgagcaaaagcagtgtcagaaaagccccattagtgtttgtagggcagttagtctttatcctctgaccagaacagaarggaatataatggtgtagtatcacagattcagaagtaagtttggagaaggtgagagcaaaactaaggagtttgggctttctctcgtatgcatttatgtttcattaaggtttctagacaggcaataaaatgaatgagaacactaagctagccacggtgggcagcgtcagtcctcattttaattatactttgtcatagttgttggatcacttctccccttcccctaccagactgatacctccttcggggaaggtacgattcctaaagcaccatgcaagaccccagctccgaacacagtgcttg

SEQ ID NO: 85440 - DNA, 601 bp, Human
ggcagcgtcagtcctcattttaattatactttgtcatagttgttggatcacttctccccttcccctaccagactgatacctccttcggggaaggtacgattcctaaagcaccatgcaagaccccagctccgaacacagtgcttggcacatgagaggggctcaatgaatatgtttcaaatgtgtgggtgaattagtgagtaaacattggaagcaattatgcattcataatagaggtttagatccgtctcctccaaactgccttgttccctggaggtatccgaatggaggaccaagtaatcayacagcggttacatcgctgacgtccttcgctcagccactagggggtagattggctttgtctcttcttgacttccttaaccttgcagaggaagtctgttagaggattaacaatagatactctgcatgactccaatagtgtcatgcagtgcagtgattaatatatatagcaaacagttttcttgctaaagcttagttgattcaatctaaatattctttcagagaggtcttcctaattgtaatgacatggtataaatataagaagaaagaatgtcaattatcacttcgtataataacagtgtta

SEQ ID NO: 85441 - DNA, 601 bp, Human
gggtatgagtgtggaagtgttgagttttggctttaactattttgtttggggtggagcaggtggggtggaagtagggaaaggagctaactcttgttatcagccatggttaggtcaataatatttagcctgacctttatatcttttatctctcattccttgttttgtattaataaaagttatcatttggagttgaaggaaaggaatattcacaactagagtattgtaagtgtttggctaggttttgagggagggtttagaattttctttttaagcaattataacaagggataattttttattrtgtaatattttatgagcacaaacttgacttgaaatttaatacacttgatattctgtgtatagaattaggttatagaaacagtatggagagttgagaaagagaaaataagtctttgggaagttagaataattagagattagaaaactgacacagattgaagaaaatgggttggtagaagaaagaccactggacttggaatcaaaaaatctaggttctagttatgattttgccaggcacttcctctctgattttgatcaaataaatttactcctacatacaaattaagataatattatctag

SEQ ID NO: 85442 - DNA, 601 bp, Human
tttttgaataaaataattcatttttgctatttttattagataagaattctgatcaacatggccgtattagtccgttctcacactgctaataaagacatacccgagactgggtaacttataaagaaaagaggtttaatttactcacagttcagcatggctgaggagacctcaggaaacacaatcatggtagattctaatcaatggttttgaccactttcagcatgccaagttcaaataattttattgaaaatcaagcaacctgacattttcattagcctatatggctcatcaagaataagtwtttgatttttatagtcttaaaacagttacagtttacaggtcctgttttcaattttcatggacctaagagagggaaccactcttgttaattctatgttatgaattggagttaatttttaagagaattgaaataaattttaatgctgagatcattcaataaatggaactcagaagtaacccatatctgttataaacaaatctttttgtatatgtaagacaattttaaaaactgtatttgcaagaaaacgacctctagctttctcatcaggagtctctaccagtgggctgtgaaaatatggta

SEQ ID NO: 85443 - DNA, 601 bp, Human
tacatgaaaaaccttgatttagatggaataactataaagtccaatgattatttcctaaatatgcctttagcataaacagtttatttgagaattcatatgtacagaaaagtgtaccaattgtaagtgtacagctcggtgatttttcacaagctatgctcatttagccagaatccaaatcaagaaacagaatattactcacaccttagaagccccctcataccatctcccaacttcaactcaagatcacagaggacagtatgggctgcttttagcagctgtccctgtgattctatgtagggartatatgtgaagcttgctcgtggttgttgatagctgcaatgtaaagtaaatgcactgtgttcttaatgctctttgtaaaagaaagtggaaactaaactgagaagataaaccagaaataatgagtctcccattctacgcctttttccccagcaccctctatgccagcttatgaacttgagacacctttgaatcaaactgacaataccgtgacagtcatgctgaaacctgcccacagcagaggagcacctgtcaggtatggaacagagggttgggccggctctagatagaagaaaactaaatc

SEQ ID NO: 85444 - DNA, 601 bp, Human
gtgcttgacactccccaggccctctgggttgattcctgtgggtggcactgagaggttgcactaatccaatggacccaaggcacgcattagatgctatccaagactcaagtgtacccatgaccatggctcagtcttttttgactttaaaagctgaaatttattaaatgaaaatgtatgctctgaccatggccttgggagtgtcatttgtttctgacccacttaacagttgctcagactcagcaataaagggtcattgggacaggactcaatattttactgcaaagcatcatgatcatgtgamtagttagagttcactcagattcaatgcctccaaactgaaggaagctgaaagcttaatcatttttcaaaaacagccagttatcccatggtactttgttcttatatggataccttttgcacattttctatacgtgtatcttactttcaaaccctttcagttggattttcattcgcatctttgtatagatctttccaagaccaagttttgttggtttgtttgtttttgagatggagtctcactctggtcgcccaggctggaatgcagtggccttatctcagctcactgcagcctctgcctccc

SEQ ID NO: 85445 - DNA, 601 bp, Human
tttcatgtaatgtttagacaaataagaactctgattatggaatcgtatggacctaaatataaagccataatgtaaattaaaacatttgaacacatctggaaatctgcaaaatgcacatgtaatcaaactgcagtacaagaaagcttttcccaaatgataagataaatactagaaggaggagggaaatggaagcgaacatctgtttgctttcctggattttgcacagtattgtgtgttcaaaaatactgtcattgtgtgatttccaaaacccatttttttcaattgatttgatttttttttwaatccgtattcattgatgttgaaaattcagtcgaatttcgtttatgcacttcactaagtaaggtggtcatgtattgatttccctacaaacactcagcttggttcatgtagattcttgaaattgcactaaactctcaatgtaaatgattgttgtctttttattgatcaacacatcagctctgtcacataaaattatttaaatcctgagatggccaagaagaacacaattccatcattccagccagtaaactagcatgtaggagagaattttaatgtctgttcatggattcaaagttttttc

SEQ ID NO: 85446 - DNA, 601 bp, Human
aaggtggaaggatcacttgaggccaggagtttgagaccaccctgggcaatgtagcaagaccctgtctctacaaaaaagaaaattaaaaaacaaaaacaaacaaacaaaaaacatagcggagcatgggtatgtgcctgcagtcccaacctaggcatggttgtgtgtgcctatactcaggaggctgaggctggaggattgcttgaacacaggagttcaagatcagcctggacaacatagagaggcccaacatagaccctctaccaaaaaaattttttttaagaaagacaggagataatcatgyatttttgttttaaaacgtttctcagaaattatggttgttggcatacaaatggttatggtttagtagttcaaggttatgaagcataaagcatgtttttttttttctcaagcagcagcaacccatttgtttatctcactgtccgtaagtccaaggaaagagatgttcagtccattaacactaccttcctagacatcctattctcttctccacgctaggagcctttgagcatgccaacctcatggggttcttgtgaagactaaatgaggtgatattatttaacacttcaaaccatgctttgca

SEQ ID NO: 85447 - DNA, 601 bp, Human
gatttagagaaatcaaaaacacttagtcctttttagaaggaaaaaaagagaatatattgatgttaaaaatactgtctggggtattgttaaagtgaatactagaacgcttgaaattgaaaaactagcctagcaatgactttccaataattcattggaaatcactaattatataaatatttttaaaccccaattttcataagcagtaaaaagttgttcttagtgtctcttgtttggaagaaccttctggatctttcttttgttgcttctcctaccttccttatattgcaccttaacccctttrctgtgggcctgtgtccatcaattttgtgacaatgactgtacgtgttgaggtgtgaccatgatgcctactcagtggatgtgggtggcacctctggttactaaaagctagagtgtgaaatgcttctctcggcttcagaaggcatgccagcagcacacttagtgggtgattgtggctcattcttggctagggccggggaagacctaagttttttatcatactgctttgctatccccaaaagaacccatgcctgtccctgaaaaggcaaatatttgagttggaactacagactccatgaaagct

SEQ ID NO: 85448 - DNA, 601 bp, Human
gaaagattaactgatttgactatagatgcctcactttcacatatgtgaaatgtgaggaaaggttgcaaattccaagagactgataaagtcatgtgtgatcactaagccggtatgcttcttagagccctagacttttagaactgaggacgaccaactcagaagtcctgaccacattcctcatgttacatttctgcttcatcctattttggtggtggggagaggaatgagggcacagatacagaaggaattatgttttacatcattctcttcagcagggcattttatcaaccagcacttatamgtatactcaatgtaactatttattataagaacaccagtgtacacaaaagtgctaatatgccttctatttccttaataactattttttaagtatattatattatgcttgtgaggcttacctgtatttcattgcaacttaattaaattaatattcagctcttcaatcagacagtagaaagattagggagtggttttggtgttttttcccatataattatgtcccttttgacatgtatgtatggcccagttccatctcatctctacttctacctgctaagtgttttcctgtcctgtatcaatg

SEQ ID NO: 85449 - DNA, 601 bp, Human
ggtttgaccatcactcaggagcattaattagatttacatgcagttgtgcagagcataaggacatttcattcaacagactgcgtatacagcagtggtcctgaaatattataatactgtcttttcattgcaccttttctacatttagctttaggtttacagatactccccactgttttacagttgcctacagtattcagtagagtcacataccatatagctctgtagcctagcagcaataggctctaccatacagcctaggggtgtagtaggctgtaccatctagggttttgtaagtgcaccstatgatgtttgcacaaagatggaatggcctaatgaggcacttctcagaatatatccccatcattaagtgactcatgaccatatttaatgttgagagtgagcatttccctaggctaaacattatgtaaaacatataaaaatataatcagaaatgcaaaatcatttgatcacaaaatgattttaataatttagtttttgaatatcatgcaatacctctaacctaattaagagtgcaataaatgtttattgaatgaacctcatctttttcttgccagcagtaataattatcacctgaaacatt

SEQ ID NO: 85450 - DNA, 601 bp, Human
agctttaggtttacagatactccccactgttttacagttgcctacagtattcagtagagtcacataccatatagctctgtagcctagcagcaataggctctaccatacagcctaggggtgtagtaggctgtaccatctagggttttgtaagtgcaccgtatgatgtttgcacaaagatggaatggcctaatgaggcacttctcagaatatatccccatcattaagtgactcatgaccatatttaatgttgagagtgagcatttccctaggctaaacattatgtaaaacatataaaaatatratcagaaatgcaaaatcatttgatcacaaaatgattttaataatttagtttttgaatatcatgcaatacctctaacctaattaagagtgcaataaatgtttattgaatgaacctcatctttttcttgccagcagtaataattatcacctgaaacatttattacagataagaagaccctagaccttcatttaactagtgggacataccaggaacaagtggagttttaaattatattttcatccctaaataaaagttaaatatcatgaaccttccatagaatgcagagctataaaagaacac

SEQ ID NO: 85451 - DNA, 601 bp, Human
tttaactttccctcaaactccatttcagacttgcttttgtgcatgaaaatatgctgcctagccttccctcccctacttttcacattttcttttcttcaaagtaatctcttctgaaggattctctgcatgggatcagacctccattctcattcccaggcccccagtgctgagggcggcaagcccagggcgcctgtgggagggtgtacagggaggctgctatagacagggaaggtcaggaatggctctcagagccaaattccactgccagtcaccccccagaaaaaccaacaaaatacttacktaatattttgatataactttaaggattaaaatggatatccagtgaagtactgaaaacaaaaaattatggcctttgtagcctaaggagtgattatagactcgacagagagtagttccaagtttgcctgacagtgatttggaaagagagaggagaacaaagacgaagaccatgcatgccttcaagcttctttcccggcccaccctcaggtacctccttcttcatccttacctcaggccttgtgggcgcctagaggagtcaagactaggaagcctggttttcatgctctgcaggacaggaatt

SEQ ID NO: 85452 - DNA, 601 bp, Human
ttttattcttcccctgtgcctggaacaaggcctgatacgtggtgaatattgtggaaagaaaggatggaggaaacatgaatgaaataattttcttctcatttgctgatgtcacaacttgcctgatcttgtgctgagagtcataaaatattagcgcctgaagggctttagtggtcagttggtgattcaggagcaaagcaggagccagtcacctgtggacggtgattcccaagtcaatgctctctcatcagcacccccttgggcacagctgcctttctctgatagttgcatttgtattccagcycatctggcccaaagcactggaacttttcgggactgaaagattttgaattggataaaatacaaactataaaatatcattcagacaaacatacaggaacaaagctatttggtgtggctttgatagtattctctttctatttttattcaaatcattaggactatttaagagaacatacttttcataatagtaactaattttggattatactttcataatcatgtgtttatgaaattgagatgattaaattgtgttaaatttatatgaaataggaaatgcaaaggaaattgtcttcacttgtta

SEQ ID NO: 85453 - DNA, 601 bp, Human
catggaaagtctaggagcagctgtgctgcttttttgtctagctgggttgtaacaggagggagctccttgcaggttgagagaggtgggaagatcacagtgctccgaggacaccagcccggtgctaaagtcactgtggagcccaggagaacgtcctccctgaaagtaattaatgattcagatatagaattgaggaatgattctgtacataccttgattcctcattccagtgaatgattcctcaatcattcattgaggaatgattcagatacagaaggaattgaggtcaaagccaacattatcrtctataactcccttgatgtgataagtgtgaatctttacaatactcaaaagaagttgactgtggaaagtcagtggagactagcttatgtgttggttgtgtctacaggagcaagtgaaaattcccttcaggccagatggtttccatcagtgccttcactggacctgtgaatgaggaatgccagcacagcctggtctgatgattaggagaactggctctgctgtcagaccacctctgccacttctgtagaataccctggtagaatggcacttcacctctacacctcagttttcacattaggaa

SEQ ID NO: 85454 - DNA, 601 bp, Human
cgcagccttttacaattggtgataataagacatataatggatactggaacactccccttctcccctataaaagctacagaatttatttccaagctgctagtagagccaatggggtaagttgtacagataactgtttacttaggctatttggggttgttaatgtgaacatagattaagtaaaatagtagtaaaatggaagtcatgcttttctgcatttctacttgtaaacaaatgtgattttcttctcttaaaattatttttgtctagagaaatttatggaaagaaacaaatatactcatctttttttttttttgattgggggagtttatcatcaacatgataggttttattttcagttttcctgttaccaaaagttggctggcaattctgcttagcttactattttacaggaagacagtatagctccaacacatacattcagctcatttaaaattttgtgagattcacagcatctgtcttttcagcatagtctgtcccattaaagaaatgggaactgaagaagttccacaagagtttctacttcctatactttgactaaatttggtatcttttttttttcctaagagaaaatagaaaaatg

SEQ ID NO: 85455 - DNA, 601 bp, Human
ggaacttaattgaaaataaaatgtgtgtattatatatacatatatatatatgcatgaatgcatgtatgtattaggatctgatggtaattaacattgactgactggaactcatatagatactttttaaaataagaagctatatttctgtgttccaagcagttttcaatagttacctttttcagattttttcaaatgactttaatttttatatgatctcagtacacgttttttaatccatagtgtcatgcctggtagtaccacatctagtgaatcttcatatgcaaaggaataaaatatcacycactatttttaagtagttctctagttataatagcagtagaaagtggagtctacgcgggcttttttcactggtggtgcgtgtctctctgaacctagtaaccaggttatgttgctgtggagcatctatttcccaagcctggttaaaactctctgagagaatgtgatagaggatgagctgcaaaagtgggtagggcgagttaccctgagctcccccagcatctcctgcagaagcaagtgcagacgtgtgtttgtgaacatgagctgtcatctggtcaacttgacagtgttgttttaaccgtca

SEQ ID NO: 85456 - DNA, 601 bp, Human
taaccaggttatgttgctgtggagcatctatttcccaagcctggttaaaactctctgagagaatgtgatagaggatgagctgcaaaagtgggtagggcgagttaccctgagctcccccagcatctcctgcagaagcaagtgcagacgtgtgtttgtgaacatgagctgtcatctggtcaacttgacagtgttgttttaaccgtcacatacagaaatgtataagaaatgctttgagaaatttaaaatgtcgtcttaaaatgaggcaatataaattaacactcaaagtcaaatacaatcattyagatcattggagtaaccatgaatacagtgggaagttctgtatgatttaatttagagacgatggtaaaaacacatcattaggtctgtagcagaagatttaatcaggtcatacttgatgagttgtgttggataaaataactttttgttgttgtttaactctcaggtgaacatagtttgaatataccatgatgtacatgtgcattttcaaaattctcactgaattcttattttgtgaacttacatgactcttttagtcagtgttagctcaacaaatatttcttggttgcatgttttgtgccag

SEQ ID NO: 85457 - DNA, 601 bp, Human
ctttcatgcgtgtgttctcatttatttcttcattactatgaaaagggaaacaggtactgctattcttatttttaagatgaggaaaaggtgtatttttggagacgaattgactcaccaaggtgactcagctgataatctgggggtcaaggcctgcactcctagccccagtgtttctttcaccattgctcatggctcgtcacccagcagcacctctggccagtgacagtattgtgtagtgtaagcatcagacctcctcttggtgaggattgagtcactgcccaatttactgtgaaaacaacaraatatctgtcatcatgctcatttacatagttaaataattatataaataacacactagtaaatgtggaaacctgacaagtttgctgttttcacaatagattgaattagatagtgatttggatcattttcttccatcagctagatttcatcaatattgtaatttgtttttcaattcaccaaaggatgattaagcaatcagatgacctgattgactaaatattccccactcctattttctgagtcatttgcaaacatttacacagcaacaaactctatccaaagaacctcttttggggaaaga

SEQ ID NO: 85458 - DNA, 601 bp, Human
atcaatattgtaatttgtttttcaattcaccaaaggatgattaagcaatcagatgacctgattgactaaatattccccactcctattttctgagtcatttgcaaacatttacacagcaacaaactctatccaaagaacctcttttggggaaagagggacacattttaatatttcctgcataacattgtcattctgtttcataaaatcacagcacaagaggaaaccttggaagatattctccctccaggcaaaactacactgttttgtgctattttattaagttctacatggacggattcakcaaccctcctttcagcacagtgtaatgtttcaccaccttttagtcagaaaatgtgtccctattgatactagaaattctcttgcaacatgggaagccattccatcttgactacatagtcaaaacagagaaataggaagatctaataactgttgataccacagagtaaagatgtttaaaatgtagaagagttcaaacatcctgagtgtgtgttgccacatactgctcacagtgcgatggcttaattgagttttcagatacagaattgctttcctaagcaacattttgaatgtacaaagattt

SEQ ID NO: 85459 - DNA, 601 bp, Human
gctaattaagattccgtttaatttctcatattctctacatgagaaaaccaattatatagcaagaccactcatatatgctaatctgctgttatttaggctttggattttgaaataggaacattaacattcatcgttcagcattttatagagaaaatgtacttttttcatgtctgaaatagtctttataatgtacatcatgagtatattaaggccccctgagaagttcctaaagaaaagaatccggaaaaaccctatgctttccaaatttatttgatccgaattcattttttaaggaacactsgagtcatgcaaaatgcagttaggtaaatgctggctcaacaagcttccaggagatcccgctgcacgtaactgaaatgaccatttagaagtctgatccacagggaccttacatttatcagcaccagatattgtcttcaaagtgtaggattggaatttctgtctttattccaattttatactttgaagacaatatctggagctgataaatcctttatcttttttcattataaaagagaatatcaccaaacttagtgataattctcttttataatgcatctttattgatattttaagttagagg

SEQ ID NO: 85460 - DNA, 601 bp, Human
tatgctaatctgctgttatttaggctttggattttgaaataggaacattaacattcatcgttcagcattttatagagaaaatgtacttttttcatgtctgaaatagtctttataatgtacatcatgagtatattaaggccccctgagaagttcctaaagaaaagaatccggaaaaaccctatgctttccaaatttatttgatccgaattcattttttaaggaacactcgagtcatgcaaaatgcagttaggtaaatgctggctcaacaagcttccaggagatcccgctgcacgtaactgaratgaccatttagaagtctgatccacagggaccttacatttatcagcaccagatattgtcttcaaagtgtaggattggaatttctgtctttattccaattttatactttgaagacaatatctggagctgataaatcctttatcttttttcattataaaagagaatatcaccaaacttagtgataattctcttttataatgcatctttattgatattttaagttagaggtcagcaaactttttatgttaagggccagataataaatatttgaggccttgtgggccatatggtctctgtcaca

SEQ ID NO: 85461 - DNA, 601 bp, Human
tgtttatataaatcatgcagtggcatatctgcaagtcaaatgctttgaataatttaggaaagtttagaaaaattgaatggcttagagtcatggagttgaactgtgcttccttataccaagagaagtgagcttgttcactcttccctctaaagccttatagacatctctatacattcatataggaaaagagtccagtaaattacttcagattgaaggtgagtagttagtgaactccaaaagacaaacttttttgcttcagcaaaggcaagtcattgtcaagatttctaacatgattacctgrgcaggactcaaaattctggtttcagaagcacctgcttacagtctaggcctgatgaaagccaagtaagaagcagaaactactttctatatgattttcactccagcaattgttttttgtgtgtgaaactaggcaatgtcccctaacatttaagaaaatggtaaagcttaactcatggtagtaaattacaaatgtttaagttgttctgtgaacttattattttggacagtaaagaaaactaagcctcaggaaaattgtagactgatgttataaggtaaagaaatgtaaaataattctatttcc

SEQ ID NO: 85462 - DNA, 601 bp, Human
cttaattcattcagtcatttatttgacatttattgagcaccttatgtgtgccaggtatgaatcgaccaactcttttcaggagttttactttgtatggttgcctagacaccttggcatcaagtacatttgtattagtaaccccaaaacctacataagtgcatactcagatgagtgaaaaattggtatcatacttatcatttagcaaagctaagaaaagacagcagttttataactgatgggaaccaaaggacctgtatttcaaaccgtttctcactgtggtaaacagcctaggaagtggtcrgtgtgacagctctgaacattttctatctgtgacccattcaaccgttgtgtttaatagatcaatcctgtcccttccagaagccaatagaagatataggaggtatacattctgaagtcttcagccattttttgttcattttgttctaactgtgctgacatcttgcccctaaaaatcctatttgatgctatacttgcactgggaagcttttgtgagatgatgagtcctttgccttgctgtccctgttgtactggtacgtggtgcttgctggttaggtttcccttggtgtaggtgggccctccc

SEQ ID NO: 85463 - DNA, 601 bp, Human
ttcttttgactgattttatgttactttatgcaagattgcaaaatatctctttttaatatgtatatatatataaatttaataagcttttccattgcaaataaaacaaaccaatggtttttcaacccacttacaaaagcataatttcgatcacccatttcttttggcaagagccataaaaaggttgaatgttaattgattttctaagagaatgacccagccactcccaccaacattatctgttttcctcctactctgctgactgtctgtccatttctctacttcccaccagtcagatcccatytcacatcctaagtcctctttatcttcagtaaaccgtggcagagctaagatgtaggtagataatgtctgtccttctggggacccaaggttctctatttgtaagatgaagatataactgattggatcttagccacactgagtagcaaggaggacagtatatggcttgaagatggtgggattgtttactgaacattagcttagttagtagcagtaacagcaggtacaaaggtccggtggtgtgatgaagcatggtcagatatgaagaattgcagaaaggtcatcatggctggagagcagagag

SEQ ID NO: 85464 - DNA, 601 bp, Human
ttatttattttaggaaattattactacaatttaaagtataaggaatcaatattcagtctaacagttttcagtctaaagatcccagtgatgtcccttagcatctgtaggcaaatggctgtgttgtactgctgtgtgattaacgttgtggttgactttggatttaggctctcttgtacataaacacttttagattactattattataaaatacctagtatttgtgagagttctttgaaaatatttatggttgtgttccaatatattagatccattcagaatggaaaggaagtcagaatttccktcatcatcataagacagcaggatgtagaggaggcaacagatcaagaaaatatcaagaattaatttagaataaatgatacccctttttgaagaaaggattcttgttttaaatactttcaccaaccttgtcaaaaaatcaagggagaagtcaggctggtgaatggaaagagaaaaagcacagtccttagaggagatgcacctcatttgccctttcagcaatatcagtgtgaaacgtgttcttccatgtctccaatgggctgagagtgaggcccaaagtcttttaaaagttgtcttctaagat

SEQ ID NO: 85465 - DNA, 601 bp, Human
ctgtaaaacagggagaatactatttctttacctcatagttagtggtgagacatcgagtgcaaaaatgcacgtagagtagagcacaaacctggctccaagggaaggcagtggaaatagcagttgctggtgcttctcatgtggctttgttgttgttactctaatataggattgttttatggcccatgaggctttcaagatgactcagtaattaatccaggccactgccagtcccaagttgacactgcagctcttcagagacattcaaaattgaacttctgggaaaatgaatggatttcttgayagtatgtagggtattatttacttgaacaccatgtggatgctgtggtctccaggagcaccgaagcaagagagggacattattattctgtcacatgtgaagacctgtgatgagtctcccactgatgatattttccatttacctgtctttgggataaaagcagcatcagcatgacccaggctgttaccttgctgttggcaatgataagcaatgctggtgttggtgatgctgatgaataaagttactgcattttcaaatacagctattttatttcaagcagtaatagcccaaaacagagcataa

SEQ ID NO: 85466 - DNA, 601 bp, Human
ctctagtgtcagatgacaattctttaacccaagggcggaataaacctcctttgtaatttattccagtttcatggactgaatacaaccaaaattcatttacttgctcttttactgaatactgactacattgtgcatagacaggggaaagcctctctcagcctttctctgtacaaacttgaactcctgcttttacacttatatgttcaaaaatatttttctccatctatacacagaccactcatggttattgttctctttacaaatgcttcttgtgtcttttacaatatccgttcagtaaagrcttgtcaaatgcccaccgtgttaaagagactgttaatcactagacagcaaaggtggtaagaaatgatctttactcttgggaagctccgatggcaggtcacctgcttgccttctcctgcattagataaatgaccctagttccttttatccttcttcgtagtccttcttttttacctcgttgatcatttgtgcttcttttctttgattccttttcctcatccacatgatgactagtatatcatgctccaggattatgtgcatgccattactctcatacatttcagaattgtattgatcatat

SEQ ID NO: 85467 - DNA, 601 bp, Human
acctcagacctttgatccagaatccacggggaacccagccatctgcatgtttcaaagctctccaaatgattcttcacccagcctgagttttaaacttcctataattggagaccctctgttttagaatatattaaacacaacgccacaataaatataagccatatttattaaagccatttattgtttgaggaactattgtgtgtttactaaatgagagtctggagagtacatgacttccactctctcctaagaccgtgtgagtcctcatcacaattctaaaaggccatcttttgtgtgtgtrgttcttaggccctgtgaaagtcatgtcacacatctcatgcaatttgctaggctctacattttttgagcctcagaaatactgatacttctagcaagcatacagaatagactaggtatacttactttttgatgagatggtgaatgacaaatttcagacagcaggaaaagctctaagtggtttttgcaaacaacaactactttgtgtaggaagctgtggtgatcctttctcccacaggaaaaaatgttaagaggtaaacacgaggtctagaccatgacctaaaatacaaatctggaagaaatt

SEQ ID NO: 85468 - DNA, 601 bp, Human
gctctacattttttgagcctcagaaatactgatacttctagcaagcatacagaatagactaggtatacttactttttgatgagatggtgaatgacaaatttcagacagcaggaaaagctctaagtggtttttgcaaacaacaactactttgtgtaggaagctgtggtgatcctttctcccacaggaaaaaatgttaagaggtaaacacgaggtctagaccatgacctaaaatacaaatctggaagaaattttgagagacagtaggtttccattttaatgccttcaaagtttagtttcaagmaaatggttggaaacttccattctgaactacatcaccttcaagaatcatctgttttggaagcagccacccccacttcctttcttgattattcacttatgtgaaagttgcacacagttgataacttattattgacagtttgtttccctattttattacttgataatgatttgagaaattcaaatggaaaaaataaaactatttcatcaaaatagtaagagcagtaataattctcttggacttttagtgtccagatgataagtgataaggctttgatagatcatcttctccacagggcgtcag

SEQ ID NO: 85469 - DNA, 601 bp, Human
gagaagatatatatcaaacaatccattatctcagtcttatatgaaaaattatgtttctgattattacttgtacattgtatatgctctgtttgccctacactggaaattagggacagaagaagagttataaattcaaaagcataatcaggttacaaagaatacacaaaatgtgactgtagattattccaggaatagtgattgacttcgcattcccaggaagaaaaacaataatatgtaatttaaatgaaaaatctaggaggtgttttgtgattatgtataatgtgaagaaggaacagctggaaaaaaactaaacaagactgcaaaggattttaattctctgggcaacaagacctgaatgaactgtctcacaatgatctttaaaacaaggatgttgctgtttttaagaaaaagtatagaaatttacctctgcatatgttcacacacacacaaaaggaaaattaattaaaatagagtattccatgaaagtcattaaaatgctagcacaaagtgatggagtactgaatttaaattttagattatcttttgggaccagtgctctttgaaacgcacttgaaggaacaatatttttacatatttccac

SEQ ID NO: 85470 - DNA, 601 bp, Human
gtgagtctcttgtgtcctgctcgttccagccacccttgcaattcaggcaggggaggctccaggcctgggtggggcagtagccttcccatggctccccaacttccttcccttcccttcttcagtgagcctgcgtattgctgcccagttgttctcaaggtactgttctgttattttctgtggttccttatttactaaatttaatctgggctgtcctacccagtgagcaacacccatcccaccataaagcctcagttccaaatcctcttcccaatcacccccagcccctgctccagaccctgcycttgaagctagtatgtgactccagaggcccctttgttctggcttatgaggcactcttcccacccagcgttgaagccttcccggtccttccagcccattcattatcgcagcctctgacaaggagccctccctcatcccctccactcttccccagctggactctgtagcttacctgtgacacttaaggcttctggccttatttactgtggtcaactccctgaaggaagaggcacatactcaactctaattcccctgcagagccttgttccagtaccttgagcacaaaacgtactaaataagg

SEQ ID NO: 85471 - DNA, 601 bp, Human
cggtccttccagcccattcattatcgcagcctctgacaaggagccctccctcatcccctccactcttccccagctggactctgtagcttacctgtgacacttaaggcttctggccttatttactgtggtcaactccctgaaggaagaggcacatactcaactctaattcccctgcagagccttgttccagtaccttgagcacaaaacgtactaaataaggggctgctaattcggaggctgtggaagccaacatgagccacacatatgaacaggacagtgctggcccacgttcacggcttcrtcccttatatttagagggaacgtcaagtgtcacagggatgcttctgtatctctgatctgaacactggtcacacccctccccaatgtaagtctgagtggggatcaccccctaccttttttttttccccctcctcttccccttcttcatcctaactaggaggagtgaagagacggcccagggctctgcatgctcttggatacagccacagccccacttcccaccctcactgttggctcgtggccatcaggattgctctcactggcccaccttccccttctctctcacgccttagcccccttc

SEQ ID NO: 85472 - DNA, 601 bp, Human
gtggtcaactccctgaaggaagaggcacatactcaactctaattcccctgcagagccttgttccagtaccttgagcacaaaacgtactaaataaggggctgctaattcggaggctgtggaagccaacatgagccacacatatgaacaggacagtgctggcccacgttcacggcttcgtcccttatatttagagggaacgtcaagtgtcacagggatgcttctgtatctctgatctgaacactggtcacacccctccccaatgtaagtctgagtggggatcaccccctaccttttttttttycccctcctcttccccttcttcatcctaactaggaggagtgaagagacggcccagggctctgcatgctcttggatacagccacagccccacttcccaccctcactgttggctcgtggccatcaggattgctctcactggcccaccttccccttctctctcacgccttagcccccttccaaccctgtcttctgtgtccttggaactcctggttggctaccagcagatcccacccatgcccagcctgggacatccctcccttccctcttctagacaacttcaaaactttttggcctgagattt

SEQ ID NO: 85473 - DNA, 601 bp, Human
tggtcaactccctgaaggaagaggcacatactcaactctaattcccctgcagagccttgttccagtaccttgagcacaaaacgtactaaataaggggctgctaattcggaggctgtggaagccaacatgagccacacatatgaacaggacagtgctggcccacgttcacggcttcgtcccttatatttagagggaacgtcaagtgtcacagggatgcttctgtatctctgatctgaacactggtcacacccctccccaatgtaagtctgagtggggatcaccccctaccttttttttttccccctcctcttccccttcttcatcctaactaggaggagtgaagagacggcccagggctctgcatgctcttggatacagccacagccccacttcccaccctcactgttggctcgtggccatcaggattgctctcactggcccaccttccccttctctctcacgccttagcccccttccaaccctgtcttctgtgtccttggaactcctggttggctaccagcagatcccacccatgcccagcctgggacatccctcccttccctcttctagacaacttcaaaactttttggcctgagatttc

SEQ ID NO: 85474 - DNA, 601 bp, Human
ccaaaactaaactcttggtctgcccacccacccctccaaacctgctcctcctgcagttctcgccctgtcagttagtagcagctgtgtctgtccagtgactcctgccagaaatctggttgttatcctaacacactcgacatccagttcatcggcaaaactgatggctggactgtcacagcgtgtctcaagtttgatggcatcttgccacctgcactgctaccttctcactccaagccatgagtgtcttccctgcatcttcgtaatagcctcataactgaggtccctgcctccaccgtggccygctacagcctgcagtacacacggctgccgggatagtgttgttgaatataagccagatcaagttcctcctctgctcagaatcctcccaaggcttctcaagcagagagagtccttccagctatctaaggaggtgtccccaccctaaaattatgcttcaccttctccgcagttcaccgcactccagtcacactcagtatttcagtctcatttgcaccttttccctttttctcctccctggatgtcactctcccactccctttcctctttcaggtctctgctcgaatgttattttctcagtaat

SEQ ID NO: 85475 - DNA, 601 bp, Human
gacttttttcagtttcgtgaatttcaaatgttacttctttttgtatagattgcttatttaacttaaaaaaattttgtttatccacatacacattttatctttaggtttttcttagcaatttgtttaatgtgacaatttcctcccagtcagccacctggtgatatgttccaatagaatattggagtggtgtatttcagatgtaattaccataaaggataattaacattaataccttaaagatttaactgaacaactagtttgagggatattcattgaatcaaaatagcaggacttattctcracattgtcagaaataaaattgacctgtagaggcttcttcagaagggtttttatttcataaggtgtgttttttgcatcatggctgctgctgttgcggctctcaaatgattggaatatgctttgtcatggaaacactgacgagcttccaatttgcttcttccctgaccttgactcacttcctggggtcagtctaatgactacagccatgttcagaatgcagggcctcatgtataaaatctcaccaggaataactttggaaagaaacatcatttacatgttcccaaaggacacaaaaaaacag

SEQ ID NO: 85476 - DNA, 601 bp, Human
tttcgtgagtcaggtgacgtaggagtggaaaacctcatgacagagtggaaagagctggtttacaaacactccgatttaattacatttttaccaacacaaaaagaaaattctaaggaggaaaatttggacataaaattcctccattcggaatgacctgtcacctagtaagggtggtgtggctcagagcatcatcacattctgattttaaaagtacaagcccttttacaaaggagtctttttagggaattgaacattgcattcctaatatttttcatcctgaatgcacttagcagaggaaacrtatatttcatcagacatggatttgacattccattacattgtagtaaacgggacaaacatgtctcatgttttagacatgagaaaggggagctaagacagccaccaccactgtaagaccctggttatctcatttaaacagattttaaatgtgggtgccagtggtgtgatcatcagccgcttccactttgtgaataaattgcttagaaggagtcttttgcctaccagatgtgacctagatttagatttccaaaggcagggggaaaaaactctattgtgttaaaaaacaattgctggtaaaaat

SEQ ID NO: 85477 - DNA, 601 bp, Human
attctgtgtgaatacgcaaagcatatcatatcagaataaccatcctgtgtcttcccacacagtggcagataaagctctgcaaaatcttagaagccacttattcaccaggaaatgtttagtactgatttccaacatactaagacatttggtaatcacaaagatatgagaagactttactttttattatagtgaggatgatgatgatgacagattttatggggcctgtgttatatgtaggcaccgtgctagggaaggtcatcagcacaacatccatgagaaagagaacccgcaaaaacagccygacagaaaaatgcagcgcgggagcagctcgtgttagaacaaatcacagagcaagtggtgtggctgggcaccgtggctcatgcctgtaatccccgcattttgggaggtggaggcaggtgaatcatttgatcactttatcccaggagttcgagaccagcctgggcaacatgacaaaaccctgtctctacaataaatacaaaaatttgttgggcgtggtggcacacacctgtagtctcagctactggtgaggctgagatgggaggatcactttgagctatgatcactccatggcactccagcc

SEQ ID NO: 85478 - DNA, 601 bp, Human
ttgttgccattgcttttggtgttttagacatgaaatctttgtccatgcctgtgctctgaatggtattgcctaggttttcttctaggatttttgtggttttaggtcttatgtttaagtctttaatccatcttgagttgatttttgtatcaggtgtaaggaaggggtccagtttcagttttctgcatatggctagctatttccaacaccatttattaaatagggaatcttttccccattgcttgtttttgtcaggtttggcaaagatcagatggttctagatgtgtggtgttatttctgaggsctatgttctgttccattggcctatatatccgttttgataccagtaccatgctgttttggttactgtagccttgtagtatagtttgaagtcaggtagcatgatgcctccagttttgttctttttacttagattgtcttggctatgtgggctcttttttggttccatatgaagttaaagtagttttttccaattctatgaagaacgtcaatggtagcttgatggagatagcattgaatttataaattactttgggcagtctggccattttcacaatcttaattcttcctatccatgagcata

SEQ ID NO: 85479 - DNA, 601 bp, Human
tggaaggtgggcttttaacagaaaatgtaaagtctgttcagttcatactaattagtacatggaattatttaacatataggcaataatggctaaaaactgacatgaccatcagctttattttaggatgttttacaaacctatcacaaagcaacaactaattttttgttcatgtatattaattcatttggcctttacctggactaatatcatctgaaaccttcttttctttgaaacattttatgaaatgtatacacttatttttactttattatgtaagcaaagcaattttttattttccgtsccacaaattatgtgttcctttaaagatttgacattttgatgcagcaaatgttaagaaaaggtgtgagataaatgtctacaaaataaatgttttatacagaaccacggggcaatgtactctcaaaattaatataaaataacttgaataggacatattttttttaccaggtttcatccatgtataattagatatatttgtataaatgaaaatacctgtatttttaacatttttcataaggaataatgtatctcaataacatgtttgacagaacttagtatgtaagcactatcaattttacca

SEQ ID NO: 85480 - DNA, 601 bp, Human
ggtactctttataattagctgacaacaccgtgcagtcatcagcttgttgcagtttaccattgctttaagtctataaatatttgaaattctgccagcatgtcttattcttttctttgagccatcattgcagaatagctaaataaatgcttttttcgtatcctcctttgcagaagcatttttagaattcttttgaatagctgtattttgtgtcatttgttgattcctgagtttacttctgataactctcaatggtgaggatgctgtatcctcttgtctggtttactgaacaagagaatcttgytaagttttagaggaagccataaagcaggggagcattagctgcacctttcctcctcagagacaaatgctggggtcttccgtggtgaaagtggagaccctggggacagctgccttatgcccacaccttggttccgtggcttactggctgtgtgaccttagacaagccacctagctcggtgtccctcagtttccccagctattccaagggcataataatagttcttacatcataaaatgttatgacaagaaaacaagttgatacctttaaagtgctggccccagtaaatattaactctattga

SEQ ID NO: 85481 - DNA, 601 bp, Human
gtcttattcttttctttgagccatcattgcagaatagctaaataaatgcttttttcgtatcctcctttgcagaagcatttttagaattcttttgaatagctgtattttgtgtcatttgttgattcctgagtttacttctgataactctcaatggtgaggatgctgtatcctcttgtctggtttactgaacaagagaatcttgttaagttttagaggaagccataaagcaggggagcattagctgcacctttcctcctcagagacaaatgctggggtcttccgtggtgaaagtggagaccckggggacagctgccttatgcccacaccttggttccgtggcttactggctgtgtgaccttagacaagccacctagctcggtgtccctcagtttccccagctattccaagggcataataatagttcttacatcataaaatgttatgacaagaaaacaagttgatacctttaaagtgctggccccagtaaatattaactctattgataatatgcattatacaccagtatacaagctgtagctgcctctctggtttcaatgctcatggcttgcgtgcctcgaagtctttgtgtccggacatggga

SEQ ID NO: 85482 - DNA, 601 bp, Human
atgctgtatcctcttgtctggtttactgaacaagagaatcttgttaagttttagaggaagccataaagcaggggagcattagctgcacctttcctcctcagagacaaatgctggggtcttccgtggtgaaagtggagaccctggggacagctgccttatgcccacaccttggttccgtggcttactggctgtgtgaccttagacaagccacctagctcggtgtccctcagtttccccagctattccaagggcataataatagttcttacatcataaaatgttatgacaagaaaacaagttratacctttaaagtgctggccccagtaaatattaactctattgataatatgcattatacaccagtatacaagctgtagctgcctctctggtttcaatgctcatggcttgcgtgcctcgaagtctttgtgtccggacatgggagaagaccaaggaacggagctgtctccccttgagagggggtcctctctccttttcccatggagagcatcatttctttgtacccaaagaaacacacgggatgggtctttaattatgaagctagctaggaacacagctagctggaatgagacagctcatttt

SEQ ID NO: 85483 - DNA, 601 bp, Human
acctggggtgggaacagaaggacagcatcactgtcttcggtgtgcataaaggccttgtcatgtatctgtgtggactccctgagcctctcctcagtgctgcttgttcaccttccacagttgcaggaggtcgaaggccctgtggccaggcaccagccctgaacttgcaccacattcagcagggctgaattctcaccagccatctcagggcacaattttcctactgattcctcatttgaatgcctggtaactccactcatttttaacctctatctattagcatagcttattaaaactggttctrtctgtgtctcttaattcctaaactcaagccctagacttcttaaaagggtattgagagagggctgcataattactactaaaattgatcattcttcacagttgatgtctcaagatggagtgtgttgacattcccagtcccacccaagtgcttcatgatctttactgggtgtgtgttttgattcatgttgatgtgacttcactttctagttcataagagcgttaaaaactgagcatatttttcttgggatgatcgtttaaacttgtatcttggttatcgaatccaggaattcaaacctaataa

SEQ ID NO: 85484 - DNA, 601 bp, Human
ttgctttttaaaaaaaaaatttcagggatgtaagtttcataatattataagatgttttaatttttctgtagtgtagatattataatggacagactccctacgtgtagtagtatgaatttgttaaagtttgaataataattatttgaattaaaaatttaatatattaaaatagttgaaatgaataggagtacctttaaattcagatacagcttaattcaaaagaaaaatgggctcatcactatcatttatttaaacgatcatttatttttaagccacctttgaaatattttttataaatcgkgtattccattgcatttttataaccaacatcaattgagattaacaagtcctttgttcaaaaaaacgaataaacctccttaagatgaaatttttttaagggaagtcagggagaactttattctttttatgtattttctatttatttatttattggagatagggacttgctctgttaaccaggctggagcacagtgacacaagctcgctgcagcctcaaactcctgggctcaagtgatcccccgtctcaacctcccaagtagctaggactgcagacatgcgccaccacgcccagaaaattttg

SEQ ID NO: 85485 - DNA, 601 bp, Human
ggaagctgtcatgcaggagtggtgttggctccttgggggacacttggggatgcctgagggtgtctttgctgagaattaccttattgtaattgcatctgttggttgcagttttgtagtcacaattgtcaagatttttctttaataatttgtcaggctaaggttgactctgagttcagatcctaaaggtcatagaagggttaaaatcataactgcctaggggggccagtagagttgacctgtgtatggatgagctcctggtgcagagagtgtggtgagaaggcacccactgtccagcttcagrcaagtatattacagtgtcacaaatcttcccatctcccctgagggaagggagaaatcttgatttctttactaagtgttctaactttttggttggcaatgaatcactttttaaagtatgtgttggccaaataaaatagatatccagtcacccgcatgtgattcttaattgtatttttaagataaaccaagcaggagacatttaaaaatcttctgtcacttacatgtctctggctacacatgttgtcttataccaaccaggaaaggacaacggatcatttcctggtcgtgctacccctttacc

SEQ ID NO: 85486 - DNA, 601 bp, Human
tctcccctgagggaagggagaaatcttgatttctttactaagtgttctaactttttggttggcaatgaatcactttttaaagtatgtgttggccaaataaaatagatatccagtcacccgcatgtgattcttaattgtatttttaagataaaccaagcaggagacatttaaaaatcttctgtcacttacatgtctctggctacacatgttgtcttataccaaccaggaaaggacaacggatcatttcctggtcgtgctacccctttacccacgtgctcattcataccctgtgatgcatgcmaatggcaccactggcctgcatcctacttcgtgatagctggttcttgctcagaaatccaagagaacttaggcatcagttatcttgtaggtgatatggccagatggtttggaataagtgtgcctcccatttctaattagagctcatccctgtgttctgcactgggattgctgttgactcctgttatttcttgctaatccaagctggaattcctctggactcttgttgagcctcagatagcaatatctgttagaatactttttctcataagactacagttaaattttgtggggtttttttctt

SEQ ID NO: 85487 - DNA, 601 bp, Human
acttaggcatcagttatcttgtaggtgatatggccagatggtttggaataagtgtgcctcccatttctaattagagctcatccctgtgttctgcactgggattgctgttgactcctgttatttcttgctaatccaagctggaattcctctggactcttgttgagcctcagatagcaatatctgttagaatactttttctcataagactacagttaaattttgtggggtttttttcttttttttttttttcctacggagtttcactcttgttgcccaagctggagtgcaatggcgccatctyggctcactacaacctctgcctcctgggttcaagcaattctcctgcctcagcctcctgagtatctaggattacaggcacatgccaccacgcccagctaattttttacatttttagtacaaacagggtttcaccatgttagccaggctggccttgaactcctgacctcaggtgatccgcccaccttggcttcccaaagtgctgggattatgggcatgagctaccgcgcctggcctaaattaaattttgtaaattctgtttacatgaatggtctttctggactttgaaaacaactccgccagt

SEQ ID NO: 85488 - DNA, 601 bp, Human
ctcaggtgatccgcccaccttggcttcccaaagtgctgggattatgggcatgagctaccgcgcctggcctaaattaaattttgtaaattctgtttacatgaatggtctttctggactttgaaaacaactccgccagtgtaggaaagaggaatgggtggccctggctgtgcccacttctgcagatggttcccaggagggaagccagcccaccccagcatggctcctcaccctgagcactgagtgctggggaccacccgctacctcctcaacacaggtgaccaaggccggagacccagagatmatctaagaacaaggctgttgctaacacgtggctgatgatttctttatgtacccttttatgccgggtttgaggagtaagatttatctgagaataagtacatagcatatttccctatgtatccattcctctctccaccccatacacacatctttacgtgtgtttcaggaggtggggagggaataaaaatttaaacagtctccagggccctgaagtttctaaactgctaagtgtccaatccacagcctggcgagctgatgtggtcttggcatcaggctgcagttgtaaaaatgctctgctgct

SEQ ID NO: 85489 - DNA, 601 bp, Human
ggcaattgctcaagtgcctgagctgaacaggcttagcttcaggatcagtttaattttctgctgtcctaattgctgtgctggtgcctggacttaaacaacctattcatttgaatctccaaacaacttcctattcatttgaatctccaaacaacttctaactcatgttccaaaacttcctaacttctaaagttgtgattttttttttaacctggaactttcaggatgctagcctgattttctaaattttgcctgactctagattaagtctagcttgtcgaatgttcttcaagaaacacactcrccattcctcagcttgccagtggtgaggtccagtctctttcaccgtataattagcgggaagtgtcccctgccctccttagccaatacccaggctgttagccatgtctctcaagggaagtctgccaagcacagaggacaatattttaccaaaggaacacagcataaataaatgttcttatcctgtgtacctttttcacttttatgatcaacactgatataaagaacaacaatagcattaaaattaactgaagttatgagtacctaagtagaatgataattcattatgtgaagagggtggttg

SEQ ID NO: 85490 - DNA, 601 bp, Human
gtgctggtgcctggacttaaacaacctattcatttgaatctccaaacaacttcctattcatttgaatctccaaacaacttctaactcatgttccaaaacttcctaacttctaaagttgtgattttttttttaacctggaactttcaggatgctagcctgattttctaaattttgcctgactctagattaagtctagcttgtcgaatgttcttcaagaaacacactcaccattcctcagcttgccagtggtgaggtccagtctctttcaccgtataattagcgggaagtgtcccctgccctmcttagccaatacccaggctgttagccatgtctctcaagggaagtctgccaagcacagaggacaatattttaccaaaggaacacagcataaataaatgttcttatcctgtgtacctttttcacttttatgatcaacactgatataaagaacaacaatagcattaaaattaactgaagttatgagtacctaagtagaatgataattcattatgtgaagagggtggttgattaatgagcaccattaacaagttcatagtttcagtggtcaaaattacagatctgattatgtgcagtgtaacat

SEQ ID NO: 85491 - DNA, 601 bp, Human
gtaccgccaaaacactggtgatgcccagattcttgcagtctcaagtgaagaaagcaatatgttctgctgcattatttttaggcaccagagagtgaaatatgggtagtgtcaggccagtcgcttccatggctatcaatttttgatcttctttactagtaacagtgagggtggcacaaattatccatggacagaataggaatgtgcccagcattctggaagcttatagtgcttcaaatcaaatccacacagctccccacgtgcagaattgtgcagttccccccttatgggcttgatttttttwaaatgtaagaaaagatattcagcatttgctacctaacacttagggctcgggtccctctcagttgaatgaagctctaattatgcatcttgacttattctgtagtttctaagtagcctttccattcagggtattcttgtggctgtctgtgaactagaaactcacagagggcaggagccatggcttgatcatgtttgtctctcccattcctaaagcagactaagcacatgataaatgtttattgatccactgcagaaatgagtgaataaacgcagatcctatctatgggagtgccttggtgcc

SEQ ID NO: 85492 - DNA, 601 bp, Human
gaaaccaagactgagcaaactaagttgcttaaagttgcatggtcagtaagcaactgaaccaaggggtaaagccaggctgctggtctccagagcttccactctgagccattatgatactttggttgaaataaaatagacctaggcaaagatagacacaagatctacctgttgagctggaaagaaagcagctgaaaattctgtgacttgaattattatgatactcatatctctcccttcacccagttaataaaagaagcaccctgcaaagccaagtgtgcaggctctaagctactcttggacrcaggctctgctcacttaaggtcaggaagcagagaggagacctgggtgcctctggctcctttggaagctcctttagcatatgaagcatctaagtaggcttgaaatatgccacaaatgaatggtcatcttcacgcaccaatagttttcaagcctccatggtatgtgtgcatgttgtaaaatccacattggtgcagcagcctgtcttacccacatgcggtgactctttccctcctcctatctggtaccacatggcattaggccagagactcccacaaacaaagcctgttgttgctttgtgtac

SEQ ID NO: 85493 - DNA, 601 bp, Human
ctataaatatcttatcacgctcctaggagatagtttccttagataaagaaatcttgtgagtgaaaggaaggaaaatgaaggtggaaaaggataaatgtcatcgatatagcacaatgagaaacaccacacctagcaagaagagacccgagtcctattttctccaaccattgtatattcattttctttctcttccgctcgaaaagtgaatttaaaaggtcctatagcagtatatcacagacacatgttaacaaatggctgcccaaaaagttacatcttcaaaaataccatgttgatttgggcaaaaaaaaaaaaaatgcttatcaaattagtaagacaaaaccttttgctttttgtggcagcagttgtgggggtgaaggaaaataaaaataataagtctaaaagtaataggtctacttcccctgttgccgagtacactctctgaacacttcataaagtgtacctccatgtagccttttcagatagcagtgatttagacatagaaacaacattatcagtaacaaggaagaaaaaaaccttaattgtctaattgatggctattatgagattccgtataattcatggaattggtaagaatttcacc

SEQ ID NO: 85494 - DNA, 601 bp, Human
ggttagcctaagtgttggggaaaatcatctaacacaaaacctattttataataaagtgtggaatatctcatttaacttattgaatactgtgccgaaagtgaaaaacagaatggttgtatggatactcgaagtacagtttctactgaatgcggatagctttagcaccattgtaaagtcggaaaatcataagtcagggaccgtctacaattgcttttgctgtattctcgttttcagcaatataaagacatacccgatactgagcagtttacaaaagaaagaggtttaatggactcacagttcyacgtggctggggaggcctcacaattatggcggaaggtgagaaaggtggcaaagatacagataaagcactgttcctgaataacatttcaagtcttgaccttttttttttttttttttataactttacagacttacctattccctgcaactcattcagggtatggatgatcttgttttatggtcttgctgcaattcatagcctgttagtagctgtgtcttcaatgtactgggaaatttatctttgtacaggaaggcactgtttcaagacccagagctgtgttcctcaatagtccaaggaacc

SEQ ID NO: 85495 - DNA, 601 bp, Human
tctaacacaaaacctattttataataaagtgtggaatatctcatttaacttattgaatactgtgccgaaagtgaaaaacagaatggttgtatggatactcgaagtacagtttctactgaatgcggatagctttagcaccattgtaaagtcggaaaatcataagtcagggaccgtctacaattgcttttgctgtattctcgttttcagcaatataaagacatacccgatactgagcagtttacaaaagaaagaggtttaatggactcacagttctacgtggctggggaggcctcacaattayggcggaaggtgagaaaggtggcaaagatacagataaagcactgttcctgaataacatttcaagtcttgaccttttttttttttttttttataactttacagacttacctattccctgcaactcattcagggtatggatgatcttgttttatggtcttgctgcaattcatagcctgttagtagctgtgtcttcaatgtactgggaaatttatctttgtacaggaaggcactgtttcaagacccagagctgtgttcctcaatagtccaaggaacctgtctcagaatcatccgggtacttaca

SEQ ID NO: 85496 - DNA, 601 bp, Human
aaacctattttataataaagtgtggaatatctcatttaacttattgaatactgtgccgaaagtgaaaaacagaatggttgtatggatactcgaagtacagtttctactgaatgcggatagctttagcaccattgtaaagtcggaaaatcataagtcagggaccgtctacaattgcttttgctgtattctcgttttcagcaatataaagacatacccgatactgagcagtttacaaaagaaagaggtttaatggactcacagttctacgtggctggggaggcctcacaattatggcggaagstgagaaaggtggcaaagatacagataaagcactgttcctgaataacatttcaagtcttgaccttttttttttttttttttataactttacagacttacctattccctgcaactcattcagggtatggatgatcttgttttatggtcttgctgcaattcatagcctgttagtagctgtgtcttcaatgtactgggaaatttatctttgtacaggaaggcactgtttcaagacccagagctgtgttcctcaatagtccaaggaacctgtctcagaatcatccgggtacttacaacagtgcat

SEQ ID NO: 85497 - DNA, 601 bp, Human
atggatactcgaagtacagtttctactgaatgcggatagctttagcaccattgtaaagtcggaaaatcataagtcagggaccgtctacaattgcttttgctgtattctcgttttcagcaatataaagacatacccgatactgagcagtttacaaaagaaagaggtttaatggactcacagttctacgtggctggggaggcctcacaattatggcggaaggtgagaaaggtggcaaagatacagataaagcactgttcctgaataacatttcaagtcttgaccttttttttttttttttttataactttacagacttacctattccctgcaactcattcagggtatggatgatcttgttttatggtcttgctgcaattcatagcctgttagtagctgtgtcttcaatgtactgggaaatttatctttgtacaggaaggcactgtttcaagacccagagctgtgttcctcaatagtccaaggaacctgtctcagaatcatccgggtacttacaacagtgcatacttctttgtcataccccaggcatattgaatcagaatgcaggatggaggaatctatacaagttcccccagtgatagggatc

SEQ ID NO: 85498 - DNA, 601 bp, Human
caccattgtaaagtcggaaaatcataagtcagggaccgtctacaattgcttttgctgtattctcgttttcagcaatataaagacatacccgatactgagcagtttacaaaagaaagaggtttaatggactcacagttctacgtggctggggaggcctcacaattatggcggaaggtgagaaaggtggcaaagatacagataaagcactgttcctgaataacatttcaagtcttgaccttttttttttttttttttataactttacagacttacctattccctgcaactcattcagggtatrgatgatcttgttttatggtcttgctgcaattcatagcctgttagtagctgtgtcttcaatgtactgggaaatttatctttgtacaggaaggcactgtttcaagacccagagctgtgttcctcaatagtccaaggaacctgtctcagaatcatccgggtacttacaacagtgcatacttctttgtcataccccaggcatattgaatcagaatgcaggatggaggaatctatacaagttcccccagtgatagggatcctcactgatgtttaacaaccactgctccagaggggtgggccagct

SEQ ID NO: 85499 - DNA, 601 bp, Human
gaaatttatctttgtacaggaaggcactgtttcaagacccagagctgtgttcctcaatagtccaaggaacctgtctcagaatcatccgggtacttacaacagtgcatacttctttgtcataccccaggcatattgaatcagaatgcaggatggaggaatctatacaagttcccccagtgatagggatcctcactgatgtttaacaaccactgctccagaggggtgggccagctgccgacatttcttgtgtcctaattgtgaggaaggttcttaaccatagaatgttaatgtaaacacaagaaaaaaaaaaagaaaaaaaaaacttctgcttaacctcagcccatttgaagcagaaagaaaattgcagggaaacccaaatctgtggtcctgattctgctgttgctttaagatcatctcaccagcaaacaccatggtttggtctcgaaagggtcccagatgaactaactcacctggcactgtaattaattgtaccagagtatgatgatgcatgaaacaatgttcactgtgtgtatgtatgtatatctacttacatatacacacaaacacatatgtttttcttgtgcttatttaagttttcatc

SEQ ID NO: 85500 - DNA, 601 bp, Human
cagcaatgcaaaaacttcaaaagacatctcaaaaggccaatcttaggatggatgtggtggctcacccctgtaatcccagcactctgggaggccgaggtgggtggatcacttgaggtcaggagttcaagaccagcctggccaacatggcaaaaccccatctctattaaaaatacagaagttagcctgtgtggtggtgtcgcccataatcccagctactctggaagctgaggcaggagaatctcttgacctgggaagcagaggttgcagtgagctgagatcacgccactgcactccagtctgrgcaacagagcgagactctgtctcaaaaaaaaaaaaaaggccaatcttagattttacaatagtggtgttatccacaggagtaaagggaagttgcaaatcttgtcacctccagaataatggctggtaaccattttcctttacactttagcagaattctggctcttcatccccctaacctggtggtctttcattagctttacaaaggtggtttagttttggggaagggttattatcatttaaactataaaagaaatgtctcccaaagttagcttggcctaagtctaggaataattaaggacag

SEQ ID NO: 85501 - DNA, 601 bp, Human
gtggtttagttttggggaagggttattatcatttaaactataaaagaaatgtctcccaaagttagcttggcctaagtctaggaataattaaggacagtttacagcttaaaggcaatatgggggttggttagctaagatctctttcactgtcatagtttcctcactgttataatttttgcaaaggcagtttaaaaccaaaagatcagagcaaagacatatgggtttgaggttttacaatgtaagaattgtaatatattatagttgatttgatgaaagaattatcaaccaagcagtataagcwcaatactgaccaagtgtggaggattattgagctcagaaatagtcatgcagtaagaggcgagggaaatctatagggaaagtgcaatttgctgtatcttattaaaataaaaatatgccttgctacctgagtaagaatgcacatactttttttaaaaaaaatctttgtcatatgactgcctattactgtttgaatcataacctccattgctgctttcattcaaaagaagccattaaattcacagacttcctgcatgtgcccagtgtgtgaaagctttaattaaatctacaagtagagccttaa

SEQ ID NO: 85502 - DNA, 601 bp, Human
ttggcctaagtctaggaataattaaggacagtttacagcttaaaggcaatatgggggttggttagctaagatctctttcactgtcatagtttcctcactgttataatttttgcaaaggcagtttaaaaccaaaagatcagagcaaagacatatgggtttgaggttttacaatgtaagaattgtaatatattatagttgatttgatgaaagaattatcaaccaagcagtataagcacaatactgaccaagtgtggaggattattgagctcagaaatagtcatgcagtaagaggcgagggaartctatagggaaagtgcaatttgctgtatcttattaaaataaaaatatgccttgctacctgagtaagaatgcacatactttttttaaaaaaaatctttgtcatatgactgcctattactgtttgaatcataacctccattgctgctttcattcaaaagaagccattaaattcacagacttcctgcatgtgcccagtgtgtgaaagctttaattaaatctacaagtagagccttaaaagaacaagaatcaaattaattgcaacatggtccacgcatttgtctctctgacagtccctgtgctt

SEQ ID NO: 85503 - DNA, 601 bp, Human
acagtttacagcttaaaggcaatatgggggttggttagctaagatctctttcactgtcatagtttcctcactgttataatttttgcaaaggcagtttaaaaccaaaagatcagagcaaagacatatgggtttgaggttttacaatgtaagaattgtaatatattatagttgatttgatgaaagaattatcaaccaagcagtataagcacaatactgaccaagtgtggaggattattgagctcagaaatagtcatgcagtaagaggcgagggaaatctatagggaaagtgcaatttgctgtmtcttattaaaataaaaatatgccttgctacctgagtaagaatgcacatactttttttaaaaaaaatctttgtcatatgactgcctattactgtttgaatcataacctccattgctgctttcattcaaaagaagccattaaattcacagacttcctgcatgtgcccagtgtgtgaaagctttaattaaatctacaagtagagccttaaaagaacaagaatcaaattaattgcaacatggtccacgcatttgtctctctgacagtccctgtgctttggagaaaaggcaatctgtgcactctt

SEQ ID NO: 85504 - DNA, 601 bp, Human
ttcttatgccatagtcaagacaaattaatttgtaatattattattcaactttttggtggcctgcaatagtgtaaaataaggaagtgatgtttgtgcttaaggaagacttctacaactggagtgaataaatattcaccccatgaggaaattagaggtaaaatctgtatatttgaggttttagacaaaaaagactccacaattcctatataagcttcagtgtataattactttgtttttatttttgttttatatccagaaggtactgtttcttaatatgtcaatgctataatataatcacacyggcaatctagaaatacctacttcccaactttcagcatttaaatgggagtttaattcaacagtgtatgattttcttgtttttaaaggcttcacctatgaatcccttaggccaaatgtttaaagctaatgaactgtagctcgttatattctgcttatatgagggaaatagcctgaagcagggtggcctggcttagtgtgctgagtccagtaggcatcttgaaggtaatttcgttggttgcacatagtttagaattataacaaggatttctgccttgaaacattacgtattttagcgtgagaa

SEQ ID NO: 85505 - DNA, 601 bp, Human
actgttctagacattgcagatatagccatgaacaaaacaaacagaaatctttgcccttctggagatttgaaagctatgtcagatgttttactctgagcgatcatcaaggaggaaaaagtgagaattgagagtgattccatctttctccaagtgtaccccgtcttttttattttgggtaatgttggttaaattaacacagtctgctaaaaccaggccatagaaagcgtggcaattgctggaggcaacttctgaggagcccacttcggtgggcagagtggcttctgctgagcctatcacagarggcggcgacctctgcggatcacgcacatcagagcctcactggaagcctgtgttcctctggaagtagacgagctatccatcctgagactgaggggcgaaaaaggaaatgagcctgaaccagactccacggaccaaacaaatgaccaagtgccagaaagccttctgtcttgggcaactgtacttctgccggagttaatagcattttctgctgcttgtgcatcttagaagagtaaaatcgttttgtgaactatttccacccatgacttctcatgacactcagttgaatcagacaagctgaggg

SEQ ID NO: 85506 - DNA, 601 bp, Human
ctatccatcctgagactgaggggcgaaaaaggaaatgagcctgaaccagactccacggaccaaacaaatgaccaagtgccagaaagccttctgtcttgggcaactgtacttctgccggagttaatagcattttctgctgcttgtgcatcttagaagagtaaaatcgttttgtgaactatttccacccatgacttctcatgacactcagttgaatcagacaagctgagggtctctgagggaagatgaatccgcatcaggctttccccagcttaacagttcagaacccacttttccttcatcrgtgctggcagtgttgcaaagataattctcagctcttgagccctttaaaatatttagctttttaatacgtgaaaaaaagaaaataccttaaaaaagaaaaagtggaactcaaaggaaaccccttcttttaaatataatggttcaattttaagatgaagatgagtagcatttgttgggggtctttaattacgctggtctgtggcttaccttaagagctagctgcctttgatgctttcagttcttattctaatttaactatttttttcctatgccattattgtaccatgaaaggaaactccct

SEQ ID NO: 85507 - DNA, 601 bp, Human
aatcagacaagctgagggtctctgagggaagatgaatccgcatcaggctttccccagcttaacagttcagaacccacttttccttcatcagtgctggcagtgttgcaaagataattctcagctcttgagccctttaaaatatttagctttttaatacgtgaaaaaaagaaaataccttaaaaaagaaaaagtggaactcaaaggaaaccccttcttttaaatataatggttcaattttaagatgaagatgagtagcatttgttgggggtctttaattacgctggtctgtggcttaccttargagctagctgcctttgatgctttcagttcttattctaatttaactatttttttcctatgccattattgtaccatgaaaggaaactccctcataaacccatcatattgttcactgtagagaagcagcgtgtgaatatgtttatagttgctgaatatattcaaaaatgtcttttttatatgattatggtcctgaatgtttatttttatttattttattttattttttactttagcttcagagggtacgtgtgcaggtttgttacttgggtatattgcatgatgctgaggtttgggcttctag

SEQ ID NO: 85508 - DNA, 601 bp, Human
cattgtttttcgcgcagtgtgtcacaaatcttgccacaccaagagttgtatttaacgatgtactgttaataatccccccagactcagctacagttaaggttgtagtcacacagcacttataattagataagtttacttttgtttcaaaactttctttgttttcattgtaagtcatggacttcctcgtttccaaaacctaaacaaaataaaccatagcttctaaatggatttagacattaaaagccttctcaagtatgtcacttttttttcttgattaaaaatatttaactcttacaagttrtttaaatatggctaaattctgttatggctaaaatcctaattttttattttatttccaaagatttgatgctgtgactttcttatcagaatcaccattgttgctcataatataatcaatcgggagagacaaaaaagaggcaggaaagcggtgaacttgtgatgcgatgacataaaggaagagaagctaatgctgtgttgtttgtcctgcaatatctgcttcattttgctttcagcagaggtttcctggctgctttttcctcctttctttgcccttctcctccttcgttcattctccaggagc

SEQ ID NO: 85509 - DNA, 601 bp, Human
agctgatcaccttgctcggggtcctgtgactagtaggagtggggctggggtcgcgagccaggcagtgtggtgtttgggcctctgccctgaccagcctgcctcctggtagttgtctccctattcaggtttgtcactagacattaccgtctggcacagggcctggcaggtcagtggcctcaggtggctctgggtctgtggccaccgtacagagcgatttgaactgttcatctctatgacccgtctttgtgtgtcttgttaatagatgtttcccagggagtatatgagttgcataaaaacataygttccttttgtgaaaagtttctctaggcaggcatatggaatagagtgtgaaaatcatgtgaccactggaggcctagtgccttcacctgaagaggcaaaattcctgggtaacaagaatctacagaggaaaaacaaaataaaatacataggtactatgttaacgtataaatgaaatgtgtctcccaatgttgccccttacctcctccatacacagtcctgttccccagggggaaatctggtttctaaatctggaaaaggaagtatatttacttctatttgttatttgttggacattttgtga

SEQ ID NO: 85510 - DNA, 601 bp, Human
tttgtatgtttttcattcatagatctcagggttgaggctgggcgtggtggctcacacctgtaatcctagcactttgggaggccgtggcaggaggatcacctgagcccagaattcatagcctgggcaatatgacaagaccccatctctacaaaaaataaattagccaggcatggtggtgtgcacctgtggtcccagctactcaggaggctgaggcaggatcacttaagtctgaggctgaggcttcagtgagccatgctggcaccactgtactccaatctgggtaagagcaagactcgtctcaaaaaaaaaaaaaaaaggtctcagggttgaaaggtaaatgaagaaaacatcccctgtttttggagagatcagctcacggggggttctgctacttctgagtggtaaggggaagggcatactgatgtccttctctgtccactctgcatctccatggacaggtgctttgtcaccctgttccaccttataaaagcaaaaatgttcccactgagaattaagcctattttgttttatcctcagcccaaagcgaaataaagccatagaaagtttttgggatgatttatcaatgcctgaattggcatcc

SEQ ID NO: 85511 - DNA, 601 bp, Human
gaggccgtggcaggaggatcacctgagcccagaattcatagcctgggcaatatgacaagaccccatctctacaaaaaataaattagccaggcatggtggtgtgcacctgtggtcccagctactcaggaggctgaggcaggatcacttaagtctgaggctgaggcttcagtgagccatgctggcaccactgtactccaatctgggtaagagcaagactcgtctcaaaaaaaaaaaaaaaaggtctcagggttgaaaggtaaatgaagaaaacatcccctgtttttggagagatcagctcacrgggggttctgctacttctgagtggtaaggggaagggcatactgatgtccttctctgtccactctgcatctccatggacaggtgctttgtcaccctgttccaccttataaaagcaaaaatgttcccactgagaattaagcctattttgttttatcctcagcccaaagcgaaataaagccatagaaagtttttgggatgatttatcaatgcctgaattggcatccttcagagctgatatgtgggctctttattcgtttattccctgggggtggagtataggggaaggtggcttacctgagtg

SEQ ID NO: 85512 - DNA, 601 bp, Human
aaggtctcagggttgaaaggtaaatgaagaaaacatcccctgtttttggagagatcagctcacggggggttctgctacttctgagtggtaaggggaagggcatactgatgtccttctctgtccactctgcatctccatggacaggtgctttgtcaccctgttccaccttataaaagcaaaaatgttcccactgagaattaagcctattttgttttatcctcagcccaaagcgaaataaagccatagaaagtttttgggatgatttatcaatgcctgaattggcatccttcagagctgataygtgggctctttattcgtttattccctgggggtggagtataggggaaggtggcttacctgagtgaggagcctggggttggcactgcccacaggtctccctcctcagctggcctggcatatccagggaagacttccatctggaatacctgagtgactgctgggttacccatcactggagactttaaagagccctcttttaaaatccaacaagatagtgttcgtcagtttattttattgacgtataatttgtttgcatttaaaattcttagaaatacatcagtctttctctgcagtcactttt

SEQ ID NO: 85513 - DNA, 601 bp, Human
acgaaaaagggggtatgagtaagtgtatgtgtatgtctgtcacctgtgtcacacaaatgcatgtgcacacacatccccccaacacacacacacccaagaaggataaacccaaagcaatggaaaatggctgcctatggggatgagtgagcaggggaatggggaggagggaataaaggtgagagctgcacaggagactcctctgactacattttttaatacagttttgactttagaaccaaatgtttttcatatcccagaaataaatagaatatatgaaacaagctcaccctgagattgtatrtagatggaagcagatgaatctgactatgtagcaaattgacagtattaccaacctacagggaaaaaaagatttcaagtaacttctgaacacatatcattttctatatattcttgtaggatgtagtctaaggacaaaaaactgaaatgaaatcttaagctttatttagatttattttattattaataatattgatattattattctaaacttattttacatatagtaggactaagtaaataagccaatatattaatgtaattaagaatctaagttatcactgtaagaaagatgcagatactt

SEQ ID NO: 85514 - DNA, 601 bp, Human
ttctcttccaggtgcttacaaattgattatgtgtaattttaattcttctttccaattttatactttccagtataaaagtcaacaaaatgtctgtaactcccaaagccctttaaaaaatatgattaaatgacagcataagggttttcttccccagtgagctatggtcagctgtaatgaacatcaactgtcctgtagcctgtggccagatgccctccccacaggggcctctcgcgcagactcagggagctttggtcacctgggcccaacaagtgtggagcagagagcagaacacagtagtgartgcacagctggcagccttctgctttgattaagatgcagaaagtgttgagggacccagggcttcctgagttagagagactgtgggccacaggccaaggcttaaagagaaagagctgcccctgtctctactccaggcacagtggctgtagggacagcacccaggccactctgctatgtgtcgctgaaccttggcctgtcttcttaaagtactgtgtgttttccaaattgtttcagacacactgggtcttcaatttccagttctcatggatgctgtattaagaaacgcaccagaccatattaa

SEQ ID NO: 85515 - DNA, 601 bp, Human
aggaagaccattagattatgtcaaaaagcagtttggaaaacatttatcatttgtagggagcccagcactgacgtttctaaattgtgtgtgacgttgacatgttcccatatgtcacgatatgttccttacttcccttgttatgagcttgggttagaagtcactgttcttttgaaccttgatgtcacctcagggcagtttgctagcactcagaaattcaaaattgcctaaagtgcgtggtgggatgtctatctgtatcataccgtgggcaaacgtctgacttgaaggcatcaaacaggcaaayggaagaaccatgaaggatgctaagttttgactgtgtctgggtagccaattgggagtgtattatgtagaaagccaaataaatgcttatttcaagcacttcaaggtaaaggacaatatttaactctggtttgttttgagagattagagtagtttatgcccataagaaatattcagaaatagttgttgagtgtgtgagtgaacagcagggcattaaataacattatagtcatggtctttatgagcgttaggccaatgttctatgtaatgaggtaaattatttaaggttcttataatgtgttat

SEQ ID NO: 85516 - DNA, 601 bp, Human
cataagaaatattcagaaatagttgttgagtgtgtgagtgaacagcagggcattaaataacattatagtcatggtctttatgagcgttaggccaatgttctatgtaatgaggtaaattatttaaggttcttataatgtgttattttaggtaaggatgttgctatttactcagtgttttttcacggaagatagtgtgctctacagattccgtgtcactaagctaagcatctatgaagcattattgataatcactcagttgactattacatacaaatttcaatgtggtcatcaactcttaaayttctttatagttaaaggataggaaaactgacaaaaaatgttactttttatcacttagtagaatttcatgagtcactagtttagaactttcatttccattcacaggacaaggttaaaagaaacagaattaagaagttgcttaggagtaggcttttctgtttattgggagtcggtattggacattcataaatttataatctgcattatgtttcagcgatacgttaatgctgagttcataggattaatcaggccacatgctgtcctgtggcttcactaatatactcctcagtcacatcagcac

SEQ ID NO: 85517 - DNA, 601 bp, Human
ccgacacactctcattggaactccatgcaggacttcaccagtcattagaagctcattccaggaatcccagcctcgaagggatcatggagaaggtgggatggagtgacctgagtctgatgggtagaaacagccacccttgctctctcccaccttcttctgtgtggacactctgcctctggaatttttagtaactgggtacctgttggaagattagttccttttgctaggctatgaactagagggagggtgtgcattcatttcactaaagtaaaattttgccttttctttgttgttagacagsatcttactcccatcatcctggctggagtgttgtggcacaaacatggctcactgcagcctcgacttcccaggcccaggtgatcctcccacctcagcctcccaagtagctgggacctacagacgtgtaccactatacctggctaacttttgtgtttttttgtagagacagggttttgccatgttgcccaggctggtctcaaactcctaggctaaagcgatctgcctaccttggcctgccaaagtgctgtgattacaggcatgaaccatcacacccggccaaaattttgccgctgatttttag

SEQ ID NO: 85518 - DNA, 601 bp, Human
gcggagaggatctaaacagaaagtaatccaaagggctacatctgtctttcttaatgacgaaccgacggctttccaccttacccttttggctacaaccagtgggattgactgctgtcttattgactctgtttatctagatatggtggacatattgcccagttagatgggctaagataccgatagccccccaaaatgccagattccagaataaatgaaatcactcagtcattaaggtgatatatttaactgggctggctgggctaatttgtccatgttaccaattattattgagcagacaaastcaggtaatgatggcagcaaaagcccatctggggcctgagactagaggaggaggaggctggccagaccctcctcagatgcgcagaggacagcttcaggataaggagagatcagatcatgcctgctccatctcggcgggctcatcttctctcgcccccatctgcatggtcctcttgattttcttcataataataacactgaaatcctttgagtgctaacattactgtaagtgtcagctgtttatgctgttatatgccttaagttatttcagccttaccacatgcagtgaaggagacactag

SEQ ID NO: 85519 - DNA, 601 bp, Human
gatcatgcctgctccatctcggcgggctcatcttctctcgcccccatctgcatggtcctcttgattttcttcataataataacactgaaatcctttgagtgctaacattactgtaagtgtcagctgtttatgctgttatatgccttaagttatttcagccttaccacatgcagtgaaggagacactagtattatccttatgttgcagctgaggaaactgaagtgtggagtttaagtaactggcccaaggtaacagatgcagtgatcagaggagcagggacccacagccaggcactgtgacrcagagcctgcgctcctcactcatatcctgcttcaggcttcacaggtcttgggaagaaaaagagaacgtttacaccctgaataacattgcaaaaggatagtgcgctgtgtctgccggtcagcagagctctttgatgatataagtaggagacacctaagcaaagtaaagttgaggtcagtgtagctccataacaaaagatagggaatgctctaggtctcctcaagaaaaatctacaccatggttttctgttttcacctacagcttagttgcccaggaagattcatttattatttatttaagt

SEQ ID NO: 85520 - DNA, 601 bp, Human
tctaaatggtaaaataagttttttctcctattaattaatatgattaataatactatgacatggagattagaaaaattaagatttaaggccaggcacgatggctcccgcctgtaatcccagcactttgggaagctgaggcagacagatcacctgagatcaggagttcaagaccagactggccaacatagcaaaaccctgtctctactaaaaatacaaaaattagccaggcatggtggtgcgcacctgtagccccagctactcgggaagctgaggcaggagaattgcttaaacctgggaggcrgaggttgcagtgagccaacatcgtgccactgcaccccagcctgggcaacagagcaagactccgtctccaaaaacaaaaaagaaaagatttaaaaactaaaatataatcttcggttttacatatatattaatgattgtttctttttcaggtgataatttttttaaatatgtgaatggctcattagtacttgtgtccttttaaaaacacttatgaataccacagcaaaattaggttgtggtgctattactatatctatttattagtctgctcaggcttccataacaaaatacgatagactgg

SEQ ID NO: 85521 - DNA, 601 bp, Human
atatctacgtagttgagattattcttgggaaatgcaaggagggactcccatctgattcagttatatggagcagctctagggtagcaccattctgggctttgagggtaacacgatgtaactggtattgtatacattaacattagtagagttccttggctgtttaaaatagctagaaatcagagaagtatgatacaaactactacggactgaatttctgggtatgtgttgtattaaaagaaaacaacaacacaaatttcggaagtttttgtagaacaactggctttcattctttaaaaaggtyggtgtcattaaaggaagaaatgctggggattgttttaggttaaagaaacatgatgacttaatgtggtgcttgatccttgattcttgagcaaaatgaaaagtttaaaagacattgggaaaatttggaagatgtagatatgcatatatattagataatatttttgtatcaatgttgtatttcttgagagtagtaatactgcagttatatggaagaattccttgttcttaggtgatacatgctaaagtattgggggaaattgtcataatgtcttcaactttcaaacggtttggcaaaataagt

SEQ ID NO: 85522 - DNA, 601 bp, Human
acaaaaccaatttttttgaggattaccaggctcgtgttttctctctagtatgtcagggtttgtgatacttctggtcagagtgtggaaagagtttgggctatcagcacaggccatattctgtttgcttcatatgcatttggagacatgaaatgatattttactggttaagtttccgctaagtgcttagattttctttattgcgtttctcttacactgttaaacaaaatattgtgtggctaaatgatttcagcctatctaatttgcttgacaattagacagtcgttctagccttaggaacaamatatgttcatcataaaaaaattaagaatgtgatctaaagttcaaagctgaaatattaaaacattaataaatagaaagctttaagaactattcactcagtatgcaaagaaacagtcatttctcgctgctctaaattctattcctgcacataaaaggaaaatatatcaagtttaacaattcaatacaaaaaaaaaccctgcaatgtgagttctccaaacaaacatccctattatccctacatacaggtatagccttaggttatatttttatgatttcatttttgaggtatatacaaaacatg

SEQ ID NO: 85523 - DNA, 601 bp, Human
gtgtggctaaatgatttcagcctatctaatttgcttgacaattagacagtcgttctagccttaggaacaaaatatgttcatcataaaaaaattaagaatgtgatctaaagttcaaagctgaaatattaaaacattaataaatagaaagctttaagaactattcactcagtatgcaaagaaacagtcatttctcgctgctctaaattctattcctgcacataaaaggaaaatatatcaagtttaacaattcaatacaaaaaaaaaccctgcaatgtgagttctccaaacaaacatccctatyatccctacatacaggtatagccttaggttatatttttatgatttcatttttgaggtatatacaaaacatgcatatggttttcatcactagaaataaactacactgagtcctttgggtttgctttctttatttctttattatatgtttaattgatcacgtactttataactttcagtattttgacattttagagtacagcaatgtgctgtattgctgtaatccacatatagttatatttggaatgatacgttatgcttgagttagaaaaataatttgacacatccactacccataacacat

SEQ ID NO: 85524 - DNA, 601 bp, Human
tagccttaggaacaaaatatgttcatcataaaaaaattaagaatgtgatctaaagttcaaagctgaaatattaaaacattaataaatagaaagctttaagaactattcactcagtatgcaaagaaacagtcatttctcgctgctctaaattctattcctgcacataaaaggaaaatatatcaagtttaacaattcaatacaaaaaaaaaccctgcaatgtgagttctccaaacaaacatccctattatccctacatacaggtatagccttaggttatatttttatgatttcatttttgagrtatatacaaaacatgcatatggttttcatcactagaaataaactacactgagtcctttgggtttgctttctttatttctttattatatgtttaattgatcacgtactttataactttcagtattttgacattttagagtacagcaatgtgctgtattgctgtaatccacatatagttatatttggaatgatacgttatgcttgagttagaaaaataatttgacacatccactacccataacacatgttcagtggatatcatgcctgccagaaatatttccatttacacactgctagctct

SEQ ID NO: 85525 - DNA, 601 bp, Human
tggatctcataagaactatacatattgaaaggtgattaatttaaaataagggatgagttgaggataatgattgctttggagttgagcgaaaagagaggttactatgaaccaaaagagaagatgcatgaagatgaacaaaatgtgaagatgcaccaagaaatggctattgtagtagtagaagcagagagaaatgcagagtgagatgagggggagagagaagactggaggcacaaaaagactttatcaaggctgaatttttattttattttattttattttgagacggagtcttgcactgtcrcccaggctggagtgcagtcgcgccatctcggctcactgcaagctccgcttcctgggttcacaccattctcctgcctcagcctcccgagtagctacaggcgcccgccaccacatccagctaattttttgtacttttagtagagacggggtttcaccatgttagccagaatggtctcgatctcctgacctcatcatctgcccgcctcagcctcccaaagtgctgggattacagtcgtgaaccaccgcgcctggccctgaatgttttaataagcaacaaatgactgatgttcctaaagtaatc

SEQ ID NO: 85526 - DNA, 601 bp, Human
gcgaaaagagaggttactatgaaccaaaagagaagatgcatgaagatgaacaaaatgtgaagatgcaccaagaaatggctattgtagtagtagaagcagagagaaatgcagagtgagatgagggggagagagaagactggaggcacaaaaagactttatcaaggctgaatttttattttattttattttattttgagacggagtcttgcactgtcgcccaggctggagtgcagtcgcgccatctcggctcactgcaagctccgcttcctgggttcacaccattctcctgcctcagcctccygagtagctacaggcgcccgccaccacatccagctaattttttgtacttttagtagagacggggtttcaccatgttagccagaatggtctcgatctcctgacctcatcatctgcccgcctcagcctcccaaagtgctgggattacagtcgtgaaccaccgcgcctggccctgaatgttttaataagcaacaaatgactgatgttcctaaagtaatccattcaaattcacatactttaatagaaaaataggcaaaggacatgaaccatcagtttataaaagaggagatgcagatgatcaata

SEQ ID NO: 85527 - DNA, 601 bp, Human
atgcagagtgagatgagggggagagagaagactggaggcacaaaaagactttatcaaggctgaatttttattttattttattttattttgagacggagtcttgcactgtcgcccaggctggagtgcagtcgcgccatctcggctcactgcaagctccgcttcctgggttcacaccattctcctgcctcagcctcccgagtagctacaggcgcccgccaccacatccagctaattttttgtacttttagtagagacggggtttcaccatgttagccagaatggtctcgatctcctgacctcrtcatctgcccgcctcagcctcccaaagtgctgggattacagtcgtgaaccaccgcgcctggccctgaatgttttaataagcaacaaatgactgatgttcctaaagtaatccattcaaattcacatactttaatagaaaaataggcaaaggacatgaaccatcagtttataaaagaggagatgcagatgatcaatatatgtattaaaggctgcacaacttcattaataagcaacaaaatggaaattttcaaagtaaaatgctaggtatcacatcatattgacaacttttgaaatcccatta

SEQ ID NO: 85528 - DNA, 601 bp, Human
gaggcagagattggaggggtcctgccacaacccagggaacatctgggccaccagaagctgaaagaacaaggaagggtccttcctctacaggtttcagagggggcatggctctaccagcatctggatttgggatttctgggctctggaactgtgagataataaatttctctggttctgatccgcccaatttagggtactttttacagcagccctaggaaattagcacagaatccaagtgggacagccgaggtcatgggtggatatgaaactgtagagttcaaaggagagatctggactagaraaataaaatttggagttttcaccggatgatatttcaccagaatagaaattggtacagttttgtggggaagcaatttatagcttgcaccactactcaaacatgagtctcaggtaaattaatatacttagaatttcttctaagggaattttccaatgcagtgatttatagataggattgatggtcacgggattatatatgacagtgaaatatttgggcactacctacatttccaataatggtgacataaataaatgatggtgcacatttcattaagtgcggttagtcattaaatcctgtgtt

SEQ ID NO: 85529 - DNA, 601 bp, Human
aagtgcggttagtcattaaatcctgtgttttcaggaaaagaattcatgacatagagaaatgatgaaataagtggtacagtaaaatccaaatgtcatttaaaataaaaatgtataaaaaagactggataggaatactctgaagtgttagcaattctgaatagtgaaataatgatttgtattttcttagatcttctctatatgttttagattttatgcaatgaaaatgaattatttttagagaaattatattacatgttcttgtattttaacaatttattgagacagaaaaaataaaataggyagagtggagtcccaaagagagggactgattttatgaatcagtaaatgccagtgttatccctggaccagcaatgaggttgctgaataaaaaagtgtatgtttgtgtgtgttggtgtgttgtaaagctaggaaaaatgtttggcagtttgaaagaaatatatctgccaacaaatattcagaaattacgtgccatattttttaaaaaagaaaactttaagcattctttatagtaggagaaacagggactaccgaggtcagaggaaatgagcagagtctagaacctcagggagcaacaaaggat

SEQ ID NO: 85530 - DNA, 601 bp, Human
ataaaaaagactggataggaatactctgaagtgttagcaattctgaatagtgaaataatgatttgtattttcttagatcttctctatatgttttagattttatgcaatgaaaatgaattatttttagagaaattatattacatgttcttgtattttaacaatttattgagacagaaaaaataaaataggtagagtggagtcccaaagagagggactgattttatgaatcagtaaatgccagtgttatccctggaccagcaatgaggttgctgaataaaaaagtgtatgtttgtgtgtgttrgtgtgttgtaaagctaggaaaaatgtttggcagtttgaaagaaatatatctgccaacaaatattcagaaattacgtgccatattttttaaaaaagaaaactttaagcattctttatagtaggagaaacagggactaccgaggtcagaggaaatgagcagagtctagaacctcagggagcaacaaaggatgggcatggtcagcaaccataaccgtaagctgagctctttcagactcctgcaggccttggcctgatgcgtgccctcctgtgcagccacgccacttgtacacagttcatttta

SEQ ID NO: 85531 - DNA, 601 bp, Human
tgaggttgctgaataaaaaagtgtatgtttgtgtgtgttggtgtgttgtaaagctaggaaaaatgtttggcagtttgaaagaaatatatctgccaacaaatattcagaaattacgtgccatattttttaaaaaagaaaactttaagcattctttatagtaggagaaacagggactaccgaggtcagaggaaatgagcagagtctagaacctcagggagcaacaaaggatgggcatggtcagcaaccataaccgtaagctgagctctttcagactcctgcaggccttggcctgatgcgtgcyctcctgtgcagccacgccacttgtacacagttcattttagtgcaggcgagttatctaaatcccacagtaaacaccctcagtatgactagtgcacaggtacatgctgaatatgtgtctcttcattcatttaacaaattccacatgagcagctgtgataagccaggcaaggttctaagctttggagaacaaaattaacaaaatctctcctcttgtggggcttgctttctgatgggaggagatagaatgtaatgaaaataagtagcttatttgtactatggagaaaaataaagctgggaaggt

SEQ ID NO: 85532 - DNA, 601 bp, Human
ttgaagtgtcaagaaaaaaatcaaggatgtctctgaggttttcagcttgagcaactacaaagatggatttgccattttctgagaaggaaactacaggaaaatgaggtccgggtgggagatgaggagaaattaagaagtcgggatttgtttggggactgagaaatttgaaatgtctctgacatctgtgatggatttaattgtgtccccccaaaaagatgttgaagtcctaacccccagtacctccgagggtgaccttatttggaaacagagtctttagggagataatcaatttaaaatgagrcaattagggtagaccctaatccaatattttataaggacaagaacagaaaaccagacaccgcaggttctcactcataagtgggagtcgaacaatgagaacacatggacacagggaggcgaacaacacacaccagggcctgtcagggtgaggggtaaggggagggagagcattaggacaaataactgatacatgtggggcttaaaacctagatgatgggttgataggtgcagcaaaccaccatggcacaggtatacctgtgtaacaaacctgcactttctgcacatgtatcccggaacttga

SEQ ID NO: 85533 - DNA, 601 bp, Human
ccccccaaaaagatgttgaagtcctaacccccagtacctccgagggtgaccttatttggaaacagagtctttagggagataatcaatttaaaatgagacaattagggtagaccctaatccaatattttataaggacaagaacagaaaaccagacaccgcaggttctcactcataagtgggagtcgaacaatgagaacacatggacacagggaggcgaacaacacacaccagggcctgtcagggtgaggggtaaggggagggagagcattaggacaaataactgatacatgtggggcttaamacctagatgatgggttgataggtgcagcaaaccaccatggcacaggtatacctgtgtaacaaacctgcactttctgcacatgtatcccggaacttgaagtaaaattaaaaaaaaaaaaaaaaaaaaaaaaaaaaggtgctcgggcaaggtggctcatgcctcatgcctataatcccaacactttgggaggctgaggtggcagatcgcttgaggccaggagttcaagaccagcctggccaacatggcgaaatcctgtctccactaaaaatgtgaaaattagctgggcatggtggcaagggc

SEQ ID NO: 85534 - DNA, 601 bp, Human
tttggaaacagagtctttagggagataatcaatttaaaatgagacaattagggtagaccctaatccaatattttataaggacaagaacagaaaaccagacaccgcaggttctcactcataagtgggagtcgaacaatgagaacacatggacacagggaggcgaacaacacacaccagggcctgtcagggtgaggggtaaggggagggagagcattaggacaaataactgatacatgtggggcttaaaacctagatgatgggttgataggtgcagcaaaccaccatggcacaggtatacctrtgtaacaaacctgcactttctgcacatgtatcccggaacttgaagtaaaattaaaaaaaaaaaaaaaaaaaaaaaaaaaaggtgctcgggcaaggtggctcatgcctcatgcctataatcccaacactttgggaggctgaggtggcagatcgcttgaggccaggagttcaagaccagcctggccaacatggcgaaatcctgtctccactaaaaatgtgaaaattagctgggcatggtggcaagggcctgtaatcccagcttctcaggaggctgaggcacgagaatctattgaacccggga

SEQ ID NO: 85535 - DNA, 601 bp, Human
tctttagggagataatcaatttaaaatgagacaattagggtagaccctaatccaatattttataaggacaagaacagaaaaccagacaccgcaggttctcactcataagtgggagtcgaacaatgagaacacatggacacagggaggcgaacaacacacaccagggcctgtcagggtgaggggtaaggggagggagagcattaggacaaataactgatacatgtggggcttaaaacctagatgatgggttgataggtgcagcaaaccaccatggcacaggtatacctgtgtaacaaacctrcactttctgcacatgtatcccggaacttgaagtaaaattaaaaaaaaaaaaaaaaaaaaaaaaaaaaggtgctcgggcaaggtggctcatgcctcatgcctataatcccaacactttgggaggctgaggtggcagatcgcttgaggccaggagttcaagaccagcctggccaacatggcgaaatcctgtctccactaaaaatgtgaaaattagctgggcatggtggcaagggcctgtaatcccagcttctcaggaggctgaggcacgagaatctattgaacccgggaggcggagtttgcc

SEQ ID NO: 85536 - DNA, 601 bp, Human
tagggagataatcaatttaaaatgagacaattagggtagaccctaatccaatattttataaggacaagaacagaaaaccagacaccgcaggttctcactcataagtgggagtcgaacaatgagaacacatggacacagggaggcgaacaacacacaccagggcctgtcagggtgaggggtaaggggagggagagcattaggacaaataactgatacatgtggggcttaaaacctagatgatgggttgataggtgcagcaaaccaccatggcacaggtatacctgtgtaacaaacctgcacwttctgcacatgtatcccggaacttgaagtaaaattaaaaaaaaaaaaaaaaaaaaaaaaaaaaggtgctcgggcaaggtggctcatgcctcatgcctataatcccaacactttgggaggctgaggtggcagatcgcttgaggccaggagttcaagaccagcctggccaacatggcgaaatcctgtctccactaaaaatgtgaaaattagctgggcatggtggcaagggcctgtaatcccagcttctcaggaggctgaggcacgagaatctattgaacccgggaggcggagtttgccatga

SEQ ID NO: 85537 - DNA, 601 bp, Human
agggagataatcaatttaaaatgagacaattagggtagaccctaatccaatattttataaggacaagaacagaaaaccagacaccgcaggttctcactcataagtgggagtcgaacaatgagaacacatggacacagggaggcgaacaacacacaccagggcctgtcagggtgaggggtaaggggagggagagcattaggacaaataactgatacatgtggggcttaaaacctagatgatgggttgataggtgcagcaaaccaccatggcacaggtatacctgtgtaacaaacctgcactytctgcacatgtatcccggaacttgaagtaaaattaaaaaaaaaaaaaaaaaaaaaaaaaaaaggtgctcgggcaaggtggctcatgcctcatgcctataatcccaacactttgggaggctgaggtggcagatcgcttgaggccaggagttcaagaccagcctggccaacatggcgaaatcctgtctccactaaaaatgtgaaaattagctgggcatggtggcaagggcctgtaatcccagcttctcaggaggctgaggcacgagaatctattgaacccgggaggcggagtttgccatgag

SEQ ID NO: 85538 - DNA, 601 bp, Human
gacaccgcaggttctcactcataagtgggagtcgaacaatgagaacacatggacacagggaggcgaacaacacacaccagggcctgtcagggtgaggggtaaggggagggagagcattaggacaaataactgatacatgtggggcttaaaacctagatgatgggttgataggtgcagcaaaccaccatggcacaggtatacctgtgtaacaaacctgcactttctgcacatgtatcccggaacttgaagtaaaattaaaaaaaaaaaaaaaaaaaaaaaaaaaaggtgctcgggcaaggtggctcatgcctcatgcctataatcccaacactttgggaggctgaggtggcagatcgcttgaggccaggagttcaagaccagcctggccaacatggcgaaatcctgtctccactaaaaatgtgaaaattagctgggcatggtggcaagggcctgtaatcccagcttctcaggaggctgaggcacgagaatctattgaacccgggaggcggagtttgccatgagcagagattgcaccactgcattccagccaaggcgacagagagagactctgcctcaaaaaaaggggttgggggcggggtgg

SEQ ID NO: 85539 - DNA, 601 bp, Human
ggttctcactcataagtgggagtcgaacaatgagaacacatggacacagggaggcgaacaacacacaccagggcctgtcagggtgaggggtaaggggagggagagcattaggacaaataactgatacatgtggggcttaaaacctagatgatgggttgataggtgcagcaaaccaccatggcacaggtatacctgtgtaacaaacctgcactttctgcacatgtatcccggaacttgaagtaaaattaaaaaaaaaaaaaaaaaaaaaaaaaaaaggtgctcgggcaaggtggctcatgcctcatgcctataatcccaacactttgggaggctgaggtggcagatcgcttgaggccaggagttcaagaccagcctggccaacatggcgaaatcctgtctccactaaaaatgtgaaaattagctgggcatggtggcaagggcctgtaatcccagcttctcaggaggctgaggcacgagaatctattgaacccgggaggcggagtttgccatgagcagagattgcaccactgcattccagccaaggcgacagagagagactctgcctcaaaaaaaggggttgggggcggggtggaaattgaga

SEQ ID NO: 85540 - DNA, 601 bp, Human
gcaaggtggctcatgcctcatgcctataatcccaacactttgggaggctgaggtggcagatcgcttgaggccaggagttcaagaccagcctggccaacatggcgaaatcctgtctccactaaaaatgtgaaaattagctgggcatggtggcaagggcctgtaatcccagcttctcaggaggctgaggcacgagaatctattgaacccgggaggcggagtttgccatgagcagagattgcaccactgcattccagccaaggcgacagagagagactctgcctcaaaaaaaggggttgggggyggggtggaaattgagacacagggagagaatgtgaagagacacagggagaaggctgcgggaggacagaggcagagattggaggggtcctgccacaacccaaggaacatctgggccaccagaagctgaaagaacaaggaattgtccttcccctacaggtttcagagagggcatggctctacctgcatctggattttgggtttctgggctctagaactgtgagataaatttctcttgttctgatccgcccaatttagggtactttttacagcagccctaggaaattagcacagaatccaagtg

SEQ ID NO: 85541 - DNA, 601 bp, Human
gaggctgaggtggcagatcgcttgaggccaggagttcaagaccagcctggccaacatggcgaaatcctgtctccactaaaaatgtgaaaattagctgggcatggtggcaagggcctgtaatcccagcttctcaggaggctgaggcacgagaatctattgaacccgggaggcggagtttgccatgagcagagattgcaccactgcattccagccaaggcgacagagagagactctgcctcaaaaaaaggggttgggggcggggtggaaattgagacacagggagagaatgtgaagagacacrgggagaaggctgcgggaggacagaggcagagattggaggggtcctgccacaacccaaggaacatctgggccaccagaagctgaaagaacaaggaattgtccttcccctacaggtttcagagagggcatggctctacctgcatctggattttgggtttctgggctctagaactgtgagataaatttctcttgttctgatccgcccaatttagggtactttttacagcagccctaggaaattagcacagaatccaagtgggaaagccgaggtcatgggtgaatatgaaactgtagagttcaa

SEQ ID NO: 85542 - DNA, 601 bp, Human
ggagagaatgtgaagagacacagggagaaggctgcgggaggacagaggcagagattggaggggtcctgccacaacccaaggaacatctgggccaccagaagctgaaagaacaaggaattgtccttcccctacaggtttcagagagggcatggctctacctgcatctggattttgggtttctgggctctagaactgtgagataaatttctcttgttctgatccgcccaatttagggtactttttacagcagccctaggaaattagcacagaatccaagtgggaaagccgaggtcatgggtgratatgaaactgtagagttcaaaggagagatctggactagagaaataaaatttggagttttcaccagatgatatttaaaacaacgagactgtatgacgttctgaaggtgtatagacagtgagccctgggggaactgttgctttaaagggtttgggagttgaggaggaactagcaaagcaaactgaaggcattgccagtgctgtagaggcaaaccaggaaggatagttccgaagtaaataaagtgttctaaggagaaaggaacattcatcttgaccaaatgctactggcaggaaggaatgtt

SEQ ID NO: 85543 - DNA, 601 bp, Human
gaagggtgaatggactgggaagggcagcacaactcccaggcagcatggagggctcgctggaggctgtggccatgcactcgtcagcatggctatgccagccagaggggagtggactctgtgcagggctgtgaccaggtgtcaggggtaagctggggagttgagggttttgtgagggaatgatgggcatgactggctgtagggtgagctgggtgagaagagagaccaggacagaagatgtcaagacctttgttgaatgaatgggcaaagataaaaaaaaagaaactgtcatctcaaacagttmaagtcaggactgcaaaagaggaccaggtgcctgtgcctggtaggaaggaggaccaagatggcttccaagaggaaaagtcttaaagcatgaacggaaatttggacagacagatgagcaggtgaggaatgggcaggtccaaggagagaatgttgtgtgccagtgccaccccaaaggcggcaatacaggtgtggcctgcaggtaatgcacttaccaacaggcctagaaactgccttcttcattactgaggattagtaatagtaattattatttcttaattataaatttaatgcttctttgtca

SEQ ID NO: 85544 - DNA, 601 bp, Human
agggaatgatgggcatgactggctgtagggtgagctgggtgagaagagagaccaggacagaagatgtcaagacctttgttgaatgaatgggcaaagataaaaaaaaagaaactgtcatctcaaacagttcaagtcaggactgcaaaagaggaccaggtgcctgtgcctggtaggaaggaggaccaagatggcttccaagaggaaaagtcttaaagcatgaacggaaatttggacagacagatgagcaggtgaggaatgggcaggtccaaggagagaatgttgtgtgccagtgccaccccaraggcggcaatacaggtgtggcctgcaggtaatgcacttaccaacaggcctagaaactgccttcttcattactgaggattagtaatagtaattattatttcttaattataaatttaatgcttctttgtcactccccagtgtgtgtgtatacacacacacacgagaattatgtatgtaacaatgacatatttacatatgtaagaaattataaaattatctatggctggacacagttgttcatgcctgtaatctcagtgctttgtggggggccaaggcaggaggatagcttgaagccaaaagt

SEQ ID NO: 85545 - DNA, 601 bp, Human
aaacagttcaagtcaggactgcaaaagaggaccaggtgcctgtgcctggtaggaaggaggaccaagatggcttccaagaggaaaagtcttaaagcatgaacggaaatttggacagacagatgagcaggtgaggaatgggcaggtccaaggagagaatgttgtgtgccagtgccaccccaaaggcggcaatacaggtgtggcctgcaggtaatgcacttaccaacaggcctagaaactgccttcttcattactgaggattagtaatagtaattattatttcttaattataaatttaatgctyctttgtcactccccagtgtgtgtgtatacacacacacacgagaattatgtatgtaacaatgacatatttacatatgtaagaaattataaaattatctatggctggacacagttgttcatgcctgtaatctcagtgctttgtggggggccaaggcaggaggatagcttgaagccaaaagtcagagaccaacctgggtgccatagcgagaccctgtctctgcaaaaaaattttttaaattagctgagtgtgatggtgcatgcctgtagtcccagctactcaggagcctgaggcagaaggatc

SEQ ID NO: 85546 - DNA, 601 bp, Human
gtcaggactgcaaaagaggaccaggtgcctgtgcctggtaggaaggaggaccaagatggcttccaagaggaaaagtcttaaagcatgaacggaaatttggacagacagatgagcaggtgaggaatgggcaggtccaaggagagaatgttgtgtgccagtgccaccccaaaggcggcaatacaggtgtggcctgcaggtaatgcacttaccaacaggcctagaaactgccttcttcattactgaggattagtaatagtaattattatttcttaattataaatttaatgcttctttgtcactccccagtgtgtgtgtatacacacacacacgagaattatgtatgtaacaatgacatatttacatatgtaagaaattataaaattatctatggctggacacagttgttcatgcctgtaatctcagtgctttgtggggggccaaggcaggaggatagcttgaagccaaaagtcagagaccaacctgggtgccatagcgagaccctgtctctgcaaaaaaattttttaaattagctgagtgtgatggtgcatgcctgtagtcccagctactcaggagcctgaggcagaaggatcacttgagccta

SEQ ID NO: 85547 - DNA, 601 bp, Human
actgccttcttcattactgaggattagtaatagtaattattatttcttaattataaatttaatgcttctttgtcactccccagtgtgtgtgtatacacacacacacgagaattatgtatgtaacaatgacatatttacatatgtaagaaattataaaattatctatggctggacacagttgttcatgcctgtaatctcagtgctttgtggggggccaaggcaggaggatagcttgaagccaaaagtcagagaccaacctgggtgccatagcgagaccctgtctctgcaaaaaaattttttwaattagctgagtgtgatggtgcatgcctgtagtcccagctactcaggagcctgaggcagaaggatcacttgagcctaggatttcaaggcttcagtgagctatgactgacctctgcgctctagcctgggtgacagagtgagacctggtttctaaaaatttaactaatgtgtacattgtataaatataaaacaaaagcatattgtctgtctcctccccctacccaccacccgtctccattccaatttccttcttcagatcttatgaacattcttcctagccacctttaggccaactcctcat

SEQ ID NO: 85548 - DNA, 601 bp, Human
aggccaactcctcatctgctgggtttcatgcagtattccagaagaccagcctgaaaatagagaactcaagctcttgtatgtttagtctgggttcctgccaaataacgtgcagcactgtcgagaatgatgtgacggacagagcttgatgcacagcatgatggggcaccctgtccacttgcctgtgagtcatgaacatttcatcatagggtttacagttttttgttatagatgtttaatcacaaaaataacagaggccacttatgctaagtatattctgtgaggatcattcttgcacacgaarggtaacagcatgaccttgatatggtaaggccttggcattgcagaggagaacaggctgcagaaggtaatgtgcgatctcataaactggactccttgtcagcattcttttgatatttcacaaatgacaaaagtcatcaagagaagattccaatggttcagatatttaacggtcacccgtgtttatactacttttgaatgggtgaaactttaggatggggattagttaaatcatgctataaattcaggcccagaaaataatggagaaagaattcccaaagctactagaattctcccacaattg

SEQ ID NO: 85549 - DNA, 601 bp, Human
ttgtatgtttagtctgggttcctgccaaataacgtgcagcactgtcgagaatgatgtgacggacagagcttgatgcacagcatgatggggcaccctgtccacttgcctgtgagtcatgaacatttcatcatagggtttacagttttttgttatagatgtttaatcacaaaaataacagaggccacttatgctaagtatattctgtgaggatcattcttgcacacgaagggtaacagcatgaccttgatatggtaaggccttggcattgcagaggagaacaggctgcagaaggtaatgtgcratctcataaactggactccttgtcagcattcttttgatatttcacaaatgacaaaagtcatcaagagaagattccaatggttcagatatttaacggtcacccgtgtttatactacttttgaatgggtgaaactttaggatggggattagttaaatcatgctataaattcaggcccagaaaataatggagaaagaattcccaaagctactagaattctcccacaattgagatgtcagttcacacccacagagggcttctggtggtgacagttggtggaatgagagccaggatcctacagca

SEQ ID NO: 85550 - DNA, 601 bp, Human
atctcataaactggactccttgtcagcattcttttgatatttcacaaatgacaaaagtcatcaagagaagattccaatggttcagatatttaacggtcacccgtgtttatactacttttgaatgggtgaaactttaggatggggattagttaaatcatgctataaattcaggcccagaaaataatggagaaagaattcccaaagctactagaattctcccacaattgagatgtcagttcacacccacagagggcttctggtggtgacagttggtggaatgagagccaggatcctacagcarcagcccttcatgaagggcacatgaaagctctgaagagtgcagaaagtctcactgtggtcactggatgaaattatgacctccagtttctcagaaaactaaaagtgtatctaccattcgatccagcagtcccactactgggtatgtaaccaaaggaaaataaatcattatatcaaaaagacacctgcatgcatgcgcttgtcactgcactgttcacaattgcaaagatacggaatcagcccaaatgcccatcatccgatgagtggataaataatatttatagaaatatttatataccatgga

SEQ ID NO: 85551 - DNA, 601 bp, Human
tttatactacttttgaatgggtgaaactttaggatggggattagttaaatcatgctataaattcaggcccagaaaataatggagaaagaattcccaaagctactagaattctcccacaattgagatgtcagttcacacccacagagggcttctggtggtgacagttggtggaatgagagccaggatcctacagcagcagcccttcatgaagggcacatgaaagctctgaagagtgcagaaagtctcactgtggtcactggatgaaattatgacctccagtttctcagaaaactaaaagtgkatctaccattcgatccagcagtcccactactgggtatgtaaccaaaggaaaataaatcattatatcaaaaagacacctgcatgcatgcgcttgtcactgcactgttcacaattgcaaagatacggaatcagcccaaatgcccatcatccgatgagtggataaataatatttatagaaatatttatataccatggactactactcagtcatagaaaagaatgaaataatgtcttttgctttaacttggatggagctggaagccattattctaaatgaagtaactcaggaatggaaaaccaa

SEQ ID NO: 85552 - DNA, 601 bp, Human
tactacttttgaatgggtgaaactttaggatggggattagttaaatcatgctataaattcaggcccagaaaataatggagaaagaattcccaaagctactagaattctcccacaattgagatgtcagttcacacccacagagggcttctggtggtgacagttggtggaatgagagccaggatcctacagcagcagcccttcatgaagggcacatgaaagctctgaagagtgcagaaagtctcactgtggtcactggatgaaattatgacctccagtttctcagaaaactaaaagtgtatcyaccattcgatccagcagtcccactactgggtatgtaaccaaaggaaaataaatcattatatcaaaaagacacctgcatgcatgcgcttgtcactgcactgttcacaattgcaaagatacggaatcagcccaaatgcccatcatccgatgagtggataaataatatttatagaaatatttatataccatggactactactcagtcatagaaaagaatgaaataatgtcttttgctttaacttggatggagctggaagccattattctaaatgaagtaactcaggaatggaaaaccaaatac

SEQ ID NO: 85553 - DNA, 601 bp, Human
gaattcccaaagctactagaattctcccacaattgagatgtcagttcacacccacagagggcttctggtggtgacagttggtggaatgagagccaggatcctacagcagcagcccttcatgaagggcacatgaaagctctgaagagtgcagaaagtctcactgtggtcactggatgaaattatgacctccagtttctcagaaaactaaaagtgtatctaccattcgatccagcagtcccactactgggtatgtaaccaaaggaaaataaatcattatatcaaaaagacacctgcatgcatrcgcttgtcactgcactgttcacaattgcaaagatacggaatcagcccaaatgcccatcatccgatgagtggataaataatatttatagaaatatttatataccatggactactactcagtcatagaaaagaatgaaataatgtcttttgctttaacttggatggagctggaagccattattctaaatgaagtaactcaggaatggaaaaccaaataccacatgttctcacttataagtgggagctaagctatgggtacgcaaaagcagacagaatggtataatggacactggagactcgg

SEQ ID NO: 85554 - DNA, 601 bp, Human
cctgcatgcatgcgcttgtcactgcactgttcacaattgcaaagatacggaatcagcccaaatgcccatcatccgatgagtggataaataatatttatagaaatatttatataccatggactactactcagtcatagaaaagaatgaaataatgtcttttgctttaacttggatggagctggaagccattattctaaatgaagtaactcaggaatggaaaaccaaataccacatgttctcacttataagtgggagctaagctatgggtacgcaaaagcagacagaatggtataatggacaytggagactcggaggggggcaggtaggggagtgagacatgaaaaactacctattggtgtacagtgtacactgttttggtggcaggtgcactaatatcccagacttcattgctatccatgtaaccaaaaaccacttgttcccctaaagctattataaaaacttgttttgcaagaaatcgaaacttaaattttagaaaacttttaaaaaattatgactctggattcctataaatgtctgcttctgtttggtgttgtatctatagcaacatagtgacaatattaggtagcaatttctgaaccac

SEQ ID NO: 85555 - DNA, 601 bp, Human
cggaatcagcccaaatgcccatcatccgatgagtggataaataatatttatagaaatatttatataccatggactactactcagtcatagaaaagaatgaaataatgtcttttgctttaacttggatggagctggaagccattattctaaatgaagtaactcaggaatggaaaaccaaataccacatgttctcacttataagtgggagctaagctatgggtacgcaaaagcagacagaatggtataatggacactggagactcggaggggggcaggtaggggagtgagacatgaaaaactrcctattggtgtacagtgtacactgttttggtggcaggtgcactaatatcccagacttcattgctatccatgtaaccaaaaaccacttgttcccctaaagctattataaaaacttgttttgcaagaaatcgaaacttaaattttagaaaacttttaaaaaattatgactctggattcctataaatgtctgcttctgtttggtgttgtatctatagcaacatagtgacaatattaggtagcaatttctgaaccacagctttgaaaatttgagcaatggtgtttccaatttcatttattaaat

SEQ ID NO: 85556 - DNA, 601 bp, Human
cccaaatgcccatcatccgatgagtggataaataatatttatagaaatatttatataccatggactactactcagtcatagaaaagaatgaaataatgtcttttgctttaacttggatggagctggaagccattattctaaatgaagtaactcaggaatggaaaaccaaataccacatgttctcacttataagtgggagctaagctatgggtacgcaaaagcagacagaatggtataatggacactggagactcggaggggggcaggtaggggagtgagacatgaaaaactacctattggkgtacagtgtacactgttttggtggcaggtgcactaatatcccagacttcattgctatccatgtaaccaaaaaccacttgttcccctaaagctattataaaaacttgttttgcaagaaatcgaaacttaaattttagaaaacttttaaaaaattatgactctggattcctataaatgtctgcttctgtttggtgttgtatctatagcaacatagtgacaatattaggtagcaatttctgaaccacagctttgaaaatttgagcaatggtgtttccaatttcatttattaaattcttttaaa

SEQ ID NO: 85557 - DNA, 601 bp, Human
agctggaagccattattctaaatgaagtaactcaggaatggaaaaccaaataccacatgttctcacttataagtgggagctaagctatgggtacgcaaaagcagacagaatggtataatggacactggagactcggaggggggcaggtaggggagtgagacatgaaaaactacctattggtgtacagtgtacactgttttggtggcaggtgcactaatatcccagacttcattgctatccatgtaaccaaaaaccacttgttcccctaaagctattataaaaacttgttttgcaagaaatygaaacttaaattttagaaaacttttaaaaaattatgactctggattcctataaatgtctgcttctgtttggtgttgtatctatagcaacatagtgacaatattaggtagcaatttctgaaccacagctttgaaaatttgagcaatggtgtttccaatttcatttattaaattcttttaaaaagtttagttattaccgatgatggcaaagaacatttaggtttcattaagtgatagttttttatgttatagtattctatgttttctttatctattaatgggtttttcttcttatctgcagt

SEQ ID NO: 85558 - DNA, 601 bp, Human
gctatccatgtaaccaaaaaccacttgttcccctaaagctattataaaaacttgttttgcaagaaatcgaaacttaaattttagaaaacttttaaaaaattatgactctggattcctataaatgtctgcttctgtttggtgttgtatctatagcaacatagtgacaatattaggtagcaatttctgaaccacagctttgaaaatttgagcaatggtgtttccaatttcatttattaaattcttttaaaaagtttagttattaccgatgatggcaaagaacatttaggtttcattaagtgakagttttttatgttatagtattctatgttttctttatctattaatgggtttttcttcttatctgcagtgaccctgtctctttgaagttttaaatccagcctaagttttcaatagttggtttgtatttctaatacgaaattcagaacatccttgatcatgattttatttatttattttgagatggagcctctctctgtcaccccggctggagtgcaatggcgcaatctcggtccactgcaacttcagcctcccaggttcaagcgattctcctacctcagcctcctgagtagcgggattacag

SEQ ID NO: 85559 - DNA, 601 bp, Human
atttgagcaatggtgtttccaatttcatttattaaattcttttaaaaagtttagttattaccgatgatggcaaagaacatttaggtttcattaagtgatagttttttatgttatagtattctatgttttctttatctattaatgggtttttcttcttatctgcagtgaccctgtctctttgaagttttaaatccagcctaagttttcaatagttggtttgtatttctaatacgaaattcagaacatccttgatcatgattttatttatttattttgagatggagcctctctctgtcacccmggctggagtgcaatggcgcaatctcggtccactgcaacttcagcctcccaggttcaagcgattctcctacctcagcctcctgagtagcgggattacaggcacctgccaccgtgcctggctaatctttgtatttttagtagagatggggtttcaccatgttggccaggctggtctcaaactcctgacctcaagtgatctgcccccttggcctcccaaattacaggcgtgagccactgcgcctggccatccttgataatgatttaaatccacttttccataggactaagcttgactatcttt

SEQ ID NO: 85560 - DNA, 601 bp, Human
tttatgttatagtattctatgttttctttatctattaatgggtttttcttcttatctgcagtgaccctgtctctttgaagttttaaatccagcctaagttttcaatagttggtttgtatttctaatacgaaattcagaacatccttgatcatgattttatttatttattttgagatggagcctctctctgtcaccccggctggagtgcaatggcgcaatctcggtccactgcaacttcagcctcccaggttcaagcgattctcctacctcagcctcctgagtagcgggattacaggcaccygccaccgtgcctggctaatctttgtatttttagtagagatggggtttcaccatgttggccaggctggtctcaaactcctgacctcaagtgatctgcccccttggcctcccaaattacaggcgtgagccactgcgcctggccatccttgataatgatttaaatccacttttccataggactaagcttgactatctttgacaccattttgaccacattattaactctagcaaataggataaaatataacagtcatacttttaaaaaataccttccctacatccagaactgggtttctgaaaa

SEQ ID NO: 85561 - DNA, 601 bp, Human
caaaatttcatgaagatacttataaaagcatctcccttatttctggaaatatgcctattttcccatgtgtctgttgtgatagacaattgttcagagtcattctggttttaagactcagttattctttctctccttgccttaattctttccttaagtcctacctagtgcttttttttctttctttctttcttttctttttttttttttttttttttgagacaagatctgtcgcccaggccggagtgcagtggtatgatctcagctcactgcagcccatacccgccgggctcaagtgatcctytcatctcagtctcctgagtagctgagactacaggctcatgccactaggctcagctactttttttcgttcattttttgtagagaccaggtctccctatttttcccaggctggtcttgaactcctggactcaagggatcctcctgccttgacctcccaaagtgctgcaattacaggatcaccacaccaggcagctattgcttcttatctggttccttgagatgcagagtaaccgggctgctttgaatgaaagaaggcttggaataaccatcatttaacctatttcacttaacccagccccct

SEQ ID NO: 85562 - DNA, 601 bp, Human
ttttcccatgtgtctgttgtgatagacaattgttcagagtcattctggttttaagactcagttattctttctctccttgccttaattctttccttaagtcctacctagtgcttttttttctttctttctttcttttctttttttttttttttttttttgagacaagatctgtcgcccaggccggagtgcagtggtatgatctcagctcactgcagcccatacccgccgggctcaagtgatcctctcatctcagtctcctgagtagctgagactacaggctcatgccactaggctcagctamtttttttcgttcattttttgtagagaccaggtctccctatttttcccaggctggtcttgaactcctggactcaagggatcctcctgccttgacctcccaaagtgctgcaattacaggatcaccacaccaggcagctattgcttcttatctggttccttgagatgcagagtaaccgggctgctttgaatgaaagaaggcttggaataaccatcatttaacctatttcacttaacccagccccctgtctgtcaataaccaggtttccctagcctaagctctatctgtgattccttcctgcta

SEQ ID NO: 85563 - DNA, 601 bp, Human
attgttcagagtcattctggttttaagactcagttattctttctctccttgccttaattctttccttaagtcctacctagtgcttttttttctttctttctttcttttctttttttttttttttttttttgagacaagatctgtcgcccaggccggagtgcagtggtatgatctcagctcactgcagcccatacccgccgggctcaagtgatcctctcatctcagtctcctgagtagctgagactacaggctcatgccactaggctcagctactttttttcgttcattttttgtagagacyaggtctccctatttttcccaggctggtcttgaactcctggactcaagggatcctcctgccttgacctcccaaagtgctgcaattacaggatcaccacaccaggcagctattgcttcttatctggttccttgagatgcagagtaaccgggctgctttgaatgaaagaaggcttggaataaccatcatttaacctatttcacttaacccagccccctgtctgtcaataaccaggtttccctagcctaagctctatctgtgattccttcctgctaaagcacaggcctaagggcctctcacagg

SEQ ID NO: 85564 - DNA, 601 bp, Human
gagtcattctggttttaagactcagttattctttctctccttgccttaattctttccttaagtcctacctagtgcttttttttctttctttctttcttttctttttttttttttttttttttgagacaagatctgtcgcccaggccggagtgcagtggtatgatctcagctcactgcagcccatacccgccgggctcaagtgatcctctcatctcagtctcctgagtagctgagactacaggctcatgccactaggctcagctactttttttcgttcattttttgtagagaccaggtctcmctatttttcccaggctggtcttgaactcctggactcaagggatcctcctgccttgacctcccaaagtgctgcaattacaggatcaccacaccaggcagctattgcttcttatctggttccttgagatgcagagtaaccgggctgctttgaatgaaagaaggcttggaataaccatcatttaacctatttcacttaacccagccccctgtctgtcaataaccaggtttccctagcctaagctctatctgtgattccttcctgctaaagcacaggcctaagggcctctcacaggagagtgca

SEQ ID NO: 85565 - DNA, 601 bp, Human
ggagagtgcagttctctttctgtcttcctcctttcccttcatattaattggttttgttgcaaaaacccgtatttctttaattttttttattttttcccttcttttcatggaagtcataaaaacctggtcattctatttctaaccccggttctctctctctcttttttctttttctttaacgtttttccaacaagattgtctgtttatgcatatcctctgtatctggaattgtcccaatgacttcaaatatgtgggggtatacatctttgtgcactaaaattttgaataacaagaatttttrtttgaaagggatcatggcatcctattttaattaatctcaataacaaataacttgttcaattctagaaccacagtctgtcatatctacatataacagtaatagcagttcagatatgtaaaacttgttattgctcatcctgtaaggcaaagaaaacacattctgctgatgtctttgttttcaatactttttctctcattcattgtgatcagggtggtaatatacctgttttaatttatttttgatcatttttcctattttgttttgtttttctgaaagaccaaacctttcatttggttaccc

SEQ ID NO: 85566 - DNA, 601 bp, Human
ggttctctctctctcttttttctttttctttaacgtttttccaacaagattgtctgtttatgcatatcctctgtatctggaattgtcccaatgacttcaaatatgtgggggtatacatctttgtgcactaaaattttgaataacaagaatttttatttgaaagggatcatggcatcctattttaattaatctcaataacaaataacttgttcaattctagaaccacagtctgtcatatctacatataacagtaatagcagttcagatatgtaaaacttgttattgctcatcctgtaaggcraagaaaacacattctgctgatgtctttgttttcaatactttttctctcattcattgtgatcagggtggtaatatacctgttttaatttatttttgatcatttttcctattttgttttgtttttctgaaagaccaaacctttcatttggttacccctttcaaaaattttgttttttgtttttctttcaactgttgacatactctctctgagacatatggtaacatattatttccatggggcatgcctaggcattttgtgggaaattacatgtatttcacagaagtagatgctctttttgac

SEQ ID NO: 85567 - DNA, 601 bp, Human
atctggaattgtcccaatgacttcaaatatgtgggggtatacatctttgtgcactaaaattttgaataacaagaatttttatttgaaagggatcatggcatcctattttaattaatctcaataacaaataacttgttcaattctagaaccacagtctgtcatatctacatataacagtaatagcagttcagatatgtaaaacttgttattgctcatcctgtaaggcaaagaaaacacattctgctgatgtctttgttttcaatactttttctctcattcattgtgatcagggtggtaatayacctgttttaatttatttttgatcatttttcctattttgttttgtttttctgaaagaccaaacctttcatttggttacccctttcaaaaattttgttttttgtttttctttcaactgttgacatactctctctgagacatatggtaacatattatttccatggggcatgcctaggcattttgtgggaaattacatgtatttcacagaagtagatgctctttttgaccaatatttttattttaaatgctattaaccaatatgctgttaatattcagcaagagtaatcaagtaactcgtcca

SEQ ID NO: 85568 - DNA, 601 bp, Human
tcaaatatgtgggggtatacatctttgtgcactaaaattttgaataacaagaatttttatttgaaagggatcatggcatcctattttaattaatctcaataacaaataacttgttcaattctagaaccacagtctgtcatatctacatataacagtaatagcagttcagatatgtaaaacttgttattgctcatcctgtaaggcaaagaaaacacattctgctgatgtctttgttttcaatactttttctctcattcattgtgatcagggtggtaatatacctgttttaatttatttttgrtcatttttcctattttgttttgtttttctgaaagaccaaacctttcatttggttacccctttcaaaaattttgttttttgtttttctttcaactgttgacatactctctctgagacatatggtaacatattatttccatggggcatgcctaggcattttgtgggaaattacatgtatttcacagaagtagatgctctttttgaccaatatttttattttaaatgctattaaccaatatgctgttaatattcagcaagagtaatcaagtaactcgtccagtgaagctgatgggattcttga

SEQ ID NO: 85569 - DNA, 601 bp, Human
gaataacaagaatttttatttgaaagggatcatggcatcctattttaattaatctcaataacaaataacttgttcaattctagaaccacagtctgtcatatctacatataacagtaatagcagttcagatatgtaaaacttgttattgctcatcctgtaaggcaaagaaaacacattctgctgatgtctttgttttcaatactttttctctcattcattgtgatcagggtggtaatatacctgttttaatttatttttgatcatttttcctattttgttttgtttttctgaaagaccaaamctttcatttggttacccctttcaaaaattttgttttttgtttttctttcaactgttgacatactctctctgagacatatggtaacatattatttccatggggcatgcctaggcattttgtgggaaattacatgtatttcacagaagtagatgctctttttgaccaatatttttattttaaatgctattaaccaatatgctgttaatattcagcaagagtaatcaagtaactcgtccagtgaagctgatgggattcttgagagagtgcaaggtttccctctctggagaatctgttgaagga

SEQ ID NO: 85570 - DNA, 601 bp, Human
aaccacagtctgtcatatctacatataacagtaatagcagttcagatatgtaaaacttgttattgctcatcctgtaaggcaaagaaaacacattctgctgatgtctttgttttcaatactttttctctcattcattgtgatcagggtggtaatatacctgttttaatttatttttgatcatttttcctattttgttttgtttttctgaaagaccaaacctttcatttggttacccctttcaaaaattttgttttttgtttttctttcaactgttgacatactctctctgagacatatggtracatattatttccatggggcatgcctaggcattttgtgggaaattacatgtatttcacagaagtagatgctctttttgaccaatatttttattttaaatgctattaaccaatatgctgttaatattcagcaagagtaatcaagtaactcgtccagtgaagctgatgggattcttgagagagtgcaaggtttccctctctggagaatctgttgaaggagggtttttgcatatatgctggtttaaaggaaatggaggtgttgaactttagaaccatgttgcttatggaaatagcttcgcgta

SEQ ID NO: 85571 - DNA, 601 bp, Human
ggtaacatattatttccatggggcatgcctaggcattttgtgggaaattacatgtatttcacagaagtagatgctctttttgaccaatatttttattttaaatgctattaaccaatatgctgttaatattcagcaagagtaatcaagtaactcgtccagtgaagctgatgggattcttgagagagtgcaaggtttccctctctggagaatctgttgaaggagggtttttgcatatatgctggtttaaaggaaatggaggtgttgaactttagaaccatgttgcttatggaaatagcttcgygtagagtaactcttagtccattttgaaaccctcttccctagaaatttctatctctttcatttaatactgtggcaaggttaataatatttacacatactttcttctgtgttgtgagatgttagtttaagttggaacatgctggcttgtcattttctaaagtgaatcagtttatctttggtttagcctgaaattgcagcagagagtacgcatcctcctgggatctgaatgtaaaataactgaaacagattgaagttggcagtgactaatgaagtcttgcgcataagtcggcaagtcagtagg

SEQ ID NO: 85572 - DNA, 601 bp, Human
ttcggttcagttctcccagcccgttcccacatagagagcaacaagatttgtgttttccagctcattaaactgacagcagaaattagattgtggtattaaaaactaaaaagttaaattacagctacacatgtcctttatgcagtggggcgtgtggaagatgtttgattttaatgtttgctataatggagaatttaaattacaatgtttgtcaaatctctaatctttgttacagagtggaatattaattacgcttttaactatgagaggtaaataaaatgagcatccactgcacgcccagggrtaaattgcagattaccaacaacgtgacataatgcactaaatgtcagttttgtcaaacaaatttagaagaacggttaaactattagcttcctgttgttctagggcctttcttgcagcaagcaactattgggagcagcagggacactgtgccttgtggaagactaagggagttaaattgaataagcaagatgaatggggagacagcaccacagaggcactcaattagtttataactgtctattaacttctgtaggtggttttgaataaacagcagattatctgttgcactcttgggggacaa

SEQ ID NO: 85573 - DNA, 601 bp, Human
agcagaaattagattgtggtattaaaaactaaaaagttaaattacagctacacatgtcctttatgcagtggggcgtgtggaagatgtttgattttaatgtttgctataatggagaatttaaattacaatgtttgtcaaatctctaatctttgttacagagtggaatattaattacgcttttaactatgagaggtaaataaaatgagcatccactgcacgcccaggggtaaattgcagattaccaacaacgtgacataatgcactaaatgtcagttttgtcaaacaaatttagaagaacggttaaactattagcttcctgttgttctagggcctttcttgcagcaagcaactattgggagcagcagggacactgtgccttgtggaagactaagggagttaaattgaataagcaagatgaatggggagacagcaccacagaggcactcaattagtttataactgtctattaacttctgtaggtggttttgaataaacagcagattatctgttgcactcttgggggacaaggggagccatgggagagggtcagtgtagcgctcaaaggaaagagattttttgattctcaattgccctctgtctt

SEQ ID NO: 85574 - DNA, 601 bp, Human
gcatgggtaatggttgtcaaaaccttctacatgtttaaaacttacacgcatacaaaggagcagtgcccgccttgacatttctcttggcagttcttgcatggaacactggtgtgatgcccccaaagaataagttgaatttaggttctttggctactttttcagaacatgttcttgggaaaagagtagtaactcttggttcttagaactcaggaagataaaacctctccatgaatgatcatagccaggatttctttccagagagggctgagagtgtggagggaaactgatggagctctctgcmtcatgcagtacatcctggagacttgcagggcgtgggaagtccccttgcttccagtgaaggcattgtttctagcttcagtgtttatgcaagttctaatctcctgatgcttaccttagagtacatttaggaaccagtgctctgttaatggaaaaactaaattctaaaagatttttaagaggcttattctggccaagcccggtggcttacgcctgtaatcccagcactttgggaggccgagacgggtggatcatgaggtcaggcgatcgagaccatcctggctaacatggtgaaaccccgtct

SEQ ID NO: 85575 - DNA, 601 bp, Human
gagagtgtggagggaaactgatggagctctctgcatcatgcagtacatcctggagacttgcagggcgtgggaagtccccttgcttccagtgaaggcattgtttctagcttcagtgtttatgcaagttctaatctcctgatgcttaccttagagtacatttaggaaccagtgctctgttaatggaaaaactaaattctaaaagatttttaagaggcttattctggccaagcccggtggcttacgcctgtaatcccagcactttgggaggccgagacgggtggatcatgaggtcaggcgatcragaccatcctggctaacatggtgaaaccccgtctctacttaaaatacaaaaaattagccgggcgtggtggaggacgcctgtagtcccagctactcgggaggctgaggcaggagaatggcgtgaacccaggaggcagaggttgcagtgagccgagatcaggccactgcactccagcctgggtgacagagcaagagtccatctcaaaaaaaaaaaaacttattctgagtcaatatgagtaaccgtggcccaaggaaaaacagtcttaagagatcctgacaaagtcaagagagtcagattaca

SEQ ID NO: 85576 - DNA, 601 bp, Human
acatcctggagacttgcagggcgtgggaagtccccttgcttccagtgaaggcattgtttctagcttcagtgtttatgcaagttctaatctcctgatgcttaccttagagtacatttaggaaccagtgctctgttaatggaaaaactaaattctaaaagatttttaagaggcttattctggccaagcccggtggcttacgcctgtaatcccagcactttgggaggccgagacgggtggatcatgaggtcaggcgatcgagaccatcctggctaacatggtgaaaccccgtctctacttaaartacaaaaaattagccgggcgtggtggaggacgcctgtagtcccagctactcgggaggctgaggcaggagaatggcgtgaacccaggaggcagaggttgcagtgagccgagatcaggccactgcactccagcctgggtgacagagcaagagtccatctcaaaaaaaaaaaaacttattctgagtcaatatgagtaaccgtggcccaaggaaaaacagtcttaagagatcctgacaaagtcaagagagtcagattacagttttctacattttggagaggaaggagttacaggcaaagacata

SEQ ID NO: 85577 - DNA, 601 bp, Human
gctactcgggaggctgaggcaggagaatggcgtgaacccaggaggcagaggttgcagtgagccgagatcaggccactgcactccagcctgggtgacagagcaagagtccatctcaaaaaaaaaaaaacttattctgagtcaatatgagtaaccgtggcccaaggaaaaacagtcttaagagatcctgacaaagtcaagagagtcagattacagttttctacattttggagaggaaggagttacaggcaaagacataaatcaatacatggaagatattgattagtttagcccataaaggtgrgatatcttgaggtggaggcttacaagtcaatagatggattcagagattctttaatttgcaattggttaaaggaacaaaacttggtctaaaaacttggagttagcagaaaggaatgttttaagttaagataagcatgctatgtcagagtcagccacaatatgacctgcttaacaaaagcagtggcttgcaggcatgacttaacccttgccttaggtattgtttataatttgatatatcattaccacaaagagtatgtttagtcaatcttatgatctctattttaacattaatgctggtcaa

SEQ ID NO: 85578 - DNA, 601 bp, Human
attaatgctggtcaattattgtgcctaaactccaaaagggggcgctataacgaggtgtgtctgacctccccatcacatccaggaactcaggaaaatttttaagatttttctgagttcctcttggctacaagtcagtggggagcttaggattttcttttaccgcatggtacaatcactagatcattataaagaattgcaaattttaatgaaattgctgaagaaacatggtgagaattaaaggggaaggagataaaagattagagatgaaggaaaaaacaagaccaagaagatgtggaaactrtgagtgatgacttccgaactttaaagtatttttagtgcttctgaatttatgtccttcaaactgtgtaccaacttgcttttttgagcatgcagacattacataatgcaagccatttatcagagttcttttacatagcacagaacagtcataagatactcttacttttcaacacacatacacacacatatatcccacaaagggattcattttccttttgctattttgaaaaggctgagaaatgtatgcctccaccagcaggattggggcattctttatgtgaacctgtcccacttaaaacca

SEQ ID NO: 85579 - DNA, 601 bp, Human
ttgctgaagaaacatggtgagaattaaaggggaaggagataaaagattagagatgaaggaaaaaacaagaccaagaagatgtggaaactgtgagtgatgacttccgaactttaaagtatttttagtgcttctgaatttatgtccttcaaactgtgtaccaacttgcttttttgagcatgcagacattacataatgcaagccatttatcagagttcttttacatagcacagaacagtcataagatactcttacttttcaacacacatacacacacatatatcccacaaagggattcattttycttttgctattttgaaaaggctgagaaatgtatgcctccaccagcaggattggggcattctttatgtgaacctgtcccacttaaaaccagttgtcaaggagagaatcaagataaaacacagtgtgtggtgggtggatccactaagtgaggaaagcttattaggaaagagttaggaaagctgtagttcctcctgaataagactcctttgagaaaaagagccaagacttaatctaactcttgggtatctgttttgacacctgtgtctgtaattgctggtttgctttgtaataggggtgtttt

SEQ ID NO: 85580 - DNA, 601 bp, Human
aggttttcagtccgctgatactaaatcaagtttagcctaaaccttcctccttacatattttaattttggcctacagatttccctgtgcatagtgaactgtaacctaaacagactgtaacctaccaatgattgtgattgtgccaatcaccaagtcttggccaaaggtggccaactgctcaaactgggttcaagcaaggcaaataccacactgtacccagttcattgtttctgtacctcacttcagttttctgtatgtacctcacttttctttttctgtccataaattgtctcccaccacgtrgctgcactggagtctctgagcctactttggcttgggaggctgcccaattcaagaatcattctttgctcagttaaactccattacatttaatttggctaaagattttcttttaacactgacctgctaagataagttgtggtttgtccataagaactcaagtatgcaaatatggaggttttttcaggccagattttggttgatttaacagaatgaatactggaaaagacacctttcatgggtatccagatatccaagaagaaatcacagtgctgtttaaaacaaaattaagccattagggaa

SEQ ID NO: 85581 - DNA, 601 bp, Human
ctacagatttccctgtgcatagtgaactgtaacctaaacagactgtaacctaccaatgattgtgattgtgccaatcaccaagtcttggccaaaggtggccaactgctcaaactgggttcaagcaaggcaaataccacactgtacccagttcattgtttctgtacctcacttcagttttctgtatgtacctcacttttctttttctgtccataaattgtctcccaccacgtagctgcactggagtctctgagcctactttggcttgggaggctgcccaattcaagaatcattctttgctcarttaaactccattacatttaatttggctaaagattttcttttaacactgacctgctaagataagttgtggtttgtccataagaactcaagtatgcaaatatggaggttttttcaggccagattttggttgatttaacagaatgaatactggaaaagacacctttcatgggtatccagatatccaagaagaaatcacagtgctgtttaaaacaaaattaagccattagggaaagtttttgtctcatttttccctcctatctgttgagtccttaccaggtataggaactgtgctttacatgta

SEQ ID NO: 85582 - DNA, 601 bp, Human
gtgcatagtgaactgtaacctaaacagactgtaacctaccaatgattgtgattgtgccaatcaccaagtcttggccaaaggtggccaactgctcaaactgggttcaagcaaggcaaataccacactgtacccagttcattgtttctgtacctcacttcagttttctgtatgtacctcacttttctttttctgtccataaattgtctcccaccacgtagctgcactggagtctctgagcctactttggcttgggaggctgcccaattcaagaatcattctttgctcagttaaactccattamatttaatttggctaaagattttcttttaacactgacctgctaagataagttgtggtttgtccataagaactcaagtatgcaaatatggaggttttttcaggccagattttggttgatttaacagaatgaatactggaaaagacacctttcatgggtatccagatatccaagaagaaatcacagtgctgtttaaaacaaaattaagccattagggaaagtttttgtctcatttttccctcctatctgttgagtccttaccaggtataggaactgtgctttacatgtattctcatttcattt

SEQ ID NO: 85583 - DNA, 601 bp, Human
aactcaagtatgcaaatatggaggttttttcaggccagattttggttgatttaacagaatgaatactggaaaagacacctttcatgggtatccagatatccaagaagaaatcacagtgctgtttaaaacaaaattaagccattagggaaagtttttgtctcatttttccctcctatctgttgagtccttaccaggtataggaactgtgctttacatgtattctcatttcattttcatcaaccccctacaaagtagatgacatgctttctctgtcaagcatatgaggaaaccaagattttasaaagtttccatctctttcataaggaaagccggaactgacagagtatgggggctggggacgggatctcttccgattgccatttactcattgaaataagttttcatctgagcggggacagagagtggttaatggaggtagaaggaggtaagagaaaagggaaaatcagttttcctaaaatgtaatgtctgtcatattattctcctgctcagcaggactttccttgtctaagaattatgtacccacttctcagctttgcctccaaggcattccacagaatgacaccagggtttcactataggc

SEQ ID NO: 85584 - DNA, 601 bp, Human
gaggttttttcaggccagattttggttgatttaacagaatgaatactggaaaagacacctttcatgggtatccagatatccaagaagaaatcacagtgctgtttaaaacaaaattaagccattagggaaagtttttgtctcatttttccctcctatctgttgagtccttaccaggtataggaactgtgctttacatgtattctcatttcattttcatcaaccccctacaaagtagatgacatgctttctctgtcaagcatatgaggaaaccaagattttacaaagtttccatctctttcayaaggaaagccggaactgacagagtatgggggctggggacgggatctcttccgattgccatttactcattgaaataagttttcatctgagcggggacagagagtggttaatggaggtagaaggaggtaagagaaaagggaaaatcagttttcctaaaatgtaatgtctgtcatattattctcctgctcagcaggactttccttgtctaagaattatgtacccacttctcagctttgcctccaaggcattccacagaatgacaccagggtttcactataggcagcttatgccttatttggtt

SEQ ID NO: 85585 - DNA, 601 bp, Human
ttaaaacaaaattaagccattagggaaagtttttgtctcatttttccctcctatctgttgagtccttaccaggtataggaactgtgctttacatgtattctcatttcattttcatcaaccccctacaaagtagatgacatgctttctctgtcaagcatatgaggaaaccaagattttacaaagtttccatctctttcataaggaaagccggaactgacagagtatgggggctggggacgggatctcttccgattgccatttactcattgaaataagttttcatctgagcggggacagagartggttaatggaggtagaaggaggtaagagaaaagggaaaatcagttttcctaaaatgtaatgtctgtcatattattctcctgctcagcaggactttccttgtctaagaattatgtacccacttctcagctttgcctccaaggcattccacagaatgacaccagggtttcactataggcagcttatgccttatttggttttctaagcattttttgaactgggcatggtggtttgcacctttaatcccagctgatcagaaggctgagacagaaggattgcaagcccaggagttcgagaccag

SEQ ID NO: 85586 - DNA, 601 bp, Human
ccacagaatgacaccagggtttcactataggcagcttatgccttatttggttttctaagcattttttgaactgggcatggtggtttgcacctttaatcccagctgatcagaaggctgagacagaaggattgcaagcccaggagttcgagaccagcttgggcaatatagtgagaccccccatctcaaaaatagataaataataggctagtgtggtggctcacacctataatcccaactctttgggaggctgagacgggcagatcaccctgaggtcaggagttcgagaccagcctggtcaacrttgcgaaaccccgtctctactaagagtacaaaaattagccgggcgtggtggcacatgcctgtagtctcagctactcgagaggcttaggcaggataattgcttgaacctgggaggtggagattacagtgagccacgatcgcaccactgcactccagcctgggagacagagcgggactctgtctcaaaaataaataaataagtaataaataaaaactggttgactaattataaataaactgaaatgcatagccatgtggtagtaattctaagagtcaagagttaattcttgtgtcttatcaa

SEQ ID NO: 85587 - DNA, 601 bp, Human
acagaatgacaccagggtttcactataggcagcttatgccttatttggttttctaagcattttttgaactgggcatggtggtttgcacctttaatcccagctgatcagaaggctgagacagaaggattgcaagcccaggagttcgagaccagcttgggcaatatagtgagaccccccatctcaaaaatagataaataataggctagtgtggtggctcacacctataatcccaactctttgggaggctgagacgggcagatcaccctgaggtcaggagttcgagaccagcctggtcaacatkgcgaaaccccgtctctactaagagtacaaaaattagccgggcgtggtggcacatgcctgtagtctcagctactcgagaggcttaggcaggataattgcttgaacctgggaggtggagattacagtgagccacgatcgcaccactgcactccagcctgggagacagagcgggactctgtctcaaaaataaataaataagtaataaataaaaactggttgactaattataaataaactgaaatgcatagccatgtggtagtaattctaagagtcaagagttaattcttgtgtcttatcaaaa

SEQ ID NO: 85588 - DNA, 601 bp, Human
agcccaggagttcgagaccagcttgggcaatatagtgagaccccccatctcaaaaatagataaataataggctagtgtggtggctcacacctataatcccaactctttgggaggctgagacgggcagatcaccctgaggtcaggagttcgagaccagcctggtcaacattgcgaaaccccgtctctactaagagtacaaaaattagccgggcgtggtggcacatgcctgtagtctcagctactcgagaggcttaggcaggataattgcttgaacctgggaggtggagattacagtgagccrcgatcgcaccactgcactccagcctgggagacagagcgggactctgtctcaaaaataaataaataagtaataaataaaaactggttgactaattataaataaactgaaatgcatagccatgtggtagtaattctaagagtcaagagttaattcttgtgtcttatcaaaatgaaatgttaaggaagcatcaagtcagtggcctaaagttggatagattaacaaaaggcttttctattttctgttcatctaagtcaacctcaaatattacagatattttttaaagaactacttatttttaaa

SEQ ID NO: 85589 - DNA, 601 bp, Human
taaataagtaataaataaaaactggttgactaattataaataaactgaaatgcatagccatgtggtagtaattctaagagtcaagagttaattcttgtgtcttatcaaaatgaaatgttaaggaagcatcaagtcagtggcctaaagttggatagattaacaaaaggcttttctattttctgttcatctaagtcaacctcaaatattacagatattttttaaagaactacttatttttaaaggactaagaattattttcaaagaagtatgtcttcaagcatcatgagcagaatgaaaggcygaatgctctccttgtgacaaagtgagtggacagacccatccgcagtgcagcatgcctatcaccagccaccagcgcagtccaaagttacatgattgaaaaagaaatttgcacctgattgaagatgctttgggctcagttttgctgtcctctccccacagaagtctaagctgttcagactgctcaagataacacttcacacagtttaggaattgtggtttatgtcgaacgccaatctatatcagctttcataacatttaatatggtggggggagtgataggtgtttgagaaattaagcaaaa

SEQ ID NO: 85590 - DNA, 601 bp, Human
ggttaaaaaaaaatgcatcactccgttaacataacacaactttggtgatgcttttgagacttcattttaatttttgaaaaagcaatcccttctgttccccatcattcccacctagcccccaatatcccccccacacacatacatacaaacacaaataaatagcatgtaaaggccaaatcgtttgctttctacattcttattaacaagtaagaacctttcactaccagtatactcaagttctgcaatatagctagttcatcttgagatctatatctgtgaaacaagaaattcagaatcagakctaaagatttttaaagtgtgatttttatatttttcctaggagaaaagggcattttttacaataaagtgacagttgtttaggataaattaataagaaaatgtaggcccttgttgggaagaattgttgatagatgggtgttttagaaaagccaaatggttagtcaaatgaccacagaaatgcctgtaggaaataaaatattaaaattctgaacactgtttgattatatgccttgtattagtttcctgttcctgctgtaaataaattcctacaaacctagtggcttaaagcaaaataattatc

SEQ ID NO: 85591 - DNA, 601 bp, Human
atgcttttgagacttcattttaatttttgaaaaagcaatcccttctgttccccatcattcccacctagcccccaatatcccccccacacacatacatacaaacacaaataaatagcatgtaaaggccaaatcgtttgctttctacattcttattaacaagtaagaacctttcactaccagtatactcaagttctgcaatatagctagttcatcttgagatctatatctgtgaaacaagaaattcagaatcagagctaaagatttttaaagtgtgatttttatatttttcctaggagaaaarggcattttttacaataaagtgacagttgtttaggataaattaataagaaaatgtaggcccttgttgggaagaattgttgatagatgggtgttttagaaaagccaaatggttagtcaaatgaccacagaaatgcctgtaggaaataaaatattaaaattctgaacactgtttgattatatgccttgtattagtttcctgttcctgctgtaaataaattcctacaaacctagtggcttaaagcaaaataattatcttatagttgagtaggttagaagtctgacacaggttttgcttggctaa

SEQ ID NO: 85592 - DNA, 601 bp, Human
taatcttccttttttaaagttagcttattagcaacctcaattccaaccacagctttaatttcattttgccaagtaatgtaccagattggtgcaaaagtaattgcgacttttgtcgttacttttaatggcaaaaccacaattacttatgcaccaacctaataaaatatattcacaggtttcgagattagtaggtggacgccttcaggagaccattctgcccagtgaatgggatctgggccctccaaaaagagacatccttttctgggttatcattcatgcacctgaagcaacctcttttagytactgctttccatgccagttaccagggctcctgaacaaacaggaagtatttactcacacataaataatcagcatctatgtttttaacttggaatagaaaggttttttaaaaaaaattttcatcctttgtgtttatgagatgcttggatacttaattctgcacatccaagggatcacttggattttatgaagtcagtgcttaaagtgggatccagaatatgcaattttatcaggcccccattgtcctatgtgcagacatcagtggcttgccttgtttctattacatagagacattccagaa

SEQ ID NO: 85593 - DNA, 601 bp, Human
atgtttgcccaggagcatagtaaaatacctgttggctaagaacaaaaacagtggcttccaagtacgtaaggataatgcttactaaccagagattcttttgaaattaaagagtaggaaaatgtttccttttgatccattgaacactctacagttagaaaactttaggtactcgtgccctctccagaaagcagcaggctcttttcttaattttttagttctgaaaataaaaattatttaacatataaggatattgggtgtattttttatctcacatgttggtttagcatatgattccttgaaytttgttgccataaataacatcatcatgattcttttgtttattgtaatttaattatcatctcagagtcatgcaagacatttgtgtcatggttttgaggtgatcatagatacatgtaatttcaacttgttttaaaagaaagccaatcttttccaaatatttgattttcaacttgtaagtttgagaaagactaatttttattatatttgtataatatgactattatttgaacctcttcaacatgaagtacacatggttatatatatatgtgtgtatacacacatgtaccaagagatcctgaca

SEQ ID NO: 85594 - DNA, 601 bp, Human
atcatctcagagtcatgcaagacatttgtgtcatggttttgaggtgatcatagatacatgtaatttcaacttgttttaaaagaaagccaatcttttccaaatatttgattttcaacttgtaagtttgagaaagactaatttttattatatttgtataatatgactattatttgaacctcttcaacatgaagtacacatggttatatatatatgtgtgtatacacacatgtaccaagagatcctgacagttacttgctgaagagatccacacacctctttgcttcttttgctctggtgcaarttcatttgcagacacctttcctcaccagtgactcatcgtgtggtgttgttaccactaggtcatctgaaataaagttgtagcctaaagcgatatgtaaataaaacccatacccgtttctcaattggtgaggtaggaagatacatatccaagtccttctgtctggtttctttttagcctatcagcctttctaagagtccttcagtctgtcatttgatataaccccatggtgtaaagaggtgaactctacaacagaggcccaacaaagataaaaaccctgacttgtcttaaaaaaaactgttt

SEQ ID NO: 85595 - DNA, 601 bp, Human
tgccaggaccaaagagccatttaccctttcattcttagtttatatgtgatttacctttccatgagttttgctatccctgtagtatttgaaaaacaccttttctgtggccaacagtgatctttggctcagtgctaataagcatttccccagtgacaatctgttgacataacctagcatggcagggtctatcacagagggtgggggtaatcaggctctggggaaccatggcctgtgaccttgaatggcaatagaccaggactgggaggagcatccatattgaatccactgatacccatggcaracgggcccatccatcctgctcctctcccaattgccactcagtccagtttcagagcgggaaactggaggaggagtgatttcttcttccttccagccaggtggcaatttgttctcctagttggcagcaatttgtcctgcagctctcccataggacacattactgaagagttcattcttcaccatggtttctttatcggttgtgattcatacccatcataaacataataacttgccaagaggtttttcttccatttcccttatttccatttcatacttttaaacatttttactgtagaaaaga

SEQ ID NO: 85596 - DNA, 601 bp, Human
gcaattgcattttttgccattatgtagcctttcagattgacatctttcacttagtgacacacgtttaagtttcctccatgcctgttcatggcttcatagcttattcctttgtaacactgaacaatattccattgtctaaatgtaccacagtttagccattcacctattgaaggacagcttggtttcttccaaattgtcagttatggataaagctatatgaacatctctatggaggttttgtgtgagcataagttttcaaatcctttgggtaaatagcaaggagcataactgctggatcatrtgggaagaatatgttaatgttgtaggaaactgacaaactgtttttcttttttttgagatggagtctcactctgtcacccagtgacagtgcagtggtacgatcttggctcactgcaatgtccgcctcccaggctcaagccattctcctgcctcagcctcctaagtagcaagtaccagagatggggtttcaccatgttggcaaggctggtctcaaactcctgacctcaaatgatccacccacttttgtgaagctccccacgaccctatattggactgaacaaaagaggacgaacgtgggaat

SEQ ID NO: 85597 - DNA, 601 bp, Human
gtttcctccatgcctgttcatggcttcatagcttattcctttgtaacactgaacaatattccattgtctaaatgtaccacagtttagccattcacctattgaaggacagcttggtttcttccaaattgtcagttatggataaagctatatgaacatctctatggaggttttgtgtgagcataagttttcaaatcctttgggtaaatagcaaggagcataactgctggatcatatgggaagaatatgttaatgttgtaggaaactgacaaactgtttttcttttttttgagatggagtctcrctctgtcacccagtgacagtgcagtggtacgatcttggctcactgcaatgtccgcctcccaggctcaagccattctcctgcctcagcctcctaagtagcaagtaccagagatggggtttcaccatgttggcaaggctggtctcaaactcctgacctcaaatgatccacccacttttgtgaagctccccacgaccctatattggactgaacaaaagaggacgaacgtgggaatagaagacaaagacaaaagagtatatttggaagaaggggtcagggggcaccttgcttctagtgaacaag

SEQ ID NO: 85598 - DNA, 601 bp, Human
tatgtccttttgcattcctatcaacaatgaatgaggagtcttgttgctctatattcttaccagcagttggtgatgtcagtgttttttagattttggccttataacagatgtgtggtggtatcttgttgttctgatttgcattttccttataacatatggtgcagagcatctttttatatgctcgtttgctatgtgtacatctttggtgaggcatcaaggtctctggcccattttttaatcccattgtttgtgttcttattgttcagttttaagagttatttgaacattatggataccagtycattaccaggtatgtcttttacaaatattttctccaagtttatggcttctttcttgacagtgtctttcacagagcaggaatttttattggaaagatgtctatcttatcattttttttcatggattatccctttaatattttaactgaaaagtcattgccatatccaaggtcatctagattttctcctatgttatcttctaggagtttcatagttttgcattttacatttaggtctataatccattttgagttaatttttgtgaagggtgtaaggcctgtgtctagattcatttttctgca

SEQ ID NO: 85599 - DNA, 601 bp, Human
gtttgttattaaccctaaataagtttctaggattttgattaggattgcactgaatctatagatcaatttgggaagaattgacatgtggacaatattaaatctttcatttatttagttctttgatttctttcatcagaattttacagttttcctctatagtttttgtacgtatttgttagatttatgcctaattatttcacttttggagatgctaatgtaaatggtattacgtctttaatgtcaaattacagttgctcattgctggtatataggaaagtattgacttttgtatattaacctkgtatcctgcaaccttgctacatttgcttattagtactaggagctaattttgttggttctttcagatttttttacacagacagtcatgtcatctgtgaacaaagagcgtttcattcattccttcttaacctgttgatattttcattttcttgtcttatggcattagctaactgagacttccaagaggatattgaaaagtattggtgagagaggacattctggccttgatcctggtatttgtgggaaagcttttatttttgcaacattaagtataatattagctatagcgttttagtagatc

SEQ ID NO: 85600 - DNA, 601 bp, Human
agtacaagcatagcttttattggcacatatatccctcccagccaaccacacaagaagcacagtacctgtcatttcctaacctttaggattagaggaattcaagcaagaaaaggcaaagaggaaagcctagtaaagttcacaatgcttctctttataggcagaacaaaaaagaatattgaggcaattactggcataaatcagtccaaagcaaatcaaagaaattcaagcaaaaagaaggcattttgcctgaattatggagctaatgatctcagtcctccacttcagtgttcctgaggagacmtggcctgagaatgtttttccagtgatctggcagattcagaagtgaagagaaaatgtattattgtaagtgcagctatggagatggagtccagtgctgcctctgtccagaacatgtgttgagaacacccaggctcaactagcatggctagctgggaggagagaggctctagaagggatgatcatgatccccacggggcaagagaggggtggtgtcagtgcccagaggagtcatgctggctcatctttcaaaatctttgtagctttaacactgtcagagatgttataagtaattttcattttt

SEQ ID NO: 85601 - DNA, 601 bp, Human
aaagaaattcaagcaaaaagaaggcattttgcctgaattatggagctaatgatctcagtcctccacttcagtgttcctgaggagacatggcctgagaatgtttttccagtgatctggcagattcagaagtgaagagaaaatgtattattgtaagtgcagctatggagatggagtccagtgctgcctctgtccagaacatgtgttgagaacacccaggctcaactagcatggctagctgggaggagagaggctctagaagggatgatcatgatccccacggggcaagagaggggtggtgtcrgtgcccagaggagtcatgctggctcatctttcaaaatctttgtagctttaacactgtcagagatgttataagtaattttcatttttctgtttaaaaatatgtctcttttctaacagcttttagcaataaaaaggcaacttattaatgaaacccttctgccttcaaagtatgaaattaaaatattattgtaactacaggcaagaaagcatttggattatgtgtcatttagaaatggtaataaagattatccgtatggtcttatgttgtcagtgccttacattgcattagcaatcacctaat

SEQ ID NO: 85602 - DNA, 601 bp, Human
attatgtggttcattttaaattctgtgtcctaggtcaatcagtgtcaagatgatttactagaaggaggtgcggttttctttcatagatgctgttaagtgcttgggcacaattagaatattttagggcatagtatatttggtattatcgtgctgtgggtgttcttaaaccttctcactgtataccttctccttaggcatctctaattctcatcttgtctgtcttgggtacacaaaacaatctctggtagcaagatctataaaaatttgtgttacctgtttatttatgttagtttccctttargtcttctggcttttgtacaggtgtcagtcattttagatgttgagtttttgatggtcagtgagcaggatgcagaggccaggattaacctatgtctccaaaagaattagaaatctctctgcttttttttcattctcttccactgaaagagggaacaaagaagccttactcctgctgaacgttgcagggaacccagcgacatgacattttttaaccttctgctctgtaggggttgacaaaacttgatgggaactaatctgggttcatttgggatttgggacagggtcatagccttttgagaat

SEQ ID NO: 85603 - DNA, 601 bp, Human
agaaggaggtgcggttttctttcatagatgctgttaagtgcttgggcacaattagaatattttagggcatagtatatttggtattatcgtgctgtgggtgttcttaaaccttctcactgtataccttctccttaggcatctctaattctcatcttgtctgtcttgggtacacaaaacaatctctggtagcaagatctataaaaatttgtgttacctgtttatttatgttagtttccctttaggtcttctggcttttgtacaggtgtcagtcattttagatgttgagtttttgatggtcagygagcaggatgcagaggccaggattaacctatgtctccaaaagaattagaaatctctctgcttttttttcattctcttccactgaaagagggaacaaagaagccttactcctgctgaacgttgcagggaacccagcgacatgacattttttaaccttctgctctgtaggggttgacaaaacttgatgggaactaatctgggttcatttgggatttgggacagggtcatagccttttgagaattcagtaccttccccttgatcctcctacagcctgagctctctgagctttgtaggttctgt

SEQ ID NO: 85604 - DNA, 601 bp, Human
ggatgcagaggccaggattaacctatgtctccaaaagaattagaaatctctctgcttttttttcattctcttccactgaaagagggaacaaagaagccttactcctgctgaacgttgcagggaacccagcgacatgacattttttaaccttctgctctgtaggggttgacaaaacttgatgggaactaatctgggttcatttgggatttgggacagggtcatagccttttgagaattcagtaccttccccttgatcctcctacagcctgagctctctgagctttgtaggttctgtgtcagkttctgctccctgtatgaacatactccaattatacgttcttgactcctcacctagttctgttctttagttttaacaatgtgccttttagattcatctgttatttcatttttgcttggaaaatatttactcaagggagtcttctctttgacactgtatatggtgatgttgacaataatttcgtaaaaacttagtaactctaggagtgtaacaattagattatgattgtgttgtactagaatcattggtcattttaatctagcttataataggagaaacagtgttttaggctgtggtgtttta

SEQ ID NO: 85605 - DNA, 601 bp, Human
attgaattctttatcctaaggaaactggccaagaagcggaaagagaccatgagcagcacccgacaggagatgactgtgatggtgaactcaatggacaagagctatgctgagcagggcacaaactgcgacgaggctttctcattcatggacacgcacaatctgaatgggagatgtaagtgcatatgtttcttggcttctaacacatctccttggttttgcaagattccaggtggtactaggggatttcaaaaaaaaaaaaaagcttcctgaagaaatttttatgccgtgttggtttcttcartcattttcagtgatcctttgtgccacaggttgcttagcagagatgttctaaaggtgataggaccagatcagagagtccagaaaaccacagtgcagtttctgtaaagatttagagagcagtgacacgaggctttccttcttttaaggaagaaggcacctgcttctcatcatccttcttgttgtttagatcccatttgtaaactatccaggtgtggaattacacatgggaagcctgttataaaaacagttcactaaatggcagtaacaagttaattgtttatttgtttagatgacaggttct

SEQ ID NO: 85606 - DNA, 601 bp, Human
catggacacgcacaatctgaatgggagatgtaagtgcatatgtttcttggcttctaacacatctccttggttttgcaagattccaggtggtactaggggatttcaaaaaaaaaaaaaagcttcctgaagaaatttttatgccgtgttggtttcttcaatcattttcagtgatcctttgtgccacaggttgcttagcagagatgttctaaaggtgataggaccagatcagagagtccagaaaaccacagtgcagtttctgtaaagatttagagagcagtgacacgaggctttccttcttttraggaagaaggcacctgcttctcatcatccttcttgttgtttagatcccatttgtaaactatccaggtgtggaattacacatgggaagcctgttataaaaacagttcactaaatggcagtaacaagttaattgtttatttgtttagatgacaggttctgcctttattatagggctgtcagtgtcaattaataaattaaactctatttcagcttcacaagtcttatgcttcataccaggtgtgtaaaccaacctcagctactgccttcccatactactacctgtgatccaggtagaaggcat

SEQ ID NO: 85607 - DNA, 601 bp, Human
aaaacagttcactaaatggcagtaacaagttaattgtttatttgtttagatgacaggttctgcctttattatagggctgtcagtgtcaattaataaattaaactctatttcagcttcacaagtcttatgcttcataccaggtgtgtaaaccaacctcagctactgccttcccatactactacctgtgatccaggtagaaggcattattttaggaaactaacaattagattgattatatcaagcacaaaaggagtagttgctttgtccctggtaatctcggagaccagagggagatacctcrctctgtggtttagggcacactttggtgagttcaaggtcgggggtttctttactgtgtgaaatctgtgcctcaggcctgagctgcataaccaggattctggtcagcatggggatggaattaaagtgcagctattcctgttacaaaaaaataatcgtagtattttaaaggccggtgggccttgtggctgtgaggagcacagaaatggcatctggcgtggggcgactgggagcagtttggacggtgtgggctcatgtcctaatacccactgtggtcagtgtggtactgcagctcccctccact

SEQ ID NO: 85608 - DNA, 601 bp, Human
aacacaggtaaatgcactctcctaaacggactgctcctggagagttaaaatatattaatatgtcatcagaataattacccagtatgcacagggatttggtcatgcttcccataaatataatggtataattgtgtcttagtgtcctgatgaggaacttagcatcaaacagatcatgtaactacatcagaggagttacaatttagacttaagtttaaccaccttgagcaactttcaagtctttatactttaatgaaattaaactgttttaaaaacactaatcaattaatacatttgaagaggttttttttacttaaaaaaattattctatcaaggctctgtcatccatgaagagcgttttaaaatgtctcttaaaattaggaaatacccatttttaatgaaatcagataaattggatgggattgactatcctgcttgataaaagggaggaagagaaggtgcaataattcagtcttgagtgtttcagaggaatattttaaagaagagcatttttgtaaggatttaaaatactaaggaacacgcatggagcaccacctttgtttttcataaagcattgtggagtattctctgcatatccaaatat

SEQ ID NO: 85609 - DNA, 601 bp, Human
cctgatgaggaacttagcatcaaacagatcatgtaactacatcagaggagttacaatttagacttaagtttaaccaccttgagcaactttcaagtctttatactttaatgaaattaaactgttttaaaaacactaatcaattaatacatttgaagaggttttttttacttaaaaaaattattctatcaaggctctgtcatccatgaagagcgttttaaaatgtctcttaaaattaggaaatacccatttttaatgaaatcagataaattggatgggattgactatcctgcttgataaaagrgaggaagagaaggtgcaataattcagtcttgagtgtttcagaggaatattttaaagaagagcatttttgtaaggatttaaaatactaaggaacacgcatggagcaccacctttgtttttcataaagcattgtggagtattctctgcatatccaaatatgagcaaggagaggatttagcaaactacgggaacattgacattgggaatcgtctccaaaagccatgtgtagacaccttcttctacttttacttgtaaaattcagcttggcctgagagcagatttctataagcaaagggcagaa

SEQ ID NO: 85610 - DNA, 601 bp, Human
accgtgggtagcatggagtcaccatgggtggtctcagagcattgtgtgttcagagtgtattacctctctgctgcccctgaccagcctctcttttatttacagctgtgtcttcaccatcgtccttcacaatgaaaacaaatacactgagcacatcggtgcctaattcctattacccaggtaacagttttttccattgtctcctctctgctctctcctcagcagtcagaatcactccgccctctctctgctatccctggtgcttgaggggcttactgtgtttgagatgttgtaacccaatgcktttctacagctttctatgcagaaaataggggtgggcattcatcaatcatttactgttctttctctttttactttctctgcattgacctgcttacggtgtatgacagacccatttgtgccaactgcaattttaggtgagaacatttccctttaccacagtttattgcaggagtaatttagaaagtcagtgaccactctgtaggagattggagttttaattctgtataatgcagtgattataagcacgacatgtgggaggtgggtggcctgggtcatggggttaaaggaaaaagagactttt

SEQ ID NO: 85611 - DNA, 601 bp, Human
tctcattattttcacttattgctaagcactaaaaacttcaattttaaaagtagcgtttttctaattatgccaaatgtcatgcagaaaaatgatcacaatggacttctggccctctacccatcctcggtgccactcagggcaccccacccccccaccaacattccaaagtgtctgtcacacagtggaatttcaaaggagctgatgatctgaacagcaaaatgacaagatggcacttataatcatatgctttattatgtgtcagatgtcactagaaatgaactaaggtgttagcccggtgggrcagaatgcatttaaagtatgaaatattcccagcagggggttacagaaaaagtcccgtttgtccaatataagaagggtgaggagaaaaatggcattacctggctgtgataaccaaacaagcatgagctgctgttgcatttgagacgcataaataacctgagtgtatcacggctgtgttctctttctactactaacctttccgaaaaggagcacaacaaaaacgacttcaaggtatataacaattcattgtagcaagagttccaccctcagttgttcgacttctccttcctaattcacttga

SEQ ID NO: 85612 - DNA, 601 bp, Human
ggtgttctgtgggcttaagcaagtttgttgcctaaggaaaaaatgaattaagatagaactttaagaatggatataaaacagagtttttaaattttgcatcattctgagggctaacaaagcccactaaaccctccctgcccacacacttttaataccaattaaaaggggaagaaaattgcattttattcttttcataagtgaggggcacaggctaatcttaggcaccagaacaatgtaatctacatacaaatgacatttgcagaatcttttgataggcgaagatttgcgatttcttcatgtrctgtggcattcattctgaggttcctctagtagattttctgaccttgggggagccgtgagtggggagggctaaaacgtgccttgtcagaaggaagaaaatgttcagatttcacagcagggttaagacaagcttattaaacaaatatcattctttaaagtcgctgctttgttattatgaacattaatgacatcttttaaagttgattagttttctttactgaaagggaatcacttggacagacaattcaagtagcaaaaatgatgcacattgtaaaaaataagtcacccagatagaccaata

SEQ ID NO: 85613 - DNA, 601 bp, Human
ccatttcagcaacagcaacatagctacacacttgtgtaccacctttcataccatgcatccccaggtgctttgcgatgcagatagaagtgaggttcccaaaccaggccctgctcatcaagcacccttggactaaattttcttcagagctgaacttctccgtaaaaaataaataacatatgaataactatagctgaattccctattgatatacaatctggtaatttttaaaacttgaatatatcttttatatgttttatataacattctcattttaagtgactttagcattatattttgacarcacccatcctcaatcataaaactgctaaagggattcagcattataatgagttaacctgtagaatgtggaattcttaatctaatagcatttccctgcataagacatttttaataggtaccatttctgcagttcattaacctaattttctagtaggcctccattaaaatagagcctctttaggcttctttgaccaaattttgacattaattttatagtacaatttggttgacttgttcaagaaatttaaatgagaaaatgtgttgaatacaaataagacttatttagacattacttggttca

SEQ ID NO: 85614 - DNA, 601 bp, Human
agatttatctttagcaattcaatgtgtaaattcagtgaaattgactgcctttgcatatttcctcatgcacttttaaagtctagcttaggaattaataggattaagagtaagacttccaaaagcttaatatcgtatgaaagacaaaattaggttattgaaaaaatataagcctaatgaatagggatgatgtctaggttctatccaatattctgaatgcagatattactgaaatgtttattaaagatgttaaagagattagttttaggctcaaataacaattcatgaaataacctgagcccarttttccatggactatttaaaaatacctacttcctataacatgctacagacaatgcatatttgaaagatgtagaaaatatttcccattcagatcttttgaataaatatgatttataagtataaactgaaatattatatactaatttgaaccatattatgactgacaactaattcagttctcaaaataaagtgttgtattcattaagtacattgcagaaaactttttctcattttagctattccgtggtcagagaggactgccaaaaagtgaatacttttaaaccctaaagccattgttcat

SEQ ID NO: 85615 - DNA, 601 bp, Human
taaagccattgttcatttaaaaaaaaagaaggaaaggaaataatgaacaaaacacatatactagagatgatatcaggaacaaataggaaggagatattgggagaagtatgaaatgggcagttctgttaggaataatcccgtcactgagtaccgtgccccttgtgctgccctcctggagggatgctgatgttgtcgtctagtggggtagatgacagggaagtgaggagtggtgatggtgggcgggcatgcctgtgccatggccgcagggagaaggggacgccccctaagaagcgtgtgtcakggaatgacatgctctggtcttgatggaggcacagccaggcttctgggaactggtggtggagtgaaaggtcccagactgcaggtactcatatgtcccactttctctaaccccagggaggtgttattctcatgagaatctggcaaatccttaaacagttatttttttgaagtttatgtagtttttagacctctaataaaacagacctctttccatcatgctgtaaagtctgcatccttttcattaacacccacccagagtcaagagtgttgagtgctaactggtgtagtgggagtctctgtg

SEQ ID NO: 85616 - DNA, 601 bp, Human
taaaaggtaataccccaaaaaagtaaaggagaaagggaatgtgtatttactttaaaagttcctgttgttctatctctattcaaaaatgccgtggaatgcttggcttcaagacttgttgaagcagtgaattacttcagtactgaagcatctttggggataaaatctaaagaatggctctggttgttgctgtgactctgtgtaatcatcccatcggcctttctggtcttcttcaatctgtatattatcaggaaaagccagtcatttatgttgtaaaatttttttgaagtagtgatgttctctytgctgaacaggtttcaaccaattcttctttatcgttttcaagacagcagtgtctcaaaattggcctaaacaccagaaggattcattactgatcaagtagccgacagaagtatgtccgaacaagagcataccatgtggtggggatgagatggagcagagctcagtgcaggttttttatttgattttgttctaacaaggtagtcatatggcacctctcaccagggagatgcaataatttgattcaaaagaaactcagacatgaatcacaataaagaagtaaacatgctgaattgaacagaaa

SEQ ID NO: 85617 - DNA, 601 bp, Human
ttgttctaacaaggtagtcatatggcacctctcaccagggagatgcaataatttgattcaaaagaaactcagacatgaatcacaataaagaagtaaacatgctgaattgaacagaaaatggcatgttgtcaacagagagtggtgcagggacctctccaggagaggagaaagagcagaaagggcaagtttgtttatgttgctgtgagagaagagctgcctggttcctctgacaagcaaagggcagtctgtgctaagcctctggggggaacctttgggcttcccagaaaagtagaagagagarcgcttcactcacgagggacagacaggtcagactcagccaccctgccccacgcagacttctgggcctttctcagctagagttgaacagggacatttgccatgactgcagctctgccctgaaccctcacacccagccctagacaagggtgtgttgcaccccttgtaagtggcttgataccacgtcaggtccaacgttgtggtgatcctgtgcgagtggagagtgagttcctccccttttgcagtccccaaaggaccttgttgatggctcgattattttttttatgcctcaatttttgaactg

SEQ ID NO: 85618 - DNA, 601 bp, Human
tgcactctaaaatcttgcttttttttttgtgacttagtctcactctgtggcccacccaggctggagtgcagtggtgccatctcagttcactgcaaccttcgcctcctgggttcaagtgattttcccaacccagcctcccaagtagctggagctacaggcacacgccaccactcctggctcatgttgtatttttagtagagtttttcaccatgttggccaggctggtctcgaactcctgacctcaggtatctgcccatcttggcctcccaaagtgttgggattacaggtgtgagccaccctstctggccccagatctccctcttatttacttgcctcctacctcagtgaagccagctgttcttgtctgtttaatgtggctacaacagaatacctggggctcggtcatttgtaaagaaaaaaggttctgcaagctgggaaggagagaagcatggcactgccttctggtgagggccatgtgctaagtcaaaggggaagtggacacgagcagtgagagaggaccaaacagaaggagaattgcttttttcattttttttaagagacactctgttgcccaggctggagtgtagtggtgtaatcatag

SEQ ID NO: 85619 - DNA, 601 bp, Human
ccattttcagtggctgccctctctcccctcccctagggcctgccctgatcacttgtctgtgccatcggaagagtcccctgacttgtcttcctacctagtctttccccttcaaatctgttccagactctgcaaccagttttctttgtaagacatggatgttatcatgtttgactgatgctgaaaactatgccacggattctttccaaaaataagaacctcagcatagcacattcagccctctgtgtcaagacctcactctgtgtttcagactttcgttgtaatgcaggtgcttcccaccgtscaggctgtgctctgcttctgctcatgtactcgccaccctgccatcctccaggcctccagggctcatgctgcaggttgtggcctctgcctggccgtgacttcagctcctccttcacttgccaaatccctttggacacagctcagatgtgactgccccccaagctgtccctgatcccaaccagaaacaaccattccccctacagtctcacagctctgtgtttgaataatatagtaggcaatatattaactgataatacagtaggcagtatattaactgataatatagtaggcaatatattaa

SEQ ID NO: 85620 - DNA, 601 bp, Human
agatatgttccatttggtcattttacttattgaaagccaacctgtttaaaaatttgaggatagacttttttttttcaaggtggagtctcactctgctgcccaggctggaatgcagtggtacagtctgggttcactgcaacctccatctgccgggttcaagagattctcccacctcagcctcccgagtagctgggactacaggcaagcaccaccacacccggctaatttttgtatttttagtagagacagggtttcaccatgttggccaggctggtctcgaactcctgacctcaagtgatcyacctgcctagggctcccaaagtgctaggataacaggtgtgagccaccactcccagctgaggatgaacatttttaatacatgtttgctttacatttcttatttaaccttgtggcaggaatgaaatatatttggtctttgtgcctggttcctgacactgagctcttaaaacccttgggattttatgagtgataagagcatcttttactaaaatctaacttgatgctaatgttgacttagagtggagcccttagctagcctcaggatggggtgggtctccagaaaaacctaatgattagagag

SEQ ID NO: 85621 - DNA, 601 bp, Human
gtttctgaatgaggtggtttctatcccgatgtgcccttcctatcttttcttcctcttgtctcccctcatttcagcctcttccgaatctcacttctaacccacaccccatctccaaaacactgggaagtctgcattgagatgataaggttatagtattagcacacttttgtatcaagttctcacagtgtctgaaatgtggttatgattccatgatgtctctaatccctactcacccagttcttaagaatcatgggcaaccccgcttgggtccccttccacgctgtggaagctttgttctttygctcttcactgtaaaccttgctaccactcaaaaaaaaaaaaaaaaagaatcgtgaatgataaggaaataatgtggactaaatgttttgaattacttaatgtttgacattttacagtgtataaattcgtattattgtcacatgtatcattcagaacacagtaatattgaattagagcccatgtttttgaccagtcatgtcacggaaaagaaagggaatatgctgacttttccaatttctattgtctcttctgaaataaagtacttttatgtccatgattgaaatataatcaaattggctgg

SEQ ID NO: 85622 - DNA, 601 bp, Human
aggtggtttctatcccgatgtgcccttcctatcttttcttcctcttgtctcccctcatttcagcctcttccgaatctcacttctaacccacaccccatctccaaaacactgggaagtctgcattgagatgataaggttatagtattagcacacttttgtatcaagttctcacagtgtctgaaatgtggttatgattccatgatgtctctaatccctactcacccagttcttaagaatcatgggcaaccccgcttgggtccccttccacgctgtggaagctttgttctttcgctcttcactrtaaaccttgctaccactcaaaaaaaaaaaaaaaaagaatcgtgaatgataaggaaataatgtggactaaatgttttgaattacttaatgtttgacattttacagtgtataaattcgtattattgtcacatgtatcattcagaacacagtaatattgaattagagcccatgtttttgaccagtcatgtcacggaaaagaaagggaatatgctgacttttccaatttctattgtctcttctgaaataaagtacttttatgtccatgattgaaatataatcaaattggctggatgccacggct

SEQ ID NO: 85623 - DNA, 601 bp, Human
gtgcccttcctatcttttcttcctcttgtctcccctcatttcagcctcttccgaatctcacttctaacccacaccccatctccaaaacactgggaagtctgcattgagatgataaggttatagtattagcacacttttgtatcaagttctcacagtgtctgaaatgtggttatgattccatgatgtctctaatccctactcacccagttcttaagaatcatgggcaaccccgcttgggtccccttccacgctgtggaagctttgttctttcgctcttcactgtaaaccttgctaccactcaaaaaaaaaaaaaaaaagaatcgtgaatgataaggaaataatgtggactaaatgttttgaattacttaatgtttgacattttacagtgtataaattcgtattattgtcacatgtatcattcagaacacagtaatattgaattagagcccatgtttttgaccagtcatgtcacggaaaagaaagggaatatgctgacttttccaatttctattgtctcttctgaaataaagtacttttatgtccatgattgaaatataatcaaattggctggatgccacggctcatgcctataatctcagca

SEQ ID NO: 85624 - DNA, 601 bp, Human
aaatcagttttacttctatacacaaactatttgaaaatgaagaggaaaaatcatatttataatagcatcaaaaagaataaaaatacttagaataaatttaaccatggatgtgaaagatctatacactggaaactagaaaacatttataaaagaaattgaagatacaaataagtggaaagaaatacccatgttcatggattggaaggcttaatattgttaaaatgcccatattacccaaactgaccaataaattcagtgcaatctccattgaaattccaatggcattttttaacaaataggaaaaaaaattctaaaatttgtatggaactacaaaggaccccaaatagccaaagcaatcttaagaaagaataaaactataggcattagactccctgatttcaaactttattgcaagctacagtaatcaaattagtatgatcctagcataaaaacagacacagagaccaatggaacagaattaggagcccagaaataaactcatgcatatatgatcaactaatattttacaagagtgccaagaatacacgatggggaaaggataatctcttcaataaatggtgttggggaaactagatatgca

SEQ ID NO: 85625 - DNA, 601 bp, Human
ggactccaatgctcattacagcattattcacaataaccaagacatggaaacaacctaaatgtttatcaatagatgaatggatgaagaaattatggtgcatatatgcaatggaatattattcagccacaaaaaaagaagtctaccctgccatttgcagcaacatgaatgaaccttgaggacgttatgcaaaatgaaatacgtcagagaaagataaacactgtatggttttacttacatgtggaatctaaaaaagtcatagaaacagagtagaacgatgattgccaggggatgggggttagargaaatggagatgttggtcaaaaggtacaaactttagttattagatgaagaagttccgggaaactaatgtacagcatggtacagcatggtgactgtagttaattatacttattacatacttgaaatttgctgagacttaagtagatcttaaatgttctcaccacacacacaaaagtaactaaattaggttataagatgtgttaactaacttgactgtggtaatcatttcacaatatatatgttacatgaaatattttaaaaacataggttgacaagtacccttaatagattgtcagttatg

SEQ ID NO: 85626 - DNA, 601 bp, Human
atgggggttagaggaaatggagatgttggtcaaaaggtacaaactttagttattagatgaagaagttccgggaaactaatgtacagcatggtacagcatggtgactgtagttaattatacttattacatacttgaaatttgctgagacttaagtagatcttaaatgttctcaccacacacacaaaagtaactaaattaggttataagatgtgttaactaacttgactgtggtaatcatttcacaatatatatgttacatgaaatattttaaaaacataggttgacaagtacccttaatagmttgtcagttatgattaggttaaggaaattccctttaatccctggtttatttatattatttaccatggatagatactggatttgataggatcctttttagcattttttgagatacaaaataattatttgatttctcttctttggtatgttaacatagaaagttaatataacatatatgtgatttatataattaatattattattatataccaaaaagccaacccttcatccttgggataaacctaacttggtcatgatatatattaaacattgctgagtgctgttaactgatcatttttca

SEQ ID NO: 85627 - DNA, 601 bp, Human
ggtgcagcacaccaacatggcacatgtatacatatgtaacaaagctgcacgttgcgcacatgtaccctagaacttaaagtataatacaaatatatatatatataaacaaaacaaaaaaaaactctttaggaaggttgtgagatccccttttttgaagatcatatatcctcaaaaatgttctcatccatcaaggatggtctaaatatgagcattgtgaaagaataatgatgtaataatgacctctatcaaggtcatcttccatggtgaggaacgtgaaatggaaaaggcatgaaacggcatatgtgcaagacttcatagctctcaagcctgatgtagcagggctggagaaagaaggaaaggccttttccgacccttaattaaagggacttttgctggctctttgcagattgctgctggcgccccatatagttcttaattaattccgcctgtgtcattacaaagtaagccctactgaagagtgggttaacagccggagtaagctccctggactgcattttctttcacttgacgctgtgtcttgaaggctccagcagtggggtggagctgcctctaggagcaggcctgttttaatcagcatatc

SEQ ID NO: 85628 - DNA, 601 bp, Human
actgcaataatgcaggcaagagatgggttggaggctgctctccaaaggaagggagcagctgaatttccacaaaaacatccatctgctctctagatgttttcaagatgccttttccaaggaggtattcttactgctctctaaggatctgggcgcatttgcacaggctcactgtcaaagtcaggtgcagaggtggaggaaattacagctcttgagtagtgtgaacctcccaaactctggcaatatctgcatcagaggcaaaatgaaaattactgtctctctgaaatttggggtgacaatcctrgagacaagacctaagcctagcatgacttatagaaacacagatactttcagctgcctctaaaacagagcagtcctctttgggggacctgtgacagattgctcactgacatcactattttgacaccccattaaattaccatggcctctttgggtttgcaagggcactgcagtgagaacaggggcagatccaagttccagaatcttcaaagattgatctcattgatatacatgggaatcaagagataggcaactcaaaaaagtcagctttgaccaagttttatgtaataaatctaaacacata

SEQ ID NO: 85629 - DNA, 601 bp, Human
ggagcagctgaatttccacaaaaacatccatctgctctctagatgttttcaagatgccttttccaaggaggtattcttactgctctctaaggatctgggcgcatttgcacaggctcactgtcaaagtcaggtgcagaggtggaggaaattacagctcttgagtagtgtgaacctcccaaactctggcaatatctgcatcagaggcaaaatgaaaattactgtctctctgaaatttggggtgacaatcctggagacaagacctaagcctagcatgacttatagaaacacagatactttcagmtgcctctaaaacagagcagtcctctttgggggacctgtgacagattgctcactgacatcactattttgacaccccattaaattaccatggcctctttgggtttgcaagggcactgcagtgagaacaggggcagatccaagttccagaatcttcaaagattgatctcattgatatacatgggaatcaagagataggcaactcaaaaaagtcagctttgaccaagttttatgtaataaatctaaacacatagaaaccctttggtccagcttctccaggacaccatcctcattccataagaag

SEQ ID NO: 85630 - DNA, 601 bp, Human
cttcacaaacctcataagcatgtatggatcaacaggaaatatatgacattgctgtggaaaaggcacttgtaaaatccctcatacagagtaatattcaatagaataagaaacatattctaaagctcagtcagacatcatggggactgtttataggcatgaaaacattgtgtgtgtgtatatatatatatacacatatatacgtatatatatgtatatatatgtatatatgtatatacatatatatacacacatatgtatatatatacatatatgtatatatgtgtgtgtatgtatatatatacatatatatacacatatatatatatacatatatatacacatatatatatatacatatatatacacatatatatatatacatatatatatacacatatatatatacacacatatatatatacacatatatatatacacacatatatatataggcggcaaacctcaatcccattatcaaaagagaaagagctattaggtaaaggaagataattgtacgataacaattgccgagatcatgatggctgctctgaatcctgcaaaacagaaaaattctgcacaatttcacgttggattaagttgc

SEQ ID NO: 85631 - DNA, 601 bp, Human
tatatatatacatatatatacacatatatatatatacatatatatatacacatatatatatacacacatatatatatacacatatatatatacacacatatatatataggcggcaaacctcaatcccattatcaaaagagaaagagctattaggtaaaggaagataattgtacgataacaattgccgagatcatgatggctgctctgaatcctgcaaaacagaaaaattctgcacaatttcacgttggattaagttgcaataaaaagtggccagagattagcagcttctttaaaagatcartgaatgttcacatttagatttcggtttgtttagaaacctagttcgtgtgtctagattcttgttttcacccagtcctcacctctcttagccgtgaagcatcacatgctccttttgcctgcctttgttcaggacactggagaatgacagtgaccagtgaccattgccatcactgtgcctgaacttctggggcactctgccttgtggcccatcaggcaaagttaggtgtcttcagttgctttagtgctatagcaataaatagtttatatgggatctaataaaatgcgatgcttcgaagcacca

SEQ ID NO: 85632 - DNA, 601 bp, Human
aaagtgtttttatttgtatttgccctgtatcatacagggttttactttttatattagtccattctcatgctgctgtgaagaaatacccaaggctaggcacagtggctcactcctgtaatcccagcaggtgaatcccaaggcaggtgaatcacttgaggtaaggagttcgagaccagcctggccaacagggtgaaaccccatctgtactaaaaatacaaaaagtcagctgggcgtggtggtgcatgcctgtaattccagctactcgggaggctgaggtacaagaatcatttgaacccaggargcagaggttgcagtgagctgagatcgtgccactgcactctagcctgggtcacagggtgagactctgtctcaaattaaaaaagaaaaaagaaatacccaaaaccaggtagtttataaaggaaagaggtttaattgatgcacagctccacagggctggggaagcctcaggaaactaacagtcacggcagaaggggaagcaaacacgtccttcttcacctcgtgacagcaaggaagagtgccgagtgaagggtgggaaaagccgcttataaaacgatcaaatctcatgagaactcactatcag

SEQ ID NO: 85633 - DNA, 601 bp, Human
caacagggtgaaaccccatctgtactaaaaatacaaaaagtcagctgggcgtggtggtgcatgcctgtaattccagctactcgggaggctgaggtacaagaatcatttgaacccaggaagcagaggttgcagtgagctgagatcgtgccactgcactctagcctgggtcacagggtgagactctgtctcaaattaaaaaagaaaaaagaaatacccaaaaccaggtagtttataaaggaaagaggtttaattgatgcacagctccacagggctggggaagcctcaggaaactaacagtcayggcagaaggggaagcaaacacgtccttcttcacctcgtgacagcaaggaagagtgccgagtgaagggtgggaaaagccgcttataaaacgatcaaatctcatgagaactcactatcaggagaatggcatggaggtaaccacccccatgattcaattacctcccaccaggtccctcccacaacacatggggattatgggaactacaattgaagatgagatttgggtggggacacagccaaaccatatcactcttcaactagcgatgcatagtgtgagtctgttaatacagctgttcatata

SEQ ID NO: 85634 - DNA, 601 bp, Human
gtccatatccaccaggccacagaaaagacatggacttgacaaactatgtaactaattactggattccaaacataaatgatgaacacatagctcccactctcagggagtccacagcctggtggcagagacagacacagaaacaacagaggatgccaggcactgtccacttagtggtcagaatactatgcagcacacaggcaggcagagtggggcacagacatctcgtggcgtctgcgagcagtgtctcctactgcagcagtgctaagcaacagtttacctcatgggggagagttggacccayaaaaaggaataaatacattctacctagcgacagactaatctgaaaatattgtaaatggtggaaatggccaagacggctgaacaccacaggtgagatggagaccggggaggaaggaagagcttctgtttgggagagaactgagagaacttgaaagccaccctggagcacatctgaggacacgagtccctaatgccatgttctctggccccaaagcgttcccaaatggtgctctcattcatctgctcacccttcatctcttcctctttccctctctcttccttcccagtgggtgccaggaag

SEQ ID NO: 85635 - DNA, 601 bp, Human
ccatcaagaaagccagatcgccagtgttgccaggtataaatgctagcttcatgtgttttgtaggttggttttagagcgtgctgtatttagtagcattggagtggtcatgtcacagtcctttgtaggtaggagatgctgtcctgaggtctagggttgattactcctcagtggatcccatcaacacttgtgggatgcattcttgatactggacactgaggacgcaaaggccatggagatgagatggtgcccctgtccccaggacaaacccaaccgggcagtcagatcgctgtggcagtagtcyagcgccgtgacacagggttttgttgcagcctggtacacagtgttctagaggctcagagaaggaaaacatggtttcttggtctatctagactcttccaagttccttcattttctctgggagcccactgaagctttgcgctgttagaagaattcagatttctcctgatggctatgacatcctttccaggagtcccttcagctctgcaacaaactcacagagagtcttggaagtgaagtggggaatccccttccataccaagtggaagagacattgctgagcctataacctcatcattgtggc

SEQ ID NO: 85636 - DNA, 601 bp, Human
cccttccataccaagtggaagagacattgctgagcctataacctcatcattgtggcatcactgatgtggcctcgtgctgagcatacagaatgcaatgaatgtcaaggggtgtagccttgggtatgctgagagatccagctagcctttctccaatacaacattgagtctgcttcttcccaatgtatagtttagtacctcctcatggagacactgagatatatttttgaatcatgagtgaaaaaagctagcatttgctgagcacttacatatgccagacactactctaagcactttgcacatmgaaacccgctcactaacaacaccacgaaataggtagtatttttgtatctattttacaggtgaggcaattgagggataaagagggttaaagagtttcacggttaataaggtatggaggcaggattccaacccaggagcagcttttataaccactgctggatgggtgctgggatgactggtcccactggcttggttttcaccaggtgtggtggctcatacttgtaatcttagcactttgggaggctgaggtgggaggattgcttgaggccaggagttggagaccagccttggcaacaaagca

SEQ ID NO: 85637 - DNA, 601 bp, Human
tgtatagtttagtacctcctcatggagacactgagatatatttttgaatcatgagtgaaaaaagctagcatttgctgagcacttacatatgccagacactactctaagcactttgcacatcgaaacccgctcactaacaacaccacgaaataggtagtatttttgtatctattttacaggtgaggcaattgagggataaagagggttaaagagtttcacggttaataaggtatggaggcaggattccaacccaggagcagcttttataaccactgctggatgggtgctgggatgactggtyccactggcttggttttcaccaggtgtggtggctcatacttgtaatcttagcactttgggaggctgaggtgggaggattgcttgaggccaggagttggagaccagccttggcaacaaagcaagactctgtctctacaaaaaaattttaaaaattagttgggcgtgatggtgcgtgcctgcagtcccagctactcaggaggcggaggcaggcaaacatgaggatggccctgtattgattgtttcctttctataaaacgtctgcaggctccccaccacgttccaagcaggttttctcctttaa

SEQ ID NO: 85638 - DNA, 601 bp, Human
aaaaagctagcatttgctgagcacttacatatgccagacactactctaagcactttgcacatcgaaacccgctcactaacaacaccacgaaataggtagtatttttgtatctattttacaggtgaggcaattgagggataaagagggttaaagagtttcacggttaataaggtatggaggcaggattccaacccaggagcagcttttataaccactgctggatgggtgctgggatgactggtcccactggcttggttttcaccaggtgtggtggctcatacttgtaatcttagcactttgrgaggctgaggtgggaggattgcttgaggccaggagttggagaccagccttggcaacaaagcaagactctgtctctacaaaaaaattttaaaaattagttgggcgtgatggtgcgtgcctgcagtcccagctactcaggaggcggaggcaggcaaacatgaggatggccctgtattgattgtttcctttctataaaacgtctgcaggctccccaccacgttccaagcaggttttctcctttaaacctccagagatcctgcccatttgtctccacttggcccgtgtgggtatttggtgtaca

SEQ ID NO: 85639 - DNA, 601 bp, Human
agtttcacggttaataaggtatggaggcaggattccaacccaggagcagcttttataaccactgctggatgggtgctgggatgactggtcccactggcttggttttcaccaggtgtggtggctcatacttgtaatcttagcactttgggaggctgaggtgggaggattgcttgaggccaggagttggagaccagccttggcaacaaagcaagactctgtctctacaaaaaaattttaaaaattagttgggcgtgatggtgcgtgcctgcagtcccagctactcaggaggcggaggcaggcmaacatgaggatggccctgtattgattgtttcctttctataaaacgtctgcaggctccccaccacgttccaagcaggttttctcctttaaacctccagagatcctgcccatttgtctccacttggcccgtgtgggtatttggtgtacagctgcttgtcacaggaacactgaattctgttcctgtacccgttgctcgtcacagctggacagagagtatgtacttaaaagggtccaataatccatctcttcattcagtaaatatttattcatcactttctttttgccagactctgtgggaggc

SEQ ID NO: 85640 - DNA, 601 bp, Human
ccactgctggatgggtgctgggatgactggtcccactggcttggttttcaccaggtgtggtggctcatacttgtaatcttagcactttgggaggctgaggtgggaggattgcttgaggccaggagttggagaccagccttggcaacaaagcaagactctgtctctacaaaaaaattttaaaaattagttgggcgtgatggtgcgtgcctgcagtcccagctactcaggaggcggaggcaggcaaacatgaggatggccctgtattgattgtttcctttctataaaacgtctgcaggctccycaccacgttccaagcaggttttctcctttaaacctccagagatcctgcccatttgtctccacttggcccgtgtgggtatttggtgtacagctgcttgtcacaggaacactgaattctgttcctgtacccgttgctcgtcacagctggacagagagtatgtacttaaaagggtccaataatccatctcttcattcagtaaatatttattcatcactttctttttgccagactctgtgggaggcactgctataaaaagataatgaaggctgaggcgggtggattacatgaggtcaggagctt

SEQ ID NO: 85641 - DNA, 601 bp, Human
tgggatgactggtcccactggcttggttttcaccaggtgtggtggctcatacttgtaatcttagcactttgggaggctgaggtgggaggattgcttgaggccaggagttggagaccagccttggcaacaaagcaagactctgtctctacaaaaaaattttaaaaattagttgggcgtgatggtgcgtgcctgcagtcccagctactcaggaggcggaggcaggcaaacatgaggatggccctgtattgattgtttcctttctataaaacgtctgcaggctccccaccacgttccaagcagrttttctcctttaaacctccagagatcctgcccatttgtctccacttggcccgtgtgggtatttggtgtacagctgcttgtcacaggaacactgaattctgttcctgtacccgttgctcgtcacagctggacagagagtatgtacttaaaagggtccaataatccatctcttcattcagtaaatatttattcatcactttctttttgccagactctgtgggaggcactgctataaaaagataatgaaggctgaggcgggtggattacatgaggtcaggagcttgagaccaacctggcaaac

SEQ ID NO: 85642 - DNA, 601 bp, Human
ttcttaccccccagggcacatttctaccaccaggatagttttcaactctcaggaccctgaacttgggatcaattttttcagcaccccaaacagaggtatcagatgtgatttgtgtgtctggcacaatgttgtcagaggcgggatgggtttaaatctacctcctaccaccatgaatttgcagtctgtggccagatcaggataagacatgcatgaaataatagatctcaggtccataaataaatggagaatgtgttgtgaggacaccactggggacttgcaggagaagggtgagtggacgagyggcagactaatcaggaaaagacctctcaggcaaaagagaaggtcgtagggtttggagataggaggaacagtttggagtccttgtcctaccacatactggctcaatgaccttgggtgagtcatgagccttctcaatgtcagaatttcctgacaagatcacgtgttgtggaaatgaacagaaatgccacattaaaagaacattgatcgttgttacctgaaaaaaaatctcacttcttcattacttctgtgttactcatcttgagtttagcagattcattacttcattaaaaaaaaaaaaaaa

SEQ ID NO: 85643 - DNA, 601 bp, Human
gggtgttaataaaatgtcattggaaaatttagatctgactgcagagaaagtaggttcgaaagggacagctgttgaggaatttccagtagcccgagtgtgacacgatgatgatgttggctagaaagaaaataagtagatgaattcagaagaagtaatggacccaaccgaaagatggatgggagacagggtgaggaagacagaagagccagagatgactcctgcgtttccgacttactggaggatgaatggttagatggatgatgggcagttgaacaggtagacacatggaaggatggatggrccattcccttccagtattatccaggatggataatactggaagggaaccagctgtggagaggagctcaggttggcatgagatcaacagcagcttatgagtttgatttggggacatattgagatgcttttgaaacatgcaaatgcgatgccaagcagacagttctgtagactgctgtgaaatctgaaagagagggatctgggctggattataaatcagtgacccatttcatgggtcatatgggtggtggtagaagccattggcaggaggaggtgatctgtggagggagcaaggagggcatag

SEQ ID NO: 85644 - DNA, 601 bp, Human
agaatggttgatacatatttgtctttgtaattggcatctgattcaaggtgaatgatatttcaagaacatatggtgaggggcatccatatactgatttatttgccccaacagtctatatctgttgttttcatagtcatctgagagctttgtttgagagaggacgcgtaagaatctgcagtttctgtgccaagtcattcttagacgtccaagcagcagagcatgggggagctggaagagccaatcatttcacttctttagcttttacattcaccgacttaatgtgagtgatggtgatacttamctatttcttgtattctggaagacatagggattaacttgagaagtgctgacctgtttcagccaggaagtgcaatcatgtgatgatcagcctgctgctctccatggcagaacacatgtcccgcgttctccaccccaactggaccctttcttgagacttaccccacgctcactgctaacacaggtatctcctgggcttgaggtggattcacttatcagtgttcaccttattttatcactaaaacaaaaatacttcataaactacataatgtatgactgttatcctctattagaaagctataga

SEQ ID NO: 85645 - DNA, 601 bp, Human
tgatttatttgccccaacagtctatatctgttgttttcatagtcatctgagagctttgtttgagagaggacgcgtaagaatctgcagtttctgtgccaagtcattcttagacgtccaagcagcagagcatgggggagctggaagagccaatcatttcacttctttagcttttacattcaccgacttaatgtgagtgatggtgatacttacctatttcttgtattctggaagacatagggattaacttgagaagtgctgacctgtttcagccaggaagtgcaatcatgtgatgatcagcctrctgctctccatggcagaacacatgtcccgcgttctccaccccaactggaccctttcttgagacttaccccacgctcactgctaacacaggtatctcctgggcttgaggtggattcacttatcagtgttcaccttattttatcactaaaacaaaaatacttcataaactacataatgtatgactgttatcctctattagaaagctatagaggccaggcgcggtggctcacacctgtaatcttagcactttgggaggccaaggcaggcagatcacctgaggaaaggagtttcagaccagcct

SEQ ID NO: 85646 - DNA, 601 bp, Human
gtggtgtaatcatagttcactgcagccccaaaccactatgctcaagggatcctcctgcctcagcctccctaggactacaggtgtgctccaccatgctaggctaattcttttttcaatttttattttttatagagacaaggtctctaaaaataataataaaaatgtcatgttgcccaggctggtcttgaactcctgagctcaagctatcctcctgcctcggcctcccaagtagcttggtctgcaggcatatgccatcacatccagctaaggtatttttgatctgtaggagaaataagtcatrtctatagataaccatatataagagcaccaaaaagtgaaatcaaaggactattgacatttaaggaaggagaatttatacccaacaacctactccatatctctattcagatggtaaacacctcagattaaatatatccaacactgcgtgcctcatttccatcacccaccccaagctggcttttctccatggttcacatcttagtcaatggcaccatcttctgccctttttctcagatcagaatcctagaagtcaacatgatacctcttctcatccacaataagtgaactgatcattgtggtc

SEQ ID NO: 85647 - DNA, 601 bp, Human
acacctcagattaaatatatccaacactgcgtgcctcatttccatcacccaccccaagctggcttttctccatggttcacatcttagtcaatggcaccatcttctgccctttttctcagatcagaatcctagaagtcaacatgatacctcttctcatccacaataagtgaactgatcattgtggtcagtcctaccacctaaatacccctcagattcagccctgtccactagccctctctatgctaaactgccattgatcccctaggactcttgcagtagcctccccattgtctccccactsccacagcccttccagttcgtcctcaacaatagcgggcatctgatgaaatgaagcacgcccctgcctgtggcttcccacggtgctcaggatgaaggtcctaatgacctggccttccctcctctctgttctcatttcccaccactctcctccctggcttctgacagcacattcaccacaccaaccttctttggtttcctgaacatactagatccttcctacctcctggcctgaatacacactatctcctggacttgaaatttaggagttctgccctctccactttccatcttcatggtttga

SEQ ID NO: 85648 - DNA, 601 bp, Human
cttctctggcccagcttgtcaccacattccagataaacttattgcaccccaactaatggtaaggcactgacatgaaataatgtgactacctgtcatgaagtggaaagccccgtcaaggaaggaaagttagaaaattgacaccgatttccttctgcctgtgctgttgacaacaaacaaaacatttactcgacaggaggttaaactccagaaaccaatatgaaattttgactttcacccattagcatttcaaggaatgggtccaggtcaatagttgctccagtgactgaggataaaagggtcygtcatctgcagctcccctggcttttatctcaaaagctgtgggcttcatttctcacccactaacccaaaagaaatgttgagtaaagttagcatcagaaaaaggcagtagcagtttagaagcagggtttcccactgctctagcaacattggaagtgaagttttgcaaaatgttcttatcaggcccccctgtgctttcctttcagggcagctggcttttatctgttctgaatactgagttttagcatacactttaattggaaggaagggtccctctgctaaaaggaacagttatttaggtaaa

SEQ ID NO: 85649 - DNA, 601 bp, Human
gctgtgggcttcatttctcacccactaacccaaaagaaatgttgagtaaagttagcatcagaaaaaggcagtagcagtttagaagcagggtttcccactgctctagcaacattggaagtgaagttttgcaaaatgttcttatcaggcccccctgtgctttcctttcagggcagctggcttttatctgttctgaatactgagttttagcatacactttaattggaaggaagggtccctctgctaaaaggaacagttatttaggtaaatactttttaaaggacatatattttcaaaaaacgamaatgcactttttatttcttcaaaagttattttgggggtaaatctgctatgttccaggctctaatctaaaggccagggacacagcagtgatcagtgcaggaaaattctgcccttagggtgctattagcacatcctttcttttttttttttaatttttagttttttatttcaataggttttgggggaacaagtggtgtgtttggctacatgaatgagttctttagtggtgatttctgagattttggcgcacccgtcacccaggcagtgtacacggtacccagtgtgtagtcttttctccctt

SEQ ID NO: 85650 - DNA, 601 bp, Human
ctaccttaggagtaagttggacatttgcaaaagtagatgtatagatagccattccatcaatatacaccagctgctctctacacagggaactgtgctggttgctgctggagagctaggctgaatccagcaagcacccccttctcacagtggttgtgtttagtggggaagatgtgcagtcacctgtatgtactttagtaggtacagtggcaggtgacatctgtgagaggaacagatacagataaaacattagggatatttggagcaggaaggggttgctttccggtgggatgactcaaaaacygttttgtggcagaggtgagattgggaagagcccttgtgaatggagaaacatcatgagcaaagatgtggaagcagaaagttagttctcccaggtggaaagcagctggtgggtcaccttggctaaaggaaacagaagagctagaggacatgttgaggaagctcatggcagtggtttttgggtgattttcccagcgtatgaagtgggtcatctgcagatggtgggggtcatgagggagcgaggttttagagaatgaggcatcctaaaggatgagtcagtgagtcaatatgggatgaactgaag

SEQ ID NO: 85651 - DNA, 601 bp, Human
atgtgcagtcacctgtatgtactttagtaggtacagtggcaggtgacatctgtgagaggaacagatacagataaaacattagggatatttggagcaggaaggggttgctttccggtgggatgactcaaaaactgttttgtggcagaggtgagattgggaagagcccttgtgaatggagaaacatcatgagcaaagatgtggaagcagaaagttagttctcccaggtggaaagcagctggtgggtcaccttggctaaaggaaacagaagagctagaggacatgttgaggaagctcatggcartggtttttgggtgattttcccagcgtatgaagtgggtcatctgcagatggtgggggtcatgagggagcgaggttttagagaatgaggcatcctaaaggatgagtcagtgagtcaatatgggatgaactgaagaaggagtaagaagcagagaagacccagctaaggctgaacagcacatgttctccccattttattattttatcattgttttcagcaataggctacatcccaggaacagtagcagggaagtgaaaaggatgtgatctgccaaaggttaggcatgggggcagggtgtacaca

SEQ ID NO: 85652 - DNA, 601 bp, Human
acatattataaatttaagtattgggtctcctcctcccatccaccctcaattttattgatttttctagctgtaactgactttgacctttgataataatgggtgacgtttctgcaaattgaaagcatcccattcaagccagatctgttgcttttttagtattaatatgttcttcctatctccccttggtttaattgtcttctgtctggccactaatatatgatgacccaatattaacttcatcatgtctgactgaccagacattagtgcaacagtaacattcaagatttatgatttagcaaaycaggggctcaaaggagaggaagtcatgtccactactgcatgtctctgtatgtagaggcagggcagagtgaagatttcaaaagcaggctcaagtgatgggcagaagagcatgcaagtgggtaggattgcccagaagtgatcgtatttcacaatcaaaatgcaaccttggagattatgtggcctgcaagctggatgaagccacacacataagaaccgactggatagaacacctgctggcctcatggtggcagccatgggggccctggataagtgttcttttgatttttgtttggttttgttt

SEQ ID NO: 85653 - DNA, 601 bp, Human
taggggttaacaaaatgtcacagattgtttataactatgtgaaatacattcctgaaagcatcaaaatttttactaactttaacaaactattactaaaatgtttactagcctaaccctgtagtaaaataccctagagtattgttataatcgttagtattttgaaccatggtcagtttgggttttacggttcatctcaggctgggttttctgcctatctgttattttgcattcgtgctgaaaagtttatgcctttgctcacctttcaacaattttagcaattataatatattagaaaatgctstctctgaatgacagagactagagtagcaggtcccatagctgatgtttattttgtaaaagcaggatgtagtagaaataacacatgtaccacagccagaaggctgggatccaaattcttgtgctgtcacagaaaaggtatttgaacttcctaaacttatttcaggtagagtcctggtgtttggtaaatagtaataatagtcaagaccttaccatgtgccagacagcattcccagcactcacacatacagagctcatttcatctttaccacaaatatgggagatatatgggattgtccccaat

SEQ ID NO: 85654 - DNA, 601 bp, Human
catagtattccatggtatatttgtactacattttctttatccagtctactgttcatgggcattttggttgattccatgtctttgccagtgtgaatactgctgtgatgaacacatgtatgtatgtatctgaatcacgcatgaatcatatagaatgatttatttttctttgggtatacagccaataatgggattgctgggtcaagtggtacttctgttgtaagttctttgagaaatttcccacactgctttccacaatggctgaactaatttacattctcaccagcactctataagcgttccrtcttctccacaacctctccagcatctgttattttttctttttaataatagccattctaattggtgtgagatggtatctcattgtgattttaatatgcatttatctaacaattggtgatgttgagcattttttcatatacttgctggccgcatggtaccttttcaagcgtatctgttcctgttttttgccaaatttttaatggggttatttggcttttgcttgttaatttgtttaagttccttatagactctggatattagacctttgtcggatgcatagtttgaaaatgttttctcccat

SEQ ID NO: 85655 - DNA, 601 bp, Human
aatactgctgtgatgaacacatgtatgtatgtatctgaatcacgcatgaatcatatagaatgatttatttttctttgggtatacagccaataatgggattgctgggtcaagtggtacttctgttgtaagttctttgagaaatttcccacactgctttccacaatggctgaactaatttacattctcaccagcactctataagcgttccgtcttctccacaacctctccagcatctgttattttttctttttaataatagccattctaattggtgtgagatggtatctcattgtgattttartatgcatttatctaacaattggtgatgttgagcattttttcatatacttgctggccgcatggtaccttttcaagcgtatctgttcctgttttttgccaaatttttaatggggttatttggcttttgcttgttaatttgtttaagttccttatagactctggatattagacctttgtcggatgcatagtttgaaaatgttttctcccattctgtaggtttttctgtttattctctggatagtttttcttgttgtgcagaagctctttaattaggtctgatttgtcaatttttgtatttgtt

SEQ ID NO: 85656 - DNA, 601 bp, Human
tgggtatacagccaataatgggattgctgggtcaagtggtacttctgttgtaagttctttgagaaatttcccacactgctttccacaatggctgaactaatttacattctcaccagcactctataagcgttccgtcttctccacaacctctccagcatctgttattttttctttttaataatagccattctaattggtgtgagatggtatctcattgtgattttaatatgcatttatctaacaattggtgatgttgagcattttttcatatacttgctggccgcatggtaccttttcaagygtatctgttcctgttttttgccaaatttttaatggggttatttggcttttgcttgttaatttgtttaagttccttatagactctggatattagacctttgtcggatgcatagtttgaaaatgttttctcccattctgtaggtttttctgtttattctctggatagtttttcttgttgtgcagaagctctttaattaggtctgatttgtcaatttttgtatttgttgccattgcttttgacatctgaggaggtgtaagatctctacagcgagaactacaaaacactgcccaaagaaatcag

SEQ ID NO: 85657 - DNA, 601 bp, Human
gggttatttggcttttgcttgttaatttgtttaagttccttatagactctggatattagacctttgtcggatgcatagtttgaaaatgttttctcccattctgtaggtttttctgtttattctctggatagtttttcttgttgtgcagaagctctttaattaggtctgatttgtcaatttttgtatttgttgccattgcttttgacatctgaggaggtgtaagatctctacagcgagaactacaaaacactgcccaaagaaatcagggatgatacaaacagtgaaaaaatattccatgctyatggataggaagaagcaatattgtttaaatggccctactgctcaaagcaatttacagattcaatgctattcctatcaaactaccaatgacattcttcacagaattagaaaaaactattttaaaattcatacagtaccatagaagagcccaaatagccaaggcaatcctaagcaaaaagaacaaagctggaggcatcactttatgtgacttgaaactgtactacatggctacagtaaccaaaacagcatggtactggtacaaaagcacacacgtagaccaacagaacagaatagagagccc

SEQ ID NO: 85658 - DNA, 601 bp, Human
ccagaaatagtgccacacacctacaaccatctgacctttgcaaagttgacaaaaacaagcaatggggaaaggactccccattattaatattattgaataataaatggtgctgggataactggctagccatatgcagaagattgaaactggaccccttccttataccatatacaaaaatcaactcaagatgaattaaagaattaaatgtgaaacctcaaactataaaaatcctggaatataacctaagaaatagcattttggacataggccccagcaaaggggccttttctttttaataccyagtaagttgcccatttacaaaataatgtccttttttgctgaccttgaaaatatactcagacaaagcagagtaggtcttactaattgcatatgttcacatttcaaaatgtaagtagtcttatgtaaacccctaaatagctagtgacatgaacttttcatttctcacatgtgaacaaacttaaactgtgcatagttaagaagccttggaacaattcatagagattgtgatctgtggagaactggctatccagataggccccaccacatgccattgaccttatcaccgccatcactgtcttcc

SEQ ID NO: 85659 - DNA, 601 bp, Human
cacttagacagtagaatatctcagccaggtagagaggatggctcatgttggcccggcaaagccaaaatcctggggcagattttggtggcattatctccaacatctctgactatttctgtttcaagttaagggctggtcagcttctattcttagaaacactttctttacatatgtcagtaaatcaaatcctgtatttagagacagtccatcttgttaaactaactttgcttggctctaccctgaccctgtttgtgtaacccctgtccccatacatataatcagttttgtctgtagttataayttgtccataatttgaaaaagagaagcctaaaaagttccctccagacactttcagctaggaacaaacttttatgtgaaaataataaaaatgtggggagtgaaggtttatagtggaaatatttacagagcctcaaacactgcacaacagttcaaactttgttgtagtgccttcattctttttgctgtcaatttgtttttcttctatctttattccacatacttctggtataggtttaataaggatttttcaaaaagataaatatggtttatattttcccagctcaaaattccccttcaggcc

SEQ ID NO: 85660 - DNA, 601 bp, Human
gagcttaattaaggaagatagagactaatgaaagcttttatttctctggcagtagcccctgaagcatatgaatataggctgttcccttcactttacttccttgacagaaggcagccagatcctttgggtcaccaaacccctccattctgaaggctgccgttcattttttttttttttgtcctcgattgccgtctctctgttcccctctttacagcatgcgcaagtacccaagctcagtttctgagcgttctctttggagaccgacactgatgaatgctctgtacctccgccagcaggatgyttctgtgctgtggacatctgtcatgttccttccttccgaggccacagcactttctcctgcgcctcttttcagctccccatgcatgccgccattcggtctgtcccagggatcagggactgaaggtccctctggaagcagtgtctctatctctgcattgtatagcatattgttgccacacactacctacccccattttattcttttctatattagagatcctctttggtgccctaatccatatcccatcactcaaatctgatgggtctgcctttctcgacctgctttctgtgtcaagaataa

SEQ ID NO: 85661 - DNA, 601 bp, Human
agcactttctcctgcgcctcttttcagctccccatgcatgccgccattcggtctgtcccagggatcagggactgaaggtccctctggaagcagtgtctctatctctgcattgtatagcatattgttgccacacactacctacccccattttattcttttctatattagagatcctctttggtgccctaatccatatcccatcactcaaatctgatgggtctgcctttctcgacctgctttctgtgtcaagaataatagaaacctttgcattccttttcacagtggtaccactgcaacctgwaatagtttacgtaactgctagggaggtccgattctagaagaggactgaatatcgcccaaaaagaatgaaatgcaaataatggtttctttcggtagatggagtttccagaaatgctttggaacatttcaattctaagagcaagtcatgctaggctacaaaccaccccattattggttttacccatagatatctctttgctttatgcaacatagtcacaatcagatctcttcaacttgttcttaaaatttcttccatatacaaccatgttttatgtcagtaactaggccaggactgtccgct

SEQ ID NO: 85662 - DNA, 601 bp, Human
aaaatttcttccatatacaaccatgttttatgtcagtaactaggccaggactgtccgctccccactaaaagaagataggcagaatggttaatgaaagcctacactctagagttgcacagcctaggctcagatagcagctctgcaagtaacctctcaatagatattagctacttattgttattatcattttgtatgttccaaaagacatatctctcaatagcagagaagcagttcaggttttaaccctagtataatgtatactcatatagttttcatgaaagctgatacatcctacacctgwtaatgcttccttccagaaggatgtatcaaagggagccacttaagtgtgcaccaacatcctgtactccctccagagtacaaagagtgccatcattgttcactgttaaactgtagacaaacataggttggaaagacaacagctgtatcctaagctggaaaagcatattttccttctgtttttgaagtcttgctgaaattgagcagccttgatagcagcgccagctccacgtcttggtgttctgaaggcttccctggtgcacacttaaagtcagatgacatgtgagtgaaaacagcttaattc

SEQ ID NO: 85663 - DNA, 601 bp, Human
aagtaacctctcaatagatattagctacttattgttattatcattttgtatgttccaaaagacatatctctcaatagcagagaagcagttcaggttttaaccctagtataatgtatactcatatagttttcatgaaagctgatacatcctacacctgttaatgcttccttccagaaggatgtatcaaagggagccacttaagtgtgcaccaacatcctgtactccctccagagtacaaagagtgccatcattgttcactgttaaactgtagacaaacataggttggaaagacaacagctgyatcctaagctggaaaagcatattttccttctgtttttgaagtcttgctgaaattgagcagccttgatagcagcgccagctccacgtcttggtgttctgaaggcttccctggtgcacacttaaagtcagatgacatgtgagtgaaaacagcttaattccaaagaccagacaagttccttcctaacaggcttcattgaaagcagttcctgagataagaattacacaggggtgttttagagaggagctttaacatggtaagttccttatatttcttaggaagaaaatggctattgattaaatt

SEQ ID NO: 85664 - DNA, 601 bp, Human
taatgtatactcatatagttttcatgaaagctgatacatcctacacctgttaatgcttccttccagaaggatgtatcaaagggagccacttaagtgtgcaccaacatcctgtactccctccagagtacaaagagtgccatcattgttcactgttaaactgtagacaaacataggttggaaagacaacagctgtatcctaagctggaaaagcatattttccttctgtttttgaagtcttgctgaaattgagcagccttgatagcagcgccagctccacgtcttggtgttctgaaggcttccstggtgcacacttaaagtcagatgacatgtgagtgaaaacagcttaattccaaagaccagacaagttccttcctaacaggcttcattgaaagcagttcctgagataagaattacacaggggtgttttagagaggagctttaacatggtaagttccttatatttcttaggaagaaaatggctattgattaaatttatctttattataaagacatactaaataatatctactatgtaattatttgtcctttttgtttttaaacatttcataatcattttaattgaataaatgattaaaagaaa

SEQ ID NO: 85665 - DNA, 601 bp, Human
caaagggagccacttaagtgtgcaccaacatcctgtactccctccagagtacaaagagtgccatcattgttcactgttaaactgtagacaaacataggttggaaagacaacagctgtatcctaagctggaaaagcatattttccttctgtttttgaagtcttgctgaaattgagcagccttgatagcagcgccagctccacgtcttggtgttctgaaggcttccctggtgcacacttaaagtcagatgacatgtgagtgaaaacagcttaattccaaagaccagacaagttccttcctaasaggcttcattgaaagcagttcctgagataagaattacacaggggtgttttagagaggagctttaacatggtaagttccttatatttcttaggaagaaaatggctattgattaaatttatctttattataaagacatactaaataatatctactatgtaattatttgtcctttttgtttttaaacatttcataatcattttaattgaataaatgattaaaagaaaagattattaaccagaaaagagaaaatagatgatggttgaagggttgtatagcatattatagacagaggtttcccag

SEQ ID NO: 85666 - DNA, 601 bp, Human
ccttgatagcagcgccagctccacgtcttggtgttctgaaggcttccctggtgcacacttaaagtcagatgacatgtgagtgaaaacagcttaattccaaagaccagacaagttccttcctaacaggcttcattgaaagcagttcctgagataagaattacacaggggtgttttagagaggagctttaacatggtaagttccttatatttcttaggaagaaaatggctattgattaaatttatctttattataaagacatactaaataatatctactatgtaattatttgtcctttttgtktttaaacatttcataatcattttaattgaataaatgattaaaagaaaagattattaaccagaaaagagaaaatagatgatggttgaagggttgtatagcatattatagacagaggtttcccaggctattttagtgtttatttaaaacctgtccgttaatgtttggtttatgccaattttctcttaatgaaatttgacataaccttttggtgtccaatcaggatttcatatgttttagaaatacacccagaaacaaacattccatgaaactaagtatgtagagaaagccacaaatagtcac

SEQ ID NO: 85667 - DNA, 601 bp, Human
ctgaaggcttccctggtgcacacttaaagtcagatgacatgtgagtgaaaacagcttaattccaaagaccagacaagttccttcctaacaggcttcattgaaagcagttcctgagataagaattacacaggggtgttttagagaggagctttaacatggtaagttccttatatttcttaggaagaaaatggctattgattaaatttatctttattataaagacatactaaataatatctactatgtaattatttgtcctttttgtttttaaacatttcataatcattttaattgaataaaygattaaaagaaaagattattaaccagaaaagagaaaatagatgatggttgaagggttgtatagcatattatagacagaggtttcccaggctattttagtgtttatttaaaacctgtccgttaatgtttggtttatgccaattttctcttaatgaaatttgacataaccttttggtgtccaatcaggatttcatatgttttagaaatacacccagaaacaaacattccatgaaactaagtatgtagagaaagccacaaatagtcacatggtttatattgtcacactttcttacttcagtct

SEQ ID NO: 85668 - DNA, 601 bp, Human
tactatgtaattatttgtcctttttgtttttaaacatttcataatcattttaattgaataaatgattaaaagaaaagattattaaccagaaaagagaaaatagatgatggttgaagggttgtatagcatattatagacagaggtttcccaggctattttagtgtttatttaaaacctgtccgttaatgtttggtttatgccaattttctcttaatgaaatttgacataaccttttggtgtccaatcaggatttcatatgttttagaaatacacccagaaacaaacattccatgaaactaaktatgtagagaaagccacaaatagtcacatggtttatattgtcacactttcttacttcagtctgaaatgagaattttggggaatggaatgagtgaaatgtaagcatcaacatgtgggttgtgtgcgctggagaaaaggctaatcgtggatacagcggaaagtgtatgcctgattttaggtataagaagagtacacacctgcaaggcaatttagaagaaattgggcaaacagcaagtacccgccaaccagagagggccaggtgaggggaaaagactcttgtcacaggaaaccctactccagt

SEQ ID NO: 85669 - DNA, 601 bp, Human
tctcttcttttactgtcaccaaattgaaattccagtggaccagtgaacacttctaaccctattatgtaattctaggcataaagagtttttcgtgtgagagttgtccttagaaaatgcgattttaacaggccagttatatttttgattttaggttaaagtattgccgagttttccccatcatagaacaattctcagtgtgtttgcttgtaattcattagttgatttccattgtttcctttaaatggtaattttcttgggatattcttagcaattcgggataatgagcaaatcatgtcccttrtacccacccatctcaactttgcttttccttttctgcagctgaaacaaaaaatatttcatgaaagttgcatgattttaacataagtagcctcaggggagaacaaatgcaactatcaaataagtgatgttaaggattattaatgctgaagccaagtatattctgtgtcactgttaccacttctgtgacacatgaggcagattcagtttgtaaagcatggtggcatattttaccgtttacatctcactactgtaaaaatgaaaagctactcaatgtaaaattatagacttaagtgttatggaa

SEQ ID NO: 85670 - DNA, 601 bp, Human
ttagaaaatgcgattttaacaggccagttatatttttgattttaggttaaagtattgccgagttttccccatcatagaacaattctcagtgtgtttgcttgtaattcattagttgatttccattgtttcctttaaatggtaattttcttgggatattcttagcaattcgggataatgagcaaatcatgtcccttgtacccacccatctcaactttgcttttccttttctgcagctgaaacaaaaaatatttcatgaaagttgcatgattttaacataagtagcctcaggggagaacaaatrcaactatcaaataagtgatgttaaggattattaatgctgaagccaagtatattctgtgtcactgttaccacttctgtgacacatgaggcagattcagtttgtaaagcatggtggcatattttaccgtttacatctcactactgtaaaaatgaaaagctactcaatgtaaaattatagacttaagtgttatggaagcatcatattgaaaaatcacataaagctttataataaaaacttagaaaaccactgaagggacaactagttctctaaatgttgagtaactgacttcgtaacccttat

SEQ ID NO: 85671 - DNA, 601 bp, Human
accttcagccatcttcattgctgatggagggaactggctgccagtgcccaaaggagggagcccaggtttcctgcagctgctttgccttaacatccctcccctttcccttcgcacttctgccattcagtgtgtacccccacccaccacacactccctccttcaggtcccagaaccacgctagaaacaaacattctggtgatgcgctcaaacgggccctggtctcgggcagttcagttcattctgcagtcagaatagtggtgctgggctgacctgaattggaattccagctttgccacatacyggcagtgctgctgtaacaaaggcacttcatctcctaagcctgtttcttgggctggagtaggtgcctcacactgctgtgttggggaatgaatgagatcgtgcatataaagagcagcatccagcacctgcctggcagggagccatctagttgtacctatttatttgtccaacacccttgtcctgggttccccttattccagcctagaagccttggttctcttattgctgacagagctttagggatggcaagagtcccccttggttttaacactgtcttcctagtacagccccagtcctccct

SEQ ID NO: 85672 - DNA, 601 bp, Human
ccacacactccctccttcaggtcccagaaccacgctagaaacaaacattctggtgatgcgctcaaacgggccctggtctcgggcagttcagttcattctgcagtcagaatagtggtgctgggctgacctgaattggaattccagctttgccacatactggcagtgctgctgtaacaaaggcacttcatctcctaagcctgtttcttgggctggagtaggtgcctcacactgctgtgttggggaatgaatgagatcgtgcatataaagagcagcatccagcacctgcctggcagggagccayctagttgtacctatttatttgtccaacacccttgtcctgggttccccttattccagcctagaagccttggttctcttattgctgacagagctttagggatggcaagagtcccccttggttttaacactgtcttcctagtacagccccagtcctccctggtctgaatcaagaggtcagcctatccaccaatcccctggttcctgagcccacctgagcctcattgccacactggggagccttggagcccacgctggccctgccagccacacgtggccggcttagggcctgccccctgcccta

SEQ ID NO: 85673 - DNA, 601 bp, Human
tgttcacattcaacatattcctgtttcttaggagttgttttgttcaatggaaagagtagacccttctgctctggacactggcgtctgtccagaacatgcaggagagctcagtgggagcctttggacttggctttggatagctgggctcagtttaccatttctctcagcccaccgtaccttgctcctcctgttcccacttcatcctcagctgctgatggctggtcacacctaaggctgagcccacacctgatcaaacctccttgcagtacaggtgccccccgtagagtccgttccaacaacmaaacacttcttcctctgttttctttctctgatttttcccgagctttgattctaaaaccggaactttccttagtcatgttttttagtatctgtcatggttgtcttccactcctaaaatctgaacttgcaaatcttatcagaattttacatttcctacaagagggccccatgggagtctccttccctcccaagtggcaacaagtggctcctgctggaggacctgctatccccaccctccctcccctctcccctccttcagagtcataccctgtcctttgagacctatggcaggtacctgact

SEQ ID NO: 85674 - DNA, 601 bp, Human
gtcatgttttttagtatctgtcatggttgtcttccactcctaaaatctgaacttgcaaatcttatcagaattttacatttcctacaagagggccccatgggagtctccttccctcccaagtggcaacaagtggctcctgctggaggacctgctatccccaccctccctcccctctcccctccttcagagtcataccctgtcctttgagacctatggcaggtacctgacttcaacaatgctagtcctgctactgcgtcgccagtcagacctaagctcttcctgactttgactgccacaggcrtcctcatacatcagttaccgaccctggccttcagacttttcttcttgtgtatccccaaaagaagtttgaagaaattatgcacctgctctaaacatttgagtttgatatcgaaaactttcatcacatgtttatgtaagtgtatttgttaataagagatagacagtatgaaatactttctaagacaaaatgaggattggtgtaattaagataaatattttatgatatgtggtgttttttaactgccttacagattcaagcataccaaacctgaaagaaaactcatgaaactttcacttacgg

SEQ ID NO: 85675 - DNA, 601 bp, Human
agcactttgggaagctgaggcgggcagatcatttcaggtcaggagctggagaccagcctggccaacacagcaaaaccccatctctactataaacacaaaagctagctgggcgtggtagcgcacgcctgtagtcccagctactctggaggttgagccaggagaatcacttgaacccagaagccagaggttacagtgacccatgatcgcgccaccgcactccagcctgggtgacagagagagactctgtctcataaaaaataaataaataaataaatagtaataaatattaccaacctctackgcttcaagggttctgagttcagaacatcttaacataagccaaaatgctaagttttactcctcacagaattgtttcagacagggaagtgagtttctggagccagaattccagcccaaacctgtaggtttttacacctgggcagtgccccatggtcatatttgagataggtggtttttcaagtgtatgaaagactattgtgaggctggacacagtggctcatccctgcaatcccagcactttgagatgatgaggcaggcagattgcttgaatctaggagttacaaaccagcccgggcaacat

SEQ ID NO: 85676 - DNA, 601 bp, Human
cagagagagactctgtctcataaaaaataaataaataaataaatagtaataaatattaccaacctctactgcttcaagggttctgagttcagaacatcttaacataagccaaaatgctaagttttactcctcacagaattgtttcagacagggaagtgagtttctggagccagaattccagcccaaacctgtaggtttttacacctgggcagtgccccatggtcatatttgagataggtggtttttcaagtgtatgaaagactattgtgaggctggacacagtggctcatccctgcaatcycagcactttgagatgatgaggcaggcagattgcttgaatctaggagttacaaaccagcccgggcaacatagtgagaccctatctctaccaaaagtacaaaaattagctgggcatagtgcctgtggtccaagctactcaggaggctgaggtgggaggatcacttgaatcaaggaggtcaaggctacagtgagccgtgatcataccactgcactccagcctgggcgacagagctagactctgtctcaaaaaaaagaaagaaagagagacagacagagacagacagagagagagaaaagaaga

SEQ ID NO: 85677 - DNA, 601 bp, Human
actggtctcaaactcctgggctcaagcaatcctcccatctctgcctctgagtagctggaattacatcagttgaggtttaagtgtcccaggatgtttgccttactgtactttacatgagagtgtgggctgttcttatcttatctctaccttagaaaatttcaagcttctggatggtggagaccatgtatgtattactcacctttacatctctactatacctcacagaatgcctggcatttaacactaggctgagtgcttaactgctgcacgcaggggtggccactcatacccactggggccrggacagtggtataaacgaacaaagcaagttaggcatgaggccacgttaggaaaatgtgcatggaaaacacactggcagcacaactcactttaaacatcatgaagaaacagggagcctccacttgggtcttggaaaagtgacctgaggaagtgacttttggactgctcagctgaaaccagcaaggagatgtgcaggctttaagtgacgcatcagcagaggggggtcttgcgggaggacgctgggaaggagcgtgagggagatagatggtcagggaggggcaggtgccctgacacagtccag

SEQ ID NO: 85678 - DNA, 601 bp, Human
tagggaacggattcaggggaggccccatgtgggtttggggtgttgtattcatccacttggtaaataggtgagttgtcatggtggctggggtttggagggggacagaaatggagtggaggaaacagggtgtgctgtgctcttgaagtagtcctaccgggtaagcacagacgcttgggggctggctgtgcttgtgaagctgaatttgattctgtatcagtgggaggcccttggattggagtagttaaaggagggaagtgacctgagatcatgtaccctagaacttaaagtataatttaaaaawatatatatatatatggaaaaaaattaaaaaaaatgaaaacctagaaagatacaaggttctatgtcattacattaaaattgtaatgcttaaaaaaaaaaaaacacctttaaagaggtggtttcagtgtggttaatatgggttctctcctgttttcttcttgccgggattgtgaggactgtgtggtacacacctgtctggtagagcccttctgagttgcttccgatgttcaaatgaggcggtatgatgtaatgcagtcagacttctggttcaaaactcagccctatagctcactagctgtgt

SEQ ID NO: 85679 - DNA, 601 bp, Human
gggaacggattcaggggaggccccatgtgggtttggggtgttgtattcatccacttggtaaataggtgagttgtcatggtggctggggtttggagggggacagaaatggagtggaggaaacagggtgtgctgtgctcttgaagtagtcctaccgggtaagcacagacgcttgggggctggctgtgcttgtgaagctgaatttgattctgtatcagtgggaggcccttggattggagtagttaaaggagggaagtgacctgagatcatgtaccctagaacttaaagtataatttaaaaaaawatatatatatatggaaaaaaattaaaaaaaatgaaaacctagaaagatacaaggttctatgtcattacattaaaattgtaatgcttaaaaaaaaaaaaacacctttaaagaggtggtttcagtgtggttaatatgggttctctcctgttttcttcttgccgggattgtgaggactgtgtggtacacacctgtctggtagagcccttctgagttgcttccgatgttcaaatgaggcggtatgatgtaatgcagtcagacttctggttcaaaactcagccctatagctcactagctgtgtga

SEQ ID NO: 85680 - DNA, 601 bp, Human
tacttcaaacaggacctgggaaacagtaagtgtttaagggacattaggtattattctgtttatgatggaatgccaatttgtacttatattatctttctttacttcaaaaaactcgaaaatgccactgtgagcttaagggaccttgacttctcagcagctctagttaatgtagaaaacatagtgtatagaaattcaaatgtgaaaagcaggggtacaagtcatcaaggtttgaaaatgatcatttttatagatgtaggggtacaagtgcagttgtgttacgtggatatattgcttagtggtraagtgtgggcttctagggcacccatcacctgaatattatacattgttgaaacgatgatttttgatatctctcacttcccatgaactagagaactcatcttatacaataaagcccatccttgaatgtctttcattaatgcttttcattgcttgttaaaggttaatgttttttattgaaaaaaaaaaacgttccgcccccttttttttccctttggggcttggtggtggcaggaatggccccctgcacctttccttctcagtagaggtctctgtgtgcctgccagctggaggagacggaatg

SEQ ID NO: 85681 - DNA, 601 bp, Human
cccacagggggacaactgctgagattaaccgtgttgcctattgtgcaaacatctgtaaacgcaccaccacagcaattgcagtggctccccgccagccagaaactgcggaaatcaaatgccctgtcttgcaaacacatctgttcacaccttgagagagggaggcttttcagagctccttgctctgaaaaatcttgggagtttgtttgtttgtccactctgtgagcaatccacagtgatcttgggagtcagaggtcaaaggcaaaggcttactgacctcccatgctgttccccctgtctttargtccttcaagggcatgggtgctaagaggagcctccctgtgtaccaggctcacatctttggacttgtgatgttggctcatgatggtcgtggtcactcagaccccaccaccaggagctgctgaatccaaatggagtagctcttggtgacagtaaagtccacccctcccctggcctggtagggtatgttctgattttgccaggagacaggtagctgagtaatacttgagatcttgggaaatgatttgaaatatgtggaagagaaaagaaaaaacaggattgatacattctgcattaaaaacct

SEQ ID NO: 85682 - DNA, 601 bp, Human
tgaatgaacatttggaaaaatgcctggaatcatcagccacgaatcaccagtgcccacccctgagcaattttactgtagagccaccacagtgaccaggccagggagggagccatgcgtgtggcagaaggaacggccgccaagtgttggctgcacagcgccccgcgcctgcaggagagcggagacaggagaaagcgaggccagctgcactgcagggagatgtctctgcctgtactttttttttctttctgggatctatttagaataatctttgtgttcaatttcatttttagattttaacacygaattctttttgttcttctggatccacatatctaattttagcattgaaaagaatttcacctagtttatttttgtatcctaatctttttttagcgtaggtcaatggataagaaaatcacaaaaactaagtgtatattatcagccaagtgagctgctagtgcttataaacaccctttattttaaagacaatgcgaatttcattatgtaaacatgtaaaaacccaggccatcttaactgatgcccagccgcagaggtgaggtggcatggtcatgttcctagatgacatgttatgaatggagtt

SEQ ID NO: 85683 - DNA, 601 bp, Human
aacaggattccatgattcacagagcttgcaggcaaggttagactagtcaggagattcagaacaaacaaatctttggtgtttcacagttacaactccataggagagcacctgatggttatactggaagacgaagccgatgtccttgatgctatagatcaggagagatctgaaaacacacccagacccacctccaccccaacccagttcagtcagagtctcttgggttaggacctgagaatttaaaaaaatctccacagtaattttaataagcagctagagttgagaaccattgcctcccgtrgagaacagtcactgggaagctaggattgtactgtggttacctagggtgatggactgagctaagctgaaagcagagccttgggtggggaaactgagaggagtgatctgtatagtgcttgggagcagtggtttaattccagagctccaaggctgtgctgtgaggacagtgataattatgctccttctgaagaaatccttgcagaagatgtcacctttccatgaattgaaaaggaggaaaggtgctgtgttttcaagcttctccagataatcttagaaatgtaagtcgagaaagggaatcata

SEQ ID NO: 85684 - DNA, 601 bp, Human
ccacagtaattttaataagcagctagagttgagaaccattgcctcccgtggagaacagtcactgggaagctaggattgtactgtggttacctagggtgatggactgagctaagctgaaagcagagccttgggtggggaaactgagaggagtgatctgtatagtgcttgggagcagtggtttaattccagagctccaaggctgtgctgtgaggacagtgataattatgctccttctgaagaaatccttgcagaagatgtcacctttccatgaattgaaaaggaggaaaggtgctgtgttttsaagcttctccagataatcttagaaatgtaagtcgagaaagggaatcatacaaacatcatgtcttaatttgacttagtacctagtatgggtttaacataacactgtcataataatatggtttacacacatgcatacagacttaccatccattcattgattcactgggttcctgctatgtgccaggcatttcctagggcactaagaaaacagcagcaaacgaaaaaggctgagttcccctccgggaggggtcttacaccgagcaatcccagaatgtcggctggcaagaaggggtgagtgagg

SEQ ID NO: 85685 - DNA, 601 bp, Human
ttatgctccttctgaagaaatccttgcagaagatgtcacctttccatgaattgaaaaggaggaaaggtgctgtgttttcaagcttctccagataatcttagaaatgtaagtcgagaaagggaatcatacaaacatcatgtcttaatttgacttagtacctagtatgggtttaacataacactgtcataataatatggtttacacacatgcatacagacttaccatccattcattgattcactgggttcctgctatgtgccaggcatttcctagggcactaagaaaacagcagcaaacgaaraaggctgagttcccctccgggaggggtcttacaccgagcaatcccagaatgtcggctggcaagaaggggtgagtgaggaatatgctggaggcagaatggggcccctagcctagagtgcctatgagaagacccctgttgggccctgacaagggaagtggctttgctcttcctgcaggcacaagctgtccatgatgctgggacctctgattcatccactggagccattgtcatcagaactatttctggaagtttctgagtaggtggcacagccctgtgtacctagtgaagccccccccccct

SEQ ID NO: 85686 - DNA, 601 bp, Human
ttaccatccattcattgattcactgggttcctgctatgtgccaggcatttcctagggcactaagaaaacagcagcaaacgaaaaaggctgagttcccctccgggaggggtcttacaccgagcaatcccagaatgtcggctggcaagaaggggtgagtgaggaatatgctggaggcagaatggggcccctagcctagagtgcctatgagaagacccctgttgggccctgacaagggaagtggctttgctcttcctgcaggcacaagctgtccatgatgctgggacctctgattcatccactrgagccattgtcatcagaactatttctggaagtttctgagtaggtggcacagccctgtgtacctagtgaagccccccccccctttgattcaggggtcacattgggctgtttgcgcaaagaaggactcactgcttctttttccccttgtgaataagtaacaagctgttaagtacacaatgaatgtacctctctgcaagccagaactgtagtgattgatggaatccgatgtttacttgtcccctctgtaaccttagattaaagtcactgaaatcttcagcctctacatcaggagaatggcacg

SEQ ID NO: 85687 - DNA, 601 bp, Human
cagcaaacgaaaaaggctgagttcccctccgggaggggtcttacaccgagcaatcccagaatgtcggctggcaagaaggggtgagtgaggaatatgctggaggcagaatggggcccctagcctagagtgcctatgagaagacccctgttgggccctgacaagggaagtggctttgctcttcctgcaggcacaagctgtccatgatgctgggacctctgattcatccactggagccattgtcatcagaactatttctggaagtttctgagtaggtggcacagccctgtgtacctagtgaagccccccccccctttgattcaggggtcacattgggctgtttgcgcaaagaaggactcactgcttctttttccccttgtgaataagtaacaagctgttaagtacacaatgaatgtacctctctgcaagccagaactgtagtgattgatggaatccgatgtttacttgtcccctctgtaaccttagattaaagtcactgaaatcttcagcctctacatcaggagaatggcacgcacatgccaagggacgtggccaaaatggctggtggagctttgtgggaggcagagtgcatggtcccttcccc

SEQ ID NO: 85688 - DNA, 601 bp, Human
actgaagggccccttgggtgtgtcactattgttcagtgtccaggctgctgcaaaaggacagctattaataaacatcgttaaatgcatcttgttttctttctattgctttgttgtttataaaatgcctgagtatacattaattccaagaatcctcaaaataactttgagaggtgttactgtgatcagtatataaagaaagaagacattgaaactcatagaggctaagtaacttgcccctaatcacacagccagttaaaaggcagaagcaaatctcaaattcaaatatttgagctccagctcyagcaatctgaaatgtcaagatacctagtacaattgggttctggtcctggatgtgcctgaacatttttatgatttcacatatatcatgtgactctccaagcctttgaagttgcatttctctcatttccttgcctttctacatgtcttataaagatttctacgcttacatttataccctcaagtatgcatggacacaaagtcgagtttgggtttttttaaaatctggattaaaagaaattttaaattccaactttctttacctgattctctctgtagcactggccttttgtaatatatattt

SEQ ID NO: 85689 - DNA, 601 bp, Human
ctgaagggccccttgggtgtgtcactattgttcagtgtccaggctgctgcaaaaggacagctattaataaacatcgttaaatgcatcttgttttctttctattgctttgttgtttataaaatgcctgagtatacattaattccaagaatcctcaaaataactttgagaggtgttactgtgatcagtatataaagaaagaagacattgaaactcatagaggctaagtaacttgcccctaatcacacagccagttaaaaggcagaagcaaatctcaaattcaaatatttgagctccagctccrgcaatctgaaatgtcaagatacctagtacaattgggttctggtcctggatgtgcctgaacatttttatgatttcacatatatcatgtgactctccaagcctttgaagttgcatttctctcatttccttgcctttctacatgtcttataaagatttctacgcttacatttataccctcaagtatgcatggacacaaagtcgagtttgggtttttttaaaatctggattaaaagaaattttaaattccaactttctttacctgattctctctgtagcactggccttttgtaatatatatttt

SEQ ID NO: 85690 - DNA, 601 bp, Human
ctacatgtcttataaagatttctacgcttacatttataccctcaagtatgcatggacacaaagtcgagtttgggtttttttaaaatctggattaaaagaaattttaaattccaactttctttacctgattctctctgtagcactggccttttgtaatatatatttttccagccataggaaagagctttttaatgctcagatcccaagagctaaggaagtagatggctatttatgttctgccaggaatctttatgttcagtgagaggaagtgcaactgcttaaaactcttaacttctctctctcactttagaaagtcaagcagaaaaaaaatggattaatttgacagatagcacagaataagaaaaatattagaaacaagaagaggccatttttcctatagaggctcatttcattctatataccacttccctgggatatctgctaattgttagcagaaagagtaatgttatctattttttaaaatttcactcttgagtactatggagataatagctaaatgatggagaaataactttctttcacggtagtagtttaagaagggtaaaaagagctcaaaggcagatgtttgatgacatgagaa

SEQ ID NO: 85691 - DNA, 601 bp, Human
tacgcttacatttataccctcaagtatgcatggacacaaagtcgagtttgggtttttttaaaatctggattaaaagaaattttaaattccaactttctttacctgattctctctgtagcactggccttttgtaatatatatttttccagccataggaaagagctttttaatgctcagatcccaagagctaaggaagtagatggctatttatgttctgccaggaatctttatgttcagtgagaggaagtgcaactgcttaaaactcttaacttctctctctcactttagaaagtcaagcagaaaaaaaatggattaatttgacagatagcacagaataagaaaaatattagaaacaagaagaggccatttttcctatagaggctcatttcattctatataccacttccctgggatatctgctaattgttagcagaaagagtaatgttatctattttttaaaatttcactcttgagtactatggagataatagctaaatgatggagaaataactttctttcacggtagtagtttaagaagggtaaaaagagctcaaaggcagatgtttgatgacatgagaaaattcagcgacaaatgacaaat

SEQ ID NO: 85692 - DNA, 601 bp, Human
tggccttttgtaatatatatttttccagccataggaaagagctttttaatgctcagatcccaagagctaaggaagtagatggctatttatgttctgccaggaatctttatgttcagtgagaggaagtgcaactgcttaaaactcttaacttctctctctcactttagaaagtcaagcagaaaaaaaatggattaatttgacagatagcacagaataagaaaaatattagaaacaagaagaggccatttttcctatagaggctcatttcattctatataccacttccctgggatatctgctrattgttagcagaaagagtaatgttatctattttttaaaatttcactcttgagtactatggagataatagctaaatgatggagaaataactttctttcacggtagtagtttaagaagggtaaaaagagctcaaaggcagatgtttgatgacatgagaaaattcagcgacaaatgacaaatttgatatttctataggtgcagttttagaaagagtatctttttgcattgacactagagacctgtgtccatctgtacaagtgagggaactgcatgtgggtattaatagatgtatttgtaagcc

SEQ ID NO: 85693 - DNA, 601 bp, Human
cccaagagctaaggaagtagatggctatttatgttctgccaggaatctttatgttcagtgagaggaagtgcaactgcttaaaactcttaacttctctctctcactttagaaagtcaagcagaaaaaaaatggattaatttgacagatagcacagaataagaaaaatattagaaacaagaagaggccatttttcctatagaggctcatttcattctatataccacttccctgggatatctgctaattgttagcagaaagagtaatgttatctattttttaaaatttcactcttgagtactayggagataatagctaaatgatggagaaataactttctttcacggtagtagtttaagaagggtaaaaagagctcaaaggcagatgtttgatgacatgagaaaattcagcgacaaatgacaaatttgatatttctataggtgcagttttagaaagagtatctttttgcattgacactagagacctgtgtccatctgtacaagtgagggaactgcatgtgggtattaatagatgtatttgtaagccccggaaattttccagttgaaacttacaacaaaaacaaaaagtttctgttgtgttttgc

SEQ ID NO: 85694 - DNA, 601 bp, Human
gctaaggaagtagatggctatttatgttctgccaggaatctttatgttcagtgagaggaagtgcaactgcttaaaactcttaacttctctctctcactttagaaagtcaagcagaaaaaaaatggattaatttgacagatagcacagaataagaaaaatattagaaacaagaagaggccatttttcctatagaggctcatttcattctatataccacttccctgggatatctgctaattgttagcagaaagagtaatgttatctattttttaaaatttcactcttgagtactatggagataatagctaaatgatggagaaataactttctttcacggtagtagtttaagaagggtaaaaagagctcaaaggcagatgtttgatgacatgagaaaattcagcgacaaatgacaaatttgatatttctataggtgcagttttagaaagagtatctttttgcattgacactagagacctgtgtccatctgtacaagtgagggaactgcatgtgggtattaatagatgtatttgtaagccccggaaattttccagttgaaacttacaacaaaaacaaaaagtttctgttgtgttttgctgcaggg

SEQ ID NO: 85695 - DNA, 601 bp, Human
ctatttatgttctgccaggaatctttatgttcagtgagaggaagtgcaactgcttaaaactcttaacttctctctctcactttagaaagtcaagcagaaaaaaaatggattaatttgacagatagcacagaataagaaaaatattagaaacaagaagaggccatttttcctatagaggctcatttcattctatataccacttccctgggatatctgctaattgttagcagaaagagtaatgttatctattttttaaaatttcactcttgagtactatggagataatagctaaatgatggasaaataactttctttcacggtagtagtttaagaagggtaaaaagagctcaaaggcagatgtttgatgacatgagaaaattcagcgacaaatgacaaatttgatatttctataggtgcagttttagaaagagtatctttttgcattgacactagagacctgtgtccatctgtacaagtgagggaactgcatgtgggtattaatagatgtatttgtaagccccggaaattttccagttgaaacttacaacaaaaacaaaaagtttctgttgtgttttgctgcagggccaatgcaggaaaccat

SEQ ID NO: 85696 - DNA, 601 bp, Human
taccacttccctgggatatctgctaattgttagcagaaagagtaatgttatctattttttaaaatttcactcttgagtactatggagataatagctaaatgatggagaaataactttctttcacggtagtagtttaagaagggtaaaaagagctcaaaggcagatgtttgatgacatgagaaaattcagcgacaaatgacaaatttgatatttctataggtgcagttttagaaagagtatctttttgcattgacactagagacctgtgtccatctgtacaagtgagggaactgcatgtggrtattaatagatgtatttgtaagccccggaaattttccagttgaaacttacaacaaaaacaaaaagtttctgttgtgttttgctgcagggccaatgcaggaaaccatctatgacttctggaggatggtgtggcacgaaaacactgcaagtatcatcatggtgaccaatcttgtggaagtgggaagggtgagtggaccgtctgctgcaaatggccattttgttccttgcttagttggtaacagaaagtaaggcatgaggcaagcttttgaactattatgtgtactccccaaaacattaacta

SEQ ID NO: 85697 - DNA, 601 bp, Human
gacaaatttgatatttctataggtgcagttttagaaagagtatctttttgcattgacactagagacctgtgtccatctgtacaagtgagggaactgcatgtgggtattaatagatgtatttgtaagccccggaaattttccagttgaaacttacaacaaaaacaaaaagtttctgttgtgttttgctgcagggccaatgcaggaaaccatctatgacttctggaggatggtgtggcacgaaaacactgcaagtatcatcatggtgaccaatcttgtggaagtgggaagggtgagtggaccrtctgctgcaaatggccattttgttccttgcttagttggtaacagaaagtaaggcatgaggcaagcttttgaactattatgtgtactccccaaaacattaactactccagctcctcctattgcttgctgcacttgcttataaattatcagtaaacatagcctgaattgctttcatttgttgcgatagcaacagacaggaaaggcactcaagatttaaaagcagttgttatcgggccatattgagagcacaaaaatacctctaagcatgaatgctgattgttgagtgtcaaaactcaatggg

SEQ ID NO: 85698 - DNA, 601 bp, Human
cacgaaaacactgcaagtatcatcatggtgaccaatcttgtggaagtgggaagggtgagtggaccgtctgctgcaaatggccattttgttccttgcttagttggtaacagaaagtaaggcatgaggcaagcttttgaactattatgtgtactccccaaaacattaactactccagctcctcctattgcttgctgcacttgcttataaattatcagtaaacatagcctgaattgctttcatttgttgcgatagcaacagacaggaaaggcactcaagatttaaaagcagttgttatcgggcyatattgagagcacaaaaatacctctaagcatgaatgctgattgttgagtgtcaaaactcaatgggtgctgcattagacatgactaccttcccaaactcaagaaaattggctctaaaaacagtgtgcagctctagattcaatccttagattagaattccagcatcttctcttgcttaaattggcctttcctgtgtctcagtttccaaacctgtggaatggaaagcatcatctttctgaaggtcttgtactaccttctccgtagtaactgtttatgagcagtgcttttatttaaccaggaaa

SEQ ID NO: 85699 - DNA, 601 bp, Human
ctgattgttgagtgtcaaaactcaatgggtgctgcattagacatgactaccttcccaaactcaagaaaattggctctaaaaacagtgtgcagctctagattcaatccttagattagaattccagcatcttctcttgcttaaattggcctttcctgtgtctcagtttccaaacctgtggaatggaaagcatcatctttctgaaggtcttgtactaccttctccgtagtaactgtttatgagcagtgcttttatttaaccaggaaacttttacatagttgtaatctcagtagtagtatgctayaggattatttccaaagtgaaattttaaaatgagcaaacacacagcgtgcagttgccttttttacagtaggttgaattccatggttgtgctaactgaagagaagttggcatcatgagatttgccctcagcaaaggcagcctagaggttatcctagaattgaaacagtgagacaggagccataaaggggttgtctcttaagattctcaggtttcaggaggcacaaaccaggaagaagaaagacatcacaattctctcataatgagaatattcagtaagtaggatatatatatatatacatac

SEQ ID NO: 85700 - DNA, 601 bp, Human
cagcaccagtctttgtgatcttggatcccgggttttaaagcccactgagggcaggaaataatgtggacacgtacaatgctaagaatttagatgttgactgccacacagaaccaaaacccacaaacagtagaccctcagagaaagggcaaactggggaagtggaggtagggagagggaggagggagaagggagaggagcaccagccagcccagggaattggcaaggaagttacaccattttcacttaggtaggatctgtgggggtaaagcacttcggccaactccagggtcaaagtaaacasctaataaaatcagaaaataattagaactgtgaatcataaagtatcatgatagtgttaaagttgtcacatgcaaataacatggtaccagagaaggaaatacatgtttttaaatgttgttattagaaaagaagaaataccaactaagcatctaattcaagaagacagatgaagaacagagcaaaaccaaagaaagaaaaaaaggaaataataaacatgaatagaaatgtattaactaaacagcacagaagcaataacaaagtgcaacaaaataaaaagctggttttgtgaaaaggttaataa

SEQ ID NO: 85701 - DNA, 601 bp, Human
agttacaccattttcacttaggtaggatctgtgggggtaaagcacttcggccaactccagggtcaaagtaaacacctaataaaatcagaaaataattagaactgtgaatcataaagtatcatgatagtgttaaagttgtcacatgcaaataacatggtaccagagaaggaaatacatgtttttaaatgttgttattagaaaagaagaaataccaactaagcatctaattcaagaagacagatgaagaacagagcaaaaccaaagaaagaaaaaaaggaaataataaacatgaatagaaatktattaactaaacagcacagaagcaataacaaagtgcaacaaaataaaaagctggttttgtgaaaaggttaataacatggacctctggcaacagatcagaaataaatagagaaaaaccacatatagccaatagcagattttttttgtactgcaatagaataatatgaataacaatatatttgatgaattaggtaattttctagaaaaatatgactttccaaaactgactcaaaaagaaacagaaattctgagtagataataattatcttaaactcgaattctggttaaaaattgacgcatg

SEQ ID NO: 85702 - DNA, 601 bp, Human
gtataacctcaatatcaaaaccagacaagactacagtaaaaggtaaaattataggtgccacacatagataggaagagatgaatagaccagtaggtccaagcaggccagatgtaagacaccaaaagcccaacatattaaggaataggataggaaaatgtatgatagtaagatttacgtaaaattatctgtattacaaagggtataataagtgaccagacaaggggggaggtactatggggctattatgcaaagtttaaacacttccagagcaatattttatatactaaaagtatagaaaccrtttctttctttcaatgatgtctctgccgggagccagcatgggagtgcaggtgagctggtgaggaggctactgaggcagggaggaccaccagcccgacctagaagagggtgctgggcctctccttccacagacctttctctggaaagaggaaactagcagtactgtgtgtccacctggttgggctgccataaccaaatgccacaagccaggaggcttacacaacagacatgtactatcttcctgttctggaggctggaaagtcccaatccgggtctggcaggattccgcttctggtgcagg

SEQ ID NO: 85703 - DNA, 601 bp, Human
aaagtatagaaaccatttctttctttcaatgatgtctctgccgggagccagcatgggagtgcaggtgagctggtgaggaggctactgaggcagggaggaccaccagcccgacctagaagagggtgctgggcctctccttccacagacctttctctggaaagaggaaactagcagtactgtgtgtccacctggttgggctgccataaccaaatgccacaagccaggaggcttacacaacagacatgtactatcttcctgttctggaggctggaaagtcccaatccgggtctggcaggattcygcttctggtgcaggccctcctcctggctttcatgtggccaccttcttgcggcaacctcacgtgtcagagagagcgcacgctctgtggtgtctcttcttacaaggacacgaatcctattgggtgagggccccaccttaatgacctcatttaaccatcattatctccttggaggcctatctccaaatacagtcacacttggggtttagggcttcaccatttgagttttgggggtacacaaatattcagtccataacagcctgcttaatggggttctcgtaaagattcagtgagtttccacat

SEQ ID NO: 85704 - DNA, 601 bp, Human
atcaaaatgacatggtttttaagggcaatagctacctacttaacatgtgtaccgcacatagtgcgtccttcatgcattaagcatgagctaggcggatgcgtgtttgtttacacagacttgctgccgattcattaaggcagagctggggacctgcttccccccattttgccctgaagcgctctgcattaggcggccctaattgctggtgttggagccgccaggagacctttcctgtcgcagcacctggtgcagaagacacagatgctgcacttccctccagcggggtccccggtacatctgmcaggacctgtcattatctaagacttccttgtcaccaccatgcctccccttttagcccacgtgttctgggaagagacccttgtcggttttcctggcacctgccaccggctgcacacctggcattgaaatggcgctggaacgtgttgtgattattttccctctttaatgaacccacctgagggacatttagtttcttaatccagtcgcctgtttcccaggcattcccatttacaccgtttgtgtggagattcaaaaactctgttgtggtattgagctgttccatctgccagaagtcttataa

SEQ ID NO: 85705 - DNA, 601 bp, Human
gagctaggcggatgcgtgtttgtttacacagacttgctgccgattcattaaggcagagctggggacctgcttccccccattttgccctgaagcgctctgcattaggcggccctaattgctggtgttggagccgccaggagacctttcctgtcgcagcacctggtgcagaagacacagatgctgcacttccctccagcggggtccccggtacatctgccaggacctgtcattatctaagacttccttgtcaccaccatgcctccccttttagcccacgtgttctgggaagagacccttgtcrgttttcctggcacctgccaccggctgcacacctggcattgaaatggcgctggaacgtgttgtgattattttccctctttaatgaacccacctgagggacatttagtttcttaatccagtcgcctgtttcccaggcattcccatttacaccgtttgtgtggagattcaaaaactctgttgtggtattgagctgttccatctgccagaagtcttataaccaaatctgcaggactcccaaaggagactttttacaccggtaatttaagctaattatttctaaacatatttagtcagttttatg

SEQ ID NO: 85706 - DNA, 601 bp, Human
ctgcatacagactgtctttgtgtcccatagctgaccttttgatgtaaagagccaaatgccattttcttttcatggtaaaaaccccaccccaaagtgaacatgggatgtatggtacatgtatgtttacctattgcacatgtgctcagctccccttataaatatgtatagctttccccccaaacctgctgatatgtatgactctgttgtgtgatacagacctggtgaggcataaaagccaacctgtccttctttctgaagagagagcaccttcagtccatgctggagactcttcccagcttgyaaaccgataacccccataaagctctcctttctactgtccagccatcctggtggtcttttagacaacaccatcttctatccattccatgtgtcagtgctgcattaatttttataaacattggctcctgacacaccactcatctgttcagaatccttcagtgattcctgtcgaatccagaacaaagcccaaacctcaagatccctctattctgtgccttcacagtgtggctctagtctacggcaagcttatttcccagcattctcttacaagtgtttgaagtgccaggcagacaaagtattt

SEQ ID NO: 85707 - DNA, 601 bp, Human
aactagaattgctgtaactttaacacaaaactagaagtcaaagaggagattggcagtgtggcctgtgatgattcccatccagacactgccaggcttcacgccactacccccagcacatcagccaagaaaggaggcactaacgaatactgagctatcagcagcaggagaaaggccttctacagactcctcaacaccagctcctccaggaaagatggttccctggctgccctggtgaacctggaggttttctctgcctgaaaacctcagttcccctctgtaaaaagttcaaccaaagagctcratttgtcatgttcacaaattagcccaaagataggctttttaatcccttctcagcacaatttaacccaacatttagtgctgtacttactgtatctatgacactaataatccaaagatagttataattcacttgtcctcaaagaatatcacctgtggtcattgagaaccgtatatcaacaatgaactgtgatacatgttcagaatgtgatagtaccaacaaagggactcattctgcctgtggcaatctaggtcttctcggagcacgtggtaaagagctggaccttagtaggaggaaggattt

SEQ ID NO: 85708 - DNA, 601 bp, Human
agaatatcacctgtggtcattgagaaccgtatatcaacaatgaactgtgatacatgttcagaatgtgatagtaccaacaaagggactcattctgcctgtggcaatctaggtcttctcggagcacgtggtaaagagctggaccttagtaggaggaaggattttattttgtctttattttagatttagggggcacatgggcaggtttgttaaatgggtatatttagtggtgctgaggttagggcttctaatgatcccatcaaccaaacagtgaacatagtccccagtaggtagtttttaaacmcttgccctccttcctctctcctcccttttatattccccagtgtttattcccatctttgtgccgtgtatacccaacgtttagctcccacttacaagtgagaacatagtatatttggttttgtttctgagttaattcacttaggataatggcctccagctgtacccatgttgtaccaaaggacatgatttcattcttttttttttctttttttttttttggtttgttttttttttgttttgtttgtttgtttgttttgttttttgagatggagtctcactctgtcacccaggctggagtgca

SEQ ID NO: 85709 - DNA, 601 bp, Human
tatcaacaatgaactgtgatacatgttcagaatgtgatagtaccaacaaagggactcattctgcctgtggcaatctaggtcttctcggagcacgtggtaaagagctggaccttagtaggaggaaggattttattttgtctttattttagatttagggggcacatgggcaggtttgttaaatgggtatatttagtggtgctgaggttagggcttctaatgatcccatcaaccaaacagtgaacatagtccccagtaggtagtttttaaacccttgccctccttcctctctcctcccttttayattccccagtgtttattcccatctttgtgccgtgtatacccaacgtttagctcccacttacaagtgagaacatagtatatttggttttgtttctgagttaattcacttaggataatggcctccagctgtacccatgttgtaccaaaggacatgatttcattcttttttttttctttttttttttttggtttgttttttttttgttttgtttgtttgtttgttttgttttttgagatggagtctcactctgtcacccaggctggagtgcagtggcacgatcttggctcactgcaacctccg

SEQ ID NO: 85710 - DNA, 601 bp, Human
cggagcacgtggtaaagagctggaccttagtaggaggaaggattttattttgtctttattttagatttagggggcacatgggcaggtttgttaaatgggtatatttagtggtgctgaggttagggcttctaatgatcccatcaaccaaacagtgaacatagtccccagtaggtagtttttaaacccttgccctccttcctctctcctcccttttatattccccagtgtttattcccatctttgtgccgtgtatacccaacgtttagctcccacttacaagtgagaacatagtatatttggttttgtttctgagttaattcacttaggataatggcctccagctgtacccatgttgtaccaaaggacatgatttcattcttttttttttctttttttttttttggtttgttttttttttgttttgtttgtttgtttgttttgttttttgagatggagtctcactctgtcacccaggctggagtgcagtggcacgatcttggctcactgcaacctccgcctcctgggttcaagcaattctctgcctcagcctcccaagtagctgggattacaggcacccaccactacgcctggctaacttttt

SEQ ID NO: 85711 - DNA, 601 bp, Human
aggtttgttaaatgggtatatttagtggtgctgaggttagggcttctaatgatcccatcaaccaaacagtgaacatagtccccagtaggtagtttttaaacccttgccctccttcctctctcctcccttttatattccccagtgtttattcccatctttgtgccgtgtatacccaacgtttagctcccacttacaagtgagaacatagtatatttggttttgtttctgagttaattcacttaggataatggcctccagctgtacccatgttgtaccaaaggacatgatttcattctttttyttttctttttttttttttggtttgttttttttttgttttgtttgtttgtttgttttgttttttgagatggagtctcactctgtcacccaggctggagtgcagtggcacgatcttggctcactgcaacctccgcctcctgggttcaagcaattctctgcctcagcctcccaagtagctgggattacaggcacccaccactacgcctggctaactttttgtatttttaatagagatggggtttcaccatcttggccaggctggtcttgaactcctgaccttgtgatccacctgccttggcct

SEQ ID NO: 85712 - DNA, 601 bp, Human
gtggtgctgaggttagggcttctaatgatcccatcaaccaaacagtgaacatagtccccagtaggtagtttttaaacccttgccctccttcctctctcctcccttttatattccccagtgtttattcccatctttgtgccgtgtatacccaacgtttagctcccacttacaagtgagaacatagtatatttggttttgtttctgagttaattcacttaggataatggcctccagctgtacccatgttgtaccaaaggacatgatttcattcttttttttttctttttttttttttggtttgttttttttttgttttgtttgtttgtttgttttgttttttgagatggagtctcactctgtcacccaggctggagtgcagtggcacgatcttggctcactgcaacctccgcctcctgggttcaagcaattctctgcctcagcctcccaagtagctgggattacaggcacccaccactacgcctggctaactttttgtatttttaatagagatggggtttcaccatcttggccaggctggtcttgaactcctgaccttgtgatccacctgccttggcctcccaaagtgctgggattacaggtg

SEQ ID NO: 85713 - DNA, 601 bp, Human
aggttagggcttctaatgatcccatcaaccaaacagtgaacatagtccccagtaggtagtttttaaacccttgccctccttcctctctcctcccttttatattccccagtgtttattcccatctttgtgccgtgtatacccaacgtttagctcccacttacaagtgagaacatagtatatttggttttgtttctgagttaattcacttaggataatggcctccagctgtacccatgttgtaccaaaggacatgatttcattcttttttttttctttttttttttttggtttgttttttttgtgttttgtttgtttgtttgttttgttttttgagatggagtctcactctgtcacccaggctggagtgcagtggcacgatcttggctcactgcaacctccgcctcctgggttcaagcaattctctgcctcagcctcccaagtagctgggattacaggcacccaccactacgcctggctaactttttgtatttttaatagagatggggtttcaccatcttggccaggctggtcttgaactcctgaccttgtgatccacctgccttggcctcccaaagtgctgggattacaggtgtgagccacc

SEQ ID NO: 85714 - DNA, 601 bp, Human
gttagggcttctaatgatcccatcaaccaaacagtgaacatagtccccagtaggtagtttttaaacccttgccctccttcctctctcctcccttttatattccccagtgtttattcccatctttgtgccgtgtatacccaacgtttagctcccacttacaagtgagaacatagtatatttggttttgtttctgagttaattcacttaggataatggcctccagctgtacccatgttgtaccaaaggacatgatttcattcttttttttttctttttttttttttggtttgttttttttttgttttgtttgtttgtttgttttgttttttgagatggagtctcactctgtcacccaggctggagtgcagtggcacgatcttggctcactgcaacctccgcctcctgggttcaagcaattctctgcctcagcctcccaagtagctgggattacaggcacccaccactacgcctggctaactttttgtatttttaatagagatggggtttcaccatcttggccaggctggtcttgaactcctgaccttgtgatccacctgccttggcctcccaaagtgctgggattacaggtgtgagccacccc

SEQ ID NO: 85715 - DNA, 601 bp, Human
ggcttctaatgatcccatcaaccaaacagtgaacatagtccccagtaggtagtttttaaacccttgccctccttcctctctcctcccttttatattccccagtgtttattcccatctttgtgccgtgtatacccaacgtttagctcccacttacaagtgagaacatagtatatttggttttgtttctgagttaattcacttaggataatggcctccagctgtacccatgttgtaccaaaggacatgatttcattcttttttttttctttttttttttttggtttgttttttttttgttttgtttgtttgtttgttttgttttttgagatggagtctcactctgtcacccaggctggagtgcagtggcacgatcttggctcactgcaacctccgcctcctgggttcaagcaattctctgcctcagcctcccaagtagctgggattacaggcacccaccactacgcctggctaactttttgtatttttaatagagatggggtttcaccatcttggccaggctggtcttgaactcctgaccttgtgatccacctgccttggcctcccaaagtgctgggattacaggtgtgagccaccccacccg

SEQ ID NO: 85716 - DNA, 601 bp, Human
tgtgtgtgtttgtttgttcactttaatggaaggcattgaggtagtgaatcgtgttctaattggtattgaaaaacaatcttggtgaccattaagaaaaggctgagaaaggctatggaagagtatggagacacgtttaggaggttagagcaaggctctaggtgaaagatgatgtgggcttgagtttgggcagaggtgttgggagcttatgaggagtatacagtttgggtgttatggtgggtaggtggtgctgataaggaaggaggagaacttgagaatgaaccagggtttctaccactgtgayttgggttgctataaaggatattaaccaagaatgggtatctctttccagcccacccccacacccccaaataaaagtaggtgtaaggagaggcaatgtgtttcatcttggacatgctgagtttaagaagctgaatgagcaataatgtggtgctttccaggaagctcaagagagagatgtgagctgaagacacagaaacaaactatgaaatattagcgtccccctttattcacaagcatctactgtgtgttaggctttggctgcactgaggatatcaagatgaaaagacatggcacaaactat

SEQ ID NO: 85717 - DNA, 601 bp, Human
ctttgggaggccgaggcaggtggactgcctgaggtcaggagtttgagtccagcctggccaacatggtgaaaccccatctctactaaaaccacaaaaaattagctgggcgtggtggcgggtgcctgtaatcccagctacttgggaggctgaggcaggagaatcgctcgaacccaggaggcggaggttgcagtgagcctagatcgcaccattgcactccagcctgggtgacagagtgagattccgtcttaaaaaaaaaaaaaaagtgtaatgcaaagtgataaccactgcaacagaacagagytcttgggagaaagtggaaagagaaaagaggaggactcacaacagaacactggagaatatctgtttctgggggcagtcgggaggaacagctgggatggagtctggaaaaggaaagcaagaggaatagggcgagaacaaagagacccagatcatgagaacgaagagaagacagcatttcaacaggaaggggatagcgaccaggtcacgagctacagaaaggccaggtaaacaggaatcagagagcaaggtagagagaaagaatgtactgagtcaggcatcctgctaaatgtttcacaagccc

SEQ ID NO: 85718 - DNA, 601 bp, Human
aatcgctcgaacccaggaggcggaggttgcagtgagcctagatcgcaccattgcactccagcctgggtgacagagtgagattccgtcttaaaaaaaaaaaaaaagtgtaatgcaaagtgataaccactgcaacagaacagagttcttgggagaaagtggaaagagaaaagaggaggactcacaacagaacactggagaatatctgtttctgggggcagtcgggaggaacagctgggatggagtctggaaaaggaaagcaagaggaatagggcgagaacaaagagacccagatcatgagaaygaagagaagacagcatttcaacaggaaggggatagcgaccaggtcacgagctacagaaaggccaggtaaacaggaatcagagagcaaggtagagagaaagaatgtactgagtcaggcatcctgctaaatgtttcacaagccctattgctcttatcacagctaccctgagtacatttaaagattcctatttttaaactaagtaagtaaggcttggtgtggttaaataatttggccaagggcatagagctagaattgaaactttggtctgtccagttccaaagcccatgctctctccccatt

SEQ ID NO: 85719 - DNA, 601 bp, Human
ctttggtacgtaccaagttcccatgggatgatagaaccaggaatccagcagcagtagaacagtggctaagtgtgcagcaaagatgcaaatgtagcttgttcttggagcagcgagtcacaggagagagatgaagcagcacctagaagggaacagggtctagacagtgattataatggttgggagtgtgtttttagtgatagagtagacataagagtaactgggagtctgaaaagaagatgtaattgccttctcaaactaaaggtacaagaaaaggggaaaagtgacagaggaaaatcacagmcaagacagaaggggatgccttcagttcataagcatatgctgcattcacaccactcaatgtgcagtcacagaaagccagggatgctaagacaaattaagtgtgtccctgtacacagggagggggcatcaagcaaagggatgaaattccgtgataaaggtttcacagcatgctgtggaagttcatgaaagaggcacctcatctagctgtggagttgagtggaggttgaagggatttgtcaataaatgcatctcagaacaaggggtgcctggtgctgagtacaggaggtgggagagcaaatga

SEQ ID NO: 85720 - DNA, 601 bp, Human
tcacagcatgctgtggaagttcatgaaagaggcacctcatctagctgtggagttgagtggaggttgaagggatttgtcaataaatgcatctcagaacaaggggtgcctggtgctgagtacaggaggtgggagagcaaatgaaaattaattggcaaaggagggagggaaggtgttccaggcagaggcaaccacaggaccctggagggaagctgcagggattcagtatgaaccaggggagatagggaatggggattctagggagaactgaggccttgtcatggatataccacgtcaggaattkggcttcagctcatgaatgacagagagccccaaaggatttgggtgtggaagtgacaaggggaaagggccacactggagatactgcagagacagagtggatcatccaaaggcagaacaatcagcatctgacttaacaaggaaaaggttactggcaaccttttgcctcagtgttttcagactgatggcctatctgagttctttgattacatgcaacagaaatcaactctggctaatttcaggaaaagggaaaagaatattataagctcaaaatgttgatgtgaagagtaaggcttacaaaaga

SEQ ID NO: 85721 - DNA, 601 bp, Human
cctctcctggtaacagtggttttcccagtgtagtaaggaacaaggccatgggctgagaagctggacgaaaagggaagtagctattttagggatgcatcaaggacataggtaaaggtgttcgcctggaatgggagtgacctcttctctggggagaaggtaaggatgggcagatataagtgagactccagttggcggctacaggatgcaggtaggtggaatcccaggacagccaatagcccaaatcctccaggtactagtggcaggggaatgtgactccaaggagaatagggtgttgtgagcrtttctaggtgaactgaaaaccaacccattcttaccccacaccttactttttgcaaccttggaatgaagggaattatccatatgaactctaaaattccatgtttatatgagagatattttcctgtttgctgtttacattttggtgacgggatccatttgaataacaaaagcatctgcactccagatccagtttaatccacatgcttccagagtccttgatgcttcctgtacactctgaataccaccaacagcagaaaacgattgagtgtggattgttaaaggggaaagattcaggacaaaa

SEQ ID NO: 85722 - DNA, 601 bp, Human
agagatattttcctgtttgctgtttacattttggtgacgggatccatttgaataacaaaagcatctgcactccagatccagtttaatccacatgcttccagagtccttgatgcttcctgtacactctgaataccaccaacagcagaaaacgattgagtgtggattgttaaaggggaaagattcaggacaaaaacatgaggactgtcactcccttgggagagagccctccgctcccatgtcctctgcactgttttcacatgaattgtgtagaggatctggaatggaatgttgccatgtgatyaggtaccagtgagacaaattctgtcagtgatccttctgtattttaatttatgcagaccataaaagatattcagtctgttctctaatttatagaccttcttttgaaaataatctaatctgactacagtaaactaagatttttgaagaaatatatccttttcagaagttctcaaaattacttaaagctatccccccaatttgtcaactgccacaatcagtcgcacccggtgagcacatttccgtgtctttacctagtgatcagcagggccgcagcgggttcctgcctgcagtagggaggggg

SEQ ID NO: 85723 - DNA, 601 bp, Human
actgtcactcccttgggagagagccctccgctcccatgtcctctgcactgttttcacatgaattgtgtagaggatctggaatggaatgttgccatgtgattaggtaccagtgagacaaattctgtcagtgatccttctgtattttaatttatgcagaccataaaagatattcagtctgttctctaatttatagaccttcttttgaaaataatctaatctgactacagtaaactaagatttttgaagaaatatatccttttcagaagttctcaaaattacttaaagctatccccccaatttrtcaactgccacaatcagtcgcacccggtgagcacatttccgtgtctttacctagtgatcagcagggccgcagcgggttcctgcctgcagtagggagggggtccttggagagaatgtggtttctttggaggactctcacgatcgtttaatgaagatatctatgcatgccccgttgtgttctgtataattgcaagtgtgactgttacctctggaagatctccttaggcaacgaaatggctattttactcaaagtgtttaatcaatagagaatcatcgtttcacatccgtcaattcaatttgg

SEQ ID NO: 85724 - DNA, 601 bp, Human
tgtagaggatctggaatggaatgttgccatgtgattaggtaccagtgagacaaattctgtcagtgatccttctgtattttaatttatgcagaccataaaagatattcagtctgttctctaatttatagaccttcttttgaaaataatctaatctgactacagtaaactaagatttttgaagaaatatatccttttcagaagttctcaaaattacttaaagctatccccccaatttgtcaactgccacaatcagtcgcacccggtgagcacatttccgtgtctttacctagtgatcagcagrgccgcagcgggttcctgcctgcagtagggagggggtccttggagagaatgtggtttctttggaggactctcacgatcgtttaatgaagatatctatgcatgccccgttgtgttctgtataattgcaagtgtgactgttacctctggaagatctccttaggcaacgaaatggctattttactcaaagtgtttaatcaatagagaatcatcgtttcacatccgtcaattcaatttggacagcaaatccatttaattaaaggtaaactgtggtttaaaggagatgcaaaaacatatacaatta

SEQ ID NO: 85725 - DNA, 601 bp, Human
tattttaatttatgcagaccataaaagatattcagtctgttctctaatttatagaccttcttttgaaaataatctaatctgactacagtaaactaagatttttgaagaaatatatccttttcagaagttctcaaaattacttaaagctatccccccaatttgtcaactgccacaatcagtcgcacccggtgagcacatttccgtgtctttacctagtgatcagcagggccgcagcgggttcctgcctgcagtagggagggggtccttggagagaatgtggtttctttggaggactctcacratcgtttaatgaagatatctatgcatgccccgttgtgttctgtataattgcaagtgtgactgttacctctggaagatctccttaggcaacgaaatggctattttactcaaagtgtttaatcaatagagaatcatcgtttcacatccgtcaattcaatttggacagcaaatccatttaattaaaggtaaactgtggtttaaaggagatgcaaaaacatatacaattataaaacaacttcatttaaccaggaaacacttaattgactacaaactgggtaatgattttgaaaaatatgagact

SEQ ID NO: 85726 - DNA, 601 bp, Human
atcgtttaatgaagatatctatgcatgccccgttgtgttctgtataattgcaagtgtgactgttacctctggaagatctccttaggcaacgaaatggctattttactcaaagtgtttaatcaatagagaatcatcgtttcacatccgtcaattcaatttggacagcaaatccatttaattaaaggtaaactgtggtttaaaggagatgcaaaaacatatacaattataaaacaacttcatttaaccaggaaacacttaattgactacaaactgggtaatgattttgaaaaatatgagactraaagaaacacatactcgcagactaaagcaaggagaaaaccatataacttttttctccaatcttattgaaggcttattcagtattttaaatactaagttctgcattttataacttagagtaatgaggtttcttatataaaacttcatatcatatgccaaccccaacctctgtaaactttattctgatagtattcctgcaaatacatacatacacaacatatttacacatgcacatttttgtttaaggctagctattcccccccccacacacacacacatttgcctgcgtgagtaaccagac

SEQ ID NO: 85727 - DNA, 601 bp, Human
ttaatgaagatatctatgcatgccccgttgtgttctgtataattgcaagtgtgactgttacctctggaagatctccttaggcaacgaaatggctattttactcaaagtgtttaatcaatagagaatcatcgtttcacatccgtcaattcaatttggacagcaaatccatttaattaaaggtaaactgtggtttaaaggagatgcaaaaacatatacaattataaaacaacttcatttaaccaggaaacacttaattgactacaaactgggtaatgattttgaaaaatatgagactaaaagaaacacatactcgcagactaaagcaaggagaaaaccatataacttttttctccaatcttattgaaggcttattcagtattttaaatactaagttctgcattttataacttagagtaatgaggtttcttatataaaacttcatatcatatgccaaccccaacctctgtaaactttattctgatagtattcctgcaaatacatacatacacaacatatttacacatgcacatttttgtttaaggctagctattcccccccccacacacacacacatttgcctgcgtgagtaaccagactagat

SEQ ID NO: 85728 - DNA, 601 bp, Human
ctacaaactgggtaatgattttgaaaaatatgagactaaaagaaacacatactcgcagactaaagcaaggagaaaaccatataacttttttctccaatcttattgaaggcttattcagtattttaaatactaagttctgcattttataacttagagtaatgaggtttcttatataaaacttcatatcatatgccaaccccaacctctgtaaactttattctgatagtattcctgcaaatacatacatacacaacatatttacacatgcacatttttgtttaaggctagctattcccccccmcacacacacacacatttgcctgcgtgagtaaccagactagatctcttttacaattttcacattccccatatctgatcagaggttcttcccaaatgtatgcacatgacacgcacacacacacacacacacacacacatgcatacacttggacatgcacacacacacatccctatctccatttcagaaatgttctttgctttgttgggagcaggaagccactgtttgttctgagtgcagaccatggtctctcttgttctgaattctggtgagttgtcaccatgaatgaatgaatttcctgtg

SEQ ID NO: 85729 - DNA, 601 bp, Human
aaacacatactcgcagactaaagcaaggagaaaaccatataacttttttctccaatcttattgaaggcttattcagtattttaaatactaagttctgcattttataacttagagtaatgaggtttcttatataaaacttcatatcatatgccaaccccaacctctgtaaactttattctgatagtattcctgcaaatacatacatacacaacatatttacacatgcacatttttgtttaaggctagctattcccccccccacacacacacacatttgcctgcgtgagtaaccagactagayctcttttacaattttcacattccccatatctgatcagaggttcttcccaaatgtatgcacatgacacgcacacacacacacacacacacacacatgcatacacttggacatgcacacacacacatccctatctccatttcagaaatgttctttgctttgttgggagcaggaagccactgtttgttctgagtgcagaccatggtctctcttgttctgaattctggtgagttgtcaccatgaatgaatgaatttcctgtggggaagacaggatcatcttcctatctgtttctcacgcctcct

SEQ ID NO: 85730 - DNA, 601 bp, Human
ctttattctgatagtattcctgcaaatacatacatacacaacatatttacacatgcacatttttgtttaaggctagctattcccccccccacacacacacacatttgcctgcgtgagtaaccagactagatctcttttacaattttcacattccccatatctgatcagaggttcttcccaaatgtatgcacatgacacgcacacacacacacacacacacacacatgcatacacttggacatgcacacacacacatccctatctccatttcagaaatgttctttgctttgttgggagcagsaagccactgtttgttctgagtgcagaccatggtctctcttgttctgaattctggtgagttgtcaccatgaatgaatgaatttcctgtggggaagacaggatcatcttcctatctgtttctcacgcctcctgtgtctctgctgttgccagtgttagaaaccttaaccccttggagtctgttcatctctcttgctggttctgctccctggtatgcgtgcagctagtgactgtgcaggcatcaggtgacctctccgcctactttaggcaaaagccagagaataaaagagaggatccttcaaga

SEQ ID NO: 85731 - DNA, 601 bp, Human
agtgactgtgcaggcatcaggtgacctctccgcctactttaggcaaaagccagagaataaaagagaggatccttcaagacatgtacaacccaattatagaggtattacataaggttgtacacgagaaggaacaaaacaccttcagctgccatgttgccttccctgccagaccataggcttctgtgagcagaaccccgaaaggctggacacagagaaagtatgagtgactgtttcaggagaggtggaagaataattacaaaggaacatgtaagctgctgcaaaataactgagtgcatacgargggaatttctgtgtactgccctccttctgttgatttcttctacattggaagaagagacttgaatctgaagccatacaaatatgtataatatattcactaaggatgtgagtgaaggtcactacacctgtttgaaatgacagaaatgtgtctacatttagcctacccaattaatccttttgtattaaatacttggtaattcagcctaatccattatgtccctttaaaaagacaaaaaaagcaaaagtcgttttcactcaaatatcgatgaaatacaaatcaggcttcagagacaattcttta

SEQ ID NO: 85732 - DNA, 601 bp, Human
tgccctccttctgttgatttcttctacattggaagaagagacttgaatctgaagccatacaaatatgtataatatattcactaaggatgtgagtgaaggtcactacacctgtttgaaatgacagaaatgtgtctacatttagcctacccaattaatccttttgtattaaatacttggtaattcagcctaatccattatgtccctttaaaaagacaaaaaaagcaaaagtcgttttcactcaaatatcgatgaaatacaaatcaggcttcagagacaattctttatgtgctataagtcatckgacacttttgtgtcagccatctctcatgctgccacagtggcaggatattacaggatcaaagcaaatttgcaggtctgaataacaagtgctgctctgagcacgctctcctggctcctccaggtaactgcgagctgggtgcagatcagctctttcacattgtctagctgagcctatggagacacctgtgcctgggcacctgcctccatggtcacccctgcggagccctgtcgctagccttcaatggacactcttgctgctttgccataattggctgaccctggaaaatcctcacttacatct

SEQ ID NO: 85733 - DNA, 601 bp, Human
aagcaaaagtcgttttcactcaaatatcgatgaaatacaaatcaggcttcagagacaattctttatgtgctataagtcatctgacacttttgtgtcagccatctctcatgctgccacagtggcaggatattacaggatcaaagcaaatttgcaggtctgaataacaagtgctgctctgagcacgctctcctggctcctccaggtaactgcgagctgggtgcagatcagctctttcacattgtctagctgagcctatggagacacctgtgcctgggcacctgcctccatggtcacccctgcrgagccctgtcgctagccttcaatggacactcttgctgctttgccataattggctgaccctggaaaatcctcacttacatctgtgcctggacttcttgtctctttgccattttactggcctgggcttggggcctctgttgtgtcactctgtcacctctaactttgtctgccacagtctttggggtacatacaggtggtcacctgcctttgtatctaaaaagtgcttcagagggcagggagcctgcatgtgtagcagatggacaagtgcacctgggaccgatgcatcacagcctgagcggtt

SEQ ID NO: 85734 - DNA, 601 bp, Human
acaattctttatgtgctataagtcatctgacacttttgtgtcagccatctctcatgctgccacagtggcaggatattacaggatcaaagcaaatttgcaggtctgaataacaagtgctgctctgagcacgctctcctggctcctccaggtaactgcgagctgggtgcagatcagctctttcacattgtctagctgagcctatggagacacctgtgcctgggcacctgcctccatggtcacccctgcggagccctgtcgctagccttcaatggacactcttgctgctttgccataattggcygaccctggaaaatcctcacttacatctgtgcctggacttcttgtctctttgccattttactggcctgggcttggggcctctgttgtgtcactctgtcacctctaactttgtctgccacagtctttggggtacatacaggtggtcacctgcctttgtatctaaaaagtgcttcagagggcagggagcctgcatgtgtagcagatggacaagtgcacctgggaccgatgcatcacagcctgagcggttttacagtgtggttccagcacattcctacctgctcgggtgtgcacagctggagtt

SEQ ID NO: 85735 - DNA, 601 bp, Human
ccattttactggcctgggcttggggcctctgttgtgtcactctgtcacctctaactttgtctgccacagtctttggggtacatacaggtggtcacctgcctttgtatctaaaaagtgcttcagagggcagggagcctgcatgtgtagcagatggacaagtgcacctgggaccgatgcatcacagcctgagcggttttacagtgtggttccagcacattcctacctgctcgggtgtgcacagctggagtttcccggcaccatcattggacgcaatatgggacagtctcagagctgcaatagyctgccttccttgttctgctcacgagcccttgaaagtcagtttttctcccgttttgcgcacagcaggtatatcctattcttgaacaatttgctgaaaagcagtaaatgaggtcctttcttgaaggcaggattcttttctcctttctctactttccaaatctactccctgagcccttcctctgccttagaaggcttagggttgtctggccacataaatacatgagtaaccactggggcctctcccaggaggataggaccaaagaaacagaaaaatccagtaactggttttagatagagcctt

SEQ ID NO: 85736 - DNA, 601 bp, Human
agattcttttctgatgttgtagagtagagaatctgaaaccaacagtgtacgtgtaggagcttcaatccattcaactggtggcatcatatacttcacatccttaggactgcttatgtgatgtgcagtcaaggattgggcaggtcatatatcatgtcactccatccttcaatgccttttgatctgtttagcagctccttgtgacaacctaaggaagagggtgagggtggtgagactcagattgacccgtgtcttttgtaaattcttcttcctttcttccttccttcacccctagagccctttrtttcctcaaagagatgaactgggacaggtacgcacttcagactgtctcagaggcatttagccctgattaatgcctctgaaattaaagcttgttatcttcctaatactgatacagaccataaagcattgtgtgttacaataaatggagcacccggagctctatactgagtgctgttcccttctcgatagcagaagtgctgggggatggtgaccaccactaacagttactggacatttcttatgggtaagtcaatgtggtgagtctttagctcatcagagtgattaagaaatagacatgatt

SEQ ID NO: 85737 - DNA, 601 bp, Human
atgttcatttttaagataggctacaaaaactttatccgaggttcttaaaaataaaatgttatccttctatctagaagaaaagaatatcgtgtgtgtgtttcaagaactttcccaggtcttgactaagtcagagaggtcacatcttggcaacttgggagacacaggagacccagtgcctgagctcaccagctctaggaaccctgatatgtgcctgttatcctgccaccccagtcctgaagctgctgccctcttctcaagcagtgtgaaggatccaagcaagccgctggtgatggggttgccwgacacctagtcctgggtgatccccggccccaactgctcccagctctgccatatccgacctactcacacatcccttgtcgcaattagttcgcaccttgcacttagcagcccatcccagcagggcagctgcctcagctgcagagagccccatggtggtggcagtgattacatacacctacacaaaggaactaggtaccctttaaaaacactgctcctacagaaaacccattcctgtgtcttcctgctcctgttgaatacaaactttccttcccaatacaattccctttatttcaaagtgtag

SEQ ID NO: 85738 - DNA, 601 bp, Human
tcgtgtggtttgtaggataacacttaaaattccacaaggggaccaggctgcatgtttctttacagctgatgaaaaccagcgttgtgggtacagatgcggccttgtgcttataagtattgtatgcccattaaataacaacattaacgaatagatgcaattggaaaacagacgctttgtgagggtactttaaggcaggaccgtaaaggcatgaaagagggatttacttatgatatgaagttatttcccaaactgaaactatccagacttccagaagctcttgatgtagtgccagttttgaaayaatcttcaaggatgtttcccaaggaaggtcccccttccaaataaagccagtatgaaaggaagaatctaggaaagctatgataagccaggtacttaatcagcaactttatatatactttaaaaaatctcatctaatcttcacaccctccctaagaagttaataataggatctcatattatgcatgagaaaacaggctcggggtggaagtcatggaagtcacctgccgcatgagaagactgaggctcagggggtgtaagtcacttgctgcaacatcacaaggtagatggaaaaaaaatccat

SEQ ID NO: 85739 - DNA, 601 bp, Human
atctgtgttctcaggatatttaaatgagtaatattttattcctgtgagacctctaaaccaaaaggtttggggatacaataaatctgttatcttggaaacaaagctggcagctgctcttggctgggctctatgtggtagctgtgcttcatggcagtgtttttgctctcactatccaatatccatccaccctcttctcagcgggcccaaacacaactattaatagaagtatggatactcggtttggatatctctttcaaaacaaagaagagtctcttaaaaactcttgagaaatcaaaacttstaactgccttattctttttcatcccttcttcccctttaaagttgtatttattggatcacattatggtgcccccaacttaagagctaacaagtacatttcttagtccttcttcatcatgggtttcttagcaaaatgagtactcatgcgcatgcacataaacacaccttcagttctgcccagactccttcctgtggatggggagagttgctgacacaggaggcagagtagaaacgcagcagcttgtgctaatggaaaaaggaggatgatggtttcagagcatgcattctgctctcctgccca

SEQ ID NO: 85740 - DNA, 601 bp, Human
ccttgcccagcacgcattctagaaggaagcggccccgcgcctcctccctcgcaattaccgccgggtcggaggcatccgggcggtgcgaagtcagcaccgtgccgagcagttgagagcagacggtgttttcttttcattgttccctcgcttcgctgggagagcggcggcacctgttccgcggaagcgcggccaaagttggaagccctggcggctgctgcctgcagccgacgcgcgggggcgcccggcttcatccggccgcgggggaccaggagcctgagagcctggaactgggtgcgggggsacagccagcccgagagggcccagggtcggatttcggatggaaccagagctcgctccagggagttgaaggagttgggagcgcatctcccaataatcccaaagaaaccgagctttcagtgcatgcaaggggcatttgatttccctcatttctgagcactgaagcactccactgtcatatttttgaaattcgagaacaaggaggttaaagagtctaaatggaagactaggtgaccatccaaaatatcatacatcaattgcatcttgtaattagtaaaatcatttttattacttaaggtaaatc

SEQ ID NO: 85741 - DNA, 601 bp, Human
cgcgcctcctccctcgcaattaccgccgggtcggaggcatccgggcggtgcgaagtcagcaccgtgccgagcagttgagagcagacggtgttttcttttcattgttccctcgcttcgctgggagagcggcggcacctgttccgcggaagcgcggccaaagttggaagccctggcggctgctgcctgcagccgacgcgcgggggcgcccggcttcatccggccgcgggggaccaggagcctgagagcctggaactgggtgcggggggacagccagcccgagagggcccagggtcggatttcrgatggaaccagagctcgctccagggagttgaaggagttgggagcgcatctcccaataatcccaaagaaaccgagctttcagtgcatgcaaggggcatttgatttccctcatttctgagcactgaagcactccactgtcatatttttgaaattcgagaacaaggaggttaaagagtctaaatggaagactaggtgaccatccaaaatatcatacatcaattgcatcttgtaattagtaaaatcatttttattacttaaggtaaatcttgataaggtgtttttattaggtaagataaacctg

SEQ ID NO: 85742 - DNA, 601 bp, Human
cggcacctgttccgcggaagcgcggccaaagttggaagccctggcggctgctgcctgcagccgacgcgcgggggcgcccggcttcatccggccgcgggggaccaggagcctgagagcctggaactgggtgcggggggacagccagcccgagagggcccagggtcggatttcggatggaaccagagctcgctccagggagttgaaggagttgggagcgcatctcccaataatcccaaagaaaccgagctttcagtgcatgcaaggggcatttgatttccctcatttctgagcactgaagcastccactgtcatatttttgaaattcgagaacaaggaggttaaagagtctaaatggaagactaggtgaccatccaaaatatcatacatcaattgcatcttgtaattagtaaaatcatttttattacttaaggtaaatcttgataaggtgtttttattaggtaagataaacctggtataacatacgttgcgggtgtgtgtgttttgttcagttgtcattttcagagaaataaatgaatttttaaagtgtatatttattcatcaataattatttttaaagtgtgcctgtataccatatatgtag

SEQ ID NO: 85743 - DNA, 601 bp, Human
cccactaccttctgcttgcataactgaagtcacaaaaaggtaaaaactaatcccccaatatacagaagaatctagtatgtcccataaaagcatctttgctaactggcatcgtgaaagtatggtgctggacactcttgaaatgaaatcattgttactgtcaaattagacatctccacaaatatacatgatctgctcaaactgactttacatctgggaaaggagaaattgtaggtctctcttactctgggatatttttgatagagcaaaggtatccatgatgtaaatttctgagatattatakataagccctttataaagtcacaaataatattcccataatgaggggggaaaagattccaaagaaggctgagcacttactgagggcagggaccatcattgtctcctgctttacagtatctgcaactcctagcatatctggtttacgtcttgccaactaaaggtaatgaggcttccctggaagggcactgaatccatggccagaaagtttcacaaggaggcagctgaaataaccagccacatagctcatgggggaacatcagtgcacctcagggggttggcattctgggagaggtcctctcag

SEQ ID NO: 85744 - DNA, 601 bp, Human
tagtgggctgcgatcacgccactgcactccagcctagatggcagagcaagaccctgtctctaaaaaagaaaacaaaacaaaaacaaataaaaaacattaaattcagcacatggagaaacagggctagagttacagaatagaaattcatccatggaggggcagggacaggaatagatgaaaatgccaggaatcctggggaggcagaagaggccaaggacagagctttgaggtggtcacgtgttcctgcccagcctctggtcctgctctcctctcgttgatgtctagaaaaacattcttaccaaaaaaaaaaaaaaaaatacaatttgctaggagaatttcaaaaatatgacagtggagtgcttcagtgctcagaaatgagggaaatcaaatgccccttgcatgcaaaattcttccacctgagattagttagaggcttcagacaatatggaaagacaatttcagattttaggaagttttgtttattgaatttatttatactaaaatgaatctgtagttctaatttgggaaaatgacttagctacttccttcagaaaaaatataattctaatctttagtgttcaatctgattttctgcccactc

SEQ ID NO: 85745 - DNA, 601 bp, Human
tctcggaaaaaaaaaaaaaaaattaagtgactctcacatttttgtatataacattaatgcttgttatgatgaaaaaccaggaagtaatagtatcaaattgggaggtatttgggctgtgataactgatgacatctatgatgttcttccccaaatgtattacattccaaaacagaaaaaaggagacactgctatgtcaatgaacaagaatgaaaactggatcagaagccgtttcctttgccactcttgtcaatagcaaacatattcaagggtggaggtttaattttgagaaatgttttctacwttccagaaactgatatttaccttgctcagaaaaagagtcttagatcagttaagagctgtagttcagcacttgaggttgctggaactgaaatctaacaaagctagagagagaagcacaccccatgctcccactccccaaaaaccccacaccccaaaaacccaccaggacatggagaaagatatgccccttttttcccctttggaataaagtatttaccgtcaataagctttcccagttcatatatgggaatgcataccaccaaaatgggatcactcctatgtgggtcatcatgcagaaagc

SEQ ID NO: 85746 - DNA, 601 bp, Human
gcagaaagctgggggagctttctaggggttttgagggtgacacagcctcagctgtatgttttctaagggagaccatggcactggcaaacattcccttggttttagggataaggaatttgggctcctaaccacctaatcatactactctgggatcacagagcctatttagcagacaacaatattgatttgcatttgtgaatccccgactgcttaattccttatagcttaaactctagtaaagaatggcattttcacagagaagtaaagcttcagcatttgtgggttattaaatgaagacatrttaacacatgggtgccaaggaagtcttatctcgaaatctgcagttgtttgcttttctggtctttcaaagcacataaaaattctgaatttcttctttgctcactaagtatgtgtgaacaatgattgatggtgaaagtgatgaggttaatgagtgtttacttttaagatacaataaaaccaaatgcagaaatggttcagaaaatgatcatggaatgagagaaggaagaaagtctaatttgatcctagatgtacatccagcgttgattccggttttgttttcaaaacagtcttttgctttaaa

SEQ ID NO: 85747 - DNA, 601 bp, Human
ctctttctttctgccttcactacagttgagtggcaggcagctccccttcgatttactgacctagcctagaattccagcaaaaatatctttcgattcccatagtatgtattggcttacatgcctgtttgccacaagcagactgtgacagccactcaaaaacatatttctgtagccctagcacctcccataatgcctggggcagtgtagtcactcagattgctagcaattggatgaatgggtaaaatatttacccacattaaaaagagaaacctaacaaacagagctgtaaatgcaaatgagytctctgacctgtctagttggaaaggtgtcctcattcattcctactgcaagcatcatctgagcatgctcagtgagtgtgcaccactccagtccctgctgtgagaggtaccaggatgccggaaagccccaacacggagttggtattgagcacacagacatcctttaatttcttcaggcccctcttctgtgcctctttctctacagactctcacctcaccagccaccttgtgatctaagtgagacaaacctttaacatagtctactttttagaaaggaatttcaaacaacccaaccaattcat

SEQ ID NO: 85748 - DNA, 601 bp, Human
tgcctgtttgccacaagcagactgtgacagccactcaaaaacatatttctgtagccctagcacctcccataatgcctggggcagtgtagtcactcagattgctagcaattggatgaatgggtaaaatatttacccacattaaaaagagaaacctaacaaacagagctgtaaatgcaaatgagctctctgacctgtctagttggaaaggtgtcctcattcattcctactgcaagcatcatctgagcatgctcagtgagtgtgcaccactccagtccctgctgtgagaggtaccaggatgccrgaaagccccaacacggagttggtattgagcacacagacatcctttaatttcttcaggcccctcttctgtgcctctttctctacagactctcacctcaccagccaccttgtgatctaagtgagacaaacctttaacatagtctactttttagaaaggaatttcaaacaacccaaccaattcatccatttgctggaattacacctaaaaattagcattttccccaaacatcatccccctttcatacccagacatcttcctaagggtacaatgccttccacattgtgtgtgagatctaaggat

SEQ ID NO: 85749 - DNA, 601 bp, Human
cctccactgacagaccccccttttcattcagtgctggtgcagggaggactggctgtttcatcgtcattgatatcatgttggacatggccgaaagggaaggggtcgtagacatctacaactgcgtcagggagctgcggtcacggagggtgaacatggtgcaaacagaggtactcccgctcatcacctagcctggggccttggtccctgggctccctcctgcatctccccatttcagggccaagggcacaaggaatccaggcaattatctgttcaagtgatctacctggcattccctgttccttccctccctccctcccttccccctttttgtttttcctctcataaacaaaccaaacaaacccaggagttttccaggtaacagaatcaagagcccaaatttgcacacttttctgtattaagggacccaaaaaagtctctgttaagtgctcagactttcaataccatttccttttattatctcttttaaactagctggtaaccagagcaagaccgctcctgagaatagtggctgaagggttatctctgtgcactttgttcttctcccagggtcctgggaagaacagaagcctcctgaccctaa

SEQ ID NO: 85750 - DNA, 601 bp, Human
ctccactgacagaccccccttttcattcagtgctggtgcagggaggactggctgtttcatcgtcattgatatcatgttggacatggccgaaagggaaggggtcgtagacatctacaactgcgtcagggagctgcggtcacggagggtgaacatggtgcaaacagaggtactcccgctcatcacctagcctggggccttggtccctgggctccctcctgcatctccccatttcagggccaagggcacaaggaatccaggcaattatctgttcaagtgatctacctggcattccctgttcctcccctccctccctcccttccccctttttgtttttcctctcataaacaaaccaaacaaacccaggagttttccaggtaacagaatcaagagcccaaatttgcacacttttctgtattaagggacccaaaaaagtctctgttaagtgctcagactttcaataccatttccttttattatctcttttaaactagctggtaaccagagcaagaccgctcctgagaatagtggctgaagggttatctctgtgcactttgttcttctcccagggtcctgggaagaacagaagcctcctgaccctaaa

SEQ ID NO: 85751 - DNA, 601 bp, Human
caatctgttggacaagaggttgttgaaaaaaaataattaaaggtcatatttatgtatagaaaaaaccgaattaactgtaataagaggctttttaaacttcccatataactaaagattaataataaatatgataagactctaccaatgaattttaagaaaagtcagtgccaaatcagaattagaggccccatatttacactgtgaactcattgaagatatatatgagaacagctctctgtacttctaagaggtttcataatcatattaacttttatgttctgaaataagaacttctaagtamttttatgttttgaattaagaacttccagacttcttgtcttcacagtaatgccaagtttttctggaccttctttgcactattattttgaccagcaaatcctaccatagacaaaattctgctcattcctcatgtgaaatactgagttccaagtgagtaggatcagaatgacagaggtcttcagccacagttttcatggtgctgcagtgcgtgtggtggtttgtattgggtccgattggttttaatcaatctgtgtaatatttggcattgcaccccagtctcctagcacttgagcccttggac

SEQ ID NO: 85752 - DNA, 601 bp, Human
gtgacttgctcctcaagaaggatttcaaggtcagcacctgagtgagcccttgaatcacaaggttccttggcctccatagcactgttcgtattcagggctgggtaacccagagctctacccaggagacgtctatggtatcaccaccacacaaaaatgtgtgtagacattgccaggtgtccccctgggggacagaaatacctggttgagaaccactggtctaacaaccatttccactccttccctctgaaggcagacatggactagtccccaacaccatggctccttgtccacagcataaccrtggcacagttacaccatggaagtgtgtgttcagactttccaaccaagagctctccattgtattcctcacatatgcattttgtccagatgtacccgagtcaaggccagactcttcccccacctctgacctcccaaatccccaggtgcctcactccactgggacttgagggctcttaattctagggacccacagtggcccttacgcctctgcctctggcccctgtgtctgatgggcactgtcagtggacgaaatccaaggagcaaaagaaagaaaactcgaactatggtgggttggggaggg

SEQ ID NO: 85753 - DNA, 601 bp, Human
tggcacagttacaccatggaagtgtgtgttcagactttccaaccaagagctctccattgtattcctcacatatgcattttgtccagatgtacccgagtcaaggccagactcttcccccacctctgacctcccaaatccccaggtgcctcactccactgggacttgagggctcttaattctagggacccacagtggcccttacgcctctgcctctggcccctgtgtctgatgggcactgtcagtggacgaaatccaaggagcaaaagaaagaaaactcgaactatggtgggttggggagggrgggggaagggaccgtcttgcagtcagccacaggaagtttgcatctttcgaaaactgcacgtgagaggagtccgctgccaaggcttcttgtcctcatgttcctttcttttctcacgcagacgctaaacatggtgacaccaacgctgcgagtagaggactgcagcatcgcactgttgccccggaaccatgagaaaaaccggtgcatggacatcctgcccccagaccgctgcctgcccttcctcatcaccatcgatggggagagcagcaactacatcaatgctgccctcatggacgtgagtgc

SEQ ID NO: 85754 - DNA, 601 bp, Human
gcacagttacaccatggaagtgtgtgttcagactttccaaccaagagctctccattgtattcctcacatatgcattttgtccagatgtacccgagtcaaggccagactcttcccccacctctgacctcccaaatccccaggtgcctcactccactgggacttgagggctcttaattctagggacccacagtggcccttacgcctctgcctctggcccctgtgtctgatgggcactgtcagtggacgaaatccaaggagcaaaagaaagaaaactcgaactatggtgggttggggagggagsgggaagggaccgtcttgcagtcagccacaggaagtttgcatctttcgaaaactgcacgtgagaggagtccgctgccaaggcttcttgtcctcatgttcctttcttttctcacgcagacgctaaacatggtgacaccaacgctgcgagtagaggactgcagcatcgcactgttgccccggaaccatgagaaaaaccggtgcatggacatcctgcccccagaccgctgcctgcccttcctcatcaccatcgatggggagagcagcaactacatcaatgctgccctcatggacgtgagtgccc

SEQ ID NO: 85755 - DNA, 601 bp, Human
aagcagaatgagcaaaccagaggacagtggagaagggaagatagcgtttgacccagcccagatcccattcctggagtgactgtgtgcttcctggcacagctcaccgggagcctacaggtagagatcgtcatgcagggcaggtagagattgtcatgcagggtgacagtgtcggggtgacagcagagacaggcaagcaattttaaggcacagcaattagttttctcaatgctttagtaaagatattaaaaagaaataatactgggacttggagataagagaagtttggaatgataaatggggyttttgcatagttactcttaaacattaaagagaaagaattggacagtgatgactcaatgttagtaatggagttagacacattttcttgaagcaggttgtcaggcaagcattagcacagtggtcctttaggagatgaatttattgctttgggatgtgcctataccaatcatagacaaccaccatgacagtaggcattatgggaagtttgaccttagcgtgttttaagaaaaaacttgttctggaaatgaattaatttcctgtccagtagacacaaattctttttcttaaaaaaaaaaaaaaa

SEQ ID NO: 85756 - DNA, 601 bp, Human
gaacaagacatcagtgattctagtgcattctttttgaaaaactgcattggaattctaaagccgcattctaaacccgaactatctggactcaaaccaagccttggctggctcatgggtaggagagacaaaaagactccagttctattcagcagacagagctgattttcagagtgagagaaaagaggctcctgggattcagtcttttagcgaacactaaactgagcatttgaatgtaaaggctttgcaattctacaagaatagcactcaactattttaagtatttataggtccggttcacggrcgtgttatgcaccatttaagccattttctacatggtttacttgggcagagcatagaatgcaatgtgccaagaggcaagtgcaacccacgtcactcatatttctttggtgtaagtggcaagcttttggtcaggagcttgaactgagaaagcaagcagaaagcagagtaagctcaggcagtagaaaaatgggcagaacggttcagatgtacatgttacagcttttattaacatctcggcttcccatcataatgcctattaatttcaacagtgggtacactttgggcatcaaaaagaacataa

SEQ ID NO: 85757 - DNA, 601 bp, Human
cactgctaactgaaaactatcctgcaatcttgggtataaatcaaccttagcaacctttgacaatgagattttagatcctttggaaaacagaagtcatctagaaattcagccagtggatcctcctttcctgacacatcattctgcataaaattaggtgattgtcttcctctgctcttggcccaggatagaaacaggttgtataataaagtagttctccccttgcctttccataggccacctgtccctcagctaaatcagaaagataaaagttagatgcggccaggcgcagtggctcacaccrgtaatcccagcactttgggaggccgaggcgggtggatcatgaggtcaagagatcgagaccatcctggccaacatggtgaaaccccctctccactaaaaatacaaaaattagccgggcgtggtggcgcatgcctgtagtccctactactcaggaggccgaggcaaaagaatcgcttgaacccggggggcggagtttgtggtgagccgagatcacaccactgcactccaacctggcgacagaacgagcttctgcctcaaaaaaaaaaaaaaaaaaaaaaaaaaaaaaaggtagatgctactc

SEQ ID NO: 85758 - DNA, 601 bp, Human
ttgtcttcctctgctcttggcccaggatagaaacaggttgtataataaagtagttctccccttgcctttccataggccacctgtccctcagctaaatcagaaagataaaagttagatgcggccaggcgcagtggctcacaccggtaatcccagcactttgggaggccgaggcgggtggatcatgaggtcaagagatcgagaccatcctggccaacatggtgaaaccccctctccactaaaaatacaaaaattagccgggcgtggtggcgcatgcctgtagtccctactactcaggaggccraggcaaaagaatcgcttgaacccggggggcggagtttgtggtgagccgagatcacaccactgcactccaacctggcgacagaacgagcttctgcctcaaaaaaaaaaaaaaaaaaaaaaaaaaaaaaaggtagatgctactcaaaaaaaagttataggaataagaagtcccaaaggaagagtaatttcaaactttaaatgcctgttaaggtttcggggctttgagaagggtttttgaagaaaaaaatcttagcagttcttccttcctgactatttccaagggtaggaattttgtggggtg

SEQ ID NO: 85759 - DNA, 601 bp, Human
tcttggcccaggatagaaacaggttgtataataaagtagttctccccttgcctttccataggccacctgtccctcagctaaatcagaaagataaaagttagatgcggccaggcgcagtggctcacaccggtaatcccagcactttgggaggccgaggcgggtggatcatgaggtcaagagatcgagaccatcctggccaacatggtgaaaccccctctccactaaaaatacaaaaattagccgggcgtggtggcgcatgcctgtagtccctactactcaggaggccgaggcaaaagaatcrcttgaacccggggggcggagtttgtggtgagccgagatcacaccactgcactccaacctggcgacagaacgagcttctgcctcaaaaaaaaaaaaaaaaaaaaaaaaaaaaaaaggtagatgctactcaaaaaaaagttataggaataagaagtcccaaaggaagagtaatttcaaactttaaatgcctgttaaggtttcggggctttgagaagggtttttgaagaaaaaaatcttagcagttcttccttcctgactatttccaagggtaggaattttgtggggtgctggctaataagca

SEQ ID NO: 85760 - DNA, 601 bp, Human
tgcatttacattcatgcaaatgttttagttactcagtatcaacaatacctagagtttgaggctgtaggaaattgcttttttaattaggccacttccaggcagaacagcaaagcatttattcttattacagcagatttgctagatctgagctgcaagggtttggactggaacataaaaatgcaacccaacaatgttatcagttccaaaccttgtcacaaaatagccttattcccaatagtggttataaatccacatgcaatcccagccagcagagcgtggagatctgggcattaagagttgyatagccatcttgagtaccttacatcctggggtggcacctagtgcctctccccggggcctgatgagagttcccttcaccatgcaaaaggggacatggcgactgccatccacatgacctcgttggaaagcagaattactcatggcttaaaaggtgctttctgagaaaatgaaggaaaaagtcccaggaaaaggacaggtggagttgaggaatcagccagcaaggaagtccaaaagcctacattgctgggaggaaaagagaaagaaaagaaaacaaagggagtcagtgaaatcttcagaattc

SEQ ID NO: 85761 - DNA, 601 bp, Human
gaaaatgaaggaaaaagtcccaggaaaaggacaggtggagttgaggaatcagccagcaaggaagtccaaaagcctacattgctgggaggaaaagagaaagaaaagaaaacaaagggagtcagtgaaatcttcagaattcctgaatgatgtctccaaacacagcatcccacatccgtaatcccagcaatttgggaggctgaggcaggaggatcactggagaagagggcttcaagaccagcctgggcaacatagcgagatccctgtgtctccaaaaatacaaaaattagccaggcatggtagyacacacctgtggccccagctacttgagaggtttaggtgcaagggttgcttgagcccaggagctcaaggctgcagtgagccatgatcgcaccactgcactctagctggggagacagagcaagaccctatctcttaaaaaaaaaggattactgagtgtcaatactaaccttatccaaactgttaggagtaaatttcctcttataactaaccttgtgtttatatgttttgaattcagttgtgtccacagtactggccagaaaacggagtacacagacacggccccatccaggtggaatttgtc

SEQ ID NO: 85762 - DNA, 601 bp, Human
ggcggggaaggccgcaccgttgtgcactgcttgtaagtgcttgacagagctcttcatttcagaacagcgaggccccacactcactctcacctcctagttctctgacttttgtttcactagaaatggagaagaaataagtaggtctaggtgaaggggtgatcatgacactcagtgagggattggttggcttttcaggaaacaggatatgcacattctgcatttggatggtgtgccgctgccgcacaagcaagcactgaccgtttcattaggacccctgcctccgccgcccactgccaagagagaaaaaaaaaaaaaacactggctcttgagagccaattgttaagttttcaggaattttctgagctgggtcttcaactgttggtaacttgaattcatccatggtagaaggatttacatcatggaaatcaacaaatgctacaactcagggctccgtcccaccagccaaaggccagtttaccatcacattacttgattattcaattggaaatcatgtcaggtctcaaaggacctggagagtgtgtgtgtgtgtgcgtgtgtgcgtgtgtgtgcgcgtgcgcgtgcatgctttttgggagaatgt

SEQ ID NO: 85763 - DNA, 601 bp, Human
cggggaaggccgcaccgttgtgcactgcttgtaagtgcttgacagagctcttcatttcagaacagcgaggccccacactcactctcacctcctagttctctgacttttgtttcactagaaatggagaagaaataagtaggtctaggtgaaggggtgatcatgacactcagtgagggattggttggcttttcaggaaacaggatatgcacattctgcatttggatggtgtgccgctgccgcacaagcaagcactgaccgtttcattaggacccctgcctccgccgcccactgccaagagagaaaaaaaaaaaaaacactggctcttgagagccaattgttaagttttcaggaattttctgagctgggtcttcaactgttggtaacttgaattcatccatggtagaaggatttacatcatggaaatcaacaaatgctacaactcagggctccgtcccaccagccaaaggccagtttaccatcacattacttgattattcaattggaaatcatgtcaggtctcaaaggacctggagagtgtgtgtgtgtgtgcgtgtgtgcgtgtgtgtgcgcgtgcgcgtgcatgctttttgggagaatgtgt

SEQ ID NO: 85764 - DNA, 601 bp, Human
atcttttgtcctctaaaaagcagtttattaacctcacctttctctagttgctgtcatcccccctttcttctcatggacccagtgcattaaaaaatctctgttggccaggcgcagtggctcacgcctgtaatcccagcactttgggagaccaaggcaggtggatcacgaggtcaggagatcaagaccctcctggctaacacgttgaaaccccgtctctactaaaaacacaaaaaattagccaggcatggtggtgggcacctgtagtcccagctactcgggagactgaggcaggagaatggcrtgaacccgggaggcggagcttgcagtgagccgagatggcgccactgcactccagcctgggggacagagcgagactccatctcaaagaaaagaaaaaaaaaatctctatcaagaaaatgacaaaaagaattcattagcagtccacatccctatttttatttctcttcaatccagatccaacctctgatcagaacaagaggctcacgctgagatgatacaatcccagcaaagaatattaacattgtagttcgtttgtattagatatatcagatttttctaaaatactaaaaataggttgcag

SEQ ID NO: 85765 - DNA, 601 bp, Human
aatctctgttggccaggcgcagtggctcacgcctgtaatcccagcactttgggagaccaaggcaggtggatcacgaggtcaggagatcaagaccctcctggctaacacgttgaaaccccgtctctactaaaaacacaaaaaattagccaggcatggtggtgggcacctgtagtcccagctactcgggagactgaggcaggagaatggcatgaacccgggaggcggagcttgcagtgagccgagatggcgccactgcactccagcctgggggacagagcgagactccatctcaaagaaaagaaaaaaaaaatctctatcaagaaaatgacaaaaagaattcattagcagtccacatccctatttttatttctcttcaatccagatccaacctctgatcagaacaagaggctcacgctgagatgatacaatcccagcaaagaatattaacattgtagttcgtttgtattagatatatcagatttttctaaaatactaaaaataggttgcagttacccctgcctgcatctggagacccccagcgtctggagctagatgtataatgcatcgctccccccgggattagcagctttctaaaaagggt

SEQ ID NO: 85766 - DNA, 601 bp, Human
agatgtcccagcccagcgcagtggctcacgcctataatcccagcactttgggaggctgaggcgggtggatcacgagatcaggagatcgagaccatcctggctaacacggtgaaaccccgtctctactgaaactacaaaaaattagccgggcgcagtggcaggtgcctgtagtcccagctacttgggaggctgaggcaggaaaatgacgtgaacccgggaggcggagcttgcagtgagtcaagatcgtgccactgcactctagcctgggcgacagagcaagactctgtctcaaaaagaaaataataataataataataataataataataataataaagatgtcccgaatagccaatgagcatagaaaagttactcaatattattcatttttaggcaaatccacattgaaaccaggatcacatgccactgtgtactcaccagaatggctgaaattttaaagacagacaaataaatgataatcccaagtgttagtgaagctgtggagtaactggaactcttatacactgtaggaaggaagtaaatactgtacaaccatttggaaactgacagcatttaccaaagctaaacatatacgcagtct

SEQ ID NO: 85767 - DNA, 601 bp, Human
acaggcaaaaacaattgatgatgctaggcttaagaatggattctctttggtgatactgatggtattgttgaggaaggaacgtgagggagcctcttggggactgaacgtggtttgtatcttgatctgaatggtggttacatggtgtatgcattggtaaaaattgactgagctgtctacttacggtctttattgtaggtatattatactttagttaaaaaactgattcagaatttcataatgggctgatcaagctgatatccgaacacgatgatctctcttaaaaccataaaacaagggacarccagatatttttggcttgcttcctaatgaaagtatactttaagtatccttgtataaataaatcaatcttgaattcttaccaagccctggaactacctaccgatttacaggaaatacagagttagaaagcagcatattaaataatatcacagagatgtgatgaatgagaaaaatctaggatgtgggactctctacaggacacagatgaacttgtttcctcaacaaataaattctcaagaaaaaagagagagcaaagaggaactcacagagtaaaataaatttgcaagacataccaaccaaa

SEQ ID NO: 85768 - DNA, 601 bp, Human
accaaatccaatctgtggactttgcctagatgtggattttttaaaaagcatctgtaagaaacaatctgagagtggattttttaaaaaagcagctgtaagaaacaatctgggaaactggaacactgactagaaatttgataattttaaaacagtaatgttattattttaggtatgatagttatactgtgtactgtgtttaaaaataaaaaggtcccatggccgggcgcggtggctcacacctgtaatcccagcactttgggaggccggggcgggcagatcactaggtcaggagattgagacyatcctggctaacacggtgaaaccccatctctactaaaaaaatacaaaaaaattagccgggcatggtggcaggtgcctgtagtcccagctactcgggaggctgaggcaggagaatggcgtgaacccaggaggcagagcttgcagtgagccaagatcgcgccactgcactccagcctgggtgacagagtgagactccatctcaaaaaaaaaaaaggtcccttatctccttgaggagagagtgactgcagagttgatgcagggatagtgcgggatgagcctggaccattatgtggttgcagag

SEQ ID NO: 85769 - DNA, 601 bp, Human
gagactatcctggctaacacggtgaaaccccatctctactaaaaaaatacaaaaaaattagccgggcatggtggcaggtgcctgtagtcccagctactcgggaggctgaggcaggagaatggcgtgaacccaggaggcagagcttgcagtgagccaagatcgcgccactgcactccagcctgggtgacagagtgagactccatctcaaaaaaaaaaaaggtcccttatctccttgaggagagagtgactgcagagttgatgcagggatagtgcgggatgagcctggaccattatgtggttkcagagagtaaagaaataaaacaggctggggacttgtcagaaaagaacaaaagagccagcctgacggagctcccactggccaaagctggaacaatgtgaacaaaatcaatattagtacccttggattttagctgatagaataaaattattatgtataagctcacactgaaataaacaaatcataaaataaataaacaataatagggaagaagagacagctctttcttagtgtagaatgttgaaagagagggaaacaggaaatcaccattaggcaaacaccacagtgataattaattgttgc

SEQ ID NO: 85770 - DNA, 601 bp, Human
atctctactaaaaaaatacaaaaaaattagccgggcatggtggcaggtgcctgtagtcccagctactcgggaggctgaggcaggagaatggcgtgaacccaggaggcagagcttgcagtgagccaagatcgcgccactgcactccagcctgggtgacagagtgagactccatctcaaaaaaaaaaaaggtcccttatctccttgaggagagagtgactgcagagttgatgcagggatagtgcgggatgagcctggaccattatgtggttgcagagagtaaagaaataaaacaggctggggrcttgtcagaaaagaacaaaagagccagcctgacggagctcccactggccaaagctggaacaatgtgaacaaaatcaatattagtacccttggattttagctgatagaataaaattattatgtataagctcacactgaaataaacaaatcataaaataaataaacaataatagggaagaagagacagctctttcttagtgtagaatgttgaaagagagggaaacaggaaatcaccattaggcaaacaccacagtgataattaattgttgcagacaagatccaccaacggatgctcaaatca

SEQ ID NO: 85771 - DNA, 601 bp, Human
ttgggctagcagaggatagaaacaaatgcacaaatgaaatattctgcctgtggctttgtgaggtagttaacctcactaattcagggacaggtatgtagcctcgagactctggttggtacttgggcacagctgaccttgatcaaaaaaaatgtcacttccctctcactgcagcctgaattaagcacatcattagaaacagacccttccaggcctttcctctaatggctccagctgcagctttcatcactcaccaggttttatgggcaggagtgatggggctttttccaaatcagtggtgcaygctgaaggacaggggtgatttttcgtgaaataaatggaggcttagatggccgaaccagaagggagcttgcggtcccagcccacgattctatcgtaacttaggactttttgtattatgtgtgatcctgagggagaagatgggatttctgggtgcccagacctccaaagtcagcagcaggtggaggataaggtcagggtctgagaaatgtaggaaagttttgcaatgtctggagaaaactatgtgacatatctgtcacggggctgttagcagggtattagataatatctggtgacaaagaaa

SEQ ID NO: 85772 - DNA, 601 bp, Human
cagctgcatttttcctgacccctttttcagcccgcttctaagttatccatctcttcaaccagcctcaagtccccatcaaagaactgggtccccagaggatggacaaggacagcacagcctgagattccccacgactcgcctagttatattcagaaggagtgctggcacctgagctcctttgaagagactccggctgcaggaaagcggctgcttcacgctggcagctcccctctcacttttgccttccttaatggcttttgaagttcccagggctctgttttaacatagaaatggtcttcargggcagatcttgcctagagaaacatagtgtcccctgtgaggtggtgggaactttggaagactcccctccacagcctagtgcactgcccaggaagtgaacaactggccccatcatttacccaaatgccttgggcagggctgacaaagctgcctctgcaggtaattacacactttaatatggagtgcagtggcgtgatcatagctcactgcagcctcaaacccctgggctcaagccatcctcccacctcagcctctcaagtagctggaactaaaggggcatgcaaccatgcctggctggttt

SEQ ID NO: 85773 - DNA, 601 bp, Human
agcctagaggctggacaccagcggggctctcagggttcatgatgtgtggaaaaggtaagggaaaaaaatcgacaactaaaagccattagacgaaaattccaaatagaatgtagccggataagcagtcccaacccacctgggagtctgaaagggagggccctgtaggaaggtgatggtcataacccttcgctgggttgatttgttactgagttgctgggagaaatccaggataaagggtggtaaagcagtgcatgctcttgcaccgggagaaaaagggcacaggttagtgtaggggacctgrgaacagggcagagctcaatcactgtgtgtgtgagcttcatctcagaccaggtgtaacaggaacagccccgtccaccatcacgtgccttgtaagattcagaaaagagcatctcctcagtggttctcaagcctggttgcccactgaagtcatctgggagctttagaacaattctgatccctgggcccacctggagactgattcgattggtcaggggcctggctgcagcagccgagtgttaaaagcccctggtgagtctcatgtgcagcctagcttaagaaccatgtctgctctagacgcagt

SEQ ID NO: 85774 - DNA, 601 bp, Human
ttctcaagcctggttgcccactgaagtcatctgggagctttagaacaattctgatccctgggcccacctggagactgattcgattggtcaggggcctggctgcagcagccgagtgttaaaagcccctggtgagtctcatgtgcagcctagcttaagaaccatgtctgctctagacgcagtatcagcccaggctgcacttgagaatccgcccacccccaactcccgggggagctttcagaaataccagtgcacaggcctgccccagcccacttcagccagaggctctgagatggagcccccrccaggtaggatagacgtgccacacggctgagaaagttggtgtaggaggatcagcgggcctctcccttccctgcagtgccatgcggcggtgttcacagctcgccgccccctccccctccgtcccacttactccagagccaggccccatcctgatctgcggatctgccgcacaggttcaggttgccccctctgtaacttacagccgaccctccagactcagcctcacctcccctttagtaagccaacaatggactcacatacaaaatgcaatgtggtgtggggcctacagctctcccccttg

SEQ ID NO: 85775 - DNA, 601 bp, Human
cctgcagtgccatgcggcggtgttcacagctcgccgccccctccccctccgtcccacttactccagagccaggccccatcctgatctgcggatctgccgcacaggttcaggttgccccctctgtaacttacagccgaccctccagactcagcctcacctcccctttagtaagccaacaatggactcacatacaaaatgcaatgtggtgtggggcctacagctctcccccttgtgccaccaactggtgtgtataggctgtccctcaatagctcttgctgtgaaatttgcagcctatttaacrgctgtgcatgtgtgtgtgcatgtgttggggtggtgagtgcaggagttgggtgggaatcagaggtgagctagggtccccaatccacactccaggcaccttgaatccacccatggtcagtcttcctgcactgttgaggaaggtttgtaataatttttgctaataccccatcccctctccccacccccagattccacttgcccatcctgccccctacactcagcaccagccaagcgcctggctcccaggagtttcccagtaagcattttctgagtgactgaaccattcttctctgcagccaga

SEQ ID NO: 85776 - DNA, 601 bp, Human
tggaaaaagtggtctatttaagggaaatacaggctagtaaaatatttgttatttgcactaggagataatttaaggaacaccttctcaaatgtcatcagacttactttaaaggcaaaccaagtccaaaagttctaaattgagaaagctggaagggaaacttaaatatgatccaaccccctgttttatgaccagaggggaatggattggccaagatgtcggggatggttaataggacctcaggctcctggtcagtgtggggcactcagacccatgagtctagaaagcaaagaacaactggatycatgtttcctatgtcagagtccacccagttgcagttccacctgagtccttcacagacattaaaggtaggattcacatcatggaataagcatttttctactagcgatttttttaataaagctttattggaatataatttgcatgccataacatttccccttttagatggaaataatagacactgggaactccaaaagagcagggaggagagggagggttgaaaaattacctgttgggtataacattcgattgtaatcagtttccagtgttttgcattcctaccagccgtgtaatgcactat

SEQ ID NO: 85777 - DNA, 601 bp, Human
tccccatctcagccagccacatccacaaggtgtgtgtaagggtgcaggcgccggccggttaggccaaggctctactgtctgttgcccctccaggagaacttccaaggaggtgagtgtgtgaacgcacctgtgttggagcacggtgtcccactctggcgggtccccagggcctgagcagcagcgatagccctgtgacaatgtgaagggccacagaactcttgtattccagtcaggggcaaagagtggagacggaaggcctgtccttctgacaagcagccccttccactgtctgacagtgggmggtcacccccactgtagcagaggggtggggggcgggtactgccaaggaggagctttggagtgataggcggggcaggcctgggacccttggtctttcccaaagggtggttccctttcaaagttgctattccaaaggtagcagtgaggatggcacaaatttatgtagccaggccactcctgtttgtccgtggagtggagaggagccaccctcctgccctctcagaggtccaggtgtgctcactcctatttgggaagagagaaggggcacagcagccctgcaggggcccctggctctgctcgt

SEQ ID NO: 85778 - DNA, 601 bp, Human
gtgaacgcacctgtgttggagcacggtgtcccactctggcgggtccccagggcctgagcagcagcgatagccctgtgacaatgtgaagggccacagaactcttgtattccagtcaggggcaaagagtggagacggaaggcctgtccttctgacaagcagccccttccactgtctgacagtgggaggtcacccccactgtagcagaggggtggggggcgggtactgccaaggaggagctttggagtgataggcggggcaggcctgggacccttggtctttcccaaagggtggttccctttcraagttgctattccaaaggtagcagtgaggatggcacaaatttatgtagccaggccactcctgtttgtccgtggagtggagaggagccaccctcctgccctctcagaggtccaggtgtgctcactcctatttgggaagagagaaggggcacagcagccctgcaggggcccctggctctgctcgtgtttctgggcttctgctggtagggggtgcgaccttcccgtttgaccctggactttctttctccactgcccactttcacccactgggcagctcaggggaggggtcctggcaggagcca

SEQ ID NO: 85779 - DNA, 601 bp, Human
gcgggtccccagggcctgagcagcagcgatagccctgtgacaatgtgaagggccacagaactcttgtattccagtcaggggcaaagagtggagacggaaggcctgtccttctgacaagcagccccttccactgtctgacagtgggaggtcacccccactgtagcagaggggtggggggcgggtactgccaaggaggagctttggagtgataggcggggcaggcctgggacccttggtctttcccaaagggtggttccctttcaaagttgctattccaaaggtagcagtgaggatggcacamatttatgtagccaggccactcctgtttgtccgtggagtggagaggagccaccctcctgccctctcagaggtccaggtgtgctcactcctatttgggaagagagaaggggcacagcagccctgcaggggcccctggctctgctcgtgtttctgggcttctgctggtagggggtgcgaccttcccgtttgaccctggactttctttctccactgcccactttcacccactgggcagctcaggggaggggtcctggcaggagccacagggcaggagggtccatgcctgtccatgctgtcctgg

SEQ ID NO: 85780 - DNA, 601 bp, Human
agcagcgatagccctgtgacaatgtgaagggccacagaactcttgtattccagtcaggggcaaagagtggagacggaaggcctgtccttctgacaagcagccccttccactgtctgacagtgggaggtcacccccactgtagcagaggggtggggggcgggtactgccaaggaggagctttggagtgataggcggggcaggcctgggacccttggtctttcccaaagggtggttccctttcaaagttgctattccaaaggtagcagtgaggatggcacaaatttatgtagccaggccactsctgtttgtccgtggagtggagaggagccaccctcctgccctctcagaggtccaggtgtgctcactcctatttgggaagagagaaggggcacagcagccctgcaggggcccctggctctgctcgtgtttctgggcttctgctggtagggggtgcgaccttcccgtttgaccctggactttctttctccactgcccactttcacccactgggcagctcaggggaggggtcctggcaggagccacagggcaggagggtccatgcctgtccatgctgtcctgggagtgtcttgagatgcccctg

SEQ ID NO: 85781 - DNA, 601 bp, Human
gggcgggtactgccaaggaggagctttggagtgataggcggggcaggcctgggacccttggtctttcccaaagggtggttccctttcaaagttgctattccaaaggtagcagtgaggatggcacaaatttatgtagccaggccactcctgtttgtccgtggagtggagaggagccaccctcctgccctctcagaggtccaggtgtgctcactcctatttgggaagagagaaggggcacagcagccctgcaggggcccctggctctgctcgtgtttctgggcttctgctggtagggggtgcsaccttcccgtttgaccctggactttctttctccactgcccactttcacccactgggcagctcaggggaggggtcctggcaggagccacagggcaggagggtccatgcctgtccatgctgtcctgggagtgtcttgagatgcccctgggggggccgccctgtaatcatcctcctctccccctccccactggctcgaaggcaggactcgggaggcttcatcagaggactctaaaggatttctggggattctccacttttcgaccctgacccaggaggaggaaggggaaggatggtggtgctg

SEQ ID NO: 85782 - DNA, 601 bp, Human
gggggtgcgaccttcccgtttgaccctggactttctttctccactgcccactttcacccactgggcagctcaggggaggggtcctggcaggagccacagggcaggagggtccatgcctgtccatgctgtcctgggagtgtcttgagatgcccctgggggggccgccctgtaatcatcctcctctccccctccccactggctcgaaggcaggactcgggaggcttcatcagaggactctaaaggatttctggggattctccacttttcgaccctgacccaggaggaggaaggggaaggatgrtggtgctgggtgggagtggggatggtgtgtgcttcatccccctctgaccgaaatcctaatcttgtctctagatctgggggctgcagtgttgtgtacctgtcacccttagccttgctgctttgacctgtattgtctgttctgaccctcctgagactggaagctgggggtaggggacacactctccttccatcctgttcctcaggagcccagcaggggtgcagaaggggaaggcagacatgagggcaggtggagtgggggtagaagcagggccagagacagaaggtggatgcctgtctggga

SEQ ID NO: 85783 - DNA, 601 bp, Human
tttcctgttcctgttcccagccacccctgtctgtctgcccagggacctacctgcctggcccactcctgctgccacccctctccatgagtgggactcctgagcagtgccaggcccaggccctcagggtggcagttgctggatggggccaggcttcccattccctggcaggcagactcttggctctggaagatccctgggggactctgacttcttggttactcaggctactccgtaagggtagccttacgagagcgtaagggcatgaggggaagtcgatgggtagaccaggtgtctctgattyctctgaggaaatgcagcttctttgccaagaactcttgggctttggtggcttcgtcgcccttgcctggggtgggcgagttttagtctcttcagctgcagaccagaagctgagctgacctgaaaagagctggagttctggagttcgggcttccaggccagggcctgcttctgggtgagagtgggaggtaatggttgcttgaggcagaggcagtaaaccctcacacccgcagctggacaaaggcaccagctggctgtattctgtgggggcaatgtggcttctggaaggtctctccagtggctc

SEQ ID NO: 85784 - DNA, 601 bp, Human
aggagcggctggtggagtggatcatagtgcagtgtggccctgatgtgggccgcccagaccgtgggcgcttgggcttccaggtctggctgaagaatggcgtggtgagtggcaccctgggctagggcgctggggggctggggtgtgccaccctgtgagtcctgggccaatccctgagctgactgctaagctgcgtcctatgccctatgcctggtagattctgagcaagctggtgaacagcctgtaccctgatggctccaagccggtgaaggtgcccgagaacccaccctccatggtcttcaarcagatggagcaggtggctcagttcctgaaggcggctgaggactatggggtcatcaagactgacatgttccagactgttgacctctttgaaggtagagaggaagaggctgggggaggaggtgggcaggaggacagggtgctgggacagggagagggaatgaccagaatatgccacaactaggggtgtgcttgcccgcacacagcagggatgggatatgccgagaataacacgccacgctcacagggcccactgagaggcctcccttgaattggggacaactcttggccctggtttggccat

SEQ ID NO: 85785 - DNA, 601 bp, Human
agggcgctggggggctggggtgtgccaccctgtgagtcctgggccaatccctgagctgactgctaagctgcgtcctatgccctatgcctggtagattctgagcaagctggtgaacagcctgtaccctgatggctccaagccggtgaaggtgcccgagaacccaccctccatggtcttcaagcagatggagcaggtggctcagttcctgaaggcggctgaggactatggggtcatcaagactgacatgttccagactgttgacctctttgaaggtagagaggaagaggctgggggaggaggygggcaggaggacagggtgctgggacagggagagggaatgaccagaatatgccacaactaggggtgtgcttgcccgcacacagcagggatgggatatgccgagaataacacgccacgctcacagggcccactgagaggcctcccttgaattggggacaactcttggccctggtttggccatttttttgtgagagacgggggcaggccctggcttggagtcttgtttatacgttcttgatgttcatctcctctctcctgtcttctcacaggcaaagacatggcagcagtgcagaggaccctg

SEQ ID NO: 85786 - DNA, 601 bp, Human
cgtcctatgccctatgcctggtagattctgagcaagctggtgaacagcctgtaccctgatggctccaagccggtgaaggtgcccgagaacccaccctccatggtcttcaagcagatggagcaggtggctcagttcctgaaggcggctgaggactatggggtcatcaagactgacatgttccagactgttgacctctttgaaggtagagaggaagaggctgggggaggaggtgggcaggaggacagggtgctgggacagggagagggaatgaccagaatatgccacaactaggggtgtgctygcccgcacacagcagggatgggatatgccgagaataacacgccacgctcacagggcccactgagaggcctcccttgaattggggacaactcttggccctggtttggccatttttttgtgagagacgggggcaggccctggcttggagtcttgtttatacgttcttgatgttcatctcctctctcctgtcttctcacaggcaaagacatggcagcagtgcagaggaccctgatggctttgggcagcttggcagtgaccaagaatgatgggcactaccgtggagatcccaactggtttatga

SEQ ID NO: 85787 - DNA, 601 bp, Human; identical to SEQ ID NO: 25537

SEQ ID NO: 85788 - DNA, 601 bp, Human; identical to SEQ ID NO: 25538

SEQ ID NO: 85789 - DNA, 601 bp, Human; identical to SEQ ID NO: 25539

SEQ ID NO: 85790 - DNA, 601 bp, Human; identical to SEQ ID NO: 25540

SEQ ID NO: 85791 - DNA, 601 bp, Human; identical to SEQ ID NO: 25541

SEQ ID NO: 85792 - DNA, 601 bp, Human; identical to SEQ ID NO: 25542

SEQ ID NO: 85793 - DNA, 601 bp, Human; identical to SEQ ID NO: 25543

SEQ ID NO: 85794 - DNA, 601 bp, Human; identical to SEQ ID NO: 25544

SEQ ID NO: 85795 - DNA, 601 bp, Human
caggctgtccacaaaaaagaccctccctctcattcagagccaactgatttttgtacactctttcttgcattttgagactctccaactttagtaccaagacccatctttgttcaggagccaactccttcatctgagggccttggagccccagacaaagaacacgtaaggaaaatgccaggccctccatgctctgggtttggagttaattctttccactcccacccactccccttgaggaacgggtctctcctccgctcctctggcccagggcttctcaaactccccacctctgttcctctarctgcagagtcagaggaagcatgacattttttctgcccttttgtgctttacctaaaaactttgcattttcttccagaacctacccacatttaataatttttagaaatagttttagtcacttaccataagaggaaaaaatggacattttcccacaaaacaatcaggtaaaactggcattgtgaaaataggaagcatatgtctccagtgctcctgggcccacctctgtgccccatggtactcgtaaatctccaaacatgccaccaccgccaccaccaccaccccacagcctacttctcagttt

SEQ ID NO: 85796 - DNA, 601 bp, Human
cagtgaatgtctgctcactccactagaatatctcctgccatctaaggaacactctccaagaaggtctcagggctagaggctatggcacacaagtacacttactctttcctcgccttctgaactcccaatcttttctcaggacttagaggacagtacacacacaactccaatctttcccttttttctcattcctcactttacttcttcattccagccttcttccttccctccacttctgtgtaattcccaaaccaggctgtcataacatcgccttcaaatcttcaaatctctctcccttctwctccaaaccaaagctcccaggctgtccacaaaaaagaccctccctctcattcagagccaactgatttttgtacactctttcttgcattttgagactctccaactttagtaccaagacccatctttgttcaggagccaactccttcatctgagggccttggagccccagacaaagaacacgtaaggaaaatgccaggccctccatgctctgggtttggagttaattctttccactcccacccactccccttgaggaacgggtctctcctccgctcctctggcccagggcttctcaaactcc

SEQ ID NO: 85797 - DNA, 601 bp, Human
tatggttactgtttccagtctatcactcctttagaaaaactcaagaaggaagaagggatccgtggtaatatttaaatcccaaaatcatactccaaggcgtggctggaaactggctgttcttctccctcaatgccttctttagaagattggcccctcccatacaaaagccctctaggctgtgattcatcatagctctccatgctcagcccctcccacaaaatgaaactgatcccttgtccctcctgaagatggatgacatcattaaagtatgggcttgatttagtggaatggaagatcacascttgggatcagaaattcagctacctagctacatcagccactatgtggtcttggcaaattcccttaactcccctatggctcagtcacttcatctgaaagttacagcatgctccaagaaaccctaagatgctctccagttctgaaattgtcagtggtggcagagcatggctagtccctactctcttcttcccagacaggagccccccaaaactgagaagtgactgggaaaatgctcagctacacacaggaattctgctagcctgcaaatcatttaaaatgaatgtttaataagacactgcat

SEQ ID NO: 85798 - DNA, 601 bp, Human
aaggcagagttttaaacaatgcaccgtgactgtttctttggagacaaataaactcaatgttcagctctaaatgaaacatgtggcagaagcacaagccatctatatatgttactaatggaaggaagggctgttcacctctcagacaatctcctttctaaatacatccccagtttctcaaaatacgaccttttaaaccaacttctcttggtatcacccaactcctctcaatatcaccgttccacatggggaccagacatataccccgatgttacctccactgagctctttgcttccctgccamcttgcctcatctccctacagttccaccagaatcacagagagtggccaatgtctccaagaccaactctgaaagtcccaacaacaatcaggagtatcgaatcccctcctccatttttgaaccaatggaccctttcattcttcttctctccaacccctcttaagtctctattctttatttctctggaaatgtcttttctcatcttcctcttgccctttcctgattccttttctcttcttactcttaagtgaggtcacattttggtccacatccccaaaacgcagtttcatcccaaaggagaga

SEQ ID NO: 85799 - DNA, 601 bp, Human
aacatcattttaacaggaggcagaggccttgtcaatctaggaaggttgaggctgtagtcataataccatttgcaagcgaggcaaggcagagttttaaacaatgcaccgtgactgtttctttggagacaaataaactcaatgttcagctctaaatgaaacatgtggcagaagcacaagccatctatatatgttactaatggaaggaagggctgttcacctctcagacaatctcctttctaaatacatccccagtttctcaaaatacgaccttttaaaccaacttctcttggtatcacccaamtcctctcaatatcaccgttccacatggggaccagacatataccccgatgttacctccactgagctctttgcttccctgccaccttgcctcatctccctacagttccaccagaatcacagagagtggccaatgtctccaagaccaactctgaaagtcccaacaacaatcaggagtatcgaatcccctcctccatttttgaaccaatggaccctttcattcttcttctctccaacccctcttaagtctctattctttatttctctggaaatgtcttttctcatcttcctcttgccctttcct

SEQ ID NO: 85800 - DNA, 601 bp, Human
tatgcagccataaaaaaggatgagttcatgtcctttgtagggacacggatgaagctggaaaccatcattctcagcaaactaacgcaaggacaaaaaaccaaacaccgcatgttctcactcataggtgggaattgaacaatgagaacacttggacacaggaaggggaacatcacacactggggcctgtcatggggtggggggaggggggatggatagcactaggagatatacctaatgtaaatgacgagttaatgggtgcagcacaccaacatggcacatgtatacatatgtaacaaacctrcacgttgtgcacatataccctagaacttaaagtaaaaataaaaataaaaataaaaaaagttaaaaaaatgtgtgtgtgtgtgttcattttaactgataaccaaattgactactattcttaccagcaggggcactatcatgttgccaatgtagaagtaaatataacacacgtgtgttctggatgactttaccaaatcaacatcattttaacaggaggcagaggccttgtcaatctaggaaggttgaggctgtagtcataataccatttgcaagcgaggcaaggcagagttttaaacaatgc

SEQ ID NO: 85801 - DNA, 601 bp, Human
ttcacttagacagggtcaaaatggccaagccaagataagattagaacttcatctacatcgagcattattttcacctcttatttattgattttaattttccttctttttttttttttttttttgagacaaagtctcactctgtcacccaggctagagcgcagtggcatgatgttggcttgctgcaacctccacctcccaggttcatgcaattctccctgcctcagcctcctgagtagctgggattacaggggcctgccaccacatccagctgatttttgtatttttgtagagatggggtttmagcatgttggccaggctggtcttgaactcctgacctcaggtgatccacccgccttggcctcccaaagtgctaggattacaggtgtgaaccacctcgctcagccttattttcacctctaatttagttatattgcaagactacccaatgatgcgagcaaaacattagcacctccattgtaaattaaattaacaccacaaaaatccaccacatttgcatgacatttcaattgttataaggctttgttattttcttcaatggtcaagtagacagacagaaggaaaatgtggcacatacacacca

SEQ ID NO: 85802 - DNA, 601 bp, Human
tgataactggcatggatggatatagctaaaatctgagcctcgtcttttcctgcatggagcaattaggaatatggggagaagtgatggggggtgagagggttaaggacactgagcagaagtgtaaagatctagcccatattctgggcttaccagggactattactgcagctggagtgtatttcacttagacagggtcaaaatggccaagccaagataagattagaacttcatctacatcgagcattattttcacctcttatttattgattttaattttccttctttttttttttttttttttgagacaaagtctcactctgtcacccaggctagagcgcagtggcatgatgttggcttgctgcaacctccacctcccaggttcatgcaattctccctgcctcagcctcctgagtagctgggattacaggggcctgccaccacatccagctgatttttgtatttttgtagagatggggtttcagcatgttggccaggctggtcttgaactcctgacctcaggtgatccacccgccttggcctcccaaagtgctaggattacaggtgtgaaccacctcgctcagccttattttcacctctaatt

SEQ ID NO: 85803 - DNA, 601 bp, Human
gtattacagttgcttacaatatttagtatagcattcatacagtagagtatgctgtagaggcttgtagcctaggagcaagagcctatagctcatagcctaggtgtgtaacagactataccacctaggtttgtgtaagtgcactctgtgatgttcacacgattaaatcacctaacgatccatttctcagaacgtgtcccaccatgaagcaacgcatgactatacatatgcatgtatattcagaaggagagaatagaaagaatgatggaaagaaagaatccaacagatagcggctgagattttytccagaattaaagaaaatcttgaatcctctaagaaagtccacagagggcaaagcacaataagaaaaaccatatatactataaaatcctgagcatgcaactaaatagataaaaggaaatacaccaaagtgtcagtaatgtttacccatggtgataggatttggagagagatttttatcttctttaaatttcaatgtatttcctaagtgctctacaatgaaaaggcattatttttatatgtctgcggaggagagaagcatttgtcatgtcaaatacacatatacagataaacagttttttaa

SEQ ID NO: 85804 - DNA, 601 bp, Human
cacaaagtgagaagagtttttcattatttataacacaaaaaaacagggaggtgtaaagaggaaccaattattatcttggaaataaagtatatccttgttgaaatctataactcaacagatagtcaaaataatagaccatccatgctgtttctttctaaaataaaataatagaccagacacaaatgaaatgatgtagttaactggagtatagaattgaagaaaccttcccaaacacagcacaaacagagaactggaaaaaaaaaaaaacaagatacatggagaattgactgagaaattacayatatatatatagtacagtcatgtgctgcataaggaggtttaggtcaacaatggaccacaagtacacaatgctggtcccataagattatattctaagtttttgctgtaccttttctgtgcttagatatgtttagatacacaaatactcaccaatgtattacagttgcttacaatatttagtatagcattcatacagtagagtatgctgtagaggcttgtagcctaggagcaagagcctatagctcatagcctaggtgtgtaacagactataccacctaggtttgtgtaagtgcactctgtg

SEQ ID NO: 85805 - DNA, 601 bp, Human
agggagttacatgcacaaagtgagaagagtttttcattatttataacacaaaaaaacagggaggtgtaaagaggaaccaattattatcttggaaataaagtatatccttgttgaaatctataactcaacagatagtcaaaataatagaccatccatgctgtttctttctaaaataaaataatagaccagacacaaatgaaatgatgtagttaactggagtatagaattgaagaaaccttcccaaacacagcacaaacagagaactggaaaaaaaaaaaaacaagatacatggagaattgaytgagaaattacatatatatatatagtacagtcatgtgctgcataaggaggtttaggtcaacaatggaccacaagtacacaatgctggtcccataagattatattctaagtttttgctgtaccttttctgtgcttagatatgtttagatacacaaatactcaccaatgtattacagttgcttacaatatttagtatagcattcatacagtagagtatgctgtagaggcttgtagcctaggagcaagagcctatagctcatagcctaggtgtgtaacagactataccacctaggtttgtgta

SEQ ID NO: 85806 - DNA, 601 bp, Human
actcctaagcctgtaccacaggccacgtagaatgggaagagagtacaaacctgagctgctgacatgggctctggcttaaaatacacaccctcacagacacagggcataagaaatcataaagttgccttgaaaataagttcacaaacaaaaattaaagaacatatgtgaacatccaactaactgactctacaaatgaaggacttcacaactgaagaaggaaagatgctagagcaatcagagaagaactttataatacatattttttagtctttgaagggacaggggagggagttacatgcamaaagtgagaagagtttttcattatttataacacaaaaaaacagggaggtgtaaagaggaaccaattattatcttggaaataaagtatatccttgttgaaatctataactcaacagatagtcaaaataatagaccatccatgctgtttctttctaaaataaaataatagaccagacacaaatgaaatgatgtagttaactggagtatagaattgaagaaaccttcccaaacacagcacaaacagagaactggaaaaaaaaaaaaacaagatacatggagaattgactgagaaattacatat

SEQ ID NO: 85807 - DNA, 601 bp, Human
aaggagccaaaatgaagtcacctacatgagatggactcctaagcctgtaccacaggccacgtagaatgggaagagagtacaaacctgagctgctgacatgggctctggcttaaaatacacaccctcacagacacagggcataagaaatcataaagttgccttgaaaataagttcacaaacaaaaattaaagaacatatgtgaacatccaactaactgactctacaaatgaaggacttcacaactgaagaaggaaagatgctagagcaatcagagaagaactttataatacatattttttartctttgaagggacaggggagggagttacatgcacaaagtgagaagagtttttcattatttataacacaaaaaaacagggaggtgtaaagaggaaccaattattatcttggaaataaagtatatccttgttgaaatctataactcaacagatagtcaaaataatagaccatccatgctgtttctttctaaaataaaataatagaccagacacaaatgaaatgatgtagttaactggagtatagaattgaagaaaccttcccaaacacagcacaaacagagaactggaaaaaaaaaaaaaca

SEQ ID NO: 85808 - DNA, 601 bp, Human
ccatggaggataggtccaatatgagccatgagaacagaggtgtcaatgtccatccagggaaaaaggggaagaactggacctagaatcaggctgctagctgtggatggtgctggaacatctgcaccatccaccattagtcacagccaaaaagcaggaccctatctgtgtcaaggagccaaaatgaagtcacctacatgagatggactcctaagcctgtaccacaggccacgtagaatgggaagagagtacaaacctgagctgctgacatgggctctggcttaaaatacacaccctcacagayacagggcataagaaatcataaagttgccttgaaaataagttcacaaacaaaaattaaagaacatatgtgaacatccaactaactgactctacaaatgaaggacttcacaactgaagaaggaaagatgctagagcaatcagagaagaactttataatacatattttttagtctttgaagggacaggggagggagttacatgcacaaagtgagaagagtttttcattatttataacacaaaaaaacagggaggtgtaaagaggaaccaattattatcttggaaataaagtatatccttgttg

SEQ ID NO: 85809 - DNA, 601 bp, Human
caaacgcaaagggcaggacaagtgtgaggtactgaaaaggatgcccctatggagcacaaatgaatattattaatggtggaaaaagagagaaattgttaaaataattgtggtatgaactgaacactctgcagccattgaaaatcaagtttaagaagtctatgtagtgataaaggaaaattccaagaatacataatcaagtttaaaaaaatatataaaagcaggttgtgaaataaaacggggtcaaaatccgagtgaacacactcagtaaccttccttttctgctcctaagacatagaatttwtaaagaaacctttagttatttttaaatttacatagtattgcttgcaaataagaaaagagaatcacagatcaaaaatagagagtaatccctaaaaataaatgaactgaaagacgggactctagggtttcaagtaggaatcaaagccacataatccatggaggataggtccaatatgagccatgagaacagaggtgtcaatgtccatccagggaaaaaggggaagaactggacctagaatcaggctgctagctgtggatggtgctggaacatctgcaccatccaccattagtcacagccaaa

SEQ ID NO: 85810 - DNA, 601 bp, Human
ggaactacctgatgcctctttagcaggagctgagtgggctccaccaacattccgatctgtgcgtctgcccttttcgagagctctcagtgtttaatgggaaggcccatcactcgcatccaaactctggagctgccaggttacaagagcaccaacttccacctcctgctgatgagctgttactcagcagttctctacaggcctttcgtatgtaaccccccaatttatgctaatcctcaggatggctggtaattatctgcccactagagagaagagaaaaattggcaaacacctatgaaatcastcagcattgagggaacaaacactgcacgaatgccctgaaccatattgtgatatgttcatccggaagctccaacaagctggcatcggagccaatgactagattcattcaatcaacaaacatttaccgtgtaacaaacgcaaagggcaggacaagtgtgaggtactgaaaaggatgcccctatggagcacaaatgaatattattaatggtggaaaaagagagaaattgttaaaataattgtggtatgaactgaacactctgcagccattgaaaatcaagtttaagaagtctatgtagtgata

SEQ ID NO: 85811 - DNA, 601 bp, Human
cagtagcattttccatctgaggctatgagaaagaagataaacaccgctgcaaacccaccagaccacagctcttcagggcccaaacgattgtcagcaacccctgagggctacttggagtgtgagtcacgctaccgggaggacgcctgttggtctctgatgacttaagtgaggaggtgttgatgatcgcatctgacatgcctcatggaaaagactaaagataggtctccccactctcccaggaactacctgatgcctctttagcaggagctgagtgggctccaccaacattccgatctgtgcrtctgcccttttcgagagctctcagtgtttaatgggaaggcccatcactcgcatccaaactctggagctgccaggttacaagagcaccaacttccacctcctgctgatgagctgttactcagcagttctctacaggcctttcgtatgtaaccccccaatttatgctaatcctcaggatggctggtaattatctgcccactagagagaagagaaaaattggcaaacacctatgaaatcagtcagcattgagggaacaaacactgcacgaatgccctgaaccatattgtgatatgttcatccg

SEQ ID NO: 85812 - DNA, 601 bp, Human
attttcttttcaatgggatgtcttccaactttaaaatgttggcaaagaattagaagttgaaagatcaagggtgggggatgcaggacaaacaaaagacaccaattaataaccttataatgtctcatttatgtgatgacttatcagaggctaccaactctctattacaaaccagagattcagttcctgtttctcttctgcacagccctctttctctctctttccccactcactctgcctacagtagcattttccatctgaggctatgagaaagaagataaacaccgctgcaaacccaccagaycacagctcttcagggcccaaacgattgtcagcaacccctgagggctacttggagtgtgagtcacgctaccgggaggacgcctgttggtctctgatgacttaagtgaggaggtgttgatgatcgcatctgacatgcctcatggaaaagactaaagataggtctccccactctcccaggaactacctgatgcctctttagcaggagctgagtgggctccaccaacattccgatctgtgcgtctgcccttttcgagagctctcagtgtttaatgggaaggcccatcactcgcatccaaactct

SEQ ID NO: 85813 - DNA, 601 bp, Human
atctaactcaaagtacaatacattaaccacttgataatgacattctttaaaagattaaagcagccatgagtctaccaccccaaagataactgctattcatattttggtatgtttgttgccagtctttccttgatgaggcacaaaattttcagagctggaagagatcttagtgataattttgtcccaaatcctcattttgcaggagaaccagaggttcagacaggtgaagggccttttctaaggtcacacaggtatttttgaaaattgaatttcattcttcagactctttgtccaaggtttycttggatcttccaactcaagttgattcatcatggctgcctggagtactgtgttgagaaggccttaaggccagtgggctcaacagggccaggtgttataggagattaatgatggcagcagtgaacatggcatccatggttgcatacatgccatagatctgccgtcttatccaggagcagcccctggaagagctacttccctcacctacatcataggcctcacagccaagtgccttcaggatactgtgtatgtaacataaatgagtgaagtgaagtgaagtgaagtgactttggggaattta

SEQ ID NO: 85814 - DNA, 601 bp, Human
ctttctggttattaaaaagtacatgtacactggagaaaaataaaaactaaaaaatgcagacacaataacaatagcattcctgtaataagcatttattataaggtaggcactgagacatggactaatatccatgatgtcatttaaatctcacaactctacaaagtggatgctattattgttcccattttagagatgaagacattgaggctcaagatattaagaacttccccatgatcacccagccagtaagaggtggaatccctgaatttaaattcaggcaatctaactcaaagtacaatayattaaccacttgataatgacattctttaaaagattaaagcagccatgagtctaccaccccaaagataactgctattcatattttggtatgtttgttgccagtctttccttgatgaggcacaaaattttcagagctggaagagatcttagtgataattttgtcccaaatcctcattttgcaggagaaccagaggttcagacaggtgaagggccttttctaaggtcacacaggtatttttgaaaattgaatttcattcttcagactctttgtccaaggttttcttggatcttccaactcaag

SEQ ID NO: 85815 - DNA, 601 bp, Human
caaaggtcaatgagatagtcttctcctacgatcactttcatgctggccacatttagcttccgtttgccaggataaagctctcagcaagtcctacaaaggcaaaggaagcttctgattgtctcagttaagaaaatacaaatcatttcatgttagaccctccacttctgacagttctgtgggattcactcccagtttctttcagagcataccctcatgtaaccacatcatccttaatcactctttctggttattaaaaagtacatgtacactggagaaaaataaaaactaaaaaatgcagacrcaataacaatagcattcctgtaataagcatttattataaggtaggcactgagacatggactaatatccatgatgtcatttaaatctcacaactctacaaagtggatgctattattgttcccattttagagatgaagacattgaggctcaagatattaagaacttccccatgatcacccagccagtaagaggtggaatccctgaatttaaattcaggcaatctaactcaaagtacaatacattaaccacttgataatgacattctttaaaagattaaagcagccatgagtctaccacccca

SEQ ID NO: 85816 - DNA, 601 bp, Human
ttacagctttgaacaatgcacaaattactgcaactcccagatcctttatttcctcatctgaaaatagagattctttaaacaaataccgttggagctgccaggttccccaggctatcactgagttattaatccttggcagagataaaatgagaaactatatatgtccacactctaaatccctaagcctcgtgcaaacatatggtccagttggtggagtcatttagtgcaaaggtcaatgagatagtcttctcctacgatcactttcatgctggccacatttagcttccgtttgccaggatamagctctcagcaagtcctacaaaggcaaaggaagcttctgattgtctcagttaagaaaatacaaatcatttcatgttagaccctccacttctgacagttctgtgggattcactcccagtttctttcagagcataccctcatgtaaccacatcatccttaatcactctttctggttattaaaaagtacatgtacactggagaaaaataaaaactaaaaaatgcagacacaataacaatagcattcctgtaataagcatttattataaggtaggcactgagacatggactaatatccatgatg

SEQ ID NO: 85817 - DNA, 601 bp, Human
gactccatcacttcaatctgaagttttgaattttaattccatcatccaacatcttaatccttttagtcaagacaaccaaaatatgaacatcaaaatctgttatttgtcttgcatctgagccccttccctaaatcaaatgtattcgtagtcattaacttgaaagggtaataaaataagagcaaaagaataagaacccaaagccctaggttctagttacagctttgaacaatgcacaaattactgcaactcccagatcctttatttcctcatctgaaaatagagattctttaaacaaatacckttggagctgccaggttccccaggctatcactgagttattaatccttggcagagataaaatgagaaactatatatgtccacactctaaatccctaagcctcgtgcaaacatatggtccagttggtggagtcatttagtgcaaaggtcaatgagatagtcttctcctacgatcactttcatgctggccacatttagcttccgtttgccaggataaagctctcagcaagtcctacaaaggcaaaggaagcttctgattgtctcagttaagaaaatacaaatcatttcatgttagaccctccac

SEQ ID NO: 85818 - DNA, 601 bp, Human
gggacggtggcttatgcctgtaataccagcactttgggaggccaagggaagaggattgcttgagtccaggagttcaagaccagcctgggcaacatggtgagacccccgtctctaccaaaaatttaaaaattagccggatatcatggcacacgcctgtgttcctagctacttgggaggctgagatgagaggatcacctaagcccaggaggttgaggctgcagtgaactatgatcatgccactgcactccagcctgggcaacagagtgaaacactgttttctttaaaaaaaaaaaaaaaaaaattgtgttgtacacctttaatatatacaatttttctttgtcagttaacctcattaaagctgagtgcggtatggggggaacctccagtgcagtctttagagtgactccatcacttcaatctgaagttttgaattttaattccatcatccaacatcttaatccttttagtcaagacaaccaaaatatgaacatcaaaatctgttatttgtcttgcatctgagccccttccctaaatcaaatgtattcgtagtcattaacttgaaagggtaataaaataagagcaaaagaataagaacccaaag

SEQ ID NO: 85819 - DNA, 601 bp, Human
aaaaatatattgtatacaggcaatttgctaagataccacatcttaagtaatctcatcacacaataaatgtaaccatgtgaggtaatggatatgttaattagtttgatggtgacaatcatctcacatttacttgtatatcagaatatcatttggggctggggacggtggcttatgcctgtaataccagcactttgggaggccaagggaagaggattgcttgagtccaggagttcaagaccagcctgggcaacatggtgagacccccgtctctaccaaaaatttaaaaattagccggatatcrtggcacacgcctgtgttcctagctacttgggaggctgagatgagaggatcacctaagcccaggaggttgaggctgcagtgaactatgatcatgccactgcactccagcctgggcaacagagtgaaacactgttttctttaaaaaaaaaaaaaaaaaaattgtgttgtacacctttaatatatacaatttttctttgtcagttaacctcattaaagctgagtgcggtatggggggaacctccagtgcagtctttagagtgactccatcacttcaatctgaagttttgaattttaattccat

SEQ ID NO: 85820 - DNA, 601 bp, Human
aagaccaacccctcctcttcctcctcctcctcagcctcctcaatgtaaagacaaggatgaagacctttatgatgacccacatccacttgaatagcaaacatattttcttccttacgattttccttatgatcttcttttctatggcttacttaagaatctactatataatacatatagcatagaaaatttgtattaattgactgtctatgttattggtaaggcttctgatcaacagtgggctatagtttatgggaatcaaaagttatacatggattttaaactgcatgggggttaatgcaastagcgcctgcattattcaaggatcaactgtgtttaataaaccaataaataaatcaaatccaaggaagtctatgaaagggtttcagagggtctgtgatcccctgaaattgcacataattttgactgcatgtttatgaacacgcactcctctggaagggtccgtagccttcattagattttaaagtggtccccaactccccccaaaatcaccccaaattatcttaaattctttgagtgagtttgtgagccaagcttcaaggtgtcagtgatttttggaaatcacaacttacattttagagtg

SEQ ID NO: 85821 - DNA, 601 bp, Human
aaaatgctctcagccctacctccctttttcagggcatggttaatatatggcagaggagacagccatcctgtgtccttttctaaacagttccctgagaaaacttctgcatacacgttggcataaatgacacgtgagatctcgctgatatcctggctggtgtgcactggtgcagcagaactggttatttaaaggctgaaatgcttccgttttgcttgtgaatagccacatcttccaggaaccccaagtgccccctgccactcagcccctcccttgggaaccccctacctccccataaccagcyactaaaggattaacacctcacataacaggtgctccagaattctacaaagtgagtgtctattctgattcagctgtgataatgctgtagtggttaaatattttgagtattcctcacagctgttaatatcaaacataaatctctcccacttttgtttaaaactcattttactgccccctgccacctgggcaatatccctttcctatcacaaggcagttcttgttacaaccttgtggggattcaatcagactggtgggaaaaattttggttatagagaatagccacaaaccttcttggaaggcc

SEQ ID NO: 85822 - DNA, 601 bp, Human
atttaattatatttgcaaagtccctttagccatataaggttagtattcacaggttccaggaattagaatgtggatgtctttgggtggggaagagggggtggtggggacatgattctgcctaccacaccccctaggactatttgagtaaaaattcctgagaagcattgaacctagaagtcctagaagggttttaggaaggattctaagacagggactcagttcctcaaagcaggagcctagtgtccagaaagggagcccacatgagaagaacaaagtcagtgttagagcaggtggaggtctsggttctgagctgaggtgtcttgactccactgaggctcagttacagaagaggagtgaggagaagccttggaattaagctctaactacctcccaacctctctgtattcattttcccaggctgctgtaacaaaggatcacagtctttattacagcaaagatggtttaaacaacagaaatgtaatttgttcacagttctcaaagctagaagtctaagacaagggagctgcaggattgctcctctgaaaactgtctccttggcatacagatggccatcctctccctgtgtcttcacatggtcctc

SEQ ID NO: 85823 - DNA, 601 bp, Human
agaggaggacctatctccttgccttctccagcttctggaggatgctggcattccttggattacagccccttcctccatcttcaaagtgcatcactccaatctctgcttctgttgccacatctgcttctctgactctcacctccctgcctccctttcataaggaatgattataaattggactcacctaggctaatccagaacagtctctccatttcaagatccttaatttaattatatttgcaaagtccctttagccatataaggttagtattcacaggttccaggaattagaatgtggatrtctttgggtggggaagagggggtggtggggacatgattctgcctaccacaccccctaggactatttgagtaaaaattcctgagaagcattgaacctagaagtcctagaagggttttaggaaggattctaagacagggactcagttcctcaaagcaggagcctagtgtccagaaagggagcccacatgagaagaacaaagtcagtgttagagcaggtggaggtctgggttctgagctgaggtgtcttgactccactgaggctcagttacagaagaggagtgaggagaagccttggaattaa

SEQ ID NO: 85824 - DNA, 601 bp, Human
tattttagatagataatatatattattttatagatagctaaatgatacacaaatatattattctttgtgagagagaatatcaaagctcaaattccatcccagatcgcctaactcaaagctccacatttttgcaatacaaactatcgttctcattatgtggaacccacccaaagaaggccagatattaaagctgtaagagcatttagcccaactttcttacttgcaggagaaactgaatttcagagtttgccgcaagtcaaggaatgcagttctggaagctagtaaaggaaaggaaacagaytcttccccagagtctccagagggagcacagctttgctgacaccttcattttggtgcagggaacctgatttcagacttctgccctccagggctgtaagagggtaaaagtgcgtttccttcagccaccatgtttgtgatgataatttattacagcagctgtagtaaactaatacaatcctggacctagccccttctcctaactcactattttgtttgaacatctactaagtacctactctccctcaaaacaatgttctgagtgctggaagtatagaatgatgaagtcatcaatacaagcggg

SEQ ID NO: 85825 - DNA, 601 bp, Human
accagcagtgtcaccaaaaataagcttctgtgattccctgggcttcactttcctcctctctacaatgagggtggtggtcctcggatccctgcctgcaacactctgcctgcacatcagggagctcaatatacatccgtccctcatgttccttccaagcaaggaaggcttggacaacaggaataccattgacagagagaagaaatccagaataagcatgaatcaaagaggacaggcctgggcaggttcagtgtgaggcacccatggccatgtcaaggagagaagcccaccaagcacctagggraacaggtcaggaacccagggcaagaggttgaggctacaactgtagattgtggaggcatctgcaaagctccaactactaaggactatatctagagaagaggagctgatgggatgcttggagggctctcgcctgtacagaggtgtaggtcccccaagcatgcaaaaggcagatcatcatcaatgaggctggagtgactcctgacttccaagaagcagcggagtctgtcaaggagtggaccttagcccaatcccattttacagatgaggaaaggtaaggtccagaagggagagaggaaggaag

SEQ ID NO: 85826 - DNA, 601 bp, Human
ggttgtggagtcaggagacctgagttcagggcccagctctgttacctgcctaccagcagtgtcaccaaaaataagcttctgtgattccctgggcttcactttcctcctctctacaatgagggtggtggtcctcggatccctgcctgcaacactctgcctgcacatcagggagctcaatatacatccgtccctcatgttccttccaagcaaggaaggcttggacaacaggaataccattgacagagagaagaaatccagaataagcatgaatcaaagaggacaggcctgggcaggttcagtrtgaggcacccatggccatgtcaaggagagaagcccaccaagcacctaggggaacaggtcaggaacccagggcaagaggttgaggctacaactgtagattgtggaggcatctgcaaagctccaactactaaggactatatctagagaagaggagctgatgggatgcttggagggctctcgcctgtacagaggtgtaggtcccccaagcatgcaaaaggcagatcatcatcaatgaggctggagtgactcctgacttccaagaagcagcggagtctgtcaaggagtggaccttagcccaatc

SEQ ID NO: 85827 - DNA, 601 bp, Human
tgttatgtgtattatatcacaataaaaaattagtcaaagtggccaaaatgttgtgaaggtgccatggaaggaaacaaaacttaagaaattcttctgatcaaaaaaacagaggttgtggagtcaggagacctgagttcagggcccagctctgttacctgcctaccagcagtgtcaccaaaaataagcttctgtgattccctgggcttcactttcctcctctctacaatgagggtggtggtcctcggatccctgcctgcaacactctgcctgcacatcagggagctcaatatacatccgtccytcatgttccttccaagcaaggaaggcttggacaacaggaataccattgacagagagaagaaatccagaataagcatgaatcaaagaggacaggcctgggcaggttcagtgtgaggcacccatggccatgtcaaggagagaagcccaccaagcacctaggggaacaggtcaggaacccagggcaagaggttgaggctacaactgtagattgtggaggcatctgcaaagctccaactactaaggactatatctagagaagaggagctgatgggatgcttggagggctctcgcctgtacagag

SEQ ID NO: 85828 - DNA, 601 bp, Human
tcactcttgggtataaatccaaaagaattgaaaacaggtgttcaaacaaaaacttgtacataaatgtttatagcagcaccattcacaatagctaacagatggaaacagcacaaatgcccatcaatggttgaatagataaattaaatatagtatatccatacaatggaatattattcagccatgaaaaggaataaagtactgattcatgctacgacatggatggaccttgaaaacattatgctaagtgaaagatgccagatgcaaaaggtcacataacagacgatcccatcccatctagaaygagtaaatccacagatacagaaagcagattaaaggtttccaggagctggaggggtggggaaatagatcgtaactgcttgatggttactggtctccttttggagtgatgatgttctggacctagatggaggtgctggtcacacaacattgtgaacgtactaaacgccactgaattgttcactttaaaatgtttagaatggcagattctatgttatgtgtattatatcacaataaaaaattagtcaaagtggccaaaatgttgtgaaggtgccatggaaggaaacaaaacttaagaaattct

SEQ ID NO: 85829 - DNA, 601 bp, Human
tctataaaactatcagatctcatgagaattcactcactcactatcatgagaacagcatgggggaaacagcccccacgatcaatcacttcccttcttcaacacttggggattgcaattcgagatgagatttggatgaggacacagagccaaaccatatcatatgctaagtgagacttggcaggaacagtagtttgttatattttaatattactactgtaatctttatttttggtttttttactagtggcaagattttgtttgtttatttgattgttagtttgctgttatcttctgcttatcrtaagtgaaactggttttcattattggcagtgatataccattctcttttaaactatatttatttttatttatttatttatttattttttgagacaggatctcactctgtcaccaaggctggagtacagtggcccaatcacagcccactgcagcctcaacctcctgggctcaggtgatcctactacttcagcctctcgagcagctgggaccacaggcatgtgccaacacacccggctaattttcatattttttgtagagacaggattccaccatattgccgaggctagtcccagactcctgg

SEQ ID NO: 85830 - DNA, 601 bp, Human
ccaaaagtaaagatggaggtgggaggaagaactcagcgatggagctagaactatgggcacgtgaaagaaagaacaagttatctaattcacctgatgggtgcactgtgggagacagagcctggtggtgatggggggcagactgaggtgattcttggatgcctggctaagggtttagaatttaccctgaatataatgttgatatcaccaaagctttaagagtggagagtaacatgtccaatgcgccccttgagtaggagagcttcccgtataagcaggaaactcagaagactggaatcaaagytcaggtggaaggtgataaggaccaggtgccagggatggagacgaaccaagagttgggcagtggaagaatggaaaacaccagagggccaggtatagtgtcagagattgttttatgtcttacttagatgagacacaaaataatattaaaagtatgcaggataaaactctgattatctttcaatccttctaattagtcagtgaggaagtctcatcttggtgctaataggtcttcaacacctttctaacacttgctaattatttaaaggagacaataatatactgtattagtccattctcacac

SEQ ID NO: 85831 - DNA, 601 bp, Human
caagtaggcacagatttgctctttcaacccacgtatactgggcactgaggggaggaagatgaaaatggctacagcaagggtatagaagaggaataaattcacagtcatgtggggaggccattctgtctgtcttctggcataaaaaaagactgagtgcataggaggcagaaggcgattgcttcaagcctaagaaatggaaaaggcaccttggagaacttgacacttaaaacttaaaggacttaaaggcaaagcgggactaacaatgacatgtttcacacttgtatttcttcttacagttttsagggttttcatacaccttatttcattcgatcctaataagaaccctgagaggtagatttcaactgtgctttccaaaagtaaagatggaggtgggaggaagaactcagcgatggagctagaactatgggcacgtgaaagaaagaacaagttatctaattcacctgatgggtgcactgtgggagacagagcctggtggtgatggggggcagactgaggtgattcttggatgcctggctaagggtttagaatttaccctgaatataatgttgatatcaccaaagctttaagagtggagagtaac

SEQ ID NO: 85832 - DNA, 601 bp, Human
agacttattcactatcacgaaaacagcacgggaaagacctgcccccatgattcaattacctcccactgaatccctcccaggacacatgaggattatggaagctacaattcaaggtgagatttaggtggggacacagccaaaccatatcaagttcaaaggctcaaaggacttcaaaagaaggggcaagaataaataatcgcacagaaatccattttaagtggtaggagggaccctggacgatgaaaagggtgatctagcccagggtccaggaaaactgtcaggcttcctgcccatctgcccmctctgcacctgcacgcatacctgacttctttctccctagaagagctcctgtcccccacagtgattttcaactctcttgctatgcatgaggtcagccatttcatggctccacccaaatcttctgatgcaaaagtggaatggactcatgccataatgctgggctgcctgatcatcgcatgtggtcagctgtgtagcagaatataaattttaaaaacccaaacgattaaactgtcacttcctattagacaaagcacattccaagatgcaactaatgagggaagagaaataaggaaagaaagta

SEQ ID NO: 85833 - DNA, 601 bp, Human
agaaggcaaatgagaagcaaggtcacatcttacatggcaagagagcatgtgcaggggaactcccatttataaaaccatcagatcttgtgagacttattcactatcacgaaaacagcacgggaaagacctgcccccatgattcaattacctcccactgaatccctcccaggacacatgaggattatggaagctacaattcaaggtgagatttaggtggggacacagccaaaccatatcaagttcaaaggctcaaaggacttcaaaagaaggggcaagaataaataatcgcacagaaatccaytttaagtggtaggagggaccctggacgatgaaaagggtgatctagcccagggtccaggaaaactgtcaggcttcctgcccatctgcccactctgcacctgcacgcatacctgacttctttctccctagaagagctcctgtcccccacagtgattttcaactctcttgctatgcatgaggtcagccatttcatggctccacccaaatcttctgatgcaaaagtggaatggactcatgccataatgctgggctgcctgatcatcgcatgtggtcagctgtgtagcagaatataaattttaaa

SEQ ID NO: 85834 - DNA, 601 bp, Human
agcaatcagggcaatggtttttgtcatattttatcaagccaacaagaacaagtgttgtataaaaaacagaaggggagtcttctgatcaaatagatttgggaaacattcgttcaaacagcaggaaataagtttaaaccgtgtctgtagcgcaggacttctcagagctttgaagaggctcatgtgcattgtaaatatctgaggatcccatgatgtacagcatctcttaaatttattttggcttaaacttttttctgtagggtcatattcctcagagccctctttgggaaagtctagagcaaaytgcaaaatgaggagagaactgagttgaagctcaaaaggtcagcaggggtcagaaatcagggatttgtgcagccaggagtttacattttatctgaaggcaatgcagtgcacatggtgagtttgcaggaagaagttttattaccatcccccatcacagaaaatgaatatccttgttggtcttttcatcagcaccagtaatcaacatctgatgggccaggagacccatgggactggtactcaggaagcagtgtgtccctcagcaagtccctgagcctctctgagcctcatatttcacatctgt

SEQ ID NO: 85835 - DNA, 601 bp, Human
cacctaatcctgtgggggacagcagtccaaggtttctcagagggcatggcttctgagatgagttttgaaggatatgagacagacagaaatagcagcacagacaagtgccagaaaatgtgaaagaggcacatttagagcaatgtgggtttttgttatattttagcaatcagggcaatggtttttgtcatattttatcaagccaacaagaacaagtgttgtataaaaaacagaaggggagtcttctgatcaaatagatttgggaaacattcgttcaaacagcaggaaataagtttaaaccgtktctgtagcgcaggacttctcagagctttgaagaggctcatgtgcattgtaaatatctgaggatcccatgatgtacagcatctcttaaatttattttggcttaaacttttttctgtagggtcatattcctcagagccctctttgggaaagtctagagcaaactgcaaaatgaggagagaactgagttgaagctcaaaaggtcagcaggggtcagaaatcagggatttgtgcagccaggagtttacattttatctgaaggcaatgcagtgcacatggtgagtttgcaggaagaagttttatt

SEQ ID NO: 85836 - DNA, 601 bp, Human
tgaggacagctgggaagctaaatcaacaaataaattatcagaatgcaggagctacaaaagtataggaacggcacctaatcctgtgggggacagcagtccaaggtttctcagagggcatggcttctgagatgagttttgaaggatatgagacagacagaaatagcagcacagacaagtgccagaaaatgtgaaagaggcacatttagagcaatgtgggtttttgttatattttagcaatcagggcaatggtttttgtcatattttatcaagccaacaagaacaagtgttgtataaaaaacaraaggggagtcttctgatcaaatagatttgggaaacattcgttcaaacagcaggaaataagtttaaaccgtgtctgtagcgcaggacttctcagagctttgaagaggctcatgtgcattgtaaatatctgaggatcccatgatgtacagcatctcttaaatttattttggcttaaacttttttctgtagggtcatattcctcagagccctctttgggaaagtctagagcaaactgcaaaatgaggagagaactgagttgaagctcaaaaggtcagcaggggtcagaaatcagggatttgtg

SEQ ID NO: 85837 - DNA, 601 bp, Human
cctgaactgtgtgcctgggtagaggaggctcagtacatgtttatggaatgactcactgaacacattaacacataagacactgttcctgtcctcactgaggacagctgggaagctaaatcaacaaataaattatcagaatgcaggagctacaaaagtataggaacggcacctaatcctgtgggggacagcagtccaaggtttctcagagggcatggcttctgagatgagttttgaaggatatgagacagacagaaatagcagcacagacaagtgccagaaaatgtgaaagaggcacatttaragcaatgtgggtttttgttatattttagcaatcagggcaatggtttttgtcatattttatcaagccaacaagaacaagtgttgtataaaaaacagaaggggagtcttctgatcaaatagatttgggaaacattcgttcaaacagcaggaaataagtttaaaccgtgtctgtagcgcaggacttctcagagctttgaagaggctcatgtgcattgtaaatatctgaggatcccatgatgtacagcatctcttaaatttattttggcttaaacttttttctgtagggtcatattcctcagag

SEQ ID NO: 85838 - DNA, 601 bp, Human
caaatgtgagctgaagcccttaagagccagcgtatgactcaccacatccccctccccacctacaccacaacaaccagccatgctccatctggtcccacaagtgaggcgatatggcgcagaagtcgtagccaaccctcggtgggcacgttgcatgaacgagaaataagcctttattgttataagccattaagatacaggggctgtttgtgcagcagggcctcatccatcctagctgatccagctttcctgaaaccctatcttaaagggcatctcctgtcactttcagtctctttaccctgcyttgcctgtggcacttaatgcaatctaacattatatatttaccgtgtttatattttgtccccatcccctggaatataagtttgataagggcagggacattgttcccccagcatcctcagtgccctgaactgtgtgcctgggtagaggaggctcagtacatgtttatggaatgactcactgaacacattaacacataagacactgttcctgtcctcactgaggacagctgggaagctaaatcaacaaataaattatcagaatgcaggagctacaaaagtataggaacggcacctaatcctgt

SEQ ID NO: 85839 - DNA, 601 bp, Human
ttcgcaagtgctgtttcctccaccctcctcccacgtattcacaaggctcccctcctttctgcattaaggtctctgtgcaaaagtcctcatgtcagagagggttcctgtgcattcattaatgctgtccaccccacagtccagttttcctctcgttccaggcacatggcaggagagccctttcctggccccttgaatcagttgtggcaatcaaatgtgagctgaagcccttaagagccagcgtatgactcaccacatccccctccccacctacaccacaacaaccagccatgctccatctggkcccacaagtgaggcgatatggcgcagaagtcgtagccaaccctcggtgggcacgttgcatgaacgagaaataagcctttattgttataagccattaagatacaggggctgtttgtgcagcagggcctcatccatcctagctgatccagctttcctgaaaccctatcttaaagggcatctcctgtcactttcagtctctttaccctgctttgcctgtggcacttaatgcaatctaacattatatatttaccgtgtttatattttgtccccatcccctggaatataagtttgataagggcag

SEQ ID NO: 85840 - DNA, 601 bp, Human
ttttgctgtgaacctaagactgctcttaaaaataaagtctgaaaaatgctgcatagctttccctccctctgccaaccagtccacaagtactggatatattggccatccatcacttgccaggcagtatctaggtgctggggggactctatgaaggggatatgctcctgcccaggtggagtttagcagggaatctggacagtgatgaagtcatttcaaatatgataaacccatcaggtatacacaaggagaaaagctaattttcatttttataggtattttataaacatttttctaaacactstactatagttagggtgattttacatatttctgccttgtttcttgtgctagaacataagatcctggccttgagtcagaggacaagtcaaaataaattttgtagccagagctaagttcagtatactgactctaagtcctataattgagactccaataccaaacaatctttgtttgggctggttagaattttccactcttacaaatgaacactcacctcatctagacctgccacttggacaactgagacggaaagatctccttaatgcagcatgtcctggaattcaagatattcattcaacaa

SEQ ID NO: 85841 - DNA, 601 bp, Human
agttggtactattctggtgggggatgtggatcacagggatggctattcatgtgtagggcagggggtatttgggatatctctgtacattctgttcaattttgctgtgaacctaagactgctcttaaaaataaagtctgaaaaatgctgcatagctttccctccctctgccaaccagtccacaagtactggatatattggccatccatcacttgccaggcagtatctaggtgctggggggactctatgaaggggatatgctcctgcccaggtggagtttagcagggaatctggacagtgatgragtcatttcaaatatgataaacccatcaggtatacacaaggagaaaagctaattttcatttttataggtattttataaacatttttctaaacactctactatagttagggtgattttacatatttctgccttgtttcttgtgctagaacataagatcctggccttgagtcagaggacaagtcaaaataaattttgtagccagagctaagttcagtatactgactctaagtcctataattgagactccaataccaaacaatctttgtttgggctggttagaattttccactcttacaaatg

SEQ ID NO: 85842 - DNA, 601 bp, Human
ggcgataattttgtgtccatgtaggcctatcagttgtaacaattaatattgttacaagttggtactattctggtgggggatgtggatcacagggatggctattcatgtgtagggcagggggtatttgggatatctctgtacattctgttcaattttgctgtgaacctaagactgctcttaaaaataaagtctgaaaaatgctgcatagctttccctccctctgccaaccagtccacaagtactggatatattggccatccatcacttgccaggcagtatctaggtgctggggggactctaygaaggggatatgctcctgcccaggtggagtttagcagggaatctggacagtgatgaagtcatttcaaatatgataaacccatcaggtatacacaaggagaaaagctaattttcatttttataggtattttataaacatttttctaaacactctactatagttagggtgattttacatatttctgccttgtttcttgtgctagaacataagatcctggccttgagtcagaggacaagtcaaaataaattttgtagccagagctaagttcagtatactgactctaagtcctataattgagac

SEQ ID NO: 85843 - DNA, 601 bp, Human
tgacattctggaaaaggcaaaactatggagacagtgaaaagatcagtggttgccaggaggtaggggcttagggaagaataaataggtagaacatagatgattttttttcatgaaattactctgtatgtcactatagtggtggatacaagtcattatgcatttgttcaaacccatagaatgtacaacaccaagggtgaattttaatgtatactatggactttaggcgataattttgtgtccatgtaggcctatcagttgtaacaattaatattgttacaagttggtactattctggtggggkatgtggatcacagggatggctattcatgtgtagggcagggggtatttgggatatctctgtacattctgttcaattttgctgtgaacctaagactgctcttaaaaataaagtctgaaaaatgctgcatagctttccctccctctgccaaccagtccacaagtactggatatattggccatccatcacttgccaggcagtatctaggtgctggggggactctatgaaggggatatgctcctgcccaggtggagtttagcagggaatctggacagtgatgaagtcatttcaaatatgataaac

SEQ ID NO: 85844 - DNA, 601 bp, Human
aaaggttacatactgtatgattccaactatatgacattctggaaaaggcaaaactatggagacagtgaaaagatcagtggttgccaggaggtaggggcttagggaagaataaataggtagaacatagatgattttttttcatgaaattactctgtatgtcactatagtggtggatacaagtcattatgcatttgttcaaacccatagaatgtacaacaccaagggtgaattttaatgtatactatggactttaggcgataattttgtgtccatgtaggcctatcagttgtaacaattaatrttgttacaagttggtactattctggtgggggatgtggatcacagggatggctattcatgtgtagggcagggggtatttgggatatctctgtacattctgttcaattttgctgtgaacctaagactgctcttaaaaataaagtctgaaaaatgctgcatagctttccctccctctgccaaccagtccacaagtactggatatattggccatccatcacttgccaggcagtatctaggtgctggggggactctatgaaggggatatgctcctgcccaggtggagtttagcagggaatctgga

SEQ ID NO: 85845 - DNA, 601 bp, Human
tttccccccaaccatcactcactctgacctggttcattctccaggagcctcagctgatttttctctagcttgatcacccttcttggtttcatgttcagttcaccattgcctttattgataaacccactcttccgctagttaaatccatgtcaccttcttgacaagcaatagtgctgaggtcagaactctccccatagccataccctaaaagatggtacatccagacaatagaatattattcaacgcaaaaaggaagtgtgacatcaagccgtgaaaagacattgagggaccttaaatgcayatttctaagtgaaagaagccaatctgaaaaggttacatactgtatgattccaactatatgacattctggaaaaggcaaaactatggagacagtgaaaagatcagtggttgccaggaggtaggggcttagggaagaataaataggtagaacatagatgattttttttcatgaaattactctgtatgtcactatagtggtggatacaagtcattatgcatttgttcaaacccatagaatgtacaacaccaagggtgaattttaatgtatactatggactttaggcgataattttgtgtccat

SEQ ID NO: 85846 - DNA, 601 bp, Human
ttggccacctacgtgtctttattcatgctgttttctccggctggagaagctcatggaaatggtttatttttgccaaagttagcatttaacgtggacataatgatggttcaactccatggatcccatgtgccaatcttcccccagctccactattgaaattctatacatccactgagtccagtccgttttccccccaaccatcactcactctgacctggttcattctccaggagcctcagctgatttttctctagcttgatcacccttcttggtttcatgttcagttcaccattgcctttawtgataaacccactcttccgctagttaaatccatgtcaccttcttgacaagcaatagtgctgaggtcagaactctccccatagccataccctaaaagatggtacatccagacaatagaatattattcaacgcaaaaaggaagtgtgacatcaagccgtgaaaagacattgagggaccttaaatgcacatttctaagtgaaagaagccaatctgaaaaggttacatactgtatgattccaactatatgacattctggaaaaggcaaaactatggagacagtgaaaagatcagtggttgccag

SEQ ID NO: 85847 - DNA, 601 bp, Human
ttccatttgctcaaaattagcatcaaagttaggaagagtcagggttaaaatacaaacaccccatgctccaaccaaagcgatctgcatatggctgtccatacgcaccatgtacttggccacctacgtgtctttattcatgctgttttctccggctggagaagctcatggaaatggtttatttttgccaaagttagcatttaacgtggacataatgatggttcaactccatggatcccatgtgccaatcttcccccagctccactattgaaattctatacatccactgagtccagtccgtttyccccccaaccatcactcactctgacctggttcattctccaggagcctcagctgatttttctctagcttgatcacccttcttggtttcatgttcagttcaccattgcctttattgataaacccactcttccgctagttaaatccatgtcaccttcttgacaagcaatagtgctgaggtcagaactctccccatagccataccctaaaagatggtacatccagacaatagaatattattcaacgcaaaaaggaagtgtgacatcaagccgtgaaaagacattgagggaccttaaatgcacat

SEQ ID NO: 85848 - DNA, 601 bp, Human
ccagacagatccaagaatgtggctagtgccatttccatttgctcaaaattagcatcaaagttaggaagagtcagggttaaaatacaaacaccccatgctccaaccaaagcgatctgcatatggctgtccatacgcaccatgtacttggccacctacgtgtctttattcatgctgttttctccggctggagaagctcatggaaatggtttatttttgccaaagttagcatttaacgtggacataatgatggttcaactccatggatcccatgtgccaatcttcccccagctccactattgawattctatacatccactgagtccagtccgttttccccccaaccatcactcactctgacctggttcattctccaggagcctcagctgatttttctctagcttgatcacccttcttggtttcatgttcagttcaccattgcctttattgataaacccactcttccgctagttaaatccatgtcaccttcttgacaagcaatagtgctgaggtcagaactctccccatagccataccctaaaagatggtacatccagacaatagaatattattcaacgcaaaaaggaagtgtgacatcaagccg

SEQ ID NO: 85849 - DNA, 601 bp, Human
actcaattcaaaagttacagggccatttttaggacatctctttgctataggaaaacaggacattttctgcaagatcaatgcttgaccaacatcagattcaatttttgcatccttcaaatcatatcaggctggaaaattaaaagtttcctctcatttttatcataattactataacaaccactaccatcttgtgtttgtccagtaatttcagcttttcaaagaaatttcaaatccattaacttagtctctaccaaggcctccgagttcgaggcattaaaggctccccaagtggaattaccarcgtgttataaacgaaagaatctgagtcaccaaaacagcccagcctctgtctgacctccgaccctcctcatctgacactacagcttttcccaaggcagctgcaggtgagatattcattcaaaccagcaggaagagaaatgctgaatctgcacaatcagaaccttctgctgacttagcaccatgtctacagagatgctgctcttgtccttcgtcctgagaaggagacacagtgtgcctgaaggagcccatctcagacaccctgcccctggcagcagccaccagggaagccagtacaatagtg

SEQ ID NO: 85850 - DNA, 601 bp, Human
tttgttcagacccctccagtggttttccatcacagttgaaataaaacccaaactgctcttttaaaaagtttaattgtgtttaattgaacaaagaatgattcaagaattgtacagatctcgaaccagaacaggtgtgaagaggctccatttctaccacaaagaaaatttatggacagagaaggaaagtggcagacagaaaatggaagcgaggtgcagaaacagctggatccattacagcttggcatttgccctacttgagcccagtttgaacagttggtcccccttgattggctgaaactcrgttgtttggacaacagtgggttacagtctgtttacacatccagttaggttgcagttcactacttatggagaaacctttaaagtatgtaaagaggcagcttttcgctaaacttaataattcccccttttgatcaacctctcagttgagagactgaccaaaactttaggcactggcatcactctgtcactatttggtttcaaatcccactaggaaatagcagtgggttttataaggtgggaacaagggcttcaggttattttttataagggttagagtagaaggaaccttcttgacctggta

SEQ ID NO: 85851 - DNA, 601 bp, Human
caatttaaagaaaaattgattaaataataatgtacttcaagggccagcatgcttttctgtaaagggccagatagtaaatgttttaggatttgtgagccatatggtcgccatagcaactgcttaactccgctgttgtaatacgaaagcacccatagaaagcacatctacagatgggtgcaattctgttctaataaaactttatttacaaagacaggtggcaggccatagtttatagatccgtaaagtaggtgataccttgatatggcaaaatccaggaaggtgatacaggaaagactgaaakaagaacagcattcagttactgggaccctgagtctcctctctttagagaaattaataaattcttatgaattcagtcttactcagagacagctataggacacccttggtgccaggtagaaacacaaataaaaggaagacaggaacaagatgggagcacggatgcatatccactcatccatttattcaacattttttttttgagatggagtctcgctctgtcgcccagactggagtgcagtggtgcgatctcggctcactgcaacctccacctcccgggttcaagcaattctcctgcctcagc

SEQ ID NO: 85852 - DNA, 601 bp, Human
ttctctctattcttgtatgtttgctaatctccatagcaataagtttattctgaaactgagtcaatttaaagaaaaattgattaaataataatgtacttcaagggccagcatgcttttctgtaaagggccagatagtaaatgttttaggatttgtgagccatatggtcgccatagcaactgcttaactccgctgttgtaatacgaaagcacccatagaaagcacatctacagatgggtgcaattctgttctaataaaactttatttacaaagacaggtggcaggccatagtttatagatccstaaagtaggtgataccttgatatggcaaaatccaggaaggtgatacaggaaagactgaaagaagaacagcattcagttactgggaccctgagtctcctctctttagagaaattaataaattcttatgaattcagtcttactcagagacagctataggacacccttggtgccaggtagaaacacaaataaaaggaagacaggaacaagatgggagcacggatgcatatccactcatccatttattcaacattttttttttgagatggagtctcgctctgtcgcccagactggagtgcagtg

SEQ ID NO: 85853 - DNA, 601 bp, Human
gatgaataagttctggagatctgctggacaacatagtgtctatagttaacaaactgtattctgcccttaaaatgttcttaagagagatctcatctcaggtgttctcactacaacaacaacaaaaacaaaacaaagagacacaaggaaactgttgaagtgaaagatatatctattaccttgattgtggccatggtttcacaggcacatgcatacatccaaactcatcaaattatgtatattaaacacacgcagtttttaatattatttagatgtcaatgcagctgtttttaaaaaaaaaaaattgaccatgagttgaagctgaattgagggtacatgagtgttcattacacattctctctattcttgtatgtttgctaatctccatagcaataagtttattctgaaactgagtcaatttaaagaaaaattgattaaataataatgtacttcaagggccagcatgcttttctgtaaagggccagatagtaaatgttttaggatttgtgagccatatggtcgccatagcaactgcttaactccgctgttgtaatacgaaagcacccatagaaagcacatctacagatgggtgcaattctgttct

SEQ ID NO: 85854 - DNA, 601 bp, Human
caataaagttttagttatgcaggatgaataagttctggagatctgctggacaacatagtgtctatagttaacaaactgtattctgcccttaaaatgttcttaagagagatctcatctcaggtgttctcactacaacaacaacaaaaacaaaacaaagagacacaaggaaactgttgaagtgaaagatatatctattaccttgattgtggccatggtttcacaggcacatgcatacatccaaactcatcaaattatgtatattaaacacacgcagtttttaatattatttagatgtcaatgsagctgtttttaaaaaaaaaaaattgaccatgagttgaagctgaattgagggtacatgagtgttcattacacattctctctattcttgtatgtttgctaatctccatagcaataagtttattctgaaactgagtcaatttaaagaaaaattgattaaataataatgtacttcaagggccagcatgcttttctgtaaagggccagatagtaaatgttttaggatttgtgagccatatggtcgccatagcaactgcttaactccgctgttgtaatacgaaagcacccatagaaagcacatcta

SEQ ID NO: 85855 - DNA, 601 bp, Human
cctgtagtaccaactactagggaggctgaggcaggaggattgcttgagctcaggagatggaggttacagtgagccactatcacgccactgtattccagcctgggcaacagagtgagactctgtctcaaaaaaaaattttttttttaaataagattgtccccaacatggctctcttggataatgccataatgaacatgagtgaacatgagggtacagatatttctttgagatcctgatttcaattctttgggatatgtacccagaagtgggattgctggatcataagatagttccattacgytggtgctattacttttaattgcaaaaaccacaattacttttgcaccaaccgataataaaaatttaaaaatttttcgaggagccgccatactgtttttcatatcagctgcattattttacattagcaccaacagtgtacaagggttccaatgtccccacatccttgccaacacttgttatctttggtcatttttataatagccatcctaacaggtgtgagataatttcacagtcactcgttgtggttttgtgttgcatctccctgatgattaatgatgttgagaacctttttaatgcctgt

SEQ ID NO: 85856 - DNA, 601 bp, Human
cacctgtagtaccaactactagggaggctgaggcaggaggattgcttgagctcaggagatggaggttacagtgagccactatcacgccactgtattccagcctgggcaacagagtgagactctgtctcaaaaaaaaattttttttttaaataagattgtccccaacatggctctcttggataatgccataatgaacatgagtgaacatgagggtacagatatttctttgagatcctgatttcaattctttgggatatgtacccagaagtgggattgctggatcataagatagttccattasgctggtgctattacttttaattgcaaaaaccacaattacttttgcaccaaccgataataaaaatttaaaaatttttcgaggagccgccatactgtttttcatatcagctgcattattttacattagcaccaacagtgtacaagggttccaatgtccccacatccttgccaacacttgttatctttggtcatttttataatagccatcctaacaggtgtgagataatttcacagtcactcgttgtggttttgtgttgcatctccctgatgattaatgatgttgagaacctttttaatgcct

SEQ ID NO: 85857 - DNA, 601 bp, Human
attctactatattaaaaaatataaatagcatatctgaaccataatttcaagcaaattattgcttgaaatgaagcttaagtaggtatttatgtttaaaaaccttgagttatttaaggatagttgatgatattaaggaattattaattaagaggaataataaaattgtatttatagtcaatacaggagttcttttaatatacttactgaaactttaaattaaaatgatataagttctgagatttgcattaaaataatcagggggttggtaaggtattagggaggagggagtattaagaaaacmagattgggcagggtgcgatggctcatgcctttaatctcagcattttgggagaccaaggcaagtggatctcttgagcccaggagtttgagaccagcctgggcaaaatggtgaaaccccatctctacagaaaaacacaaaaatgagccaggcatggtggcacacacctgtagtaccaactactagggaggctgaggcaggaggattgcttgagctcaggagatggaggttacagtgagccactatcacgccactgtattccagcctgggcaacagagtgagactctgtctcaaaaaaaaatt

SEQ ID NO: 85858 - DNA, 601 bp, Human
ctcattataggaatttggtatacttaggatagattaccttaattctattttctgtttatccaattagatttgccggtcttaattgtactataaattgtgttgagctggtgaagatgactatgaagttgttgttccttcagatttcatggttggtatgcatgtcgctggtgtttgctccaggcactgactaactctgtctgggttgtgaaaacaaggacactgtaagacctttcataccattcaaagaagaaagtggacaacgccttccgctaagggcctccttaacgtggtgtattccagkgtgtggtatactgatggtgtacaagatcattttagatggtgcagggatacattttcctcttaaattttcaaaaattcaggagccattctactatattaaaaaatataaatagcatatctgaaccataatttcaagcaaattattgcttgaaatgaagcttaagtaggtatttatgtttaaaaaccttgagttatttaaggatagttgatgatattaaggaattattaattaagaggaataataaaattgtatttatagtcaatacaggagttcttttaatatacttactgaaactttaaa

SEQ ID NO: 85859 - DNA, 601 bp, Human
ttagataaaaataacatgtaatttgtttggtaattatatgtttccacaactgctgaaagcaactcattataggaatttggtatacttaggatagattaccttaattctattttctgtttatccaattagatttgccggtcttaattgtactataaattgtgttgagctggtgaagatgactatgaagttgttgttccttcagatttcatggttggtatgcatgtcgctggtgtttgctccaggcactgactaactctgtctgggttgtgaaaacaaggacactgtaagacctttcataccwttcaaagaagaaagtggacaacgccttccgctaagggcctccttaacgtggtgtattccagtgtgtggtatactgatggtgtacaagatcattttagatggtgcagggatacattttcctcttaaattttcaaaaattcaggagccattctactatattaaaaaatataaatagcatatctgaaccataatttcaagcaaattattgcttgaaatgaagcttaagtaggtatttatgtttaaaaaccttgagttatttaaggatagttgatgatattaaggaattattaattaagaggaa

SEQ ID NO: 85860 - DNA, 601 bp, Human
tgcattgccaaaggtcacactgctcaccaacagcaggacagggacaataaatctggtcttatgactccagctgagagtgctttccaccacagcactatgtctaacctggtggaaatgcagcaacttcaatcctcacctgcctcaacttaggagaagcctctgcctctcctatcacactcaacagggatatgtttcttgaggctgatgccagctcaaagcttcattgcaaaattcttccaggctacctgttctgagttataggaaatatcccaaagcgcccatgtcctaccattccagggtrcaaaagagcacgaacccacaagaagatattggaagatttactgagccacagggaaatgaggaaatgagagcaaagtaaggaagttatataagggtcacacacacacacactcaaaaaacccagggttaaggttagctgcagcacacagagacttgcagcttacatttagggagacgaataagtttaaagaacagataaattaaaaagactaaggctccatacacgtcagagccctgacttaacctcaaccatccaggctcaagttaaaccaacgaaagtgaccaggcatagtggctcatg

SEQ ID NO: 85861 - DNA, 601 bp, Human
catgtagctcaagtggggcaacttcagcatctccagctctcaggatatgcacatgaccagcctggtcagtcagtgtattcctatcctgaacaatgtgattggttgatttatgggcaagtgaggaagaggagtccaatcagagttagccctgggacttctgatgaagcgaccaggaagtggactctgcactctgtttcccctaagtcacttaactgacagaataaagatgcaacacttctgctagtgactgtcttgccacactgggagttggggtggggagacattccctgaataaagtcartacaggctgggtgtggtggctcctgcctgtaatcccagaaattttggaggccaaggtgggaggactgcttgagcccaggagtttgagaccagcctgggcaacatagtgagaccccatctcttcaaaaataaaaataagcaaccaggcatggtggtatgcacctgtagtccaagctactcaggaggctgaggtgggaggatcgcttgaaccccggagggtgaggctggagtgagccagatcgtgccactgcactccatcttaggagacagagcaagacactgtctcaaaaaaataaaaaat

SEQ ID NO: 85862 - DNA, 601 bp, Human
cctgactctcaatctagtaaatttttctattataattcaaataggtagcctatgggagaatgagatctttggttttctctagtccagaaaacactctttcttctggcacttttggggaaccaactgtccccacttttcattccatgtagctcaagtggggcaacttcagcatctccagctctcaggatatgcacatgaccagcctggtcagtcagtgtattcctatcctgaacaatgtgattggttgatttatgggcaagtgaggaagaggagtccaatcagagttagccctgggacttcygatgaagcgaccaggaagtggactctgcactctgtttcccctaagtcacttaactgacagaataaagatgcaacacttctgctagtgactgtcttgccacactgggagttggggtggggagacattccctgaataaagtcagtacaggctgggtgtggtggctcctgcctgtaatcccagaaattttggaggccaaggtgggaggactgcttgagcccaggagtttgagaccagcctgggcaacatagtgagaccccatctcttcaaaaataaaaataagcaaccaggcatggtggtatg

SEQ ID NO: 85863 - DNA, 601 bp, Human
gctgctcacacttagagtagtaaggccttggatgttacttagtccagtgtttccagactttctttacgataagaatcacctggggataccttgttaaaaaggcaagtatgcaaccttacccaaacatactgaatcaaagtggggtggggggaatacccaagaggttgtaagtttaaagagctcacaggttatttttaatatcagagaggtttaggaaacactgatttggtctgtatcaggtgcagcaaattcaaatatgtgcagaacccagagagatgagataaataatttttatttttttgaagggagtctcactctatcccccaggctggagcacagtggcgcaatcttggctccctgcaacctccgcctcccaggttaaagtgatcctcatgcctcagtctccagagtagctgggattacaggcacctgagatccagtaaatgagaaataggaatctatagccctgctgaacatttcataaggcctggcataattcaaattctgccctgtaatcaggctgtcccaggcaacacaggcaagattaaagaaatatttaagtttatttgctttgggctggaatatatataactcagtgtag

SEQ ID NO: 85864 - DNA, 601 bp, Human
agatgtggctgctcacacttagagtagtaaggccttggatgttacttagtccagtgtttccagactttctttacgataagaatcacctggggataccttgttaaaaaggcaagtatgcaaccttacccaaacatactgaatcaaagtggggtggggggaatacccaagaggttgtaagtttaaagagctcacaggttatttttaatatcagagaggtttaggaaacactgatttggtctgtatcaggtgcagcaaattcaaatatgtgcagaacccagagagatgagataaataatttttttttttttgaagggagtctcactctatcccccaggctggagcacagtggcgcaatcttggctccctgcaacctccgcctcccaggttaaagtgatcctcatgcctcagtctccagagtagctgggattacaggcacctgagatccagtaaatgagaaataggaatctatagccctgctgaacatttcataaggcctggcataattcaaattctgccctgtaatcaggctgtcccaggcaacacaggcaagattaaagaaatatttaagtttatttgctttgggctggaatatatataactc

SEQ ID NO: 85865 - DNA, 601 bp, Human
cagacttactgtgaggattaaatgagatatttaaagtacctggcatagtttcttgcacataataaaatttcaatacatgccaactattatcattatcattattactatgccatcattatcagaatgttttgaatatagaattgcttgaggatagtttattgaatgatgagtgaattaagtgctgagagaacatcatccactaaggtctgagtacctagatttcagaattcttggtatgggagttctccagtggggaaacaaaaagccttgcaattaagaaaactgaaaaagaacagaacargcttggcccagttgccgaagaccagtcgtgtgtgaaatgcctcagaacaccggatggagacagcacggatcaagccaagtaaaaattgagagcatgaaacagacagccctggaggcctggaatctgctgaggccatttcttcctgagacctaggggtggaagcttgggggtcaagtctgctttgagaggcaagatctcaggctgtgtgcagaacacttttgcacctcgtgtctcagtgatgggaggtcagggtgagcttccccaccaaaccccaacaggtgtttattataccctgtgggg

SEQ ID NO: 85866 - DNA, 601 bp, Human
tagtagaaattaaaggctctgtagataatgcttcatgaaaagtgggctgtttccatcaagcctaaatcatataagtgtgtgagatggttaacactgaagactcagaagtcagagagggctgagtttgaaaccacattcgatcactattcaactgtgagactgtattggttcattttcacaatgtaaagaactatctgagactgggtaatttataaggaacagaggtttaattgactcaccgcttggcatggctggggaaggagacctcaggaaacttacaatcatggtggaagacgaagasgaagcgaggaacatctcacacagcggaaggatggggatgggtagaaaagaagcaattgacacacacttttaaaccatcagatctcgtgagaactcgcttactatcacgagaacagcaaggggaaaatccgcccccgttatccaatcacctcccaccaggcccctccctgacacgtggggattacaatttgagatgagatttgggtggggacgcagagccaaaccatatcagagacactgtgcactctgtttccttctatgagcctcagttttcccatctgtcaagcaggggtaagaatag

SEQ ID NO: 85867 - DNA, 601 bp, Human
acaaatccctaccgttggctgcttccagcaccttcactccccctgcaggtgggctaaacctgcttccaaagccagaaaagacagagtcggaggggttcacagtgagcaagcttcagtatatggaggcaaggactgggggcatatgggaaagccccaacagcacatgctacataaccctaataagtaggtggtaccaccctcatttaaaaggagaacaaaaatgaggctcagagaagataaagtaacttgcttaaatgaggaggctggattgaaagcaggcctgactctaaagtcacattcytgccccctacacatgctgacaggtgttcctattttctccatcttagtttgagccatatcacccacacctggaggtctgcaatgacctaatgctttcacctgcctccagtccttcctgcacactatggacaatttcatttcccttccttagctacttacaaaacggaggacgaagttcaaactccatattcaggcactcgattattcccgtcagctggctgtatggccactgtatgccttcctgccccagccctggcctacatttccttaattcaactcacgtgccatttttcttcttttc

SEQ ID NO: 85868 - DNA, 601 bp, Human
gggaactgaccttgggcctcacgactgtgctaagcacttaacatacaatgtttcgttttatcattattatgacctgaggccctgaaaaagaatttgagctcccagtggtttgagaaatgatcccaggaaacactggtaagaggaaagagaagtgagacagggaagtaaaaggaaacaataaatggtaaattttaaattaagtgactgcttaaggcaactgggccttaagatcactagagacatctgggatatagcatgaaatatctactctacatcacagttatcctgcctacaagacaamggactggagtgcttatccacaaatccctaccgttggctgcttccagcaccttcactccccctgcaggtgggctaaacctgcttccaaagccagaaaagacagagtcggaggggttcacagtgagcaagcttcagtatatggaggcaaggactgggggcatatgggaaagccccaacagcacatgctacataaccctaataagtaggtggtaccaccctcatttaaaaggagaacaaaaatgaggctcagagaagataaagtaacttgcttaaatgaggaggctggattgaaagcaggcct

SEQ ID NO: 85869 - DNA, 601 bp, Human
aatttaggatgcaagaggcatttggctaattatactcaattgtagacctgttatccatggtgttaaacaaggactaaaggttaaagatactgattaataattaataaactatctcattaaaaaaagaaatcattgcaatattttgctctgcatattctaggtgaccttttcctcccccatttttcttcatattttggatgaatttatctgtcagtggaaatgtcttgaaagaataagttcactccaccttcacaaggatggtaatgatgatgatgtttatagcagctaccatttatcgggsaactgaccttgggcctcacgactgtgctaagcacttaacatacaatgtttcgttttatcattattatgacctgaggccctgaaaaagaatttgagctcccagtggtttgagaaatgatcccaggaaacactggtaagaggaaagagaagtgagacagggaagtaaaaggaaacaataaatggtaaattttaaattaagtgactgcttaaggcaactgggccttaagatcactagagacatctgggatatagcatgaaatatctactctacatcacagttatcctgcctacaagacaaagg

SEQ ID NO: 85870 - DNA, 601 bp, Human
actctacttttcatcactctcccttttacactctgctccaccatccaaccccactggttctgaaggtttcctattgaaccaccctcccagaaagcccatcatcttctgctttggaaagccaatattgtaaatattggaagcataacttccagcacacacaaacacacacacacgcaatatcatcccacctcttcaacagatgaaggcgaaaacaactaaaatccaagagtaaatctccagctaaaaacaagctcaaatagcaacaagaacttcaaggaggagattcatttgcaactaggtkctaatgaaaccaggtcctccttccaagaaaatcaaactgtgtaactcagaatagccaatttaggatgcaagaggcatttggctaattatactcaattgtagacctgttatccatggtgttaaacaaggactaaaggttaaagatactgattaataattaataaactatctcattaaaaaaagaaatcattgcaatattttgctctgcatattctaggtgaccttttcctcccccatttttcttcatattttggatgaatttatctgtcagtggaaatgtcttgaaagaataagttcactc

SEQ ID NO: 85871 - DNA, 601 bp, Human
aagtctaaaagcagatgcgcttatcctttcaatcactctacttttcatcactctcccttttacactctgctccaccatccaaccccactggttctgaaggtttcctattgaaccaccctcccagaaagcccatcatcttctgctttggaaagccaatattgtaaatattggaagcataacttccagcacacacaaacacacacacacgcaatatcatcccacctcttcaacagatgaaggcgaaaacaactaaaatccaagagtaaatctccagctaaaaacaagctcaaatagcaacaaraacttcaaggaggagattcatttgcaactaggtgctaatgaaaccaggtcctccttccaagaaaatcaaactgtgtaactcagaatagccaatttaggatgcaagaggcatttggctaattatactcaattgtagacctgttatccatggtgttaaacaaggactaaaggttaaagatactgattaataattaataaactatctcattaaaaaaagaaatcattgcaatattttgctctgcatattctaggtgaccttttcctcccccatttttcttcatattttggatgaatttatctg

SEQ ID NO: 85872 - DNA, 601 bp, Human
acactcaagacagcttctcacgcattcctctatctcctcccctggggccaaggtccagataagcacatataagttaagtgagcaagtctaaaagcagatgcgcttatcctttcaatcactctacttttcatcactctcccttttacactctgctccaccatccaaccccactggttctgaaggtttcctattgaaccaccctcccagaaagcccatcatcttctgctttggaaagccaatattgtaaatattggaagcataacttccagcacacacaaacacacacacacgcaatatcatsccacctcttcaacagatgaaggcgaaaacaactaaaatccaagagtaaatctccagctaaaaacaagctcaaatagcaacaagaacttcaaggaggagattcatttgcaactaggtgctaatgaaaccaggtcctccttccaagaaaatcaaactgtgtaactcagaatagccaatttaggatgcaagaggcatttggctaattatactcaattgtagacctgttatccatggtgttaaacaaggactaaaggttaaagatactgattaataattaataaactatctcattaaaaaaaga

SEQ ID NO: 85873 - DNA, 601 bp, Human
acctcccttaaagtcaactgattataagctttaatcacacctacaaaacaccttcacaacccacctacattagagtttgactgagtacagactgtagccccatccaagttgacacagaactgacagttgttgcattcatcatactccgtccctaacactcaagacagcttctcacgcattcctctatctcctcccctggggccaaggtccagataagcacatataagttaagtgagcaagtctaaaagcagatgcgcttatcctttcaatcactctacttttcatcactctcccttttacmctctgctccaccatccaaccccactggttctgaaggtttcctattgaaccaccctcccagaaagcccatcatcttctgctttggaaagccaatattgtaaatattggaagcataacttccagcacacacaaacacacacacacgcaatatcatcccacctcttcaacagatgaaggcgaaaacaactaaaatccaagagtaaatctccagctaaaaacaagctcaaatagcaacaagaacttcaaggaggagattcatttgcaactaggtgctaatgaaaccaggtcctccttccaagaa

SEQ ID NO: 85874 - DNA, 601 bp, Human
gaactgttagcattcgtatttccactcacagtctgttgaaggatgtctagtctttttctctgatgtgtctccaaattattctagcctctgcccaacacacaattccaagaccactgccactttttaaggtatttgttacaacagagccctattcttggcaccaaaatctgtattattgagggttcaattaaaggaacagatgagcgggagacatatattaagaaatacatgacaaggaattggcttacatgattgtggggaatgggtaggtaagtccaatatccacagggcaggctggaayttctgggcatgagctaaaccttctctcctcaggtggaatttactcttcagagaagcctcagctctactcttaaggcatctgactgattgaatcaggcccacccagattatctaagataacctcccttaaagtcaactgattataagctttaatcacacctacaaaacaccttcacaacccacctacattagagtttgactgagtacagactgtagccccatccaagttgacacagaactgacagttgttgcattcatcatactccgtccctaacactcaagacagcttctcacgcattcc

SEQ ID NO: 85875 - DNA, 601 bp, Human
tggggattcactccatcagacaaaaaatggttcttcacagttctttcctagataatcctaatatctattctttgcttctgatttgatggccaaggggtacatgagtctcatacctaatctcttcaaagagcactctgtgtggctgaatactgggactttttatctttccaacgaactagcaaaaaaaactgttcagccataccctttcctaacatgctttcctgatagtaaatctcctaattttagcatcttttgcaatccagataggctgagaatttcccaagtcatcaaatcttgcttkctttttgcttaacagttcttgcttcaatctctttcctctcacattttactaaaaggagcaagaagaaaccaggctgccccttcaacactttaccaagttcattgcttgcaagttcagatttccacacaactgtagcatataattcagataaatgctctgccactatataacaaggatgtcctttcctccagttttcaataacatttccttcgtaggtagccctccctggtaatgcttttaacgtccatatttccaccaaaagtctgttcatgatgatttaggtagtctctaaaatgatgt

SEQ ID NO: 85876 - DNA, 601 bp, Human
gcagtgagccaatatcatgccactgcactccagcctgggttgacagagtgagattcagtctcaaaaaaaataataattataaataaataaataaatctcatgagctcagatgtctaaaatcttatctcaatcacctaagtcaagtacttataagaatctgagcatgatccctcctgggtcaaagtttctctccaactgtggacctgtaaaactagaaaacggattatctgctccccagatgcaattgtggaacaggcatgggatatcagttacaggggtttttgatcaaaaaaggaatcawtgaaaagaaaaaacaagttaccacatccaaacaattttggaattcagttaggcagtccggatgcagtggctaatccctgtaatcctaacactatgggaggccaaggtggttggaatgcttgagcccagacattggagaccaacctggacaacgtggtgaaaccccacctctaaaaaagaaaaaaaaaatacaaaaacagattagctgggtatggtggtgcatgcctgtagtccaacctactcaggaggctgaggtgggagaatcacttgagaccaggaagtcgaaggtgcagtgagtgat

SEQ ID NO: 85877 - DNA, 601 bp, Human
gccataaagttagtggcttagagtgatgtaaaatgtattaaagtcctggaggtcagaaacctaaaatggaccagcaggccttcctagtgcttccttctaaggctttagaggagaatccatttcttaccttttccagtttgtagagtctgcccacattccttagctcatggccacatcactctaactctgtttccatggtcacatctccttctctgactcttccatgcccgcctcttataagtacagtcacaattatattgggcccaccagataattttggatgaggctctcatctcaagayggatccataacttaatcacatcttcaaaatcccttttgccataaatcataacatttatacaggagtcagagtttagaaggtgaacatctttgagaggtcgtagttctgcctgccaggccaccatcttgctcccaaagattcactccatctccccaaaactaactcacgatagtgtcaaagtccaaaattttcatcaaaatctcatcagaccaggcacagtgactcatgcctgtaatcccagcattttgggaggccaaggcgggtggatcacctgaggtcaggagttcgagaccagcctgg

SEQ ID NO: 85878 - DNA, 601 bp, Human
aacaggaagagtaattcgccattattattagcatgttattattgttattattactactactgttattattttacttatgagcgcttatgatgtgtcaggcactgcactaagcattttaccaccattattctcctctaagctccatatccctaaaaaaaagtattataatccccatttataagtaaggaaactgaggttcagagatgtgaaatagtctgggcttggtggctcgcgcctgtaatcccagcactttgggagactcaggcaggcagatcacttgaagtcaggaattcaaggccascctggccaacatagtgaaatcccatctcttctaaaaatacaaaaattagccgggcgtggtggtgcatgcctgtaatcctagctactcaggaacctgaggcaggagaatcgcttgaacccgggaggcagaggttgcagcgagctgagattgtgccactgcactccagcctgggcaacagaatgagcagaacaagacaccgtctcaaaaaaaaaaaaaaaaaagatgtgaaataacttgtccaaagtaaactcagccagtaatgggtggcaaagctggatttggggccatgcaacatgtctc

SEQ ID NO: 85879 - DNA, 601 bp, Human
gacaagactagagtaggaaagtaccttctgtgataggccctcagagaaagggcgtctgtttcagccaagaaggtcagggaagacttcctgggagacatggcttttgaatgggattagccagtttaagaggtggggaagaacatttcataggcaatggcctgagtgcctgctgttctttttgcttgtaacacacttgtgcccctgacccaccatggatcttgtattctcttcactaatatccctctgcctagagtggcaaaacaggaagagtaattcgccattattattagcatgttattaytgttattattactactactgttattattttacttatgagcgcttatgatgtgtcaggcactgcactaagcattttaccaccattattctcctctaagctccatatccctaaaaaaaagtattataatccccatttataagtaaggaaactgaggttcagagatgtgaaatagtctgggcttggtggctcgcgcctgtaatcccagcactttgggagactcaggcaggcagatcacttgaagtcaggaattcaaggccagcctggccaacatagtgaaatcccatctcttctaaaaataca

SEQ ID NO: 85880 - DNA, 601 bp, Human
agatttcaagagctggcatgatggaaaatagcggcaggggctgatcaagatggcatggagtgaggcttctgaaaacacttattgaccagcttgcatgctgtgggtgatcgataaatattaaacaccgaggctagtggagaacaggttttaatgaggcccagaacagcatgtagagtgggctgtagtagtgaggggccatggagatgctaagcaaccagtctcatgcctgcaggtcccccatgtccatgcttctccctaggctgttctcagttacaaagacaaagcaaaccaactcgggggsaaattcatcgggaagttggaagctaaagggtccctcctagcatggccaaggcctgccgctccagtctcttctcaccacttatcccattttttttttttttaatgctcagggtataacaataaataagagagggacagagagcacctctgctctcggagtttccaggctactgagagaggcttcaaatgcattgacaagactagagtaggaaagtaccttctgtgataggccctcagagaaagggcgtctgtttcagccaagaaggtcagggaagacttcctgggagacatggcttttgaa

SEQ ID NO: 85881 - DNA, 601 bp, Human
gaggcaaatgaaatggaacttaagcttctgcatctctgcagtcgggacttttgttagaaaagcacttaaaaaattcaaggcacatccacaagatttcaagagctggcatgatggaaaatagcggcaggggctgatcaagatggcatggagtgaggcttctgaaaacacttattgaccagcttgcatgctgtgggtgatcgataaatattaaacaccgaggctagtggagaacaggttttaatgaggcccagaacagcatgtagagtgggctgtagtagtgaggggccatggagatgctaascaaccagtctcatgcctgcaggtcccccatgtccatgcttctccctaggctgttctcagttacaaagacaaagcaaaccaactcggggggaaattcatcgggaagttggaagctaaagggtccctcctagcatggccaaggcctgccgctccagtctcttctcaccacttatcccattttttttttttttaatgctcagggtataacaataaataagagagggacagagagcacctctgctctcggagtttccaggctactgagagaggcttcaaatgcattgacaagactagagtagga

SEQ ID NO: 85882 - DNA, 601 bp, Human
ccaaacacagactcatctcttcagctatcctgagaagtgtggggactgaggactaagagggacagaggcagcaatataaaaaccagtgccctcaaggttcaggaggcaaatgaaatggaacttaagcttctgcatctctgcagtcgggacttttgttagaaaagcacttaaaaaattcaaggcacatccacaagatttcaagagctggcatgatggaaaatagcggcaggggctgatcaagatggcatggagtgaggcttctgaaaacacttattgaccagcttgcatgctgtgggtgatmgataaatattaaacaccgaggctagtggagaacaggttttaatgaggcccagaacagcatgtagagtgggctgtagtagtgaggggccatggagatgctaagcaaccagtctcatgcctgcaggtcccccatgtccatgcttctccctaggctgttctcagttacaaagacaaagcaaaccaactcggggggaaattcatcgggaagttggaagctaaagggtccctcctagcatggccaaggcctgccgctccagtctcttctcaccacttatcccattttttttttttttaatgctca

SEQ ID NO: 85883 - DNA, 601 bp, Human
aaggaccaagggaaaagagagcaggatttggtctgagatataagcaggagattatggtgctccttctaggccacagcaagcaattgattttaattctaggtaaaatggaaagctggaggaagattttaataaagatgcatgtgattcaagatatgggttttgtcatcgttcttactcactcgaccagcgaggtcatgcattgatcataggatgtcaaagctggaagaagataccagtttagaagatgctgctgtcactgaatgcagatttcataaggagttgcagtgaaggtagaagcatktttcatggatctgtgttaagggcagagctagaagcccttgctgatggtttctacatagcaggtaagagggagagagaaatcaaaggtgacttgtaggtttgtagtttgaacagctagatggaaaatgaggtcatttactaagacaagaaagtaagaaggagagataggtatggggacatgctaaagacaatgagactcagaaaagccaagagactcattcaaggttacatggctgggaaatgatagaggcagacttggaacgctggtccctgggactccacggcagggttcaaatggtaa

SEQ ID NO: 85884 - DNA, 601 bp, Human
taggagaaaatgaagctgagtaatgggctaatggctagagtggaggctacttgaacttggatgatcatgaacagcctgtcacagtcagcaatgtttgagacgaaacttgaatggtgagaacaagacaaccacagaaaggtccaggggaagaaattcccaagcaaacggaacaacacgtgcaaaggtgagtgtgaggaatgttccagaaagataaaggaccaagggaaaagagagcaggatttggtctgagatataagcaggagattatggtgctccttctaggccacagcaagcaattgaytttaattctaggtaaaatggaaagctggaggaagattttaataaagatgcatgtgattcaagatatgggttttgtcatcgttcttactcactcgaccagcgaggtcatgcattgatcataggatgtcaaagctggaagaagataccagtttagaagatgctgctgtcactgaatgcagatttcataaggagttgcagtgaaggtagaagcatgtttcatggatctgtgttaagggcagagctagaagcccttgctgatggtttctacatagcaggtaagagggagagagaaatcaaaggt

SEQ ID NO: 85885 - DNA, 601 bp, Human
ttacatgctaaatgtctctataaagcaccatgcgccaagctaggctgctaagaaacagatgcaaaacagatgcaaagatccatgagatagctgagaagttaaagaattttaattcaacaaaaggcaagaaaagtttcttaggagcataatacagtcaagggaggcctgatgcaactggagagtcatagaaattctggctcccagctattaacaatagtatttcttaccatggcagtttcaatgcacatatgtgcatgagtgtgtctgtgcatacctgagcacgctcttatttcatccccggaaccaatctttattcatttaacagatatttattaagcacctactatgtgcatcacttttttttttaagcacctactacgtgcgtgacttacttttttaaaacagggtctcgctctgttgcccaggctggaatgcagtggcacgatcagagctcactgcagcctcaaatttctgggctcaagtgatcgtcctacctcagcttcctatgtagctgggactgcaggtgtaagccatgacacctggtgaagtcattttagtttttagtagagacaaagtctctctgtgttgcccaggctggtga

SEQ ID NO: 85886 - DNA, 601 bp, Human
tgtaatattaacctatctgggaagtgtgaactgtaaagaagaggccattacagaatgttgagattggccaaaccaccactgtagatgctccattcactggaaccagccttggaatgcagagggctcctgccaccccactcttctaggctagaggtgggcagcaccctccaggcaagagcatgaatcatgtgtgcctgcttgctgctccccctctctccaacagatgactgggcaaaaatagaagagaatccctcctttataaatatctttacatgctaaatgtctctataaagcaccatgmgccaagctaggctgctaagaaacagatgcaaaacagatgcaaagatccatgagatagctgagaagttaaagaattttaattcaacaaaaggcaagaaaagtttcttaggagcataatacagtcaagggaggcctgatgcaactggagagtcatagaaattctggctcccagctattaacaatagtatttcttaccatggcagtttcaatgcacatatgtgcatgagtgtgtctgtgcatacctgagcacgctcttatttcatccccgtaaccaatctttattcatttaacagatatttat

SEQ ID NO: 85887 - DNA, 601 bp, Human
cccttggtgtcttactaagccctgggaatgtcatgcctggataggagtgtttttttgcttgtgggggccttgggtcacaccagagagtctaacagtgtgatttagagtgggggcttagaatcacatagcatgagctcaacctccagaggacctggaagccaaggtcacccatataagaactcaacagcagaccccaaaaaagactctgcacgccaaggctcagtgagcttcccttgttggcaacgtcccatgcttattttcatccgttgttgctgagaaggtggcactgtccatgattccrtaggaagatcaccactggcagctcacggttggacctttcatgattctgcctatgtgtccctcttttggctgattttagtctgtatccttcagctataacaagccatagccgtgggtgcaacagcttgcagcgagttttgtgagtttccagtgaattatcaaagataagggtggtcttggcagccctcaatcttccaagtgatgtcagaaatgatcgttttatgaactgtacccctcaactttgcagctacacacttaaggacattctgatggaaggagctgtaatattaacctatctggg

SEQ ID NO: 85888 - DNA, 601 bp, Human
gagctcttccatagtaaagaattaaacctcgcccaaaaagaagtctggtctttacccttggtgtcttactaagccctgggaatgtcatgcctggataggagtgtttttttgcttgtgggggccttgggtcacaccagagagtctaacagtgtgatttagagtgggggcttagaatcacatagcatgagctcaacctccagaggacctggaagccaaggtcacccatataagaactcaacagcagaccccaaaaaagactctgcacgccaaggctcagtgagcttcccttgttggcaacgtyccatgcttattttcatccgttgttgctgagaaggtggcactgtccatgattccgtaggaagatcaccactggcagctcacggttggacctttcatgattctgcctatgtgtccctcttttggctgattttagtctgtatccttcagctataacaagccatagccgtgggtgcaacagcttgcagcgagttttgtgagtttccagtgaattatcaaagataagggtggtcttggcagccctcaatcttccaagtgatgtcagaaatgatcgttttatgaactgtacccctcaactttgcag

SEQ ID NO: 85889 - DNA, 601 bp, Human
gttgagctcttccatagtaaagaattaaacctcgcccaaaaagaagtctggtctttacccttggtgtcttactaagccctgggaatgtcatgcctggataggagtgtttttttgcttgtgggggccttgggtcacaccagagagtctaacagtgtgatttagagtgggggcttagaatcacatagcatgagctcaacctccagaggacctggaagccaaggtcacccatataagaactcaacagcagaccccaaaaaagactctgcacgccaaggctcagtgagcttcccttgttggcaamgtcccatgcttattttcatccgttgttgctgagaaggtggcactgtccatgattccgtaggaagatcaccactggcagctcacggttggacctttcatgattctgcctatgtgtccctcttttggctgattttagtctgtatccttcagctataacaagccatagccgtgggtgcaacagcttgcagcgagttttgtgagtttccagtgaattatcaaagataagggtggtcttggcagccctcaatcttccaagtgatgtcagaaatgatcgttttatgaactgtacccctcaactttg

SEQ ID NO: 85890 - DNA, 601 bp, Human
aggcactggaagcaagaaaagggccagcaccaccgctatctacgtaagtcatccataccaagagtatcaagttgagctcttccatagtaaagaattaaacctcgcccaaaaagaagtctggtctttacccttggtgtcttactaagccctgggaatgtcatgcctggataggagtgtttttttgcttgtgggggccttgggtcacaccagagagtctaacagtgtgatttagagtgggggcttagaatcacatagcatgagctcaacctccagaggacctggaagccaaggtcacccatayaagaactcaacagcagaccccaaaaaagactctgcacgccaaggctcagtgagcttcccttgttggcaacgtcccatgcttattttcatccgttgttgctgagaaggtggcactgtccatgattccgtaggaagatcaccactggcagctcacggttggacctttcatgattctgcctatgtgtccctcttttggctgattttagtctgtatccttcagctataacaagccatagccgtgggtgcaacagcttgcagcgagttttgtgagtttccagtgaattatcaaagataagggtgg

SEQ ID NO: 85891 - DNA, 601 bp, Human
ctttttatagcatgaactatgtccttcaccactgtatccctagcaactagcacagagcctggcacctagctcacaatcaataaatatttgtggaattgatggatgaattcaggcactggaagcaagaaaagggccagcaccaccgctatctacgtaagtcatccataccaagagtatcaagttgagctcttccatagtaaagaattaaacctcgcccaaaaagaagtctggtctttacccttggtgtcttactaagccctgggaatgtcatgcctggataggagtgtttttttgcttgtgagggccttgggtcacaccagagagtctaacagtgtgatttagagtgggggcttagaatcacatagcatgagctcaacctccagaggacctggaagccaaggtcacccatataagaactcaacagcagaccccaaaaaagactctgcacgccaaggctcagtgagcttcccttgttggcaacgtcccatgcttattttcatccgttgttgctgagaaggtggcactgtccatgattccgtaggaagatcaccactggcagctcacggttggacctttcatgattctgcctatgtgtccctct

SEQ ID NO: 85892 - DNA, 601 bp, Human
tccccagcctttttatagcatgaactatgtccttcaccactgtatccctagcaactagcacagagcctggcacctagctcacaatcaataaatatttgtggaattgatggatgaattcaggcactggaagcaagaaaagggccagcaccaccgctatctacgtaagtcatccataccaagagtatcaagttgagctcttccatagtaaagaattaaacctcgcccaaaaagaagtctggtctttacccttggtgtcttactaagccctgggaatgtcatgcctggataggagtgtttttttgcttgtgggggccttgggtcacaccagagagtctaacagtgtgatttagagtgggggcttagaatcacatagcatgagctcaacctccagaggacctggaagccaaggtcacccatataagaactcaacagcagaccccaaaaaagactctgcacgccaaggctcagtgagcttcccttgttggcaacgtcccatgcttattttcatccgttgttgctgagaaggtggcactgtccatgattccgtaggaagatcaccactggcagctcacggttggacctttcatgattctgcctatgt

SEQ ID NO: 85893 - DNA, 601 bp, Human
ctcaagaactttctcaccactcaacctctgcatgtgatattcctccacctaaacactacctccctacccccatactccaccctggttggccaacttctaatcatttttccaatcttagcctaactaccaccgccctgggaagtcttcaccagcaactgtgccaggcacccttgtgcaccaagagcctttagtatcatttctagcatcatggtatatttatatataagaataattgcctgtttatctgtctccccagcctttttatagcatgaactatgtccttcaccactgtatccctagsaactagcacagagcctggcacctagctcacaatcaataaatatttgtggaattgatggatgaattcaggcactggaagcaagaaaagggccagcaccaccgctatctacgtaagtcatccataccaagagtatcaagttgagctcttccatagtaaagaattaaacctcgcccaaaaagaagtctggtctttacccttggtgtcttactaagccctgggaatgtcatgcctggataggagtgtttttttgcttgtgggggccttgggtcacaccagagagtctaacagtgtgatttagag

SEQ ID NO: 85894 - DNA, 601 bp, Human
tcacactctgaagtcctgacctcaccataaacaaagagccttttctgggggagttggagctgccctaagccagtgaaagccaatgctcatacgcttgccctatccaactgctttcattagctccattctttttagtctaaaagccttcctgacagcaacaggggccaagaatttctctcatgaaccccattttcttgatttcaaaatccacttgccttgggagaaacgcttgaacctgggaggtagagattgcagtgagcagagatcgtgccactgcactccagcctggcaacagagattmagtcttgaaaaaaaaaaaaatccacctgccttggtacaagatgggaaagtctttgggtgtttattggctgtatgttcaagatgaatcacctgtgagctgtggcatccatgaaaatgtggagctccttaccatcctcaagaactttctcaccactcaacctctgcatgtgatattcctccacctaaacactacctccctacccccatactccaccctggttggccaacttctaatcatttttccaatcttagcctaactaccaccgccctgggaagtcttcaccagcaactgtgccaggca

SEQ ID NO: 85895 - DNA, 601 bp, Human
tccctagagtacagcgagttctctcccactcagagcagaaggaggtctgacacactcacacctgcaggaaaactgggggccaggaggtgggagacaaaatgaggacacagacaggaggagccccagactccttcctgactccctgccttcaccagaatgaagtagggaggcttagagctccttccaactgcactgttttgcttactgaattttcattttgcttttcttaattataagaataatgcaaagtcccatcaacaacatttttgtgtgagttgatggatttctttatatatatatattttttttttttgagataggatctcgctctgtcgcccaggctggaatgcagtggcacaatcagagctcactgcagcctcaaattcctaggctcaagtgatcctcctgcctcaggcttccaagaaacagactacaggcgtgcaccaccacacctggctcatttaaaaaaattattttttgtagagaggggggtctcgctatgttacccagactggtctcaaactcctggcctcaagcaacactcctgccactgcctcccaaagcactagaaatagaggcaagagccagtgcccagccagtt

SEQ ID NO: 85896 - DNA, 601 bp, Human
gctccctagagtacagcgagttctctcccactcagagcagaaggaggtctgacacactcacacctgcaggaaaactgggggccaggaggtgggagacaaaatgaggacacagacaggaggagccccagactccttcctgactccctgccttcaccagaatgaagtagggaggcttagagctccttccaactgcactgttttgcttactgaattttcattttgcttttcttaattataagaataatgcaaagtcccatcaacaacatttttgtgtgagttgatggatttctttatatatatatattttttttttttgagataggatctcgctctgtcgcccaggctggaatgcagtggcacaatcagagctcactgcagcctcaaattcctaggctcaagtgatcctcctgcctcaggcttccaagaaacagactacaggcgtgcaccaccacacctggctcatttaaaaaaattattttttgtagagaggggggtctcgctatgttacccagactggtctcaaactcctggcctcaagcaacactcctgccactgcctcccaaagcactagaaatagaggcaagagccagtgcccagccag

SEQ ID NO: 85897 - DNA, 601 bp, Human
cagctccctagagtacagcgagttctctcccactcagagcagaaggaggtctgacacactcacacctgcaggaaaactgggggccaggaggtgggagacaaaatgaggacacagacaggaggagccccagactccttcctgactccctgccttcaccagaatgaagtagggaggcttagagctccttccaactgcactgttttgcttactgaattttcattttgcttttcttaattataagaataatgcaaagtcccatcaacaacatttttgtgtgagttgatggatttctttatatatatatattttttttttttgagataggatctcgctctgtcgcccaggctggaatgcagtggcacaatcagagctcactgcagcctcaaattcctaggctcaagtgatcctcctgcctcaggcttccaagaaacagactacaggcgtgcaccaccacacctggctcatttaaaaaaattattttttgtagagaggggggtctcgctatgttacccagactggtctcaaactcctggcctcaagcaacactcctgccactgcctcccaaagcactagaaatagaggcaagagccagtgcccagcc

SEQ ID NO: 85898 - DNA, 601 bp, Human
ctcagctccctagagtacagcgagttctctcccactcagagcagaaggaggtctgacacactcacacctgcaggaaaactgggggccaggaggtgggagacaaaatgaggacacagacaggaggagccccagactccttcctgactccctgccttcaccagaatgaagtagggaggcttagagctccttccaactgcactgttttgcttactgaattttcattttgcttttcttaattataagaataatgcaaagtcccatcaacaacatttttgtgtgagttgatggatttctttatatatatatattttttttttttgagataggatctcgctctgtcgcccaggctggaatgcagtggcacaatcagagctcactgcagcctcaaattcctaggctcaagtgatcctcctgcctcaggcttccaagaaacagactacaggcgtgcaccaccacacctggctcatttaaaaaaattattttttgtagagaggggggtctcgctatgttacccagactggtctcaaactcctggcctcaagcaacactcctgccactgcctcccaaagcactagaaatagaggcaagagccagtgcccag

SEQ ID NO: 85899 - DNA, 601 bp, Human
agtttgcaagatactgaagtcgcacgttgtttctaagaacactgatgctctaaatctccagcttttgacttcaggaaaatggcacttactttatattcatagaatttctggggcagttcttctcaaactttaacatgcacgtgaatcgccgagggatcttgttaagaggcagattctagctcggtcagtctggatgggacctgagattctgcattcaggttcccagaggatgtcaaagctgctggtgcatggaccacactttgaatgatgagatctgtttagctggttggtaggtacctgrtggctgagctttcaaactctgtaatcagactacctgggtttgcatccagcctccactgtttaccctttcttactgtgtgcctcagcttccacatttgcagaatagtgctcaaaataacagtacaaatagagctgctccgtgggttacagaaagctatatgtataaatcactcggcacagtgtatggcacatgagcactcaagaggtgagctgtttctgccctggtgtaatcatccctcacagagcccttgttcccaccttctttccaggcagtagaaagccagaatagtctccagagaca

SEQ ID NO: 85900 - DNA, 601 bp, Human
tttccaggccattctgcctgagttgagatcattatgctgcttctttcattgcacaggaacgtgggggttttctctaaactatgactcatagcaaagcatacaggcaatcgtgtagagaaacctgttctccccaggaaaggagggtgagcaaatgctaaaagttttgatactttaatatagcactggccgtggctaattttacttaatatgaaagatttcaaataatggaaacactgacaggcaaaaacattaaaagtttgcataaaatctcaaaaaaccctgcaaacaagagagaagcatkgtctaattaaaataaaggaaaagattgctactgggttcctgaatactcttttcacaaaggcttcacgtcagatgaacttcaagcaccaagcagcagggatcccactgaagtttattcagcgcccttctgggcactaccagctgtgaaactggtaacctattgacaaataggttatttttccagctgcacccatattcaagagcttgaccaacaaagtcccctgataatatttggccatgagtcagaatgtattaggcaccttctgtagccagagccaaaaaaactctggctacaggagaa

SEQ ID NO: 85901 - DNA, 601 bp, Human
cgggagcccacacatctttctctgtgttcttgtgaccatggaaatcaggcaggtctcaagaaacaaagtcacagaggcacgagctcatcatctattttcacaacactaatgcaagagacctccaacacaagcaaagcaaaggtaccgactgggtgcagccacatatcgtgactttccaggccattctgcctgagttgagatcattatgctgcttctttcattgcacaggaacgtgggggttttctctaaactatgactcatagcaaagcatacaggcaatcgtgtagagaaacctgttctycccaggaaaggagggtgagcaaatgctaaaagttttgatactttaatatagcactggccgtggctaattttacttaatatgaaagatttcaaataatggaaacactgacaggcaaaaacattaaaagtttgcataaaatctcaaaaaaccctgcaaacaagagagaagcatggtctaattaaaataaaggaaaagattgctactgggttcctgaatactcttttcacaaaggcttcacgtcagatgaacttcaagcaccaagcagcagggatcccactgaagtttattcagcgcccttct

SEQ ID NO: 85902 - DNA, 601 bp, Human
acctctgtattaaaatgatctctattttcttttcattaagggaaaaatatacaaggggggtggatgcagggggcaaggagtgggtaagcagaccagaaagagactccacattaaaacacacaggaaaacagatcttctctctggaagacacctgcaatctctttgtttcctttcttatattaggtcttccgcatggtcaaggaaagagacccactccagttagttcaagagaaactgtttattgtaaggacacatgcagattgctaccagaagccttcatattctctccccactcccctgycccatggtcccctatttccactcccctccagtcatccccacactgtcctcctcccacagctgtcccctgttccttcctaacttcagctcattgtggcatcttttcagcccctgtatccacgatgctaactgaaaaatcctattctatttctaattcaaaagcccacattcaagctcatcctttcaaacccagccacagacgtcaaatttcagactgaggactggatatactttcatcggtccaacactcttggtcaaagcagcaatccacagcaagaagggcggggcaaccacaaagatt

SEQ ID NO: 85903 - DNA, 601 bp, Human
ccattctcctatttaacctactgggctttaaagccagtggccctttttcttagcttcctcattcatgaaacagttttctggggaggccctagaattttacctctgtattaaaatgatctctattttcttttcattaagggaaaaatatacaaggggggtggatgcagggggcaaggagtgggtaagcagaccagaaagagactccacattaaaacacacaggaaaacagatcttctctctggaagacacctgcaatctctttgtttcctttcttatattaggtcttccgcatggtcaaggmaagagacccactccagttagttcaagagaaactgtttattgtaaggacacatgcagattgctaccagaagccttcatattctctccccactcccctgccccatggtcccctatttccactcccctccagtcatccccacactgtcctcctcccacagctgtcccctgttccttcctaacttcagctcattgtggcatcttttcagcccctgtatccacgatgctaactgaaaaatcctattctatttctaattcaaaagcccacattcaagctcatcctttcaaacccagccacagacgt

SEQ ID NO: 85904 - DNA, 601 bp, Human
atttgttgtcacaactatggactgctacctgcatttagtgggtagagtccagggatgttgctatatatcttacaatgcacagaacagcccctcccacagcaaagaattctcctgctcaaaatgtccatagtgccaaggttaaagcttgatattataacctaaggttcccatcccaacttgaccaattaatcattttataactttctccattctcctatttaacctactgggctttaaagccagtggccctttttcttagcttcctcattcatgaaacagttttctggggaggccctagaaytttacctctgtattaaaatgatctctattttcttttcattaagggaaaaatatacaaggggggtggatgcagggggcaaggagtgggtaagcagaccagaaagagactccacattaaaacacacaggaaaacagatcttctctctggaagacacctgcaatctctttgtttcctttcttatattaggtcttccgcatggtcaaggaaagagacccactccagttagttcaagagaaactgtttattgtaaggacacatgcagattgctaccagaagccttcatattctctccccactccc

SEQ ID NO: 85905 - DNA, 601 bp, Human
aagatcagcataaacaaagtcacattcaggccaggactcttaagaaaggggcgtgttttctcctcacttatttttctgctgattggaaagaaaagacagtgagatttaggggactggaagagccacaatatggcagaaatctaggtccctgaatcactgcatggccataggaaagctgttcaccaaccaggaacaccattacatcagcaggaagcaaacttctactatgttataccactgatatttgagggcttatttgttatagcatctaccattatcctttgaattacgaagctaaggraaaaaaagcccattggctttaaaacccagcagagttcagtaggaggaggaagatggagaaagttataaagtaatcaagttgggtgggaacctcaggttagatcctcattacacttagaatgagcgttacccatttgacacaggtggatatctttgctgttactcaaagccaagaggaaggtattttccagctttatttgatgaataaattgataaataaatatcagcttaatattttccagaaatctgttaattcatacaggtaagagactgtgccttagtcatctctgtagcctccaca

SEQ ID NO: 85906 - DNA, 601 bp, Human
gaagatcagcataaacaaagtcacattcaggccaggactcttaagaaaggggcgtgttttctcctcacttatttttctgctgattggaaagaaaagacagtgagatttaggggactggaagagccacaatatggcagaaatctaggtccctgaatcactgcatggccataggaaagctgttcaccaaccaggaacaccattacatcagcaggaagcaaacttctactatgttataccactgatatttgagggcttatttgttatagcatctaccattatcctttgaattacgaagctaagrgaaaaaaagcccattggctttaaaacccagcagagttcagtaggaggaggaagatggagaaagttataaagtaatcaagttgggtgggaacctcaggttagatcctcattacacttagaatgagcgttacccatttgacacaggtggatatctttgctgttactcaaagccaagaggaaggtattttccagctttatttgatgaataaattgataaataaatatcagcttaatattttccagaaatctgttaattcatacaggtaagagactgtgccttagtcatctctgtagcctccac

SEQ ID NO: 85907 - DNA, 601 bp, Human
agaaaagattcaagtagcagacagactgctgtatctaaaaacttgggttcttttcccagctccatcttaaactgtgcagaaagagaattctgctaaactctccccactgctgaataaagtgtcctatgtgaacaggatcctgatggtaaattttcataaccagagactgtcacagaattttagccaagatgagccattcaatattgatttattctacttgatcggaaatcatcagtagtccaattgtcctttctaatggaagatcagcataaacaaagtcacattcaggccaggactcttragaaaggggcgtgttttctcctcacttatttttctgctgattggaaagaaaagacagtgagatttaggggactggaagagccacaatatggcagaaatctaggtccctgaatcactgcatggccataggaaagctgttcaccaaccaggaacaccattacatcagcaggaagcaaacttctactatgttataccactgatatttgagggcttatttgttatagcatctaccattatcctttgaattacgaagctaagggaaaaaaagcccattggctttaaaacccagcagagttcagta

SEQ ID NO: 85908 - DNA, 601 bp, Human
gtcacccccaccccaccccacgcagcaattgtagtttttcccgccccgatacttgcgacatcaatgtactgctgtgggtacagctctacaagcacctgttttgcaattttcaggttaacaagtaaaatcttccttgagtgtatacctctaagcctgtgaacaatatttctcatccattcatcccctctgaaaatattttacatgcccaatcctctggtaggtaattaggatatagaaattgggcacaatctatgtcttccagtcctggtatggcggagaagaaaagattcaagtagcagayagactgctgtatctaaaaacttgggttcttttcccagctccatcttaaactgtgcagaaagagaattctgctaaactctccccactgctgaataaagtgtcctatgtgaacaggatcctgatggtaaattttcataaccagagactgtcacagaattttagccaagatgagccattcaatattgatttattctacttgatcggaaatcatcagtagtccaattgtcctttctaatggaagatcagcataaacaaagtcacattcaggccaggactcttaagaaaggggcgtgttttctcc

SEQ ID NO: 85909 - DNA, 601 bp, Human
catctgttgtggctggtgttatctttgccatcacttaaggagaatctgccaaagactgagtctgacagaggaaagcggagcccaggtacaggaagacgttctcgaagacattgttatatatctgtattcagccgtgctggaagccagataccctgaactttttagttacctgatcaaataaatgttcctgtttggcttcaggttctcatttagactcctgtcacttatatctctggctaataaagggaactatggtcacccccaccccaccccacgcagcaattgtagtttttcccgcccsgatacttgcgacatcaatgtactgctgtgggtacagctctacaagcacctgttttgcaattttcaggttaacaagtaaaatcttccttgagtgtatacctctaagcctgtgaacaatatttctcatccattcatcccctctgaaaatattttacatgcccaatcctctggtaggtaattaggatatagaaattgggcacaatctatgtcttccagtcctggtatggcggagaagaaaagattcaagtagcagacagactgctgtatctaaaaacttgggttcttttcccagctccatctt

SEQ ID NO: 85910 - DNA, 601 bp, Human
gagttgataaatgctgaagctggatggtgagtataggagagttatctctgcttatgattagagttacctctattttcatgcattttggaaaatcatcataataaaaagttaattttgaaaaaagaatctcttttactcaagtttgaggtaaagtctcatttcacctcactgggtcttcctggaccagataaccatccccgaactgttcacagggaccaggagcatataatgaccacattgttccagcactgaaccatatgctccatctctgcaccaggaggaatctctacaaaaagctcasgggctacagctggggagagggcttaacagagattgattacatacaattaccagaagaatggaaatgagtgttaagataaaaaatacacaggttcattccataatgacaatagaaatatagtggacatagaatatctttcctcatcaagcatccattctagttttttactgaagaattgtccctgcttgcccctttatccctgtggactgggcaccccttgtgctaatggtgcacaagtgacttggtctgaacaatgagagggagaccctggtgatgggtgcagagatgagcacatggcac

SEQ ID NO: 85911 - DNA, 601 bp, Human
gatgttgggaatttgctccaaaataatctactgtgggtggcaataaaatgaattaagattgtccatgagttgataaatgctgaagctggatggtgagtataggagagttatctctgcttatgattagagttacctctattttcatgcattttggaaaatcatcataataaaaagttaattttgaaaaaagaatctcttttactcaagtttgaggtaaagtctcatttcacctcactgggtcttcctggaccagataaccatccccgaactgttcacagggaccaggagcatataatgaccrcattgttccagcactgaaccatatgctccatctctgcaccaggaggaatctctacaaaaagctcaggggctacagctggggagagggcttaacagagattgattacatacaattaccagaagaatggaaatgagtgttaagataaaaaatacacaggttcattccataatgacaatagaaatatagtggacatagaatatctttcctcatcaagcatccattctagttttttactgaagaattgtccctgcttgcccctttatccctgtggactgggcaccccttgtgctaatggtgcac

SEQ ID NO: 85912 - DNA, 601 bp, Human
agcaagaaactggggggacatggtttagttggaaggtgatcacaggaagtgtggtgaggaagtagaaaaataagacaggaaaggaaaagaagccagcagcagggaaattcatgggaaggttacttctggggataacagggatttaaccccacaagggccctccaataacagtgtaggacacacctcattactgtctccctgagcagcaaagaagccagggtatgccaacttctatccctcatcattaaagacagttctggggggcatttatttatcccctgccacttcaggtctgccataygcaggagccaaacacaatcgtatggccagagaacattcttaggcagagagatgcctgtgcttgaggtgagaagccatcactgtgttgggaactgtccatctaagcttcaggtgaccctcagggtgggccaagaggatatgagtggggcatcaacaacatagctacagggaatattctagctcaagtgactgaaaaaaaaaaaaaaagtagctaagcttactccatgcacaggtgaattcaggacccaaaatctgtcatctggatttcgtgttcctccttcttgctgttctgctgccacac

SEQ ID NO: 85913 - DNA, 601 bp, Human
gaacttaaaattaaatagaaatttttaaaaaggaaatagaaccatggaagcttaagcaaaatgaagcaaaggggaattacttcagttaagttttactttagagcagatgctaaagcaagaaactggggggacatggtttagttggaaggtgatcacaggaagtgtggtgaggaagtagaaaaataagacaggaaaggaaaagaagccagcagcagggaaattcatgggaaggttacttctggggataacagggatttaaccccacaagggccctccaataacagtgtaggacacacctcaktactgtctccctgagcagcaaagaagccagggtatgccaacttctatccctcatcattaaagacagttctggggggcatttatttatcccctgccacttcaggtctgccatatgcaggagccaaacacaatcgtatggccagagaacattcttaggcagagagatgcctgtgcttgaggtgagaagccatcactgtgttgggaactgtccatctaagcttcaggtgaccctcagggtgggccaagaggatatgagtggggcatcaacaacatagctacagggaatattctagctcaagtg

SEQ ID NO: 85914 - DNA, 601 bp, Human
accagagtctgttggtggtggggaagggagagcatcaggataaatagctaatgcatatggggcttaatacctaggtgataggttgagaggtgcagcaatccattatggcaaatgtctacctaggtaacaaacctatgttctgtacatgtatcccagaacttaaaattaaatagaaatttttaaaaaggaaatagaaccatggaagcttaagcaaaatgaagcaaaggggaattacttcagttaagttttactttagagcagatgctaaagcaagaaactggggggacatggtttagttggraggtgatcacaggaagtgtggtgaggaagtagaaaaataagacaggaaaggaaaagaagccagcagcagggaaattcatgggaaggttacttctggggataacagggatttaaccccacaagggccctccaataacagtgtaggacacacctcattactgtctccctgagcagcaaagaagccagggtatgccaacttctatccctcatcattaaagacagttctggggggcatttatttatcccctgccacttcaggtctgccatatgcaggagccaaacacaatcgtatggccagaga

SEQ ID NO: 85915 - DNA, 601 bp, Human
ggtcaaggccctggcccttggagcctccacagtgatgatgggctccctgctggccaccaccacggaggcccagcggcgagtacttcttctcagacagggtgcagctcaagaagtactggggcatgggctcgctagatgccatggagaagagcagcagcagccagaaacgatacttcagcgagggggaaaaggtgaatattgtgcagggtgtctcggcctccatccaggacaaagggtccattcagaagtttgtgccctacctcatagcgagtaaccagcatggctccatgatgtactcagragagctcaaatttgagaagtggaccatgtcagcccagatcgagggtggcgtccatggcctgcacgcttaccagaagcagctgtactgaggatagcagtggaggatgaggtggtggagggagcataccccagtgtccaccttcgggcacaacctctctccataactgagtggtccacagatttgcactacgggttccccagctcctttccagggagagaggaggagaggtcctgagggctctgcagcccctcgctgagcatcccctacagagtcgggcctgctccctgggccaggctgcct

SEQ ID NO: 85916 - DNA, 601 bp, Human
caggtgattgggaggaatgtggtgacagcagcccaggctaagaacctgattgacactggtgtggatggactgcatgtagttatgggctgcagctctatctgcatcacccaggaagtgatggcctgcggtcagccccagggcactgctgtgtacaaggtggccaagtacgctcagcactttggtgtgtccatcatagccgatgtggcatccagaccgtggggcacgtggtcaaggccctggcccttggagcctccacagtgatgatgggctccctgctggccaccaccacggaggcccagcrgcgagtacttcttctcagacagggtgcagctcaagaagtactggggcatgggctcgctagatgccatggagaagagcagcagcagccagaaacgatacttcagcgagggggaaaaggtgaatattgtgcagggtgtctcggcctccatccaggacaaagggtccattcagaagtttgtgccctacctcatagcgagtaaccagcatggctccatgatgtactcaggagagctcaaatttgagaagtggaccatgtcagcccagatcgagggtggcgtccatggcctgcacgcttaccaga

SEQ ID NO: 85917 - DNA, 601 bp, Human
tgaagaagaatcgagactacattctggcctccaaggattcccacaagcagctgctgtgcagggcagctgtgggcacccatgaggatgacaaatactgcctggacctgctcacctgggtaggcatcaacgtcatagtcttggactcctcccaagggaactcggtgtatcaaatcaccatggtgcattacatcaaacagaagtacctccacctccaggtgattgggaggaatgtggtgacagcagcccaggctaagaacctgattgacactggtgtggatggactgcatgtagttatgggctrcagctctatctgcatcacccaggaagtgatggcctgcggtcagccccagggcactgctgtgtacaaggtggccaagtacgctcagcactttggtgtgtccatcatagccgatgtggcatccagaccgtggggcacgtggtcaaggccctggcccttggagcctccacagtgatgatgggctccctgctggccaccaccacggaggcccagcggcgagtacttcttctcagacagggtgcagctcaagaagtactggggcatgggctcgctagatgccatggagaagagcagcagcagcca

SEQ ID NO: 85918 - DNA, 601 bp, Human
atcgccatgagctagtggccatcgtctcccacaccaacctgaagaagaatcgagactacattctggcctccaaggattcccacaagcagctgctgtgcagggcagctgtgggcacccatgaggatgacaaatactgcctggacctgctcacctgggtaggcatcaacgtcatagtcttggactcctcccaagggaactcggtgtatcaaatcaccatggtgcattacatcaaacagaagtacctccacctccaggtgattgggaggaatgtggtgacagcagcccaggctaagaacctgaytgacactggtgtggatggactgcatgtagttatgggctgcagctctatctgcatcacccaggaagtgatggcctgcggtcagccccagggcactgctgtgtacaaggtggccaagtacgctcagcactttggtgtgtccatcatagccgatgtggcatccagaccgtggggcacgtggtcaaggccctggcccttggagcctccacagtgatgatgggctccctgctggccaccaccacggaggcccagcggcgagtacttcttctcagacagggtgcagctcaagaagtactggggcat

SEQ ID NO: 85919 - DNA, 601 bp, Human
tgggcatcatctcctcccgagacatcaactttcttgctgagaaggaccacaccaccctcctcagtgaggtgatgacgccaaggatcaagctgatggtggctccagcaggcatgacattgaaacaggcaaatgagatccttcagcctagcaagggaagctgcctatggtcaatgatcgccatgagctagtggccatcgtctcccacaccaacctgaagaagaatcgagactacattctggcctccaaggattcccacaagcagctgctgtgcagggcagctgtgggcacccatgaggatgamaaatactgcctggacctgctcacctgggtaggcatcaacgtcatagtcttggactcctcccaagggaactcggtgtatcaaatcaccatggtgcattacatcaaacagaagtacctccacctccaggtgattgggaggaatgtggtgacagcagcccaggctaagaacctgattgacactggtgtggatggactgcatgtagttatgggctgcagctctatctgcatcacccaggaagtgatggcctgcggtcagccccagggcactgctgtgtacaaggtggccaagtacgctcagcac

SEQ ID NO: 85920 - DNA, 601 bp, Human
cggcatggcttctcttgcatcctcatcactgagatgggcaccatggggagcaagttggtgggcatcatctcctcccgagacatcaactttcttgctgagaaggaccacaccaccctcctcagtgaggtgatgacgccaaggatcaagctgatggtggctccagcaggcatgacattgaaacaggcaaatgagatccttcagcctagcaagggaagctgcctatggtcaatgatcgccatgagctagtggccatcgtctcccacaccaacctgaagaagaatcgagactacattctggcctycaaggattcccacaagcagctgctgtgcagggcagctgtgggcacccatgaggatgacaaatactgcctggacctgctcacctgggtaggcatcaacgtcatagtcttggactcctcccaagggaactcggtgtatcaaatcaccatggtgcattacatcaaacagaagtacctccacctccaggtgattgggaggaatgtggtgacagcagcccaggctaagaacctgattgacactggtgtggatggactgcatgtagttatgggctgcagctctatctgcatcacccaggaagtgat

SEQ ID NO: 85921 - DNA, 601 bp, Human
ataaggtcaagaagtttgaacagggcttcatcacggaccccgtggtgctgagcccctcacacactgtgggtgatgtgctggaggccaagatccggcatggcttctcttgcatcctcatcactgagatgggcaccatggggagcaagttggtgggcatcatctcctcccgagacatcaactttcttgctgagaaggaccacaccaccctcctcagtgaggtgatgacgccaaggatcaagctgatggtggctccagcaggcatgacattgaaacaggcaaatgagatccttcagcctagcaagggaagctgcctatggtcaatgatcgccatgagctagtggccatcgtctcccacaccaacctgaagaagaatcgagactacattctggcctccaaggattcccacaagcagctgctgtgcagggcagctgtgggcacccatgaggatgacaaatactgcctggacctgctcacctgggtaggcatcaacgtcatagtcttggactcctcccaagggaactcggtgtatcaaatcaccatggtgcattacatcaaacagaagtacctccacctccaggtgattgggaggaatgtggtgaca

SEQ ID NO: 85922 - DNA, 601 bp, Human
accccagagttccaggccaacgaggtgcataaggtcaagaagtttgaacagggcttcatcacggaccccgtggtgctgagcccctcacacactgtgggtgatgtgctggaggccaagatccggcatggcttctcttgcatcctcatcactgagatgggcaccatggggagcaagttggtgggcatcatctcctcccgagacatcaactttcttgctgagaaggaccacaccaccctcctcagtgaggtgatgacgccaaggatcaagctgatggtggctccagcaggcatgacattgaaasaggcaaatgagatccttcagcctagcaagggaagctgcctatggtcaatgatcgccatgagctagtggccatcgtctcccacaccaacctgaagaagaatcgagactacattctggcctccaaggattcccacaagcagctgctgtgcagggcagctgtgggcacccatgaggatgacaaatactgcctggacctgctcacctgggtaggcatcaacgtcatagtcttggactcctcccaagggaactcggtgtatcaaatcaccatggtgcattacatcaaacagaagtacctccacct

SEQ ID NO: 85923 - DNA, 601 bp, Human
aacttcagccctgacccggaagatcatgctgaagacaccactgatctcttcccctatggacactgagacagaggccgacatggccatcgcgatggctctgatgggaggtattggtttcattcaccacaactgcaccccagagttccaggccaacgaggtgcataaggtcaagaagtttgaacagggcttcatcacggaccccgtggtgctgagcccctcacacactgtgggtgatgtgctggaggccaagatccggcatggcttctcttgcatcctcatcactgagatgggcaccatgggsagcaagttggtgggcatcatctcctcccgagacatcaactttcttgctgagaaggaccacaccaccctcctcagtgaggtgatgacgccaaggatcaagctgatggtggctccagcaggcatgacattgaaacaggcaaatgagatccttcagcctagcaagggaagctgcctatggtcaatgatcgccatgagctagtggccatcgtctcccacaccaacctgaagaagaatcgagactacattctggcctccaaggattcccacaagcagctgctgtgcagggcagctgtgggcaccc

SEQ ID NO: 85924 - DNA, 601 bp, Human
ggcagcagcggcaggcggccgcgcgggtgtttgtcgcttcgcggggccttgcggcagcatggcggaccatctgatcagtggcggcaccggctacgtgccccaggactggctcaccgtgcagcagctcttcctcggcgccaactgccgcacccacaacaacttcctgattctcccatggttcatagatttcatagctgatgaggtagacctaacttcagccctgacccggaagatcatgctgaagacaccactgatctcttcccctatggacactgagacagaggccgacatggccatcgcratggctctgatgggaggtattggtttcattcaccacaactgcaccccagagttccaggccaacgaggtgcataaggtcaagaagtttgaacagggcttcatcacggaccccgtggtgctgagcccctcacacactgtgggtgatgtgctggaggccaagatccggcatggcttctcttgcatcctcatcactgagatgggcaccatggggagcaagttggtgggcatcatctcctcccgagacatcaactttcttgctgagaaggaccacaccaccctcctcagtgaggtgatgacgcca

SEQ ID NO: 85925 - DNA, 601 bp, Human
acagtttggaggctttcaagggatttgttcaattccatttctaaaaggaatctatactgagaaaataacagtaaatataaaggtttatgcacagagatgtttatcagtggcatttatattagcaaaagtttccatgaaaatgaccaaggcacccaacactaagtggttaaataaccaccactatgggcattaaaaattatgcttacagttcccaggcccacagcgtcagcagcagcggcagcagcggcaggcggccgcgcgggtgtttgtcgcttcgcggggccttgcggcagcatggcgraccatctgatcagtggcggcaccggctacgtgccccaggactggctcaccgtgcagcagctcttcctcggcgccaactgccgcacccacaacaacttcctgattctcccatggttcatagatttcatagctgatgaggtagacctaacttcagccctgacccggaagatcatgctgaagacaccactgatctcttcccctatggacactgagacagaggccgacatggccatcgcgatggctctgatgggaggtattggtttcattcaccacaactgcaccccagagttccaggccaacg

SEQ ID NO: 85926 - DNA, 601 bp, Human
caagggatatttcaaagataaaaccaacaggatttgctgacagactgcaagtatgagataaggagaaatcttgtagcaggttctggataagtgatcataaatcctactccgttttcctcctgggaatatttagtccataaaaaacttcccaggctccactcctttcacagctcaacacagatgatgtcagtggccttagaagccatatgttgaaggtggcagaaccaaaagatgaaaggagctgagcccctgaatcgtcacttgtcagagggccgccctctgaatacaaacatccacattygacttcagacgagtaagaagtacatctgtggtggattcagtttctgctattcagggatgtatgtgttaaactaacttttcttaacctaattacttcagacaaaaatcaagaaaaagctagtatatcagctcgaccaattaagtggagctaagaatactcttacttcagctcttaaaagaactgattgaaatgagacagtttggaggctttcaagggatttgttcaattccatttctaaaaggaatctatactgagaaaataacagtaaatataaaggtttatgcacagagatgtttatca

SEQ ID NO: 85927 - DNA, 601 bp, Human
aaccaccatatatgttcttggaaattcaccaagcacattaccatgttaggcagacttattactattctgcaatatctgcaagtaacatagaagcaaaaaaagcacataacacataaaataattacacatagacctgaggtagaaaacaaataatcagaggagaaggcaagagaaaggtgaagccaccttaggtagaatggtcaggaaacatcctttctgagaaaacatttaggctgagaagctaattaagaaataacagagaaaactaatgaaacccaaagctgattctctttaaaaaaamaaaaaaaaacaaaattgataaacctaggtagactgatcaagaagaaaagagactatcagaaataaagtctggtgcattactacagactttcagatattaaaaggattaaaaaacccttatgcctataaatttgacaacctagatgaaatggacaaattcctggaaagatacaaattaccaaagctttttcaaaaagaaatagaaaccttcaccaaccctgtatcaattaaagaaattgaacccatagtttaaaaccctcccacaaagtaaacttcaggcccagatgtcttctctgctgca

SEQ ID NO: 85928 - DNA, 601 bp, Human
acacagctgacaggtaacagagccagaactcaaaccccaggcctcctgatcacagctgccatgttgcacaaccctcatctcagaaggaatcagaatttgtgttcacggttacacgtgttcagggtcacacacttagtgtacgatgtagccggggttaaagctgagatgagccaactctagaccctagtctcttaaccactatagatactgctgtgctagcatacttggaaaccaccatatatgttcttggaaattcaccaagcacattaccatgttaggcagacttattactattctgcartatctgcaagtaacatagaagcaaaaaaagcacataacacataaaataattacacatagacctgaggtagaaaacaaataatcagaggagaaggcaagagaaaggtgaagccaccttaggtagaatggtcaggaaacatcctttctgagaaaacatttaggctgagaagctaattaagaaataacagagaaaactaatgaaacccaaagctgattctctttaaaaaaaaaaaaaaaaacaaaattgataaacctaggtagactgatcaagaagaaaagagactatcagaaataaagtctg

SEQ ID NO: 85929 - DNA, 601 bp, Human
agaccagggctgaaggaagttagacacgcttctgtgaagaaaactgatattctgctggggtttgcaagatccctaaaggtcccgtcctccccctgggaatcccagcagtttagaagattcctgaaagggaaaggagcagctcacctgagacaagcaagggccagattgttgaagccatcgttgccctgctgagcttcaggacactcaactcacagttgcagatttcataagcaacaaaaagaagaatccatttcacaggcatttttcagtgcctgtctgaccacactgatcaaggcagtgrgggtacagaggtgcacaaaacgtgcaaagtgcctgctacagtgatgcttaccctctggtggggagagctgaagttctgggaaagtacagtttgagggaatgcctcatatgcaaaaggccaaccctgggctagatcctactcatgtatgtctcatccagttcctcccaataatcccaagattaggtactccttgcatcaaatcattttaaagaagagaaaattgagtgtattagtccattttcatgctgctgataaagacataactgaaactgggaagaaaaagaggtttaatggacttac

SEQ ID NO: 85930 - DNA, 601 bp, Human
accacaaggcataaacagcagcagtccccagaggacaatgtacacacaacctctttcctccaactctggtgttgaaactgccctgagctgactttaaatccactgcaggtagttgcatgaggagtacttacaggatcctgctggctctgttgctactctctatcatggagtcctgcagcctttgaataaatacctgccaggccaagctagcaaatagcacagtttcatgtctggaatttgcagaccagggctgaaggaagttagacacgcttctgtgaagaaaactgatattctgctgggrtttgcaagatccctaaaggtcccgtcctccccctgggaatcccagcagtttagaagattcctgaaagggaaaggagcagctcacctgagacaagcaagggccagattgttgaagccatcgttgccctgctgagcttcaggacactcaactcacagttgcagatttcataagcaacaaaaagaagaatccatttcacaggcatttttcagtgcctgtctgaccacactgatcaaggcagtgagggtacagaggtgcacaaaacgtgcaaagtgcctgctacagtgatgcttaccctctggt

SEQ ID NO: 85931 - DNA, 601 bp, Human
gaaagcagggtggatctgtctcccccaaaggaaaccacaaggcataaacagcagcagtccccagaggacaatgtacacacaacctctttcctccaactctggtgttgaaactgccctgagctgactttaaatccactgcaggtagttgcatgaggagtacttacaggatcctgctggctctgttgctactctctatcatggagtcctgcagcctttgaataaatacctgccaggccaagctagcaaatagcacagtttcatgtctggaatttgcagaccagggctgaaggaagttagacaygcttctgtgaagaaaactgatattctgctggggtttgcaagatccctaaaggtcccgtcctccccctgggaatcccagcagtttagaagattcctgaaagggaaaggagcagctcacctgagacaagcaagggccagattgttgaagccatcgttgccctgctgagcttcaggacactcaactcacagttgcagatttcataagcaacaaaaagaagaatccatttcacaggcatttttcagtgcctgtctgaccacactgatcaaggcagtgagggtacagaggtgcacaaaacgtgca

SEQ ID NO: 85932 - DNA, 601 bp, Human
agccaagatgatgaccattcttataagtgaaagagttttttttttttgtttggggaagtgtttttttttttctttttatctttcattcctgttcaaattcttttttaatttacacataagaaaaagtggtctggcacagtggctcacatctgtaatcctagcactttgggagactgagagggaggactgcttgagaccaggaattcgagaccaacctgggcaatatattgagaccctgtctctatttaaaattgttttaatttaaaaaaatttacaataaataaataaaaataagaaaaamctcccaaatcccaccactctagtacaaccaaagtggccacaccatcacacgtgaggttgttcacagcatccttctctggggatgattctaagtcccttgaagatagggagcgtgactagtttgtctctgaatccctggtacctggaagtggcctgacccccagaaggcactccgatgacgtctgttgaatggatagatgagaatgcacataagaaaaagtgatttttttcctaacaaagtaaaatggcattccacggactttggggaagttggctccttcacttctagagaaaaaaggag

SEQ ID NO: 85933 - DNA, 601 bp, Human
gcacacgtaatcccagctacttgggaggctgaggcaggagaatggcttgaacccaggaggtgggggttgcagacagctaagatcgtgccactgcacgccagcctcggtgacaaggcaagactctatctccaaaaataataattctaaataaagcaaaataaaatgtatgcataaacatatatatgcaaaggtatatgtatatgcacatacatgcatacatgtgtatagatatatgtacagtatagcctgccagctatgttaaaagaagttttttgcaaagccaccttttgtgtatggaactgtgtgtgaaaaaagacttatagaactgtgagaaacttggataaaatgaggcatgcgtacttccccatctgaaatagccaagatgatgaccattcttataagtgaaagagttttttttttttgtttggggaagtgtttttttttttctttttatctttcattcctgttcaaattcttttttaatttacacataagaaaaagtggtctggcacagtggctcacatctgtaatcctagcactttgggagactgagagggaggactgcttgagaccaggaattcgagaccaacctgggcaatat

SEQ ID NO: 85934 - DNA, 601 bp, Human
gtacaacaatcccttggctcccatgaacatcgtagaccccactgtgtgcaggggccgcagtcgacggcagggtatgaggagaaacaggacaggtttccatgtcccttgtgagcgcagagtgtaggaggaagattgacaggaaaaccaaaataagacacctgaaactccacgatatgataaatgatatgacaacagggggaggtgctaaatgttacgagagtgcagcagaggcataaaataaaagaagcctgaagcaaacttttaattcgttacacaaaaaagtctttagtcttctttgccragattaaagcagtgccactctgggtctggagccgaactggtagctggggtctagaagaattcagagttcatcccgagtcttctctagagatggaagcctggagaagcctggagaagcctggggaagccagaaggccctgaacccctgacaaaaagcctaaggatcctcacccagcaatgctgaccacgaccattaaaacatgaagcccacccccaaagaggaaaatccttgccctttaatgaagctgccaaaaacctccaaatttaacagtttgcactgtgtctttctgcagacacagaa

SEQ ID NO: 85935 - DNA, 601 bp, Human
aggcaaaaagtgcaaagcataccgaaaaataaatatccagccttaaaaaatcagtacaacaatcccttggctcccatgaacatcgtagaccccactgtgtgcaggggccgcagtcgacggcagggtatgaggagaaacaggacaggtttccatgtcccttgtgagcgcagagtgtaggaggaagattgacaggaaaaccaaaataagacacctgaaactccacgatatgataaatgatatgacaacagggggaggtgctaaatgttacgagagtgcagcagaggcataaaataaaagaagmctgaagcaaacttttaattcgttacacaaaaaagtctttagtcttctttgccgagattaaagcagtgccactctgggtctggagccgaactggtagctggggtctagaagaattcagagttcatcccgagtcttctctagagatggaagcctggagaagcctggagaagcctggggaagccagaaggccctgaacccctgacaaaaagcctaaggatcctcacccagcaatgctgaccacgaccattaaaacatgaagcccacccccaaagaggaaaatccttgccctttaatgaagctg

SEQ ID NO: 85936 - DNA, 601 bp, Human
aatcagtatgtaagttacattcattcccctctgcttctggctttccatctgattagatcaaaagcactcttgcatatggaaagcttgcacgagcacaattttacgtggttatgggaaggaatggtgttctctatgtgtatttttattttttccaatgattggattctccagggtgcgcacatgacagagacaagtttctgtactgagtcctgattccctaggcaaaaagtgcaaagcataccgaaaaataaatatccagccttaaaaaatcagtacaacaatcccttggctcccatgaacwtcgtagaccccactgtgtgcaggggccgcagtcgacggcagggtatgaggagaaacaggacaggtttccatgtcccttgtgagcgcagagtgtaggaggaagattgacaggaaaaccaaaataagacacctgaaactccacgatatgataaatgatatgacaacagggggaggtgctaaatgttacgagagtgcagcagaggcataaaataaaagaagcctgaagcaaacttttaattcgttacacaaaaaagtctttagtcttctttgccgagattaaagcagtgccactctgggtctg

SEQ ID NO: 85937 - DNA, 601 bp, Human
taataatcagtatgtaagttacattcattcccctctgcttctggctttccatctgattagatcaaaagcactcttgcatatggaaagcttgcacgagcacaattttacgtggttatgggaaggaatggtgttctctatgtgtatttttattttttccaatgattggattctccagggtgcgcacatgacagagacaagtttctgtactgagtcctgattccctaggcaaaaagtgcaaagcataccgaaaaataaatatccagccttaaaaaatcagtacaacaatcccttggctcccatsaacatcgtagaccccactgtgtgcaggggccgcagtcgacggcagggtatgaggagaaacaggacaggtttccatgtcccttgtgagcgcagagtgtaggaggaagattgacaggaaaaccaaaataagacacctgaaactccacgatatgataaatgatatgacaacagggggaggtgctaaatgttacgagagtgcagcagaggcataaaataaaagaagcctgaagcaaacttttaattcgttacacaaaaaagtctttagtcttctttgccgagattaaagcagtgccactctggg

SEQ ID NO: 85938 - DNA, 601 bp, Human
ggaccagtttgaagaaggaatatcataggagtccaataaatactactagaatgaatgacttaataatcagtatgtaagttacattcattcccctctgcttctggctttccatctgattagatcaaaagcactcttgcatatggaaagcttgcacgagcacaattttacgtggttatgggaaggaatggtgttctctatgtgtatttttattttttccaatgattggattctccagggtgcgcacatgacagagacaagtttctgtactgagtcctgattccctaggcaaaaagtgcaaagsataccgaaaaataaatatccagccttaaaaaatcagtacaacaatcccttggctcccatgaacatcgtagaccccactgtgtgcaggggccgcagtcgacggcagggtatgaggagaaacaggacaggtttccatgtcccttgtgagcgcagagtgtaggaggaagattgacaggaaaaccaaaataagacacctgaaactccacgatatgataaatgatatgacaacagggggaggtgctaaatgttacgagagtgcagcagaggcataaaataaaagaagcctgaagcaaacttttaa

SEQ ID NO: 85939 - DNA, 601 bp, Human
gaagttgagcctgggcatctgggaggatggtggtgccatgccctggaggaggaccagtttgaagaaggaatatcataggagtccaataaatactactagaatgaatgacttaataatcagtatgtaagttacattcattcccctctgcttctggctttccatctgattagatcaaaagcactcttgcatatggaaagcttgcacgagcacaattttacgtggttatgggaaggaatggtgttctctatgtgtatttttattttttccaatgattggattctccagggtgcgcacatgacaragacaagtttctgtactgagtcctgattccctaggcaaaaagtgcaaagcataccgaaaaataaatatccagccttaaaaaatcagtacaacaatcccttggctcccatgaacatcgtagaccccactgtgtgcaggggccgcagtcgacggcagggtatgaggagaaacaggacaggtttccatgtcccttgtgagcgcagagtgtaggaggaagattgacaggaaaaccaaaataagacacctgaaactccacgatatgataaatgatatgacaacagggggaggtgctaaatgttac

SEQ ID NO: 85940 - DNA, 601 bp, Human
cgaagatacaatatttgtgaagggactgtgaaaacgagagtaggcagaggcaaagggttgttattttttctctaggactaaataaaaatataaatgctatttctcttaacacaaaccagtttgaagaaactattcgacgtattcattctgtcatctgttcattcatctgttattgaacctttcaaggtaaaagattagaggattctggccagcagagaaaagagaaaagtggatggatatgaacactatgtagaaggtgtagtcacagggtgaggggtgtgagggaaatggtggcagcaasaagttgagcctgggcatctgggaggatggtggtgccatgccctggaggaggaccagtttgaagaaggaatatcataggagtccaataaatactactagaatgaatgacttaataatcagtatgtaagttacattcattcccctctgcttctggctttccatctgattagatcaaaagcactcttgcatatggaaagcttgcacgagcacaattttacgtggttatgggaaggaatggtgttctctatgtgtatttttattttttccaatgattggattctccagggtgcgcacatgacag

SEQ ID NO: 85941 - DNA, 601 bp, Human
taaaatacagaactcacacatgagcataaccgaagatacaatatttgtgaagggactgtgaaaacgagagtaggcagaggcaaagggttgttattttttctctaggactaaataaaaatataaatgctatttctcttaacacaaaccagtttgaagaaactattcgacgtattcattctgtcatctgttcattcatctgttattgaacctttcaaggtaaaagattagaggattctggccagcagagaaaagagaaaagtggatggatatgaacactatgtagaaggtgtagtcacagggygaggggtgtgagggaaatggtggcagcaagaagttgagcctgggcatctgggaggatggtggtgccatgccctggaggaggaccagtttgaagaaggaatatcataggagtccaataaatactactagaatgaatgacttaataatcagtatgtaagttacattcattcccctctgcttctggctttccatctgattagatcaaaagcactcttgcatatggaaagcttgcacgagcacaattttacgtggttatgggaaggaatggtgttctctatgtgtatttttattttttccaatg

SEQ ID NO: 85942 - DNA, 601 bp, Human
acaagctcagtttatcaatgtccttcttaaaatacagaactcacacatgagcataaccgaagatacaatatttgtgaagggactgtgaaaacgagagtaggcagaggcaaagggttgttattttttctctaggactaaataaaaatataaatgctatttctcttaacacaaaccagtttgaagaaactattcgacgtattcattctgtcatctgttcattcatctgttattgaacctttcaaggtaaaagattagaggattctggccagcagagaaaagagaaaagtggatggatatgaayactatgtagaaggtgtagtcacagggtgaggggtgtgagggaaatggtggcagcaagaagttgagcctgggcatctgggaggatggtggtgccatgccctggaggaggaccagtttgaagaaggaatatcataggagtccaataaatactactagaatgaatgacttaataatcagtatgtaagttacattcattcccctctgcttctggctttccatctgattagatcaaaagcactcttgcatatggaaagcttgcacgagcacaattttacgtggttatgggaaggaatggtgttct

SEQ ID NO: 85943 - DNA, 601 bp, Human
acagaactctagacttaattagccagctcatagctcttccacatactttttggaggtagattttgtctctatgggctctacttcttcccttagattctagagcaccatggaatgtatctgctctatgttcaagatgaaagcccttcaaataattgggtatagcaatctactcacccctctcacttcctcatttctctccactctcagaaatgcaaacatttatccttttgttgatgttattcaggaaccacttccagcagcctgtacctcccttagtcatgttccttttaacaagctcagkttatcaatgtccttcttaaaatacagaactcacacatgagcataaccgaagatacaatatttgtgaagggactgtgaaaacgagagtaggcagaggcaaagggttgttattttttctctaggactaaataaaaatataaatgctatttctcttaacacaaaccagtttgaagaaactattcgacgtattcattctgtcatctgttcattcatctgttattgaacctttcaaggtaaaagattagaggattctggccagcagagaaaagagaaaagtggatggatatgaacactatgtaga

SEQ ID NO: 85944 - DNA, 601 bp, Human
ctccagtgacagaactctagacttaattagccagctcatagctcttccacatactttttggaggtagattttgtctctatgggctctacttcttcccttagattctagagcaccatggaatgtatctgctctatgttcaagatgaaagcccttcaaataattgggtatagcaatctactcacccctctcacttcctcatttctctccactctcagaaatgcaaacatttatccttttgttgatgttattcaggaaccacttccagcagcctgtacctcccttagtcatgttccttttaacragctcagtttatcaatgtccttcttaaaatacagaactcacacatgagcataaccgaagatacaatatttgtgaagggactgtgaaaacgagagtaggcagaggcaaagggttgttattttttctctaggactaaataaaaatataaatgctatttctcttaacacaaaccagtttgaagaaactattcgacgtattcattctgtcatctgttcattcatctgttattgaacctttcaaggtaaaagattagaggattctggccagcagagaaaagagaaaagtggatggatatgaacac

SEQ ID NO: 85945 - DNA, 601 bp, Human
aaatgtaaacttgtccaaagacatacatctagtcatgagaaagctgaaacccaaaacagctaagccgatgtatcacagcctctgaatcaccatcactgaaagaaacaacacacttggggatgggggagtggctctccttgcacaagctgggatgcaatttgcagacattttgcagagcagaaaatatatgagtctctgaagggcagtgatcaatcatttcagccatcttaaatgagaccagaatagatacaagaagaatctcagccacatataactctaaccatcaagggtattactaacycccaaaatatttcatcttcttgaagttttatggctatggctcttgagtgttttgggggtacagggagatatgggtttaggcagctgaagcaatacctatctatagataagaatatcgccagaagtcctaataacctcagaaaatctacaaaacaagagagtccatatgtatgccggaatccctgcccctgacatgtttactctgctgactacctccagtgacagaactctagacttaattagccagctcatagctcttccacatactttttggaggtagattttgtctctatgggctcta

SEQ ID NO: 85946 - DNA, 601 bp, Human
agagacgtatcccactcacagacatggagtggatgcctcggttgctgcatcatttaacaagcatctattgtctgctctgtgccatcccctatggtaggcactgggacgaaaagaatgaatgatccttgacatcaagaagctcaaagactagctggaaagatactaatatagcaattccttttattttctctaataggagacccactcgcaactatgaggaatagatactatcagcagcaacagcaactttttttttaaggacaaagaaagtaaatatgggaaaatgtaaacttgtccaaaracatacatctagtcatgagaaagctgaaacccaaaacagctaagccgatgtatcacagcctctgaatcaccatcactgaaagaaacaacacacttggggatgggggagtggctctccttgcacaagctgggatgcaatttgcagacattttgcagagcagaaaatatatgagtctctgaagggcagtgatcaatcatttcagccatcttaaatgagaccagaatagatacaagaagaatctcagccacatataactctaaccatcaagggtattactaacccccaaaatatttcatcttc

SEQ ID NO: 85947 - DNA, 601 bp, Human
ttgagaggggtattttttacagaatcagctcatctaatcatcacacgaactcctagacattggtgctattttcaccaactatttcaataaggacacagaggttctgatatggtttgggtgtttgttccctccaaactcatgttgaaatgtcacctccagtgttggaggtagggcctggcgggaggccattagatcatgggggcagatccctcatgaacagcctagcaccataaccctggtaatgagtgagctctcgctcttagttcacatgagatttggttgtttaaaagagtgtggcacygatcccctttctctcttgctctgtctttcaccatgcgatatgctacccccctttcaccttccaccatgattggaagcctcctgaggcctcaccagaagccaagctgaagccagcaccatgcttcctgtatagcctgcagaaccgtgagccaattaaacctctcttctttacaaattacctaatgttgggtatttctttcttctttttttcttttttttcttttcttttttattgggggggacagagtctcactctattgcccaggctgtagtgcagtgttgtgatctctgctcactgcaa

SEQ ID NO: 85948 - DNA, 601 bp, Human
acaggaaaagctgaaaacatggtggtaatcctagagataatagtaatagcagtatttatggagcaatgagtatgtttgtagattgagaggggtattttttacagaatcagctcatctaatcatcacacgaactcctagacattggtgctattttcaccaactatttcaataaggacacagaggttctgatatggtttgggtgtttgttccctccaaactcatgttgaaatgtcacctccagtgttggaggtagggcctggcgggaggccattagatcatgggggcagatccctcatgaacrgcctagcaccataaccctggtaatgagtgagctctcgctcttagttcacatgagatttggttgtttaaaagagtgtggcactgatcccctttctctcttgctctgtctttcaccatgcgatatgctacccccctttcaccttccaccatgattggaagcctcctgaggcctcaccagaagccaagctgaagccagcaccatgcttcctgtatagcctgcagaaccgtgagccaattaaacctctcttctttacaaattacctaatgttgggtatttctttcttctttttttctttttttt

SEQ ID NO: 85949 - DNA, 601 bp, Human
gatttgaatggcccagatggtggcactcagccaggctccctaaccactggagttaatccatcacagacgtgctggccaatgtttttcaaggtgtgattctccaggtgtgacttccatggaggagacacttggatccgatctgccttcaaaaaagaatgtgtcattcagccactgggggtgcaggttactgacatcctctggcttcagagccctcaggattcacttccacttttgagctgaggtcacattctgccagagcagtcctcagccagtgacagggcatgagggggacatggggccyggcaacttctgcccaacatggggctcctttcatgggcaacctcttctccaaagctttctgttaggttggcagagactgtctggtctgcatggtggtctgaagctctcccttgcacaattctacttcctgccttccctattttattttttcccaggtacttatgccctctcaataaacttcttgtgcccctaactccatctcagcatctgtttcctggaagatccaactggctcaccttggagagaacagaaactaaaagccacaacatgaagcgtatacaagaaccaggtaagttaagta

SEQ ID NO: 85950 - DNA, 601 bp, Human
aatcagttctcccaccaggatgattagcgcccagaaagtgtaagtaaatatttgtggagaaaactgatttgaatggcccagatggtggcactcagccaggctccctaaccactggagttaatccatcacagacgtgctggccaatgtttttcaaggtgtgattctccaggtgtgacttccatggaggagacacttggatccgatctgccttcaaaaaagaatgtgtcattcagccactgggggtgcaggttactgacatcctctggcttcagagccctcaggattcacttccacttttgarctgaggtcacattctgccagagcagtcctcagccagtgacagggcatgagggggacatggggcctggcaacttctgcccaacatggggctcctttcatgggcaacctcttctccaaagctttctgttaggttggcagagactgtctggtctgcatggtggtctgaagctctcccttgcacaattctacttcctgccttccctattttattttttcccaggtacttatgccctctcaataaacttcttgtgcccctaactccatctcagcatctgtttcctggaagatccaactggctcac

SEQ ID NO: 85951 - DNA, 601 bp, Human
tttataacaatcagttctcccaccaggatgattagcgcccagaaagtgtaagtaaatatttgtggagaaaactgatttgaatggcccagatggtggcactcagccaggctccctaaccactggagttaatccatcacagacgtgctggccaatgtttttcaaggtgtgattctccaggtgtgacttccatggaggagacacttggatccgatctgccttcaaaaaagaatgtgtcattcagccactgggggtgcaggttactgacatcctctggcttcagagccctcaggattcacttccrcttttgagctgaggtcacattctgccagagcagtcctcagccagtgacagggcatgagggggacatggggcctggcaacttctgcccaacatggggctcctttcatgggcaacctcttctccaaagctttctgttaggttggcagagactgtctggtctgcatggtggtctgaagctctcccttgcacaattctacttcctgccttccctattttattttttcccaggtacttatgccctctcaataaacttcttgtgcccctaactccatctcagcatctgtttcctggaagatccaac

SEQ ID NO: 85952 - DNA, 601 bp, Human
ggccctgtctctggagtgcctagattcagcactgggagaagcaaataactgagagaaggaaagagaatgccatcctgtctccctcccttgcacccccttcctcagctaactagtgttcccctggctcaaagaaaatgtggaagttggtggtttttcacaaggatgatactatctggagctgctgtcctctgagagtaggacgggtcagaagagatctgcacctgctctgttaaggtagtcttgccatctctaagggtttgatttgctggcttgtttactggagtcagaaacagaataaagktaactcacttcaaaggctagattcaaatgctacttcctagaagataccttcaggaccctccttcactcccaaatagaaggaactctgctttttcaacatggtattgaagtcagaatgtttgttattccaaacaccagtactgaaacgtctgctcattccgtgaagttcctgaggtgccgagtgctggggatataacagtgaagatggataattctccattcttacggagcttcattgagggagctcagggaggcaggagttagtcaataatcacaaaagtaaagcaacatcacaaattgt

SEQ ID NO: 85953 - DNA, 601 bp, Human
atgaggggatttttttagaactctagttctcagttctgactgcatattattctcaccaagaaaacagttttttttttttgagatggaatctcgctcttattgcccaggctggggtgcaatggcacaatctcagctcactgcaacctccacctcttgggttcaagcgattctcctgcctcagcctcctgagtagctgggagtacaggcacccaccacaatgcctggctgatttttgtatttttagtagagacagggtttcaccacgttggccaggctggtctcaaactccttacctccagtkatctgcccgcctcaacctcccaaagtgctgggattataggcatgagccactgtgcctggcccagaaagcattttttaaaagaggaacccagacccttggagaaatgactgattgctgattccagggttgaagcaggaaaagtataaaatgaaccaagagcatcttattgttccagaaagtaagggaatgtgcaccaaaaaaaaaaaaaaaaaaaaaaaatgaggacttctagggatggaattttgtcccctacaaattcatatattgaagccttaacctgccattgactatatttggaga

SEQ ID NO: 85954 - DNA, 601 bp, Human
agagagcccacgtagtgtggtttctctccttgtatcaatgagaatgaaacccaaagagaactgatgcatcacccagtgagtgaatataggagctacagtgaaacccatgtctcctgtcctcctactccaggtttctaaacaggaagcatcagaacctggctgtcagaaaaataatctgaggccccaaggtttcatggagcagttactctctgctcagcactaagccacgtgtacagaggagataccaataaggaaaatgactgggtccctggttataatgtcctaaatctgtaatggagtkaatcaacaagacacttgcaaacaaaatggtgagggctcaggaggctgtaatttttaaaaagtgctggactgaggaaaggtgagagttacaggctcagttctgccactcgcctgctgtgtgactttgagctggtcattccctatctcttaataacagcttcttcatctatagaatgtgggtatacatgaggggatttttttagaactctagttctcagttctgactgcatattattctcaccaagaaaacagttttttttttttgagatggaatctcgctcttattgcccaggctggggtg

SEQ ID NO: 85955 - DNA, 601 bp, Human
attgtgtcattttatcttgcctagctccaaaaggagcagcctctgtcagaagatctcaatcatcataggcacatcccaggtgtgtgtcctgcttctcatcaggcctccccatcttactagaccactaggttcagccctgacttgtaggaggggctgggcctccatagcttctaaaaacatacagttaatctacagcatctctcctacatttgctgcgtagcattggcaccttcactcaagtgacagtattatagtcaggtggcatcgatcagctttaatcagccttatatttaagagctasagtctctgggtgttttagggaatacccgggcaacaaagtgaaaaaaaaaaacaaaaaaccttttgcagtagattgcatgattgcacaactggcccaattcttcatctcttactggaaacatgtcactgtcacgtgattctgtggtccctgccacttaagaaccaggatacagttcctcacctcttgactttgagtttgatcacgtgacttagtttggccaattacgtgagggagacgtgccagtgtgccggttttggcttttgcccagggtgtctaagaccgtagggaagagattgtctg

SEQ ID NO: 85956 - DNA, 601 bp, Human
ccacgttagcagtcggaatacaggggacagcatcacctcctttgcctccagaggtctgagggtgcagtggaaagagatcagggtgtcttcaagagtttgaatttctctcttctcaagaatagaaggaaaattaagcattatttttttctctcaatgattttgccttttataataagtaactcttatagactccttactatgtgacatgccctgtttcaaacatataaaatatattaactaatttaatgctcataacaactctatgaggtcagttctattttatcccttttaacaaataagyaaactagagcacagatgggttaagtgacttgtccaagatcacacagcaagctagtagagacgggattcaaactaaacggtaactcaagtcccttctcttaagccctccatctcatgtactcagaggcattaaatctcaaggtatacataaaagataaggtaaaaggcagcatgaaaagttgcttttttttttttttttaacaggctggagtgcaatgccacaatcttggctcactgcagcctctgcctcctgggttcaagcaattctcctgcctcagcctcccaagtagctgggattaca

SEQ ID NO: 85957 - DNA, 601 bp, Human
aatgttgtgtgaggtcttcccacgttagcagtcggaatacaggggacagcatcacctcctttgcctccagaggtctgagggtgcagtggaaagagatcagggtgtcttcaagagtttgaatttctctcttctcaagaatagaaggaaaattaagcattatttttttctctcaatgattttgccttttataataagtaactcttatagactccttactatgtgacatgccctgtttcaaacatataaaatatattaactaatttaatgctcataacaactctatgaggtcagttctattttrtcccttttaacaaataagtaaactagagcacagatgggttaagtgacttgtccaagatcacacagcaagctagtagagacgggattcaaactaaacggtaactcaagtcccttctcttaagccctccatctcatgtactcagaggcattaaatctcaaggtatacataaaagataaggtaaaaggcagcatgaaaagttgcttttttttttttttttaacaggctggagtgcaatgccacaatcttggctcactgcagcctctgcctcctgggttcaagcaattctcctgcctcagcctc

SEQ ID NO: 85958 - DNA, 601 bp, Human
tggtgaaaatgttctaaaatttatttggggtgatggttgcaaaatctgtaactttactttaaaaatcattggattatgtatttacaatgagtgcattttatgataagtaaattatatatcaataaaggtattaaaataattaatcctctaacagcccacacaatagtttagtcatctgcatgccttgatatacctccagtctagtcctttcaacaaagaatagaagagtttagtcaaatgaggagtctttgggattggaatggttctagcctcattctctaaataattctacccaaacaayatttaggaataatttttttagagtggcataaacaccataattacatgcacatacttttcatcttttctgttctagaaaaggagtcttcttacagtccaaggaaaatcagtctctacactgaattataaattaacatttcagcagacatgcaatgttgtgtgaggtcttcccacgttagcagtcggaatacaggggacagcatcacctcctttgcctccagaggtctgagggtgcagtggaaagagatcagggtgtcttcaagagtttgaatttctctcttctcaagaatagaaggaaaat

SEQ ID NO: 85959 - DNA, 601 bp, Human
ggtattaagggaaagagacaaatcactggaacaaaactgaacgtttagaaataagctctgacactgtcaattgatttttgacaaacatgacaggataatttgataggaaaaagatagtcttttcaacacatgatgctgggaaaatttgatatcaatatgtgaaaaagtgaacttaaatccttatctccaaaccacacaaaaattaactcaaaatagatcttagacctaaatataacaactaaaactataaggctccttgaaaaaaaaattagagaaaaccatcatgtccttgggttaagcrgaaagctcttagacacaaaaccattcattattcttttactagacataaatgaaaaaataggcaaattcatctccattaaaatttaaaacttttgcactccaaagacaccattaagaataaaaagacaagccagactaggagaaaacatttgcaaatcatacatatgataaagaactgtatcaaaaatatataaagaactcctacaactcaataataaaacaaacagctcaaaaataagatgagctaaaaaactctatactcaatagttatttcatcaaagatgaaatacacatggccaat

SEQ ID NO: 85960 - DNA, 601 bp, Human
atgtgataaaaaaaaatcttaagatacatttatccatttattttacagcttttttagtatttaggacctaccaggcattatatgaggtgctaaagacacaacggtgaccaagacacagtctactggtctctgtcccctatactctattttaccatatctatctccaaccctgtcagacccaagagggaggggtttccagtagccaaaaaaaaaatagacccaggcaaaataattttgaaatagaaaaacaatggtgaaggacttacattaccctcatttcaaacatattacaaagctacaraaatcaagagagtgtggtattaagggaaagagacaaatcactggaacaaaactgaacgtttagaaataagctctgacactgtcaattgatttttgacaaacatgacaggataatttgataggaaaaagatagtcttttcaacacatgatgctgggaaaatttgatatcaatatgtgaaaaagtgaacttaaatccttatctccaaaccacacaaaaattaactcaaaatagatcttagacctaaatataacaactaaaactataaggctccttgaaaaaaaaattagagaaaaccatcat

SEQ ID NO: 85961 - DNA, 601 bp, Human
aaaaatgccacagtgccactttccatcctggacaaacagcccaggacatacagggaggcagggattggcacacatggaaggagagtgctggcccctggctgcgtcctcacctctgtgctcagggctgtgagtgaggatggcagacacaacaatctatacccaccccagacctgcggcatctcttaatctgtgctccacaagatcagcgtctgatcctggggccgcgggctgtctggggaacatgcagttctttagtgtctggatatcattagctaatttgtgtgtccaatttcaaagaaawgtttcctccctagaggagtttctactcaaaggactggctatttttggctcccacccactcggctgtgttgtgcgaagccagcatttcctagactatcccaacccccaccttttcctctctccagagtcagcagcactggagtccaaaacagtctcctgggcatccccatagccttgtattcccatccatctcgcaagaaaagataagtcagcactcttgtagaggacatgcttccaactaggatcaagggaagagcttcattcaccctttctttctcttattcatccattcatttgttta

SEQ ID NO: 85962 - DNA, 601 bp, Human
agtagcttattactgtagcatgaacctgcttaaactgactgatacaacagttaaattatatcatctatataagagacttaatgcatatctggcattttcttttttatttatttttgggcagggttggggaacagggtcttactctgcgacccaggctggagtgcagtagcatgatctcagctcattgcagcctccatctgggctcaagtgatcctcccacctcagctttccaagtagctgggactataggcatgcaccaccatgcccagctaattttttttttttttttttttttgagacwgggtttcaccacgttgcccaggctggtctcgaactcctgggctcaagcaatctgcccacctcggcctcccaaagtgctaggattacaggtgtgagccaccacgcctggccttagcaaattctaagcactcagaaaagttactttattattgctattatcagtatcatcatcatggattctcacccttttggagacatcccataccttgttgaaagcttttgttgttgtttactcatgaaacctttggaccctctcccttgagaaacgcacatttggacacaattttgaagataagtgcag

SEQ ID NO: 85963 - DNA, 601 bp, Human
tccgtcagtctgactcttgcatctaagacatgaagcagagctgcaactaacctcatataactggaacaagaaatcaactttcataaacaactccaaaatctcagtagcttattactgtagcatgaacctgcttaaactgactgatacaacagttaaattatatcatctatataagagacttaatgcatatctggcattttcttttttatttatttttgggcagggttggggaacagggtcttactctgcgacccaggctggagtgcagtagcatgatctcagctcattgcagcctccatckgggctcaagtgatcctcccacctcagctttccaagtagctgggactataggcatgcaccaccatgcccagctaattttttttttttttttttttttgagacagggtttcaccacgttgcccaggctggtctcgaactcctgggctcaagcaatctgcccacctcggcctcccaaagtgctaggattacaggtgtgagccaccacgcctggccttagcaaattctaagcactcagaaaagttactttattattgctattatcagtatcatcatcatggattctcacccttttggagacatc

SEQ ID NO: 85964 - DNA, 601 bp, Human
ctcgagagtctgaccaagtccatgcaaatcttgaacctctcacttaataaatacacagcactggggagaaagttaacctctctgagcctcagtttccacatctgtaagaaagggacaatgataataatcactactatatctaccgcattggtttttataaggaatgtaatagattatgttattgttcaaatatctgctgtccctcctctctacaggactcctccctactggacaattggaatcctcgccaatgttgggctgggagccagcggaatgtaagtgggagtgacagtgccacttscaggagaatctttaagatccatctcttcatctacatccttctcttttccctcttccatgagattagcaatgacctagaaaggagccctccgtcagtctgactcttgcatctaagacatgaagcagagctgcaactaacctcatataactggaacaagaaatcaactttcataaacaactccaaaatctcagtagcttattactgtagcatgaacctgcttaaactgactgatacaacagttaaattatatcatctatataagagacttaatgcatatctggcattttcttttttatttat

SEQ ID NO: 85965 - DNA, 601 bp, Human
aaggtgaattagaggacatgaaggcactcagtgtgcagcccccgtaaactgaccagaaccacttcatgcaaacagaagctagttctgggtgtgcaaatcttatcaggaaggaatgttgcttggttggccgtgtcaaacctgtataaagcgaggggcagagtcaggtggttggttggaaacagtgatggaacaagtcttttgagatggcctgtttctgtttaacccttaggaaagaaagccaaatgatggttagcaagggagaggatataatgtggtaagtctgagctcctgtctggttatrgctaggaactcagttttcaaggtttctctgggatccccctggccaagaaggggttccatttaattagttggggtggtttaggattttatttttatttctaggattcaaaccaaccagtctggccccaaagtttatgcgcttaaccacaacactagaatgaattagttaattaacaaacaaaaaatgtcacgtctgtcacattctgtaatgcctggggccatattgggggatgtgcctgtgtgctccacgggtgtcctcttgaatgttataacctctacatgaagcaaaatcctatgtcct

SEQ ID NO: 85966 - DNA, 601 bp, Human
tatgtactggaaaaataagctcaagggctccaagtagaaatagttgtagtcctggagtcagccttgggtttagctccacttccaaaatgtgtcaacttatagaacccttattttttcatagggttatgaagccactggtctattttatccaacagagaaatcagctccaagcaaatcccacctggacacagtgtctttgcctgactccagaaacaagatggcactctgtctccagtggttccactttacctagatttggagcctccaaaacattgtatggccacactccatctctgcctamgatggaattatgagagagctttggaaaatggctgttccaaaagtgatagtcttaacacaaagatcaggaagaatatttgatttggattaccacccacagcaggcagaattctaagatgttcccaaagtgatagtcttaatccacaggaagaatatttggtttggattaccagccacagtaggcaaaattctaagatgaccaccaatgacccatgtccttgtgtgatctcctccccttgagtacaggtgaacctgtgaatatgataggacatcgcttctgtgattatgttacatcatatgg

SEQ ID NO: 85967 - DNA, 601 bp, Human
cacattcaatcaaactgtcactttgtttatgaaaaagtgtcgagtggctggaaatggcaagaacaagcactgaagattaatgctctaaattttttctgattaaaagtatgattgaggcattaagaaagctagctccatgaacccagggcaggccttaagcccaacattttgccatcttcaaatacaactggggacagttgtaaaaacaaatagaacttctctctgcctagaggtttcctttcatgaagataaagtttctagctggaactggctgtttttgcagggaagcacacatgagacragctttttggagtctctccaatacctgcctgtttcataaatggcacagtctccaaatctgatgctcactggaccagggtcaggctatggaactgattaaaataagtaggaacctccaaggccctatgtccctactctccattttcagattgatcagctgagacctatgtactggaaaaataagctcaagggctccaagtagaaatagttgtagtcctggagtcagccttgggtttagctccacttccaaaatgtgtcaacttatagaacccttattttttcatagggttatgaagccact

SEQ ID NO: 85968 - DNA, 601 bp, Human
cccattccttcattcccgtctcgaatgttctgccccagtgaatatcttcgcctccctgttagactctgagatcttgtactgcagaatccactgttgctcatacaattctgagttgtacctgagggcagaatcagagtggtctttttgccttttgtgtttgcagagtcccaactgcagaagagagtgacatgccataaacaggtcaaatgtcgttaatataaatatctaccatggggcaatttccgaggctcttacatgcttcgtcctgaggttagcatgaggcaactgcactcactgctaygccttcccacacttattctaagggacagccagctaggatggagtgggagctgatgccctggattaaggtgcctggttaattccacttgcctggtttcctttgttctcaaactctgcctggagatgaagctattgcgaagtcagtctcagcttgtgcttctaagttctgctccttacatatgcccccagaaagttgttccaagtgaaggcagcttaattaaaaaccacattcaatcaaactgtcactttgtttatgaaaaagtgtcgagtggctggaaatggcaagaacaagcactgaaga

SEQ ID NO: 85969 - DNA, 601 bp, Human
gttggcctttaaggggagacctgaagaatgagatggagacaatgcagccatgtttcaggcagaggaaaacgctaagcccatggggtaggcactatggtctgaatgtctgtatccctccaaaattcagatgttaaaacctaatcctcaatgtgatggtgttaggaggtagggcccttgggaggtgattaggtcatgagggccaagccctcataaatgatattcatgccctgataaaagaggctccagagagatcaacggccccttccattaccaatgaagaacaaaacaaaatgatgacagycatctatgaaaaaggaagcaggccctcaccagacatgaatcttctggtgccttgaccctggacttaagcagcctacagaactataagaaatagatgtttgttgcttacaagctacccagtttatgacattttgctatagcagcccaaacagactaagaaagcaggaaagagcttggcacaggctgggaagaagcgacagaaagaaggttgctatgataacgcaatggtgtaatcagtgtgatttttatgtgcttgtatcagagaaccctgggtgcaattcctgtatgaagaattgcatga

SEQ ID NO: 85970 - DNA, 601 bp, Human
ttgcaattgcaaacactgttgtgcattctgaatccccagtgtctttctgtttttcaccagccatgatcatgacagtgacaacaataacaatacagccttatgctcatagctccattcattcaaacagccatgcaacaacacctgagatttgttgtgcatctgtgaggactgaaggtccgagctccttcctccaaccacccataccacactcactgaggactcactaggtgtcaggcaccatcttagcacaaataagatacacaaggcctgtgcctttgggagcttaatttctagtagggamtggaggagaggggcatatggacaataacaaccaaaaaaaatggtaatgtcacagtatgataaaggctgtgaaagaaataaagtgcaagctagagaataataggagagaactgactgggtagtcagggaaggcctcttaaggagttggcctttaaggggagacctgaagaatgagatggagacaatgcagccatgtttcaggcagaggaaaacgctaagcccatggggtaggcactatggtctgaatgtctgtatccctccaaaattcagatgttaaaacctaatcctcaatgtgatggtg

SEQ ID NO: 85971 - DNA, 601 bp, Human
agaatgcagctgctcctctgtgctctgccctcggttgctactgccctgcgaggcaaactcgaggctgggaatctcctcctttctctgtctgcagcagctgcagtgaaacaaagggcacagcccccttcaggccaagagaggtgagaagctgctggggagctgatgtcaccactaccccctccgaagcccatccatggggcacagtgcactccactggcagatcccggaaagggagcacgctgactgactggctgactgactgcctgccacatcaccgtctctgcattgcaattgcaaacaytgttgtgcattctgaatccccagtgtctttctgtttttcaccagccatgatcatgacagtgacaacaataacaatacagccttatgctcatagctccattcattcaaacagccatgcaacaacacctgagatttgttgtgcatctgtgaggactgaaggtccgagctccttcctccaaccacccataccacactcactgaggactcactaggtgtcaggcaccatcttagcacaaataagatacacaaggcctgtgcctttgggagcttaatttctagtagggaatggaggagaggggca

SEQ ID NO: 85972 - DNA, 601 bp, Human
ccagcccctgggggaaggagaagccaggccacgtagtcatgtccccatggagaatgcagctgctcctctgtgctctgccctcggttgctactgccctgcgaggcaaactcgaggctgggaatctcctcctttctctgtctgcagcagctgcagtgaaacaaagggcacagcccccttcaggccaagagaggtgagaagctgctggggagctgatgtcaccactaccccctccgaagcccatccatggggcacagtgcactccactggcagatcccggaaagggagcacgctgactgactgrctgactgactgcctgccacatcaccgtctctgcattgcaattgcaaacactgttgtgcattctgaatccccagtgtctttctgtttttcaccagccatgatcatgacagtgacaacaataacaatacagccttatgctcatagctccattcattcaaacagccatgcaacaacacctgagatttgttgtgcatctgtgaggactgaaggtccgagctccttcctccaaccacccataccacactcactgaggactcactaggtgtcaggcaccatcttagcacaaataagatacacaagg

SEQ ID NO: 85973 - DNA, 601 bp, Human
ggaatttatcctggatgacctgcgtggggccaatatcatcaccagggtcacaagtgcagaacctttcctggctttgggtagaaagagatgtgacttcagaagaaaggcacagaggaatgcaatgttgctggcactggagatggaggaagcgaccacaagccaaagggtacaggcagcctctaaaagctggaaagcccagtaaatggattctcccctgcagcctccagaaagaacacagcactgcaccttgattttagcccagtgagatgtgggtgaccagtaggattataaattgatgtgytttaagccactgtgtgtaatttgttatagcagcaaagggaaaaaatactaataggatgtgtaacaggcatctcaagtctatcatccatctcagccacattagcccctgacttcgttgctgaggccaaacattttggtggcatctccaactctcctctttctctcattctgcacaaatccatcagtaaacccagtacatcccacactctcaccactgccactacaagtttggtccatgccacctctcacctggatgacttctgtttccacctgtgccctcttacaatccagtatcaacagt

SEQ ID NO: 85974 - DNA, 601 bp, Human
agaactcctatatgatccagcaattccatttctaggtatgtatatacccaagagaactgaaaacagatgttcaaacaataacttgtatgtaagtgttcatagcagcattactgatagcagccaaaaactggaaacaatctaaacatcctacaatcaatgaagggataaacaagatatgatatggccattcaatggaatgttatacacccataaaaaggaatgaagtactgataccttctacaacatggatgggcattgaagacattatgctaagtgaaggaaaccagacgcaaaaggccaygtattatacaattccatttacatgaaatttccagaataggcaaatccatagagacaaaaagtagatccatggtttctagggctggggacaaagggagacagagtgacggctaaaaatatgaggtttctttttgtggttttggaactgttctagaattagggagtggtgatggttgcacaatatagtcaatatactaaaaagcattggactgtgaactttaacatgataaattttatgtgaattatatctcaaaaacatttaaacgtaagactaggtatcacttattgaccaatttctcct

SEQ ID NO: 85975 - DNA, 601 bp, Human
tatttgcaaattatatatctcataaaagtctagtatccagggtacatagagaacactcacaactcaacaatagaaaggcgactccgtttttaaaaaaggcaaagggtctcaatagacatttcttacaagatggcatacaaacagccactaagcacataaaaatatgctcaatacaaacagtgattagagaaatgcaaatcaaaatcacaatcagatagcacttcacactcaccaggatggctaaattcagaagaatggaaataacaaatgttgaccaggatgtggagaaataagaaacccygtacactgattgtgagaatgtaaaatggtacagctgctatggaaaacagtacgacagttcttcaaaaagctacacatagaactcctatatgatccagcaattccatttctaggtatgtatatacccaagagaactgaaaacagatgttcaaacaataacttgtatgtaagtgttcatagcagcattactgatagcagccaaaaactggaaacaatctaaacatcctacaatcaatgaagggataaacaagatatgatatggccattcaatggaatgttatacacccataaaaaggaatga

SEQ ID NO: 85976 - DNA, 601 bp, Human
taaaaatccagaaaaaaaaaaaaaattagccgggcaacagtagcacgtgcctgtaatcccagctactcaggaggctgaggcaggagaatcacttgagcctgggaggcggaggttgcagtgagtgagctgagatcgtgccactgcactccaatctgtgtgacagagtgagacccccgtcacaaaaaaaaaaaaaaacgaagtgaaaacacgacacacagaaaatatttgcaaattatatatctcataaaagtctagtatccagggtacatagagaacactcacaactcaacaatagaaaggygactccgtttttaaaaaaggcaaagggtctcaatagacatttcttacaagatggcatacaaacagccactaagcacataaaaatatgctcaatacaaacagtgattagagaaatgcaaatcaaaatcacaatcagatagcacttcacactcaccaggatggctaaattcagaagaatggaaataacaaatgttgaccaggatgtggagaaataagaaaccctgtacactgattgtgagaatgtaaaatggtacagctgctatggaaaacagtacgacagttcttcaaaaagctacacata

SEQ ID NO: 85977 - DNA, 601 bp, Human
ctgtggaccccctgacatcagaatcacctgggaatctgcttaaacatgtgcatcctaggctctatccctaaatttagattcagtatttctggggaatatcccaggaatccacatatttaacaagttatctgggtgattgtctgtgctcactgaagtttgggacactagagaatagagagtagtcaaagcctatggctggttttcattatggtggagaagcagaaggaaaaatgtgctcagaggcagaggcaagatgaggaaactcagtgacaagaccccctttttttttttttttttttttgagacagagtctcttttcgttgcccaggcccaggctggagtacagtggcccaagctcggcttactgcaacctcctcctccctagttcaagagattcccctccctcagcctcccaagtagctgggattacaggcacccaccgccacgtctggctagtttttgtattgttagtagagatggggtttcaccatgttggccaagctggtctcaaactcctgacctcaaatgattcactcgccttggcctaccaaaatgctgggattacaggtgtgagccaccgtgcccagtcaagatcccgtaa

SEQ ID NO: 85978 - DNA, 601 bp, Human
acagatcagctctgctactcagtggctgtggaacttgggcaggttaattaaactctctaggctacaagatggctgaaagccatctgtgggatagatgagatgagatggcagatgtgcaatgcacatagcagctgtttccatgaatgctaatcccttttatgctctccttgtggtcctctgctttcccaaagcgtatttatttactaattcactcagttctttaaccaacatgtattgagtgtctactctgagcctggagctgggtgctggatattcaacaacagataagaaaggcagagaycctgtactagtctgttcttgcattgctataaagaaatacctcagactgggtaatttataaagaaaagacgtttaattggctcacagttctgcaggctttacaggaaacatggtactggcatctgcctggcttctggggaggcctcaggaagcttacagtcatggtggaaggtgaagggggagcaggcacatcacatggccagagcaggagagagtaagtcttggggggaagtgctatacacttttaaatgaccagatctcaaagtaactcggagcaagagttcactcagtaccaagagtg

SEQ ID NO: 85979 - DNA, 601 bp, Human
aatacccacgaaaaattcacactccatctctgaatgaggaggctaggtttttccaacggtggagccacaaaagtctgttttgacaagttatctccccgtaaacatactggtttatctcatgctgaacaattagatgtgctatttaggcaaaataaaaaatatattgcacattttctagacagcctgttagcatccatgccaatgacacgaacatcaggacatggggctgatattaaagtaaccagaaacacaaatgtgtattgcaacactcggaacattgccatctgtgtgttgcatgccyggagggacacccagggaggactgcgtgaagacagggtgagaaagagtccaggagaaaaacagcagctgagaggagtggggtgggcagggattggagtagaagcagatgggaggctgagattacccacaggctaagccagtggttctatactggggacacattcccacccccaccccaagggacattggcaatgtctggatgcatgagggttgtcataaattgggcagggggtgctactagcatggcatgggtagaggctacatgtcctgcaatgcgtattatatccaccccctccacccc

SEQ ID NO: 85980 - DNA, 601 bp, Human
tggggctttttctgaagccgttttttccctcatttttttctgtccacaaaacagcaggaaataatttgctttaaatccacataaaatacccacgaaaaattcacactccatctctgaatgaggaggctaggtttttccaacggtggagccacaaaagtctgttttgacaagttatctccccgtaaacatactggtttatctcatgctgaacaattagatgtgctatttaggcaaaataaaaaatatattgcacattttctagacagcctgttagcatccatgccaatgacacgaacatcakgacatggggctgatattaaagtaaccagaaacacaaatgtgtattgcaacactcggaacattgccatctgtgtgttgcatgcccggagggacacccagggaggactgcgtgaagacagggtgagaaagagtccaggagaaaaacagcagctgagaggagtggggtgggcagggattggagtagaagcagatgggaggctgagattacccacaggctaagccagtggttctatactggggacacattcccacccccaccccaagggacattggcaatgtctggatgcatgagggttgtcat

SEQ ID NO: 85981 - DNA, 601 bp, Human
tgactgaagcatcttaagctgcccctcccagtgtttgctaaatgtcatggcagagggttaacctcccaggagattgagaaggttaaatgagataccacgtgtgcagaggccagcatggtgcccagctcagcagtaggcacttgggaaatgtcacctttaacactgatatgtaagaccagcccatcatagcagcattattcacaatagccaaaggtgggaacaacccaaatgtccattgacagaagaacaggtaaacaaaatgtaaatacatacaatgaaatattagccagcgttcaaaaasaaaggacattcggatacatgctacaccagcacactccctagctcacgatattttaagtggatgaataaatgaatgagcaaaaaaagagcaccctacctctaactggatcccccagctgtgaactctctcacattttttctctagcaaattccctcttttttgctgtttctttctcctcttttctgttctattctctttcttcatcccctatgctttaaaagacacttgcatctggggctttttctgaagccgttttttccctcatttttttctgtccacaaaacagcaggaaataatttg

SEQ ID NO: 85982 - DNA, 601 bp, Human
atcactctgagaccttaggatgagtgactgaagcatcttaagctgcccctcccagtgtttgctaaatgtcatggcagagggttaacctcccaggagattgagaaggttaaatgagataccacgtgtgcagaggccagcatggtgcccagctcagcagtaggcacttgggaaatgtcacctttaacactgatatgtaagaccagcccatcatagcagcattattcacaatagccaaaggtgggaacaacccaaatgtccattgacagaagaacaggtaaacaaaatgtaaatacatacaatkaaatattagccagcgttcaaaaagaaaggacattcggatacatgctacaccagcacactccctagctcacgatattttaagtggatgaataaatgaatgagcaaaaaaagagcaccctacctctaactggatcccccagctgtgaactctctcacattttttctctagcaaattccctcttttttgctgtttctttctcctcttttctgttctattctctttcttcatcccctatgctttaaaagacacttgcatctggggctttttctgaagccgttttttccctcatttttttctgtc

SEQ ID NO: 85983 - DNA, 601 bp, Human
catctctctaaggtcagatcttcagaattcatcctttcataaagttgttttaatgcatgtttaaatctctgtcatttgctcactgtgtgacttcaggcaagttattgaacctcaattttcttatctctaaaatagggctaatcatagctcctacctcataaggtttttaaaagaattcagtgacagcatggatgaagggcatctagcatagttcttgacttgtagcgtgtgctcagtagtgttaataattatggaagagctcattggccaccaagtgaatgctaagctggaagaggattgratacattatttactccaaccccatctcaagccaagactataaccctctcaatttcatgggaggttgaccctctgtcatgacattggacaaacattgggagggggggcgcttaacatggtttggtcattcctcccacggtctcagggtgatagatactgggtggaaacatgggtctcttacgaatagagagctgaaagtcacctacccataccttaaagagtgttccttgagagagggctttcggaaatggatttagacatcatgaatccaacaactaagagatcatttatctgtcctcct

SEQ ID NO: 85984 - DNA, 601 bp, Human
ccattttggtgcatcagaacaacgttgtcactggtctaacctcatcttcactccctggggactgaggtcttgcctgattcccaaagccctgcaccagagatcctcaaacattttcaactaggactttatcaacgggaaaaagatggacagcttcactccatgttaacccagcgactccatcaaacctatgcttgtttctactgttcatgcctctacattgatgtttctcaagcttttatgatccaggtctccttgataaacatttttaacctcacattttcctctaatgctatttgaaatkgcaagagaaattaatatggtgactaaaacatatcaagagatgtcatagttcaatagaccctgctactaacaaccccaggtgcaaatctttgcttcacatgctattctctgactcttacttgcatagtctgttttgacttctccatgtgcttcagtgaaatgcaaattactgtttgatcccatggactagactatggggaaatctccattgtttcagggcaagattgatattcagctggttgtttatggctggcaagcattcacacggtcagtgcattcatccaaacggacgaatccccat

SEQ ID NO: 85985 - DNA, 601 bp, Human
gaataaataattctcaagcaaatcagaggatctaaattacatgttacaggtaggtttgattagtacagaaccactgcttcaatatacttttatcagtagataaaatcctcctaaaaacagtgtccataggagtcaaaataataaaaaagaacactaggtggtgaaaatattggaaacttctagacgtacagtagccttcatttcttgcaccgccaaaagccgggctgataatggagcaaataccctcttcccaggctcccctgaggaagctgccactttattcatgaccccacagtcaccktctcctggaagcctttcctaattagagcccttctagaattctgggattttatgtctcagcagtatggtgagaacaataggattgttctgttctgctttattcgaatcatactgatgtgtcatttttcaatgatccttaagttactctcaaacagagagcttttcttacccatggtaggttctcaatcgatgtctatagaattgaactgactttgttggtgagtgttttgtttcttccacgagaacagatattccttcagaatcaggggctgactcttctatttttcaaacaacccccaaa

SEQ ID NO: 85986 - DNA, 601 bp, Human
tttaacatgagaaggaaataaaattcttacttaagccattgataatctggattttctgtcataaaccaccaaactgaatccaattgatttagtatcccgtgaatatttgttgaatgaataaataattctcaagcaaatcagaggatctaaattacatgttacaggtaggtttgattagtacagaaccactgcttcaatatacttttatcagtagataaaatcctcctaaaaacagtgtccataggagtcaaaataataaaaaagaacactaggtggtgaaaatattggaaacttctagacrtacagtagccttcatttcttgcaccgccaaaagccgggctgataatggagcaaataccctcttcccaggctcccctgaggaagctgccactttattcatgaccccacagtcaccgtctcctggaagcctttcctaattagagcccttctagaattctgggattttatgtctcagcagtatggtgagaacaataggattgttctgttctgctttattcgaatcatactgatgtgtcatttttcaatgatccttaagttactctcaaacagagagcttttcttacccatggtaggttctcaa

SEQ ID NO: 85987 - DNA, 601 bp, Human
agcaaattaacacaggaacagaaaaacaaatacttcatgttctcacttataagtgagagctaaacactgggtatacatggatataaaaatgggaatagacactggggatgatgataagcgtgaggagagcaaggctgaaaaactacctgttgtgaactatgctcactacttggatgatgggaccattcatatcctcagcatcacagaatatacccatgaaacaacccagcacatgtatccactggatctaaaataaaagttgaaattataatttaaaaatgggttagaatcatagcaaatmactgtgcatgagccccgcctagccatttctagtacataacctggtatttggcttctagtagatgcttatgacagcaaccataagcctcccacccaaaaatctattctctccttctttaacatgagaaggaaataaaattcttacttaagccattgataatctggattttctgtcataaaccaccaaactgaatccaattgatttagtatcccgtgaatatttgttgaatgaataaataattctcaagcaaatcagaggatctaaattacatgttacaggtaggtttgattagtacagaac

SEQ ID NO: 85988 - DNA, 601 bp, Human
gcaaacacaattcctaaccaatatatgcacctgcccgaatactaaaatccaatgaatagagattcctgagattcctttacatactcatttccactcattcactctgatttaaatacagtcaactgtgtgtctcactttgattgatggggtgccatcaaaagcaaaattttctcccttgttgcttctgaaaaagactcccaaacccacagtgaagtcagtctggggcagagagaggtggtgtgatattatatatgtcattataaactctaagtgcctcttttccgaactcttagaaggttartagtggcaaaggcaacaaaaaagtcacagtgatgaatagaacatgttggaaagtggctcagagagtaggaattaaagaatgccagctccagtaaatgtcacatatcaatcaaaagtgaagaaagggagttccctccaaaagtggcagaggggacaccttcataaacagaacataaaggccaatcgaactcagcagcaaaatgggacgtattcagccagagcctgtcactttgtacaatggcaacaaaccattccgtcagcttctctgctgaaatcagagaagtactaaaagggatttttg

SEQ ID NO: 85989 - DNA, 601 bp, Human
cctacctccaggctgctttaatctgagaaggaaataaacttctcttttgttttagcatttccaggcttatttattggcaaacacaattcctaaccaatatatgcacctgcccgaatactaaaatccaatgaatagagattcctgagattcctttacatactcatttccactcattcactctgatttaaatacagtcaactgtgtgtctcactttgattgatggggtgccatcaaaagcaaaattttctcccttgttgcttctgaaaaagactcccaaacccacagtgaagtcagtctgggrcagagagaggtggtgtgatattatatatgtcattataaactctaagtgcctcttttccgaactcttagaaggttagtagtggcaaaggcaacaaaaaagtcacagtgatgaatagaacatgttggaaagtggctcagagagtaggaattaaagaatgccagctccagtaaatgtcacatatcaatcaaaagtgaagaaagggagttccctccaaaagtggcagaggggacaccttcataaacagaacataaaggccaatcgaactcagcagcaaaatgggacgtattcagccagagcctg

SEQ ID NO: 85990 - DNA, 601 bp, Human
gggtctatgtgccaagtgttgttctgtgtgctaagtgtacaatggcgacaacagtagtagcacgatattatgggttcttcctctgacatatgctaataaccccactaatatcaccagacctcaagaataaatacaatctaagtaaatacaatgggcttgctatgcaaactgaacttcaaggtaagttccctaggtattcctgccacttgtaactatgttggtggcacttaggcccttccaatataaatgttctggggcctccactagatgaggagcaaaatatccaaggcctcttcccaartggatatatagacaataaataaatcatacaagtaaatatatatttatcaattttgttgaattctatgaaggaaaaaaatacagctctacaaagaaaataacaagggtgcaggggacagggcactaattatgattagggagtaacagaaagcctctgtaaggtggaaaaacaaaacaaactcataagtagttaaaaaaaaaaaatcacttcccaaagaggcttacacgatcagggaagtattgggctttgggtaagtgctacacactctcagaggacagggagtccactgaagactgcaaa

SEQ ID NO: 85991 - DNA, 601 bp, Human
caaatgaattcacacatacactccctcacccactagaagttcatatccctggacagctggtagcagtcattccagttaacagcatttctgaatgcagagaaaaccaggcaacaaatacttaatgagcatttcctaaatgcagtgtcatactaataacagagaagataaatacatgtaccagaatttctactctgaagaaattaataatataattgattcacccatacatatatccaagcaaccaaccattcatccctccacccatttaccctttcactcatccacctttccacccttgatscattcaaccctacatctttccactcatccattcaaataatcattcacccttctctttatacaacaactcctttaccaatccatcctcttccccttccagccaggctggtcctcccttcccattctacacctacccattaagccaccttccattgcttcatacatccatctcttcaaccctctaaccacctgtattgggttgagcagcatccttcaaaaattcatgctcactcagaacctaataatatgaccatatttgaaaagaaggcctttgtagatgttatcaactaaattaatatga

SEQ ID NO: 85992 - DNA, 601 bp, Human
tttaggatcacccacgctacatttacccatccaatctgaaacaataaaagcaattgtgcctgtctgaggcatatttttctgccatcaggtttaaaatgttaaataaataataattgaaatatgaaatagtggtgtctatacatgtacatttttgtcactccctaaacagcaggaattatacccaacatttaagttctttctcagggtttcactaagcatactccaggctagagacagctccaggctggatattgcaccaaatgaattcacacatacactccctcacccactagaagttcayatccctggacagctggtagcagtcattccagttaacagcatttctgaatgcagagaaaaccaggcaacaaatacttaatgagcatttcctaaatgcagtgtcatactaataacagagaagataaatacatgtaccagaatttctactctgaagaaattaataatataattgattcacccatacatatatccaagcaaccaaccattcatccctccacccatttaccctttcactcatccacctttccacccttgatccattcaaccctacatctttccactcatccattcaaataatcat

SEQ ID NO: 85993 - DNA, 601 bp, Human
ttccttaggcaaataagataaaagcttcaacagaaaccaatgtagcccaaatttaggatcacccacgctacatttacccatccaatctgaaacaataaaagcaattgtgcctgtctgaggcatatttttctgccatcaggtttaaaatgttaaataaataataattgaaatatgaaatagtggtgtctatacatgtacatttttgtcactccctaaacagcaggaattatacccaacatttaagttctttctcagggtttcactaagcatactccaggctagagacagctccaggctggayattgcaccaaatgaattcacacatacactccctcacccactagaagttcatatccctggacagctggtagcagtcattccagttaacagcatttctgaatgcagagaaaaccaggcaacaaatacttaatgagcatttcctaaatgcagtgtcatactaataacagagaagataaatacatgtaccagaatttctactctgaagaaattaataatataattgattcacccatacatatatccaagcaaccaaccattcatccctccacccatttaccctttcactcatccacctttccac

SEQ ID NO: 85994 - DNA, 601 bp, Human
caaactccctattaacagtgcactggcaaactcagtcacttcaatagacaacatcagaataggtgcttttaaattcaactaagcccttccttaggcaaataagataaaagcttcaacagaaaccaatgtagcccaaatttaggatcacccacgctacatttacccatccaatctgaaacaataaaagcaattgtgcctgtctgaggcatatttttctgccatcaggtttaaaatgttaaataaataataattgaaatatgaaatagtggtgtctatacatgtacatttttgtcactccctwaacagcaggaattatacccaacatttaagttctttctcagggtttcactaagcatactccaggctagagacagctccaggctggatattgcaccaaatgaattcacacatacactccctcacccactagaagttcatatccctggacagctggtagcagtcattccagttaacagcatttctgaatgcagagaaaaccaggcaacaaatacttaatgagcatttcctaaatgcagtgtcatactaataacagagaagataaatacatgtaccagaatttctactctgaagaaattaataa

SEQ ID NO: 85995 - DNA, 601 bp, Human
aaatggatatatttgaatatggaatgacaataagaagttaaaatttaattttaaaaaactgaacagaataaagaaacaaagccaaagaaaggaaaagatcctacgtggataaagcagaaacctccacacaagagctgtattattagttggtgcaaaagtaatcgtggtttgtaatggcaaggaccacaaatacttttgcaccaatctaatacatccataaatggatatatttgaatatggagtgacaataagaagttaaaatttaattttaaaaaaccgaacagaataaagaaacaaagcyaaaaaaaggaaaatatcctacgtggataaagcagaaaccaaaagtaaaccaagcgaaaaaaaagaagccaaataaaactataagctgatcttcagaggaaaaacattaaatgaatcttctgacatgactgttcaagaaaaacaaaccaaagaaaagaaaacccaaatggccaataaatgtgaaaatatgttcaacttcttaataagataaatgcaaattgaagaccatggttagattccgttttacatctatcatataagcaaaaatgaacaggactaatacaaagatttaaagagatat

SEQ ID NO: 85996 - DNA, 601 bp, Human
tgctataaggtcatgactattccaccctgcaatctcttcagcacccactctgtactttgggactgtttttcctctccatggaattctaagctcaaataactgcagtcagttgtaaaagtgcacagacaggaacaagacacctcctgcatgggtctcagagtctgatggaaagggcagtcgtaagtgagtagtaataaaacattgggaagaaaaactccatgggtgcagggcattgccttttcacaggagtatccccagagccaagatcaatggctgacccatagtaggcacttaataaatatttgttgagtgaatgaatgagtagtaactcaaagtagtttttaaagtgctccaagtatacaaagctggaaggaattaattctgccttgcatgtgtgtgtctgagggggtgtatcagggactggaccattcgaattgaatattgccgaattcacacaacttggcaaagagaaagggtattccagggagagagaactgcatgtacaagagcaaggaggtagaaaataccaggaacggtcaccagagcatgccagggtgagtgcaatactgtgcaggtggtacagaagatggggcagagagac

SEQ ID NO: 85997 - DNA, 601 bp, Human
agttgatcaaacaataagaaacactgtgtgcaacactcagttcctgggattttggtgctataaggtcatgactattccaccctgcaatctcttcagcacccactctgtactttgggactgtttttcctctccatggaattctaagctcaaataactgcagtcagttgtaaaagtgcacagacaggaacaagacacctcctgcatgggtctcagagtctgatggaaagggcagtcgtaagtgagtagtaataaaacattgggaagaaaaactccatgggtgcagggcattgccttttcacargagtatccccagagccaagatcaatggctgacccatagtaggcacttaataaatatttgttgagtgaatgaatgagtagtaactcaaagtagtttttaaagtgctccaagtatacaaagctggaaggaattaattctgccttgcatgtgtgtgtctgagggggtgtatcagggactggaccattcgaattgaatattgccgaattcacacaacttggcaaagagaaagggtattccagggagagagaactgcatgtacaagagcaaggaggtagaaaataccaggaacggtcaccagagc

SEQ ID NO: 85998 - DNA, 601 bp, Human
gggagggaaagacaaaattgtccccagttgaaaaccactgctctaagccaatatgatagccccattgccttagccagtgatggttttaggggtgagcacgtgatccagttctgaccaatgtggcatgagaggaagtcatattgaggccttttgagaaatgttctctcactcttaagaagctacaaaactgaaagtgtctctttctggttgctggcatatctagatcacatcttatcaccaccctgaggatgcagccaataaaaaaggatgaaatacatttttaaattgtttttttttttttcttaaagccatggctcctcagttaacctaagcaactttagggtcaccataccttaagactcttcactacataataaatgaaattcatttcattactgacggcataaatttgagttggggttttgttacttgcagccaaaagcatcccaatataaacaccttcccatcttttccataacaaacctactttgcttctctcgcttattagtagtcaaaacatcacctttcaatgcatcccaatgccgtataggatggtttaaagagccctggagtctgaggcaaacagctaagtttgagcagc

SEQ ID NO: 85999 - DNA, 601 bp, Human
atgccagactgggtcagaccaatggcccattctggccatggcactgtctgacagaggcatccagaaacgttttgcagaaaagagctgtatttgtctcctatgacatcagtcatcaaaaatgtgcaaagtcctcctgaagcagatcatcttggggtgccccacccaacttccatgccacccttttccaagctgatggagtcctcattttgttcaagtgcttacttgcctacaggaggctcaggattaaatctcttttgccctatgccagggtttctcaacctctgcactactgaccagatcrtgtttctttgctgggtgggctgtcctgtacattgtaagatattttacagcatccctggtccctacatgctgatattagtagcatctcccgacaaacacctacctgtgaacaccaaaaatatcgccagactattacccttcggggagggaaagacaaaattgtccccagttgaaaaccactgctctaagccaatatgatagccccattgccttagccagtgatggttttaggggtgagcacgtgatccagttctgaccaatgtggcatgagaggaagtcatattgaggccttttgagaaat

SEQ ID NO: 86000 - DNA, 601 bp, Human
tgacagttccttgccaattggccgaagtcttccttggtgccttccatcaccagggtgcagacatgattcaaggatttctggtaagatctggccaggaaaatgtatcccacgagctcaaaactgccaagcactattgttaagaacacagatggcctccttcaggaaagtattattttctttccctaaatagaagcaaggtaaatatgttcttccttcttatgtttaccaagggtctctggctggtttacatccttttgtacagcaggctctctctcaggcctcttgcaaattttttttttttgcactggctcccgaatgttctgctcctaagactccgaatctgcactgctctggctacgtgagagagaggttcaaagtgggacacagcttcaccatcagttaatcctgactgatcttctgccagaggtgacaacctatcctcggggtttggcagtgagcctgatgaagataagaaatgccagactgggtcagaccaatggcccattctggccatggcactgtctgacagaggcatccagaaacgttttgcagaaaagagctgtatttgtctcctatgacatcagtcatcaaaaatgtgcaa

SEQ ID NO: 86001 - DNA, 601 bp, Human
acatacacacacatatatatatacacacatatatatacacgtataaatatgtgtgtatatatacacacatatatatgtatatatatacacacacacatatatatatacacatacgtgtgtgtgtgtgtgtgtatatatatatatatatagagagagagagagagagagagacagagacagagacagagacagagacagagagtgcctcactctgtagcccaggcaggaatacggtggcgcaatctcggctcactgcaacctctgcctcccaggtcccggttcaagcaattctcccgcctcmgtctcgccaccatgcccagctaatttttgtatttttagtaaatacggggtttcacaatgttggccaggctggtcttgaagtcctgacctcgtgatccacccacctcggcctcccaaagtgctgggattacgggtgtgagccaccacacctggcctgcaatattttttcacacccggcctacaatatcatttttaaaatcatgtgtacatggctttttgctgcacagaaaagtttgacttgcctgccctcctttatgctttttctttcctctgttgatgtctttgctgagtccttatgaag

SEQ ID NO: 86002 - DNA, 601 bp, Human
ggtcaaactcctgtgccaaatactccttttgttcagcccctgagcctagatattacagcatttgatgcttaatatacacttgcccactgcttgatcaatggaagggggctgcaatatacatatacatacacacacatatatatatacacacatatatatacacgtataaatatgtgtgtatatatacacacatatatatgtatatatatacacacacacatatatatatacacatacgtgtgtgtgtgtgtgtgtatatatatatatatatagagagagagagagagagagagacagagasagagacagagacagagacagagagtgcctcactctgtagcccaggcaggaatacggtggcgcaatctcggctcactgcaacctctgcctcccaggtcccggttcaagcaattctcccgcctccgtctcgccaccatgcccagctaatttttgtatttttagtaaatacggggtttcacaatgttggccaggctggtcttgaagtcctgacctcgtgatccacccacctcggcctcccaaagtgctgggattacgggtgtgagccaccacacctggcctgcaatattttttcacacccggc

SEQ ID NO: 86003 - DNA, 601 bp, Human
tcttaaggtcaaactcctgtgccaaatactccttttgttcagcccctgagcctagatattacagcatttgatgcttaatatacacttgcccactgcttgatcaatggaagggggctgcaatatacatatacatacacacacatatatatatacacacatatatatacacgtataaatatgtgtgtatatatacacacatatatatgtatatatatacacacacacatatatatatacacatacgtgtgtgtgtgtgtgtgtatatatatatatatatagagagagagagagagagagagasagagacagagacagagacagagacagagagtgcctcactctgtagcccaggcaggaatacggtggcgcaatctcggctcactgcaacctctgcctcccaggtcccggttcaagcaattctcccgcctccgtctcgccaccatgcccagctaatttttgtatttttagtaaatacggggtttcacaatgttggccaggctggtcttgaagtcctgacctcgtgatccacccacctcggcctcccaaagtgctgggattacgggtgtgagccaccacacctggcctgcaatattttttcaca

SEQ ID NO: 86004 - DNA, 601 bp, Human
accactgggccactgaatccatcagtccccaactttgatctacgtcagagtttctggtcatgtgaaataataagtttatacatcgtataatctactttgagtcaaggttctcataattacttgcagctaaacataccccaactcattcaaggagctacttgtaatgggctctctgcattttacatttggtagtatcttagacactttttacagattctttctaatctctctagtatcctacaatttagatattatcacccctactttacagatgaggaaactgaggcttgatgccgttaartaacttttcctaggtcacatagctagtgagaggcaccgctaggattcagtacaggcctttgaactcaaagttgacattcgttccaacccaccaggctgatgatcaaagtggcacgctaagaaagcaccccaggatttgctcagaaaggcagccgggatcacatcagcagcaagcccaaactttaaatgctcactcgctacctccttatctttttgtggagctaaacattatcctctgccatgatgccttccaaagcaggacaggtcttgatgtgattttccacttctcactatatatggt

SEQ ID NO: 86005 - DNA, 601 bp, Human
ctgtatgcaatgcctcaaacttcaggaacccttttggaaccagcctatgagtagactcaacactaaggatggtagaacagacggaagggaagaaggtggattcttgttgataccactgggccactgaatccatcagtccccaactttgatctacgtcagagtttctggtcatgtgaaataataagtttatacatcgtataatctactttgagtcaaggttctcataattacttgcagctaaacataccccaactcattcaaggagctacttgtaatgggctctctgcattttacatttggyagtatcttagacactttttacagattctttctaatctctctagtatcctacaatttagatattatcacccctactttacagatgaggaaactgaggcttgatgccgttaaataacttttcctaggtcacatagctagtgagaggcaccgctaggattcagtacaggcctttgaactcaaagttgacattcgttccaacccaccaggctgatgatcaaagtggcacgctaagaaagcaccccaggatttgctcagaaaggcagccgggatcacatcagcagcaagcccaaactttaaatgc

SEQ ID NO: 86006 - DNA, 601 bp, Human
ctgctggggttgggatggaggcggcatggggaaacatttactaactcacacctaagggggccataggaagataaaatctctcttctgccacatttgtgtctgtatgcaatgcctcaaacttcaggaacccttttggaaccagcctatgagtagactcaacactaaggatggtagaacagacggaagggaagaaggtggattcttgttgataccactgggccactgaatccatcagtccccaactttgatctacgtcagagtttctggtcatgtgaaataataagtttatacatcgtataakctactttgagtcaaggttctcataattacttgcagctaaacataccccaactcattcaaggagctacttgtaatgggctctctgcattttacatttggtagtatcttagacactttttacagattctttctaatctctctagtatcctacaatttagatattatcacccctactttacagatgaggaaactgaggcttgatgccgttaaataacttttcctaggtcacatagctagtgagaggcaccgctaggattcagtacaggcctttgaactcaaagttgacattcgttccaaccca

SEQ ID NO: 86007 - DNA, 601 bp, Human
agttctgatgctgacccaatcccggacaatgatatattaagaggaatctgctggggttgggatggaggcggcatggggaaacatttactaactcacacctaagggggccataggaagataaaatctctcttctgccacatttgtgtctgtatgcaatgcctcaaacttcaggaacccttttggaaccagcctatgagtagactcaacactaaggatggtagaacagacggaagggaagaaggtggattcttgttgataccactgggccactgaatccatcagtccccaactttgatctacktcagagtttctggtcatgtgaaataataagtttatacatcgtataatctactttgagtcaaggttctcataattacttgcagctaaacataccccaactcattcaaggagctacttgtaatgggctctctgcattttacatttggtagtatcttagacactttttacagattctttctaatctctctagtatcctacaatttagatattatcacccctactttacagatgaggaaactgaggcttgatgccgttaaataacttttcctaggtcacatagctagtgagaggcaccgctagg

SEQ ID NO: 86008 - DNA, 601 bp, Human
atatgtctgcaaatttttcaatactcccctccttcaaaaggtaaagcttaatcctccctgtgtgcttggcaactctcttctcatgaatggagtgggggacaaaagacagtgtgatttctgagatgacatcaacaaaggcaatgtggttgccttctctcttttggatcactcactctgaggaagttggctgccatgacatgagggacttcaagcagccccacggagaggttctcaaaatcaataaatgaggccccctgccagcagcctcggaaacaagccatccatgccagccagtcctccmgcctcagtccagcctttagatcactgcacctctggccaatgtactgaccacagcctcacaagagaccctaggcaagaatcccccaactaagttgctcccgaatatgatccacataatcagtaagataataaatgcttgttgcttcaaacttctaagttttgggatgatttgttatgcaccaatagctaactaatacacaacacagccatcagtacatagttctgatgctgacccaatcccggacaatgatatattaagaggaatctgctggggttgggatggaggcggcatggggaaaca

SEQ ID NO: 86009 - DNA, 601 bp, Human
tgaccaccagataacaatggaatttctgttgtaccacacataaggtagttttaaaatatgtctgcaaatttttcaatactcccctccttcaaaaggtaaagcttaatcctccctgtgtgcttggcaactctcttctcatgaatggagtgggggacaaaagacagtgtgatttctgagatgacatcaacaaaggcaatgtggttgccttctctcttttggatcactcactctgaggaagttggctgccatgacatgagggacttcaagcagccccacggagaggttctcaaaatcaataaaygaggccccctgccagcagcctcggaaacaagccatccatgccagccagtcctccagcctcagtccagcctttagatcactgcacctctggccaatgtactgaccacagcctcacaagagaccctaggcaagaatcccccaactaagttgctcccgaatatgatccacataatcagtaagataataaatgcttgttgcttcaaacttctaagttttgggatgatttgttatgcaccaatagctaactaatacacaacacagccatcagtacatagttctgatgctgacccaatcccggaca

SEQ ID NO: 86010 - DNA, 601 bp, Human
aaaaaacaaaaacccaccctagatattgccaaatgtcccctggcctagataattgcaactagtccttcaaaaatcagggcagtgtcacctcctccaggaagccccctggccccctcatcccccaaacagcagcaaattcactgcgtgtttactttagctctttcccacatcagactgaaaccaggtctgcttctattttgtgcccctgacgctagcacagtgcccgcccggcagggagcagacatcccctcccaccccccaatgtccccactgatgtctgttgatcaactagatgatagasagtgagtggaaaagaaaggcagaggggggacccactcttgttccttggtgccagggtttaaagaggtttggctgcatctagcgtgttttctcagatgctctcttgctcacgactcaaaggcgaatgcgaatgtgcattcgtagcgggggcagggatgaactgcactccaaacctgcaccaaaaacctgctctctatccccagggtctcaggtaaatgtggctttgtttaaaagcgcattctctggatcttctgttttcatttttaaactgtaaaagatagagttgtttgtttgaaaatcg

SEQ ID NO: 86011 - DNA, 601 bp, Human
ccactgcactccagcctgggcgacagaatgagactccttctcaaaaaaaaaacaaaaaacaaaacaaaacaaaaaaaacaaaaacccaccctagatattgccaaatgtcccctggcctagataattgcaactagtccttcaaaaatcagggcagtgtcacctcctccaggaagccccctggccccctcatcccccaaacagcagcaaattcactgcgtgtttactttagctctttcccacatcagactgaaaccaggtctgcttctattttgtgcccctgacgctagcacagtgcccgccyggcagggagcagacatcccctcccaccccccaatgtccccactgatgtctgttgatcaactagatgatagacagtgagtggaaaagaaaggcagaggggggacccactcttgttccttggtgccagggtttaaagaggtttggctgcatctagcgtgttttctcagatgctctcttgctcacgactcaaaggcgaatgcgaatgtgcattcgtagcgggggcagggatgaactgcactccaaacctgcaccaaaaacctgctctctatccccagggtctcaggtaaatgtggctttgttt

SEQ ID NO: 86012 - DNA, 601 bp, Human
ggaggcggagcttgcagtgagccgagatcgcgccactgcactccagcctgggcgacagaatgagactccttctcaaaaaaaaaacaaaaaacaaaacaaaacaaaaaaaacaaaaacccaccctagatattgccaaatgtcccctggcctagataattgcaactagtccttcaaaaatcagggcagtgtcacctcctccaggaagccccctggccccctcatcccccaaacagcagcaaattcactgcgtgtttactttagctctttcccacatcagactgaaaccaggtctgcttctatyttgtgcccctgacgctagcacagtgcccgcccggcagggagcagacatcccctcccaccccccaatgtccccactgatgtctgttgatcaactagatgatagacagtgagtggaaaagaaaggcagaggggggacccactcttgttccttggtgccagggtttaaagaggtttggctgcatctagcgtgttttctcagatgctctcttgctcacgactcaaaggcgaatgcgaatgtgcattcgtagcgggggcagggatgaactgcactccaaacctgcaccaaaaacctgctctctat

SEQ ID NO: 86013 - DNA, 601 bp, Human
aggagatagagatcatcctggctaacatggtgaaaccctgtctctactataaaaaacacaaaaaaaattacccgggcatggcagcaggcgcctgtagtctcagctactagggtggctgaggcaggacaatcacgtgaacccaggaggcggagcttgcagtgagccgagatcgcgccactgcactccagcctgggcgacagaatgagactccttctcaaaaaaaaaacaaaaaacaaaacaaaacaaaaaaaacaaaaacccaccctagatattgccaaatgtcccctggcctagataattscaactagtccttcaaaaatcagggcagtgtcacctcctccaggaagccccctggccccctcatcccccaaacagcagcaaattcactgcgtgtttactttagctctttcccacatcagactgaaaccaggtctgcttctattttgtgcccctgacgctagcacagtgcccgcccggcagggagcagacatcccctcccaccccccaatgtccccactgatgtctgttgatcaactagatgatagacagtgagtggaaaagaaaggcagaggggggacccactcttgttccttggtgccag

SEQ ID NO: 86014 - DNA, 601 bp, Human
tgtgtcctcacagtggaagggtctagagatttttgccttgcctggcttgccctaatcccattcatgacttaatcacctcccaaaggctccaccccacctcagcctatcactttggagatcaagatttcaacatatgaattctagggggacgctaacattcaaaccacagcacttttcctcctcttgtctagacctgtgtttcttaaccccagcactgcgaacatttggggctggataactctgcattggagggggctgtcctgcacacactgtaggttatttacaagcatccctgtcctcyacctactagatgccagtagcaactccaccttatccccagtttggacaacagaaaaacctagatattgccggccaggcgcggtggctcacgcctgtaatcccagcactttgggaggccgaggcgggcagatcacgaggtcaggagatagagatcatcctggctaacatggtgaaaccctgtctctactataaaaaacacaaaaaaaattacccgggcatggcagcaggcgcctgtagtctcagctactagggtggctgaggcaggacaatcacgtgaacccaggaggcggagcttgcagtg

SEQ ID NO: 86015 - DNA, 601 bp, Human
acggtcagcttcctggattacaggcactgccttctcactgtgtcctcacagtggaagggtctagagatttttgccttgcctggcttgccctaatcccattcatgacttaatcacctcccaaaggctccaccccacctcagcctatcactttggagatcaagatttcaacatatgaattctagggggacgctaacattcaaaccacagcacttttcctcctcttgtctagacctgtgtttcttaaccccagcactgcgaacatttggggctggataactctgcattggagggggctgtcctscacacactgtaggttatttacaagcatccctgtcctccacctactagatgccagtagcaactccaccttatccccagtttggacaacagaaaaacctagatattgccggccaggcgcggtggctcacgcctgtaatcccagcactttgggaggccgaggcgggcagatcacgaggtcaggagatagagatcatcctggctaacatggtgaaaccctgtctctactataaaaaacacaaaaaaaattacccgggcatggcagcaggcgcctgtagtctcagctactagggtggctgaggca

SEQ ID NO: 86016 - DNA, 601 bp, Human
ctcagttccagaggttgggaagtccaagatcaaggtgccagcatattcggtgtctggtgacggtcagcttcctggattacaggcactgccttctcactgtgtcctcacagtggaagggtctagagatttttgccttgcctggcttgccctaatcccattcatgacttaatcacctcccaaaggctccaccccacctcagcctatcactttggagatcaagatttcaacatatgaattctagggggacgctaacattcaaaccacagcacttttcctcctcttgtctagacctgtgtttctyaaccccagcactgcgaacatttggggctggataactctgcattggagggggctgtcctgcacacactgtaggttatttacaagcatccctgtcctccacctactagatgccagtagcaactccaccttatccccagtttggacaacagaaaaacctagatattgccggccaggcgcggtggctcacgcctgtaatcccagcactttgggaggccgaggcgggcagatcacgaggtcaggagatagagatcatcctggctaacatggtgaaaccctgtctctactataaaaaacacaaaaa

SEQ ID NO: 86017 - DNA, 601 bp, Human
ggaatgcttttctgccttagtctgttcaggctgctgtaacaaaacacataaactgcgcgtaaaaacaacagactttatttctctcagttccagaggttgggaagtccaagatcaaggtgccagcatattcggtgtctggtgacggtcagcttcctggattacaggcactgccttctcactgtgtcctcacagtggaagggtctagagatttttgccttgcctggcttgccctaatcccattcatgacttaatcacctcccaaaggctccaccccacctcagcctatcactttggagatcargatttcaacatatgaattctagggggacgctaacattcaaaccacagcacttttcctcctcttgtctagacctgtgtttcttaaccccagcactgcgaacatttggggctggataactctgcattggagggggctgtcctgcacacactgtaggttatttacaagcatccctgtcctccacctactagatgccagtagcaactccaccttatccccagtttggacaacagaaaaacctagatattgccggccaggcgcggtggctcacgcctgtaatcccagcactttgggaggccgagg

SEQ ID NO: 86018 - DNA, 601 bp, Human
ctaatttttgtattacagtgacagggtcttgctatgttgcccaggctactctccaactcctggattcaagcaatcctcttgtctcagcctcccaaattgttgagattacaggcatgaatcattgtgcctggctctactcccatttctaagccctctcccacacccagcagtccttccagacaaacccagctgtctgcagctcctcccagtctacatcataatcccctggaatgcttttctgccttagtctgttcaggctgctgtaacaaaacacataaactgcgcgtaaaaacaacagacattatttctctcagttccagaggttgggaagtccaagatcaaggtgccagcatattcggtgtctggtgacggtcagcttcctggattacaggcactgccttctcactgtgtcctcacagtggaagggtctagagatttttgccttgcctggcttgccctaatcccattcatgacttaatcacctcccaaaggctccaccccacctcagcctatcactttggagatcaagatttcaacatatgaattctagggggacgctaacattcaaaccacagcacttttcctcctcttgtctagacct

SEQ ID NO: 86019 - DNA, 601 bp, Human
actaacagcccgcatttgaagcctctccccgccgtgtgcagccctgccaccctccaccgcacccgacacgcattatccagagtgatcattctaaaaagtatattggactaagttacttaaaacctgcttaaaacactttaatgtttccccttccctaagataaagtctaaaccccttagcatgatattcaagggtcttcattcatctccatctgacagcttctctactcctatttcttttattattggtttttattttttagagacagggtcttgcactgtcacccaggctggtgtgcagyggagtgatcagagttcactgcagcctctacctcctggactcaggtgatcctcccacctcagcctcctgagtatctgagacaggcgcatgccaccacacccagctaatttttgtattacagtgacagggtcttgctatgttgcccaggctactctccaactcctggattcaagcaatcctcttgtctcagcctcccaaattgttgagattacaggcatgaatcattgtgcctggctctactcccatttctaagccctctcccacacccagcagtccttccagacaaacccagctgtctgca

SEQ ID NO: 86020 - DNA, 601 bp, Human
agtaatttgcccgtgtccttatgcaacatgctgacctggtcggtcatttaaatgaaagggcacggcagccatgcaaaactctatctccctaatgcttttcttcccattgctttcttcttcttgaaatataaaaacgaccctgttgtataactgcattccattgcactgcattaactaaaccaattctaagttcttttgtggaaacatggtgatcacttctccgcttgcatgcactaacagcccgcatttgaagcctctccccgccgtgtgcagccctgccaccctccaccgcacccgacaygcattatccagagtgatcattctaaaaagtatattggactaagttacttaaaacctgcttaaaacactttaatgtttccccttccctaagataaagtctaaaccccttagcatgatattcaagggtcttcattcatctccatctgacagcttctctactcctatttcttttattattggtttttattttttagagacagggtcttgcactgtcacccaggctggtgtgcagcggagtgatcagagttcactgcagcctctacctcctggactcaggtgatcctcccacctcagcctcctg

SEQ ID NO: 86021 - DNA, 601 bp, Human
tagacacctccctggatggatggagcactggaatttgggctaccagagagttccgcctcggttagcagaagtaatttgcccgtgtccttatgcaacatgctgacctggtcggtcatttaaatgaaagggcacggcagccatgcaaaactctatctccctaatgcttttcttcccattgctttcttcttcttgaaatataaaaacgaccctgttgtataactgcattccattgcactgcattaactaaaccaattctaagttcttttgtggaaacatggtgatcacttctccgcttgcatgyactaacagcccgcatttgaagcctctccccgccgtgtgcagccctgccaccctccaccgcacccgacacgcattatccagagtgatcattctaaaaagtatattggactaagttacttaaaacctgcttaaaacactttaatgtttccccttccctaagataaagtctaaaccccttagcatgatattcaagggtcttcattcatctccatctgacagcttctctactcctatttcttttattattggtttttattttttagagacagggtcttgcactgtcacccaggctggtgtgcag

SEQ ID NO: 86022 - DNA, 601 bp, Human
tttttttttttgagatggattctcactctgtcacccaggctggagtgcagtggcgcaatctcggctcattgcaaacgccattctcctgcctcatcctctggagtagctgggactacaggcacccgccacaacgcccggctaattttttttttttgtatttttagtagagatggcgtttcactgtgttagccaggatggtctccatctcctgacctcgtgatccgcccacctcggcctcccaaaatgctgggactacaggcgtgagccaccgtgcctggccagtattattttttttaagatygtatgcatcttcataccatctctcctctctgcatgtctgtttctgtgtccaattttcccctttttataaggacaccagtcttatcagattagggctcacactaatgacctccttttaacttgattacctctgtaaagaccctctctccaaataaggtcacatcctgaggtactgagggttaggacttcaacatatattttgttttggtgggggatacagcccatgatgccttgtcagatgacacctctgatcccaggaggatccatgccgtggagacaaacaactcattatttgccttga

SEQ ID NO: 86023 - DNA, 601 bp, Human
atagatggtgttctatttatgccataataaaaatattagtacttactttttttttttcttttttttttttttttttttttttttgagatggattctcactctgtcacccaggctggagtgcagtggcgcaatctcggctcattgcaaacgccattctcctgcctcatcctctggagtagctgggactacaggcacccgccacaacgcccggctaattttttttttttgtatttttagtagagatggcgtttcactgtgttagccaggatggtctccatctcctgacctcgtgatccgcccrcctcggcctcccaaaatgctgggactacaggcgtgagccaccgtgcctggccagtattattttttttaagattgtatgcatcttcataccatctctcctctctgcatgtctgtttctgtgtccaattttcccctttttataaggacaccagtcttatcagattagggctcacactaatgacctccttttaacttgattacctctgtaaagaccctctctccaaataaggtcacatcctgaggtactgagggttaggacttcaacatatattttgttttggtgggggatacagcccatgat

SEQ ID NO: 86024 - DNA, 601 bp, Human
agcctcaggcattccttggctcatagatggtgttctatttatgccataataaaaatattagtacttactttttttttttcttttttttttttttttttttttttttgagatggattctcactctgtcacccaggctggagtgcagtggcgcaatctcggctcattgcaaacgccattctcctgcctcatcctctggagtagctgggactacaggcacccgccacaacgcccggctaattttttttttttgtatttttagtagagatggcgtttcactgtgttagccaggatggtctccatstcctgacctcgtgatccgcccacctcggcctcccaaaatgctgggactacaggcgtgagccaccgtgcctggccagtattattttttttaagattgtatgcatcttcataccatctctcctctctgcatgtctgtttctgtgtccaattttcccctttttataaggacaccagtcttatcagattagggctcacactaatgacctccttttaacttgattacctctgtaaagaccctctctccaaataaggtcacatcctgaggtactgagggttaggacttcaacatatattttgtttt

SEQ ID NO: 86025 - DNA, 601 bp, Human
gtactgcaaacttggtggcttgaacaatataatttttttctctcatagttctggaggctgaaagtgtaagatcaaggtgtcggtggttccctctggagtctctgaaggacaatctatttcatgcctttcttccagcttctggtagcctcaggcattccttggctcatagatggtgttctatttatgccataataaaaatattagtacttactttttttttttcttttttttttttttttttttttttttgagatggattctcactctgtcacccaggctggagtgcagtggcgcaatctcrgctcattgcaaacgccattctcctgcctcatcctctggagtagctgggactacaggcacccgccacaacgcccggctaattttttttttttgtatttttagtagagatggcgtttcactgtgttagccaggatggtctccatctcctgacctcgtgatccgcccacctcggcctcccaaaatgctgggactacaggcgtgagccaccgtgcctggccagtattattttttttaagattgtatgcatcttcataccatctctcctctctgcatgtctgtttctgtgtccaattttcccctt

SEQ ID NO: 86026 - DNA, 601 bp, Human
gctttcaaacttgagtgtgcatgggcatcacccactggagtcaccgaccaggagatctcaggggaagcccaagaatctgcattcccaagtgatgctgatgctgctggtccagggaccacactttgagaaccactgcactggatgatcgatttttttttttttttttttgagatagggtctcactctgtcacccaggctggagtgcagtggtatgatcttggctcactgcaaactctgcctcctgggttcaagcaattctcatacctcagccttcccagtagctaggactacaggtgcttgycaccatgcctggctaatttttgtatttttagcagagacggggtttcaccatgttggccaggctggtctcgaactcctgacctcaagtgatccgcctgcctgggcctcccaaagtggtgggattacaggcgtaagccaccatgcccagcacgattaatggatttctatggaatttaatttcctttctgcctactgctttcaggtaaaaacgatgattgattcagattcccctgatgatctcacttgcataactgagatcaggggtttttctgaaattcaccaggacttctccccttttcaa

SEQ ID NO: 86027 - DNA, 601 bp, Human
acctgctgaaaggtgaagaggacagagccttggcagagattaatgccttcctgatgccaggcggccgtgagaactgagattggcagtgtgaaggtccaccttctctgcaaccaaatcataagtgtcccatagacaaaggctttgtgtttatctgccttcagactggtcagtgatcagggaagcttagcaacttggggcaaaactggctcagggccgggcatggtggctcatgcctgtaatcctagcacttcgggaggctgaggaaggctgatcacttgagaccagaagtgcgagaccatcytggccaatatggtgaaaccctatctctactaaaaatccaaaaaattagccggaatgttagcacatgcctatagtccctgctactcgggaggctgaggcaggagaagtgcttgaacccaggaggcggaggttgcagtgagccaagatcgtgtcactgcaccccaggctggacgataagagtgagaccccacgtcaaaaaaaagcaaaaaaaaaaaaaaaaaaaaaaaaaaaaactggctcagaactgatggagccacactttgagaaggatgttgacttgctggctaatgaatgattaagg

SEQ ID NO: 86028 - DNA, 601 bp, Human
cagccttgtgcgtatgctgatgctgcatgaaatccctgcttcttcatcgttcgtcacaagaggtaagttccccagctccatcccagcccagcagccaaccataggaaaggcagctgagaagtgccttccttctcctgccttcttgggtcattgagcaaagaggagacagaggcacacgggcccactctctcttctttttttcctatcaaccgggccaaacaaccagcaaggaacacctgctgaaaggtgaagaggacagagccttggcagagattaatgccttcctgatgccaggcggccrtgagaactgagattggcagtgtgaaggtccaccttctctgcaaccaaatcataagtgtcccatagacaaaggctttgtgtttatctgccttcagactggtcagtgatcagggaagcttagcaacttggggcaaaactggctcagggccgggcatggtggctcatgcctgtaatcctagcacttcgggaggctgaggaaggctgatcacttgagaccagaagtgcgagaccatcttggccaatatggtgaaaccctatctctactaaaaatccaaaaaattagccggaatgttagcacatg

SEQ ID NO: 86029 - DNA, 601 bp, Human
cacagacgaggaactgaggcaccaaggaaaatgaaaactttccagtaggcacacccctagaaagtggtggattcagggttgaacgaacacagtttaatgccggtctccactctgagccattaaacaacagtggtggaacacacaccaaacaacaaatggggaaactgaggcccagagagctttcatcatagcttctgcctgactcccagctgcaactcctaacataagtctctgctcatgtgaaagagttcagtgtcctcacccaatggagagtttccttatcattgtccttaaccaatgragagtttcttgtgtccatatatccagtgtccttacccagtggagagtttctcgaacccatgactacaccatgcttttaagcacaccaggctcctaggataccacaggtgccccagctggtttgcacctgtgggcaaagtttgccctgcattcctgggcacgtgattatacctatattggggtgaatttctgtgactttcccagatgcatgtatctgacacccccacctaccaaccgtgaactgttataattccatcaacatttgccaagcaagattgtaccacatggaactctgcagtga

SEQ ID NO: 86030 - DNA, 601 bp, Human
cccatttcacagacgaggaactgaggcaccaaggaaaatgaaaactttccagtaggcacacccctagaaagtggtggattcagggttgaacgaacacagtttaatgccggtctccactctgagccattaaacaacagtggtggaacacacaccaaacaacaaatggggaaactgaggcccagagagctttcatcatagcttctgcctgactcccagctgcaactcctaacataagtctctgctcatgtgaaagagttcagtgtcctcacccaatggagagtttccttatcattgtccttamccaatggagagtttcttgtgtccatatatccagtgtccttacccagtggagagtttctcgaacccatgactacaccatgcttttaagcacaccaggctcctaggataccacaggtgccccagctggtttgcacctgtgggcaaagtttgccctgcattcctgggcacgtgattatacctatattggggtgaatttctgtgactttcccagatgcatgtatctgacacccccacctaccaaccgtgaactgttataattccatcaacatttgccaagcaagattgtaccacatggaactct

SEQ ID NO: 86031 - DNA, 601 bp, Human
tataaacaacaattggcgcacactgtacaaattaagtgattttttttaaatgtgggtctacccacctctaagcctttcatctaatttgataccttccacagagataccttgatctaaatgccacctctgctgagtttcttttagcgccttttgcattatgaaaagtcagtatctcattgaatcttctcatcaaaacagccagacatttaccatgtgttccaagtgctttatataaattaactttcagcccttgcaacccaccttcaaaggtaaatactatcattatccccatttcacagaygaggaactgaggcaccaaggaaaatgaaaactttccagtaggcacacccctagaaagtggtggattcagggttgaacgaacacagtttaatgccggtctccactctgagccattaaacaacagtggtggaacacacaccaaacaacaaatggggaaactgaggcccagagagctttcatcatagcttctgcctgactcccagctgcaactcctaacataagtctctgctcatgtgaaagagttcagtgtcctcacccaatggagagtttccttatcattgtccttaaccaatggagagtt

SEQ ID NO: 86032 - DNA, 601 bp, Human
acaagctacttcaagcttgttgagccttgggtaacgatggctatgccagagagacatgggagacttcaatgacataaaatggatgatattttataaacaacaattggcgcacactgtacaaattaagtgattttttttaaatgtgggtctacccacctctaagcctttcatctaatttgataccttccacagagataccttgatctaaatgccacctctgctgagtttcttttagcgccttttgcattatgaaaagtcagtatctcattgaatcttctcatcaaaacagccagacatttascatgtgttccaagtgctttatataaattaactttcagcccttgcaacccaccttcaaaggtaaatactatcattatccccatttcacagacgaggaactgaggcaccaaggaaaatgaaaactttccagtaggcacacccctagaaagtggtggattcagggttgaacgaacacagtttaatgccggtctccactctgagccattaaacaacagtggtggaacacacaccaaacaacaaatggggaaactgaggcccagagagctttcatcatagcttctgcctgactcccagctgcaac

SEQ ID NO: 86033 - DNA, 601 bp, Human
tgcttgtccatttgccgtctctgtccttatacagaaacgtcatctctctaaggcaggggctttgtcgtggtcagtgctgcgttcctggcacccagcagagagcccgtagacagtggtgcacaataattacccatggaatggtgaatgtttcttagcaactgtaacttactgcctgcactcctctcccctgcagccagttctccacgtggccaccagaggatgcttctggaaggtaaatctcatgttcaccaccatccaccctggctttaaaatctttagtggtttctttctgctcttatarcaaagatgcaacacccaaatgtggcctgagggtctcagcacggttctgctctgacctccttcactcttaccctccaagcaccagggtcttctcaggcaatttttttcagaccagacatttgctatgatccctccggccacagggcctatgcccagtctctttccacttcctgcaatgcttttcccttccctctgtcacccaccctagtcttcacatctcagtttcagcccatgtcctcagggaaccttctctgaccttcctgggtgggtcacacagtacttattacagcgcatcgtattt

SEQ ID NO: 86034 - DNA, 601 bp, Human
actcacatgggtgtcccttcacttcaaatgtcagcacaagaggtttttcctgcctaaatggcagccaatatgctctagtctctcgccctgcttttaagtatttcttcccagccacactgcttcctgccacattcattcacttgcttgtccatttgccgtctctgtccttatacagaaacgtcatctctctaaggcaggggctttgtcgtggtcagtgctgcgttcctggcacccagcagagagcccgtagacagtggtgcacaataattacccatggaatggtgaatgtttcttagcaacygtaacttactgcctgcactcctctcccctgcagccagttctccacgtggccaccagaggatgcttctggaaggtaaatctcatgttcaccaccatccaccctggctttaaaatctttagtggtttctttctgctcttatagcaaagatgcaacacccaaatgtggcctgagggtctcagcacggttctgctctgacctccttcactcttaccctccaagcaccagggtcttctcaggcaatttttttcagaccagacatttgctatgatccctccggccacagggcctatgcccagtctc

SEQ ID NO: 86035 - DNA, 601 bp, Human
caccctctaaataaaatacgtaaatcctcaatgtggcctttacaatctgcctcttttaatccttctctgcagccacaatgacttctatgatggtcttccaataccctgagcctgttcccacctcagggtctttgccattgctgtgctgccccctggaaagcccttcccccagatactcacatgggtgtcccttcacttcaaatgtcagcacaagaggtttttcctgcctaaatggcagccaatatgctctagtctctcgccctgcttttaagtatttcttcccagccacactgcttcctgmcacattcattcacttgcttgtccatttgccgtctctgtccttatacagaaacgtcatctctctaaggcaggggctttgtcgtggtcagtgctgcgttcctggcacccagcagagagcccgtagacagtggtgcacaataattacccatggaatggtgaatgtttcttagcaactgtaacttactgcctgcactcctctcccctgcagccagttctccacgtggccaccagaggatgcttctggaaggtaaatctcatgttcaccaccatccaccctggctttaaaatctttagtggtttc

SEQ ID NO: 86036 - DNA, 601 bp, Human
acccctgctgagtttcctatgcccttctctgctccagatcatgttgtgtttgtatgaatagcatgtgcacaggtgagacactgcctccttggaagacaccaaaggcgtgtggctgctgtgtccagtcacgtgctcagacttcacccctgctatggggatgagggcaagggtattggttttggtctcctgcctgcacttactgttgccctgggggtgaagatgctacctgaaaacccacatatcctggaaaggtctcacacaaggatcaggcgttttcagacagaaaggttttcttgttgaygttttctactgcattctctcttaagctcaagactttttattttgtgttttttacattgatgagttataaaggggcctctctcatctttcccttctttttaccttcttctttgctgaatctctgctctctggccaggagtcattacatagaaacttaagtgcagggtgatcatctattaactcagcaaatagttatcgacagctacaatctcagatactatttaaggcttcagagatacagcagtgagcaaaattgctgtcaaagtgcccacattctagtggaaaaagcaataaatagatg

SEQ ID NO: 86037 - DNA, 601 bp, Human
aggaggctgagacaggagaattgcttgaacccgggaggcagaggttgcagtgagctgagattgcgctactgcactctagcctgggccacagagtgagactctgtctccaaaaaaataaataaataaataaaagtatatatatacaaaaagaaactcaatggaggctgcagcatcttcaaagtttatcactgattgtgtaaagcaagcacgggctatgtgcaagctgggctgcctatggacaggaagggatcattttcagaggcgtttcaaatcatcttcacgttcttgggtgattttttawaaaaaaaatcattaaatgttatacaactctcatttctctcgtccttcaatattactgcatttctctcatcattcaatattactgtcagttctggcagaaaatataatatacccctgctgagtttcctatgcccttctctgctccagatcatgttgtgtttgtatgaatagcatgtgcacaggtgagacactgcctccttggaagacaccaaaggcgtgtggctgctgtgtccagtcacgtgctcagacttcacccctgctatggggatgagggcaagggtattggttttggtctcctgcc

SEQ ID NO: 86038 - DNA, 601 bp, Human
caggaggctgagacaggagaattgcttgaacccgggaggcagaggttgcagtgagctgagattgcgctactgcactctagcctgggccacagagtgagactctgtctccaaaaaaataaataaataaataaaagtatatatatacaaaaagaaactcaatggaggctgcagcatcttcaaagtttatcactgattgtgtaaagcaagcacgggctatgtgcaagctgggctgcctatggacaggaagggatcattttcagaggcgtttcaaatcatcttcacgttcttgggtgattttttwaaaaaaaaatcattaaatgttatacaactctcatttctctcgtccttcaatattactgcatttctctcatcattcaatattactgtcagttctggcagaaaatataatatacccctgctgagtttcctatgcccttctctgctccagatcatgttgtgtttgtatgaatagcatgtgcacaggtgagacactgcctccttggaagacaccaaaggcgtgtggctgctgtgtccagtcacgtgctcagacttcacccctgctatggggatgagggcaagggtattggttttggtctcctgc

SEQ ID NO: 86039 - DNA, 601 bp, Human
taaggcagccaattaaagtagaaactcagacctggcacaatgctcacgcctgtaatcccagcactttgggaggccgaagggggtgtagatcacctgaggtctggagttcgagaccagcctggccaacatggtaaaaccccgtctctactaaaaatacaaaaattagccaggtgtggtgctgcatgcctgtaatcccagctactcaggaggctgagacaggagaattgcttgaacccgggaggcagaggttgcagtgagctgagattgcgctactgcactctagcctgggccacagagtgasactctgtctccaaaaaaataaataaataaataaaagtatatatatacaaaaagaaactcaatggaggctgcagcatcttcaaagtttatcactgattgtgtaaagcaagcacgggctatgtgcaagctgggctgcctatggacaggaagggatcattttcagaggcgtttcaaatcatcttcacgttcttgggtgattttttaaaaaaaaaatcattaaatgttatacaactctcatttctctcgtccttcaatattactgcatttctctcatcattcaatattactgtcagttctggca

SEQ ID NO: 86040 - DNA, 601 bp, Human
ggtttctccatgttggtcaggctggcctcaaaccccttaggtcaggtgatcctcccgcctcggcctcccgaagtgctgggattagaggcgtaaaggctgcagtcacgtagactcaaaagaaaaacagtattttaaaaaaaagaacaagaatgctgtataaaacagtaaacagtaaaacataatgcagcaattaaaagttaatgccccaacatttattttggggatacggcatatgtctcacctagtctgggactaaaaagtttcctgccttattcatgcaggggcttcttcatggtttgcrtaaggcagccaattaaagtagaaactcagacctggcacaatgctcacgcctgtaatcccagcactttgggaggccgaagggggtgtagatcacctgaggtctggagttcgagaccagcctggccaacatggtaaaaccccgtctctactaaaaatacaaaaattagccaggtgtggtgctgcatgcctgtaatcccagctactcaggaggctgagacaggagaattgcttgaacccgggaggcagaggttgcagtgagctgagattgcgctactgcactctagcctgggccacagagtga

SEQ ID NO: 86041 - DNA, 601 bp, Human
ccactcagtgagaaacacgccaaacaagaaccaggtctgcttttctctcacttcctcccaccccaaaacaatgcagaacttgaaatcaggtgctttcagattcaggtgaacgaacctcaggaacaactgcacttccagtcccctctctttctcaatcacagaaacgatcaagttctctcctattccacctgcctgttctcaagtggaccctcccgtggagatggctctatttcaaatcaaaaccccatcgcaccaccacccaagggcttccttttgcctttccctaatccactttttgccyagtgcttattatcagctgacacattaaatatttgttatgtttctgttggcctctcctcacacaaagaagacaggtttgttgactgctgtatctccagcatgcacagcccattgaaggctcaagtagcatttgttacatgagaaaataagttgtttatagccctccccaacacctagcatccacataaagtgtaagggatcttataaaggagttgcccatattacagatgaggaaactgaggctcagagagaacagacttttccaagctctcacagcaaagtttagcatctcagctatcaa

SEQ ID NO: 86042 - DNA, 601 bp, Human
taaaaaaatatctagagcatgaggacacagaaaggacttccagaatcccccacccagtggcaaccacttggacacatgactgcttggagattgagagccaaattcaaatcccaacttaggttctcactaattggatgagttggggcaagtcacgtcaccttcctaaggctcagtttgctcctctgtataacaagagtaataaaaagtagcttcctcatggtattattgtgaaaaataaaataaaatgcttggtgcactgtccagcatgtacagggaatctattgctattatttattattgktactaacagcattagatgcatttcctttctctgcatcttgaaggtagtctatgcaaagtacccagcatagcctgtaggatatctccaggccattagagagagaaaaaaaaaagtccttcctaaattcaaacttcatatcacttcgccctctgatttaagcagggcattaggttcatctctaactctccctttctgtcaactgaagaacatggatctgctccattcactgcacagtcaagctggggggcactgcagagaacaaggaaagaagaccaccaccagcagacatgggccatggca

SEQ ID NO: 86043 - DNA, 601 bp, Human
tagccagggtcctggagccaacctcaaggcagcctctttgactcacacaatactgtctggctacatcatcactgttctcagcccaaccttcctcctggccatagaatctctgtatgctcactacagaaaaaaataaaaaaatatctagagcatgaggacacagaaaggacttccagaatcccccacccagtggcaaccacttggacacatgactgcttggagattgagagccaaattcaaatcccaacttaggttctcactaattggatgagttggggcaagtcacgtcaccttcctaagsctcagtttgctcctctgtataacaagagtaataaaaagtagcttcctcatggtattattgtgaaaaataaaataaaatgcttggtgcactgtccagcatgtacagggaatctattgctattatttattattgttactaacagcattagatgcatttcctttctctgcatcttgaaggtagtctatgcaaagtacccagcatagcctgtaggatatctccaggccattagagagagaaaaaaaaaagtccttcctaaattcaaacttcatatcacttcgccctctgatttaagcagggcat

SEQ ID NO: 86044 - DNA, 601 bp, Human
ggattgcaatgacattatgtatccgaggcagtggaagtttcctctaaagaaaaaatgggaggcaagtggcttgaggaagtcaggcacagcgagcttcgtagccagggtcctggagccaacctcaaggcagcctctttgactcacacaatactgtctggctacatcatcactgttctcagcccaaccttcctcctggccatagaatctctgtatgctcactacagaaaaaaataaaaaaatatctagagcatgaggacacagaaaggacttccagaatcccccacccagtggcaaccacttkgacacatgactgcttggagattgagagccaaattcaaatcccaacttaggttctcactaattggatgagttggggcaagtcacgtcaccttcctaaggctcagtttgctcctctgtataacaagagtaataaaaagtagcttcctcatggtattattgtgaaaaataaaataaaatgcttggtgcactgtccagcatgtacagggaatctattgctattatttattattgttactaacagcattagatgcatttcctttctctgcatcttgaaggtagtctatgcaaagtacccagcata

SEQ ID NO: 86045 - DNA, 601 bp, Human
ggcgtgaatcaccatgcctgacacagcagaacctttgagatatatttaagcaaggaggctggaataccgcctcatttgactccagggaaaatataactttttcccagagatgaaaataaagacaccagagcggggtccactcaaggatactgatgtgagccatcccctgcctccctatatcggctggcagagacaggcaggctaggggatgcaaaatctcatgggtagagatgcagccttgcttcagagaaatcttactgcaaaccctggaggccagactttagacaggattgcaatgacmttatgtatccgaggcagtggaagtttcctctaaagaaaaaatgggaggcaagtggcttgaggaagtcaggcacagcgagcttcgtagccagggtcctggagccaacctcaaggcagcctctttgactcacacaatactgtctggctacatcatcactgttctcagcccaaccttcctcctggccatagaatctctgtatgctcactacagaaaaaaataaaaaaatatctagagcatgaggacacagaaaggacttccagaatcccccacccagtggcaaccacttggacacatgactgc

SEQ ID NO: 86046 - DNA, 601 bp, Human
gggctaagaagactggagattactaatggtgcagctgaatcataaaactaccatgcttataggaaactcgtggctctggggtttaacgaaaggttttatatttttaatttgccagatcagggaagcagcagggtcttttttttttttttttttttttgagatggggtcttgttttgtcatccaggctggagtgcagtggtgtaattacaactcacagcagcctcgacctcctgggctcaggcatcctcctgcctcagccttccaagtagctgggactataggcctatgccaccacatctgrctattttttcttttttttggagggacagggtctccctgtgttccccaggctggtcttgaactcctaggcttaagtgatcctcctgcctcggcctccctaagtgctggaattataggcgtgaatcaccatgcctgacacagcagaacctttgagatatatttaagcaaggaggctggaataccgcctcatttgactccagggaaaatataactttttcccagagatgaaaataaagacaccagagcggggtccactcaaggatactgatgtgagccatcccctgcctccctatatcggctg

SEQ ID NO: 86047 - DNA, 601 bp, Human
gataagtcatggaagagtcagagaggagagaaaagaagagggaagggaggaagagggaagagaggatgatggagagaggaatcgagagatgagaggagatggagaggaaaagagaggaggaaagaagagaggaatgagtaaagaagaaaattgaaagaggtggcagagagatgggaggggctaagaagactggagattactaatggtgcagctgaatcataaaactaccatgcttataggaaactcgtggctctggggtttaacgaaaggttttatatttttaatttgccagatcagggamgcagcagggtcttttttttttttttttttttttgagatggggtcttgttttgtcatccaggctggagtgcagtggtgtaattacaactcacagcagcctcgacctcctgggctcaggcatcctcctgcctcagccttccaagtagctgggactataggcctatgccaccacatctggctattttttcttttttttggagggacagggtctccctgtgttccccaggctggtcttgaactcctaggcttaagtgatcctcctgcctcggcctccctaagtgctggaattataggcgtgaat

SEQ ID NO: 86048 - DNA, 601 bp, Human
ttcaaaacagagcctcccacaaaataatccaaaatttaaatgaattttttaaaaaaagcatagttgaaatggagataagtcatggaagagtcagagaggagagaaaagaagagggaagggaggaagagggaagagaggatgatggagagaggaatcgagagatgagaggagatggagaggaaaagagaggaggaaagaagagaggaatgagtaaagaagaaaattgaaagaggtggcagagagatgggaggggctaagaagactggagattactaatggtgcagctgaatcataaaactaycatgcttataggaaactcgtggctctggggtttaacgaaaggttttatatttttaatttgccagatcagggaagcagcagggtcttttttttttttttttttttttgagatggggtcttgttttgtcatccaggctggagtgcagtggtgtaattacaactcacagcagcctcgacctcctgggctcaggcatcctcctgcctcagccttccaagtagctgggactataggcctatgccaccacatctggctattttttcttttttttggagggacagggtctccctgtgttccccaggc

SEQ ID NO: 86049 - DNA, 601 bp, Human
ccactcactcctcactgaagaggtaggcacaatagctttctcactgcttagcaattatatcaagtaagagctgttggatggcatgagagaccacaagtagacacagaatggctatttggttggctggctgctcattttttgagcaaataaaataagcactaaattcaaaacagagcctcccacaaaataatccaaaatttaaatgaattttttaaaaaaagcatagttgaaatggagataagtcatggaagagtcagagaggagagaaaagaagagggaagggaggaagagggaagagagkatgatggagagaggaatcgagagatgagaggagatggagaggaaaagagaggaggaaagaagagaggaatgagtaaagaagaaaattgaaagaggtggcagagagatgggaggggctaagaagactggagattactaatggtgcagctgaatcataaaactaccatgcttataggaaactcgtggctctggggtttaacgaaaggttttatatttttaatttgccagatcagggaagcagcagggtcttttttttttttttttttttttgagatggggtcttgttttgtcatccaggctg

SEQ ID NO: 86050 - DNA, 601 bp, Human
atttggatttttggctcattgcagactaatgatgcacaagtggtctcattaatggtatgcatgtttgtttgtttgtttgtttgagacggaggctcgctctgtcacccaggctggagtgcagtggcaccatcttggctcactgcaacctccacctcctgggtcaagcaattcttctgcctcagcctcctgagtagctgggattacaggtgtgtgccaccacacccagctaattttatttttagtagagatggggtttcaccatgttagccaagctggtctcaaactcccaacctcatgatcyacccgtcttggcctcccaaagtgctggaattacaggcgtgagccaccgtgcccagccaatgtcacgcacagttttaagcaaaactatgtttcagtctcagctaaactatgtcattaccacgtcttctctgtctcccattgccgcttagagatcacaagatatgccaagatgggtctggcttttagagactctcattttgcagacccattcaagccatggatttagtgtagtgtcaagatgagaagcctaaacaacatagagaaagcccacgttcagccataacttcccactcactcctca

SEQ ID NO: 86051 - DNA, 601 bp, Human
cccataaactgtcattgtgcctcttgttcagaagaacaggttggggcttagagaggttaaatgactcatccgaggtcatatagcttgtcctcagagccagaattcgaatccaaagacatgttcttaagaaccatggcattcacctctccctaggacacacaagggctcaaatcgagcccatgaggcttctatcagctatctaccagttcatttggatttttggctcattgcagactaatgatgcacaagtggtctcattaatggtatgcatgtttgtttgtttgtttgtttgagacggagsctcgctctgtcacccaggctggagtgcagtggcaccatcttggctcactgcaacctccacctcctgggtcaagcaattcttctgcctcagcctcctgagtagctgggattacaggtgtgtgccaccacacccagctaattttatttttagtagagatggggtttcaccatgttagccaagctggtctcaaactcccaacctcatgatccacccgtcttggcctcccaaagtgctggaattacaggcgtgagccaccgtgcccagccaatgtcacgcacagttttaagcaaaactatgttt

SEQ ID NO: 86052 - DNA, 601 bp, Human
acatgggcaccattttacatacagagaaaacatcccaaaacattgcagtgatgacacatatttattaagcataaaccttaggccaggtacatcacacattatgccatttaatccaccccataaactgtcattgtgcctcttgttcagaagaacaggttggggcttagagaggttaaatgactcatccgaggtcatatagcttgtcctcagagccagaattcgaatccaaagacatgttcttaagaaccatggcattcacctctccctaggacacacaagggctcaaatcgagcccatgagscttctatcagctatctaccagttcatttggatttttggctcattgcagactaatgatgcacaagtggtctcattaatggtatgcatgtttgtttgtttgtttgtttgagacggaggctcgctctgtcacccaggctggagtgcagtggcaccatcttggctcactgcaacctccacctcctgggtcaagcaattcttctgcctcagcctcctgagtagctgggattacaggtgtgtgccaccacacccagctaattttatttttagtagagatggggtttcaccatgttagccaagctgg

SEQ ID NO: 86053 - DNA, 601 bp, Human
gacccttcgaagtgggtattataattacaactttatatgtgagaaaactaaggtttaagatttgattagtaacctggcacaaatcttaaaaccagtaagagaacacatcaggattcgaacaccaatatgagcccattttctactcttactgctgatgtgagtactaagtcctcattaactggtgatgaaagaaatagatgtgaaggaattaaaacaccaaaaagagccttggtatttcctctcatcttggttcaataacctcttgtgagaaaaaagttttcagtgcgtgtcgctataaatragcatgattggcttgccagttgaacctacaaacagaaataatgtgagaggtcacaagtccactcatttgcactggacttccaaagagttttgtcatgcagtgtctcagttaatcccccaatagctcagggaggtggacatgggcaccattttacatacagagaaaacatcccaaaacattgcagtgatgacacatatttattaagcataaaccttaggccaggtacatcacacattatgccatttaatccaccccataaactgtcattgtgcctcttgttcagaagaacaggttggggct

SEQ ID NO: 86054 - DNA, 601 bp, Human
aggtgtggtttttacaatgacccttcgaagtgggtattataattacaactttatatgtgagaaaactaaggtttaagatttgattagtaacctggcacaaatcttaaaaccagtaagagaacacatcaggattcgaacaccaatatgagcccattttctactcttactgctgatgtgagtactaagtcctcattaactggtgatgaaagaaatagatgtgaaggaattaaaacaccaaaaagagccttggtatttcctctcatcttggttcaataacctcttgtgagaaaaaagttttcastgcgtgtcgctataaatgagcatgattggcttgccagttgaacctacaaacagaaataatgtgagaggtcacaagtccactcatttgcactggacttccaaagagttttgtcatgcagtgtctcagttaatcccccaatagctcagggaggtggacatgggcaccattttacatacagagaaaacatcccaaaacattgcagtgatgacacatatttattaagcataaaccttaggccaggtacatcacacattatgccatttaatccaccccataaactgtcattgtgcctcttgttca

SEQ ID NO: 86055 - DNA, 601 bp, Human
gattaacacaggaatctaaaggagaaaatcctactaatcagggggatatagcttaactttcttgcttaaacaacccgagatgatcagccagacttcccaagcctgtaaaaagagggctctaccaatgagaaattaaccacctggtattgagatggtagattccgactgagtccactcaggctgatcttagaccgagttggcaacaaacaaaaagagggccacagctgcccccagtgttcagctgcattcccaagctagagaacgagacacttccaaatctgaaataactcatccaactgargcagggctctataaacaacagacaagtaaaatacattgaataaatattacataatctattttctttagtggttgtgtctgtatatatgtgggtacattcaggtgtggtttttacaatgacccttcgaagtgggtattataattacaactttatatgtgagaaaactaaggtttaagatttgattagtaacctggcacaaatcttaaaaccagtaagagaacacatcaggattcgaacaccaatatgagcccattttctactcttactgctgatgtgagtactaagtcctcattaactggt

SEQ ID NO: 86056 - DNA, 601 bp, Human
gcataatcagtatgactaccacacctggtattccaatgtctaccagggataaactgctcagtttgtagattaacacaggaatctaaaggagaaaatcctactaatcagggggatatagcttaactttcttgcttaaacaacccgagatgatcagccagacttcccaagcctgtaaaaagagggctctaccaatgagaaattaaccacctggtattgagatggtagattccgactgagtccactcaggctgatcttagaccgagttggcaacaaacaaaaagagggccacagctgcccccartgttcagctgcattcccaagctagagaacgagacacttccaaatctgaaataactcatccaactgaagcagggctctataaacaacagacaagtaaaatacattgaataaatattacataatctattttctttagtggttgtgtctgtatatatgtgggtacattcaggtgtggtttttacaatgacccttcgaagtgggtattataattacaactttatatgtgagaaaactaaggtttaagatttgattagtaacctggcacaaatcttaaaaccagtaagagaacacatcaggattc

SEQ ID NO: 86057 - DNA, 601 bp, Human
cctgtgcatgatgtcaccacttccccaaacttctccctctcacctccaagtttgtgctaaaccgcttaccaagcagcttcagactcattaacatctaatcagccctaattggctgcaattcagcagaagtcctttcagggggcaggtgactggcagaatccccagaagcaagcccacagcctttggagagcagtcactgggtgggtgggagagggaagaccacagctgggtcccctaagcagcctgtaccttcccagctctaaggcagccatgagacctaggtagtgaatgaatggactgstcaatgacggctctattcaacacatatttattgaacatctatgttgtgtcagactctgccctcctggaatccctcctggatggccctgtgaggggaatctactattgttcccattttatagcagaggaaaatgacgcccagaaaggtgaagggcttgcccaatatcccagcagctggtaagtgttggagccagaattctcacctcagcagtctaccgcagactccaagctcttcgccactcagtgaactgtgatacattcccccagttaccaatggtagactttgaaaaaggaaataaaa

SEQ ID NO: 86058 - DNA, 601 bp, Human
gttattatttcaatacgaggtgggagtttagtgcagcaggctgcagctgtgtgtgcaataaatatagaattagaattttccacattgagtttctgaaaaactaaggagaacatgaactctggattcaagagagtcatactagctatacgatacaaggttaattgttctgattctcagctgcaaaatgaggataaataatcatggtgccacctatgatgctgtaaggacaagataaaagtaagtacatataaagcaccaagcatagtgcttggcccatgttaagagctcaataaaaagcatkattttactataattatgatcatcattattatcattgctactcccctgccaggtttagcaggggtcctacctgtaccagctccaacataaagagccacaggacagtctggacagacaactgagatgctgtacgtcttggtcaggcccttgcacttctccagcctgtgcatgatgtcaccacttccccaaacttctccctctcacctccaagtttgtgctaaaccgcttaccaagcagcttcagactcattaacatctaatcagccctaattggctgcaattcagcagaagtcctttcaggg

SEQ ID NO: 86059 - DNA, 601 bp, Human
ccaagatgttcagaagtcaattgcataaaaaaccacctttcacaatgtagatgatcaataaatataaaagggagttctgcacgttattatttcaatacgaggtgggagtttagtgcagcaggctgcagctgtgtgtgcaataaatatagaattagaattttccacattgagtttctgaaaaactaaggagaacatgaactctggattcaagagagtcatactagctatacgatacaaggttaattgttctgattctcagctgcaaaatgaggataaataatcatggtgccacctatgatgytgtaaggacaagataaaagtaagtacatataaagcaccaagcatagtgcttggcccatgttaagagctcaataaaaagcattattttactataattatgatcatcattattatcattgctactcccctgccaggtttagcaggggtcctacctgtaccagctccaacataaagagccacaggacagtctggacagacaactgagatgctgtacgtcttggtcaggcccttgcacttctccagcctgtgcatgatgtcaccacttccccaaacttctccctctcacctccaagtttgtgct

SEQ ID NO: 86060 - DNA, 601 bp, Human
gtagatatgttgaccaaagggtaccaactctccattataaggtgaatgaataagttctgaggatggtgactacagttagtaatatcatactatacacttgaaatttgtgaagcgattagatcttaattatactcacaccacatacacagacacccaaaatggtaaccaacagtcgtgaaagatgtgttaattaattcgatggtggtaatcatttcacagtctacacactcatcaaaacatcacattgtacaccttgaatacaaaccactttatttgtcagttaaacctcaataaagctggraggaaaaaaacagtataccaaagaaatgaaaagatgggccaggtgcagtggctcacgcctgtaatcccagcactttgggaggctgagatgggtggatgacgaggtcaggagttcaagaccagcctggccaacctggtaaaaccccatctctactaaaaatacaaaattagcagggcatggggcgtggggcaggtgcctgtagtcccagctacttgagaggctcattgaaactctttgggctcagtttcttcatctggagaatgggaattctcatacctaacctacattatttttccatta

SEQ ID NO: 86061 - DNA, 601 bp, Human
agtgatcctggattcatcttacactgacttcctggctgacttagaaatggccataatgtagatatgttgaccaaagggtaccaactctccattataaggtgaatgaataagttctgaggatggtgactacagttagtaatatcatactatacacttgaaatttgtgaagcgattagatcttaattatactcacaccacatacacagacacccaaaatggtaaccaacagtcgtgaaagatgtgttaattaattcgatggtggtaatcatttcacagtctacacactcatcaaaacatcacwttgtacaccttgaatacaaaccactttatttgtcagttaaacctcaataaagctgggaggaaaaaaacagtataccaaagaaatgaaaagatgggccaggtgcagtggctcacgcctgtaatcccagcactttgggaggctgagatgggtggatgacgaggtcaggagttcaagaccagcctggccaacctggtaaaaccccatctctactaaaaatacaaaattagcagggcatggggcgtggggcaggtgcctgtagtcccagctacttgagaggctcattgaaactctttgggctca

SEQ ID NO: 86062 - DNA, 601 bp, Human
agctcagcgagggttcaggactaccggagtcagaaggagtgatcctggattcatcttacactgacttcctggctgacttagaaatggccataatgtagatatgttgaccaaagggtaccaactctccattataaggtgaatgaataagttctgaggatggtgactacagttagtaatatcatactatacacttgaaatttgtgaagcgattagatcttaattatactcacaccacatacacagacacccaaaatggtaaccaacagtcgtgaaagatgtgttaattaattcgatggtggtratcatttcacagtctacacactcatcaaaacatcacattgtacaccttgaatacaaaccactttatttgtcagttaaacctcaataaagctgggaggaaaaaaacagtataccaaagaaatgaaaagatgggccaggtgcagtggctcacgcctgtaatcccagcactttgggaggctgagatgggtggatgacgaggtcaggagttcaagaccagcctggccaacctggtaaaaccccatctctactaaaaatacaaaattagcagggcatggggcgtggggcaggtgcctgtagtccc

SEQ ID NO: 86063 - DNA, 601 bp, Human
aaatgctttcttctaagattgcagccaggtctgtgtcagctcagcgagggttcaggactaccggagtcagaaggagtgatcctggattcatcttacactgacttcctggctgacttagaaatggccataatgtagatatgttgaccaaagggtaccaactctccattataaggtgaatgaataagttctgaggatggtgactacagttagtaatatcatactatacacttgaaatttgtgaagcgattagatcttaattatactcacaccacatacacagacacccaaaatggtaaccaayagtcgtgaaagatgtgttaattaattcgatggtggtaatcatttcacagtctacacactcatcaaaacatcacattgtacaccttgaatacaaaccactttatttgtcagttaaacctcaataaagctgggaggaaaaaaacagtataccaaagaaatgaaaagatgggccaggtgcagtggctcacgcctgtaatcccagcactttgggaggctgagatgggtggatgacgaggtcaggagttcaagaccagcctggccaacctggtaaaaccccatctctactaaaaatacaaaatta

SEQ ID NO: 86064 - DNA, 601 bp, Human
cctctttactactcatttgtttggcaaatgctttcttctaagattgcagccaggtctgtgtcagctcagcgagggttcaggactaccggagtcagaaggagtgatcctggattcatcttacactgacttcctggctgacttagaaatggccataatgtagatatgttgaccaaagggtaccaactctccattataaggtgaatgaataagttctgaggatggtgactacagttagtaatatcatactatacacttgaaatttgtgaagcgattagatcttaattatactcacaccacatayacagacacccaaaatggtaaccaacagtcgtgaaagatgtgttaattaattcgatggtggtaatcatttcacagtctacacactcatcaaaacatcacattgtacaccttgaatacaaaccactttatttgtcagttaaacctcaataaagctgggaggaaaaaaacagtataccaaagaaatgaaaagatgggccaggtgcagtggctcacgcctgtaatcccagcactttgggaggctgagatgggtggatgacgaggtcaggagttcaagaccagcctggccaacctggtaaaaccc

SEQ ID NO: 86065 - DNA, 601 bp, Human
agtataaggataaaataagatataaacatttgacacagtgtctggcatgtgacaagcatttgatacatgaaagctactgtttatcattgttttataattatcactattattaagttgtaaaaattagaattagattatgcatggaaagcatctatcaccgtctggcatacagcagaggcacaataaatggaagatattgtcacaaggatagcaaggaggaaatgtttaatctgtaaggatttcaaagagggaagctaaaattgtatttctaagcagaaatttgtggacccattttaatgamaagataaaacacatttctagttagcagcattccttgtacataaacaatttatctacccaaggctagaaaacggtatgccctcaagtagattaaatcaaccctgccgggtacccccaatgcctctttactactcatttgtttggcaaatgctttcttctaagattgcagccaggtctgtgtcagctcagcgagggttcaggactaccggagtcagaaggagtgatcctggattcatcttacactgacttcctggctgacttagaaatggccataatgtagatatgttgaccaaagggtacc

SEQ ID NO: 86066 - DNA, 601 bp, Human
tcacctcactgctaacacttcattagtaaaataaggacactaacagtaccttcatgtgtggcgagtataaggataaaataagatataaacatttgacacagtgtctggcatgtgacaagcatttgatacatgaaagctactgtttatcattgttttataattatcactattattaagttgtaaaaattagaattagattatgcatggaaagcatctatcaccgtctggcatacagcagaggcacaataaatggaagatattgtcacaaggatagcaaggaggaaatgtttaatctgtaagsatttcaaagagggaagctaaaattgtatttctaagcagaaatttgtggacccattttaatgaaaagataaaacacatttctagttagcagcattccttgtacataaacaatttatctacccaaggctagaaaacggtatgccctcaagtagattaaatcaaccctgccgggtacccccaatgcctctttactactcatttgtttggcaaatgctttcttctaagattgcagccaggtctgtgtcagctcagcgagggttcaggactaccggagtcagaaggagtgatcctggattcatct

SEQ ID NO: 86067 - DNA, 601 bp, Human
cctcagttgccccattaataaaaagagggaagtcacctcactgctaacacttcattagtaaaataaggacactaacagtaccttcatgtgtggcgagtataaggataaaataagatataaacatttgacacagtgtctggcatgtgacaagcatttgatacatgaaagctactgtttatcattgttttataattatcactattattaagttgtaaaaattagaattagattatgcatggaaagcatctatcaccgtctggcatacagcagaggcacaataaatggaagatattgtcacaakgatagcaaggaggaaatgtttaatctgtaaggatttcaaagagggaagctaaaattgtatttctaagcagaaatttgtggacccattttaatgaaaagataaaacacatttctagttagcagcattccttgtacataaacaatttatctacccaaggctagaaaacggtatgccctcaagtagattaaatcaaccctgccgggtacccccaatgcctctttactactcatttgtttggcaaatgctttcttctaagattgcagccaggtctgtgtcagctcagcgagggttcaggactac

SEQ ID NO: 86068 - DNA, 601 bp, Human
cccaacgtaagtttgtgaccttgagcaaattgcaggatctgtctgtgcctcagttgccccattaataaaaagagggaagtcacctcactgctaacacttcattagtaaaataaggacactaacagtaccttcatgtgtggcgagtataaggataaaataagatataaacatttgacacagtgtctggcatgtgacaagcatttgatacatgaaagctactgtttatcattgttttataattatcactattattaagttgtaaaaattagaattagattatgcatggaaagcatctatcacmgtctggcatacagcagaggcacaataaatggaagatattgtcacaaggatagcaaggaggaaatgtttaatctgtaaggatttcaaagagggaagctaaaattgtatttctaagcagaaatttgtggacccattttaatgaaaagataaaacacatttctagttagcagcattccttgtacataaacaatttatctacccaaggctagaaaacggtatgccctcaagtagattaaatcaaccctgccgggtacccccaatgcctctttactactcatttgtttggcaaatgctttcttct

SEQ ID NO: 86069 - DNA, 601 bp, Human
acgttgctctgattctctaggtcccagaatctctgagttgcagacaccttggaaatcctcattgtcataagcaagaatgccccagagttacagctccaccttcccaatctgagcactggctgtggcctgccttcagtgactttggaccatgccagcagctcagaccccactttttctcccaagttcccccaaacctcaagaaaaaatattttttttggaaaacgtgtttttaacaatgatcatccatttcccaataagtccaaggaagtgttgatctccaaaaaaaaaaaaaactgaatcycaacgtaagtttgtgaccttgagcaaattgcaggatctgtctgtgcctcagttgccccattaataaaaagagggaagtcacctcactgctaacacttcattagtaaaataaggacactaacagtaccttcatgtgtggcgagtataaggataaaataagatataaacatttgacacagtgtctggcatgtgacaagcatttgatacatgaaagctactgtttatcattgttttataattatcactattattaagttgtaaaaattagaattagattatgcatggaaagcatctatcaccg

SEQ ID NO: 86070 - DNA, 601 bp, Human
gaaaactcatctcccaacccgacgttgctctgattctctaggtcccagaatctctgagttgcagacaccttggaaatcctcattgtcataagcaagaatgccccagagttacagctccaccttcccaatctgagcactggctgtggcctgccttcagtgactttggaccatgccagcagctcagaccccactttttctcccaagttcccccaaacctcaagaaaaaatattttttttggaaaacgtgtttttaacaatgatcatccatttcccaataagtccaaggaagtgttgatctccaaaaaaaaaaaaaactgaatcccaacgtaagtttgtgaccttgagcaaattgcaggatctgtctgtgcctcagttgccccattaataaaaagagggaagtcacctcactgctaacacttcattagtaaaataaggacactaacagtaccttcatgtgtggcgagtataaggataaaataagatataaacatttgacacagtgtctggcatgtgacaagcatttgatacatgaaagctactgtttatcattgttttataattatcactattattaagttgtaaaaattagaattagattatg

SEQ ID NO: 86071 - DNA, 601 bp, Human
gggggtgtggctctcagctcaattctagcctgaccttcttatagatggctgagagaaccctagaggctatttcacgctgtcaacactaatgatacttctgctgagagaggggtgaacctctggtccacctattgctgatgctgcacgagggaaactctatccagggaggtgattgtcctggtgccacggcactcacagctgggcatgcctgcactgccagtcaccccccacacaccgtgcaccccagctccgctttcaccatgaagatgagcaggaaagaaaactcatctcccaacccgasgttgctctgattctctaggtcccagaatctctgagttgcagacaccttggaaatcctcattgtcataagcaagaatgccccagagttacagctccaccttcccaatctgagcactggctgtggcctgccttcagtgactttggaccatgccagcagctcagaccccactttttctcccaagttcccccaaacctcaagaaaaaatattttttttggaaaacgtgtttttaacaatgatcatccatttcccaataagtccaaggaagtgttgatctccaaaaaaaaaaaaaactgaatccc

SEQ ID NO: 86072 - DNA, 601 bp, Human
tgcagttgatgtgacagaagcccctggagaagagttcaccaaaacgtgaaaggggagtccagcagctgcgtgctaagggggtgtggctctcagctcaattctagcctgaccttcttatagatggctgagagaaccctagaggctatttcacgctgtcaacactaatgatacttctgctgagagaggggtgaacctctggtccacctattgctgatgctgcacgagggaaactctatccagggaggtgattgtcctggtgccacggcactcacagctgggcatgcctgcactgccagtcacyccccacacaccgtgcaccccagctccgctttcaccatgaagatgagcaggaaagaaaactcatctcccaacccgacgttgctctgattctctaggtcccagaatctctgagttgcagacaccttggaaatcctcattgtcataagcaagaatgccccagagttacagctccaccttcccaatctgagcactggctgtggcctgccttcagtgactttggaccatgccagcagctcagaccccactttttctcccaagttcccccaaacctcaagaaaaaatattttttttggaaaacgtg

SEQ ID NO: 86073 - DNA, 601 bp, Human
tacttttacatttagaagaatcaaatgatatgacttttttaaagagatgagttattaaaaggagacgtgatcagaagacatttagcttcgtttaggaggcaaagcagatgcacgtgggccatttcaaatagaaaaccataagactgtatgtgaaaaaggaccctaagatgaaacagtggtgggtgttataagaattctgatctcagtaaggtaagaggaggctggtgttttccagaaacagaagagaagaaggtggggtttctgtgctagcaccagaagacacaaactggaggcagcaatmccactgcagttgatgtgacagaagcccctggagaagagttcaccaaaacgtgaaaggggagtccagcagctgcgtgctaagggggtgtggctctcagctcaattctagcctgaccttcttatagatggctgagagaaccctagaggctatttcacgctgtcaacactaatgatacttctgctgagagaggggtgaacctctggtccacctattgctgatgctgcacgagggaaactctatccagggaggtgattgtcctggtgccacggcactcacagctgggcatgcctgcactgccag

SEQ ID NO: 86074 - DNA, 601 bp, Human
ctcctcttccttgtcctggccctgatacgtggctttccaattttctacgatgagagtagttacttttacatttagaagaatcaaatgatatgacttttttaaagagatgagttattaaaaggagacgtgatcagaagacatttagcttcgtttaggaggcaaagcagatgcacgtgggccatttcaaatagaaaaccataagactgtatgtgaaaaaggaccctaagatgaaacagtggtgggtgttataagaattctgatctcagtaaggtaagaggaggctggtgttttccagaaacakaagagaagaaggtggggtttctgtgctagcaccagaagacacaaactggaggcagcaatcccactgcagttgatgtgacagaagcccctggagaagagttcaccaaaacgtgaaaggggagtccagcagctgcgtgctaagggggtgtggctctcagctcaattctagcctgaccttcttatagatggctgagagaaccctagaggctatttcacgctgtcaacactaatgatacttctgctgagagaggggtgaacctctggtccacctattgctgatgctgcacgagggaaactctat

SEQ ID NO: 86075 - DNA, 601 bp, Human
tgtacttgcccaaccttagtctcagccctgctggatcctctattattatgttaatcatggaattcttggcattaatttctattctctaaaatattgcactgaaatggtatttaccttgataacttaattgtttggcacccttttaaattttgcatccaaggagggattcttaatctcctcttccttgtcctggccctgatacgtggctttccaattttctacgatgagagtagttacttttacatttagaagaatcaaatgatatgacttttttaaagagatgagttattaaaaggagacrtgatcagaagacatttagcttcgtttaggaggcaaagcagatgcacgtgggccatttcaaatagaaaaccataagactgtatgtgaaaaaggaccctaagatgaaacagtggtgggtgttataagaattctgatctcagtaaggtaagaggaggctggtgttttccagaaacagaagagaagaaggtggggtttctgtgctagcaccagaagacacaaactggaggcagcaatcccactgcagttgatgtgacagaagcccctggagaagagttcaccaaaacgtgaaaggggagtccag

SEQ ID NO: 86076 - DNA, 601 bp, Human
ggtgataaatgactcatcagtcaagataagtaatattttaatatgatatttttacaaataaaaaccaatgcaaaaaaaatgatgcaaaacaaatcaaaatttgaaataaagacaagatccgactgtacttgcccaaccttagtctcagccctgctggatcctctattattatgttaatcatggaattcttggcattaatttctattctctaaaatattgcactgaaatggtatttaccttgataacttaattgtttggcacccttttaaattttgcatccaaggagggattcttaatctcytcttccttgtcctggccctgatacgtggctttccaattttctacgatgagagtagttacttttacatttagaagaatcaaatgatatgacttttttaaagagatgagttattaaaaggagacgtgatcagaagacatttagcttcgtttaggaggcaaagcagatgcacgtgggccatttcaaatagaaaaccataagactgtatgtgaaaaaggaccctaagatgaaacagtggtgggtgttataagaattctgatctcagtaaggtaagaggaggctggtgttttccagaaacagaag

SEQ ID NO: 86077 - DNA, 601 bp, Human
tttctgtcctctgaagagcatgctgctactggggcaaatgagtttgagtccagagccgacaatgagcaggtgatcaagccccaagtgaaatggcctacaagcccctcatcttctgaccacaaaaacaccataggaacatagagacactgccatttttttaaaaggaaccttatgaggaatacagacaaagaaacagataatcattacacattaagataatcattacacgattaatagataatcattacacgttgttaagtgctacaatggcagcatgatagggcacttgatgagtcttggkggggcggcagtcagagaagactacctgggggctggggatcatgaaagaaggcaggaggggaaatcatttctgcacaggttacagtagactgagtgcatgttctagagccaaacagccttggttgcatcttggtttgttcggcttatttcgagctatgttaattgcaagtcactactctctgagggtctctaagtgctctgagaaatatgaacagtaacagttcccagctattgtgagttgttgtgggggttgtacaaaagaacaagcataacataagaaaagcataagaatgagcctgag

SEQ ID NO: 86078 - DNA, 601 bp, Human
tctcttacctgctctctgggcctcccagcctggactcgcacaagggcaccatcccactacccctcatacttccaatcagtgcagaccagagccaccccaaccccactatcatcactcacatgagcagcaggatggagctggcacagaagacaagcctcctacacctcctctgccaaatcttcaaatatcatcagtcacactggaaaatggccccaggccactgctgcttaatgggccatgatggatgaacacagatctagagaaatgattgtttaccaactaagggatcagagcctatggscctctttctgtcctctgaagagcatgctgctactggggcaaatgagtttgagtccagagccgacaatgagcaggtgatcaagccccaagtgaaatggcctacaagcccctcatcttctgaccacaaaaacaccataggaacatagagacactgccatttttttaaaaggaaccttatgaggaatacagacaaagaaacagataatcattacacattaagataatcattacacgattaatagataatcattacacgttgttaagtgctacaatggcagcatgatagggcacttgatgagtc

SEQ ID NO: 86079 - DNA, 601 bp, Human
gtggtaggcatggcctgagcacgggaaacccagggtaatgtaagaggcgcagagaagaggccccctaattcagcctgcaatggtgcagtggagtgggggacagtcaggaaagacactttggatacctgagcgttgtttggtttcccatgtagcctgtggacttctcatggtacatgtttcatctgtcaccccatccaacaatcagcacacagctcaaacaagatggggtcagatctccacttcatacacactggatttccacacatgcatgggaaagaaaagaaggactattgccccacarattcactgcatctagtattgctaaggggctgcagcctcttgccaaccacagacccatctcagtggacaatgcaaagggtagcattaaatcatgagctttgtgagggcagggagccctgtgcctcctatctggcatagcatcccacacctggtgggtgcctagtaattgtccataggataaatggataacaacggagagacgaagaatttattgtagttgtgtttttgcaatagtttctctcccccactgggtgattattcatgcactgcttctccacattagggcaaagtgagctcacat

SEQ ID NO: 86080 - DNA, 601 bp, Human
agctctttgggaggtcgaggtgggaggatcacctgaggtcagcctggccaacatgataaaaccccgtctctactaaaaatacaaaaattggttgggtgtgatggcaagtgcctgtaatctcagctactcaggaggctgagacaggagaattgcttgaacccaggaggtgaaggttgcagtgagccaagatcatgccattgcactccagcctgggtgacaagagtgaaactccatctcaaaaaaaaaaaaaaaaaaaaaagtggtaggcatggcctgagcacgggaaacccagggtaatgtragaggcgcagagaagaggccccctaattcagcctgcaatggtgcagtggagtgggggacagtcaggaaagacactttggatacctgagcgttgtttggtttcccatgtagcctgtggacttctcatggtacatgtttcatctgtcaccccatccaacaatcagcacacagctcaaacaagatggggtcagatctccacttcatacacactggatttccacacatgcatgggaaagaaaagaaggactattgccccacagattcactgcatctagtattgctaaggggctgcagcctcttg

SEQ ID NO: 86081 - DNA, 601 bp, Human
atggcaaaagggactttgcagatgtgattaaggtaaagatcttgagatggggagaaaggacatttgaaagtagagtctgagaaagatatttgaagatgccctggtgctgccttggaagatgaggaaggggccttgagccaaggaaatcaggcaaggaaaaagcagcttcttcccctagagcctccagaaagagttcagccctactaacaccttgattttagctccatgagacccatttcagctttctgacctgcagaactgtaggataataaatttgtattattttaagccagtaagtttrcggtaatttatttcagcaataggcaactaatacaccatgtatcaactgcaaacaattgttgcagttctagaaagctggcccaatttaccagttcttgggtgggaggcggtagaggagcagaaaagataacttttgagtactgagattaatacctgggagaggaaataatctgtacaacaaaccccagtgacacgtgtttacctatgtaacaaaccttcgcatgtacccccaaacctaaaataaaagtttcaaaaatctggattttaaaaagagatccatccctagatattttcgtgaata

SEQ ID NO: 86082 - DNA, 601 bp, Human
attagttaggatcccagtccaatcagtgatacttggaaatgattttggctttttttgtaagctacagcacattcaaggtcatttctataataacatcattcttactcatttacaatctgaaatgttttcttgagtgggagcgaaatggaaaaagtttttaatgtgttatgctttgtcttacatattctttaatcctgtacagaacagagcacagattcaatgttgaattgaactgattatgtgacatcctgcaaacaataaaagcatcacttttaaagaacttaaagttccttctcacacmttttatacctgatctccagcccctcaaagggttgtattaatgcatttaaccctcatatgctaaatttcatttctaattataggataaccacaggaaaaatggttatccagaccagccctttaactcaagaatcacaaatgcaacatctagcatggagaagcaggtaaagaaaataatgtaaaccttgttcaatcgattctaaaagggtggccatgtgggacaggcagaacaatggcccccaaaggtgtccatgtcctaatccctggaacctgtgaatatgttaccttacatggcaaaagg

SEQ ID NO: 86083 - DNA, 601 bp, Human
agtgggaatctgctttgtggcgggatgacgttcaccaagcatcgttcagggctggttcaccatgatgcctgtccaaacccctgagcacctagtgtctgtaccacacatgtaagtacttaatcacatgctacaccaagctgctcatagtttcaccctataactcttgtctctgcagacagacaaaagcttttctggaggctggagaccatagcatagataagaggtcctcaaaactaatggatcatgagcagctgtgaggtgtgatgcactaattagttaggatcccagtccaatcagtgawacttggaaatgattttggctttttttgtaagctacagcacattcaaggtcatttctataataacatcattcttactcatttacaatctgaaatgttttcttgagtgggagcgaaatggaaaaagtttttaatgtgttatgctttgtcttacatattctttaatcctgtacagaacagagcacagattcaatgttgaattgaactgattatgtgacatcctgcaaacaataaaagcatcacttttaaagaacttaaagttccttctcacaccttttatacctgatctccagcccctcaaag

SEQ ID NO: 86084 - DNA, 601 bp, Human
tcccagggccaaggcgggacccaaatcaaccactcattctccaaacatttccaacacaggaggaaaaacacaaggtcagggccgattcactgactgctgtgtgctgaagtaactgcctgtcagatcctccttcatggatccctagagaggctctccttattcattgcagatgcacgctttttgcagagcacccttgaaacatgctaattaattatttttttttaatctaagttacccagtgttggtttcatctacctgctgccctactgcagaatcagaaagtgggaatctgctttgtggygggatgacgttcaccaagcatcgttcagggctggttcaccatgatgcctgtccaaacccctgagcacctagtgtctgtaccacacatgtaagtacttaatcacatgctacaccaagctgctcatagtttcaccctataactcttgtctctgcagacagacaaaagcttttctggaggctggagaccatagcatagataagaggtcctcaaaactaatggatcatgagcagctgtgaggtgtgatgcactaattagttaggatcccagtccaatcagtgatacttggaaatgattttggct

SEQ ID NO: 86085 - DNA, 601 bp, Human
atatttagtaaggtgctaaggtacctgtgggattgcctgagttgtgactcttaagacattgcaagtaaaaagttacaactgacatcagcatccaaccattcttctgtaagtagcaatattctatttccttttgccttggtgggtccatcagtctacgtgtctactctcccagggccaaggcgggacccaaatcaaccactcattctccaaacatttccaacacaggaggaaaaacacaaggtcagggccgattcactgactgctgtgtgctgaagtaactgcctgtcagatcctccttcayggatccctagagaggctctccttattcattgcagatgcacgctttttgcagagcacccttgaaacatgctaattaattatttttttttaatctaagttacccagtgttggtttcatctacctgctgccctactgcagaatcagaaagtgggaatctgctttgtggcgggatgacgttcaccaagcatcgttcagggctggttcaccatgatgcctgtccaaacccctgagcacctagtgtctgtaccacacatgtaagtacttaatcacatgctacaccaagctgctcatagtttcaccc

SEQ ID NO: 86086 - DNA, 601 bp, Human
agtgaggagcaaggcccaaagaaacaagcacgactgtgaattctgtttgaattcctgctttctactccctagtactgtgccctcaggcacatagatgaacatctcagttcctttctcctttctgataagggtagagaacagcaaggcctacctggttctttccttattttattattatcaagctgttcatttcagcacatatatctagcttttactttgtacactaatacaagaagaatcctcacctaggtgagtttccacagccttatttttcttagtcctccagagttttcaagagaaycttattccacagacaggaaaaataactaatgggtactaggcttaatacctgggtgctgaaataatctgtactacaaacccttgggatatcagtttacctgtataacaaacttgcacatgaaccctcgaacttaatataaaagttttaaaaggataacatttggaacctggagagcattagcaatagtacctacctgtaaaaatgttgtaaaattaaataagatcatgtataggaactgtttaatatacttcatagtactttataggtacttcataggttcataaatgcttcccaccgtta

SEQ ID NO: 86087 - DNA, 601 bp, Human
ctgtaatagagtatgcgccactcgaaaccataagtgcccttttatttgtgattcggctcaattcccaaggacggcacaacccctagactcagaccaggaaaggcagtggtaacaaacagggagacctgggcaggatgggggttgcaatagagtctgtgcctgagctcacctgggcacccaccccacatgttcctcaagggtcttgcttgcagggagctcagtgatataagcacagattgcaaaactaagccttccctttatcaccctcagtgttcccagtgccttgctcaaatgagaaagaaaaaaaaaaaatcaacctgccaatctggtctttcctgcagtaaatgaaaactagctctgttcctgcatagaacagaagagtccaggcagctaagtcacatgaccggagacaaaccaggcagaaagaagtcacgtgggaccacaatgaacaagaggcagagacaggccggatgatggccaaatgcacaatgaaactggaactgaggttcctaaagatgctggcacagcgttgcacagtcacttgtcttgggccagaccaaagcacagtcccctctactctacgagtgaggagcaaggccca

SEQ ID NO: 86088 - DNA, 601 bp, Human
atgtgggtattgcctattcaaaacaaataaatatttttaaaaatgtaatcatagaaacacaatagagttgacacacagagaggtagaaggtaggtaaggatgaagtgaggattaggagctaagaagaggtgaattttttcaatgcaaaagtaggcaggtgagagcgacatactgtaatagagtatgcgccactcgaaaccataagtgcccttttatttgtgattcggctcaattcccaaggacggcacaacccctagactcagaccaggaaaggcagtggtaacaaacagggagacctggrcaggatgggggttgcaatagagtctgtgcctgagctcacctgggcacccaccccacatgttcctcaagggtcttgcttgcagggagctcagtgatataagcacagattgcaaaactaagccttccctttatcaccctcagtgttcccagtgccttgctcaaatgagaaagaaaaaaaaaaaatcaacctgccaatctggtctttcctgcagtaaatgaaaactagctctgttcctgcatagaacagaagagtccaggcagctaagtcacatgaccggagacaaaccaggcagaaagaagt

SEQ ID NO: 86089 - DNA, 601 bp, Human
ataaaaagtagtatatttatttgttgggtctttttggtgccagacattggagatttagcagtaaacaaaacaagccctggctccatttagcttacactctgatggagagagacaggcaatacactaatacagatgaaaatacgttatatgtcaagtgctgataaagtcccgtatttatgctggaatttgggtgaatcatgtcaatttgctggtaagtgaccactttgatccataaagaaggtgattttgaaaggcttagccaaatacatactcagacaaaatgatgtacaagaaacagcarttcctccaggaaggaagcttagaagaaaaaatacttgctagacacatacagatgctgatttaatttttgtaatcccatgtgggtattgcctattcaaaacaaataaatatttttaaaaatgtaatcatagaaacacaatagagttgacacacagagaggtagaaggtaggtaaggatgaagtgaggattaggagctaagaagaggtgaattttttcaatgcaaaagtaggcaggtgagagcgacatactgtaatagagtatgcgccactcgaaaccataagtgcccttttatttgtgatt

SEQ ID NO: 86090 - DNA, 601 bp, Human
agggtacattttcaccatggatgcacattccatgcaactgttagaaaacaaaactgatttacaggtaccaacaaataataatttgaaaaacatggcagtaaatgaagaaagcaaggtgtagaacagagcacagagttggctaccatttgtgaataaaaagtagtatatttatttgttgggtctttttggtgccagacattggagatttagcagtaaacaaaacaagccctggctccatttagcttacactctgatggagagagacaggcaatacactaatacagatgaaaatacgttataygtcaagtgctgataaagtcccgtatttatgctggaatttgggtgaatcatgtcaatttgctggtaagtgaccactttgatccataaagaaggtgattttgaaaggcttagccaaatacatactcagacaaaatgatgtacaagaaacagcaattcctccaggaaggaagcttagaagaaaaaatacttgctagacacatacagatgctgatttaatttttgtaatcccatgtgggtattgcctattcaaaacaaataaatatttttaaaaatgtaatcatagaaacacaatagagttgac

SEQ ID NO: 86091 - DNA, 601 bp, Human
actgcaatgaaatcgtctcaggcaaaggtgcatgcacccagatttttaaacccagtttttttacaatgcaacttcaacatctgcatcaataaataaaccacgtgaacaaccaaaacgacttttttagacagtgagaagagctgtgtgcaagacaaaatgggccatgagatagagagtgctaagggggagcggtcaaggaggatctatcactcctaaagagatgacattctggctgtggctagaagaacccaatcatgtaaatttcattttatttcttaaaaaatgttatgggtacatagtrggtgtatatatttatggagtacatgagatattttggtacaggcatttaatgcataataatcgcatcagggtaaaatgaggtttccatcacctcaagcattcatcatttctttcaacgttcctattgtactccctcagttattctaaaatgtacgacaaattattgctgactacagtcaccctgttatgctatcaaacactagatcttacgcattccatcttaactatattttttacccattaaccctccctatttcccagcaccctctctcacaactacccttcccagactctagtaacc

SEQ ID NO: 86092 - DNA, 601 bp, Human
aagcaaagacactgagctatgagtaagaggaataagtgcttgagaaagactgtgggttccacagacttgttggttctcccactgattttggtcaagttatttcaggtaatggatcatgcagtcacacgtccgcattgcctcacctgctctattttactgtgtctctcctgggaagaaatcttggaaaagggtaagaaggttgtttactgtcctggttccctgtgtgtgctgcctctcactattacccatgaaagggaatcaaaagggggctgggaaagtttcacggagagggttgagaacwcacaaataaagaggacaattaggcccggcatggtggctcacacctgtaatcccagcattttgggaggctgaggcgggcacatcacgaagtcaggagtttgagaccagcctggccaatatggtgaaaccccatctctactaaaaatacaaaaatcagctgggcatgatggtgcgcacctgtagtcccagctactcaggaggctgaggcaggagaatcgcttgaacccgggaggcagaggttacagtgagccgagatcacaccactgcactccagcctgggtgacagagcgagactccatct

SEQ ID NO: 86093 - DNA, 601 bp, Human
aaccaagaacagaggagaagaaatggcaccaatattggaaccatgaagtcctgggtttaaattgtggctctattatctactacctgggtgcatctatcaggtaggattcacctggttgcaagtgacagaaaattcaaaccatcttaaacaatagagatacataagcttctgtgactggaatgaccagtggcaaagatggcttcaggagttttcaagtcagtagaccaatgatgtcatcaagattttgctccttccaactctctgccctacataccctctgctgaaactatcttatggctgrtgccccatcgtgaacacaacatgggaacctgccaacattccacaagtgcttccatgcatgctcttgtatctttagaaggttctcagaagccctccaataaaatctcccatctcatcgttcttaactatgattcatgctaatcaatgagccagtcaccatggccagtgaatcagaattgcatggattggcttaagcctgagtcacatggcctgcttttaccaaaggacatgaaattcatggggtaggcacggatatccaacgggaaattatggcagttaccataagaaaaaagagcaaatt

SEQ ID NO: 86094 - DNA, 601 bp, Human
accagtgggccacttgttggaagtcctaagcagtgagttatgttctaaagcactattaatagtctatagagtcctttaaggtactttagcatggaataagggaggaaacagaggagagagaacagtgttctgggtaccttggcctaccggatctacactgatttcattgtattaaggaagacaaaaaaacaaagattcttccctatccatcatgcttctttggttttggacagcaccttgtaaatatcattttcctctttctcctttttcttctcttccgctgctgtcttcatttatttayttttctatttctccagaaatgggtgcaatactgcatatcttcagcttcttcagttttgtactcccattactttggtcctagtcttggttatactcaaagggcagatttcacaaatgaactctagactcctcctgggcccaggaagtttgtcctgcttaccatggccataatctgtaggcaatgactctccatccctgagacccattaatttaactaggatgataaacagaaaaataaataaaggtgttgtgatatggggaagaaaagcagcatactgaggtcagcctaccttacccgtgg

SEQ ID NO: 86095 - DNA, 601 bp, Human
tttgcctttccaggttccagggagttcctgcattcctcccctgagcaccctcattattccacctctgtttcctctaccttcactatacatctcctcctctgactctctccctcctgcctcctttcttcccttataaggacccagtattattacactgggttgacctgaatagtccaggataatctccccatttcaagagccttaacttaatcacagttgtaaaatctcttttgccaaattaggcaacacatccactggttccaagcattagggcatggacacatttggtgagtccttctcstaccacatgtgaagaacatgcatgtgttaaccactgcggctatttctacactactcctactattacagagaaagaaagtttttttttctcctcctaaaaggaaaataagtagcagtcatgtctcagctatcaagagaaagggtaaaaacctataccctcattccttgaaattcctctaaaattacttaatatattgcttttcttccaccagtgggccacttgttggaagtcctaagcagtgagttatgttctaaagcactattaatagtctatagagtcctttaaggtactttagcatgg

SEQ ID NO: 86096 - DNA, 601 bp, Human
aagaaggatgttcttatgtcaaagagtttccagctatattagagaggtagtagagtcagtggttaagaatccaagttctggtatcagactgcctgggttcaaatcctgactcaactgcttaactcaagaagtgaccttggcatattaaacttaccactctaaacagcattttgtaatctctaaaatgaaggattgataagaatcaagctgtccatcaatgagactggataaagaaaatgtggcacatatacactatggaatactatgcagccataaaaaaggatgagttcatgtcttttgyagggacatggatgaagctagaaaccatcattctcagcaaactaacacaagaacagaaaaccaaacactgcatgttctcactcataagtgggagttgaacaattagaacacatggacacagaaaggggaacatcacacactgggcctgtcaggggttgggggctaggggagggatagcattaggagaaacacctaatgtaggtgacaggttgatgagcgcagcagaccaccatcacatgggcatacctctttaacaaaactgcacattctgcacatgtaccccagaactgaaagtatatat

SEQ ID NO: 86097 - DNA, 601 bp, Human
atggggcatgttgtgtgaatacttaatagatacagaattttcatttggagtcatgaaaatgttttggaagtagagatcgaaggtccttgcacaacattgtgaatgtacttaatgtcactgaattgtactctttaaaatggttaaaatagtaaactctatgttatgggcactttactgcaataaaaaacatagaactgccagatcacaaagtatgctctttaaatttttataaaaattggcaaattgccttgcaaaatcttactccctttatgtttttgtattactgtatatatctctatgyatctttctcaactaatttcagaatcagtctcactcttctctctctctctccttctccctccctccttttctctcccccttgccttcctctccaactctctaacagttctgacaatagtcacaaatactcctcctccccctcctgcaaaaacttttcaggtcatgtatcagtttcaattacatgcattgctttctccttcaggacttcctggatggcttgctgagggacataaacatcctaggggtgcgggtagggggtgtggaatatacaaagaatccttatttctttagtcagctcaga

SEQ ID NO: 86098 - DNA, 601 bp, Human
agaggtgacctgggttacttcccccatcttctctgtactcaggccttgtagctccttctctctaaggcaataaagtaaactgtcattgttccagagaatgtggagccctcctcgtccccaggtgggaggtgaaatgagagagtctcagcaatgggatcccatcaattaggaggaaagcattctcttcactaagttctgccctgaggattgacgtccccgagatgttaacctctgtgtgtcaatgaagcagggaaactggacagttggttcacttttctaaatgcaggagcaagatgagggwaattattgatttctatcaaaacagacaagaagcaaatagaagagaagaccatgggcagggaagggtttgaatacaaatggaaaccaccaggcatagcattgggagcttctgaactaagtttcaggtcagaggtacctgcgtcaccacagcatggaaaaacgtaagggagaattcttggctcaccatctccattggaactcctttaccctgaaagtgctttttccagtgtctcctgttgctatggtaattagaggtattcctggctgggatcttgatgatggtgaataagcaaacaaacat

SEQ ID NO: 86099 - DNA, 601 bp, Human
attgcagatggaaagtttatttttgaacattctgtagtgaggcaagggaagaagaaatccatcacatggaatatcaccctccatgttatcatcttacatctttggcacaaacgctcggaagtaaaggtaatagtgtgaaatacctcctttctcacttaaaaatggaatgaatgatctagatcttcaacaataggctcatttttccaatttccaatgcgaactgctgaagagggccctgcacctgtcagaatgcaaagcccatttgtcagttcctggatagtttctttcagctatttcaagrggtgacctgggttacttcccccatcttctctgtactcaggccttgtagctccttctctctaaggcaataaagtaaactgtcattgttccagagaatgtggagccctcctcgtccccaggtgggaggtgaaatgagagagtctcagcaatgggatcccatcaattaggaggaaagcattctcttcactaagttctgccctgaggattgacgtccccgagatgttaacctctgtgtgtcaatgaagcagggaaactggacagttggttcacttttctaaatgcaggagcaagatgagggaaa

SEQ ID NO: 86100 - DNA, 601 bp, Human
ttcggacacatcattgtaatcctctggtcttctgttgcaccatcatgtcttcttacttgcaaagagtagtctgatattctacaggaattgcagatggaaagtttatttttgaacattctgtagtgaggcaagggaagaagaaatccatcacatggaatatcaccctccatgttatcatcttacatctttggcacaaacgctcggaagtaaaggtaatagtgtgaaatacctcctttctcacttaaaaatggaatgaatgatctagatcttcaacaataggctcatttttccaatttccaaygcgaactgctgaagagggccctgcacctgtcagaatgcaaagcccatttgtcagttcctggatagtttctttcagctatttcaagaggtgacctgggttacttcccccatcttctctgtactcaggccttgtagctccttctctctaaggcaataaagtaaactgtcattgttccagagaatgtggagccctcctcgtccccaggtgggaggtgaaatgagagagtctcagcaatgggatcccatcaattaggaggaaagcattctcttcactaagttctgccctgaggattgacgtccc

SEQ ID NO: 86101 - DNA, 601 bp, Human
ccaagtcaacagaggcaagagatcccaggtccatcatgagtcaggacaggcggctcatgtggggaaaaggatgcattctttgtttttgctcctggctcagatttcggacacatcattgtaatcctctggtcttctgttgcaccatcatgtcttcttacttgcaaagagtagtctgatattctacaggaattgcagatggaaagtttatttttgaacattctgtagtgaggcaagggaagaagaaatccatcacatggaatatcaccctccatgttatcatcttacatctttggcacaaackctcggaagtaaaggtaatagtgtgaaatacctcctttctcacttaaaaatggaatgaatgatctagatcttcaacaataggctcatttttccaatttccaatgcgaactgctgaagagggccctgcacctgtcagaatgcaaagcccatttgtcagttcctggatagtttctttcagctatttcaagaggtgacctgggttacttcccccatcttctctgtactcaggccttgtagctccttctctctaaggcaataaagtaaactgtcattgttccagagaatgtggagccctcctcgt

SEQ ID NO: 86102 - DNA, 601 bp, Human
cactaaaataaaataaataataaataaatctgttttattttgttttccctaaaaattgaggctcttccattttaaatctctcctgtgcaatgggcatgcttccctcctacattgcaggttgggaaacaaagacacagaggaaatgggtggcttgcccaaagtcacccaaaaactctgtcagagagagaactcagactaaaacctaaatctgcccctaactccaacccccattcgtaaagaccccagtctccaagtcaacagaggcaagagatcccaggtccatcatgagtcaggacaggcrgctcatgtggggaaaaggatgcattctttgtttttgctcctggctcagatttcggacacatcattgtaatcctctggtcttctgttgcaccatcatgtcttcttacttgcaaagagtagtctgatattctacaggaattgcagatggaaagtttatttttgaacattctgtagtgaggcaagggaagaagaaatccatcacatggaatatcaccctccatgttatcatcttacatctttggcacaaacgctcggaagtaaaggtaatagtgtgaaatacctcctttctcacttaaaaatg

SEQ ID NO: 86103 - DNA, 601 bp, Human
ttgttcttgaatttatgcagaggctcactttgcatcaaccagggctaataaatcaggatgcagagaaatcaaggcagctgtgcaaaatacagttcacatggaagtgtggacagtggacaaatctgacacagagagacaatactcggctatgtaaatcggtgcataacataaagcacaatgtgcatactacctgggactgaaattatctccttctcagtcttgcttccaacactacccgttcctgccataataatgataaactctcatatctaaaaaataagataaaataaggccggtggcggtggctcacgcctgtaatcccagcgctttgggaggccaaggtggatggatcacttgaggtcaggagttcaagaccaacctggcaaacatggcaaaacctcatctctaccaaaaatacaaaaaaaaaaccccaaaaaattagccaggtatggtggtgcacgtctgtagtcccagctactcctcgggaggctgaggcccaagaatcatttgaaccctagaggcagaggttgcagtgagccgagatctctccactgcactccagcctcggctacacagcaagactctgtctcaaaaataaata

SEQ ID NO: 86104 - DNA, 601 bp, Human
gcacttaagggcctcaacacatatacaccatggaatactatgcagccataaaaaagaacaagttcatgtccttcgcagagacatggatgaagctggaaaccatcattctcagcaaactaacataggaacataaagccaaacaccacatgttcttactcataagtgggagttgaacaatgagaatacatggacacagtgaggggaagatcacacaccagggcctgtcagggggtagtgggcaaggggagggatagcattaggacaaatgcctaatgcatgcggggcttaaaacctagatgaygggttgatgggtgcagcaaaccaccatggcacatgtatacctatgtaacaaacctgcacgttctgcacatgtatcccagaacttaaagtataataattaaaaacaaaaaagataaggacgtcaagttccctccatgttgcttcgaaagacatgatgtaattaccttttatggctcagtagtattccatggtatgtttatatcattttctttatccaatgatccgttcatggacacttgaaaagatagggaatcaatccaagttgcaatcctggttcttaataagaagccttctcagagga

SEQ ID NO: 86105 - DNA, 601 bp, Human
taagtgggttaacaagggaacagaaatccaagtaacacatgttctcactaataagtaggaactaaaattgggtgctcatggacataaagatgggaacaatagacattggggatcccaaaagggaggagggagggagggggtcaagggttgaaaaactacctatcaggtagtgcattcactacactacttgggcaacaggaacattagaggctcaaacttcagcattacataatatgtctatgtaacaaacctgcacacgcaccccctgaatctctctctctacagcgcgcgcgcgcgcgcrcacacacacacacacacacacacacacacacacacggttgatggaaaatgaatgctgcctctagatactgactcaacagtctcaactatgttcttacattggcatttttttttttcacctgtctccttctcaaaaggtcaagagcaggagaaatttcgcctaacagagtttgtaaggtaggttttggataatactattttcttattttaagaaataacttgggctaggtgcggtggctcacgcctgtaatccaagcactttgggaggccgaggcaggtggatcacctgaagtcaggagtt

SEQ ID NO: 86106 - DNA, 601 bp, Human
ctaagtgggttaacaagggaacagaaatccaagtaacacatgttctcactaataagtaggaactaaaattgggtgctcatggacataaagatgggaacaatagacattggggatcccaaaagggaggagggagggagggggtcaagggttgaaaaactacctatcaggtagtgcattcactacactacttgggcaacaggaacattagaggctcaaacttcagcattacataatatgtctatgtaacaaacctgcacacgcaccccctgaatctctctctctacagcgcgcgcgcgcgcgagcacacacacacacacacacacacacacacacacacggttgatggaaaatgaatgctgcctctagatactgactcaacagtctcaactatgttcttacattggcatttttttttttcacctgtctccttctcaaaaggtcaagagcaggagaaatttcgcctaacagagtttgtaaggtaggttttggataatactattttcttattttaagaaataacttgggctaggtgcggtggctcacgcctgtaatccaagcactttgggaggccgaggcaggtggatcacctgaagtcaggagt

SEQ ID NO: 86107 - DNA, 601 bp, Human
acagcactatttacaatagcaaagacatagcatcaacccacatgcccatcaacaatggaatggataaagaaaatgtgatatatatacactatggaatgctacacagccataaaaaagagtgaaatcatgtcctttccagcagtatggatgcagctgaaggccattatcctaagtgggttaacaagggaacagaaatccaagtaacacatgttctcactaataagtaggaactaaaattgggtgctcatggacataaagatgggaacaatagacattggggatcccaaaagggaggagggarggagggggtcaagggttgaaaaactacctatcaggtagtgcattcactacactacttgggcaacaggaacattagaggctcaaacttcagcattacataatatgtctatgtaacaaacctgcacacgcaccccctgaatctctctctctacagcgcgcgcgcgcgcgcgcacacacacacacacacacacacacacacacacacggttgatggaaaatgaatgctgcctctagatactgactcaacagtctcaactatgttcttacattggcatttttttttttcacctgtctccttctc

SEQ ID NO: 86108 - DNA, 601 bp, Human
tggtgggaatataaattagttcagccccagtggaaagtagtttggagatttctcaaagaactaaaaatagaattaccattctacccagcaatcccatcactgggtatatgcccaaaggaaaataaatggttccaccaaaaatcccctgcactcatatgtttatcacagcactatttacaatagcaaagacatagcatcaacccacatgcccatcaacaatggaatggataaagaaaatgtgatatatatacactatggaatgctacacagccataaaaaagagtgaaatcatgtcctttcsagcagtatggatgcagctgaaggccattatcctaagtgggttaacaagggaacagaaatccaagtaacacatgttctcactaataagtaggaactaaaattgggtgctcatggacataaagatgggaacaatagacattggggatcccaaaagggaggagggagggagggggtcaagggttgaaaaactacctatcaggtagtgcattcactacactacttgggcaacaggaacattagaggctcaaacttcagcattacataatatgtctatgtaacaaacctgcacacgcaccccctg

SEQ ID NO: 86109 - DNA, 601 bp, Human
cctaacttcaaactatactacaatgctacagtaacccaaacagcatggtactggtaaaagacacatagaccaatgaaacagaatacagaccccctaaaataaagctgcacacctacaaccaactgatctttgacaaagtcaacaaaaataagcaatgaggaaagaacccccatccaataaatggtgctgggaaaactggctatccatatgcaaaaggctaaatctggacccctatcttttactatatacaaaaattaacccaagatggattaaagacttaaatgtaagacctcaaactataaaaaatcctagaagaaacctaggaaatactgttctggacattagcctaggcaaataatttatgactaagtcctcaaaagcaaatgcaacaaaaaaaaattgacaatcggaatctagttaaactaaaggtcttctgcactgcaaaagaaactatcaatacactaaatagacaacctacagaatgggggaaaatatttgcaaactaggtatccaacaaagggctaatattcagaagctataaggaacttaaatcaagaaaaaaaacaaataactccattaaaatcaggcaaaggacatgagc

SEQ ID NO: 86110 - DNA, 601 bp, Human
gataaccagacaggaggacggtcctacaactaactctcattttcccttcaagccaatattgaagacttgatatcttggtccattattctgtccaaataaggaaaggaaacaatgttgaatcttgatacgtgacctgataagactttggtgctctctgaacatccatcttctttgcctcaaaataaaaaatatagggttgatgaatgggcaaggcaatcctaagcaaaaagaataaagccaaagccatcacattacctaacttcaaactatactacaatgctacagtaacccaaacagcatrgtactggtaaaagacacatagaccaatgaaacagaatacagaccccctaaaataaagctgcacacctacaaccaactgatctttgacaaagtcaacaaaaataagcaatgaggaaagaacccccatccaataaatggtgctgggaaaactggctatccatatgcaaaaggctaaatctggacccctatcttttactatatacaaaaattaacccaagatggattaaagacttaaatgtaagacctcaaactataaaaaatcctagaagaaacctaggaaatactgttctggacattagcc

SEQ ID NO: 86111 - DNA, 601 bp, Human
gcatggagtcaatttaatacatttcgagagtttactctacaaaagccaacatctttccagacttggggcaggaggttctctctacccaggagagaaatccaaagactgtacagctaatacttggacgtgtctagcatcatgctcagtggtttacctgaatcatctctaattctcacagcaaccattttgcagacaagaaatctgcagcttgtaaaaaataagcccaagatgcaaaccctggtttttctgcctccaaagcccatatggcttccacaacaccaacctaccacttagacgcaayagaagaataccagatctcaagagaagtaggagcctgcatcactacagttgatgtcaggggcaggaatcaagagtgaagaaaaggagatgtcaagatgtctggggagtgtgtctctcctgaacactgaaggaaagagatccatagggtgtgtgtggtgtgtgcgtgtgtgtgtgtgtgtgtgtgtgtgtgtgtgacacagagagaggtcttacaaacacacatttttaaatttttaatacataaaaacagtggacaaattataccactcaattttctacaatttgaacacatccatacaac

SEQ ID NO: 86112 - DNA, 601 bp, Human
ccaagcatggagtcaatttaatacatttcgagagtttactctacaaaagccaacatctttccagacttggggcaggaggttctctctacccaggagagaaatccaaagactgtacagctaatacttggacgtgtctagcatcatgctcagtggtttacctgaatcatctctaattctcacagcaaccattttgcagacaagaaatctgcagcttgtaaaaaataagcccaagatgcaaaccctggtttttctgcctccaaagcccatatggcttccacaacaccaacctaccacttagacrcaatagaagaataccagatctcaagagaagtaggagcctgcatcactacagttgatgtcaggggcaggaatcaagagtgaagaaaaggagatgtcaagatgtctggggagtgtgtctctcctgaacactgaaggaaagagatccatagggtgtgtgtggtgtgtgcgtgtgtgtgtgtgtgtgtgtgtgtgtgtgtgacacagagagaggtcttacaaacacacatttttaaatttttaatacataaaaacagtggacaaattataccactcaattttctacaatttgaacacatccata

SEQ ID NO: 86113 - DNA, 601 bp, Human
agaagaaaattattagacattcaaattctgtatatttggcttaaataaaagcaaagaaagatggagaaggtctcattcatgtgagatctgtttactctgcacagcctatgtcagaggtaatggtcttaaatagttttaggaggatctaggttgaactcagatctgaaccaggtagaaacacccattctaaatggagaaaattcccaagcatggagtcaatttaatacatttcgagagtttactctacaaaagccaacatctttccagacttggggcaggaggttctctctacccaggagakaaatccaaagactgtacagctaatacttggacgtgtctagcatcatgctcagtggtttacctgaatcatctctaattctcacagcaaccattttgcagacaagaaatctgcagcttgtaaaaaataagcccaagatgcaaaccctggtttttctgcctccaaagcccatatggcttccacaacaccaacctaccacttagacgcaatagaagaataccagatctcaagagaagtaggagcctgcatcactacagttgatgtcaggggcaggaatcaagagtgaagaaaaggagatgtcaa

SEQ ID NO: 86114 - DNA, 601 bp, Human
atagaagaaaattattagacattcaaattctgtatatttggcttaaataaaagcaaagaaagatggagaaggtctcattcatgtgagatctgtttactctgcacagcctatgtcagaggtaatggtcttaaatagttttaggaggatctaggttgaactcagatctgaaccaggtagaaacacccattctaaatggagaaaattcccaagcatggagtcaatttaatacatttcgagagtttactctacaaaagccaacatctttccagacttggggcaggaggttctctctacccaggasagaaatccaaagactgtacagctaatacttggacgtgtctagcatcatgctcagtggtttacctgaatcatctctaattctcacagcaaccattttgcagacaagaaatctgcagcttgtaaaaaataagcccaagatgcaaaccctggtttttctgcctccaaagcccatatggcttccacaacaccaacctaccacttagacgcaatagaagaataccagatctcaagagaagtaggagcctgcatcactacagttgatgtcaggggcaggaatcaagagtgaagaaaaggagatgtc

SEQ ID NO: 86115 - DNA, 601 bp, Human
cttagcatcaaaatcaccctaatgagcttttcagtgtgcatatacccgagtttccttccagcaccactgaatcagaatctctggatatggtacccaggaatctatattctgaaccagcatacttggcatcattgatgcaggaggtccatagactccagtaagagacattgtattagggactccacttttcactgagcacataatttgatacttactggtatggctgtttgttattgcagagcatgtctggtccctgcaaccagattactaattatgaaaaaacagaatctaaccctaaccytaacatggcccagacctcgctaaatgattttaggcattaggccaatacagatggcctaaagactttttatatttcttccttttataaaacattaattttgtaggtgcatatgaaagccaactcactcccatttataactcagaaactatggaagcaaaaaaaatgcagctagaataatgttgttttctttgtatactgttaggcacagaagtggaattccacctattcactaagaatagtagctacctgataacatccagttatccaaatgcagtaaaataaatgagggcataagaaagc

SEQ ID NO: 86116 - DNA, 601 bp, Human
ttatctttcaagatctagatatcaccttttccttcttccataaatactacaacctcacataggtattttctgtcctccaattgtgtagagtgctagtaattcaataacttagcatcaaaatcaccctaatgagcttttcagtgtgcatatacccgagtttccttccagcaccactgaatcagaatctctggatatggtacccaggaatctatattctgaaccagcatacttggcatcattgatgcaggaggtccatagactccagtaagagacattgtattagggactccacttttcactragcacataatttgatacttactggtatggctgtttgttattgcagagcatgtctggtccctgcaaccagattactaattatgaaaaaacagaatctaaccctaaccctaacatggcccagacctcgctaaatgattttaggcattaggccaatacagatggcctaaagactttttatatttcttccttttataaaacattaattttgtaggtgcatatgaaagccaactcactcccatttataactcagaaactatggaagcaaaaaaaatgcagctagaataatgttgttttctttgta

SEQ ID NO: 86117 - DNA, 601 bp, Human
ttgtcatcagtaagaacaaacctaatgatgttattacaacatccagatatggggccaattatttatatgttcattttatatggtcccgcatttagaatagaatgaaattttaatttattattttggtttttacctgcctttatcattaggaagtgatgtttattagtcagtgaattaagaggaaaatatcaaggagacatctgcactcccatatttgttgcagcactactcacaatagccaagatttggaatcaacctaaatgtcaacagacaaatggataaagaaaatgtggtacatatrcacaatggagtactgtacagccatgaaaaagaatgagatcctgtcatttgcaacaatatggatggaactggaggttagtatgttaaatgaaataagccaggcacagaaagccaagcttcatattcccacttatttgtgagagctaaaaaaaaaaaaattaaaacaattgaactcatggaggtagagagtagagtgatggttaccagaggctaggaagggtagttgggggatggtatgaggtagtgatggttaatgagtacaaaaatatagttagatagagtaagatctaatatttaatag

SEQ ID NO: 86118 - DNA, 601 bp, Human
cacacacataccagtatgttctccttctctcacagacacactcacatgtggacacacactcatgcatgcatgcgcgcacacacacacacaccgagtaacttgattctccatgagactctgccagaaactaaactattgacaaaagtttcctgatgtgcccaactctctaggtgtgcttctcagttacgttgggcccaaacctaaagatgttaacttccttgtcatcagtaagaacaaacctaatgatgttattacaacatccagatatggggccaattatttatatgttcattttatatgrtcccgcatttagaatagaatgaaattttaatttattattttggtttttacctgcctttatcattaggaagtgatgtttattagtcagtgaattaagaggaaaatatcaaggagacatctgcactcccatatttgttgcagcactactcacaatagccaagatttggaatcaacctaaatgtcaacagacaaatggataaagaaaatgtggtacatatacacaatggagtactgtacagccatgaaaaagaatgagatcctgtcatttgcaacaatatggatggaactggaggttagtatg

SEQ ID NO: 86119 - DNA, 601 bp, Human
tatagttgtgatttttatctacatgctcattttagaattcatgggggcatcctgtctcataattttttgtagctattatccattagtttttggttttttattacttttgttagtttgtctgttttttgaggagtgggttcaaagatatcaaaaactctgctgctatcttccagatttccctaataaacgtatctgcgatatgacactccttcagctacaaacacacacataccagtatgttctccttctctcacagacacactcacatgtggacacacactcatgcatgcatgcgcgcacrcacacacacaccgagtaacttgattctccatgagactctgccagaaactaaactattgacaaaagtttcctgatgtgcccaactctctaggtgtgcttctcagttacgttgggcccaaacctaaagatgttaacttccttgtcatcagtaagaacaaacctaatgatgttattacaacatccagatatggggccaattatttatatgttcattttatatggtcccgcatttagaatagaatgaaattttaatttattattttggtttttacctgcctttatcattaggaagtgatgttta

SEQ ID NO: 86120 - DNA, 601 bp, Human
tttatagttgtgatttttatctacatgctcattttagaattcatgggggcatcctgtctcataattttttgtagctattatccattagtttttggttttttattacttttgttagtttgtctgttttttgaggagtgggttcaaagatatcaaaaactctgctgctatcttccagatttccctaataaacgtatctgcgatatgacactccttcagctacaaacacacacataccagtatgttctccttctctcacagacacactcacatgtggacacacactcatgcatgcatgcgcgcrcacacacacacaccgagtaacttgattctccatgagactctgccagaaactaaactattgacaaaagtttcctgatgtgcccaactctctaggtgtgcttctcagttacgttgggcccaaacctaaagatgttaacttccttgtcatcagtaagaacaaacctaatgatgttattacaacatccagatatggggccaattatttatatgttcattttatatggtcccgcatttagaatagaatgaaattttaatttattattttggtttttacctgcctttatcattaggaagtgatgtt

SEQ ID NO: 86121 - DNA, 601 bp, Human
ggatttatagttgtgatttttatctacatgctcattttagaattcatgggggcatcctgtctcataattttttgtagctattatccattagtttttggttttttattacttttgttagtttgtctgttttttgaggagtgggttcaaagatatcaaaaactctgctgctatcttccagatttccctaataaacgtatctgcgatatgacactccttcagctacaaacacacacataccagtatgttctccttctctcacagacacactcacatgtggacacacactcatgcatgcatgcgygcacacacacacacaccgagtaacttgattctccatgagactctgccagaaactaaactattgacaaaagtttcctgatgtgcccaactctctaggtgtgcttctcagttacgttgggcccaaacctaaagatgttaacttccttgtcatcagtaagaacaaacctaatgatgttattacaacatccagatatggggccaattatttatatgttcattttatatggtcccgcatttagaatagaatgaaattttaatttattattttggtttttacctgcctttatcattaggaagtgat

SEQ ID NO: 86122 - DNA, 601 bp, Human
gggttgctggatcatacagaagttctacttttagtatgaggaaactccataccgtttttcataatggctgttctaaattcccaccagcaatgtatactagttctctttctccacatccttgccagtatttactttttgtatttttgataatatcttttctgagctgagattatatctcactgtggtttcgatttgcattttcctcatgattagtgatgtcaagtatttttttcataaacttgtccatttgcatatctttaagagatgtttatttaactcatttgcccatttttaatcggattttttttttgctgttgagttccttgtatattctgcatattaatcccttgtcagttgagtagtttgcaaatattttctctcattctgcaggttgtctcttcactctgattttttcctttgctgagcagaagcttttacatttgtctatttttgctgatgttacctgtgcttttgaggtcttctctataaaaatctttttgcagaccaatgccctggagtttaccctgttttcttctagcagtttcacagttttaggttttacacgtcagtctttaacccattttgagtgtattttgtatat

SEQ ID NO: 86123 - DNA, 601 bp, Human
caggtgtgagccaccgcgcccagccaagatgttgttattttaatggctgaatagtattccattgtgtatacataccacattttcttcatctgttaattcagtggttgattcaatgtcttggcccctgtgaatagtgctgcaataaacatggcagtgggtaaagaatatctcttcaacatactgatttcctttcctttgaatatttacccagtaatggggttgctggatcatacagaagttctacttttagtatgaggaaactccataccgtttttcataatggctgttctaaattcccacsagcaatgtatactagttctctttctccacatccttgccagtatttactttttgtatttttgataatatcttttctgagctgagattatatctcactgtggtttcgatttgcattttcctcatgattagtgatgtcaagtatttttttcataaacttgtccatttgcatatctttaagagatgtttatttaactcatttgcccatttttaatcggattttttttttgctgttgagttccttgtatattctgcatattaatcccttgtcagttgagtagtttgcaaatattttctctcattc

SEQ ID NO: 86124 - DNA, 601 bp, Human
acctgtagtctttggtaactgctttgctcattgcagtgacaagacactctaggaaggtttatcttgttcatttccaccctacaccttgaatcacccactttcccagtggtctccctcagtggaaaataatttaaaaaccaaactctaagtggaggagtacttagttttactaggttggttactgttctaggatatatgtattttaagtaaaaatacatcataagttcatactgatactttttaaattgacattgtatattaatatttatggggtacggtgtgatacttcaatacatgtatrcaatgtgtaatgatcaaggcaaggtaattagcttatccatcacctcaaacttgtcatttcttgtatttagaacattaaaaagtctgcttttctagctatttaaaaatacacaatatatttttaactatggtcatcctacagtgtgatagaatactagaacctatgcttcctgtctagcgtaattttgtatcctttaaccaacctgtggctacacccttcctggcctctagtaaccactaatctactttctacttccatgagatcaatgctttgagcttccacatgaagtgaaaacacgtg

SEQ ID NO: 86125 - DNA, 601 bp, Human
gaagaactgatacaagaagggcagaatacagtaaacgcatgcttcttcccccatgtatgttttcagaacaatgaattggttccctagcatcctccaagggttaccaattagttatcttttaaaatatcttattattacaaactcacggattttatgtatttcaatgccctgcaattagtatcttcattgatgcccaagctgttccatctttggccagttgatttcagattggcttctgagtccctttgacctgtagtctttggtaactgctttgctcattgcagtgacaagacactctagraaggtttatcttgttcatttccaccctacaccttgaatcacccactttcccagtggtctccctcagtggaaaataatttaaaaaccaaactctaagtggaggagtacttagttttactaggttggttactgttctaggatatatgtattttaagtaaaaatacatcataagttcatactgatactttttaaattgacattgtatattaatatttatggggtacggtgtgatacttcaatacatgtatgcaatgtgtaatgatcaaggcaaggtaattagcttatccatcacctcaaactt

SEQ ID NO: 86126 - DNA, 601 bp, Human
tgaccaggaggattccttctatgatctcaaggcagcactgccatgctgctcagcgcctccaatcatgtctcaaggtaattgggctggtagatgtttacctatctgcaaagcttagttatgatcccattaggtcatttccagaaaggttcacataaacttgggtcactttatattctttttaaacttgtcatcatgggaaatgtcaaacatagaaaacagaaaaaatagtataacaaacccccatgtatcctccactcaattttaactattttcaattcgtgactgatcttgttttgtccayattcttaccaatgttctccttccaatgcattattttgaagtgaactccagatatcatatcattcatctgtaaatatttcagtatacatctctaaaagtcaaggactcctttttacaaatatcatcacaataccatcatcacactcaaaatttaccttaatccttaatattatcaagtgtctggtctgtgttcatatttcgctgattgttctatatacttttagaaaaatcgtattcttttgacttagaatacacacaaggtctatatgattaatatggtatttatttatgtatttatttt

SEQ ID NO: 86127 - DNA, 601 bp, Human
atctaaggaacaaggaagacagtgccacatggttattctgaagacgagatcagctcctatcccttgggccactctccatctttctcattttgctctacaatagaccttgacagtttcctgtcaccagctttttccctcctcagtgtcttcgcactgtctgttccctatacctggaatgctttttcctccgctgttcccatcatcaggacctcctttttatccttcagatttcagcttaaacgtctcatgctctgagaggccttttcttgctagagcagggtctttgtccatcagtcttcaycacagctctgcttattacctcccccataacactgtccaaaatctgtaattagttttttcacctgtgtattgatgtctccctatactagaatctggacatgaaaagactgtatcctcattctctagtacaatgccaggcatttaagcatttaatattcacagaatgaatgactgtactagaaaacgcttggaggctatacagtcctatatacatataagggactatgggactatatatatatatatatatatatatatatatatatatatatatatatatatgtatacgtatgtatttatc

SEQ ID NO: 86128 - DNA, 601 bp, Human
gatgctggctgtgccatatattcactggatgattttggacacattcttcacctttctgagccttttcttccatgcaaaatgaggcagttggatgttatacttgtaaacatgacaatgctacagcataacgaaagcaccaactgataaagaaaaagcaatgggttgtcagttcccaatgcaagttagagttgtgtgtgatttggtctagaaagcaagggccactcacttttcaaagtatccacggagaagctatgtgactcaggcaaatgcagttacagggacctggctcagcctcttcctrtctgtgtgaacttgggcaagtcttttcaccttgcttaccctcagtttgctcatttcgagaaaggtgataattcccagccttgctggtttattgtgatgattaacatgagtatggaaggtggttagtactttgtctgctccttagtccttctcctcctcctccctatcctcttcctcctctcattcctctccttccccttcctcctctacttcctcctctttctcctcctccctttcctccccatcctcctcttactcctccttaatgaagcaagatcttccctctgtaagaacattacat

SEQ ID NO: 86129 - DNA, 601 bp, Human
agaagaaggcactagacttggagttagaacttggatgctggctgtgccatatattcactggatgattttggacacattcttcacctttctgagccttttcttccatgcaaaatgaggcagttggatgttatacttgtaaacatgacaatgctacagcataacgaaagcaccaactgataaagaaaaagcaatgggttgtcagttcccaatgcaagttagagttgtgtgtgatttggtctagaaagcaagggccactcacttttcaaagtatccacggagaagctatgtgactcaggcaaaygcagttacagggacctggctcagcctcttcctatctgtgtgaacttgggcaagtcttttcaccttgcttaccctcagtttgctcatttcgagaaaggtgataattcccagccttgctggtttattgtgatgattaacatgagtatggaaggtggttagtactttgtctgctccttagtccttctcctcctcctccctatcctcttcctcctctcattcctctccttccccttcctcctctacttcctcctctttctcctcctccctttcctccccatcctcctcttactcctccttaatg

SEQ ID NO: 86130 - DNA, 601 bp, Human
atacctctcttagctcaatctcagctccaagcaaattgaaaatctctactaattcacaaaaaaataaaaataaaaaaataaaactttttaattaggtcaaccctgcagcttaacaacgaagatgaagaaaaagatcttgggcaagaacaagacagctgtggtttgagaagaaggcactagacttggagttagaacttggatgctggctgtgccatatattcactggatgattttggacacattcttcacctttctgagccttttcttccatgcaaaatgaggcagttggatgttatacttstaaacatgacaatgctacagcataacgaaagcaccaactgataaagaaaaagcaatgggttgtcagttcccaatgcaagttagagttgtgtgtgatttggtctagaaagcaagggccactcacttttcaaagtatccacggagaagctatgtgactcaggcaaatgcagttacagggacctggctcagcctcttcctatctgtgtgaacttgggcaagtcttttcaccttgcttaccctcagtttgctcatttcgagaaaggtgataattcccagccttgctggtttattgtgatgatta

SEQ ID NO: 86131 - DNA, 601 bp, Human
gagataattataattaaagttaatttcattgcatgccatctgccagatactatgttaagccctttatgtgtagaaatgaaaggagagttctgtgcgcacgctaggtgctctgtatacagcgtaccacccactccaaagctgagagtggaaggcagagctcaagcaatcattaaccacagcacacgttcaggcagttttgccactaaattttaaccagtacatatataaaagtgtcccactctcctcctcatatcccatatgcacacgtgcacacccatgtgtgcatgtactcacatgtgcrcacacacacatacacacacacttcaattcggtcggcttttccttggggagtagactttggtgagtaaatacctctcttagctcaatctcagctccaagcaaattgaaaatctctactaattcacaaaaaaataaaaataaaaaaataaaactttttaattaggtcaaccctgcagcttaacaacgaagatgaagaaaaagatcttgggcaagaacaagacagctgtggtttgagaagaaggcactagacttggagttagaacttggatgctggctgtgccatatattcactggatgattt

SEQ ID NO: 86132 - DNA, 601 bp, Human
tcgcgtgacaaatgacatctgagaaccaagtcgtaccaggcaaaggctgccacatgagtggaatacaaaatagttttctgcatgtgttcagttcactgctgtaaataagattcactggagacctgaaacaggagggcccaaaataattttggttctgattccgacaacaaagaaagagttgactctccaccttctctaactgatcatagtgattaatctctcaccagccagtttattacatagtcctgctcaatctaaagctggcatgcaagacaccattttcaaaaattaaacaagccasgtgtggggacacatgcctgtaatcccagctacttgggaggctgaggcaggaggatcgcttgagcccaggaatccaaggctgcagtgagccatgactgtgtcactgcactccagcctgggcaacagagcaatactcttggagcaagggagggaggggggagggagggaggactgaccggagtttgagtcctgggtttatcatttgctaattgagtgattttaggaagttatttaagccttgaagtctccatttcctaatctgtaaaactgaaaaaatagtattacctcaccctaaatgaga

SEQ ID NO: 86133 - DNA, 601 bp, Human
gctattctaaaggaaattttatagcttacataaatggggagcctcgtgtcacttacataaataatcaccttgaacataaagcaaaccatatcattaaatcctggccagacaccatggcatgactactatgtgagtctgtgttctttaactggggctgtgtaccacctaaagccatctcatttacctgaggtgatatgcagccccatattctgggaaacacttatgtaacctaactctctcacatgtccaaaggaggacaggacactaactggtctcctgtaaccaaacaagttgctgccasatcccggtgttctgatcctttgttgaacgttccttcctctgttctgtgagtcttttattagcattaagagtggaacccaagcctcctctttaaagttggcgtttgaaacccaacagaaaactgcaagctccaggaccctgaaccaactgagactcagaagtgctggtggcattcagcatccaagaacacttagagccaagtttgtgctgtctttttaacacgactaataccatcagtggaattaatagaaaaatgaaagccggcactctaattccagtaatgaaatcacaggcgcacagc

SEQ ID NO: 86134 - DNA, 601 bp, Human
ggggaaatacagaaacaacaataaacatgccaaacccaaacacatcgataactgcattaaatgactgtggactaaaagttgaagactctcagaatggatcaaacaaaaacaagaccaactattctctacctacaagagatgtactttcaatgtaaagacgcagacagattcaaagtaaattaatggaaaaagatacaacacacaaccagaaaatgttagaagaatggaccatctttattagcatcagataaaacagacttcaagacagtattcccggaggggcatttcataatgagaaaarggtcaattcatcagaaagatataataaccataaatgtgtatgaacttaataacagaacccccaaaaatacagaatggaactaaaaggaaaaatagacaactccacaatcacagtttctcttcaacttccatcacagatatttcccattatttattattagtctataaaccaactttttaaaatgtaattaagctattctaaaggaaattttatagcttacataaatggggagcctcgtgtcacttacataaataatcaccttgaacataaagcaaaccatatcattaaatcctggccaga

SEQ ID NO: 86135 - DNA, 601 bp, Human
gaggtatagattaaaagccaataaataagttaaaacaaagtgtgtaaatactctaaaaatccataaaaaggcagatataatgggcaaaatgaatcccccaaagatgtccacacctttaaccctggaacctctgaatgtgttatgttacatgaaaaaagtgattatggacctaaaaacggagagattatcctggtttattccatggatcctactcacaagtcccctgaaaaacagagaactttctccagctggagtcagagaagtagcagagaagaagtcagagagactcaaagtgtcagargatcttcattcaccattgctggaggagctacatggaaagcatgagaaagaagtctctaggagcaaagaccagcctgccatccacagactgcaaataaatgggaacctcagttccacaactcttcggtttgtgaatcattcgtcacagcagcaacagaaaactaacagagcaggaaagggagaagagagacatgaaaaacagaggggaaatacagaaacaacaataaacatgccaaacccaaacacatcgataactgcattaaatgactgtggactaaaagttgaagactctcagaatgga

SEQ ID NO: 86136 - DNA, 601 bp, Human
agaaaactggttatagaaggaaatagtttaaattttataggaattaaagtattaaaatttttaaataattttctgcatctattaagataattctgcatctattgagatgagaggtatagattaaaagccaataaataagttaaaacaaagtgtgtaaatactctaaaaatccataaaaaggcagatataatgggcaaaatgaatcccccaaagatgtccacacctttaaccctggaacctctgaatgtgttatgttacatgaaaaaagtgattatggacctaaaaacggagagattatccwggtttattccatggatcctactcacaagtcccctgaaaaacagagaactttctccagctggagtcagagaagtagcagagaagaagtcagagagactcaaagtgtcagaggatcttcattcaccattgctggaggagctacatggaaagcatgagaaagaagtctctaggagcaaagaccagcctgccatccacagactgcaaataaatgggaacctcagttccacaactcttcggtttgtgaatcattcgtcacagcagcaacagaaaactaacagagcaggaaagggagaagagagac

SEQ ID NO: 86137 - DNA, 601 bp, Human
tagaggaaaagctctcaattttcaccactgagtatggtgtttgttgtgggcttgttgtatttgacctttattggatatacttctatcatgaaaacactcagaaaactggttatagaaggaaatagtttaaattttataggaattaaagtattaaaatttttaaataattttctgcatctattaagataattctgcatctattgagatgagaggtatagattaaaagccaataaataagttaaaacaaagtgtgtaaatactctaaaaatccataaaaaggcagatataatgggcaaaatgratcccccaaagatgtccacacctttaaccctggaacctctgaatgtgttatgttacatgaaaaaagtgattatggacctaaaaacggagagattatcctggtttattccatggatcctactcacaagtcccctgaaaaacagagaactttctccagctggagtcagagaagtagcagagaagaagtcagagagactcaaagtgtcagaggatcttcattcaccattgctggaggagctacatggaaagcatgagaaagaagtctctaggagcaaagaccagcctgccatccacagactgc

SEQ ID NO: 86138 - DNA, 601 bp, Human
tgaaaaagaattaaagacttttcagataaaataaaactaagagaattcatttccagcagaccagcccttcaagaaatgctaaaggaagttattcaagctgatacaagagaaaataataccagaagaaaactctaattccttcaggaattaatgaagagcattagaagcataaatatctggataagcataaaagactcttcttttaattaaaaaaatacatatgcatgtgactatttaaagcacaaatccttacattgcctcttggggtattaatgtacagatgcaatgcatataacactawagcatacaggatggtgagggtggaagaagagagacaggccctctcacattgttttatacggttttatactcagaaaaagaaagagaagcgaaactaaaggcagttagcctggtgcctaggaaccagacccaaaaccaaggaaccagacccgaaatcaggcctgggcctgcctgacctaagcctggtagttaaagatcgacccctgacctaaccggttatgttatctatagattccagacattgtatggaaaagcactgtgaaaatccctgtcctgttctgtttcgttctgattaccggtg

SEQ ID NO: 86139 - DNA, 601 bp, Human
aacaaattctataattagtgaaaatgcccttcaagaatgaaaaagaattaaagacttttcagataaaataaaactaagagaattcatttccagcagaccagcccttcaagaaatgctaaaggaagttattcaagctgatacaagagaaaataataccagaagaaaactctaattccttcaggaattaatgaagagcattagaagcataaatatctggataagcataaaagactcttcttttaattaaaaaaatacatatgcatgtgactatttaaagcacaaatccttacattgcctcttrgggtattaatgtacagatgcaatgcatataacactatagcatacaggatggtgagggtggaagaagagagacaggccctctcacattgttttatacggttttatactcagaaaaagaaagagaagcgaaactaaaggcagttagcctggtgcctaggaaccagacccaaaaccaaggaaccagacccgaaatcaggcctgggcctgcctgacctaagcctggtagttaaagatcgacccctgacctaaccggttatgttatctatagattccagacattgtatggaaaagcactgtgaaa

SEQ ID NO: 86140 - DNA, 601 bp, Human
ggttagaagcaagatgaagtcacttaagtcagatctctttcactgccatgatttctcagttataatttttgcaaaggtggtttcaaaagttcctacaagaaagagaatggagaaggggaaaaaatattgaagaataatggccaaaaagaaatttggtgaaagacataaacttacaaattcaagaaactcaaagaaccccaaataggacaaatgtggagaaaaccatgctaggcacatcacagtcaaactgatgaaaatcaaaagaaagaaaatctcaaaattagcaagagaaaaatagcamattatatatagagaacaatgattcaaatttttcacagacttaagattagaaactacagagtccagaagacagtggaataatgtctttataagtgctggggggaaaaaaaacaaattctataattagtgaaaatgcccttcaagaatgaaaaagaattaaagacttttcagataaaataaaactaagagaattcatttccagcagaccagcccttcaagaaatgctaaaggaagttattcaagctgatacaagagaaaataataccagaagaaaactctaattccttcaggaattaatgaa

SEQ ID NO: 86141 - DNA, 601 bp, Human
ttcacacacagccagctgtgcaggagaccagagttttattatgactcaaaatcagtttccccaagaatacagggatcagagtttttaaggataatttggtgggtagagggccagtgattcaggagttctgattggctgtctggagatgaaatcacagggcgttaaaattgtcctcctgctgtgagtccgttcctgggtgggggccacaaggccagatgagccagtttatcaatctgggtggtgctaactgatccatcagatgaagggtctgcaaaatatctcaagtaccgatcttaggttktacaatagtgatgttatccccaggagcaatttggggagctttagagtcttgcagccttcaactgcatgactcctaaaccataatttctcatcctctggctttaggcaatccccaggcaggaagggtgtttgttttgggaaagggctaatatctctttgtttcaaagttaaactataaactaagtttctctgaaggttattttggcctacacctccgcccaggaaaaacaaggacaacttggaggttagaagcaagatgaagtcacttaagtcagatctctttcactgccatgatttctca

SEQ ID NO: 86142 - DNA, 601 bp, Human
tttcacagggacattgaaacatggaagaagggctcatcatagagttctacatttttgccacctaggtctgacagcatgctgctgtcccaaaatggcaccgggtggctcaacatctagtggaagagccaacctctttctggcctgaggaggtggaagttagagacctggaagtccacggccagcagaatataaaaaccccagaaagaggagacttagagaagggaattcttggcatgtatatgtaaactctgcccaagcctctggccagtccttgaacaaagggtgagtagacaaggctcaragtagtttgcatttaaacccaacaggactgagaactaagcctccacctgagagacagatatggaaatgtaagtataaccaggttagttacctgctaagacacaaatatgaatactctttaaggaaatataacccacaatatagcattcacaaagtgctagtacaattcaaaattactttacatataagaagtagggaaatctgacccattctcaagcaaaaaagacttactttacatataagaaatagggaaatctgacccattctcaaggaaagaagacaatcaacagaggccaatccc

SEQ ID NO: 86143 - DNA, 601 bp, Human
tattctcctcttgaatctgaccagcacagtgactatgtgaccaatagaaaagcctaattttcagtaaaacagaagcttccacttcttccctgatataacaattgcccttgggtatgtcaactcaaaactcaaccaccatgctttgtgaaatccaagccacttaaaaaggttacattaggcagtgagctacgcccccaagccaatagccagctccatccacttagccatgtcatgagccatctcatacatttcagcccaactgtgctctcagggaactgtagcctcagctgttattacatgsagcagaaaaaccacctagtagagcccagtcaacccacagaactgtgactgacaataaaatgattcttgtttctagctcctgtatcttgtagcaagaatatataagaatgtaaaactgccaatgtcgggtaagaaaatgagatggctgaagatgatgacatgtcagtctaactttaccataaaaattatctgatctagtttatctgaaaaatagttccagcagtgtagaagtttaagaaaacagcagaagatagccagagttctgcttctggtatggtaggaaatctcttaacagattccc

SEQ ID NO: 86144 - DNA, 601 bp, Human
ttcaggaattctataaagagatgatcaaggcatgaacaaaggctatgggtgacaaataagagcagacagtatgaggtggggtgaattaaggatgcccacactgttttctgttattcttcccattgacaggtggattgctttattctcctcttgaatctgaccagcacagtgactatgtgaccaatagaaaagcctaattttcagtaaaacagaagcttccacttcttccctgatataacaattgcccttgggtatgtcaactcaaaactcaaccaccatgctttgtgaaatccaagccacwtaaaaaggttacattaggcagtgagctacgcccccaagccaatagccagctccatccacttagccatgtcatgagccatctcatacatttcagcccaactgtgctctcagggaactgtagcctcagctgttattacatggagcagaaaaaccacctagtagagcccagtcaacccacagaactgtgactgacaataaaatgattcttgtttctagctcctgtatcttgtagcaagaatatataagaatgtaaaactgccaatgtcgggtaagaaaatgagatggctgaagatgatgacat

SEQ ID NO: 86145 - DNA, 601 bp, Human
tgtagatagtcatttgagaggcaagactggggggaaggggagaggctagaaggctatttcaggaattctataaagagatgatcaaggcatgaacaaaggctatgggtgacaaataagagcagacagtatgaggtggggtgaattaaggatgcccacactgttttctgttattcttcccattgacaggtggattgctttattctcctcttgaatctgaccagcacagtgactatgtgaccaatagaaaagcctaattttcagtaaaacagaagcttccacttcttccctgatataacaattkcccttgggtatgtcaactcaaaactcaaccaccatgctttgtgaaatccaagccacttaaaaaggttacattaggcagtgagctacgcccccaagccaatagccagctccatccacttagccatgtcatgagccatctcatacatttcagcccaactgtgctctcagggaactgtagcctcagctgttattacatggagcagaaaaaccacctagtagagcccagtcaacccacagaactgtgactgacaataaaatgattcttgtttctagctcctgtatcttgtagcaagaatatata

SEQ ID NO: 86146 - DNA, 601 bp, Human
acaatgtgaatttaaaaaaaatcattttggttcaagaaatatgtattaaggatctctgatgagctagacacaaagttaggtactgaagataaaataaataaagcaggcagagtcccctaccttaagaaaattacaggctggtaaactctcaacaggagaaatattggatatatcaaatatagttccttcccctgagaaacgcagactggttggtgagacagacaaatagattttatgatttcagaacaatgtagtaaatgttaaagtattacagaatgctatggaataatggagagatgaraggctcattcaccctgggaaataaaggaagcctttctggagaagacaaagagttgtgtagatagtcatttgagaggcaagactggggggaaggggagaggctagaaggctatttcaggaattctataaagagatgatcaaggcatgaacaaaggctatgggtgacaaataagagcagacagtatgaggtggggtgaattaaggatgcccacactgttttctgttattcttcccattgacaggtggattgctttattctcctcttgaatctgaccagcacagtgactatgtgaccaataga

SEQ ID NO: 86147 - DNA, 601 bp, Human
ctccctattcacaaataattatctagcccaaaatgtcaagaattccactgctgaacaactctgccttaaagccttagctgcatcagcagctcacaggagactcacaggcacgcctactcccgcacgccatcttagacctactgaattagaattctctgaagtggggcctggggttggtgttttaacacactctccgtgtgaatcttatacacactacagttcaagaatcacactctaggtagagccaaccttgacgtcaaagaaatctcgagttcttgttctgcaccaagcattgggatcsctgatacagaaaaaagcagctcaaattcaatgtttgagtaagcacttgacttcagccttcaggatacaacctgctaggcctccaggtgaataatttaacttgttttctctttattagcactattccagaaaaaaattgacctgtaaggttcatagtccaaagcaacaagtctttaatgtacaatccttttcttagccctggagcttggagattatttcttcaagtttaaagctaggaaatagagcagtgttttggtgcattgcccactagagagactggagtagagaccaatgcaggaaa

SEQ ID NO: 86148 - DNA, 601 bp, Human
ttacttggacattttatccatccttcatggttttaaatatatgccaatgccttccaaatccagatcattccactgggctttgatatttaaagaactggatgttcatggtgccccataagccagttaagctcagcagactctaaaactgaccttgtcatccaccacccaaacttactcagtgatacctcaatccacagccatccagataccctagaccagtggttctcaacatgcaatgactgtgctccaccaggggatatttcgctatgcctggagatgcatttagctgtcacagctaggrggcagggtatgactggcacccagtgggtaaagaccagggttgctgctaaacatcctacaatgcacaggaaagctccctattcacaaataattatctagcccaaaatgtcaagaattccactgctgaacaactctgccttaaagccttagctgcatcagcagctcacaggagactcacaggcacgcctactcccgcacgccatcttagacctactgaattagaattctctgaagtggggcctggggttggtgttttaacacactctccgtgtgaatcttatacacactacagttcaagaat

SEQ ID NO: 86149 - DNA, 601 bp, Human
ctactgacatcacctcccttttctccttgacacactctcctccattgctgcctgaaacatctttttctccttgtccttctcttatatccccctatcattccttcttagatgcacactttcttcactcgccacttaatgagttagtgttccccaaggctctgtgttgcatccattgttcctcactgggtacatcatttacttggacattttatccatccttcatggttttaaatatatgccaatgccttccaaatccagatcattccactgggctttgatatttaaagaactggatgttcayggtgccccataagccagttaagctcagcagactctaaaactgaccttgtcatccaccacccaaacttactcagtgatacctcaatccacagccatccagataccctagaccagtggttctcaacatgcaatgactgtgctccaccaggggatatttcgctatgcctggagatgcatttagctgtcacagctaggaggcagggtatgactggcacccagtgggtaaagaccagggttgctgctaaacatcctacaatgcacaggaaagctccctattcacaaataattatctagcccaaaa

SEQ ID NO: 86150 - DNA, 601 bp, Human
caaggtgatctcctcgtcccatggtccttttttgaacttggtgttaccgaatctttcctctactgacatcacctcccttttctccttgacacactctcctccattgctgcctgaaacatctttttctccttgtccttctcttatatccccctatcattccttcttagatgcacactttcttcactcgccacttaatgagttagtgttccccaaggctctgtgttgcatccattgttcctcactgggtacatcatttacttggacattttatccatccttcatggttttaaatatatgccartgccttccaaatccagatcattccactgggctttgatatttaaagaactggatgttcatggtgccccataagccagttaagctcagcagactctaaaactgaccttgtcatccaccacccaaacttactcagtgatacctcaatccacagccatccagataccctagaccagtggttctcaacatgcaatgactgtgctccaccaggggatatttcgctatgcctggagatgcatttagctgtcacagctaggaggcagggtatgactggcacccagtgggtaaagaccagggttgctgc

SEQ ID NO: 86151 - DNA, 601 bp, Human
gctaattttgtaattttagtagagatggggtttctccatgttggtcaggctggtctcaaactcccaacctcaggtgatccacccgcctcagccttccaaagtgctggtaattacaggtgtgagccactgcgccctgccctcaaaccacatatattaaagtaaaaagaaaaagttgaaattaatattaataatgtatcttattcaactcactatattatcattttaatgtgcaatcaatataaaaattattattaatgagatatttcacattcttttttttcacagcaagtctgaaattcasagtgaatttaacacatatagcacatttcaggtcacactagccacacttcaaatgctcagtagacacagggagtcaatggccatcctgttgcacaaaacaggtttctgtggtcaaggtgatctcctcgtcccatggtccttttttgaacttggtgttaccgaatctttcctctactgacatcacctcccttttctccttgacacactctcctccattgctgcctgaaacatctttttctccttgtccttctcttatatccccctatcattccttcttagatgcacactttcttcactcgcc

SEQ ID NO: 86152 - DNA, 601 bp, Human
ccagctaattttgtaattttagtagagatggggtttctccatgttggtcaggctggtctcaaactcccaacctcaggtgatccacccgcctcagccttccaaagtgctggtaattacaggtgtgagccactgcgccctgccctcaaaccacatatattaaagtaaaaagaaaaagttgaaattaatattaataatgtatcttattcaactcactatattatcattttaatgtgcaatcaatataaaaattattattaatgagatatttcacattcttttttttcacagcaagtctgaaatycagagtgaatttaacacatatagcacatttcaggtcacactagccacacttcaaatgctcagtagacacagggagtcaatggccatcctgttgcacaaaacaggtttctgtggtcaaggtgatctcctcgtcccatggtccttttttgaacttggtgttaccgaatctttcctctactgacatcacctcccttttctccttgacacactctcctccattgctgcctgaaacatctttttctccttgtccttctcttatatccccctatcattccttcttagatgcacactttcttcactc

SEQ ID NO: 86153 - DNA, 601 bp, Human
accacacccagctaattttgtaattttagtagagatggggtttctccatgttggtcaggctggtctcaaactcccaacctcaggtgatccacccgcctcagccttccaaagtgctggtaattacaggtgtgagccactgcgccctgccctcaaaccacatatattaaagtaaaaagaaaaagttgaaattaatattaataatgtatcttattcaactcactatattatcattttaatgtgcaatcaatataaaaattattattaatgagatatttcacattcttttttttcacagcaagtytgaaattcagagtgaatttaacacatatagcacatttcaggtcacactagccacacttcaaatgctcagtagacacagggagtcaatggccatcctgttgcacaaaacaggtttctgtggtcaaggtgatctcctcgtcccatggtccttttttgaacttggtgttaccgaatctttcctctactgacatcacctcccttttctccttgacacactctcctccattgctgcctgaaacatctttttctccttgtccttctcttatatccccctatcattccttcttagatgcacactttc

SEQ ID NO: 86154 - DNA, 601 bp, Human
tgatccacccacctcggcctcccaaagtgctggaattacaggcatgagccaccatacctggtcgtatttatttttttgacagagttttgctcttgttacccaggcgggagtgcggtggcgtgatctcggctcactgcaacccctgactcccgggttcaagagagtctcctgcttcagtctcccaagtagctgggattataggtgggcaccaccacacccagctaattttgtaattttagtagagatggggtttctccatgttggtcaggctggtctcaaactcccaacctcaggtgatccrcccgcctcagccttccaaagtgctggtaattacaggtgtgagccactgcgccctgccctcaaaccacatatattaaagtaaaaagaaaaagttgaaattaatattaataatgtatcttattcaactcactatattatcattttaatgtgcaatcaatataaaaattattattaatgagatatttcacattcttttttttcacagcaagtctgaaattcagagtgaatttaacacatatagcacatttcaggtcacactagccacacttcaaatgctcagtagacacagggagtcaatggc

SEQ ID NO: 86155 - DNA, 601 bp, Human
cctcccgggttcaagcaattctcctgcctcagcctcccaagtagctggaattacaggcatgcgccaccacacctggctaattttgtatttttagtagatttggggtttcaccatgttggccaggatggtctcgaactcctgacctcaggtgatccacccacctcggcctcccaaagtgctggaattacaggcatgagccaccatacctggtcgtatttatttttttgacagagttttgctcttgttacccaggcgggagtgcggtggcgtgatctcggctcactgcaacccctgactcccrggttcaagagagtctcctgcttcagtctcccaagtagctgggattataggtgggcaccaccacacccagctaattttgtaattttagtagagatggggtttctccatgttggtcaggctggtctcaaactcccaacctcaggtgatccacccgcctcagccttccaaagtgctggtaattacaggtgtgagccactgcgccctgccctcaaaccacatatattaaagtaaaaagaaaaagttgaaattaatattaataatgtatcttattcaactcactatattatcattttaatgtgca

SEQ ID NO: 86156 - DNA, 601 bp, Human
aattagccgggcgtgctggcgtgcgcctgtagtctcagctacttggggaggctgaggcagtagaatcgcttgaacctggaaggtggaggtttcagtgagccaagatcgcaccattgcactgcatcctgggcgacagagcgagactccatctcaaaaaaaaaattacataatggactttggggacttaggggtagggaaagtttgggagggggtgagggataaaagactacaatagttagtagtcttaggtgatgggtgcaccaaaatctcagaaatgaccactaaacaacttatccctgtraccaaaagcacctgtaccccaaaaactattgaaatagaaattaaaaaaattttaaaacagtatgaattattaatgcattaggaggcaaagacagtgaaatgtcagaaagaaagacacttatgactgcggttggaattcatacagtgtttcattatttccaaaggtagtccccatctattatctcacgtaaacctccagacaacccagtgggtaggcgttattattgcaacgtgattcttactcccattttgcaggaaaaaaggaggaggctgaaagaggttgaaaatagatacaagttaa

SEQ ID NO: 86157 - DNA, 601 bp, Human
aggtcaggagtttgagaccagcctggctaacgtggcgaaacccgtgtctactaaaaatacaaaaattagccgggcgtgctggcgtgcgcctgtagtctcagctacttggggaggctgaggcagtagaatcgcttgaacctggaaggtggaggtttcagtgagccaagatcgcaccattgcactgcatcctgggcgacagagcgagactccatctcaaaaaaaaaattacataatggactttggggacttaggggtagggaaagtttgggagggggtgagggataaaagactacaatagttrgtagtcttaggtgatgggtgcaccaaaatctcagaaatgaccactaaacaacttatccctgtaaccaaaagcacctgtaccccaaaaactattgaaatagaaattaaaaaaattttaaaacagtatgaattattaatgcattaggaggcaaagacagtgaaatgtcagaaagaaagacacttatgactgcggttggaattcatacagtgtttcattatttccaaaggtagtccccatctattatctcacgtaaacctccagacaacccagtgggtaggcgttattattgcaacgtgattc

SEQ ID NO: 86158 - DNA, 601 bp, Human
tgcgactctgtggtaataaagaatatgaattatgcttacaattgcaaagatatggaacaaacctaagtgcccatcagccaatgagtggatcaagaaaatgtggtagatatacaccacggaatactattcagtcataaaaaggaacaaaatgatgtcttgcagcaacttagatgaagctggaagccattattcgaagcgaagtaactcgggaatggaaaaccaaatatcgttatgttctcacttataagtgggagctaagctatgacgatgcaaaggtataagaatgatacaatgggccggrcacagtgactcacgcctgtaatccccgcactttgggaggccaaggcgggtggatcacttgaggtcaggagtttgagaccagcctggctaacgtggcgaaacccgtgtctactaaaaatacaaaaattagccgggcgtgctggcgtgcgcctgtagtctcagctacttggggaggctgaggcagtagaatcgcttgaacctggaaggtggaggtttcagtgagccaagatcgcaccattgcactgcatcctgggcgacagagcgagactccatctcaaaaaaaaaattacataatggactt

SEQ ID NO: 86159 - DNA, 601 bp, Human
cccaaaaggcttgttaaaacacagactgacaatccctgcccctcactttctgattcagtaggatgcatatgggcctgagaatgtgcatattttggccctatctcaagtgatagtgatgatgctggtccagaaaccacactttgagaaccacagcacaaaggttacccagtgcccttccttgtttaatagtgactcattttccacacttcagccttcagcagtagtgaaacatgagtcactgttaagttctcacgatgaaattctcactattagttcagcactattaagtgactcatgttcsacacttcagtggtagattctgtgttcagcaggtcccacattttgaaatttggggtgaattcttcctgcgactctgtggtaataaagaatatgaattatgcttacaattgcaaagatatggaacaaacctaagtgcccatcagccaatgagtggatcaagaaaatgtggtagatatacaccacggaatactattcagtcataaaaaggaacaaaatgatgtcttgcagcaacttagatgaagctggaagccattattcgaagcgaagtaactcgggaatggaaaaccaaatatcgttatgt

SEQ ID NO: 86160 - DNA, 601 bp, Human
tggaaacgggattgctgggttgaatatttctgtctttaggtcttcgagaaattgccacattgtcttccacaacagctgcactaatctacattcccaccaacagtgtataagcctcgatcagaatcacccaaaaggcttgttaaaacacagactgacaatccctgcccctcactttctgattcagtaggatgcatatgggcctgagaatgtgcatattttggccctatctcaagtgatagtgatgatgctggtccagaaaccacactttgagaaccacagcacaaaggttacccagtgcccwtccttgtttaatagtgactcattttccacacttcagccttcagcagtagtgaaacatgagtcactgttaagttctcacgatgaaattctcactattagttcagcactattaagtgactcatgttcgacacttcagtggtagattctgtgttcagcaggtcccacattttgaaatttggggtgaattcttcctgcgactctgtggtaataaagaatatgaattatgcttacaattgcaaagatatggaacaaacctaagtgcccatcagccaatgagtggatcaagaaaatgtggtagata

SEQ ID NO: 86161 - DNA, 601 bp, Human
cgtgtccttataatagaacgatctatattcctttcggtatatacctggaaacgggattgctgggttgaatatttctgtctttaggtcttcgagaaattgccacattgtcttccacaacagctgcactaatctacattcccaccaacagtgtataagcctcgatcagaatcacccaaaaggcttgttaaaacacagactgacaatccctgcccctcactttctgattcagtaggatgcatatgggcctgagaatgtgcatattttggccctatctcaagtgatagtgatgatgctggtccasaaaccacactttgagaaccacagcacaaaggttacccagtgcccttccttgtttaatagtgactcattttccacacttcagccttcagcagtagtgaaacatgagtcactgttaagttctcacgatgaaattctcactattagttcagcactattaagtgactcatgttcgacacttcagtggtagattctgtgttcagcaggtcccacattttgaaatttggggtgaattcttcctgcgactctgtggtaataaagaatatgaattatgcttacaattgcaaagatatggaacaaacct

SEQ ID NO: 86162 - DNA, 601 bp, Human
gttcaaggatacacatgcagatttgttacacaggtaaacttgtgccatgggggtttgttgtacaggttatttcatcacccaggtattaagcctagtgcctattagttactttccagactctcttcctcctcccaccctccaccctctgcaaggccccattgtgtgtttttccactctatgtgtccatgtgttctcatcatttagctcccacttttaagtaataatatatgatatttggttatctgttcctgtgttagtttgctaaggataatggcctccagctccatccatgtccctgcamaggacatgatctcatccttttcttatggctgcatagtattctgtggagtatgtgtaccacattttcttgatccactctatcactgatgggcaaatatttaggttgattccatatgtttgctattgtgaacagtcctgcaagaacatacacatgcccgtgtccttataatagaacgatctatattcctttcggtatatacctggaaacgggattgctgggttgaatatttctgtctttaggtcttcgagaaattgccacattgtcttccacaacagctgcactaatctacattcccaccaa

SEQ ID NO: 86163 - DNA, 601 bp, Human
agcacgagggcagggttctcaacttttcttttacttttaagttcaaggatacacatgcagatttgttacacaggtaaacttgtgccatgggggtttgttgtacaggttatttcatcacccaggtattaagcctagtgcctattagttactttccagactctcttcctcctcccaccctccaccctctgcaaggccccattgtgtgtttttccactctatgtgtccatgtgttctcatcatttagctcccacttttaagtaataatatatgatatttggttatctgttcctgtgttagtttsctaaggataatggcctccagctccatccatgtccctgcaaaggacatgatctcatccttttcttatggctgcatagtattctgtggagtatgtgtaccacattttcttgatccactctatcactgatgggcaaatatttaggttgattccatatgtttgctattgtgaacagtcctgcaagaacatacacatgcccgtgtccttataatagaacgatctatattcctttcggtatatacctggaaacgggattgctgggttgaatatttctgtctttaggtcttcgagaaattgccacat

SEQ ID NO: 86164 - DNA, 601 bp, Human
aaataaaatgtgtggaattaaggaataaatgaatggagaggaaatcacccaggatcacaatcaagggtgatatttacattctaaagcaggggttgacaatccatggcttgtggaccaaatcctccccacagcctcttttatatagccccaaaacacagccaagccctttcctgtattgtctgtggctgcctttgtgctatagcagcagaatgtgtggcctcttggtttgccaagcctaaaatattgactatctgggcttttacataaaacacttgccaattgctgctttacaatactttcyggtagcttatcaaaataatcttgggatcttttaaatatgcagcaccttaagcccagaatctgaattttaactagtttcccaaggttcgagaatccttgcacttatagagaattgatctgatttgacaagcacgagggcagggttctcaacttttcttttacttttaagttcaaggatacacatgcagatttgttacacaggtaaacttgtgccatgggggtttgttgtacaggttatttcatcacccaggtattaagcctagtgcctattagttactttccagactctcttcctcctccc

SEQ ID NO: 86165 - DNA, 601 bp, Human
tgtccagtccatgtctagcacacagctgagacccaataaaataaaatgtgtggaattaaggaataaatgaatggagaggaaatcacccaggatcacaatcaagggtgatatttacattctaaagcaggggttgacaatccatggcttgtggaccaaatcctccccacagcctcttttatatagccccaaaacacagccaagccctttcctgtattgtctgtggctgcctttgtgctatagcagcagaatgtgtggcctcttggtttgccaagcctaaaatattgactatctgggcttttamataaaacacttgccaattgctgctttacaatactttctggtagcttatcaaaataatcttgggatcttttaaatatgcagcaccttaagcccagaatctgaattttaactagtttcccaaggttcgagaatccttgcacttatagagaattgatctgatttgacaagcacgagggcagggttctcaacttttcttttacttttaagttcaaggatacacatgcagatttgttacacaggtaaacttgtgccatgggggtttgttgtacaggttatttcatcacccaggtattaagcctag

SEQ ID NO: 86166 - DNA, 601 bp, Human
gcaacatattcacagcatggacatcttagggaagccattattcttcctatcacacgtgaaattatttagcacaacgtctggcttatagtgtgtgcttaataattgtcaggaactatattactattattaaatgtgattcaagagtatgagaaggaaatgccaaatcctctggaccaataagcatgcaaatataaaccaagttaggtgtaaatcctgggaatactcaggtctcagggaactactccaaatgatgtacaaacctagagtttccatttaggcaaaaggttctaataaagtaagrcttcttcactaaatactatcagttgcatactcacacgctggcagaacaaagactgcagggtgtttcagcatctccataccaacagctagaacagattcctctcctaaccctctgtgccgtatcaaccagctggtctagtctgactcacaaatggctacagcctggtggtaaacggaactttgttaaccatttgcaaaaaattccaggcaactggggagatggaacaaaaatgccccccaaagctgcctcaatatcattaaaagttgggcagtgaggaagccaggaaatagaacacaaagc

SEQ ID NO: 86167 - DNA, 601 bp, Human
cccctttacactataagcaacatattcacagcatggacatcttagggaagccattattcttcctatcacacgtgaaattatttagcacaacgtctggcttatagtgtgtgcttaataattgtcaggaactatattactattattaaatgtgattcaagagtatgagaaggaaatgccaaatcctctggaccaataagcatgcaaatataaaccaagttaggtgtaaatcctgggaatactcaggtctcagggaactactccaaatgatgtacaaacctagagtttccatttaggcaaaagkttctaataaagtaaggcttcttcactaaatactatcagttgcatactcacacgctggcagaacaaagactgcagggtgtttcagcatctccataccaacagctagaacagattcctctcctaaccctctgtgccgtatcaaccagctggtctagtctgactcacaaatggctacagcctggtggtaaacggaactttgttaaccatttgcaaaaaattccaggcaactggggagatggaacaaaaatgccccccaaagctgcctcaatatcattaaaagttgggcagtgaggaagccagg

SEQ ID NO: 86168 - DNA, 601 bp, Human
cacttctgtggttctgaaatgtgaaatgggtctcgctggactaaaatcaaggtgtcagcaggattgctttcctttccggaggccgtaggggagaatccacttccttgacttttccacctttcagaggctgcccacattcctcggcttatgactccttccttcatcttcaagccagcaccactgcatctctctgactcttccatcttcacatctttctctgtccacatcctggaaaagctcttcacttttgaggattcacaggattaagttggtcccaccttgctaatccaggatcatccgmatctcaaggtactaaaccctgaatctcacaactgcaaagtcccctttacactataagcaacatattcacagcatggacatcttagggaagccattattcttcctatcacacgtgaaattatttagcacaacgtctggcttatagtgtgtgcttaataattgtcaggaactatattactattattaaatgtgattcaagagtatgagaaggaaatgccaaatcctctggaccaataagcatgcaaatataaaccaagttaggtgtaaatcctgggaatactcaggtctcagggaactactc

SEQ ID NO: 86169 - DNA, 601 bp, Human
gttcattttctattgctgctatgacaaattaccatcaacttggcgggggcttaaataatcctcacttattgtcttacacttctgtggttctgaaatgtgaaatgggtctcgctggactaaaatcaaggtgtcagcaggattgctttcctttccggaggccgtaggggagaatccacttccttgacttttccacctttcagaggctgcccacattcctcggcttatgactccttccttcatcttcaagccagcaccactgcatctctctgactcttccatcttcacatctttctctgtccayatcctggaaaagctcttcacttttgaggattcacaggattaagttggtcccaccttgctaatccaggatcatccgcatctcaaggtactaaaccctgaatctcacaactgcaaagtcccctttacactataagcaacatattcacagcatggacatcttagggaagccattattcttcctatcacacgtgaaattatttagcacaacgtctggcttatagtgtgtgcttaataattgtcaggaactatattactattattaaatgtgattcaagagtatgagaaggaaatgccaaatcct

SEQ ID NO: 86170 - DNA, 601 bp, Human
agggaatcgtcaaatatccaaatggagtttcataccatggagcttacatgaatttacagtacaagtgtggccctggaaccagtgacccaatcctgcatctaccacttgataaatatgggaccttgcacaattactcagccttgaattcttcttcctgaaaatgtgaccactgttagtgcttaattgaggttcttgtgacaatttaatgggatcagccatggtgcgttcattttctattgctgctatgacaaattaccatcaacttggcgggggcttaaataatcctcacttattgtcttayacttctgtggttctgaaatgtgaaatgggtctcgctggactaaaatcaaggtgtcagcaggattgctttcctttccggaggccgtaggggagaatccacttccttgacttttccacctttcagaggctgcccacattcctcggcttatgactccttccttcatcttcaagccagcaccactgcatctctctgactcttccatcttcacatctttctctgtccacatcctggaaaagctcttcacttttgaggattcacaggattaagttggtcccaccttgctaatccaggatcatccgc

SEQ ID NO: 86171 - DNA, 601 bp, Human
gttctgcatctcgatctgtgtggtcacaattgtatatatgtgtaaaaattcattgagctttacacttaagattcatgcattatactatatgtaagctatgcctccataaagtaccactgaaacataaacaaaaggcttttagataattactacaggtttattaaccttcagcctctgtatatttattgagaatctgctattcaataattcatccattcaacagatatttactatatagctactctgtgccaggtactattctaggcactggagtatagcaatgatggacaaactccctgcytcatggggcttgcattttagagctatgtgccagacatagtgccatgtcctggtggaggagaggaagtgcttgtggtgcaggaatgaaagaactcacagtctagtggacagacagacacaaagtcacaccgcaccatgcagtaagtgctgtgatagggcatgtggtgtcttgatgcacagcaggaaggggccacgtgggttgattgcaaatttggagagggctcccaagaaaacacaacacagcctgaggatgaagcagcagagattgcaggtgactctttggaggaggcaacagcatcct

SEQ ID NO: 86172 - DNA, 601 bp, Human
ccccccacccctgacaggccccagtgtgtgatgttcctctccctatgttcatgtattctcattgttcaacttccacttatgagtgaaaacatgtggtgttaaacaattttttaaaaaatgttctgcatctcgatctgtgtggtcacaattgtatatatgtgtaaaaattcattgagctttacacttaagattcatgcattatactatatgtaagctatgcctccataaagtaccactgaaacataaacaaaaggcttttagataattactacaggtttattaaccttcagcctctgtatayttattgagaatctgctattcaataattcatccattcaacagatatttactatatagctactctgtgccaggtactattctaggcactggagtatagcaatgatggacaaactccctgcctcatggggcttgcattttagagctatgtgccagacatagtgccatgtcctggtggaggagaggaagtgcttgtggtgcaggaatgaaagaactcacagtctagtggacagacagacacaaagtcacaccgcaccatgcagtaagtgctgtgatagggcatgtggtgtcttgatgcacagca

SEQ ID NO: 86173 - DNA, 601 bp, Human
acaactatctggtctttgacaaacctgacaaaaagaagcaatggggaaaggattccctatttaataaatggtgctgggaaaactgcctagccatatgtagaaagctgaaactggatcccttccttacaccttatacaaaaattaatccaagatggattaaagacttatatgttagacctaaaacgataaaaaccctagaagaaaacctaggcaataccattcaggacataggcatggtcaaggacttcatatctaaaacaccaaaagcaatggcaacaaaagccaaaattcacaaatgggrtctaattaaactaaagagcttctgcacagcaaaagaaaccaccatcagagtgaacaggcaacctacagaatgggagaaaattttcgcaacctactcatctgacaaagggctaatatccagaatctacaatgaactcaaacaaatttacaagaaaaaaacaaacaaccccatcaaaaagtgggcaaaggatatgaacagacacttctcaaaacaagacatttatgcagccaaaaaacacatgaaaaaatgctcatcatcactggccatcagagaaatgcaaatcaaaaccacaatgagata

SEQ ID NO: 86174 - DNA, 601 bp, Human
gataatttttgtatttttggcagagatgaggttttgccaatgtcgtccaggctagtctcaaactcctggactaaagtgatcctcctgcctcagtctcccaaagtgctgggattacaggcatgagccaccgcacccagctgtaattttcttagtctcaatttcctgagttatacacttgagctaataacatttaccattcaagcgagtttgttattgttgttgtcatttacgtgcaatttaatggatgtaaaatactcagcactatagtgcttggtatatagcaagcattcaatatatgtaygactttagcacccaaaagactattagaaaagtacagtacttattcacgtactcgtttacttaatggctctttattaagcctcaaccatgtaccaagaactactatctcactgaagctgtggtcccggaggaagacattccaagtctgaatctctggttaccactctgatggaaatacgcagctacaacccaatagaaggtcacatgctccagacagggaactcatctaatgatatgggggtgcaggggtgggggatcactaggagagtgcaggagtaaagaggtttctacacttatccta

SEQ ID NO: 86175 - DNA, 601 bp, Human
agtagcagggactacaggtgtgttccaccacacctggataatttttgtatttttggcagagatgaggttttgccaatgtcgtccaggctagtctcaaactcctggactaaagtgatcctcctgcctcagtctcccaaagtgctgggattacaggcatgagccaccgcacccagctgtaattttcttagtctcaatttcctgagttatacacttgagctaataacatttaccattcaagcgagtttgttattgttgttgtcatttacgtgcaatttaatggatgtaaaatactcagcactayagtgcttggtatatagcaagcattcaatatatgtatgactttagcacccaaaagactattagaaaagtacagtacttattcacgtactcgtttacttaatggctctttattaagcctcaaccatgtaccaagaactactatctcactgaagctgtggtcccggaggaagacattccaagtctgaatctctggttaccactctgatggaaatacgcagctacaacccaatagaaggtcacatgctccagacagggaactcatctaatgatatgggggtgcaggggtgggggatcactagga

SEQ ID NO: 86176 - DNA, 601 bp, Human
tctgcctcctgggctcaaaccatcctcccacctcaacctcccaagtagcagggactacaggtgtgttccaccacacctggataatttttgtatttttggcagagatgaggttttgccaatgtcgtccaggctagtctcaaactcctggactaaagtgatcctcctgcctcagtctcccaaagtgctgggattacaggcatgagccaccgcacccagctgtaattttcttagtctcaatttcctgagttatacacttgagctaataacatttaccattcaagcgagtttgttattgttgttktcatttacgtgcaatttaatggatgtaaaatactcagcactatagtgcttggtatatagcaagcattcaatatatgtatgactttagcacccaaaagactattagaaaagtacagtacttattcacgtactcgtttacttaatggctctttattaagcctcaaccatgtaccaagaactactatctcactgaagctgtggtcccggaggaagacattccaagtctgaatctctggttaccactctgatggaaatacgcagctacaacccaatagaaggtcacatgctccagacagggaac

SEQ ID NO: 86177 - DNA, 601 bp, Human
actttatttttatttatgtatttatttcagacaaggtctggctctgttacccaggctggagtgcaatggcatgatctcagctccctgcaacctctgcctcctgggctcaaaccatcctcccacctcaacctcccaagtagcagggactacaggtgtgttccaccacacctggataatttttgtatttttggcagagatgaggttttgccaatgtcgtccaggctagtctcaaactcctggactaaagtgatcctcctgcctcagtctcccaaagtgctgggattacaggcatgagccaccrcacccagctgtaattttcttagtctcaatttcctgagttatacacttgagctaataacatttaccattcaagcgagtttgttattgttgttgtcatttacgtgcaatttaatggatgtaaaatactcagcactatagtgcttggtatatagcaagcattcaatatatgtatgactttagcacccaaaagactattagaaaagtacagtacttattcacgtactcgtttacttaatggctctttattaagcctcaaccatgtaccaagaactactatctcactgaagctgtggtcccggag

SEQ ID NO: 86178 - DNA, 601 bp, Human
tcatgccctgcatgtctccccataggagctcataataggcttgtaggttccacctgattctgaaaatcaagttatggcaccgaggttttggaatcacttcaatctatttgcagagtgagcctggttagtatttaaatatgccacccaagctaccgatgtgcaacgtatcaactcttcacctgggatgatttattccaggagtcgccgttctgacttagtacacaggctttccactgtgctaaagcaaggagcccaaagaactagagggcttgccaatggttttcttgtggttttattcgtstactaattaaaaacattggccaggcatggcggctcacgcctgtaatcctaacactttgggaggctgaggtgggtatatcacctgaggtcaggagttcgagaccagcctggccaacatggtgaaaccccatctctactaaaaatacaaaaactacctgggcgtggtggcgcatgcctgtgatcccagctactcagaggatgaagcaacagaatcgcttgaacccgggaggcagaggttgcattgagccaaaatcgggccactgcactccagcctcggtgacagagcgagatttcatctcaa

SEQ ID NO: 86179 - DNA, 601 bp, Human
acaaccatctcccttttaagtcactgaacaactgctaggagcctctgagccatgctaccccagaataccccagaatactcattcctattcaaatatttggttttcagtgttacaaggacaagtattcatttggaccagagaaataggctggatttgcactcatctgtcacagtgccctgaaatcagcctcaaatgattcacagccctcttgaaaacatctccaatctcctaagagataaaaagcctcactcattttcccacccctgacccaccaaccagcttccatccctaaacctagagsgaaattatgatgttctgtctcctcctcctatttctattcctcatgccctgcatgtctccccataggagctcataataggcttgtaggttccacctgattctgaaaatcaagttatggcaccgaggttttggaatcacttcaatctatttgcagagtgagcctggttagtatttaaatatgccacccaagctaccgatgtgcaacgtatcaactcttcacctgggatgatttattccaggagtcgccgttctgacttagtacacaggctttccactgtgctaaagcaaggagcccaaagaa

SEQ ID NO: 86180 - DNA, 601 bp, Human
acactaaagcataaactgccttaacagactagaaaatcgatacaagcatgggcttgttcactgatacatcccttgtgctggctgtacagaaggtgccagtgaatatttgttagataaatgaattaatgaataaatacagaggagttggtagggaaaaggcacaaaatgagcagaattggtgctaatttatgttgaatcagacaaatgttcagcttatgccccaaatttttacaaccatctcccttttaagtcactgaacaactgctaggagcctctgagccatgctaccccagaatacccyagaatactcattcctattcaaatatttggttttcagtgttacaaggacaagtattcatttggaccagagaaataggctggatttgcactcatctgtcacagtgccctgaaatcagcctcaaatgattcacagccctcttgaaaacatctccaatctcctaagagataaaaagcctcactcattttcccacccctgacccaccaaccagcttccatccctaaacctagagcgaaattatgatgttctgtctcctcctcctatttctattcctcatgccctgcatgtctccccataggagct

SEQ ID NO: 86181 - DNA, 601 bp, Human
cttgaatgctgacttgccacaaagccatggctccctcttgctgatgtgggcaatgttggtcttctgagatcatctttcttggcaaaccagaccgtgaattgccaaatttactactcctcatgcccatcaatgaccacacagacacatgcacacacacacacaggttcaaccccacttccatatctttagcaatggtctcctggggctctgttcccacggattttatctggcacagtatgtctgaggtgtgacccagaaatccgtatttttaagtagattctgaagcaaatagtctgcaaaytggtactaggacagaccccatgggatggaagcactttgccaaagtgaactatcaggaattacagagagctggggaaagaatgcttgctgtgtattaggtttcagttgcatatattcgtttgcataccagattgcaagcagagggcagaaattagaacctgaatagcttcataccttacctccacctgtctccaagccacatatagtatgtgctaaataaacactaaagcataaactgccttaacagactagaaaatcgatacaagcatgggcttgttcactgatacatcccttgtgctgg

SEQ ID NO: 86182 - DNA, 601 bp, Human
catgcaattaacttccaatacatttagttgttatcataattgccattaataacatccagcctgacctgaacttactactaaatccatcctccttgaatgctgacttgccacaaagccatggctccctcttgctgatgtgggcaatgttggtcttctgagatcatctttcttggcaaaccagaccgtgaattgccaaatttactactcctcatgcccatcaatgaccacacagacacatgcacacacacacacaggttcaaccccacttccatatctttagcaatggtctcctggggctctrttcccacggattttatctggcacagtatgtctgaggtgtgacccagaaatccgtatttttaagtagattctgaagcaaatagtctgcaaattggtactaggacagaccccatgggatggaagcactttgccaaagtgaactatcaggaattacagagagctggggaaagaatgcttgctgtgtattaggtttcagttgcatatattcgtttgcataccagattgcaagcagagggcagaaattagaacctgaatagcttcataccttacctccacctgtctccaagccacatatagtatg

SEQ ID NO: 86183 - DNA, 601 bp, Human
gggcttggaggagggaatgaatgaaggcagaaaagcaggcccagagaaatctcactaaagcaactccagaaaagagagaaagatctgaactaggattgctgcaatacagatacacaaaagagaggttcaagagatgtttaggaggtacattcaactggtcttggcaactcatggatcggattggcagggagattggggagtgaaagaggattgccaagtgaatggtgatgtcacttacaaaagtggagaacaggttagggaccctgctttcttcctcacaattgtagctccagcacctagycttgtacctgacatacagtagccactctgtaaatgttttttgaatgaatgagtgagcaagggtggaagtgagtataggtagggggacagagaaatgcatatggaattcaggtttaggttagctgcttttgaaacctccctgcagggagtccaccaagaaggtggataggcaggtctgaagatgagaaaggggtcagggctgaggcttgagatttagaagttgtctatctgctgggggcggtagttgttgacagctgtgcatggcatcccctaacaaaagaaggagagtgtgtgtggaaaa

SEQ ID NO: 86184 - DNA, 601 bp, Human
agagagaaagtcaggcaacaagaaagtgagagaaaaagggaaaaaggaagaaaaagagggaggaagaaagagcatggaaaggaggaaggatggagagacacagacagggagtgaaaaaaagagacaaggagttaatgctttctggggttgacgagaagaatccatgaaagaattttttagcagcggtgtgacatgagcaagtttttatcttcgggaaggaccacttgagcttgagtatgaggaagggcttggaggagggaatgaatgaaggcagaaaagcaggcccagagaaatctcactraagcaactccagaaaagagagaaagatctgaactaggattgctgcaatacagatacacaaaagagaggttcaagagatgtttaggaggtacattcaactggtcttggcaactcatggatcggattggcagggagattggggagtgaaagaggattgccaagtgaatggtgatgtcacttacaaaagtggagaacaggttagggaccctgctttcttcctcacaattgtagctccagcacctagccttgtacctgacatacagtagccactctgtaaatgttttttgaatgaatgagtgag

SEQ ID NO: 86185 - DNA, 601 bp, Human
taaaacaggaaaagcaatttccaccaacttcatagatcagatgagctcatgtacagtagctgtttactgattatttattgcattccgatcatttcttccacattatctcattcagtctttaacgaaaccccatgaagaaggtagtattaatgtctaatgtcaaaactaattaatttaaattttactggattccaaaacccttgctcttcaccactgacaacgtgcacctccctccttatcggtgcttaacctgtgagctccctttcctttacctggtcattctcccatatattcagatacsatctgaagatcaacccttccccagcacagtgcttcctccatcaccagcttcttcctctggaagcaatgcatccacagcagaagaatgcaccctgaactaatgccaggagatttagcaacctaatctgcactgttttcctggagcataatattctgctcgcaaatcactccccccactgaagctaacacaatacagagcatcctttaacttatgtaaataagcatcttatgggcatccgatttattcacctctcattgctttggagaccagcagaccaaatacagaatatcatctgcccct

SEQ ID NO: 86186 - DNA, 601 bp, Human
gaatgaatgaatggatggatgaatggatagacggacagatggatggatgggtagacgggtgggtggatggatgaatggagagatgggataaacagatggacagatggatggacagatggatggatggacagataaatggatgggtggttggatggatggacggacagataaatggatggatgggtgggtgggtggatggatggatggatggacagatgaacagatggacggatgggtggatgtgacatgagttgtgggtataagagattgaagaaataaacgaacatccagtgagaaaggsagtggctgagttagtagcacagtgatgggttagagagggcagggtataagtgagagctggatgaacagggggtgtgaaatgagggggctcagaggtagaactgagtgtctgcagtgtgagaatccattgctacccaaactctcacaatctgaaggcaggaaagtaataaacaattctgaggagggttgggctggcattcttcactgtctgaacccttgttacttgctctctaggattcaggaaccaaacagattcaggcaaagtggattccttctctatcaaaacccaggaaaggaattg

SEQ ID NO: 86187 - DNA, 601 bp, Human
tatttctattcccattctacagttaaggaagttggggcttagagagaggcagttctcaaactccaatgagcataagaatcaccttggatcttgttaaaacacagcgggtgggggctggggcattgcaagcaagctcccgagtggcatcagttgctgctagtccatggaccaagctttcagtagcaaagttctagaggtcaagtcacatggcatgcccaatatcatgctgcaagcatctctcagagtgatggttctgacccaggggtcctggtgccaggtgacctctgtccatcccagggargactaggcaatgacataagacagtgtctgatgtctaacattctcaccaccgtgtgtttccttcaggtatatcacaggtatgtcatgcctgtcagtccccatcgtcttatccagcaaaacactttcagttatgagtcagaacatactgcatgggagtaaaggaagaggggccaccctggggtgaaccgcctcactcctgggagagaactgaagccatccaggaacgagaagagcacagagagagaaggaagcaccggtcagtcctatggtgcccatggccatctgccaagcaaagaaaatg

SEQ ID NO: 86188 - DNA, 601 bp, Human
cctgttatcaaaggcacagacactggtaccaaatagagggttcaaatttcagctctttctcttactggtgtctgggccttggacaaaatccttactagctctgaggctccattttctcatttttttttttaaatggagggaattttattccctaccttaaagaggttgttgtgattgggataatgcatgtattactctgagcacataccgagagctccattaatgagagctgtgattatggtggctgttgtaatcaagaaagaatcaaccacaatgacagcaacaaaacccaaaacactamaacccacaaacacagcactaatgcaaatacaaacagctcccctgtggcttttttccacgtcttctaaatgacacaactttgcagcaccatggcaaaggagctcttatcgcgtgccaagcactgaggtgaaagcaggttgacaacccatcccaatgttaaacctgaatgttccgctttgcaggaaccctttcagtcctggacaaatcaggacaatcagtcgatcacacagagatcttcaagtgcatttatttaatcctcacactaatgtttcagggaatatttctattcccattctacagt

SEQ ID NO: 86189 - DNA, 601 bp, Human
tcaaccccacacccatttccacaacttattttcctgctgtctgccaagaaaaggaaataatggaggtaactcagcaacgatccagagagactcctggggaatttgcattctcctgttgaggattgcccttgtgagccctggtaagccctgatgtgctttctgttactctcatagtgtatcaactgagcatttcaacatattttatttcaatttccaggggtgagaggaaaagtaaaaacatcaaataagcctggtaagcctgaggattcagatggatagcattctcacgtgcacataagcwgaattggtcacactggaaaacaactactccaccaccacccacctccctcccccttcctctgtcatcatcatcctccatcatcatcacatccatcctcctcctcctcaccatcatcatcatgaccatcatcatagccaatatctctcttgggcatatccaatatgtagctctatatagcatacagtgggatgtcttattattatccctgcattaaagattttaatctggatcgtatgtggttgcctagttgcggagaggtgtgaatcttgcatgtccttcagactgacaattcttgagggt

SEQ ID NO: 86190 - DNA, 601 bp, Human
tagtttttcctctgtctcttctcaacagcagtatggttgagaagtaggtattcaagttagtatctttaaagccaagtacaatgtctgacacacactaggggcctgataagtacttggggaaggatgagaggggcaggaggcttacacccaagaagcatgagagaattggtcactattgtcaaccccacacccatttccacaacttattttcctgctgtctgccaagaaaaggaaataatggaggtaactcagcaacgatccagagagactcctggggaatttgcattctcctgttgaggaytgcccttgtgagccctggtaagccctgatgtgctttctgttactctcatagtgtatcaactgagcatttcaacatattttatttcaatttccaggggtgagaggaaaagtaaaaacatcaaataagcctggtaagcctgaggattcagatggatagcattctcacgtgcacataagctgaattggtcacactggaaaacaactactccaccaccacccacctccctcccccttcctctgtcatcatcatcctccatcatcatcacatccatcctcctcctcctcaccatcatcatcatga

SEQ ID NO: 86191 - DNA, 601 bp, Human
tgttttaaacacagagcgagggaggcaggagggtgtgggattctgggtgtctgctctagactctgtgtttcagtaccatcataactgaggactcattcaatcaggtctagagcattcaatcctgttccagaatgttccagagcttgctgggtccccagggtgacacctgactccatgggtaccaaagcctggtgtttcctagagcataatagcaacttacattccatttacccattcataaaggttacaaagcccatccacacccattatctctttgatcctaactactcaagagataacrcaagtggcataacactcatggatggcatttctcctaaagacacaggatgagaggttaaatgacttccctgagatctacatggccccatggtgatggcagctcagtcatcgtgagatgcatccagttttcccttgctcacatcagtggctctcattcctggctgcacatatgaatcccttgaagagttatcaaagaataacctatgcattgtgccccatgcaagtctgattgaaagggaatctctgtggcctgagtatctgaactttaaagctgatttattagtttttcctctgtctcttc

SEQ ID NO: 86192 - DNA, 601 bp, Human
ttctacatatcagcctctgaccacctctggcactcggcttccttagaatgtgcagctgggggagaggaacagatttcatacacccactttggttctgaagcaaaagcacttctctccccatgctcactgctctgcggaagacagaacaaactgttttaaacacagagcgagggaggcaggagggtgtgggattctgggtgtctgctctagactctgtgtttcagtaccatcataactgaggactcattcaatcaggtctagagcattcaatcctgttccagaatgttccagagcttgctgrgtccccagggtgacacctgactccatgggtaccaaagcctggtgtttcctagagcataatagcaacttacattccatttacccattcataaaggttacaaagcccatccacacccattatctctttgatcctaactactcaagagataacgcaagtggcataacactcatggatggcatttctcctaaagacacaggatgagaggttaaatgacttccctgagatctacatggccccatggtgatggcagctcagtcatcgtgagatgcatccagttttcccttgctcacatcagtggct

SEQ ID NO: 86193 - DNA, 601 bp, Human
attctacatatcagcctctgaccacctctggcactcggcttccttagaatgtgcagctgggggagaggaacagatttcatacacccactttggttctgaagcaaaagcacttctctccccatgctcactgctctgcggaagacagaacaaactgttttaaacacagagcgagggaggcaggagggtgtgggattctgggtgtctgctctagactctgtgtttcagtaccatcataactgaggactcattcaatcaggtctagagcattcaatcctgttccagaatgttccagagcttgctsggtccccagggtgacacctgactccatgggtaccaaagcctggtgtttcctagagcataatagcaacttacattccatttacccattcataaaggttacaaagcccatccacacccattatctctttgatcctaactactcaagagataacgcaagtggcataacactcatggatggcatttctcctaaagacacaggatgagaggttaaatgacttccctgagatctacatggccccatggtgatggcagctcagtcatcgtgagatgcatccagttttcccttgctcacatcagtggc

SEQ ID NO: 86194 - DNA, 601 bp, Human
ttcagagctgcctggttgaaactcttaaagcacccctttaaccatgccactgccctgctctatagtcatcaatagctcccataggcctaccatgttaagttcagactccctagcctacccatctatgtgcaccagctttatagttgaaataccatgagctctagggtctattgaacctaaattcaagtcctgcctctgagggactgtggctaacctagccagccccgtggctttgaaaaagtgcttaatctttctgggcctgagtttctttacctataagataggaataatgacccttccrtcacatgggtctgctgtgagaatgggatgaaaaggtagaagtgggagactcatctgtccacgcctgactttgacagtttgggtgcttgtctccacatcctcggtcctacagaccacacagacatcgtcagaaacctaagagggtcctcatcctatttcaagaactggcctctccaggtccactgacatgctggtttcaaatccccaccaccccatgcaaaccagctcattcattctgagcccaaggagcctgtataatgcaaagaagaaactgcctttccatacagcaatgaatccatgc

SEQ ID NO: 86195 - DNA, 601 bp, Human
ggtggatcagcatcttgcactaagtacacaaggaatacagaaagctctcaacaagacacacgctaaaggcaccattggaacctaataaaaagggtctatgagacacttccttgggaagattggtactggtggagaggtggaggtcagacatgccagatggtgatggaatgtgggatcctccaacacccttgctctatgtactctgagctagacatgaccagggtacccatgaaaaggtctgtgcacagagcaaagctgtaagcacacgcatcttatctggttctctacatgtagagaggarggcatggctgcactgtgaacttcctcaggagaaagataattggagggacagcagttaattggcccagagccagctcggcacaggccatctgtgaaagagtaggtgcaaaaacccttgctttgtgctgtctccaccccctgtcatgccaaacttcagcccaagctgaatctctcccattacccactatgctgatccccattcgcagcctctctgcagaaaatggagaatactagaacctctggggttggactacccagctccaatcctcattatgtggccttggatgggggggaaaaaaaa

SEQ ID NO: 86196 - DNA, 601 bp, Human
gaaaagaaagtaaaacagaggatgaggcaggaggtggtttatatagaagcacaaactgcgtcctagaagtaaggaaagtaaatcacacatcaatcatttgcagacattcctgagcatctactatatcccagactccagaacagatcctgcaaatacagagaggacagaagcccctgtactcaggagctcatagccaggtcctggaaggatgtctgtaattattgcttgcttatcatctattcttctcattttcctctagttcgtcctgccccttcctcctttgagtctatatggttctaayagaacaaactctatctgacccccaccccagctcatgaccggaaaatcaagccacggaaataaaacagcatcagcaaagacagttttctaacgatatatttggagcccctagagtctgccaagtatgaagccatttctcctggacccctttgttatacaagccagtgagtttctatgttcatttaaggagtttgagtagggtttctgtcacttgaacatacggctcccacataatacagagtatcataaataccatgtggacatctaccttttcaatcaacaaatatttatcgaacacctt

SEQ ID NO: 86197 - DNA, 601 bp, Human
ctgatttatctgagttccttcctgatatctggacaattatttaaaatgctgaaagtggcagtgtagaaacaggattactaaagagagtaaaaggacagaggacggagaaatgtcaaaggagcatgatttcttaattcaaggttcatttttcagatttatgttaattgtaagaagtatattctgtctacttcatcacacacacacacacacacacacacacacacacacacacacacactcctccagccccagttcagagataacctctgaactgtagcagattcaaagtcctaaagccttycagaaatatttcagagtgacatagtaccctgctggtaataaaccaacatggtttgttgactgtatttcccttttattattattatttttttgagatggaatctcactctgtcacccaggctgaagtgcagtggtgcgatctcagctcactgcaacctctgcctctccctcttgggttcaagtgattctcctgcctcagcctcatgagtagctgggatcacaggcatgctctaccacacctggctaacatttgtatttttagtatagacagggtttcaccatgttgaccaggctggtctca

SEQ ID NO: 86198 - DNA, 601 bp, Human
aatcctttttgtttttttgtttttaaatgctttctttggcctttctctagctccctgtcaagggcagcctggcaggtttccactattccctggggtgggcgtcagggaccgtgggagagtgtgggaaggagagactgcttgtgccttatccaaacttacacactgggtggacaccaccagccctgcatggatggagagatgtttcattaaacaccaagcagtggatggcgacttaccacgcttgatgcattgcttctctggggctgaaataccatttacaaaattactgtgtttaaaggcrtaactttgggaaattgcgcaacagcatttcacagcagcagaattttttaaaaaaagcatagaatccagggtggtcactggaaagggatctaaatgtcttgccaattatccttctagaattccttttcctgtatatgttatatttcaattgccctaaaattgatttatgtttccatcaaaattatatgtttctgaatattccagctgcagggcacatattatgatggaagtgagaattcattagcctcgtttgtgtctttgggctggcagcaatcctgcctctgtaagagactcccatgtc

SEQ ID NO: 86199 - DNA, 601 bp, Human
catagtagtaaccatttacagactgcttttccatacgccacacactggtctaagatgcaaatgcttttcttgtccccatattacacctgagggagccgacgtggagttcagtgactcacccaaggtccgaagtctaaaaaagtacagattaggttcgaacccatgcaacctggccccagtgcccatgctcttaaccgtgatgccactgcctcccagggggccctggccactcctgaactggacagattcttgtgatggaaccggacacaacagccgggattccaccagccaaacaggtcawggtttaccttcacaattttgggagttaacagtgacatggtctgtgcttggtgaaggaacagatgtttaataactgtgcagtagcaaggaggttatataacatggctgagctatttttaaactttggaaaatgctgactgctcttttcaaagtgtcttctgtaaaatcaggaatattaaacatgaagaaaatgtccccctttcctgtacttttttttgcctgaaactctatgtacagaaacggttgggtgtaaggtcatgaacataccttcccttgcaagcagcccctggtaccacgccca

SEQ ID NO: 86200 - DNA, 601 bp, Human
tctccatgtcctacttccctaactaaaatgggaaccacacagaacatacagttgtaattcagtaattaaagaatagaactgaaatgcacttccattgcttgctttcctagcttactcagagcttgcagtgtaacaagtataaagttataataatgatgatgatgaccacaataataagaaaaataaaattataataatgacctgatagttatttgtaaaatgccttctccatgcctggcaccatgctaaatgtatatactttaagatgttacaagaagaagagatgtctatcttacacacrcaccctctttaggaaaactcctgggttcacagttgttaataacttatacttggtaaatatgtggtaaattcatagtcaagtctgtcatactacctagaccatgaagttttcttgatgccacactgccctcttcccaatggccatatttctcccaaggtaatcctttggtaagagggttttggtctgaaaaacatccaccctctcccttctatgacctcctcttcagtaagtgtaaaatgtgtcccctccgctgtggaataagaaacacatatatgcatgcagagagaaagacacacacac

SEQ ID NO: 86201 - DNA, 601 bp, Human
atactaattcataactctcctgggataagactttttttgccccctcatttgtgctatagatctacttgagctcttctacttgatttccagtgcagtaacttctccatgtcctacttccctaactaaaatgggaaccacacagaacatacagttgtaattcagtaattaaagaatagaactgaaatgcacttccattgcttgctttcctagcttactcagagcttgcagtgtaacaagtataaagttataataatgatgatgatgaccacaataataagaaaaataaaattataataatgayctgatagttatttgtaaaatgccttctccatgcctggcaccatgctaaatgtatatactttaagatgttacaagaagaagagatgtctatcttacacacacaccctctttaggaaaactcctgggttcacagttgttaataacttatacttggtaaatatgtggtaaattcatagtcaagtctgtcatactacctagaccatgaagttttcttgatgccacactgccctcttcccaatggccatatttctcccaaggtaatcctttggtaagagggttttggtctgaaaaacatccaccc

SEQ ID NO: 86202 - DNA, 601 bp, Human
atgggtcattaaaccaagaatttttcctatgttattttagaaatgaagatttaaagtagtatcaatgtaacttagacatgaataaaactctttctcacatatatatcttccttctatttccctttctgcaggggtaataatttacaatgttgttggtttttaaagctgaagcctgacttcataactcaagaagtcaatccaaaacacataaatggtcatgccaggtgtcatcaatgaaggccaaataacttcccttcaatactaattcataactctcctgggataagactttttttgcccmctcatttgtgctatagatctacttgagctcttctacttgatttccagtgcagtaacttctccatgtcctacttccctaactaaaatgggaaccacacagaacatacagttgtaattcagtaattaaagaatagaactgaaatgcacttccattgcttgctttcctagcttactcagagcttgcagtgtaacaagtataaagttataataatgatgatgatgaccacaataataagaaaaataaaattataataatgacctgatagttatttgtaaaatgccttctccatgcctggcacca

SEQ ID NO: 86203 - DNA, 601 bp, Human
ttgactaagcacaatacctgcatttaagtggtatcatcctccctattcttggaattttctctgtttacaatcaaggaaatggaggctcaaagaagttaaggaactctcccagaataacccagataataagagggtttgaacacagcactgtctaagtctacattccacaaagtcacatagctttgggaaaaatgatttgtgttcctctggattctctcacctcgtatctcttgctgatttactttgagactcagctgtttttcccacttctgagttcagagtcccaatcagatgtacagcraaggcccacaggacagcttggcctctgaggtgcctgatttcactgcgagaagtgtttgttgagcatatggtgatctcccagataaatatttgcaaagagttaatcacattcacctagggaagttttaactctggtcaagctcagagaattaactgagcaggcatttctattggcattacaaaaaaccaacagtgatcattctgattactaaataaaaatatgtcaaccaggtttagcacagtctcttaatgggtcattaaaccaagaatttttcctatgttattttagaaatgaagattt

SEQ ID NO: 86204 - DNA, 601 bp, Human
cttgccatactttctcaatgtactgattaaataaaactgctggtaggattaactctgcaaggatgcacccaacccagatatattcaccatagccatagattacacatttttggaaggcctactacgatgtctatcatggagcaaacactgtgcagacgcccaccaggcatcaaaacaaaatcaacattgggaacagagtctccatgtgggaagagcacctggaatttacagcgtaactctttctctccaacattctcctttcccttggaggattatttaccaattaatgttaaagttcctyatggtttaaacccaggccctcctgagtcatcattctcccctgcaagaccttgcccagtcgtagggctttgactgccatcaataagctcaaatcctgtgtattgcattttcggtttgtactcagactcttctctctgattgcctactgagatttccacttggatatctcaaaagtatgtctaatttaacatgtctaaaattggatgtccctgactctctgttccccaacatttctttcctcatttcttctgtttagtaaaagacaccaccatctactcagctatacaagaggaaaattatt

SEQ ID NO: 86205 - DNA, 601 bp, Human
aatataacctatgaaacttgaagtttccccactcaccctcacatacataatgatgcgttgattaaattaaattgtttaaacttcctcttattaatagtgatggaaatgaaaaggaaatgagcacatttctcaggagagctattttctatcacatggaaaactgggcagtgtggatttactctttgtgtttggccaagacttaaccaaatgaagcagatcctcaggaagctgactgtggggatttggacaatggtacaccagacaccagcagatctgccagttcatttacccaactttgagrcccatgtagaaatgtggctggcctcccatgcccacgcagaacacagctagcaccatcacgctggaccgtgactcctccatccctaagattcatgccaggatttgaggcaccaggaacctggacgggggctcattcacacctgcaggcaggcagcatccacatggaagcaagaggtgagagaagcaaagaagcaaggagacaaaggcagagaacaggtggagaggcccgttctgcctctcttgctcccacctggaagggatgatcaggagagcttttggcctatatatagatagaggtgca

SEQ ID NO: 86206 - DNA, 601 bp, Human
tttatgatctacagctacatgaaatgatcacttagtcgcagatgactatgtaccagacacacccagctgtaattttgaaagccaagttcattttactttgttttgagaaaatgtgggcaaaagattagaggcgcctctccaatcttgggaagcctctagtcatggaaaatcatatcccagcagtgctttatatgatttcacctgcagctttaagtaagaatgtttgaccagtaatgctgtaagcatataggataagagagacctatgttgtacacacttccagttgtgctaactcaggtaygaagatctctggaggtgagctatcaaaactccctgttattgctcattctaatatctgccaatcttaataatcatcaagttcttgttttggaaataaatacacataatgatgattatgataaaaataataaaaatgagtacaagacaacctgggataaaatactttaaaaagccctggaggtaacatggataaataaaccaacccaggtggggactaaggtgtactgcgcagagatgacagtcacttccagcttccagttgatcattagcaggtcaggatatgggattattatcactaact

SEQ ID NO: 86207 - DNA, 601 bp, Human
gggatattacagtccatcttggtctgaagtagcagtcaatagaatggaattcattgaaggtaaataagaccattaaatctctcaaacatatctccaagtagttagaatttacaaaccccaaatttatttttaaagcaaatattgaaacccccagtatgactaagaaaaagaaagcagattggaaccaaatactttactacgttaaatgacacattggaaattttcaagacaatttcttaagcaagtaatacgggttccatccggctccatcatttgccattcacttgacaaatgtcataaygccactgcacaccccaccagagcaaatattttcttccaaccttaaaataacatctacaaattaattcagtctgtcaaggggaactctccttgggtaattcaggaagtttttgcctttgggtaaggcactctaggcacaaacaactcaaattctcacctgtaagttgaaccaagaaggaggtttatgatctacagctacatgaaatgatcacttagtcgcagatgactatgtaccagacacacccagctgtaattttgaaagccaagttcattttactttgttttgagaaaatgtgggcaa

SEQ ID NO: 86208 - DNA, 601 bp, Human
attgcttttcattcttttgtgatgatccatattctgtttggtattactttctttctccctgaagaacttcatttaatatttttttgtaatgcagatctgctgctaattcttccagttattctattctaaaaagtatttcattttcactgtggaaagatattattactgtgcaaagaattctaagtttacattgttttctttcagtacaaaatatctttctgcattcttttctaacctgtattgtttccgacgagaagtcggctgacatcttttttcactctgacagctttcaactgtggtrtatctttttagctgatatatctttaaaactgattttgagaaatttgattatgctatgtcttcatatttctcattctcaggatttaagttttttgaactgagggtttatagttttcattaaatttgaaaatttttcattccattatttttccaaaattcttcctgcccccttttacttcagggattcaaattaaacatatattaaaatcctcagtcgtgctcaatgcatagttcaaattgtgttttctctaagagtttcatttggggaaattactttgttttcaagttcactgattttttt

SEQ ID NO: 86209 - DNA, 601 bp, Human
ttggttgtgacattgttaaaatcatctgtatctttactaactttgcttgttctagcaattattaagagtattgaaatctcctactataattatgaatttatttccccttgcagttgcatcagttttgcttcattattttgaagctatactagatgcatagtttgatctttttgatgaattgactcatttatcataatgaaatggcaatatttaatgccaaaaatcttcatgatctgaaatctacttagtgtcttattaatacagccagtccagttttttaaaattagtattagtgtgtacrtatttttccatatttcaactttcaacctatttatgcttttatatttaaagtgggtttcttatgggcaccttagagttggttcttgctttgtgatgtttatactatttacatgtaatgtgattattaatacagtaggtttaaacctatcatcttgctatttgttctatctaatctttgttctctttttcctttctacttaccttcttttgataagttgaatattttttatcattctgttttatttcctttgtggcttattagccagagcattggggtttttttaatgttagtggtttgttt

SEQ ID NO: 86210 - DNA, 601 bp, Human
aattgatgtcattgttattaatattagaagtacaccatcaatggaggtagtttaggtggtggtgacaagcactgactctggagttaaattatttgggtttgtgaactgtctctgcaacttgctacttatataaactagttgttatttcacctctttgagcctccgttttttcatctgttaaatggagatactaatggcacctacatgacaggtttgttgtgagaattagattgattaataaatagaatttagcacagtatgccagacacactctaggcacttgataaatgctaattactgyagatgtgataatacctttggttgttgttaattaatcaacatctgtacttccttcctgggattattgagagtgctgcaacaatttctcatctgccaattatttgccaactttgtcttctggagttggaggcataagagttaggtcaatctctttgtgtaatcttggttatatgatgtcacctctgtgaacattatctgtaaaattggaataatcccatgcaactcaaagaattgttatgaggattcaagattttgtatatgagtctaaaacactatataacattattgtaataattattaa

SEQ ID NO: 86211 - DNA, 601 bp, Human
catccaggctggagtgcagtggcgcgatctcgtctcactgcaagctccgcctcccgggttcacgccattctcctgcctcagcctccctagtagctgggactacaggcaactgccactgcacccggctaattttttgtatttttagtagagatggggtttcaccatgttagctaggatggtcttgatctcctgacctcatgatccgcccgcctcagcctccgaaagtgctgggattacaggcgtgagccaccactcccggccaactatacagaattcttaataaggcaagctgaagctgacrgcaatttacaagtcagggaaataagaatcaactggtcaaggaacacatcaaaactgggaggacttgaatcaagtccaccacccttaataatagccaccttccttaagaacagcacagacctacacaactatccaaatgttctaataaaggtagaaaatacatacaaacaagtatttttctgtgaaagcagctttatggtaagattatttatcaaggccattgccccaattacttgtttctacttatttgaacagagacagtgtaatggaatcctgctcctaaaacttgtatgttttttta

SEQ ID NO: 86212 - DNA, 601 bp, Human
cttttaggggtagggtaatgaggtggttctgaaactagatagtggtgatggttgtacaacattgtgaatgcacttaatgccactgaattatacagtttaaattgttaaaatggcaaattttttgttttctgtatttttccacaacaaagaatcattttaaatgaaagtaacaaagaaagcaagcagatggctgaatagaactgagctaattcaaggatacaataagtagttgaaaagcagtcatagctgagatatgagatttaaactcatatttgagtctcatatgaagtctcagagttcttttttttttttttttttttgagacggagtcttgccgttgcccaggctggagtgcagtggtgcgatctcggctcactgcaacctctgcctcccaggtttaagtgattctcctgcctcagcctcctgagtagctgggactacaggtgcccaccactacacctggctaatttttgtatttttagtagaaatggagtttcaccatgttggccagtctggcctcaaactcctgacctcagaccatctgcctgccttggcctcccaaagtgctgggattacaggcatgagccactgcacccagcct

SEQ ID NO: 86213 - DNA, 601 bp, Human
gaatcttttaggggtagggtaatgaggtggttctgaaactagatagtggtgatggttgtacaacattgtgaatgcacttaatgccactgaattatacagtttaaattgttaaaatggcaaattttttgttttctgtatttttccacaacaaagaatcattttaaatgaaagtaacaaagaaagcaagcagatggctgaatagaactgagctaattcaaggatacaataagtagttgaaaagcagtcatagctgagatatgagatttaaactcatatttgagtctcatatgaagtctcagasttcttttttttttttttttttttgagacggagtcttgccgttgcccaggctggagtgcagtggtgcgatctcggctcactgcaacctctgcctcccaggtttaagtgattctcctgcctcagcctcctgagtagctgggactacaggtgcccaccactacacctggctaatttttgtatttttagtagaaatggagtttcaccatgttggccagtctggcctcaaactcctgacctcagaccatctgcctgccttggcctcccaaagtgctgggattacaggcatgagccactgcaccca

SEQ ID NO: 86214 - DNA, 601 bp, Human
gtgaggggatgcaccacaccgtggcctggcaccaggccctccctggtgacattgggaaagtaggtcagtttcagagctggctgggggatgaatggtcagccaggagcaagtggtgggaattaaagatgctgagtgagaggttgacttaagcatgggatctaggagacagggagtgttattagtctgtttttcacactgctgataaagacatacctgaactgggaagaaaaagaggtttaatggacttataattccatgtggctggggaggcctcacaatcatggtggaaggcaaggaggascaagtcatgtcttacatggaagggagcaggcaaaaagagtttgtgcagggaaactccacctttttaaaaccatcagatctcatgagacttattcactatcacaagaaaagcatgggaaaaacccgcccctatgattcaattacctcccaccaggtccttcccacaacatgtggtaattcaagatgagatatgggtggggacaatgccaaaccatatcagggagcttccctagcacaacagaaagaatgaaagccagccctaggttgagctgtccagtagatctttctagcacaatggcaa

SEQ ID NO: 86215 - DNA, 601 bp, Human
tgcagtggtacgatctcggctcattgcaacccccacctcctggattcaagcgattcacctgccttagcctctctagtagctgggactacaatcgcgtgccaccatgcccagctaatttttttgtatttttagtagagacggggtttcactgtgttagccaggatggtctcaatctcctgacctcatgatctgccacctcggcctcccaaagtgctgggattacaggcgtgagtcaccgtgcccggcctctcttggttttcttaatccattcctcatgtgacagcacttagcaacacattgyctcctgctattctctgaggattccactttcacacatttggtcccaccaggagcaaaggtcagatcttcccttctgtcatttatgtttatccagcagacttgccattgagcacagcatgttcaccatttattgacttgattcaaaaagggataccttaatctccacccgaggaccaccttttccctacttgacaccaaacacaaggaaggctgagcaaggacaataagccaggccacaaatctttgtccatattatttttctgcagctgtaattcctgttcattccctgcatcaggcttat

SEQ ID NO: 86216 - DNA, 601 bp, Human
gctggagtgcagtggtacgatctcggctcattgcaacccccacctcctggattcaagcgattcacctgccttagcctctctagtagctgggactacaatcgcgtgccaccatgcccagctaatttttttgtatttttagtagagacggggtttcactgtgttagccaggatggtctcaatctcctgacctcatgatctgccacctcggcctcccaaagtgctgggattacaggcgtgagtcaccgtgcccggcctctcttggttttcttaatccattcctcatgtgacagcacttagcaayacattgtctcctgctattctctgaggattccactttcacacatttggtcccaccaggagcaaaggtcagatcttcccttctgtcatttatgtttatccagcagacttgccattgagcacagcatgttcaccatttattgacttgattcaaaaagggataccttaatctccacccgaggaccaccttttccctacttgacaccaaacacaaggaaggctgagcaaggacaataagccaggccacaaatctttgtccatattatttttctgcagctgtaattcctgttcattccctgcatca

SEQ ID NO: 86217 - DNA, 601 bp, Human
tcctaataatctttccttctcttggttctgtttttttttttttttttttggcgggggggtgggggggtgggtgggggtgacggagtctcactctgttgcccaggctggagtgcagtggtacgatctcggctcattgcaacccccacctcctggattcaagcgattcacctgccttagcctctctagtagctgggactacaatcgcgtgccaccatgcccagctaatttttttgtatttttagtagagacggggtttcactgtgttagccaggatggtctcaatctcctgacctcatgatcygccacctcggcctcccaaagtgctgggattacaggcgtgagtcaccgtgcccggcctctcttggttttcttaatccattcctcatgtgacagcacttagcaacacattgtctcctgctattctctgaggattccactttcacacatttggtcccaccaggagcaaaggtcagatcttcccttctgtcatttatgtttatccagcagacttgccattgagcacagcatgttcaccatttattgacttgattcaaaaagggataccttaatctccacccgaggaccaccttttccctacttg

SEQ ID NO: 86218 - DNA, 601 bp, Human
tgcctcatcctcttcagtctaaacccagtatttgtttttaacaaggctgatttcaagctgtttcttcattgtggggtttcctaataatctttccttctcttggttctgtttttttttttttttttttggcgggggggtgggggggtgggtgggggtgacggagtctcactctgttgcccaggctggagtgcagtggtacgatctcggctcattgcaacccccacctcctggattcaagcgattcacctgccttagcctctctagtagctgggactacaatcgcgtgccaccatgcccagcyaatttttttgtatttttagtagagacggggtttcactgtgttagccaggatggtctcaatctcctgacctcatgatctgccacctcggcctcccaaagtgctgggattacaggcgtgagtcaccgtgcccggcctctcttggttttcttaatccattcctcatgtgacagcacttagcaacacattgtctcctgctattctctgaggattccactttcacacatttggtcccaccaggagcaaaggtcagatcttcccttctgtcatttatgtttatccagcagacttgccattgagcac

SEQ ID NO: 86219 - DNA, 601 bp, Human
ctagttgcaatgcagatatgatggctggagcagtagcagccatcttgaattatgatgtggaagccactggctgagggtggcagagccacagggtagaaggagcctgggtcccggacactgtggaataccacaccagccctagacaacctttgcacaagaaagaattcaatgcctatcttctttaagctacttttatgttttagaatttctgccatttaaaaaaataattttagctgagttaagcagtcaactggttatttgaaccaaaatctttcagatttcataggctttgaattaaggygcaccagcactcatttaacctccctacacctcagttgccctctctgaaaaatgggggggtggtaccacacacttctttatttttccaactctacgatatttaattttctctcctcatcttcccctactcccatgaatacacaatgcatttggtcctaaccccatctcttagtatatgctgttcctcccacccagaatgcctttctgcctcatcctcttcagtctaaacccagtatttgtttttaacaaggctgatttcaagctgtttcttcattgtggggtttcctaataatctttcctt

SEQ ID NO: 86220 - DNA, 601 bp, Human
ttccttcctccttccttctagttgcaatgcagatatgatggctggagcagtagcagccatcttgaattatgatgtggaagccactggctgagggtggcagagccacagggtagaaggagcctgggtcccggacactgtggaataccacaccagccctagacaacctttgcacaagaaagaattcaatgcctatcttctttaagctacttttatgttttagaatttctgccatttaaaaaaataattttagctgagttaagcagtcaactggttatttgaaccaaaatctttcagatttcawaggctttgaattaaggcgcaccagcactcatttaacctccctacacctcagttgccctctctgaaaaatgggggggtggtaccacacacttctttatttttccaactctacgatatttaattttctctcctcatcttcccctactcccatgaatacacaatgcatttggtcctaaccccatctcttagtatatgctgttcctcccacccagaatgcctttctgcctcatcctcttcagtctaaacccagtatttgtttttaacaaggctgatttcaagctgtttcttcattgtggggttt

SEQ ID NO: 86221 - DNA, 601 bp, Human
gtgtgccagatactttccatatgttacctgaattctcacccaaagaactaagtgcagattttctcattttacagagagaaaacagaggtgggttttataatggtgtgaaaagctatacgggtcaagagacttctggttgttcatcaatatcctcttttcttctgccttagtaacagaaattctatttttagaggggcacagaacctccaataataaagcttacatttctagcttccctagtagctaggcatgaccctatgacaattttctggataataggaagacagaaggtatgatatgyataacttataggaagtactgtaaaagaaggaggtgagcccgtctttgttccttcctccttccttctagttgcaatgcagatatgatggctggagcagtagcagccatcttgaattatgatgtggaagccactggctgagggtggcagagccacagggtagaaggagcctgggtcccggacactgtggaataccacaccagccctagacaacctttgcacaagaaagaattcaatgcctatcttctttaagctacttttatgttttagaatttctgccatttaaaaaaataattttagctg

SEQ ID NO: 86222 - DNA, 601 bp, Human
agagcgatcacttaaggataagggactaaaatgtatttagcctctaatatatgttgaatggtgtgccagatactttccatatgttacctgaattctcacccaaagaactaagtgcagattttctcattttacagagagaaaacagaggtgggttttataatggtgtgaaaagctatacgggtcaagagacttctggttgttcatcaatatcctcttttcttctgccttagtaacagaaattctatttttagaggggcacagaacctccaataataaagcttacatttctagcttccctagyagctaggcatgaccctatgacaattttctggataataggaagacagaaggtatgatatgtataacttataggaagtactgtaaaagaaggaggtgagcccgtctttgttccttcctccttccttctagttgcaatgcagatatgatggctggagcagtagcagccatcttgaattatgatgtggaagccactggctgagggtggcagagccacagggtagaaggagcctgggtcccggacactgtggaataccacaccagccctagacaacctttgcacaagaaagaattcaatgcctat

SEQ ID NO: 86223 - DNA, 601 bp, Human
gcgtgcatttccaagttcactcaatcacctgtgcctatgctgccaaattattcaagatctccaagtggcagatgtgcgtgcatgttgctcttccaaccaaaaactatagaatgagatgatatggatcaattgacattcaattcaaggtgcgatttttatttcagaatttctggatattcacatactggaatatagaattcataaaagcagggattttgcctggtttttccttctgctgctttttctcccttgaagaacctagaatactacctggtataaagtagatgctcaatgcaaattygtggaatgaacaaaagtctcaactctctgtctttttgttttctttcgtttttccttttgatgatgagccctactttgtctctctgtccagtgggtgtctacctgctttctgtgaattacaactagacatccagtgaggtaactcaaaggcagagaggaaaggtcgggggtgatatgccaatgggactctaacattcctaactccacttacatcgttaatatgttgttcttttttatacgatattatttggggaaaatacatattatatatatatttttgagacacagtcttgtctgtcac

SEQ ID NO: 86224 - DNA, 601 bp, Human
gccagtggaaccagctcacataatgagcttctaatccaaatgagcagaaaaaaatgtatgtaacgtggcgtgcatttccaagttcactcaatcacctgtgcctatgctgccaaattattcaagatctccaagtggcagatgtgcgtgcatgttgctcttccaaccaaaaactatagaatgagatgatatggatcaattgacattcaattcaaggtgcgatttttatttcagaatttctggatattcacatactggaatatagaattcataaaagcagggattttgcctggtttttccttcygctgctttttctcccttgaagaacctagaatactacctggtataaagtagatgctcaatgcaaatttgtggaatgaacaaaagtctcaactctctgtctttttgttttctttcgtttttccttttgatgatgagccctactttgtctctctgtccagtgggtgtctacctgctttctgtgaattacaactagacatccagtgaggtaactcaaaggcagagaggaaaggtcgggggtgatatgccaatgggactctaacattcctaactccacttacatcgttaatatgttgttcttttt

SEQ ID NO: 86225 - DNA, 601 bp, Human
ccagcctggccaacatggtgaaactccatctctactaaaaataccaaaaattagccaagcgtagtggcaggcatctataatcccagctactcatgtggctgagacaggagaaccacttgaatccaggaggtggaggttgtggtgagtggagatcgcaccattgcactccagcctgggcaacaagagcaaaactccgtctcaaaaaaaaaaaaaaaaaaaaaaaaaaaaaagtcaagacagaaaaataataactccaacacagagatactctaaaatgggctcagaaaccacaacataaagraacagaaagaagaaaaggatttttataaggagaaaagtattgtttattctttcaacacaaattctattgtggtcaattaaaaaaataatgttagttgtcttggctgagcaatactgaattttaaagattttaggacacaaaatagaaatcttcttaagggcaggggtctttgttctgatcactgcaactctaaaacacctagaagagggtgtgtcctgacttttaagccagagcttaaaagtaactgtggaataaatgaaaaaatgaatgagcaggcataggtctctaggatcctgcaca

SEQ ID NO: 86226 - DNA, 601 bp, Human
taaaaagtcttaacagcagagccagaacttaaacatcaaggcagagaaggccaggcgcggtggctcgcacctgtaatcccagcactttgggatgccaaggcaggtggatcacctgaagtcaggagtttgagaccagcctggccaacatggtgaaactccatctctactaaaaataccaaaaattagccaagcgtagtggcaggcatctataatcccagctactcatgtggctgagacaggagaaccacttgaatccaggaggtggaggttgtggtgagtggagatcgcaccattgcactcyagcctgggcaacaagagcaaaactccgtctcaaaaaaaaaaaaaaaaaaaaaaaaaaaaaagtcaagacagaaaaataataactccaacacagagatactctaaaatgggctcagaaaccacaacataaagaaacagaaagaagaaaaggatttttataaggagaaaagtattgtttattctttcaacacaaattctattgtggtcaattaaaaaaataatgttagttgtcttggctgagcaatactgaattttaaagattttaggacacaaaatagaaatcttcttaagggcaggggtc

SEQ ID NO: 86227 - DNA, 601 bp, Human
aagccatgcttccccttgccatttagtatactcatttccagagtccctctgtccttgtgtgaacagccaaccataatgggctgcataagcttctttaactatgacttaaaatatctcattcctccagatttctattttatctctttcgtcttatagtcataagtctcctttaacttccaaaatctaattatttgagatgttctctagacatatttattattcactatttcccccttagactttaattctcttactgtttcacaaatgccaccataacccatttagtgtttctcaattttcrgttaattttccatctactttgccatttctgaagttcccagggacgtttcctggatcacagtgtcccttaaatgcctccttgaactgcttgggtgtcacagtttcttcgtttgtcatttaatttacatgtttttgaaaacacagtcagttttctttaacctcttttcaattctcaagatactttcattttcacagagtgttttttttttgttttttttttttctcttacaagcattctcctggtgtttgcaaatcccttcaactttgatgtctatcttagtgctttctcatcttccattaa

SEQ ID NO: 86228 - DNA, 601 bp, Human
aatgcaatgctttttaaagccatgcttccccttgccatttagtatactcatttccagagtccctctgtccttgtgtgaacagccaaccataatgggctgcataagcttctttaactatgacttaaaatatctcattcctccagatttctattttatctctttcgtcttatagtcataagtctcctttaacttccaaaatctaattatttgagatgttctctagacatatttattattcactatttcccccttagactttaattctcttactgtttcacaaatgccaccataacccatttaktgtttctcaattttcggttaattttccatctactttgccatttctgaagttcccagggacgtttcctggatcacagtgtcccttaaatgcctccttgaactgcttgggtgtcacagtttcttcgtttgtcatttaatttacatgtttttgaaaacacagtcagttttctttaacctcttttcaattctcaagatactttcattttcacagagtgttttttttttgttttttttttttctcttacaagcattctcctggtgtttgcaaatcccttcaactttgatgtctatcttagtgctt

SEQ ID NO: 86229 - DNA, 601 bp, Human
caaattttccatgcagttttcactctttttccaccctgtcatattttctaacaccctactacaaatgcaatgctttttaaagccatgcttccccttgccatttagtatactcatttccagagtccctctgtccttgtgtgaacagccaaccataatgggctgcataagcttctttaactatgacttaaaatatctcattcctccagatttctattttatctctttcgtcttatagtcataagtctcctttaacttccaaaatctaattatttgagatgttctctagacatatttattattyactatttcccccttagactttaattctcttactgtttcacaaatgccaccataacccatttagtgtttctcaattttcggttaattttccatctactttgccatttctgaagttcccagggacgtttcctggatcacagtgtcccttaaatgcctccttgaactgcttgggtgtcacagtttcttcgtttgtcatttaatttacatgtttttgaaaacacagtcagttttctttaacctcttttcaattctcaagatactttcattttcacagagtgttttttttttgtttttttttttt

SEQ ID NO: 86230 - DNA, 601 bp, Human
atatttctaatgaacagctgttctagactctctttgtgcttttgcttttgtttttaactggtagactgtaatcatggaagcagggacctcatctgccttgcttagtattatatttctagtgctaaacagggtgtgcgccacagagctggtgctgaacatgtgcagaatgaataaaagaataacttgctgcttctatgttgttgaggtttcatgacatcgaggaaagagaataggctttacagtgagacagtacctggcaccttgggcagcgtatttaaaatctactgagcctccatttcctttttttttttttttttttttgcaaaaatggattaagttaaaccatacagactagccatgacagtttcatatggtttaacctaacttcatagttcgcataaaatgcctagcacagtgcctggtatacagctattaataaatagtagttaacattgatgcaaattttccatgcagttttcactctttttccaccctgtcatattttctaacaccctactacaaatgcaatgctttttaaagccatgcttccccttgccatttagtatactcatttccagagtccctctgtccttgtgtgaac

SEQ ID NO: 86231 - DNA, 601 bp, Human
ggtctcataaataattttaggttgatttcatgttggagtagtttaggcatgttgggttaaataaaatatattattaaaattaattttatctgcttctcttcacttttttaatgggctaccagaaaatttaagttacatgtgacttgcattatatttctaatgaacagctgttctagactctctttgtgcttttgcttttgtttttaactggtagactgtaatcatggaagcagggacctcatctgccttgcttagtattatatttctagtgctaaacagggtgtgcgccacagagctggtkctgaacatgtgcagaatgaataaaagaataacttgctgcttctatgttgttgaggtttcatgacatcgaggaaagagaataggctttacagtgagacagtacctggcaccttgggcagcgtatttaaaatctactgagcctccatttcctttttttttttttttttttttgcaaaaatggattaagttaaaccatacagactagccatgacagtttcatatggtttaacctaacttcatagttcgcataaaatgcctagcacagtgcctggtatacagctattaataaatagtagttaac

SEQ ID NO: 86232 - DNA, 601 bp, Human
tgcatggtgatcagagataacattgaaaaataggtagacaatatttcctatatttcctatattatgattgaatataaacggggccagaattgtccaattctcactaggcctgctatcacgttagatagccagccaccaaccacgtgtagctattgagcatttgaaatgtggttagtctgaattgaaatgtgccatccatgtaaaaatacacacagaattttgaagacttcgtatttttcaaaagagtaaaaggtctcataaataattttaggttgatttcatgttggagtagtttaggcawgttgggttaaataaaatatattattaaaattaattttatctgcttctcttcacttttttaatgggctaccagaaaatttaagttacatgtgacttgcattatatttctaatgaacagctgttctagactctctttgtgcttttgcttttgtttttaactggtagactgtaatcatggaagcagggacctcatctgccttgcttagtattatatttctagtgctaaacagggtgtgcgccacagagctggtgctgaacatgtgcagaatgaataaaagaataacttgctgcttctatgttg

SEQ ID NO: 86233 - DNA, 601 bp, Human
caggttcaagcaattatcctgcttcagcctcactagtagctgggattacaggtacctgccaccactcccggctaattcttatatttttagtagagacagggttgcaccatgttggccaggctggtttgaactcctgacatcaaatgatccacctgccttggcctcccaaagtgctgggattacaggcgtgagccaccatgcccagccaaaacagtgattgttttaatcaagaaggtagcatacgcagttgagcacctttctttggatttacttaaaatctccttctttaatttcccatctmcatgttctccacttgttcccttttcttccatttggtagtaaaatcagatggaattagcagagtgattactgagacgcaaacactgttcttcagattatatgaaaataactatgcagaaatcctcatgcttcagatttttctgtgttcctctaagattcaatattctgggtgaatgactccatatactcaatgttaatattgtctttttctattaaaagtcttcagtcccttgggaggggggaaaaaaaaacctctaacagaaatttctgctgaacagtaatttcattatgaagttggcag

SEQ ID NO: 86234 - DNA, 601 bp, Human
gtaaattatcaagaaatttggaaatatccagtttgttatctgtttggaaatgctggatcagggaacaaatgttttggtttcgataaagacacttgctcctggggagagccattcacaaggttgcgtaacatgaactgaatgtcacagcaactttttttttttttggaaacagggtctcactctgccacccaggatggagtgcagtggtgtaatctcagctcactgcaaccttcacctcccaggttcaagcaattatcctgcttcagcctcactagtagctgggattacaggtacctgccaycactcccggctaattcttatatttttagtagagacagggttgcaccatgttggccaggctggtttgaactcctgacatcaaatgatccacctgccttggcctcccaaagtgctgggattacaggcgtgagccaccatgcccagccaaaacagtgattgttttaatcaagaaggtagcatacgcagttgagcacctttctttggatttacttaaaatctccttctttaatttcccatctccatgttctccacttgttcccttttcttccatttggtagtaaaatcagatggaattagcaga

SEQ ID NO: 86235 - DNA, 601 bp, Human
actttggggtgaatgtagttcaggttgagtctacctagcgccccaaatgtgggaaaactgaaaaatttagtaaattatcaagaaatttggaaatatccagtttgttatctgtttggaaatgctggatcagggaacaaatgttttggtttcgataaagacacttgctcctggggagagccattcacaaggttgcgtaacatgaactgaatgtcacagcaactttttttttttttggaaacagggtctcactctgccacccaggatggagtgcagtggtgtaatctcagctcactgcaacctycacctcccaggttcaagcaattatcctgcttcagcctcactagtagctgggattacaggtacctgccaccactcccggctaattcttatatttttagtagagacagggttgcaccatgttggccaggctggtttgaactcctgacatcaaatgatccacctgccttggcctcccaaagtgctgggattacaggcgtgagccaccatgcccagccaaaacagtgattgttttaatcaagaaggtagcatacgcagttgagcacctttctttggatttacttaaaatctccttctttaattt

SEQ ID NO: 86236 - DNA, 601 bp, Human
acactttggggtgaatgtagttcaggttgagtctacctagcgccccaaatgtgggaaaactgaaaaatttagtaaattatcaagaaatttggaaatatccagtttgttatctgtttggaaatgctggatcagggaacaaatgttttggtttcgataaagacacttgctcctggggagagccattcacaaggttgcgtaacatgaactgaatgtcacagcaactttttttttttttggaaacagggtctcactctgccacccaggatggagtgcagtggtgtaatctcagctcactgcaacsttcacctcccaggttcaagcaattatcctgcttcagcctcactagtagctgggattacaggtacctgccaccactcccggctaattcttatatttttagtagagacagggttgcaccatgttggccaggctggtttgaactcctgacatcaaatgatccacctgccttggcctcccaaagtgctgggattacaggcgtgagccaccatgcccagccaaaacagtgattgttttaatcaagaaggtagcatacgcagttgagcacctttctttggatttacttaaaatctccttctttaat

SEQ ID NO: 86237 - DNA, 601 bp, Human
agaccaccaatggcctttacctcagctagcgaaaataagttaccagtcactctgtacctgctgccctaagttgataattagggtggccaactcactgaggtgtttcttattgagtacaatgagatcttaagccaggtttcaattatccaacactttggggtgaatgtagttcaggttgagtctacctagcgccccaaatgtgggaaaactgaaaaatttagtaaattatcaagaaatttggaaatatccagtttgttatctgtttggaaatgctggatcagggaacaaatgttttggtttygataaagacacttgctcctggggagagccattcacaaggttgcgtaacatgaactgaatgtcacagcaactttttttttttttggaaacagggtctcactctgccacccaggatggagtgcagtggtgtaatctcagctcactgcaaccttcacctcccaggttcaagcaattatcctgcttcagcctcactagtagctgggattacaggtacctgccaccactcccggctaattcttatatttttagtagagacagggttgcaccatgttggccaggctggtttgaactcctgacatca

SEQ ID NO: 86238 - DNA, 601 bp, Human
aataagttgggggcaagtgggaaagtaacttgggagaggacgctagagacagacgcaggagtcagataagcaagtactatatagactgagtttagacttcatcttgtgtttatttggaatggaggcttgaaatgcaagtttgtaagaggcagatgggcaaacagatgaggctttgtagtaacgcaagcaaggaatagagacgacggtcaaagaaagcaacaggtggaatgaagagattggacagataggcaggcaactgcaatggaatttcagtacaaaaactaccgacaaagaccaccartggcctttacctcagctagcgaaaataagttaccagtcactctgtacctgctgccctaagttgataattagggtggccaactcactgaggtgtttcttattgagtacaatgagatcttaagccaggtttcaattatccaacactttggggtgaatgtagttcaggttgagtctacctagcgccccaaatgtgggaaaactgaaaaatttagtaaattatcaagaaatttggaaatatccagtttgttatctgtttggaaatgctggatcagggaacaaatgttttggtttcgataaagac

SEQ ID NO: 86239 - DNA, 601 bp, Human
tgtgttcaatgagctgccgtcagttcacaataagttgggggcaagtgggaaagtaacttgggagaggacgctagagacagacgcaggagtcagataagcaagtactatatagactgagtttagacttcatcttgtgtttatttggaatggaggcttgaaatgcaagtttgtaagaggcagatgggcaaacagatgaggctttgtagtaacgcaagcaaggaatagagacgacggtcaaagaaagcaacaggtggaatgaagagattggacagataggcaggcaactgcaatggaatttcartacaaaaactaccgacaaagaccaccaatggcctttacctcagctagcgaaaataagttaccagtcactctgtacctgctgccctaagttgataattagggtggccaactcactgaggtgtttcttattgagtacaatgagatcttaagccaggtttcaattatccaacactttggggtgaatgtagttcaggttgagtctacctagcgccccaaatgtgggaaaactgaaaaatttagtaaattatcaagaaatttggaaatatccagtttgttatctgtttggaaatgctggatcagg

SEQ ID NO: 86240 - DNA, 601 bp, Human
gaaggaagaggaaggaaaagttgagcagctcttgctcatgcacatggagaaaatgcaaagtccaaggcagaaaaccctgaaacatcatgatgtgttcaatgagctgccgtcagttcacaataagttgggggcaagtgggaaagtaacttgggagaggacgctagagacagacgcaggagtcagataagcaagtactatatagactgagtttagacttcatcttgtgtttatttggaatggaggcttgaaatgcaagtttgtaagaggcagatgggcaaacagatgaggctttgtagtaacscaagcaaggaatagagacgacggtcaaagaaagcaacaggtggaatgaagagattggacagataggcaggcaactgcaatggaatttcagtacaaaaactaccgacaaagaccaccaatggcctttacctcagctagcgaaaataagttaccagtcactctgtacctgctgccctaagttgataattagggtggccaactcactgaggtgtttcttattgagtacaatgagatcttaagccaggtttcaattatccaacactttggggtgaatgtagttcaggttgagtctacctagcgc

SEQ ID NO: 86241 - DNA, 601 bp, Human
agagaagcagtggctaattctatggtgattccatgactggaaaaaggaaacaaagttaaagggatttgggttgtgctgagaaggaagaggaaggaaaagttgagcagctcttgctcatgcacatggagaaaatgcaaagtccaaggcagaaaaccctgaaacatcatgatgtgttcaatgagctgccgtcagttcacaataagttgggggcaagtgggaaagtaacttgggagaggacgctagagacagacgcaggagtcagataagcaagtactatatagactgagtttagacttcatcytgtgtttatttggaatggaggcttgaaatgcaagtttgtaagaggcagatgggcaaacagatgaggctttgtagtaacgcaagcaaggaatagagacgacggtcaaagaaagcaacaggtggaatgaagagattggacagataggcaggcaactgcaatggaatttcagtacaaaaactaccgacaaagaccaccaatggcctttacctcagctagcgaaaataagttaccagtcactctgtacctgctgccctaagttgataattagggtggccaactcactgaggtgtttcttattga

SEQ ID NO: 86242 - DNA, 601 bp, Human
aagctgtttttattttttaagctgacattttggttccatttcccagggttatttttagccccgtcacattgtctggcatactgtgggggctcagttaatgtttggcaagtatgttgacagatcatcaccaaagggaaatccacccatccatacattcatccatctatatatctacccttccaaacatctgtcaatgcagtcattcatctatccatcaatccatcaatacatttacctgtccattcatccatctatcaatacattcatcaatccattaatccatccatccatccatctatcygtcaatacattcattaatacgttcatccattcttccatccattaggcatgtttgagcatctcctatgtatcacaccctgtaccagaactatgccatgaaaatgatacaaaaatgaccaaaaatacttaatttttcaaggttggggagagggacacacaaaataactataacgaagaacaataagtgtaaaaatagagatatggactaagttgttggaaagcataagagaagcagtggctaattctatggtgattccatgactggaaaaaggaaacaaagttaaagggatttgggttgtgc

SEQ ID NO: 86243 - DNA, 601 bp, Human
gacaaattaatgatgcagagaaaatgcttactatttaatgttaaagaagcagaaaagaggataaaaacagggcttgtctatgtctaaaagggttatgggtatttttcatttttttgtgtgtgtatctttgtattcttcaagttctctgcaatcaaatactttaacaaacagaaaactaaaacactgctattctagaaggaacaaaggataatcactattctatctggtttatttggggtatctcttatcacttcctagaaaggttttttgttttttgtttttatttttgttattttttttragacggagtctcactctgtagcccaggctgtagtgcattggcacaatcttggctcactgcaacctccgcctcccaggttcaaatgattctcctgcctcagccttccaagtagctagggttacaggtgcccaccactatgcccagctaatttttgtatttttagtagatacagggttttgccatgttgaccaggctggtcccgaactcctgacctcaggtgatccgcctgcctctggctcccaaagtgctgggattacaggcatgagccaccacacctgccggaaggatattttcttgatt

SEQ ID NO: 86244 - DNA, 601 bp, Human
aaaccgtgggaaggtgcaggcatggtggctcacacctgtaatcccagcactttgggaggctgaggtaggggaatcacctgaagtcaggagttcgagaccagcctgaccaacatggagaaaccccgtctctactaaaaatacaaaaaaattagctgggcatggtggtgcaaacctgtattcccagctactcagaaggctgaggcaggagaattgcttgaacccgggaagcagaagtcacggtgagccgagatcgtgccattgcactccagcctgggcaacaagtgtgaaaccctgtctcagaaaaacaaacaaacaaaaaaaactatgggaagacatagaagcgagggtgacatcaaagaggtaatagatcatgtcaattgaaggctgtgtagagaatagattggaggggaaccagagcgggtacagagggactacttatgctattcttacaaaccaggtcaaagataatggtggctttgactctggttgtggccaaagaagaagagaaggaggaagagaaaaagcaacagcaaacaagaccgagtggagagatatttaggaggtatttagtgaaagattagatgaggggaagggagaaaga

SEQ ID NO: 86245 - DNA, 601 bp, Human
agagtatgctataagaaagtgaaataggggtgaggcaaggctgaggaagtgcagcttgacctgaaggctcaattggcattaactaggcaagaaaagacacaaacaggcaaaagaggcaacatgtgcaaagactctgtggtgtgcataccaggaactgaatgcagaccagagaggctgaagcagagaaagacaggaaaatgtgagatcaggtgaggctgagaagatgaataggaacagaaagtgcaggattttagagaccatgttaaatgtctgtcttaaaaccgtgggaaggtgcaggcayggtggctcacacctgtaatcccagcactttgggaggctgaggtaggggaatcacctgaagtcaggagttcgagaccagcctgaccaacatggagaaaccccgtctctactaaaaatacaaaaaaattagctgggcatggtggtgcaaacctgtattcccagctactcagaaggctgaggcaggagaattgcttgaacccgggaagcagaagtcacggtgagccgagatcgtgccattgcactccagcctgggcaacaagtgtgaaaccctgtctcagaaaaacaaacaaacaaaaaaaac

SEQ ID NO: 86246 - DNA, 601 bp, Human
tggaatgtaagctttttgtcctgccagattcatagacctatattcaaatgatcttcttacaggaagatctgaaaacacattctattatactctaacaaacttccctgaaggaagctgcttgctcataaaccacatggcattcaatgttgaaaaaatgacattccattattcattatttattcaactaatatatatgaagcatttgctatatgtcaggactcagctagttggttcagggtaaataagaaaatgaacatgattcccaccctcaagaagtttagagtctaagggggaggatagwcatgaattgattaaacacagatttatgacaaatgatacaagggacgggagagtatgctataagaaagtgaaataggggtgaggcaaggctgaggaagtgcagcttgacctgaaggctcaattggcattaactaggcaagaaaagacacaaacaggcaaaagaggcaacatgtgcaaagactctgtggtgtgcataccaggaactgaatgcagaccagagaggctgaagcagagaaagacaggaaaatgtgagatcaggtgaggctgagaagatgaataggaacagaaagtgcaggatttt

SEQ ID NO: 86247 - DNA, 601 bp, Human
acatctctcctctctgacccaggtcatgacatgtatggtacataagatgatgatttttttctttgcaaacgattttttgtattttcaatagctaatatacatgtagttgaaaatatgctttataagaaaaataacctccctctctaactcatgatttacagaagtgatacatttaagtttttaaaattagtttatttaaagcaaaagactgagtacatgaaaatacagagggttcgttcatatggcaatgactatggtacacaattaggaagtttaggcaaacttctatgatcattgctayatagtcaacacttattagtgtaatgctgcaacccagacttcactgtctttaaattatccttagttcagacctttcctactgggatttgagaacagacatacagcgcaccacacaattaccacagttcacccagagaaagcattccaattgcaccttacagatttagtctgccttgttgcaagaaagacgtgctcttggctgtgagatgggatctagagcagctcaacaggaaatgcgtgggagaaagaagcactgtgagcccctttattgcccatgctttcttccctcccctgcattcag

SEQ ID NO: 86248 - DNA, 601 bp, Human
gttgatttttacttgtgtatttatgatttttttcttctacttcatttgttcactttgctcttttctaacttctaaatttataagcttaaatcattgacactgaattcacactttccttttttattataagcagttaaagctatgaatttcttagtgtgccttcaatcttattcctcaaattttgatattttgtgttttcattatcattctgactaaagtattttctaatgtctttctgatttcttctttgacctataggtttagaagtgtgttgccatttccaaatatttggagattttcyagatatatttttgttactaatttttattttaatgctgttatgatcaaagaatgcaccctccattatttcaattcttctaaacacattgagacttttgttttatgctccagaatgtagtctactttggtggatttcccatgtgcactcgaaaggctgtgcattttatagttgctgggtgtaggatgcaaaactttcctaagcttcctcctcactgttcttttctaggaatctgtcattgtctccccagagtcaatgcttctgtttgtatagtatttccccctgatttcagtcaattacatt

SEQ ID NO: 86249 - DNA, 601 bp, Human
ttgtacatattactaggccattctgttttattaatataccataatttgttcattcatttccttgttgatggacattgaattatttctgatgttttgctataatgaataaagttgcaatgaacattcttgtacaagtattactttttggatatatgtttatctttctttgggataaataactaggagtaaaattgctggataagatttgtgtgtgtatgtgtacgtttattaaaaaacaaacaaaaaaaacacacacacagtttttggccaggcgcgtggctcacgcctgtgatctcagcamtttgggaggctgaggcgggtggatcacttgaggtcaagagtctgagaccagcctggccaacatggtgcaactatctctaccaaaaatataaaaaattagcctctgtggtggcacatgcctgtaatcccagctactcaggggggctgaggtggagtctcgttctctcgcccaggctggagtgcagtagctcaatcttggctcaccggaacctccacctcccggattcaagtgattcttgtgcctcagcctcccaagcagctgggactacaggtgcacaccaccatgcccagctaatttttg

SEQ ID NO: 86250 - DNA, 601 bp, Human
aagcaatggatattgttattataattggtattcatgtcagggggttaaatatgaaagctcagtgaaaactgttagttaattgtgctgggtatcccgatctgaaggatttaaggttttgttgttttgttttgagacaaaaccttgctctgtcacccaggttgaagtgcagtggtgcgatctcagctcactgcaaccctcgcctcccaggttcaagtgattctcctgcctcagcctcctgagtagctgggattacaggcaccaccaccatgccgggctaattttttgtatttcagtagagacragatttcatcatgttgcccaggttggtcttgaactcctgagctcaggcaatctgactgccttggcctcccaaagtgctaggattacaggcatgagccaccaagcccggcccggatttaggtttttttttaaactaagcacaatgacatacaacaaaatgaatggatcttgtgtcataatttgatgccttttgacaaatgttcaagataggaaataactgccatcactccagaaaattccctgtgcccctgtcctgtcaactgcactcacccacagaagcaaccactattctgatatctaa

SEQ ID NO: 86251 - DNA, 601 bp, Human
ttaagcatgacagaagcccatagaatcccagccgactccatctccatatacacactaagatctaagtttcttgagtacagaaaatattttttctcttgtttatgatggactccaagcatcaaggatagggcctggtacacagtaggcacttaataactatttgttgaataaaaaaatgaatagacgaaccatgaagtcagggctccggtggatcaactgaaggatcaatacaagaggtgatcaataagcaatggatattgttattataattggtattcatgtcagggggttaaatatgaawgctcagtgaaaactgttagttaattgtgctgggtatcccgatctgaaggatttaaggttttgttgttttgttttgagacaaaaccttgctctgtcacccaggttgaagtgcagtggtgcgatctcagctcactgcaaccctcgcctcccaggttcaagtgattctcctgcctcagcctcctgagtagctgggattacaggcaccaccaccatgccgggctaattttttgtatttcagtagagacgagatttcatcatgttgcccaggttggtcttgaactcctgagctcaggcaatctga

SEQ ID NO: 86252 - DNA, 601 bp, Human
cccgatttgtgagagaaagtctgctccattctgagttctgtgtctgcagtatacaggcaggcctggtgtttggcgtctgtataatccacaccagccacctacaaaggcctggaaaaaagcaagtgcccctctaagggcttgtcgtgttttcccagacaccctcattacatgctgctgctttcagtgacgccactggctgacctcggagatgaaaagaaatcgcctccgagtcccagaataacagctccctcctcagcagtctttcccctctgctgacctgctgtaccagcgtgtagtgctgggggggcagctttaagggtaacacgactggtatttacctgctccactggctttctctttcttagagacagaagcacacggagttatttctgaagcactagatcccctgagtgccaagaggatagagcaactacaggcagtatttgtgcattctaagctcaactcagcagcaattcccaaagctgccttttatgggaaattgctatgtttcaacaggaatttgaagaaaggcccacaaaatattaaaaggcatcttctgtatctggaaatggagtgtatcaagggcagctgtcacctgcac

SEQ ID NO: 86253 - DNA, 601 bp, Human
ctattaaacaaatacctactcagatgactaaatgagataatgaatgtaaaattgtcatcatagttattggtacagagtagctcttaataaatggcagctgaagtcgtcgataccaacagatcatagaggggtccatttgtgcactaggcccaaacccttgtggtgaagctgaaaaaacacagatgaaaggaacagaccttcccctcttggggattctagtctaagcgaagatgaataggcaagcaaacaatgccaaagcaagctgttaacactcttacgaattagtatacaggtctgcagraatgaagtggaaaagggcagacccactttgagctacccagatatagaatcaatggaaagggtgtccttagcaaagaggacaaatgtttgaaggggcaggaacatcaggagcaggtgacagctgaatactagggcttgggggacactccggggataagaagaaagctttctgtgttggggtacgggcgaataaacatatccgtgggaggaagatgatgagtttgactttggacaaggtgatattgggtgtctgtgggtcagccacgtgtggtgctgtaggcaagtctggaggccgtgagac

SEQ ID NO: 86254 - DNA, 601 bp, Human
ggagatgcaataaatgcctataccctgagttctaattagctgggttcaggtagaatcaattgcatccagtgagaggaaaggaagcagacacctttctaagggtaggaggaggaactccctaaatttctcctctagaatacctccttcccgctgccagttgttccacatgatgtagtggtggtgaacacagccttcgggggcaggcggacctccacttacatccttcttccatcacacaccagctgggagatcttaagctggtcactaaccagagagaaactctggttctctgaaccagaayttccatctctgaagcagggagaagaatacctactttagaagtgctattaaacaaatacctactcagatgactaaatgagataatgaatgtaaaattgtcatcatagttattggtacagagtagctcttaataaatggcagctgaagtcgtcgataccaacagatcatagaggggtccatttgtgcactaggcccaaacccttgtggtgaagctgaaaaaacacagatgaaaggaacagaccttcccctcttggggattctagtctaagcgaagatgaataggcaagcaaacaatgccaaa

SEQ ID NO: 86255 - DNA, 601 bp, Human
atgggaggactgtttgaggttaggagattgagaccagcctgggcagcatatcgagaacttgtgtctgcaaaagaaataaaaattagccaggcaaggtggtgtgcacttgtgtccccagctacttgggaggttgaggcaggaagaccccttaagcccaggaatttgaggctgtagtgggatatgattgtgcctgcactccagcctggtaacagagtgagaccatgtctctaaaaaaaagttaaaaattacaaggtctgggagatgcaataaatgcctataccctgagttctaattagctggkttcaggtagaatcaattgcatccagtgagaggaaaggaagcagacacctttctaagggtaggaggaggaactccctaaatttctcctctagaatacctccttcccgctgccagttgttccacatgatgtagtggtggtgaacacagccttcgggggcaggcggacctccacttacatccttcttccatcacacaccagctgggagatcttaagctggtcactaaccagagagaaactctggttctctgaaccagaacttccatctctgaagcagggagaagaatacctactttagaagtg

SEQ ID NO: 86256 - DNA, 601 bp, Human
atgttcttcaattttagcaatccacataatcgttctatcaattgtcatttactggtgtcctcacaattgcaatttttctccatgatttcttttacacaatcttcactgggatgtgtgcggagaagccaagaacaatgtttgcataaatacttccatcctctggctggatgaacttttttgaagactactgatatctcatacacacacacaacacacacacacacacacaaacacacacagaagcaaactgacactaacaacctgcatgttttcttgagatcttgaaactcactgggccctrctaggctaaatgtggtagtagtgatgggaaagagatggcaaggagagggagctaaaatacaataatttagataggagggagctatagcattctataattacaaatcacatcatgtaataattgcaccccacgcatcactatgcctcactagacctgatagcacaatgatacaccacagtcagaaccacagactcaagagagcaatcatagcttttgtaagatctcctttatcatatctgtactaggaatcctataactggaatctactttatttcacacaagacataacatatggggtgc

SEQ ID NO: 86257 - DNA, 601 bp, Human
ttaatgggcatgagaatcactagggaggcttataaaacatgcagattcagaatcagaaatgctgattccatagacttgaggcagggctaaggcctttacatctttcccaaggtgattctaatctaggtagcccaaggaactacacgtataaaaagcccatactaaaagatgctcctcatttggggaagttaatggggaaaagagtctttccattcattctccaaatccttattgagcctctgctattgaataccagagatataatggtaaaggagagactgaaaacacaccatgagctctmagtgctagccgtggccagaattcatggctttaccaatgggctgctattgtctttctaagcaaagagagttgtaatatgtttctccctgccggtagaatgtgtcacaatgttcttcaattttagcaatccacataatcgttctatcaattgtcatttactggtgtcctcacaattgcaatttttctccatgatttcttttacacaatcttcactgggatgtgtgcggagaagccaagaacaatgtttgcataaatacttccatcctctggctggatgaacttttttgaagactactgatat

SEQ ID NO: 86258 - DNA, 601 bp, Human
taagttctattatctctgttgatgggacaaatttttaacaaaaaaatcatttaataacaatatctattgagaaaaatctaggtaacaggcactgaactacatctataaacagcgttttatttgccttgttattctctcatttgccagaagttattcaagatgcaacaagattccaatttccttctttccttttcctctgtagtttctcctaagcattgctactgagcagtatattccaaaggaagaaagaagcacaaaagctaagaagcaagaatcttgataacaggatgacctaaataamaccatttcagggttacacagagtaagtctatgccctaaagcagtagctttacatctttaatgggcatgagaatcactagggaggcttataaaacatgcagattcagaatcagaaatgctgattccatagacttgaggcagggctaaggcctttacatctttcccaaggtgattctaatctaggtagcccaaggaactacacgtataaaaagcccatactaaaagatgctcctcatttggggaagttaatggggaaaagagtctttccattcattctccaaatccttattgagcctctgct

SEQ ID NO: 86259 - DNA, 601 bp, Human
cttggggttatatgtctgaggtcagctagggactgacagtgcctagaggcccctgcattccttatcatggagccccctcgatcctcaaatgtagaagtcagactaagcattctcacactccaaatttctttctgcaactattaggcttgtgtgaaactaattgcagttttcgctgttttttttaaatggcaaaacccacgattacttttgccccaacctaatagctgcacaaaactttctacttttaaaggggtcatgtgattgggtgaggctcgccccaataatctccttgttgagtaaytcaaagtcaactgagaagtcctttctgccatgtggcctaataaaaccaaggagtgacagctcatcatgtcacatactcccaggggagaggcttagaaaaggccaagtgtcactggagaccattctaagaattctgcataccacacagctatgttccaatcacattgaactcttctccagatgggccttgggcactcttgcctctgaacctgactttttcccactgcatggaatggcctcctcacacatattcagaaatccaaatcttgcttattctcgtgagaccttgttcaaacgagaa

SEQ ID NO: 86260 - DNA, 601 bp, Human
acagttctgcaggtcagaagtcccagcgggctcagctgggtttttgctcagggtgtcacaaggccaaaatcatggcactacccaggctgggctcatatctggaggatcttggaagaatccacttccaagctcactcagattgttgggcaagctcacctccttggggttatatgtctgaggtcagctagggactgacagtgcctagaggcccctgcattccttatcatggagccccctcgatcctcaaatgtagaagtcagactaagcattctcacactccaaatttctttctgcaactatyaggcttgtgtgaaactaattgcagttttcgctgttttttttaaatggcaaaacccacgattacttttgccccaacctaatagctgcacaaaactttctacttttaaaggggtcatgtgattgggtgaggctcgccccaataatctccttgttgagtaactcaaagtcaactgagaagtcctttctgccatgtggcctaataaaaccaaggagtgacagctcatcatgtcacatactcccaggggagaggcttagaaaaggccaagtgtcactggagaccattctaagaattctgcatacc

SEQ ID NO: 86261 - DNA, 601 bp, Human
atcaagaacatcaccgtcatcaccatcatcatcaatcatctttatcattagtatccctatcaacgtatgttcccatagagatgtcttttctatgaactgcatttttttttgttttaagttctgaaatctgaaaaactttcagcagaatgttgctctgcaggagagcgcctgttcaactgctgttctttttggagttgggttgatgttacaactgcaacaacaacaacaacaacagcaacaacaaaagaaccagtgcaagacacacacacacacacacacacacgcacacacagttgcacasacacatgctttgggagatggcatcacttatttcagttgaatgtgttaatttgctagagatctactatattttcctcactgtgacctaacatattgtactgtgtgagtatttaaaatagtcactatgcgtgactctagggaagtcagatgattattttattttatttatattcacctttgctaaatcctgatgcacagatgataattttaaatgttttataatggctcaattttccctctctatggctcacatcatttgagaaacttaacgatcattatataaggaaacaaattaaattcc

SEQ ID NO: 86262 - DNA, 601 bp, Human
caacaaatgcttactatttatttacgtcatattcagacaactactacagtcaatctccttcctctacttgctttcaaacttattttagaaatattttatttttccccaaatggaagctcactttgaacctcaacataacataccaatcagatgaagctttgccatctccagttgaaggtgggtcttacctcataagccccctacccacccagagaccctggtggcactctaagttctgaaaggaatcagcattcaagggaatataattagaaaagaaaatttgccttaaagtccactgttwctttgttctctctctctcgtctccctcttcccccttctctctcccccttcctctccccagttccgtcttcctctctccctctcccccctctctctccccttcttcccctctctcttccccctcttcaggccctctctatctcttccactccctctcccacctctctgcctctccctctcttctccctctctcctcttttctccccctcccgctctcactctcccccttactctttccctctccccccatcccccctccctgtcctgctatccctccctagccctctccctgcctccctct

SEQ ID NO: 86263 - DNA, 601 bp, Human
aaaatttccatcattcatcctaggaactgtgcaaagtactggaacaagcactaaacttggagactcacaagacctaaatttgaatcctttctcagctattaattttttaaaaatcatagaacatctctaagtttgcatgactcaaatatgaaatcagagactcacttcacagggttattatgcggctaaagtgaaataataagtacagaaggccatactgtaaggtttggtatagaataggtgctcaacaaatgcttactatttatttacgtcatattcagacaactactacagtcaatcyccttcctctacttgctttcaaacttattttagaaatattttatttttccccaaatggaagctcactttgaacctcaacataacataccaatcagatgaagctttgccatctccagttgaaggtgggtcttacctcataagccccctacccacccagagaccctggtggcactctaagttctgaaaggaatcagcattcaagggaatataattagaaaagaaaatttgccttaaagtccactgttactttgttctctctctctcgtctccctcttcccccttctctctcccccttcctctc

SEQ ID NO: 86264 - DNA, 601 bp, Human
actttgtcctaaagaatacgagttaagtccacacaaaagcctaggtattgtcatacccccaacttccactcaacttccaaggcagataccatccctgtgaatctccacaacctatatgaaaatttccatcattcatcctaggaactgtgcaaagtactggaacaagcactaaacttggagactcacaagacctaaatttgaatcctttctcagctattaattttttaaaaatcatagaacatctctaagtttgcatgactcaaatatgaaatcagagactcacttcacagggttattatgyggctaaagtgaaataataagtacagaaggccatactgtaaggtttggtatagaataggtgctcaacaaatgcttactatttatttacgtcatattcagacaactactacagtcaatctccttcctctacttgctttcaaacttattttagaaatattttatttttccccaaatggaagctcactttgaacctcaacataacataccaatcagatgaagctttgccatctccagttgaaggtgggtcttacctcataagccccctacccacccagagaccctggtggcactctaagttctg

SEQ ID NO: 86265 - DNA, 601 bp, Human
gggtaagtgggtgggttcaagagtgaatggatgcccatatggctggatgaattacggttggtctgatgggctgatgaatggatggatggtttattagatgattaatctttggatgactagctgggtgcatgggtggataaatggatgggaaaatggttcaatcccatcagagacagtcatagtgtatagttactttgtcctaaagaatacgagttaagtccacacaaaagcctaggtattgtcatacccccaacttccactcaacttccaaggcagataccatccctgtgaatctccacawcctatatgaaaatttccatcattcatcctaggaactgtgcaaagtactggaacaagcactaaacttggagactcacaagacctaaatttgaatcctttctcagctattaattttttaaaaatcatagaacatctctaagtttgcatgactcaaatatgaaatcagagactcacttcacagggttattatgcggctaaagtgaaataataagtacagaaggccatactgtaaggtttggtatagaataggtgctcaacaaatgcttactatttatttacgtcatattcagacaactactac

SEQ ID NO: 86266 - DNA, 601 bp, Human
acccctacgtcctcatgtcctcacctgtttacccccacatccgcacgtcctcaccacctgcttctttgtttgatcaccaataaatagtgtgggcttccggagctcagggcctttgcagcctccatacactagcgttggcctcctggacccaccttatatactcttaacctgtcttttcccattcctttgactctgccggattttgtagcccccacagcctggtgttgggtctgatcaccccaacattccctaaaatcccggggatattttattagtcatctctgcttcgcctgtacctacyacaggcctggcactgagtcagtaatcagtgaatgcttggtaaacagatcaatagtgggtaagtgggtgggttcaagagtgaatggatgcccatatggctggatgaattacggttggtctgatgggctgatgaatggatggatggtttattagatgattaatctttggatgactagctgggtgcatgggtggataaatggatgggaaaatggttcaatcccatcagagacagtcatagtgtatagttactttgtcctaaagaatacgagttaagtccacacaaaagcctaggtattgtcat

SEQ ID NO: 86267 - DNA, 601 bp, Human
ctacccctacgtcctcatgtcctcacctgtttacccccacatccgcacgtcctcaccacctgcttctttgtttgatcaccaataaatagtgtgggcttccggagctcagggcctttgcagcctccatacactagcgttggcctcctggacccaccttatatactcttaacctgtcttttcccattcctttgactctgccggattttgtagcccccacagcctggtgttgggtctgatcaccccaacattccctaaaatcccggggatattttattagtcatctctgcttcgcctgtacctrctacaggcctggcactgagtcagtaatcagtgaatgcttggtaaacagatcaatagtgggtaagtgggtgggttcaagagtgaatggatgcccatatggctggatgaattacggttggtctgatgggctgatgaatggatggatggtttattagatgattaatctttggatgactagctgggtgcatgggtggataaatggatgggaaaatggttcaatcccatcagagacagtcatagtgtatagttactttgtcctaaagaatacgagttaagtccacacaaaagcctaggtattgtc

SEQ ID NO: 86268 - DNA, 601 bp, Human
aaatatgttctccattatctcaggtagcagagcatattacatatgtgtcaaagaaaatgctaaaccatcacagctatgcttgatgcactgctacctttctacccctacgtcctcatgtcctcacctgtttacccccacatccgcacgtcctcaccacctgcttctttgtttgatcaccaataaatagtgtgggcttccggagctcagggcctttgcagcctccatacactagcgttggcctcctggacccaccttatatactcttaacctgtcttttcccattcctttgactctgccggaytttgtagcccccacagcctggtgttgggtctgatcaccccaacattccctaaaatcccggggatattttattagtcatctctgcttcgcctgtacctactacaggcctggcactgagtcagtaatcagtgaatgcttggtaaacagatcaatagtgggtaagtgggtgggttcaagagtgaatggatgcccatatggctggatgaattacggttggtctgatgggctgatgaatggatggatggtttattagatgattaatctttggatgactagctgggtgcatgggtggataaatgga

SEQ ID NO: 86269 - DNA, 601 bp, Human
caccaagctctgtgccaaagggtggaaggctgccctgccacaccacaatctaagcccagggcataaaacccctcgtggcttggatacaatccaaggctcagggcataaaatcccttgtggaattgcactggaatggcctctggaatgtgcacagacttgctggctccttgcttcttactctcccaggcttgtaaatatgttctccattatctcaggtagcagagcatattacatatgtgtcaaagaaaatgctaaaccatcacagctatgcttgatgcactgctacctttctacccctacrtcctcatgtcctcacctgtttacccccacatccgcacgtcctcaccacctgcttctttgtttgatcaccaataaatagtgtgggcttccggagctcagggcctttgcagcctccatacactagcgttggcctcctggacccaccttatatactcttaacctgtcttttcccattcctttgactctgccggattttgtagcccccacagcctggtgttgggtctgatcaccccaacattccctaaaatcccggggatattttattagtcatctctgcttcgcctgtacctactacaggcct

SEQ ID NO: 86270 - DNA, 601 bp, Human
gggggagcagctctctgttctgtccattttcttagggacagatgttattcctgtctgttccatcagcaggcaaatggggaaataatagaacagagacaatggaaagaaagtgagaagcaggcccagacagcagccactgagctccagtaattgtgggtggggtaggggagaaatctagctgctgctatcagatgcaatgtgaaataaagaaaaataatgtttgtggttcagttactagaatggataagatgactgtcaccctttggatagctcttctttatcctttaggacttggtcctarcttaggtctttcaggaagttttttcacctccccagtgcccaggctggagtaggtgtcccagtgtgccatgtgcacctctcctgtttatgctcatttcacaatgctgtaactagcagtgcatttccctgtccctcccactacattataagttccctgttggtagaagagctgaggcaggactagcttctctgtcataatgtaaaagagtcttggaacgtgtcctgggcccaggctctaaaccccctcatggcctttggaacaccaagctctgtgccaaagggtggaaggctgccctgccac

SEQ ID NO: 86271 - DNA, 601 bp, Human
gtaattatctcaaggtacaagttcttcagagtctagaaagcacattaaatcctccacagcttagagaccaatgctgagaatatgcaacctctttttatctctatttctccccctgttccaaaccaggttccaatgccaagaaaaacagggtagtggaatgggaagcttctgctgccaatggcacagatgaggaaaccaaactgtagctacagaggcaggctgacagagccacttgtagccagaagcagattgctggggggagcagctctctgttctgtccattttcttagggacagatgtyattcctgtctgttccatcagcaggcaaatggggaaataatagaacagagacaatggaaagaaagtgagaagcaggcccagacagcagccactgagctccagtaattgtgggtggggtaggggagaaatctagctgctgctatcagatgcaatgtgaaataaagaaaaataatgtttgtggttcagttactagaatggataagatgactgtcaccctttggatagctcttctttatcctttaggacttggtcctaacttaggtctttcaggaagttttttcacctccccagtgcccaggct

SEQ ID NO: 86272 - DNA, 601 bp, Human
gaacaagtctcgtctctaaatcttagtctcttcacctattaaaagcaggtaaatgtttctgctttccctgtatacagcatggatgtcaggatctgatacccaaaactaattgttgccctgctttcctatgttagatctgcctgtcctagtttcttcaaacacactttaattgtggaaagaaaacatatgccatcagctataatctgctggaccacatagaggccagcacggtaggaatcaacaggaattaggattcttccgattcaaattgtttgtttcaatgttaaagttaaagacaacrtaagtgagaggccattggtttctatgagtcattctacaactccctttaagggaatacgagttgattctcttgtttttccccaactttagatttttttctcatgggcatttccaacggagtctttcttcacatccagggaagtcaagatggctcagcctctactcttcccatctcaaacaggcccactcagtctttctaatttgcagaattataatttaaatggaaggaatatagactccaggaatatgatttcgatgagttttaaagcacgttttcaaaagacaatggctagataacaaa

SEQ ID NO: 86273 - DNA, 601 bp, Human
tcaggagtttgagaccagcctgagaaacaaagtgagacaccccccatctctaaaaaacaacaacaacaacaacaacaaacaaacaaacagaaaagaaacatctgtggaatctttcctggtcttagagaaaacaaaacaaaaaagtggagtgaaatgtttactattcttgcagaagaaggctgaacaagtctcgtctctaaatcttagtctcttcacctattaaaagcaggtaaatgtttctgctttccctgtatacagcatggatgtcaggatctgatacccaaaactaattgttgccctsctttcctatgttagatctgcctgtcctagtttcttcaaacacactttaattgtggaaagaaaacatatgccatcagctataatctgctggaccacatagaggccagcacggtaggaatcaacaggaattaggattcttccgattcaaattgtttgtttcaatgttaaagttaaagacaacgtaagtgagaggccattggtttctatgagtcattctacaactccctttaagggaatacgagttgattctcttgtttttccccaactttagatttttttctcatgggcatttccaacggag

SEQ ID NO: 86274 - DNA, 601 bp, Human
ggcaataatagtgccaatatcatcaggattttgtatgagttaagagagatcatgcatctaaagttctgactcacaaaaagcatttaataaatagtagctttaatatcctcacaggaaccccaaggggtgggtattatcattagctccattttgctgttggaaacaaagaatgacagatttccagaattagcgggagtctcacaaatgttacccctggccaaactcaacagcgtaaatgttgatcaaactcgctctctaaccccaaacagctcagctcctaaccggtgccatgctcagtgaracaggggaggaagtcgccagcccacttctcctgaccatgatgctgttctctctttgtctacgtagactagtcacttcatctcttggcattgattttgtattttgggcttctgatcagacacatctgtgtttctagcttttgtccccactgatttatagtataacttgacagatgtcccatctgtattttttgaatcctcatccattttcagtgagatgacaatgcctcaatgcaaagcctccatgtcattttggtaatgaaactcaaatcttcgggtaaagaaaatgtggtatatataca

SEQ ID NO: 86275 - DNA, 601 bp, Human
cttgttctctgttccttagacttctcatttataaaataggggcaataatagtgccaatatcatcaggattttgtatgagttaagagagatcatgcatctaaagttctgactcacaaaaagcatttaataaatagtagctttaatatcctcacaggaaccccaaggggtgggtattatcattagctccattttgctgttggaaacaaagaatgacagatttccagaattagcgggagtctcacaaatgttacccctggccaaactcaacagcgtaaatgttgatcaaactcgctctctaacyccaaacagctcagctcctaaccggtgccatgctcagtgaaacaggggaggaagtcgccagcccacttctcctgaccatgatgctgttctctctttgtctacgtagactagtcacttcatctcttggcattgattttgtattttgggcttctgatcagacacatctgtgtttctagcttttgtccccactgatttatagtataacttgacagatgtcccatctgtattttttgaatcctcatccattttcagtgagatgacaatgcctcaatgcaaagcctccatgtcattttggtaatga

SEQ ID NO: 86276 - DNA, 601 bp, Human
agtcaaagcatgggcttcggagtcagacaaatggggttcagaatacggttcaggttagcggaaattaacttgttctctgttccttagacttctcatttataaaataggggcaataatagtgccaatatcatcaggattttgtatgagttaagagagatcatgcatctaaagttctgactcacaaaaagcatttaataaatagtagctttaatatcctcacaggaaccccaaggggtgggtattatcattagctccattttgctgttggaaacaaagaatgacagatttccagaattagcgrgagtctcacaaatgttacccctggccaaactcaacagcgtaaatgttgatcaaactcgctctctaaccccaaacagctcagctcctaaccggtgccatgctcagtgaaacaggggaggaagtcgccagcccacttctcctgaccatgatgctgttctctctttgtctacgtagactagtcacttcatctcttggcattgattttgtattttgggcttctgatcagacacatctgtgtttctagcttttgtccccactgatttatagtataacttgacagatgtcccatctgtattttttg

SEQ ID NO: 86277 - DNA, 601 bp, Human
tagtcaaagcatgggcttcggagtcagacaaatggggttcagaatacggttcaggttagcggaaattaacttgttctctgttccttagacttctcatttataaaataggggcaataatagtgccaatatcatcaggattttgtatgagttaagagagatcatgcatctaaagttctgactcacaaaaagcatttaataaatagtagctttaatatcctcacaggaaccccaaggggtgggtattatcattagctccattttgctgttggaaacaaagaatgacagatttccagaattagcsggagtctcacaaatgttacccctggccaaactcaacagcgtaaatgttgatcaaactcgctctctaaccccaaacagctcagctcctaaccggtgccatgctcagtgaaacaggggaggaagtcgccagcccacttctcctgaccatgatgctgttctctctttgtctacgtagactagtcacttcatctcttggcattgattttgtattttgggcttctgatcagacacatctgtgtttctagcttttgtccccactgatttatagtataacttgacagatgtcccatctgtatttttt

SEQ ID NO: 86278 - DNA, 601 bp, Human
tccaggcctcatgctagatacttggcatgtatatcatttatgatgcctctgagctatgaagtggctgggtgaccatgttccaatcaattcacttctctggtcctcatttttctcatctataaaataatatgtaccatttggggttgtagtgaacataaaatgtggtaatgtacataaagtggttggctcaggacctgtgatggaatcacagtttaaaaactattaggcactttttttttggaatgatgcaaggaaaactaagctccattcgcttcccacttaaattctctatctcccacarcatggcacaattgcacttgctttgtagaatttgattgaagaaagtagcagaagttagtagtcaaagcatgggcttcggagtcagacaaatggggttcagaatacggttcaggttagcggaaattaacttgttctctgttccttagacttctcatttataaaataggggcaataatagtgccaatatcatcaggattttgtatgagttaagagagatcatgcatctaaagttctgactcacaaaaagcatttaataaatagtagctttaatatcctcacaggaaccccaaggggtgggtat

SEQ ID NO: 86279 - DNA, 601 bp, Human
gcactttgtatatgcataatagttcctgtttattaagatctttctaactacgttccaggcctcatgctagatacttggcatgtatatcatttatgatgcctctgagctatgaagtggctgggtgaccatgttccaatcaattcacttctctggtcctcatttttctcatctataaaataatatgtaccatttggggttgtagtgaacataaaatgtggtaatgtacataaagtggttggctcaggacctgtgatggaatcacagtttaaaaactattaggcactttttttttggaatgatrcaaggaaaactaagctccattcgcttcccacttaaattctctatctcccacagcatggcacaattgcacttgctttgtagaatttgattgaagaaagtagcagaagttagtagtcaaagcatgggcttcggagtcagacaaatggggttcagaatacggttcaggttagcggaaattaacttgttctctgttccttagacttctcatttataaaataggggcaataatagtgccaatatcatcaggattttgtatgagttaagagagatcatgcatctaaagttctgactcacaaaaagc

SEQ ID NO: 86280 - DNA, 601 bp, Human
gttcacttggctaagaagctgtattggggaaaaaatgaaaagaaatagaaaaaaaaagatagaaatttcagataatagacacactggaagacacatcctagccagaaagctgcgtgtcattatgtggataataatacaaaagtcctagagttaatatagctctttatgggctagaagttgctggttattttctcatttcacttgaccatcacagcagagtcacatagatgtgaaagagatattattacaatttttcagagcggtaaactgatgttccttcaagtaactttttttctttttyttttttttttctttttttgtagagatggagtctcgctctgttgcccaaggtggagtgcagtggcatgatcttggctcaccgcaacctccgcttcccaggttcaagcaattctcctgcctcagcctcctgagtagctgaaactacaggcacacactgccatgcctggctaattttttgtattttagtagagacagggtttcactgtgttgcccaggttggtctcgaactcctgagctcaggcaattcaccctcctcggcctccctaagtgctaggattataggcatgagccaccacgcctg

SEQ ID NO: 86281 - DNA, 601 bp, Human
tcaccctgcccagaaaaccccttcccactctctgcctggcactctcctatgtgtccttcagaactcaacacagagggcagctgttctgggaagcagcctctaatcccataaaactgggcaggtagcctctcctttccctacctcactagctagtgtgagacctgcacactcatctgtctgccccagtggactcattgagggtgggactgtgttctgtttgcctttatggccctcgtacccagcccagggctgcttacataatagatgcacaaatacctatgaaatgaacaagttagccagragcggtggctcacatctgcaatctcagcactttgaaggcaaggcaggaggatcacttgaggccaggagtttgagaccagcccgggcaacatggcaaaactctgtctctactaaaaatacaaaaattagctgagtgtggtggtacatgcctgtaatctcagctactcgggaggctgaggcatgagaatcactttaacccgagaggaagaggttgcaatgagcctaaatcacaccaatgcactccagcctgggcaacagagcaagactctgtctctaaataaataaaacagacaagttagca

SEQ ID NO: 86282 - DNA, 601 bp, Human
gacaaccaactcctggttccagccctgccccacatcaactcatgaatcacacagaactaatcacaggcttctgagtacattgagcttttctctcagtgccaggtttcaacacgctactcaccctgcccagaaaaccccttcccactctctgcctggcactctcctatgtgtccttcagaactcaacacagagggcagctgttctgggaagcagcctctaatcccataaaactgggcaggtagcctctcctttccctacctcactagctagtgtgagacctgcacactcatctgtctgcccyagtggactcattgagggtgggactgtgttctgtttgcctttatggccctcgtacccagcccagggctgcttacataatagatgcacaaatacctatgaaatgaacaagttagccaggagcggtggctcacatctgcaatctcagcactttgaaggcaaggcaggaggatcacttgaggccaggagtttgagaccagcccgggcaacatggcaaaactctgtctctactaaaaatacaaaaattagctgagtgtggtggtacatgcctgtaatctcagctactcgggaggctgaggcatga

SEQ ID NO: 86283 - DNA, 601 bp, Human
gcactaaaaatgcagagttgagtgcttgccatagagagagtatggcccacaaagcctaaaatatttactagccagccctttacataaacagttaggggttttgtcaacccctgctctaagtccttatctgtaaaggatccactcaccagtgaggaagataaaatacaatgccctctgaattaatcatacaataaaacagaaaatgctaacagccaaagggtgaaaggtgcaagaaatgcagagggcttcagaagtgagaggcagatctgatgagggaaggaagaaatcatgaaggagtgcratggaggggagttgtgcagtttgcaaaggacctgaaaagtcagagtggaaagaagggatgtgtaggatcagagaacagcatgcacaaaagcttagaagctgagttttaatgacatgtttgtgaactaggaagttgtccaaacaggaagaaacacaaatatataaaggagaagagagggaaagaggaataaagggataccatgggacaagactgaagaagcccttggatattgggctacaatccctttgtgcacattggaatttggttgcatttaagttgaaattggcaattggccttggg

SEQ ID NO: 86284 - DNA, 601 bp, Human
atgcatcgttatgatgaaatgcacactgatgagaatttcaattttccttagataagatggtattttgacaatcatttttctttgctcatctctggcccaaaactactttgctccaggcttgtctgagctctaaagtattccaacaagaggatcatttgaaatactaaagccaacagaagatttaatagtgagaaaacagtaataagcttaacgacagctttgcccagttaaaaacgtgattattctaaggcactgggggaagaggagggttcccttgggatgggatggataagacttgctrtttttgaaaactaagcctaagtaacccaccaccgtcaatccaatttcacccaaaccaattatccccatctcagacagtaatcaacaatttgagagccctatggagccactgggagaaatgagaatcatggtgaccaatcaggaagcctctcagcattgcttttcccactgaattattaatatagtggcaaacacagcagtttaaaagaaccgtgcatttggagttggaagacccaagtccaagttcaactatgatacttatgagctatgtcacatcaaaacctttcaaactcacacaaat

SEQ ID NO: 86285 - DNA, 601 bp, Human
aggagataagttccaggtaattaaactgcaggctaaggaagcacgagacttcaatgcatcaaacctgacttgaaggatctaacaagtcaaaagctgatggatttcctcactcagcattatgtaaaaagccaattccatttggatctcagccctgaacattcaaagttaacctcattgactgtgtctgcagagttttgcaataaggttacagaacctggaggtatcaatcagtggaacagcatttcatccccctcgcctgtgaaaagttattgcgttgtgagaggtgaaatgtctggaactyggtagcaggtctctgatgggcatttgttcttctgtatctggggcaaaataataaatttaagtttttgagatggacattttccttcttccaaatgaaaggggttggtgcctgaggccctgctagttattatgaggatgctaaccaaagccgttgtgcatgggtgaaatgcatcgttatgatgaaatgcacactgatgagaatttcaattttccttagataagatggtattttgacaatcatttttctttgctcatctctggcccaaaactactttgctccaggcttgtctgagctctaaag

SEQ ID NO: 86286 - DNA, 601 bp, Human
tttcaaagatcagcataacatccaattgtaaaataaatgaaatgccatttgcagtctggcagagtaaacagctcttttggggagtatttacctgaatgatattaagaagttttttttccctcagcaaacttgccaataagagttagaaagtggctaagagaggtagactgtgatcctgggctgacagctgaaaaagccttttatttattgtgataatcaattcattcttaccagcctgaaaattatgactgaacatgactatagatatgacttctcttactctatggcaagtttttttttcaatgaaaaccttgaaaagtggtaaaatgtggggctgagtgtgtaacagtttataaaaggagataagttccaggtaattaaactgcaggctaaggaagcacgagacttcaatgcatcaaacctgacttgaaggatctaacaagtcaaaagctgatggatttcctcactcagcattatgtaaaaagccaattccatttggatctcagccctgaacattcaaagttaacctcattgactgtgtctgcagagttttgcaataaggttacagaacctggaggtatcaatcagtggaacagcattt

SEQ ID NO: 86287 - DNA, 601 bp, Human
ttacagtaacagtgataactattattattttttaatacctgcataaagacaatttagaaatatggtaaaggtttttgtttgaccttctaatgtactttttctgggtaaatttcaaagatcagcataacatccaattgtaaaataaatgaaatgccatttgcagtctggcagagtaaacagctcttttggggagtatttacctgaatgatattaagaagttttttttccctcagcaaacttgccaataagagttagaaagtggctaagagaggtagactgtgatcctgggctgacagctgaraaagccttttatttattgtgataatcaattcattcttaccagcctgaaaattatgactgaacatgactatagatatgacttctcttactctatggcaagtttttttttaaatgaaaaccttgaaaagtggtaaaatgtggggctgagtgtgtaacagtttataaaaggagataagttccaggtaattaaactgcaggctaaggaagcacgagacttcaatgcatcaaacctgacttgaaggatctaacaagtcaaaagctgatggatttcctcactcagcattatgtaaaaagccaattc

SEQ ID NO: 86288 - DNA, 601 bp, Human
acagaaacaggaattggggctggggaaggttaaacacataacattggatgagaacttgacctaaggacagtcctttgttacagtaacagtgataactattattattttttaatacctgcataaagacaatttagaaatatggtaaaggtttttgtttgaccttctaatgtactttttctgggtaaatttcaaagatcagcataacatccaattgtaaaataaatgaaatgccatttgcagtctggcagagtaaacagctcttttggggagtatttacctgaatgatattaagaagtttttkttccctcagcaaacttgccaataagagttagaaagtggctaagagaggtagactgtgatcctgggctgacagctgaaaaagccttttatttattgtgataatcaattcattcttaccagcctgaaaattatgactgaacatgactatagatatgacttctcttactctatggcaagtttttttttaaatgaaaaccttgaaaagtggtaaaatgtggggctgagtgtgtaacagtttataaaaggagataagttccaggtaattaaactgcaggctaaggaagcacgagacttcaatgca

SEQ ID NO: 86289 - DNA, 601 bp, Human
atcacagaaacaggaattggggctggggaaggttaaacacataacattggatgagaacttgacctaaggacagtcctttgttacagtaacagtgataactattattattttttaatacctgcataaagacaatttagaaatatggtaaaggtttttgtttgaccttctaatgtactttttctgggtaaatttcaaagatcagcataacatccaattgtaaaataaatgaaatgccatttgcagtctggcagagtaaacagctcttttggggagtatttacctgaatgatattaagaagttytttttccctcagcaaacttgccaataagagttagaaagtggctaagagaggtagactgtgatcctgggctgacagctgaaaaagccttttatttattgtgataatcaattcattcttaccagcctgaaaattatgactgaacatgactatagatatgacttctcttactctatggcaagtttttttttaaatgaaaaccttgaaaagtggtaaaatgtggggctgagtgtgtaacagtttataaaaggagataagttccaggtaattaaactgcaggctaaggaagcacgagacttcaat

SEQ ID NO: 86290 - DNA, 601 bp, Human
caatcacagaaacaggaattggggctggggaaggttaaacacataacattggatgagaacttgacctaaggacagtcctttgttacagtaacagtgataactattattattttttaatacctgcataaagacaatttagaaatatggtaaaggtttttgtttgaccttctaatgtactttttctgggtaaatttcaaagatcagcataacatccaattgtaaaataaatgaaatgccatttgcagtctggcagagtaaacagctcttttggggagtatttacctgaatgatattaagaagytttttttccctcagcaaacttgccaataagagttagaaagtggctaagagaggtagactgtgatcctgggctgacagctgaaaaagccttttatttattgtgataatcaattcattcttaccagcctgaaaattatgactgaacatgactatagatatgacttctcttactctatggcaagtttttttttaaatgaaaaccttgaaaagtggtaaaatgtggggctgagtgtgtaacagtttataaaaggagataagttccaggtaattaaactgcaggctaaggaagcacgagacttca

SEQ ID NO: 86291 - DNA, 601 bp, Human
cttgatgttgaattccactgctaccaacacggacatccaaaaggcgatcagaacagcagatcaggcagagaaaatcaactgttcaaatgtgaaccatgtgtcaattaggtaatttgggggtttcaaccaagaggaatgtcattaatgctctagcagctgattggacttctcccttgcctctgtggtcatctccatccattatgtaaggggccttagaaaggaggatttcatcttcattctgtatcatgttatatttgagatattgttggccaacacaacacaattctgtttctatatctgyatctgttattataaaaacccaaacataaacttggttgaacttaaggggctgcttcttggaggagaaaactagaatgcatataggtctgcaaaaaaagtttaggaggagatgtgaaggtaactaggacaatcacagaaacaggaattggggctggggaaggttaaacacataacattggatgagaacttgacctaaggacagtcctttgttacagtaacagtgataactattattattttttaatacctgcataaagacaatttagaaatatggtaaaggtttttgtttgaccttctaatg

SEQ ID NO: 86292 - DNA, 601 bp, Human
ttggacttcagggcaggagctgttaccactgcctgatatttccaaggctgccatcctatttgctttgggaaatattaaggcaaacatgagcagtttggtttcttaagggaatatttcatggatcagttgggaagacagtattaataattagcaccatgcagcacagtgatgtcctgagagttggagaagccaggttctcgccccaatatgcacagtcttccactttgggaaggggcaacattttctttccatgtggagcacaggaggtggggagaaagcagccagaggtggtcttacagtktgcttttactcatgacagttttacttcttccatttgcctgtgaattgactcttctgaggaccttgaattccaccacagaaaatacctctaacagcagagctgcactgagctctactttgcaggcttgatgttgaattccactgctaccaacacggacatccaaaaggcgatcagaacagcagatcaggcagagaaaatcaactgttcaaatgtgaaccatgtgtcaattaggtaatttgggggtttcaaccaagaggaatgtcattaatgctctagcagctgattggacttctcccttgc

SEQ ID NO: 86293 - DNA, 601 bp, Human
tttatggataacagcatcaactgtcttagaacccagtactgatctggtaattcatagaaacgtgttttgattgttatttccatgaacaacccgcatctctgcttccattctcctcttgaggctcagccaacaggggaagagctcaatgcttgttcaatctcaaatttaaaagcggaaaaatctttggaacaaagagccatcattttcttcaggagttcatgtataatcttcagtcctccagagttcctttgttgccagatccctggggaaagataggagtcctatttctttggattacttktaattctttgtgtgctcttaaaagtgatgggttcttgtaattagctaaaaagttaatagtgttttctctcttttggttctaccttggagtaatataatgccagagacttgaaaaatcagcaaaaataaaaaaggagctctttcataatcatggattaattttttgaacttgctcttgggagtccttcattgtgcaagttccgtatcagtccgtcttccatgggctgcaataataattattaaacaattaacgagtataattgttggcatttattgaggtactgtgatcaccccaacgggc

SEQ ID NO: 86294 - DNA, 601 bp, Human
gtatctttatggataacagcatcaactgtcttagaacccagtactgatctggtaattcatagaaacgtgttttgattgttatttccatgaacaacccgcatctctgcttccattctcctcttgaggctcagccaacaggggaagagctcaatgcttgttcaatctcaaatttaaaagcggaaaaatctttggaacaaagagccatcattttcttcaggagttcatgtataatcttcagtcctccagagttcctttgttgccagatccctggggaaagataggagtcctatttctttggatyacttttaattctttgtgtgctcttaaaagtgatgggttcttgtaattagctaaaaagttaatagtgttttctctcttttggttctaccttggagtaatataatgccagagacttgaaaaatcagcaaaaataaaaaaggagctctttcataatcatggattaattttttgaacttgctcttgggagtccttcattgtgcaagttccgtatcagtccgtcttccatgggctgcaataataattattaaacaattaacgagtataattgttggcatttattgaggtactgtgatcaccccaa

SEQ ID NO: 86295 - DNA, 601 bp, Human
agtagcaacatggattagcatcacttccatgccgctgaatgcacatctgacacacaaacaaaccgatcacaggttaacacataagtaattctgggtcttgggttgctgcttgaaaccaaaagcagatctaaatgtaattgatccagaaacaacaataaagatatctgagccactgctgtggcttgatattaggttgacatatgctgtatctggaggactttgcagttgagttcagtgatgttttttaaaccaatacctgatctaaagagtatcccagaaaaccagtctgctgaaatcaagygtcactttggaactcaattttcccctgtgtggtatgcacaaacaagtttctatgcagaaattactaaagagcaggtgtgggtcaaacctgctctgtcttcactgccatgagccttggatggctaccggcagagtgaaactaagaactgcttttcagatattgaggtaaagtgcctgcttcctctgaatgcactgttttaaatgcaacgattggaggtggtgggattatgaagctttggcatgaataagaacctttcctggaagctgattaagaatgcagactcctgtatctctggagtgt

SEQ ID NO: 86296 - DNA, 601 bp, Human
gcttccaaatatgaaacaggcatggtggctcgcgcctgtaatcccagcacttcgggaagctgaggtgggcagatccctcgagatcaggagttccagatcagcctggccaacatggtgaaaccccatctgtactaaaaatacaaaaattagccaggcatgggtctgtaatcccagctactcgggaagttgaggcatgagaatcacttgaacccaggaggcggaggttgcagtgagctgagattgcaccactgcactccagcctgggtgacagagcaagagtctctcaaaaaaaaaaaaaaagaaaaaaaaagaaagaccaagggagttagtaggttgcctgttatggggttttatctttatcctatgggcaagtgacatatgtaagggatggggatgaggacttactgaagaccttactgaaatcaatcccccaattagaagtggattaaacacttcttctcaatgtagtgcagagatagagtttgtagctagaagattcggaaggcagagtgacaagctgggagatggctgcaggatctggatgacacaggccatgatggtcaggctggtgtgaactcaaagtgtaaaatcaacagaaaag

SEQ ID NO: 86297 - DNA, 601 bp, Human
cacaattaaacatggaaaaattcataatagagataaaaagtatttcccaaacttcctcttgtgtataggaagtttattacaattaaaatagcactaaaaaccgtgcatacataagtgtctgatacataagtgtccagtgaatgtcagtttttactattataagaactcaagcaataccatcagtacacctacacatatatgtatacatattcctatacatctatacatgaacctctacataaaagcacacttatatacaggtacattcatgcctacccacgctcacattataatcacataygctcacacccacacgtacaactacaaatacacacatacctaacacaaacacatatactcgaacctctacacacacacacacacacacacacacacacacacagagaggatatgaagctacaatgatgcatacacttttcacaaaacacaccctgaacgacacccactttcctgcctatgcctacactatttcttctgcctggaattcttctccttattatctccccctactgaaatcctacccactcttttcaggcctagctcaaatgccaatactcccatggaacctaattctccatct

SEQ ID NO: 86298 - DNA, 601 bp, Human
gaagtgtgagccaataccagggttgcaccacatttcctccagcagtgcttccaggagtaaggtttcaatccatttcctccagcagtgcttccaggaataaggtttcaatgcatcagagcaagtgaaatcatacagtccttgtcaatcacatgctatttttggagcttggagggaaaatgaagttccaggacaccttgccaaacttctggttatatttatacacaaccaggacaggcaagcacgcttgtgtgtgtgtgtgtgtgtgtgtgtgtgtgtgtgctgtatacatgtacatgtatawgcacatatggatcccattgagttttcaggcatcaacttcattgctacagaacccctctcttctctcctttacatggcacaggacaagagggttcagaatcattaatagcacaggcttagagatcagacagatgaacaggttcaaatcttgtcactgctttagccatgtgaccttgaacaagccacataatctttttgaacctcagttcactcaatcaccaaataaaaacaacacttccatttcatatgctgttatgaggcttacttataagataataacaacaaacatctcttaatgcac

SEQ ID NO: 86299 - DNA, 601 bp, Human
aaacacagagaggttatgtgacttgcacaaactcacacagcaataagtggtggaaccagagttataacgtggggctttctgaacccaaaggtgctttctcgctatgtacagtgtttctgtgaattgagctacagtaaccacgttatagctccaacactcttccttccttgcagacatgtttcctaaagtcccaagataatgtaaattaaggcaaagactagcagaatctttggtgatgtcattgaccacatcacaacccccacaccatgggagtcaggcaaaagtttcagtccaacgctcrctcatggagagaaaagttgcaaaggtttatgagcccccagagtgcaataacttcctaaatcttctccaagttctactccctgttcctgacacatccaagtatccatgggtcagccaaggaggttgaagatgagtggtaggtagagagaactcgatcaggagctgaagctgctgtgtcaacactgccctaggtcccaagagctcttaccttcttttctcatctgatagacccttcggcaccccactgcaaacaccaaaaatctcaactactaaatcgtatataccagataaaggagaacag

SEQ ID NO: 86300 - DNA, 601 bp, Human
taagtgtcaccagaaatgaatctcaaacccttaaagagaattcaaacatgccggacaccaggagaggtgacagggtgggaggagagaaaagaatcagtgctctctaagattacctcatcatatgggctggaaaatttttgctggctataaagaaacatttcctgtggctaattacaaaattgtccagcattgctgatacatttctttttaagataggatggcgagtagagcaatttggttaaacacacacacacatgttcatttattcacgctatgatatgtaacaggctggggagaatgytgagcgcatcaaattcttcattcattcgacatagatttattgaagacctacgatgtcccagtgccagcctaggaataatgatggctaaaacagaatgactcttgccttcttggaactgtcagtcagttgtacgacatagatcaaaccaaaaatactgaaatatgcaaatagataaagaaatatacaagtgtttccttttggaacatgttataccaatcccttttctttccatttgccttggaagactcaaacacaaccttcgagagagggtgggtagttcagtgggtaagagaatggctt

SEQ ID NO: 86301 - DNA, 601 bp, Human
taataccaacctcgaggaaaacacctcgtgtgaaaagctaagtgccaaatccaggcttgtctgtgttgaccagacccactcacctctcctcctgtaatgtttaagtgtcaccagaaatgaatctcaaacccttaaagagaattcaaacatgccggacaccaggagaggtgacagggtgggaggagagaaaagaatcagtgctctctaagattacctcatcatatgggctggaaaatttttgctggctataaagaaacatttcctgtggctaattacaaaattgtccagcattgctgatacmtttctttttaagataggatggcgagtagagcaatttggttaaacacacacacacatgttcatttattcacgctatgatatgtaacaggctggggagaatgctgagcgcatcaaattcttcattcattcgacatagatttattgaagacctacgatgtcccagtgccagcctaggaataatgatggctaaaacagaatgactcttgccttcttggaactgtcagtcagttgtacgacatagatcaaaccaaaaatactgaaatatgcaaatagataaagaaatatacaagtgtttcctttt

SEQ ID NO: 86302 - DNA, 601 bp, Human
atggggcctcctccagggtgacgatgctgagatggttgtcatccggctcacagtcggagaaggacttgtacctgggccacacggcgtgcctcaggctcagcgtatggttctcccacttgcccacctgcagcacaaacacaaagacacagctgtgctttcttccgccgctgatttctggagaggcaaatcctttccctgccagagacatccatccgtctcaagggcctttctgccacatatctcaacatatgcatctacttctgtgctaagacaaacgggcataaagagaaaacagaatatrgggcagttctccatcccagccgccctcatccccagaggaatcaacctgcatctctggaggcagtgcccaggcactgatacctttacagccccgcaggtggttctaatgttctgccagagttcaggaccacggatggcaaggaaacagcatagacttttagaatcagagaggtctgggtttgattctcccactgtaccacttactagctgtactaggcaagctcttaatcctaagatcttctgttttctcatctgtataatgaacacaattccccctacttcctaaggatgccatgggaat

SEQ ID NO: 86303 - DNA, 601 bp, Human
ttatcatatttacaatgggcaaaactactcacctcatattgctggtggaattaaatgaatgcaagtgtggcacatctctaggaatttatctaagtcttttttaaattgattattgtattatacctactataacgacgtgtattttctatgacattttgtgattcaagtacacatattgttactatcgatgatccatgctatttcaaagggttgggcacgttcaggtgacagcattcctgccactcacttgattttgacgaacttccgacatggcacggtgttcctcacacacgtctcggtyagggggtctatgtcttccacgatgacgaatggggcctcctccagggtgacgatgctgagatggttgtcatccggctcacagtcggagaaggacttgtacctgggccacacggcgtgcctcaggctcagcgtatggttctcccacttgcccacctgcagcacaaacacaaagacacagctgtgctttcttccgccgctgatttctggagaggcaaatcctttccctgccagagacatccatccgtctcaagggcctttctgccacatatctcaacatatgcatctacttctgtgctaagac

SEQ ID NO: 86304 - DNA, 601 bp, Human
tatatttaatacataaaatatatgttttataatattttaaatatataaaatacactgttttatatatttaaatatataaaatacactgttttatatatttaaatatataaaatacactgttttatatatttaaatatataaaatacactgttttatatatttaaatatataaaatacactgttttatatatttaaatatataaaatacactgttttatatatttaaatatataaaatacactgttttatatatttaaatatataaaatatactgttttatatatttaaatatataaaatayactgttttatatatttaaatatataaaatatactgttttatatatttaaatatataaaatatataatttctatatatttatatataatgttttatattttaatatattaagatatgttttatatttattttaatatacaaaaatgttttctatattaaaaatataaagatattttttgaatatgtatgttcaaaaataaataaatgaataaattaaattaaactagaaagactgaaggggaggattgattcaacctaagggttaaaaacatgtctgtggagtcagttggaccactgtttg

SEQ ID NO: 86305 - DNA, 601 bp, Human
tttttaatatataaaaacatatggtgttttatatatttaatacataaaatatatgttttataatattttaaatatataaaatacactgttttatatatttaaatatataaaatacactgttttatatatttaaatatataaaatacactgttttatatatttaaatatataaaatacactgttttatatatttaaatatataaaatacactgttttatatatttaaatatataaaatacactgttttatatatttaaatatataaaatacactgttttatatatttaaatatataaaatayactgttttatatatttaaatatataaaatacactgttttatatatttaaatatataaaatatactgttttatatatttaaatatataaaatatataatttctatatatttatatataatgttttatattttaatatattaagatatgttttatatttattttaatatacaaaaatgttttctatattaaaaatataaagatattttttgaatatgtatgttcaaaaataaataaatgaataaattaaattaaactagaaagactgaaggggaggattgattcaacctaagggttaaaaac

SEQ ID NO: 86306 - DNA, 601 bp, Human
cctcaagtaatctgcccagcttggcctcccaaagtgctgagattatagatgtgaatcactgtgtccaaccatatgtatttttaatatataaaaatacgatgttttatatttttaatgtataaaatatgatgttttacatattttaatgtataaaaatatatgatcttttatatttttaatatataaaaacatatggtgttttatatatttaatacataaaatatatgttttataatattttaaatatataaaatacactgttttatatatttaaatatataaaatacactgttttatatatttaaatatataaaatacactgttttatatatttaaatatataaaatacactgttttatatatttaaatatataaaatacactgttttatatatttaaatatataaaatacactgttttatatatttaaatatataaaatacactgttttatatatttaaatatataaaatatactgttttatatatttaaatatataaaatacactgttttatatatttaaatatataaaatatactgttttatatatttaaatatataaaatatataatttctatatatttatatataatgttttatat

SEQ ID NO: 86307 - DNA, 601 bp, Human
tgacctcaagtaatctgcccagcttggcctcccaaagtgctgagattatagatgtgaatcactgtgtccaaccatatgtatttttaatatataaaaatacgatgttttatatttttaatgtataaaatatgatgttttacatattttaatgtataaaaatatatgatcttttatatttttaatatataaaaacatatggtgttttatatatttaatacataaaatatatgttttataatattttaaatatataaaatacactgttttatatatttaaatatataaaatacactgttttatatatttaaatatataaaatacactgttttatatatttaaatatataaaatacactgttttatatatttaaatatataaaatacactgttttatatatttaaatatataaaatacactgttttatatatttaaatatataaaatacactgttttatatatttaaatatataaaatatactgttttatatatttaaatatataaaatacactgttttatatatttaaatatataaaatatactgttttatatatttaaatatataaaatatataatttctatatatttatatataatgtttta

SEQ ID NO: 86308 - DNA, 601 bp, Human
gttgcctaggctggtcttcaactcctgacctcaagtaatctgcccagcttggcctcccaaagtgctgagattatagatgtgaatcactgtgtccaaccatatgtatttttaatatataaaaatacgatgttttatatttttaatgtataaaatatgatgttttacatattttaatgtataaaaatatatgatcttttatatttttaatatataaaaacatatggtgttttatatatttaatacataaaatatatgttttataatattttaaatatataaaatacactgttttatatattttaatatataaaatacactgttttatatatttaaatatataaaatacactgttttatatatttaaatatataaaatacactgttttatatatttaaatatataaaatacactgttttatatatttaaatatataaaatacactgttttatatatttaaatatataaaatacactgttttatatatttaaatatataaaatatactgttttatatatttaaatatataaaatacactgttttatatatttaaatatataaaatatactgttttatatatttaaatatataaaatatataattt

SEQ ID NO: 86309 - DNA, 601 bp, Human
agccatgttgcctaggctggtcttcaactcctgacctcaagtaatctgcccagcttggcctcccaaagtgctgagattatagatgtgaatcactgtgtccaaccatatgtatttttaatatataaaaatacgatgttttatatttttaatgtataaaatatgatgttttacatattttaatgtataaaaatatatgatcttttatatttttaatatataaaaacatatggtgttttatatatttaatacataaaatatatgttttataatattttaaatatataaaatacactgttttatatatttaaatatataaaatacactgttttatatatttaaatatataaaatacactgttttatatatttaaatatataaaatacactgttttatatatttaaatatataaaatacactgttttatatatttaaatatataaaatacactgttttatatatttaaatatataaaatacactgttttatatatttaaatatataaaatatactgttttatatatttaaatatataaaatacactgttttatatatttaaatatataaaatatactgttttatatatttaaatatataaaatata

SEQ ID NO: 86310 - DNA, 601 bp, Human
atttatttatttttgagtcagagtctcactctgttgcctaggctggagtgtagtggctcgatctcgacttattgcaacctccacctcccagattcaagtgattctcatgcttcagcctcctgagtagctgggatcacaggcgcccaccaccatagctggctaatttttgtacttttaagaaagacagggtttagccatgttgcctaggctggtcttcaactcctgacctcaagtaatctgcccagcttggcctcccaaagtgctgagattatagatgtgaatcactgtgtccaaccatatrtatttttaatatataaaaatacgatgttttatatttttaatgtataaaatatgatgttttacatattttaatgtataaaaatatatgatcttttatatttttaatatataaaaacatatggtgttttatatatttaatacataaaatatatgttttataatattttaaatatataaaatacactgttttatatatttaaatatataaaatacactgttttatatatttaaatatataaaatacactgttttatatatttaaatatataaaatacactgttttatatatttaaatatataa

SEQ ID NO: 86311 - DNA, 601 bp, Human
atgaatcatgatgaattatgaatcatgaatcatgggatgtacacttgcccttccttggtgggccccacctcttcctcatctccaggagagtggaggctgggggactgcttatcaaaaaaaaacttcatcccagggagccacagtggggacactggagaaagcaagggcctttttaggaggggcatatttatttattccatgatgtattcaggatttcaacttcaaagaggctgacatttgtgacctcactgataaaattttctccaaaccaaaacaggccttcacaatacatttagcaatyacatattatatctttaaaatcctgatctcaaggactgagatctgggcacttgcatcttgtgtgataatagctgagactggagtttgaaacgaggaagtaaaaatctctcttcctagtcatgaaacaaacattggtgtgtcatgctgtgcccttgtaactgagggtgcaaatattaataagtcacattccctatatgtaggtggctcagaagccagggagaagacaaactatacactgtaaagacaggtgatgagggtagagagagatacacccaggtactgtggaagtaggaagagctaa

SEQ ID NO: 86312 - DNA, 601 bp, Human
tcacaccactctctttctgttcatcacaaggtttattacaacatggggtcacccatttcttcctggtcgaattgttttctaaccacgtaagttccatgatggaaaggtcctagtcttttgccctccctgttcatccatgtatcccctgtgcccagcaatgtgcctaacatgcaaactgtgcttaatgcacattcattcattctgtattaaaacaatttatttataacaattttacttataacaatgtctgtgttatttcactgtaaaggaattcagcaaaaatcattaaaacattcctgaycccaaaacatggtctgtttcacacaattatgaatcatgatgaattatgaatcatgaatcatgggatgtacacttgcccttccttggtgggccccacctcttcctcatctccaggagagtggaggctgggggactgcttatcaaaaaaaaacttcatcccagggagccacagtggggacactggagaaagcaagggcctttttaggaggggcatatttatttattccatgatgtattcaggatttcaacttcaaagaggctgacatttgtgacctcactgataaaattttctccaaaccaa

SEQ ID NO: 86313 - DNA, 601 bp, Human
cttctcacaccactctctttctgttcatcacaaggtttattacaacatggggtcacccatttcttcctggtcgaattgttttctaaccacgtaagttccatgatggaaaggtcctagtcttttgccctccctgttcatccatgtatcccctgtgcccagcaatgtgcctaacatgcaaactgtgcttaatgcacattcattcattctgtattaaaacaatttatttataacaattttacttataacaatgtctgtgttatttcactgtaaaggaattcagcaaaaatcattaaaacattcmtgaccccaaaacatggtctgtttcacacaattatgaatcatgatgaattatgaatcatgaatcatgggatgtacacttgcccttccttggtgggccccacctcttcctcatctccaggagagtggaggctgggggactgcttatcaaaaaaaaacttcatcccagggagccacagtggggacactggagaaagcaagggcctttttaggaggggcatatttatttattccatgatgtattcaggatttcaacttcaaagaggctgacatttgtgacctcactgataaaattttctccaaa

SEQ ID NO: 86314 - DNA, 601 bp, Human
actcatcactctctagcactgcactgggtttcattccgtttcccaaactcccaagctcctttcctccccagggcctttgcacctgccattgcctctacctggaaggctttgcccagatattcacatgtctggcttcttctcatcctgtatatatcaccttaaatcttatctgtgtgagctaaagtaaccccacataccccgatgtactctcttctcacaccactctctttctgttcatcacaaggtttattacaacatggggtcacccatttcttcctggtcgaattgttttctaaccacrtaagttccatgatggaaaggtcctagtcttttgccctccctgttcatccatgtatcccctgtgcccagcaatgtgcctaacatgcaaactgtgcttaatgcacattcattcattctgtattaaaacaatttatttataacaattttacttataacaatgtctgtgttatttcactgtaaaggaattcagcaaaaatcattaaaacattcctgaccccaaaacatggtctgtttcacacaattatgaatcatgatgaattatgaatcatgaatcatgggatgtacacttgcccttccttgg

SEQ ID NO: 86315 - DNA, 601 bp, Human
agctccatctccaccaattacccagaatggagggggttgggctagagttaaaactgccacaaatatgatagaaatgtgtcctaagtacattaaagttgatggaatgtccagataccatttccttcttagtatacatggctctgaaaaatgtgtcaaaatcgaattctctttttctttctggtcgctgttggccatgcactgatgccctttccctacctctgttcatttgtatcaccttcattctatgttccttcccttcttcccctatcacaggctcttccttcacctggtcaagatttcyggaagattagagagaagttttaggtgccccaggtttaagattcaaggtcacaggcatatagtggcattctttggtctccctggaaacctcagccagtttatgagttatctcacccatatccctgaacatgaggtatatttctaaatacaaatgatcaatgacgcattttcacccaacaagcacccactaagtgcctactgtgcacaagacatggaactgggccttggggacacaggatgaaaaaggcacgcagcaaaggcaatagttgaatttatcacagtaattatggaattgcagacc

SEQ ID NO: 86316 - DNA, 601 bp, Human
ctggcctcaagtgatactcccactttggcctttcaaagtgctgggattacaggtgtgcgacaccatactcaagctggaaaacataattttgagtaacagaagtgggttgtaaatgacacctgcttatcaatgctttcctttatctcaggatcacagactgcctgtcttgaatcactctcttcaccattgtatcccacccccacatcctgtcagtgacttgtactcaaccactctgcttctgtcaacccagaccaccatagagactttactctcttgcctagaggctggatgacctgctgtsatccaccacccttagtgggggggtagtaggaggccacatctgtgtatatttacatgtgatgattagtgacctcaacactgtacagtcatgggatatgtgccagctccatctccaccaattacccagaatggagggggttgggctagagttaaaactgccacaaatatgatagaaatgtgtcctaagtacattaaagttgatggaatgtccagataccatttccttcttagtatacatggctctgaaaaatgtgtcaaaatcgaattctctttttctttctggtcgctgttggccatgcac

SEQ ID NO: 86317 - DNA, 601 bp, Human
gaaacgaggaaaggaagaaaggaaagaaagaaagaagcaagctattttggaacggtgaaaaacatgttttcttttttacatttttagggtttttccccaaattatctagtaagtacatactacttatgtaattggcaacacagacacacacacacgcatcaaacaacattgatttacatgatatacatcatctctatatccatgaaggtgggcagatttgacagaacaattttttaagagacacgctcttgctctgttgcccaggctgggttgcagtgatgtgatcatggctcatggcagmctggacctcctggcctcaagtgatactcccactttggcctttcaaagtgctgggattacaggtgtgcgacaccatactcaagctggaaaacataattttgagtaacagaagtgggttgtaaatgacacctgcttatcaatgctttcctttatctcaggatcacagactgcctgtcttgaatcactctcttcaccattgtatcccacccccacatcctgtcagtgacttgtactcaaccactctgcttctgtcaacccagaccaccatagagactttactctcttgcctagaggctggatg

SEQ ID NO: 86318 - DNA, 601 bp, Human
aagttgggtggatcccctgaggttgggagtttgagaccagcctggccaacatggagaaaccccatttttactaaaaatacaaaaatgagctgggcatggtggcatgcacctgtaatcccagctacacaggaggcataagaatagcttcaatctgggaggtagaggttgcagtgagccaagatcgcaccactgcactccagcctaggtgacagaatgtgactctgtcgagagaaagagagaaagaaagaaagagagagagagagagagaggaagaaagaaagaaagaaagaaagagagaaasagaaagagaaaaaggggggagagggagagatagaaagaaagaaagagagagagagaaagagagggagggagagagaagagagaaagaaagagaaagaaataaaggaggaaacgaggaaaggaagaaaggaaagaaagaaagaagcaagctattttggaacggtgaaaaacatgttttcttttttacatttttagggtttttccccaaattatctagtaagtacatactacttatgtaattggcaacacagacacacacacacgcatcaaacaacattgatttacatgatatacatcatct

SEQ ID NO: 86319 - DNA, 601 bp, Human
tcacattcatcccctcattggttgaattgctgtaaagaaaaaccccaagaccacagaatgttagcactggaaggtttgttcacaatcattagctgtactcttctcctatttttcagatgagtaaactgaagttgaaaaggggaagtggctttcccaaggacacactgtgagtacatgacagcaaaagcagaaagtgtccttaattatagcagttatcatgacaagaactaacacttattgagtaattactatttgctaagcactatcctaaaggcttcatactaattgttgaattaatctycatgacattttctgaattagttgatatttgtacacccattaaacaggtaaaaattaccaactcttaaatttttaagagtttataacatacacaactttagactagagtttagtcatcagatctaaactgagtcataaaaacttactagagaatggaagagaggaggatgtgaaattctcagagaaagcaaggttttgcttcattctataattacagaggcttgaaaccaaaggggagaagtgaaggtacccagacaacacctcagccaagaatcaggagacctgggttctattccatgcc

SEQ ID NO: 86320 - DNA, 601 bp, Human
agcctaggggatgaaaagataacttacttcaccgatcattccattccacacattgttaactttcttgccatgcttcccattggtcaccagatagaggtcgtaagtaaacttcacagttctggaaagcttcttcagaatatcaatgcagaaccccttgcagcatttcttcacattcatcccctcattggttgaattgctgtaaagaaaaaccccaagaccacagaatgttagcactggaaggtttgttcacaatcattagctgtactcttctcctatttttcagatgagtaaactgaagttkaaaaggggaagtggctttcccaaggacacactgtgagtacatgacagcaaaagcagaaagtgtccttaattatagcagttatcatgacaagaactaacacttattgagtaattactatttgctaagcactatcctaaaggcttcatactaattgttgaattaatcttcatgacattttctgaattagttgatatttgtacacccattaaacaggtaaaaattaccaactcttaaatttttaagagtttataacatacacaactttagactagagtttagtcatcagatctaaactgagtc

SEQ ID NO: 86321 - DNA, 601 bp, Human
gcaaaaaaaaaaaaaaaaaaaagagagagagagaacaacagtactttacttttcctgctaacattcctgaggactgcaggccctttgtctgagtaagagcctaggggatgaaaagataacttacttcaccgatcattccattccacacattgttaactttcttgccatgcttcccattggtcaccagatagaggtcgtaagtaaacttcacagttctggaaagcttcttcagaatatcaatgcagaaccccttgcagcatttcttcacattcatcccctcattggttgaattgctgtaaaraaaaaccccaagaccacagaatgttagcactggaaggtttgttcacaatcattagctgtactcttctcctatttttcagatgagtaaactgaagttgaaaaggggaagtggctttcccaaggacacactgtgagtacatgacagcaaaagcagaaagtgtccttaattatagcagttatcatgacaagaactaacacttattgagtaattactatttgctaagcactatcctaaaggcttcatactaattgttgaattaatcttcatgacattttctgaattagttgatatttgtacacc

SEQ ID NO: 86322 - DNA, 601 bp, Human
ctgccatggccaaacagagctaaacaagttcctttctggtcccatcctctgagcaaacaagatttcctacaattccttataggaaagcaatagtcactatgaaattcacacacctagaaaagcagaaggtgagacggtgccattacttcttgaaaccatgacactgattcccgtttccacaaagggcacagagaagtccaccacttcagaacgttcctcattgatggtgagcgagccaactgccatgactgcccgttgatagaccacctggatgcaaggcaaaaaaaaaaaaaaaaaaaagagagagagagaacaacagtactttacttttcctgctaacattcctgaggactgcaggccctttgtctgagtaagagcctaggggatgaaaagataacttacttcaccgatcattccattccacacattgttaactttcttgccatgcttcccattggtcaccagatagaggtcgtaagtaaacttcacagttctggaaagcttcttcagaatatcaatgcagaaccccttgcagcatttcttcacattcatcccctcattggttgaattgctgtaaagaaaaaccccaagaccacagaat

SEQ ID NO: 86323 - DNA, 601 bp, Human
gcagcatcctctgaaatatgctgccatggccaaacagagctaaacaagttcctttctggtcccatcctctgagcaaacaagatttcctacaattccttataggaaagcaatagtcactatgaaattcacacacctagaaaagcagaaggtgagacggtgccattacttcttgaaaccatgacactgattcccgtttccacaaagggcacagagaagtccaccacttcagaacgttcctcattgatggtgagcgagccaactgccatgactgcccgttgatagaccacctggatgcaaggcaaaaaaaaaaaaaaaaaaaagagagagagagaacaacagtactttacttttcctgctaacattcctgaggactgcaggccctttgtctgagtaagagcctaggggatgaaaagataacttacttcaccgatcattccattccacacattgttaactttcttgccatgcttcccattggtcaccagatagaggtcgtaagtaaacttcacagttctggaaagcttcttcagaatatcaatgcagaaccccttgcagcatttcttcacattcatcccctcattggttgaattgctgtaaagaa

SEQ ID NO: 86324 - DNA, 601 bp, Human
taatttgggacaaacccacttatatgggagtgccaagggggaattagtgatctgaatttcatgatattcaacaagatagttacagtcaaaactcatttatgataaccaaacagttaatacaacactttcctttaaagacaaaaataatgctttactatgttccatgaaatttcaactctagccaggctacccaatacagtccaagtgctagagaaaagcagatgatagaaaacatagctcttccttgatttaaaaaaaaaaaacaccttttatgtaaaaacataaatttacaaaacggttaaaaaaatcacaagaatttccttctttacaaactatttggcttaatgggtagtcacatttaaaatatgattcgattaattttaaatcagcatatacttttcagactattcctattagcagaatattggcataaatcatcgtgcagtcatcattattttcactcttacatctagcaaataaatgactgctgttctttgtgggatggaggatggatatgtagatgctgaataaaggtctatgagctggtttaaattaactgtggacagctttatttttaaatgttttcaatattctaagcaat

SEQ ID NO: 86325 - DNA, 601 bp, Human
aaccttccctaatttgggacaaacccacttatatgggagtgccaagggggaattagtgatctgaatttcatgatattcaacaagatagttacagtcaaaactcatttatgataaccaaacagttaatacaacactttcctttaaagacaaaaataatgctttactatgttccatgaaatttcaactctagccaggctacccaatacagtccaagtgctagagaaaagcagatgatagaaaacatagctcttccttgatttaaaaaaaaaaaacaccttttatgtaaaaacataaatttacraaacggttaaaaaaatcacaagaatttccttctttacaaactatttggcttaatgggtagtcacatttaaaatatgattcgattaattttaaatcagcatatacttttcagactattcctattagcagaatattggcataaatcatcgtgcagtcatcattattttcactcttacatctagcaaataaatgactgctgttctttgtgggatggaggatggatatgtagatgctgaataaaggtctatgagctggtttaaattaactgtggacagctttatttttaaatgttttcaatatt

SEQ ID NO: 86326 - DNA, 601 bp, Human
aatggacactggagactcagaaagggagaggatgggagggagatgagtgatggaaaattacctacaatgtacactatttaggtgacaggtacactaaaggcccagacttcaccactatataattcgtccatataaccaaaaatcacttgtacccctgagctattgaaattttttaaaaattatacatatttttcccctctcagttttcctccagagattcacgtttgtcttaaccttccctaatttgggacaaacccacttatatgggagtgccaagggggaattagtgatctgaatttcrtgatattcaacaagatagttacagtcaaaactcatttatgataaccaaacagttaatacaacactttcctttaaagacaaaaataatgctttactatgttccatgaaatttcaactctagccaggctacccaatacagtccaagtgctagagaaaagcagatgatagaaaacatagctcttccttgatttaaaaaaaaaaaacaccttttatgtaaaaacataaatttacaaaacggttaaaaaaatcacaagaatttccttctttacaaactatttggcttaatgggtagtcacattta

SEQ ID NO: 86327 - DNA, 601 bp, Human
agcaacgagtgcaaaatcaaatccagagagtggcaagcattttaacagcttaaatggattatcaaaaatgaaaacagtaaatccatagcgctctgaatgtaaggcagtgtccaaaatcctgttagtcaatatttcactgaagagaacgaaacatgaaagtttcactggatgccaacattacatataaatgaagacagtggaagaataagacaatgggcttggagttggtgtccacaaattggtttcagtttacaatttgctttaagagataaagttatttttgtctctggaaaaatataakaaagttagttgactttaatataactgttttcccaggggggagatttctcaaacaactaaaagtagatctaccatttgatccagcaatttcactactgggtatctacccaaaggaaaagaagttattatatcaaaaagacacttgcacacatatgtttatcagagcacaactcacaattgcaaagatatggaatcaacctatgagcccatcaactgatgattgcataaagaaaatgtggtatatatacattgtggaatactactcagccataaaaaagaatgatgcaatgtcttttgcagc

SEQ ID NO: 86328 - DNA, 601 bp, Human
caatatcagctggttgcattgttcctggcatagtgaggctctcttattaaaatacgagtatctgaatccatgtcagacggagggacaaaaggaacataatgaggtgtgtatttgtcagggtccacattactccaacaaaggttacaaaaattgaagcaacgagtgcaaaatcaaatccagagagtggcaagcattttaacagcttaaatggattatcaaaaatgaaaacagtaaatccatagcgctctgaatgtaaggcagtgtccaaaatcctgttagtcaatatttcactgaagagaaygaaacatgaaagtttcactggatgccaacattacatataaatgaagacagtggaagaataagacaatgggcttggagttggtgtccacaaattggtttcagtttacaatttgctttaagagataaagttatttttgtctctggaaaaatataagaaagttagttgactttaatataactgttttcccaggggggagatttctcaaacaactaaaagtagatctaccatttgatccagcaatttcactactgggtatctacccaaaggaaaagaagttattatatcaaaaagacacttgca

SEQ ID NO: 86329 - DNA, 601 bp, Human
gtaatttagtgactaggaaaaatattaagcctactgggtaaaaacagctttgaaaatagtttcctctggttacaatttattttacttttaaaaatgcagcaggaaaagtgtggggaaagagaggttttgctaaatttagcaaaatacttgacatttttatggaaatgttttacaaatgcaagcaagataaaaatctagagaaactgggttgaggccagattcaatattcacgacccattttcataagacaagccaattgatatttttttctctctgattgaattggaaaaagagttctctytagctcactaaagagatacaagacttttttgtgtgaaaagaaacaatttctttccattttgatccatgaactcacttcctctaaccctttcttaacctccaggacaaaggattcctgccaaagagtctgaaagggaatgaggggaaacatgactaggagtgactaaagagtgaatgtccacttaagaattattaagattctgcatgtgttgtcaatatcagctggttgcattgttcctggcatagtgaggctctcttattaaaatacgagtatctgaatccatgtcagacggagggacaa

SEQ ID NO: 86330 - DNA, 601 bp, Human
gattttgaatgttttggctcttccagatgactaagccagtgaatggaaaaatgtagcttagctggttcattatgactttcaaaatctgtagataatgaccgtaaataagggggtgcacagtcaatcaaatagggatgtaatttagtgactaggaaaaatattaagcctactgggtaaaaacagctttgaaaatagtttcctctggttacaatttattttacttttaaaaatgcagcaggaaaagtgtggggaaagagaggttttgctaaatttagcaaaatacttgacatttttatggaartgttttacaaatgcaagcaagataaaaatctagagaaactgggttgaggccagattcaatattcacgacccattttcataagacaagccaattgatatttttttctctctgattgaattggaaaaagagttctctctagctcactaaagagatacaagacttttttgtgtgaaaagaaacaatttctttccattttgatccatgaactcacttcctctaaccctttcttaacctccaggacaaaggattcctgccaaagagtctgaaagggaatgaggggaaacatgactaggagtgact

SEQ ID NO: 86331 - DNA, 601 bp, Human
agtagtttgaggaatgttcttaaactagattttataaagtcattttctttgcatagactgaagttgaaacccatgacaattttagcatttgacaagcattttttaaattaattgtcagaaaagttccttcaaatctgctttcccaacaaattgaacatcagtggttttcacctaacaactattgacttcaggttatgacaagattaaaatatttcattttgttttatccatcagttgaagtacataaaccatacttttctggtattacaagcaatatcagtgacccaaaaccattcatacratggtacaccaacgcagtataatgtattctttgtgtgtgtgtgattgagtctcgctctgtccctcaggctggagtgcagtggcacaatctcgactcactgcaacctctgcctcctggttttaagcgattctcctgcctctgcctcatgagtagctggtattacaggtgtgtgccaccatgcccagctaatttttgtatttttagtagagatgggtttcaccatattggtcaggctggttctgaactcctgacctcatgatccacccacctcggtctcccaaagtgctgggattacaggcg

SEQ ID NO: 86332 - DNA, 601 bp, Human
atcattatttatggcattgtttagtatctggttgattgaagatggtttatgtggtaatcaccactcttcaatggtgaggaagaagttgaaagatttcaataaaactaggttcctaatagattcccatgacctgttgagtatttccaatattaaaacatctaagtgaaaagaatatgtatccatcacattaaagtgctctgctttttgggggatatgagacttcaagttccatcctctaccatatcaagtcattttttgggaaagagatttggtcctgacacttttctgataacacccattkagaaggtagtgcccactgaggaaagcccactcaaaatggcataacgtgtatgacataaaccctggctagagtgggatccttttaatgagttatagctaacgaatgcctcccaattttatttcctatctactgattgtccctttatcaactacaatgcactaagatcaatgcattttattttagcacacttgatttcctcctggcatcaccaacaggaaaatataaccctatggggaaatatatcacttcatagttatatttattgtcaaactaatgtaaattgattcagtagtttgagga

SEQ ID NO: 86333 - DNA, 601 bp, Human
taaaattgtatgtcacccttcaggtcctagctcaatgaacatcctttcccattggaccatcttatctaacgtagtgtctgcaccccatcactatcatgtcactatgtttttttcttcttcttgatatttattataatctgttattattagtttgtgtgtctacatgttattttcacaactaaattctaaactgcctgatagaaaatctctatttgatttaccacattatctctggcagcagtatagtgcctcctggcacgtagtacccatttgataaatattcatcagaaaatgtgtaaattcacaacagcacaagccctgattatgcaaatataaggaactactgtatcacagtgtggtcactcacagaaactgtctcagattccaccctgttggaaatcttcttagaggttaaattaccctttaaatgaaggcttgcaatctcccattaaacacaacatcattatttatggcattgtttagtatctggttgattgaagatggtttatgtggtaatcaccactcttcaatggtgaggaagaagttgaaagatttcaataaaactaggttcctaatagattcccatgacctgttgagtatt

SEQ ID NO: 86334 - DNA, 601 bp, Human
ggcaattctcctgccttggcctcaaaaagccttgacatcacaagtatgagccactgcaccccctcagcctttttctgtttcttgagcatctcaagattatttcagcctttctgtttgctgttccttttacatgaaatgactgtaactgtttttgacagataaaattgtatgtcacccttcaggtcctagctcaatgaacatcctttcccattggaccatcttatctaacgtagtgtctgcaccccatcactatcatgtcactatgtttttttcttcttcttgatatttattataatctgtkattattagtttgtgtgtctacatgttattttcacaactaaattctaaactgcctgatagaaaatctctatttgatttaccacattatctctggcagcagtatagtgcctcctggcacgtagtacccatttgataaatattcatcagaaaatgtgtaaattcacaacagcacaagccctgattatgcaaatataaggaactactgtatcacagtgtggtcactcacagaaactgtctcagattccaccctgttggaaatcttcttagaggttaaattaccctttaaatgaaggcttgcaat

SEQ ID NO: 86335 - DNA, 601 bp, Human
aaaaccctctccaaatggagacattaaggaatggaacaatagatcttaattcttccaacacttcacagatggaagacatttcattgcagggtcatggaaaatgaacactgatgtcatatcacagcactttttccagtatatcctcgcaatagctatgcagcccttttaagattcttaaatgttccttgcaacagacttaactaaagagacagaatgatatgccaaaatttatggcgatggggcatatgcaggctgtaaaacacacatattagggttttcaagtctttgttctgcatgggcaaaaaaaaaaaaaaaaaaaaatcaactgatgccctaatttcatagggaaggtttccctttaacaggaggttaatttttatgtcatttaagtaaatgaagatatgaaaaaatgatctactcagatgtcacctgccaatataagcagagtgggcaataaataaagtggcagaagcaaattcacattaatggaagttatgaagtgctgggcaggaagcctaggaaaagcaagctctctgcacattggaggccaaacccaggctacagctgtacttataatatccatgacacaacccattaaaga

SEQ ID NO: 86336 - DNA, 601 bp, Human
cacagcctacagtgctccttcaccccaatttcttctcatccaggaaaatgggccttccttaacatcacacattcgaaaggatgaatttcaacctaagcacttgagtcataggtcattcacaagcaccatcagaaagatcatataaataggaaacacgaccactcggggaagccaggcttccaaattagatctggaatcttttaggtctaggagagctaaccttaatgttctgtttcaaaaactttgagaaagaggacaatttgagttaaagagaaaaaaccttctggcttttgtgcattcragttgatggatctcaatgagaggcacctgaatctcttcctcctgaaaggagagcagttaagaccaaccctcagatggagaggaaagcaaggtgaccttacctttttgtcactgaggccggtcacttggtccacaaattcctcttggatcatgaaggcagccagattggctgtgtagctagccaggaatatgacagcgaagaaggcccatacagataccatgatcttgctggtggtccctttaggattctggacaggcacggagttattgaacaccaggccccaaagaagccatatagctt

SEQ ID NO: 86337 - DNA, 601 bp, Human
ttgatgaatggcaaaaggatatatgtagacttatgtcaaaaagatatgttagcgaggttttataacgagagacaaattatccccacacacagaacagaaaatctttgtggtgctgcaatctcaacacttgctgagcttagcaagtcaggatgtttcctgaactaaagtctcaataggaggatgcacccagtttacctcttttcttcctcaatgtgtgtttctgaatagctactcaaaccctgcaacccttgttatatttcatttcactggagaatgagagagcaggtgtttttactcctgycttactgatgtgggaagtacagccctataagggaagattagtgatatatctgagtagaaagaaccagtgggaaattaaaaaaacagaaagaaagaaagaaaaaaactctctgctccttttgtgtgccttgaagacatttcaggtgagtcagaagcgctgatgctgagactgatttggctgtatggaaaagaggagctgtcagataattttgtctctgggtagggcttaaagatgactttttttcaggtcatagatgaggtacccacagcctacagtgctccttcaccccaatttcttctc

SEQ ID NO: 86338 - DNA, 601 bp, Human
ctttaaccccaacccctcatcagctctcttgacaagattctttcaaccacagtgtgtatcatggataagctgtaaaagctttccatggattgattttctattcagcagtttgttgatgaatggcaaaaggatatatgtagacttatgtcaaaaagatatgttagcgaggttttataacgagagacaaattatccccacacacagaacagaaaatctttgtggtgctgcaatctcaacacttgctgagcttagcaagtcaggatgtttcctgaactaaagtctcaataggaggatgcacccrgtttacctcttttcttcctcaatgtgtgtttctgaatagctactcaaaccctgcaacccttgttatatttcatttcactggagaatgagagagcaggtgtttttactcctgtcttactgatgtgggaagtacagccctataagggaagattagtgatatatctgagtagaaagaaccagtgggaaattaaaaaaacagaaagaaagaaagaaaaaaactctctgctccttttgtgtgccttgaagacatttcaggtgagtcagaagcgctgatgctgagactgatttggctgtatggaaa

SEQ ID NO: 86339 - DNA, 601 bp, Human
ggtatctgttactgggtgtttccaagtcagtgaaggtcagtcaaattattagtggttttaattagttttcccacaagtggtcatgttatttagacccaaaactatgtagtaaggatttccccccgcccttgcctttgaacatagcaacaaaaagcaaaatatgctgccaaccactttcttgaaaaatcctctcttccaggacattgcttcctgctgcttccaccatacctccaatcacttctaggaattgcacttttgatcccataatgtgacagacttgcacaatagcgcttcatgtctgcagagggattcatatgctacaagatacatttacatatgtggctttctttcatccttactgcaattgtgactcccaaatttacaaagcagacaaagcaggcaccgtgaggtgacatggctttaaaaacattatacggctggctggcgagtggcagagaggaaacaggcagagaggaaacacaacttttctgactctaaacacagtgtgttatctgctgcctctgagataccacccgctttaggcggggatcttacagtagctgaccccaagtgaaggatttgggggtgagcatgatttact

SEQ ID NO: 86340 - DNA, 601 bp, Human
atggagactgagctttgtctcttgaggatatggtatctgttactgggtgtttccaagtcagtgaaggtcagtcaaattattagtggttttaattagttttcccacaagtggtcatgttatttagacccaaaactatgtagtaaggatttccccccgcccttgcctttgaacatagcaacaaaaagcaaaatatgctgccaaccactttcttgaaaaatcctctcttccaggacattgcttcctgctgcttccaccatacctccaatcacttctaggaattgcacttttgatcccataatgygacagacttgcacaatagcgcttcatgtctgcagagggattcatatgctacaagatacatttacatatgtggctttctttcatccttactgcaattgtgactcccaaatttacaaagcagacaaagcaggcaccgtgaggtgacatggctttaaaaacattatacggctggctggcgagtggcagagaggaaacaggcagagaggaaacacaacttttctgactctaaacacagtgtgttatctgctgcctctgagataccacccgctttaggcggggatcttacagtagctgaccccaa

SEQ ID NO: 86341 - DNA, 601 bp, Human
aggttctcatctgctgcttagaaactgcgccatttggagcaaccagttaagctcctgagcctgaatttctctatctgtaaattggagattgcttttgcaacaaatcttatagtgtttgaaagaacacctggcatcctctaatgcttgggatagatcacctgttgttacccacgacatttcagccaaacaatgaagcctgtctccttacagtttggagaacagaggattattttctaattttttttccatccaatatggaggcatgtctgaaggtcatccaagtgactaaaacatggcaagyatttgatgatggaggaggtagagatgcaacacttggagataaaatttccagaaaaatgcagcaattaaccaagatattttttctttttttgtgaaccaaaaactacccatttattaaaaatatctatctgtcttctgtgcctgtaaataagggacatctggcaactggagcccctatttctagtacagtcttctgttggtgaagtcccacgtgcttcttgatgtgagcagcaagcaggtgtgtccttgagcagagagaggatcagctgggaggaggcctggctgcctgaactgggaccac

SEQ ID NO: 86342 - DNA, 601 bp, Human
agaaatacaatgggagcagataggaactgaggcatgccgagagtcaatttctgtaaggtttatcgctcgcagacctgtggtgaaaaggaaactgccatccttaccccgttttcaggctgaccaaggcgtcctctactcctttctgattaaatttggtcatgtactgatgcatgtagggatagttattccgaatgtttctctccgtgcttccattaggcactgtcccaaatcgaaaaggtggggaatagtcatgaggtctctgaaactggagagagaacgagaaaggaagagagagagtagraaaagaaagagaagggaggagggggaggagagaacaaataataaattagtgatcattttgtctggtgttaggaggtaaatgcatgcattagggcaggatgacaataaaatgttgctttttggtctttctttctacttagtcacatcttcagccagtctgtgagctccaggagggtggacacagcatctgttttcttctgtactactgctcagatcctagcacagagcccggctgggtgctccataggtatttgttgagttgaacttttcagtgccattacagagactagcacagtgttag

SEQ ID NO: 86343 - DNA, 601 bp, Human
aagcatcctggatttgctttttcttcacccaactcagaaggaaacctgggatgctcattagattaacaaaaactgccctcaactggggcccatctggaccacagtcactctccagaaatacaatgggagcagataggaactgaggcatgccgagagtcaatttctgtaaggtttatcgctcgcagacctgtggtgaaaaggaaactgccatccttaccccgttttcaggctgaccaaggcgtcctctactcctttctgattaaatttggtcatgtactgatgcatgtagggatagttattscgaatgtttctctccgtgcttccattaggcactgtcccaaatcgaaaaggtggggaatagtcatgaggtctctgaaactggagagagaacgagaaaggaagagagagagtaggaaaagaaagagaagggaggagggggaggagagaacaaataataaattagtgatcattttgtctggtgttaggaggtaaatgcatgcattagggcaggatgacaataaaatgttgctttttggtctttctttctacttagtcacatcttcagccagtctgtgagctccaggagggtggacacagcatc

SEQ ID NO: 86344 - DNA, 601 bp, Human
aagtttaaagaaatcattccaaaccagaatgagcactgtgggaatgagtttttcagaaatcatagacttaacttctgaataaatgctctcccagcccctgctgagatgccaaagacattccaaaggcacagactgaaaggacagaatgctcacagccaaaactaccgggatttctatgcagaaatctgggctttgatgctttagaggggcctctgtctccccctaccagacacaaagccagcagcaaggccttcacaatgggcttgccgaacagccgaaaaggaggttatttattaagccrcaaggagaatgcacctacagtcatgtttccatgcaggaatctgtgacaactgaaatgccccatatgagctaattttctggataatcaaaatcccctcattaaacaactctgtcatttaaaataaaatcatttttattggatttaatcctttctaaaatggatttcatgcattcctgggtctacatccaggacacactccgtgcttcctacgagaatgattcctagcaagactttctcccagagagttccacatgcaagcagaaagaaaccaatgtgggctttagcaaaggaaggggtagg

SEQ ID NO: 86345 - DNA, 601 bp, Human
atctgcatttgtgctcatggtctgtccaaaacaacagtatatgttgattaaaagaccacaatggaaacaaacaaaaatcccaaacccatggctaaactgtaaagtcatcaacaattggtcttttcaggtatctgtgaaagtggaagacacaaatattctatggctcagcagttgcagtcttcggtgtataccaacagaaatgcgctcactcattaacaaaagaagcattattcataatggccccaaaataggacattacccaaatgtccatcaagattaggacagagacatccatgtgtgstgcattccagcaatgagaatgaaagcactgaaattacatgcaacaatcttgcaaacacaatgttgagccaaagacgacaaaaaagaaaagagtgtggctttatttctatgttaaaacagcaggcaccaagaatctacggctttagaagtgcaggtggcgggtggaagatattgactggaagagggtgtggggcggggttccagggagtgatgacctggatgatcagtttgtacgaagccataaagcagcatatttaatatttgtgaattttctgcatttttgttatacttcaaaagttta

SEQ ID NO: 86346 - DNA, 601 bp, Human
ctgtctccaaccattatcatctgcatttgtgctcatggtctgtccaaaacaacagtatatgttgattaaaagaccacaatggaaacaaacaaaaatcccaaacccatggctaaactgtaaagtcatcaacaattggtcttttcaggtatctgtgaaagtggaagacacaaatattctatggctcagcagttgcagtcttcggtgtataccaacagaaatgcgctcactcattaacaaaagaagcattattcataatggccccaaaataggacattacccaaatgtccatcaagattaggasagagacatccatgtgtgctgcattccagcaatgagaatgaaagcactgaaattacatgcaacaatcttgcaaacacaatgttgagccaaagacgacaaaaaagaaaagagtgtggctttatttctatgttaaaacagcaggcaccaagaatctacggctttagaagtgcaggtggcgggtggaagatattgactggaagagggtgtggggcggggttccagggagtgatgacctggatgatcagtttgtacgaagccataaagcagcatatttaatatttgtgaattttctgcatttttg

SEQ ID NO: 86347 - DNA, 601 bp, Human
ctgagtttaaagtaacaatgcaaagcatcccccacatgggagattgagtatagaatgaatctgccatctgcccacgttttctaagatggatgttataattattatatggcttccagaaaccaatttgtacaatttatggccacgaatggtttccatttctctcctttttgctattatattaaaaaaaagattgaaaaagaaagaaaacaacccattttgtgctctggttaataaatggagggagagaaagccagctaggcatcaaccactgtctccaaccattatcatctgcatttgtgckcatggtctgtccaaaacaacagtatatgttgattaaaagaccacaatggaaacaaacaaaaatcccaaacccatggctaaactgtaaagtcatcaacaattggtcttttcaggtatctgtgaaagtggaagacacaaatattctatggctcagcagttgcagtcttcggtgtataccaacagaaatgcgctcactcattaacaaaagaagcattattcataatggccccaaaataggacattacccaaatgtccatcaagattaggacagagacatccatgtgtgctgcattccagcaat

SEQ ID NO: 86348 - DNA, 601 bp, Human
aaaaaaaaaaaagacttgtactccttcagctctagtttctgagtttaaagtaacaatgcaaagcatcccccacatgggagattgagtatagaatgaatctgccatctgcccacgttttctaagatggatgttataattattatatggcttccagaaaccaatttgtacaatttatggccacgaatggtttccatttctctcctttttgctattatattaaaaaaaagattgaaaaagaaagaaaacaacccattttgtgctctggttaataaatggagggagagaaagccagctaggcatyaaccactgtctccaaccattatcatctgcatttgtgctcatggtctgtccaaaacaacagtatatgttgattaaaagaccacaatggaaacaaacaaaaatcccaaacccatggctaaactgtaaagtcatcaacaattggtcttttcaggtatctgtgaaagtggaagacacaaatattctatggctcagcagttgcagtcttcggtgtataccaacagaaatgcgctcactcattaacaaaagaagcattattcataatggccccaaaataggacattacccaaatgtccatcaagat

SEQ ID NO: 86349 - DNA, 601 bp, Human
aggttgcagcggggagagactgcaccattgcactccagcatgagcaacaagagcgaaactccgtctcaaaaaaaaaaaaaaaaaaaaaaaaaagacttgtactccttcagctctagtttctgagtttaaagtaacaatgcaaagcatcccccacatgggagattgagtatagaatgaatctgccatctgcccacgttttctaagatggatgttataattattatatggcttccagaaaccaatttgtacaatttatggccacgaatggtttccatttctctcctttttgctattatattaraaaaaagattgaaaaagaaagaaaacaacccattttgtgctctggttaataaatggagggagagaaagccagctaggcatcaaccactgtctccaaccattatcatctgcatttgtgctcatggtctgtccaaaacaacagtatatgttgattaaaagaccacaatggaaacaaacaaaaatcccaaacccatggctaaactgtaaagtcatcaacaattggtcttttcaggtatctgtgaaagtggaagacacaaatattctatggctcagcagttgcagtcttcggtgtataccaaca

SEQ ID NO: 86350 - DNA, 601 bp, Human
tatataaatatcttatctattcaaaatttaatttaggctgggcatagtgactcactcctgtaatcccagcactttgagaggctgaggcaggagaatggcttgagccttctgaatttgaaatcagcctgggtaacacggcaaaacctcatctccacacgaaacacaaacattagccaggtgtggtggtgcttgcctgtagtcccagctactcaggaggctgaggtgggatgattacctgagcccagggaagtccaggctgcaataagctatgattacactactgtactccaacctgggtgayagagtgagaccctgtctgaaaaaaaaaaaaaaatttaaataattaatcaaggagcctgttaaacatgtatgtggtttccccaaatattaactccaatgaaattaaatctccagtaatgataactgctgtgctttcatccctaagagtatattgaattattttttaaaaaatgacttgtggctgggtgcagtggctcatgactgtaatcccagcactttggaaggccaaggcaggaggatcacctgagctcagaagttcaagatgtgcctagtcaacatggtgaaaccctgtctctacaaa

SEQ ID NO: 86351 - DNA, 601 bp, Human
gccgatggctcttaagtatataaatatggccaaaatttactgagaaaagtgcaaatttatatctcagcatactttttacctattagcaaaattttgaaagattaattacacattgtattggcaaaactttggagaaataagctctctcatgcactgatggggtaagtatgaatttcctttggagggagatttggcaatatctgttaaaattgcaactgtgacccactctttcaagaaatttattctacactgaatgtgacgcaatacaaagatattcactacagctttgtttgcaatagcraaagattggaaacaacctaaatgtccaacaatagaggcctgaccaaataaaatatggtatatttgcataatgaaagattatgactctataaaaaataactttatggctttttatgcattaatatagaaagattcagaagaacatattggaaggatacacagagtaaatgtggttaccatggaggggtactagatgaggaatagtgtgcagggaaaacttttcactgtttttttctttttatgtacttttttatttttgacgtatataaatatcttatctattcaaaatttaatttaggct

SEQ ID NO: 86352 - DNA, 601 bp, Human
tgcatggaaaaaaaaaagcaagctcaaaagactaaaaaagaaatagggaaaatatttgtaatcacatcacaaaaggctcatctgtccaatatataaattaataagaaaaagaccaacaaaccaatagaaatattaataaaagtaaaaaaggaattgccgatggctcttaagtatataaatatggccaaaatttactgagaaaagtgcaaatttatatctcagcatactttttacctattagcaaaattttgaaagattaattacacattgtattggcaaaactttggagaaataagctctytcatgcactgatggggtaagtatgaatttcctttggagggagatttggcaatatctgttaaaattgcaactgtgacccactctttcaagaaatttattctacactgaatgtgacgcaatacaaagatattcactacagctttgtttgcaatagcaaaagattggaaacaacctaaatgtccaacaatagaggcctgaccaaataaaatatggtatatttgcataatgaaagattatgactctataaaaaataactttatggctttttatgcattaatatagaaagattcagaagaacata

SEQ ID NO: 86353 - DNA, 601 bp, Human
cacaatgaatagtgtgttggacttctaaaacagtagttctcaaatattcgtgtgtctcaaaatcacgtggtgtggcgtgctgcggggaatgatgcttattataataaagattcacaggctccatagctagagagaaagccttgtcctgggcccaggaatctgcattttgacaggtaatcatgtgattcaggtacagttggtccattggccaggcttggaggcacccaattttggggcatgattctaaatcctttctgcaaaactgacagttgtttgcatatgtggtttgtctgagtcttcmtaagtgtttgacacagataaaagaatctcatgaactagtttagagatcaaagaattcaaccatttcacttcttagatggggaaactagaaagtgacttggagaggtgacatgacttgtcccaggacacagctagctaatgctcgagtccagactcaaacccagctgggactgtcacttgacagtaatccaaagcctgtctggtgttcaggactctcccagaaaattacaacccacaatttcactgaccctggtgtgcatgcacgtggctttgctaggcagcagatgttactgaaacgtgt

SEQ ID NO: 86354 - DNA, 601 bp, Human
aaatagtagttctcagctctgttgcacaatgaatagtgtgttggacttctaaaacagtagttctcaaatattcgtgtgtctcaaaatcacgtggtgtggcgtgctgcggggaatgatgcttattataataaagattcacaggctccatagctagagagaaagccttgtcctgggcccaggaatctgcattttgacaggtaatcatgtgattcaggtacagttggtccattggccaggcttggaggcacccaattttggggcatgattctaaatcctttctgcaaaactgacagttgtttgyatatgtggtttgtctgagtcttcctaagtgtttgacacagataaaagaatctcatgaactagtttagagatcaaagaattcaaccatttcacttcttagatggggaaactagaaagtgacttggagaggtgacatgacttgtcccaggacacagctagctaatgctcgagtccagactcaaacccagctgggactgtcacttgacagtaatccaaagcctgtctggtgttcaggactctcccagaaaattacaacccacaatttcactgaccctggtgtgcatgcacgtggctttgctag

SEQ ID NO: 86355 - DNA, 601 bp, Human
ggttgtaccacacgatgaatgcatttaataccactgaactatacacttaaaaatgtgaagatggcaaattttactctatgcatattttatcacaataaaaaatactgggaaaaaagacaatcctctcttccaattcttctaactactgcatgtaaaggaaaccaacagagacctgttttttaacattgtgctgagaatgaaatcgcacaggggactggggatcctgagagctgaaaactgaggcttctaaggaaattgggacttttccataaatgtatacacccagacttgtacatgaaartcaattaaaagaaaaacacaaactatcccactgtgtcttgaaatattaggctcttcggagttctagggacgttgtttaatttaaatctggcatatgtgcgacgcttgcagttttgcccccatgccaaaatggcttggaggacatcagcttctgatgactgagcatttgtaaatctaaatctgtctccactcatttcagcttcagctccctcttctagagtggatgttcttaaaatttgattagggcatatcggagtcacctgaagagcttgttaaaccatgcagatcttcagacccctcc

SEQ ID NO: 86356 - DNA, 601 bp, Human
aatgcaaaactttctatgaagacatttcaaacacatacacggagatgggactacactgttcttttgtttttacagacatgtcactgaggacaactcaagccttttagaaaaatatttattggtaaaaagacaatactccctaaatttttttttaaatgtgcatcaaaagacactatcaatgtaatagctagaatataaaaaggtaacccatggaataggaaaaaatatttgcaaattgtatatctgataagggattgatatccagaatatacagagaactcttaaaacctaacaacaaccaaaaaaaaaaaaaaaaagaaaacccaaacaacccaaatgtaaaatggccaaaagacttgcatatccacctctcaaaagaataaatacaattgcccaataagcaggtaaaaagcgctcgataccactaatcattagggaaatgcaaatcaaaactgcaatgagataccacctcatacccagtgggatggctactattagaaaaacagaaaacaacaagtattggcaaggatgtggagaaattggaacccttgtgcactgttggtgggaatgcaaatgggactgtggaaaacagtatggttgt

SEQ ID NO: 86357 - DNA, 601 bp, Human
agccgagattgtgccattgcactccagcccgggcaacaagagcgaaactccgtttcaaaaaaaaaaaaaaaaaatggtacattcctaaatcccacaggctttgcaaacctgtgctctaggataggaattcagtgctcatttgtttttcaatgcaaaactttctatgaagacatttcaaacacatacacggagatgggactacactgttcttttgtttttacagacatgtcactgaggacaactcaagccttttagaaaaatatttattggtaaaaagacaatactccctaaattttttttwaaatgtgcatcaaaagacactatcaatgtaatagctagaatataaaaaggtaacccatggaataggaaaaaatatttgcaaattgtatatctgataagggattgatatccagaatatacagagaactcttaaaacctaacaacaaccaaaaaaaaaaaaaaaaagaaaacccaaacaacccaaatgtaaaatggccaaaagacttgcatatccacctctcaaaagaataaatacaattgcccaataagcaggtaaaaagcgctcgataccactaatcattagggaaatgcaaatcaaaac

SEQ ID NO: 86358 - DNA, 601 bp, Human
tttgtgtctgattctgtttgactgataaaatacagcaaataaaacctgctcaaatggcatctttgaaaaaatttgctctgcagagcaactgaacctcagtgacaacccttatactctcctggtttacctttgccttgggaatgccaatatccctgaaccagtttcttttgagcatagaaatgataatgctgtgattttatcagttctcagatcatcaattaatatgatatgtactctataatatatgcacatatgtaatatctaactttagttttaaattctcccctgaaccataaccccrtatttccaactgcctaggtggcatttccaagtggggaagtaagcctaacttctatacttactaattctgcaatgtagttacttagctgaatagcctattgggtaattaggttaacattgttgagcttcacattcttcatctcttaaaagggatattaatggtacccagatcgtaggggtgttgtgaggattaattgagattaggcatatgaagtgctcaggtctgtagctcactaattgtcaggtcacattaagtgcaaagatgcctggacatatgatgatggtgttccaaaggcacttc

SEQ ID NO: 86359 - DNA, 601 bp, Human
gaattcagcagctggaaatgaaccatttgtgtctgattctgtttgactgataaaatacagcaaataaaacctgctcaaatggcatctttgaaaaaatttgctctgcagagcaactgaacctcagtgacaacccttatactctcctggtttacctttgccttgggaatgccaatatccctgaaccagtttcttttgagcatagaaatgataatgctgtgattttatcagttctcagatcatcaattaatatgatatgtactctataatatatgcacatatgtaatatctaactttagttttmaattctcccctgaaccataaccccgtatttccaactgcctaggtggcatttccaagtggggaagtaagcctaacttctatacttactaattctgcaatgtagttacttagctgaatagcctattgggtaattaggttaacattgttgagcttcacattcttcatctcttaaaagggatattaatggtacccagatcgtaggggtgttgtgaggattaattgagattaggcatatgaagtgctcaggtctgtagctcactaattgtcaggtcacattaagtgcaaagatgcctggacatat

SEQ ID NO: 86360 - DNA, 601 bp, Human
tagtctgttttttttgcctttttttttttttccgtctctgagtttaaagaattatgatctcactttatttaactcctgccccccacagacatttttttctactttaaaaaaagtttttataggtggccttgaaaatcctttaacgttgttttaatagagcttaccaggaaataattccaagaaccccacccccccgcaaaaaaaaaaaagatgtctgtgtttacttgagtttttattaaggaaaaaactttctaactctatgatgtggaagcaattatttttgagctttgtttgcagtgtkggggtggatctcagaaaccaggtcattgttgatctgattttctctggagatgacgctaccccatttagaacagctcactgaaccctgatgtctatgcccgctttcgaattcagcagctggaaatgaaccatttgtgtctgattctgtttgactgataaaatacagcaaataaaacctgctcaaatggcatctttgaaaaaatttgctctgcagagcaactgaacctcagtgacaacccttatactctcctggtttacctttgccttgggaatgccaatatccctgaaccagtttcttttg

SEQ ID NO: 86361 - DNA, 601 bp, Human
atgcattaagctctgaattgtgcggtaatccaagcaaaaagaaaaccataagttgttataagaattgtgttgtcaacaagatcaaagcgtgcctcaaacagaacaaagcaatgctcttcatcgtacagaagtgtgagggatgctacaggacgacattctccacaagctgtcctgtaataaccgtatcagcaaccttttcaaaaataactatttcttgtagtacccttcagtgctagttaaggcatgatgaaaacacaaagcagtaaaagctaaattaattaatattcctctagctcaatgraattatcacctggtccttaaatgtggaaactaaacaacagaactgtctactttaattgagaaaagcaaaacaaatttgcatatgcaccgactcaacttgtatgaattgtatatatgcgttgacaatacaagaatgaaatgcaggaaaaaatagagaattatagtcagaagaaacttttttctagctattgcaagtaatactgtgttgctgaaaatttgttaaatgtaaaaagatgtaaagtccatcatcccaatcacctagcagcatctccgataacattttgatatatttctttttagt

SEQ ID NO: 86362 - DNA, 601 bp, Human
taaaaaaatttaaaaaacaaagaattgctttgtgtccaaagcaattcaggtagctcacactcactgtaatagaatagaataaggtttacacatacggataaagcaattggagttaagtgaattcagaagtggaatagtagctcagtcttagggaaagtcagtaaacagattttcaggccaaaggctccacaattgtgaaagaagaatcatgcattaagctctgaattgtgcggtaatccaagcaaaaagaaaaccataagttgttataagaattgtgttgtcaacaagatcaaagcgtgcstcaaacagaacaaagcaatgctcttcatcgtacagaagtgtgagggatgctacaggacgacattctccacaagctgtcctgtaataaccgtatcagcaaccttttcaaaaataactatttcttgtagtacccttcagtgctagttaaggcatgatgaaaacacaaagcagtaaaagctaaattaattaatattcctctagctcaatgaaattatcacctggtccttaaatgtggaaactaaacaacagaactgtctactttaattgagaaaagcaaaacaaatttgcatatgcaccgact

SEQ ID NO: 86363 - DNA, 601 bp, Human
tggaatctgttagttagaaatgcctcacttaagccggtcacggtaactcacgcctgtaatcccagcactttgggaggccgaggtgggaggatcacctgaggccaggagttcaagaccagcctggccaacatggcgaaaccccgtctctgctaaaaatacaaaaattaaccgggtgtggtggtgcacccctgtaatcccactacttgggaggctgcagcatgagaatcactcaaacctcggagatggaggttgcactgagctgagatagtaccgctgcactccagtctgggtgacagagcgmgactctgtctcaaaacaaaaacaaaaaagaaagaaaaaagaaataaacaataaaataaataaaaacacacaataaaaaaatttaaaaaacaaagaattgctttgtgtccaaagcaattcaggtagctcacactcactgtaatagaatagaataaggtttacacatacggataaagcaattggagttaagtgaattcagaagtggaatagtagctcagtcttagggaaagtcagtaaacagattttcaggccaaaggctccacaattgtgaaagaagaatcatgcattaagctctgaattg

SEQ ID NO: 86364 - DNA, 601 bp, Human
tggtgggccattagaaacggccttaattgtggaatattatgagaacagtcatattttttattttttttacattgtgactcaaagcaggggctctggcgtaagattgatcccagacacgctgcttaatctctcaatgcctgtttcctcaaaggtggatgaaaatcttgatggtcaccgtcatataggtttgtcatgatgtttaaattagataatggaggcaaagcatttaacacagtacctggcactcaggtaagctcccaataaatggaatctgttagttagaaatgcctcacttaagccrgtcacggtaactcacgcctgtaatcccagcactttgggaggccgaggtgggaggatcacctgaggccaggagttcaagaccagcctggccaacatggcgaaaccccgtctctgctaaaaatacaaaaattaaccgggtgtggtggtgcacccctgtaatcccactacttgggaggctgcagcatgagaatcactcaaacctcggagatggaggttgcactgagctgagatagtaccgctgcactccagtctgggtgacagagcgagactctgtctcaaaacaaaaacaaaaaagaaagaa

SEQ ID NO: 86365 - DNA, 601 bp, Human
cacacattcatttattttccttatctcaatggaagaagaaacattgccccttttgaaacagtagtaaagattttaaagaaaaaaggagaacttttgaagtaaaaatatgacgaaattggtactaggttttgcataatggtgggccattagaaacggccttaattgtggaatattatgagaacagtcatattttttattttttttacattgtgactcaaagcaggggctctggcgtaagattgatcccagacacgctgcttaatctctcaatgcctgtttcctcaaaggtggatgaaaatcytgatggtcaccgtcatataggtttgtcatgatgtttaaattagataatggaggcaaagcatttaacacagtacctggcactcaggtaagctcccaataaatggaatctgttagttagaaatgcctcacttaagccggtcacggtaactcacgcctgtaatcccagcactttgggaggccgaggtgggaggatcacctgaggccaggagttcaagaccagcctggccaacatggcgaaaccccgtctctgctaaaaatacaaaaattaaccgggtgtggtggtgcacccctgtaatcccac

SEQ ID NO: 86366 - DNA, 601 bp, Human
ctgcttcttcacagttcttccccaggaggaattttctgaccatgtgcttcctgtggcttggctcgaatagaagaaattcatttcctccacgctcttgctccacacattcatttattttccttatctcaatggaagaagaaacattgccccttttgaaacagtagtaaagattttaaagaaaaaaggagaacttttgaagtaaaaatatgacgaaattggtactaggttttgcataatggtgggccattagaaacggccttaattgtggaatattatgagaacagtcatattttttattttwtttacattgtgactcaaagcaggggctctggcgtaagattgatcccagacacgctgcttaatctctcaatgcctgtttcctcaaaggtggatgaaaatcttgatggtcaccgtcatataggtttgtcatgatgtttaaattagataatggaggcaaagcatttaacacagtacctggcactcaggtaagctcccaataaatggaatctgttagttagaaatgcctcacttaagccggtcacggtaactcacgcctgtaatcccagcactttgggaggccgaggtgggaggatcacctgag

SEQ ID NO: 86367 - DNA, 601 bp, Human
agtgtctcctaacctgtgttagaggctttccatggtctgagtgagcccagtgccaggaaaactcacttctccctgcagcaagagaacacacagggctgatacattaacaccatgacctttttagcacctgggtcagtggagatgtgtttataattttactgtggggagaaaggaagctgagctattccaaacctgtgatgcttcatgggtgagagcaacttcgcatctcctaaccccacgaccttgtaacagataggtacaacccttgccagagctgttcccttctcaggacaagcagagsgttagcacaacatcatgggtcagaaaagatgttgggtcttcaactgaatgctggcactgctactcattagatgttaaccttcagacgaactgtggcttctgcctgaacttcagtgtcctcctctataaaatggagaaaatgattatctggcagagttgaatcaggaggaaatgaggtcacatgtttgaagttcccatgtgagttcagcaagcaataacaagaggtgggccaggtgtggtggctcatgcctgtaattccaacactttgggaggccgagacaggcggatcacttgaggtcag

SEQ ID NO: 86368 - DNA, 601 bp, Human
aggaggtagaggttgcagtgggccgagatcgcgccgttgcactccagcctgggtgaatgagccagactctgtctcaaaaagaaaaacttcctggcatggagtgagggctacctaaacaactgagaccaggaggcaggggatagggaaggtatgggaaattggccagcacaattaccacctgatggtgggagttcacacgcaagaatccactttgcatacctgtgtgctgtgcattcctgtggaatacaccaccactccccacagcacacccagataaagtactgggcagcatggcctcttyccctggtccccaagacacctgaggacagcctccactggcagcactgatgtcggatacctatcaggaggtgatgttgggaaaaccacactacagcctaggtgagtatacctccaaattcatgtacacctgggacatcagagtatgcccttatttgaaaatcatgtctttgcagatataattgtttaaggatcttgagataaagtcatcctggatttagggtgggtcctaactccaacggctggagtccttagaagaagaggagacataccaagggaagaaggtcacctggagatggaggca

SEQ ID NO: 86369 - DNA, 601 bp, Human
gcctgtaaacccagctactctggtggctgaggcaggagaatcacttgaacctgggaggcagaggttgcagtgagccaagatcgtaccactgcactccagcctgggcaacagagcaagactctgtctcagaaaaacaaaaacatatgcaaatgcatataataaaagtcttggagaaatggaacgtacatcaaacagacaacagattggcattgagatgccaagccaaaggaatgcttatctgtattttcatttttttttttttacaatgaggatacattttttaatgagaagcaatatagcrtaatggttaagggcatagctcctagagccagttcaaatcccagctctgaagcttaccagcactgtgcctgcgtcatgacttaagctgtctgtatagtggagatgctgggcatgccaacctcccagagaagctgtgaagattaaactaagagttacaggtaatacactcataaaagctgctggggccgggtgtggtggctcatgccagtaatcccaacactttgggaggctgaggagggtggatcccctgaggtcgggagttcgagaccagtctggccaagatggtgaagccccatctcta

SEQ ID NO: 86370 - DNA, 601 bp, Human
catagagtttgatagcattccacagaataaaattttattctgtgtggacatatattaatatatacaaatgcagaccgggcacggtggctcactcctgtaatcccagcactttgggaggccgaagtgggtggattactgaaggttaggagtttgagatcagcctgggcaacatggtgaaaccccatctctattaaaaatacaaaaatcagctgggcgtcatggcgcacccctgtagtagcctgtaaacccagctactctggtggctgaggcaggagaatcacttgaacctgggaggcagagrttgcagtgagccaagatcgtaccactgcactccagcctgggcaacagagcaagactctgtctcagaaaaacaaaaacatatgcaaatgcatataataaaagtcttggagaaatggaacgtacatcaaacagacaacagattggcattgagatgccaagccaaaggaatgcttatctgtattttcatttttttttttttacaatgaggatacattttttaatgagaagcaatatagcataatggttaagggcatagctcctagagccagttcaaatcccagctctgaagcttaccagcact

SEQ ID NO: 86371 - DNA, 601 bp, Human
tattagagacagaatattaaagtaggcgtttcttaccccaaaatccactctctgcaccaagaggccactcagaaaatataaaaataagcaaatcaaataaattgactacgtaagtttgaaggcttcaagaaaatataaatacttccacccagaaattctatgtcctggtttcattcctagaaaaccacttgtagaggtacacagaggactccccaacgatccttaacacagccatatgactgatagccctcatcccacccccccaaaaaaagtctagtgagaagaaaatgcttaaaaataytctgatgcatgcatatcatggagttctttccagcagtcaaagagaatgaaggcaaaaaatggaaagctctccaaaacatatcgttcactgaaaaccaaactgtgacatactgcatagagtttgatagcattccacagaataaaattttattctgtgtggacatatattaatatatacaaatgcagaccgggcacggtggctcactcctgtaatcccagcactttgggaggccgaagtgggtggattactgaaggttaggagtttgagatcagcctgggcaacatggtgaaaccccatctc

SEQ ID NO: 86372 - DNA, 601 bp, Human
gaaggagaaagagatgttagtaaggtacagagagggagagaataaaaagtgagatatattgcaagaaactaagagaaaaaaggggggaaagaaagagagaaaaagaggatagaagaaggtaacggggaaggagtgaggacagtgatatggtttgtctgtgtgcccacccaaatctcatcttgaattgtagctctcataattcccacctgttgtgggagggacccagtgggggataaatgaatcatggggccagtttcccccataaggttcttgtggtagtgaataagtctcatgagatatkattgttttagaagagttttcctcttttacttggttctcattctctcttgcctgccaccatgtaagacatgcctttcaccttccaccatgattgtgaggcctccccagccacatggaactttgagtccattaaacatctttttccttataaattatccagtatcgggtatgtctttatcagcagtgtgaaaatgaactaacagagagagagagggagatggagagggagagggggaaaaagtggggggagagagggagggaggggagagagggagggaggggggagggggagggggagagg

SEQ ID NO: 86373 - DNA, 601 bp, Human
ttgtgtttaaattttataaatatttgcttcatcgatcaggatttggaccacaacaaattttactaatttataacttctgccattttgagttttcttttgtggttattatttccaccaagtcaagtccatttctcctgggtcaaaattgtacagagatccaaaattagctaagaagatttgagtcatctatggatttttagtcaataccaaatttcaccctgtgtgctttcagctcttgtcagtttattttgtgtggcttatttttttaccaataatattcactgtgaattgggcaaaaaatatggatggttaatatttatttttttagctgataataaatcctgagtgattttgtaagacagaggcagagagaagcagagaaggggagaggatagaagagaggaagagaactagggaggaggaagagatccagatggaaggaggtaccaagcaaaacacgaagacggagacagaaagagagaaaaacgatgagaaagagaaagtgaggaagagaaacagagaaggagaaagagatgttagtaaggtacagagagggagagaataaaaagtgagatatattgcaagaaactaagagaaaaaa

SEQ ID NO: 86374 - DNA, 601 bp, Human
actcaacctatacagggactacctgccatcagcacagaatggtctaaaactggctttgggaaaatggcctagaatcacattttgattctgggtttgtgaatacaaactctaaagtcagagttataccaacattgatgaattttcacaaaggaagcatttttcaaagcaaactcccttaagctaatttaattcctcgatcgatgtcttgcatagcgtagttaaattgtttccaacttttttggaaacatttttactggggtcaattcttttgtgtttaaattttataaatatttgcttcatygatcaggatttggaccacaacaaattttactaatttataacttctgccattttgagttttcttttgtggttattatttccaccaagtcaagtccatttctcctgggtcaaaattgtacagagatccaaaattagctaagaagatttgagtcatctatggatttttagtcaataccaaatttcaccctgtgtgctttcagctcttgtcagtttattttgtgtggcttatttttttaccaataatattcactgtgaattgggcaaaaaagatggatggttaatatttatttttttagctgat

SEQ ID NO: 86375 - DNA, 601 bp, Human
cctggggaggactataccccacagtagaggcatggacacattagggatgggaacttgtattatcaagcggcttgacatttcctaatcaaaagtttccggttttagctcatcatcttcttatgcatgtttgcagatgctctctgggggtctcagcacatttaaaggctaattatatagttaaagttaattattcattcattaacattcaagaagcctttaacaagacactgcttgtcttgatgaattaatgaaaccagcatgtgcacatgagtgtgtgtgtgtgttactgaaaattaaaacrtctctttgatgataactgaatatatttttttcagatcaaaccaaacccttgccaggaagaggaacacattagcacttgaggtcagttggcatgtttgggcaactgtggaacagggaacacaattcagatttatcttcaccagctccatgagtgaagcccggtcatgggacctctctgagcttcagtattctcatctgtaagatgggaaataaataataacttattacagggctggctgttggatggattaaaatggaagtgaaggtgttttgcttgtaattgcagatgctggtgggattt

SEQ ID NO: 86376 - DNA, 601 bp, Human
ttatacctgcacaatggccttgaaagtccaatcctagccccaagactgtttactggcaaatctaattgtccctaccctggggaggactataccccacagtagaggcatggacacattagggatgggaacttgtattatcaagcggcttgacatttcctaatcaaaagtttccggttttagctcatcatcttcttatgcatgtttgcagatgctctctgggggtctcagcacatttaaaggctaattatatagttaaagttaattattcattcattaacattcaagaagcctttaacaagasactgcttgtcttgatgaattaatgaaaccagcatgtgcacatgagtgtgtgtgtgtgttactgaaaattaaaacatctctttgatgataactgaatatatttttttcagatcaaaccaaacccttgccaggaagaggaacacattagcacttgaggtcagttggcatgtttgggcaactgtggaacagggaacacaattcagatttatcttcaccagctccatgagtgaagcccggtcatgggacctctctgagcttcagtattctcatctgtaagatgggaaataaataataacttatt

SEQ ID NO: 86377 - DNA, 601 bp, Human
gtgttaggctgcagcctggtatgggcagcactggcttggaacaccactgaggggctggttccttagaaccaagagcatccaactgaaagcccagttaagaacacacagctaagggaacccatttactcttctctgcttggtgcatgttctcttccttttttgaagaggaatttgtctttgtgccacattctcagttcctacccaggtaccagggttgtgtttctcccactgggcaggaggacgttcagaggtcaggtctgagaactgtgggatgttgcctgtgatgaggacagagacaccrtctgacacactggggtccatgccacctttctgcctccactccctatagaagatgttggagaggagcgatccctcttctccaatgtctgcgacagaccaaagacaccttggcttcacaccatgagggctggagcagtgctggagctcaaaagaatgccatgctatgctggctacatgacaggctcaccccctgccaggcatcttagtggctgtgcgggtgccattaccttctccatcaccggcagtcctcaaggagcacaaatgattagaaatgacagtaattcagaacaagagggggaaa

SEQ ID NO: 86378 - DNA, 601 bp, Human
aggtgggcggatcacctgaggtcgggagtttgagaccagcttgaccaacatggagaaaccccgtctctactaaaattacaaaaaaaatagctgggcatggtggcacatgcctataattccagctactcgggaggctgaggcaggcgaatctattgaacccgggaggcagaagttgcagtgagccgagattgcaccactgcactgctgcactccagcctgggcaacaagagcaaaactccatctcaaaaaaaaaaacaagaaagaaaaatggagccaacaatatttgcccttagagggctgytgggaataaagtgttattatataagtaaagtatgtgtgcaatgctcagaacataacaaatgctcgaaacacataaatgcattcaatcaaattcagattttatgccaaaggggctcaccaattttatggatcctataggagaaatccagttctgcatactttatatgcattattatattttttggtccttctccttgtgcagggatgggcatactactgccatccccattgtcagatggagaaactgaggcattgagcagtaaagtgactcagcactaccacccagcccatacgtgtcaaa

SEQ ID NO: 86379 - DNA, 601 bp, Human
atttagattgtaatgtagggggtcccacgtgcctatgggctattgcggcacagccctagctgttctgtggcaagcaaggggaaggcttagggagcaggactctgggtctccctttttgctctgacccaaaaagtctacttttgatccgttttctattggaaaaaataattgttcctgttgttaaaaagaaaaaaaaatcccctaaatctctgagatttgtcaacagggactttgggcaaagcaactgcatttctcaggctcagttttccctatgaaaaatggagccaacttgccgggcacrgtggctagcgcctaaagtcccagcactttgggaggccgaggtgggcggatcacctgaggtcgggagtttgagaccagcttgaccaacatggagaaaccccgtctctactaaaattacaaaaaaaatagctgggcatggtggcacatgcctataattccagctactcgggaggctgaggcaggcgaatctattgaacccgggaggcagaagttgcagtgagccgagattgcaccactgcactgctgcactccagcctgggcaacaagagcaaaactccatctcaaaaaaaaaaacaagaaa

SEQ ID NO: 86380 - DNA, 601 bp, Human
acagactagataaagaaaatatggtacatatacaccatggaatactatgcagccatgacaaagaacaacatcatgtcctttgcagagacatgaatggaggtgcacaccattatcctgagcaaactgatgcaggaacaaactatgaattaaaataaataataacaaatggaatcactaataatcactttaaaaaaagagatggccattgtctgcaagatgttttataaaataatacttagcatttcacagacatcatcccactgaggcctcacaactgtccagtagcaagatattattattrttattatttttctattctgtctataagcagacaaggttcagaaagcctaaggcagcctggggcttgttggtgatatttccagactttatattataaaaccctctaggacaacactgtccaatagaactttctgcaatgctggaaatgctctgacaccatctactatggatatcgagcacttgaaatatgtttagtgcaaatgagttgtaaatttcatttaatttcattaatttagattgtaatgtagggggtcccacgtgcctatgggctattgcggcacagccctagctgttctgtggc

SEQ ID NO: 86381 - DNA, 601 bp, Human
gacatggcatcaacctcaatcaaacccaccagtgacagactagataaagaaaatatggtacatatacaccatggaatactatgcagccatgacaaagaacaacatcatgtcctttgcagagacatgaatggaggtgcacaccattatcctgagcaaactgatgcaggaacaaactatgaattaaaataaataataacaaatggaatcactaataatcactttaaaaaaagagatggccattgtctgcaagatgttttataaaataatacttagcatttcacagacatcatcccactgaggyctcacaactgtccagtagcaagatattattattgttattatttttctattctgtctataagcagacaaggttcagaaagcctaaggcagcctggggcttgttggtgatatttccagactttatattataaaaccctctaggacaacactgtccaatagaactttctgcaatgctggaaatgctctgacaccatctactatggatatcgagcacttgaaatatgtttagtgcaaatgagttgtaaatttcatttaatttcattaatttagattgtaatgtagggggtcccacgtgcctatg

SEQ ID NO: 86382 - DNA, 601 bp, Human
cccaaaggaatgtaaatcattctattataaacacacaggcacacatatgttcactgcagcactattcacaatagcaaagacatggcatcaacctcaatcaaacccaccagtgacagactagataaagaaaatatggtacatatacaccatggaatactatgcagccatgacaaagaacaacatcatgtcctttgcagagacatgaatggaggtgcacaccattatcctgagcaaactgatgcaggaacaaactatgaattaaaataaataataacaaatggaatcactaataatcactttwaaaaaagagatggccattgtctgcaagatgttttataaaataatacttagcatttcacagacatcatcccactgaggcctcacaactgtccagtagcaagatattattattgttattatttttctattctgtctataagcagacaaggttcagaaagcctaaggcagcctggggcttgttggtgatatttccagactttatattataaaaccctctaggacaacactgtccaatagaactttctgcaatgctggaaatgctctgacaccatctactatggatatcgagcacttgaaatat

SEQ ID NO: 86383 - DNA, 601 bp, Human
ctctaaaatgggtaagaaaactaaatcggagatgactcaacttcatgacactttctcaactttattgcctttctttaacaagaaaacataaaacagtgaagcaaaaaaataaaaataaaaatggcaaagagaggatgtgaaacactgcatcttttcagagacagctgccgaaggactccctatgggaacaaaactatttggcaggtttacagccgtgttcttcattttaatttttttttgtttctataatggtttgaggtggcgcaaaactgtaggacttgtctcatccacagaaacactmtgaagctttgatctcaaggtaggggtatcagagacttggttttaggctctgagagtattaaagggaatcagatcaagcagcagcagaagagaactgggcactgattggcaacagcgatggtaacctagagctgtcatacgtaacctggagcaacctagagcttggcttgatgacagcaagtcaagaggaacagccagcaatagtgagacctgcagaaatatgggatggagagttatacaaggtcaaaagtaacttgtgtataatgggagtagggtgtgtaacaggaacactggagtagta

SEQ ID NO: 86384 - DNA, 601 bp, Human
tattcagatggagtctcactccattgcccaggctggagtgcaatggtgcgatctcagctcactgcaacctccacctcctgggttcaagtgattcttgtgcctcagcctcccaaatagctgggattacaggtgcctgccaccactcccggctaatttttatatttttagtagagacagggtttcaccaggttggtcaggctggtcttgaactcctggcctcaagtgatccacccacctcggcttcccaaagtgctgggattacaggtgctaattatgattagatccctatcagtagtcctgkatattgtttccaaatgttaaagttatttaacgaggctgaaatgatcactgtggaatgcagggatgaatgtctcaactctaaaatgggtaagaaaactaaatcggagatgactcaacttcatgacactttctcaactttattgcctttctttaacaagaaaacataaaacagtgaagcaaaaaaataaaaataaaaatggcaaagagaggatgtgaaacactgcatcttttcagagacagctgccgaaggactccctatgggaacaaaactatttggcaggtttacagccgtgttcttcat

SEQ ID NO: 86385 - DNA, 601 bp, Human
ttattattattattattcagatggagtctcactccattgcccaggctggagtgcaatggtgcgatctcagctcactgcaacctccacctcctgggttcaagtgattcttgtgcctcagcctcccaaatagctgggattacaggtgcctgccaccactcccggctaatttttatatttttagtagagacagggtttcaccaggttggtcaggctggtcttgaactcctggcctcaagtgatccacccacctcggcttcccaaagtgctgggattacaggtgctaattatgattagatccctrtcagtagtcctggatattgtttccaaatgttaaagttatttaacgaggctgaaatgatcactgtggaatgcagggatgaatgtctcaactctaaaatgggtaagaaaactaaatcggagatgactcaacttcatgacactttctcaactttattgcctttctttaacaagaaaacataaaacagtgaagcaaaaaaataaaaataaaaatggcaaagagaggatgtgaaacactgcatcttttcagagacagctgccgaaggactccctatgggaacaaaactatttggcaggtttacag

SEQ ID NO: 86386 - DNA, 601 bp, Human
tgtagggtgttatggggctgcactgtgtccacccctaacattcatacagaagtagggtgaacccctaatccactgtggctgccgtccttattaaaaggagaaatctgaacacagacatgcacacagggagaacgccatatgaagactggagttatgctgctgcaagccaaggaactaccagaagtcaggagagaggcctggaacagatccctccctggagccttcggtggaagcgtggtcctgcagatgccctgatcttggacatctagcctccagagctgcgagacagtcatttctgttstttaagctgctcaggttgcattcctttgttatggctgccctaggaaaccaagacatagtgccaaagcagccatagagaatgtgtaaacaaacgaactttgctgtgttccgataaaatgttatttaggaaaacagatgggtccacgggctgtagtttgccaacccttgttttaatcccgaaaatgttattatgccacacaaactatttcacatattgctttcttctctcattccatacctagtgaatatatttccatgtgaatacacatagcacttttaaattcttttttgatacacttat

SEQ ID NO: 86387 - DNA, 601 bp, Human
atttagaaaggtttgcatcagaacaaaataaaccactaaggggcagaagaatttggtggtagtgtgtatgaaggggaaaggaactaaataggaatattttttcctcccaaaagaaatacatgtgctgcttatttatcatacagaaattattgcagaatttttaaaaatccaaataatatagaaaagtattaaaaatacaattaaaattaaagctacctataattctataactcagattcaacctttgttaacatgttagtgaacagccttccaaatgttttagtgagtatgcacaaacacrcatacacagagattggcaaactttcttctataaagacaagataataaatagttgaggctttgtaggacataccgtctctgttgcagctattaaactctgctgttgtagggtgttatggggctgcactgtgtccacccctaacattcatacagaagtagggtgaacccctaatccactgtggctgccgtccttattaaaaggagaaatctgaacacagacatgcacacagggagaacgccatatgaagactggagttatgctgctgcaagccaaggaactaccagaagtcaggagagaggc

SEQ ID NO: 86388 - DNA, 601 bp, Human
gaaccttttctctccaacttacaagaggcagctaaataaagacatgaaggatccatatacccaagtgagtaaacagttgagtttgctggtttgctaagtgtttgtccttaacactcccagtggtggaggacagtgccctatttagaaaggtttgcatcagaacaaaataaaccactaaggggcagaagaatttggtggtagtgtgtatgaaggggaaaggaactaaataggaatattttttcctcccaaaagaaatacatgtgctgcttatttatcatacagaaattattgcagaattttwaaaaatccaaataatatagaaaagtattaaaaatacaattaaaattaaagctacctataattctataactcagattcaacctttgttaacatgttagtgaacagccttccaaatgttttagtgagtatgcacaaacacgcatacacagagattggcaaactttcttctataaagacaagataataaatagttgaggctttgtaggacataccgtctctgttgcagctattaaactctgctgttgtagggtgttatggggctgcactgtgtccacccctaacattcatacagaagtagggt

SEQ ID NO: 86389 - DNA, 601 bp, Human
cctggcataacacgttctgtaatcatctctgaatatagcctccactatttgaacggggcttctgccctctggcttgagcctttctatcctcctcataccgagctcatttttggtgttaacctgctatctgagctgactttgcttttcctatttcctccgtgttggcaattgaaaggaaaccaacctgccattccaagccacggccagcctctagaggccatgccaggaaaccccgggctatagtgagatcaccagctatgaagtagaaagggcagacaggaggaaatgcttctggtgacayagctggcccaagcggctttacagttctataaatgccacagtctcattagactgcaatagagattgcctttccttcattcctccacgggataagaacatgagttgccatgttggtacaacatgactccaccgtgagtcatgcctgataagtctaggaaagagtctttgacctcaaaatgcatcagaaatcctttctctggagtgaaattgggactgattacagcctagttatgtaattttgtacagcagcgtttctcaaccacagcctaccaacatgtgaggttggataattttgtgtttt

SEQ ID NO: 86390 - DNA, 601 bp, Human
ttaaatataaaacacatttagaatgcctgatggcactgtgagaatctaggatttaactctgtgaatagaaagaagataagaagccacaagtaattgtgcacttcattcgaattcacactaaccctatgcactagctaacctctgcctattttgatattgcatttcactgtagtggtaactagatttttctctcccacctgtagcctggcataacacgttctgtaatcatctctgaatatagcctccactatttgaacggggcttctgccctctggcttgagcctttctatcctcctcatascgagctcatttttggtgttaacctgctatctgagctgactttgcttttcctatttcctccgtgttggcaattgaaaggaaaccaacctgccattccaagccacggccagcctctagaggccatgccaggaaaccccgggctatagtgagatcaccagctatgaagtagaaagggcagacaggaggaaatgcttctggtgacacagctggcccaagcggctttacagttctataaatgccacagtctcattagactgcaatagagattgcctttccttcattcctccacgggataagaaca

SEQ ID NO: 86391 - DNA, 601 bp, Human
cacagcagagaacatggccagtgatctgaggaaggtacaaatgccctatggagaattcaaagactcacatgttctcatttgggagttaaatataaaacacatttagaatgcctgatggcactgtgagaatctaggatttaactctgtgaatagaaagaagataagaagccacaagtaattgtgcacttcattcgaattcacactaaccctatgcactagctaacctctgcctattttgatattgcatttcactgtagtggtaactagatttttctctcccacctgtagcctggcataacaygttctgtaatcatctctgaatatagcctccactatttgaacggggcttctgccctctggcttgagcctttctatcctcctcataccgagctcatttttggtgttaacctgctatctgagctgactttgcttttcctatttcctccgtgttggcaattgaaaggaaaccaacctgccattccaagccacggccagcctctagaggccatgccaggaaaccccgggctatagtgagatcaccagctatgaagtagaaagggcagacaggaggaaatgcttctggtgacacagctggcccaag

SEQ ID NO: 86392 - DNA, 601 bp, Human
taccatgaggaaaataaatgcttactgttgtacgcctctaagatctcacagcaaaaagctgaccaacacagccacaaatcattattacacagcagagaacatggccagtgatctgaggaaggtacaaatgccctatggagaattcaaagactcacatgttctcatttgggagttaaatataaaacacatttagaatgcctgatggcactgtgagaatctaggatttaactctgtgaatagaaagaagataagaagccacaagtaattgtgcacttcattcgaattcacactaaccctatgmactagctaacctctgcctattttgatattgcatttcactgtagtggtaactagatttttctctcccacctgtagcctggcataacacgttctgtaatcatctctgaatatagcctccactatttgaacggggcttctgccctctggcttgagcctttctatcctcctcataccgagctcatttttggtgttaacctgctatctgagctgactttgcttttcctatttcctccgtgttggcaattgaaaggaaaccaacctgccattccaagccacggccagcctctagaggccatgccag

SEQ ID NO: 86393 - DNA, 601 bp, Human
ttcctttctgtgcttctgccatggccaggaaaagagcttccccaggtagctgctaccttttcagcccgagacacagcagaaacacgtgtggagcagagaccacaccactgattcgtacgcttgtggcaggaagcagaggcactatccccaccccaggcagagcttctccactcaacctgcactaccatgaggaaaataaatgcttactgttgtacgcctctaagatctcacagcaaaaagctgaccaacacagccacaaatcattattacacagcagagaacatggccagtgatctgaggraggtacaaatgccctatggagaattcaaagactcacatgttctcatttgggagttaaatataaaacacatttagaatgcctgatggcactgtgagaatctaggatttaactctgtgaatagaaagaagataagaagccacaagtaattgtgcacttcattcgaattcacactaaccctatgcactagctaacctctgcctattttgatattgcatttcactgtagtggtaactagatttttctctcccacctgtagcctggcataacacgttctgtaatcatctctgaatatagcctcca

SEQ ID NO: 86394 - DNA, 601 bp, Human
tgttagcagacgtgaacgtgaccaagcagtggcttgaaatgtgcatgtgcagctaggcgttcctttctgtgcttctgccatggccaggaaaagagcttccccaggtagctgctaccttttcagcccgagacacagcagaaacacgtgtggagcagagaccacaccactgattcgtacgcttgtggcaggaagcagaggcactatccccaccccaggcagagcttctccactcaacctgcactaccatgaggaaaataaatgcttactgttgtacgcctctaagatctcacagcaaaaagckgaccaacacagccacaaatcattattacacagcagagaacatggccagtgatctgaggaaggtacaaatgccctatggagaattcaaagactcacatgttctcatttgggagttaaatataaaacacatttagaatgcctgatggcactgtgagaatctaggatttaactctgtgaatagaaagaagataagaagccacaagtaattgtgcacttcattcgaattcacactaaccctatgcactagctaacctctgcctattttgatattgcatttcactgtagtggtaactagattttt

SEQ ID NO: 86395 - DNA, 601 bp, Human
tttggccccaattcttcagcatactctcagtgtccacactattgccataaaacttcaagacctatctcatgaaaggcagagtatacctgcaatcccttgaccctgaacttggccacctgacctgctttggacagaaggatgttagcagacgtgaacgtgaccaagcagtggcttgaaatgtgcatgtgcagctaggcgttcctttctgtgcttctgccatggccaggaaaagagcttccccaggtagctgctaccttttcagcccgagacacagcagaaacacgtgtggagcagagaccayaccactgattcgtacgcttgtggcaggaagcagaggcactatccccaccccaggcagagcttctccactcaacctgcactaccatgaggaaaataaatgcttactgttgtacgcctctaagatctcacagcaaaaagctgaccaacacagccacaaatcattattacacagcagagaacatggccagtgatctgaggaaggtacaaatgccctatggagaattcaaagactcacatgttctcatttgggagttaaatataaaacacatttagaatgcctgatggcactgtgagaatctag

SEQ ID NO: 86396 - DNA, 601 bp, Human
tgtgaaccctggcccattctattctttgtctaaatcttgccacacgtgttttctttatgaatcattctgtcctttattcttaaagatactagttatgtctcgtatttctccttgaccattctcttatctacccaacacacctaagaatatatatgtatgtatatatatacacatacataagaatatataccacatacataacacgtgtgtatatgtatgtctacatatgtgtatatatacacgtgtgatataaatttatatatgtgaattactagaaacgtttcgattttaggattagatrttttgcatttatacatttgtcagcctactggactgtaagttcattgagggtaagaagaaaaagaccatgataaccccttctgggaatatcagtgcctacgaaaacatctgtttctcagtaaatgttgggtatcgatgctgagcaatgctgaaacatatgcatgagcattgttactccagtactgagagccaaagatgccatggtgcactctatcattttagaaagaccacagacaattagatggaaaaggaaggcaacatcttgctaggatcttgtgtatgcttccaggcagatgaacag

SEQ ID NO: 86397 - DNA, 601 bp, Human
tgcagtaagggaacagcaacaggggtggacatggatagcgtatgccctcgaggaatctataatgcagtgcactcaagtggcccagggcacatggagaggccaacaatggcatctaatgtgtgccaggcatggactagcttctttatgtttattttcatatttaatccttaaagaattctgattttaaaatgagaaaaatgagactctaagaaattaatttgccccaggtcacaccactaggaaactgcagaaccttcatcttacttatttcacttctcttgctttgctaaatgccacaagygtagagataagggagttcacaggcagggtatctagcttagaggtctttatgggagtattcacagaggagcgcagaggctgaaggatggatgagatgtcatatcaggaaatggggttaggaaaagagggaaggaggaattccatttttatagggtgttgcatgcagcaatccacacttatctaaaaaaaaaatttcaaatggtgaaattctggatgctgtagaaagttgaaagggaaaaatattcaggggtaaggggcattcaaggatttccccagtccacactgtcataccattcctaag

SEQ ID NO: 86398 - DNA, 601 bp, Human
ggctgctgaccaatatgcctggagataccccaactgtcctctacgaccattacttctactgcagaggtcaagtctttcccaaagaaacagaacaaaggaccatcactggttttgtgttccctttgttttgtttttaatatataatttgtctaggaggcagagaacctgggtttgagccccaactctgcactccctcgctgtgcatctttaggtgaggtcatatcccctctgtggcttcagtttccatattactggactaagtagcaatttatgatccactacagttgtaaaagccagggartatataattctgttggttatatgcctcatattgcacatattaaatatgtgcatatatgtgcctcatatgcatattgcatatattgcattaaagagcataatacagggatatttgactattataatatacaaataagacaatggaggaatttgcctctatcttgtggtgaatacagaggtaagatgcctgggaagactgtcaaaagattggcagtgattcagtgattacctccttgcatctctctctctagaggtatctagtgtcctttctaaagaaaataaggtccctttcattaaagaa

SEQ ID NO: 86399 - DNA, 601 bp, Human
aactttctgaaattctggagattatgcagctccaagaagctctgtggggaacaagcaattccagcaaccaagacaggtctttgtgaacctggagaggctgctttgcaagcctgtatcgaggccaaacatctgacttctcttaattacattctgtccttgtttcattccttctcatctcctgcttctgggtccttagttttccccaaactggcagggttgaatgatctcaaaaattaggctgggcctgctcccacggtgctggggcctgaggcatggacgagtctccttcaccatgaacaayggaaaaaaagtgtaggtcattttctctcccaccctaaacttctgtcgcaaagtgattttgcccagtaccttctgcagggtaatgatgctgtttcattagtaaaagaggaaggagcactgactctggggtgtgacctacctgtgtttaaatcacagccttgcccctttccagatgagaaaaccacctgtcttccaagatgtctatgagggtttatagcagctaaagaagtaacatcatgtaaagattaaagcaaagatcctggcgccctcctgcataggtaccaattgtaccaatctcaga

SEQ ID NO: 86400 - DNA, 601 bp, Human
cattcatagcctaccctcatatctcctatgttctttattgtggttggcatgtggactaacgcttagaagtgccaaaccatttatgcctctagttttcacaatcaccaagggctctgtgtaaacccaattagaagccctgagagaaagagaatgaataaaactcagggcaaagattcaatatcatggaccccaactgagtgattggatggcaactgatatgtgtactcaacgtctgccaatcacaggataaaatgtttctaaatggtaaatattgttactttaaagagtgattcttaaaccktatggatggagctgaagaccattattctcagtaaactaacaaaggaacagaaaaccaaataccccatgttctcactttcaagggagagctaaaggatgagaacacatagacatatagaagggagcaacacacactggggcctaatggagggtggaggataggaggagggagaggatcaggaaaaacaaataatgggtactgggcttaatacctgggtgatgaaataatctgtacaacaaacccccatgacacaagtttacctatatagcaaacccgtacatgtacccatgaacttccaac

SEQ ID NO: 86401 - DNA, 601 bp, Human
gctttcatgtctatttcgatccttcctggatgaggaagcttaacattaaagcttatctgactacgtcttccattcatagcctaccctcatatctcctatgttctttattgtggttggcatgtggactaacgcttagaagtgccaaaccatttatgcctctagttttcacaatcaccaagggctctgtgtaaacccaattagaagccctgagagaaagagaatgaataaaactcagggcaaagattcaatatcatggaccccaactgagtgattggatggcaactgatatgtgtactcaacrtctgccaatcacaggataaaatgtttctaaatggtaaatattgttactttaaagagtgattcttaaaccttatggatggagctgaagaccattattctcagtaaactaacaaaggaacagaaaaccaaataccccatgttctcactttcaagggagagctaaaggatgagaacacatagacatatagaagggagcaacacacactggggcctaatggagggtggaggataggaggagggagaggatcaggaaaaacaaataatgggtactgggcttaatacctgggtgatgaaataatct

SEQ ID NO: 86402 - DNA, 601 bp, Human
tattataagtaaactagagatgatttaaagtataagatgtgcatagattatattcaaatgctacaccattttatatcaggaacttgagcatccacagattttggtgtctgtaggagaccctcaaaccaatcctccacaatactgagggacaactgtatatataatatattgcctttccaaatgaaagtgtttaaaaaatatagactgagagggatttggggccactgtttatccatgccataaattttgcacgagcctatgtgacatcaatgtttgacttaccaacaagccattcattatrtcttatttccactttgatggttctcttgacatttgactttctctggtttgagcaattcactgcttgtcaggcatgggcctggcatgctgaccttgtactaatcctggtgttggattgataacagacactaagattctgaatctcaacaggcccattagggaattcactgcaaatttacgcagattaaatcccctggagttttaccactgaggaagactcagtggctctccaggatatttatggatattatctgtttcttaataagtactgttccattattattccaaatatgtctctagt

SEQ ID NO: 86403 - DNA, 601 bp, Human
aatatgacgccatatatcaagactcctagagatctttagaaccagtaacctttaaattctacatctaagagtttgttgcaaatagttcaaaagaaaaaagaaataggcatgaagaaatttcttccatcgttatctatactagccaaatatcaaaatgtgtagcatttggaaaataatgtaatggtttctggtttaataaagatgatgacattttatgcaaaaaattaaaataattgtgaaagcagatagtatagttacataagaatgcttaaaatgtaataataagtgaaaaatcatggamtataaaagtatatataaccaataattataattaaagaaatgtgtctgcaagtaacagggatcaggagataatacataaattaaaaacaattatgttaaagtagtagattggggtgattatatgtacagtcagccctttctgtatttgtgaattcaaatgatcacagattgaaaatattttggggagaaaatggtgtctgcactaaacatatacagacttttttttcttgtcattgtttcctaaaccatacggtgtaacaactatttagatcgcatttatattccattaggtattataagt

SEQ ID NO: 86404 - DNA, 601 bp, Human
tcctaaagtgctgggattacaggtatgagtcactgcacccagggttaacaaaccttttgggcatcaatatgacgccatatatcaagactcctagagatctttagaaccagtaacctttaaattctacatctaagagtttgttgcaaatagttcaaaagaaaaaagaaataggcatgaagaaatttcttccatcgttatctatactagccaaatatcaaaatgtgtagcatttggaaaataatgtaatggtttctggtttaataaagatgatgacattttatgcaaaaaattaaaataattrtgaaagcagatagtatagttacataagaatgcttaaaatgtaataataagtgaaaaatcatggactataaaagtatatataaccaataattataattaaagaaatgtgtctgcaagtaacagggatcaggagataatacataaattaaaaacaattatgttaaagtagtagattggggtgattatatgtacagtcagccctttctgtatttgtgaattcaaatgatcacagattgaaaatattttggggagaaaatggtgtctgcactaaacatatacagacttttttttcttgtcattg

SEQ ID NO: 86405 - DNA, 601 bp, Human
agtgttcttttactttgggggttaagtgaggtaataataaggaaagttgaagaaaacagactttctaaaccagaggagagaaaaatacaaacttttttaagcgtgatatttctttacaaaaagagaaaatttctttaaggataaggggaaaccagtcatgtttagttaaattcttccaattgttggaattgtttcaaaataacatgtcacttttattgtttaagccagaggtcactaatcttttttttttttttatggtaaacggccaattagtaaatattttcagcactacaggccatayggtctctatcacaactactcaactctgcctttgtagcacaaaaacagccatagacaatgcgtaatacaggaatgagtgtggttgtgttccagtaaaactttataaaaaacatgtaatgggccataatttgcagaattctgatttaaccaatcaaaacatgaaacatgaaataactttttatatttatataaaagagatagcatgttgcaccttctaaaatagcaaaaagaactgtaatgcctaatgctgctagatagtggtaaaattggtacattgatccactattactattactttaga

SEQ ID NO: 86406 - DNA, 601 bp, Human
gtcatagtttatagaaggtaacaaatagaaaaaaacagtgagtggcatagtacaggtataagtgttcttttactttgggggttaagtgaggtaataataaggaaagttgaagaaaacagactttctaaaccagaggagagaaaaatacaaacttttttaagcgtgatatttctttacaaaaagagaaaatttctttaaggataaggggaaaccagtcatgtttagttaaattcttccaattgttggaattgtttcaaaataacatgtcacttttattgtttaagccagaggtcactaatcttttttttttttttatggtaaacggccaattagtaaatattttcagcactacaggccatacggtctctatcacaactactcaactctgcctttgtagcacaaaaacagccatagacaatgcgtaatacaggaatgagtgtggttgtgttccagtaaaactttataaaaaacatgtaatgggccataatttgcagaattctgatttaaccaatcaaaacatgaaacatgaaataactttttatatttatataaaagagatagcatgttgcaccttctaaaatagcaaaaagaactgtaatgc

SEQ ID NO: 86407 - DNA, 601 bp, Human
gttgattacttgtggggggcatattgactggcatgggccatgaggaagctttctaggatagtggtcacattttatagctcaatctgggtgggagttgcacagctgtacaaaaattaactggatattgggatttgtgcaatataacgaatgtatgtcatagtttatagaaggtaacaaatagaaaaaaacagtgagtggcatagtacaggtataagtgttcttttactttgggggttaagtgaggtaataataaggaaagttgaagaaaacagactttctaaaccagaggagagaaaaatayaaacttttttaagcgtgatatttctttacaaaaagagaaaatttctttaaggataaggggaaaccagtcatgtttagttaaattcttccaattgttggaattgtttcaaaataacatgtcacttttattgtttaagccagaggtcactaatcttttttttttttttatggtaaacggccaattagtaaatattttcagcactacaggccatacggtctctatcacaactactcaactctgcctttgtagcacaaaaacagccatagacaatgcgtaatacaggaatgagtgtggttgtgt

SEQ ID NO: 86408 - DNA, 601 bp, Human
gacctcctctcccttttcccaagtctaaggcaccagatggggtgagacagtggccagggatgagtggaagagcacatgcgggtggcagagaagctagatatcaattctaactcaggaaagtaagtggggcagactccacagtcctctgcccccattgtactgacattaaatctgaggtcaggttacatgaaccaaggtcacaaaataaggcaatgttgatgttggggcaagaatctggatctctaaatgactggtggcaacagccaaccacacagccactgatgaagacacctagagttcwgttgcacaagccagctttacctcttacagaaagtcgaaaaggagcacttgcaaattggagaaactacctgcactgctggcaggaatgtaaattggtttacattttcagaacactggttcaaagtatctactaaagttgagtagacgcgctctattacccagcaatttcattcctaggtatatttccaaaccaataagtgcctttgtgcacaagaaaggtacaaaaatatccaaagcagacaaaaactaaaagtgatgtaaatgcccatcagcagcaaaatggataaatttgtacgataaa

SEQ ID NO: 86409 - DNA, 601 bp, Human
cactttaagtttgcaggcaaatgcctgaatgatccatttaaaggaagcagtgggaaagcatggagcctggtctcccaggttggggagatgcctctgagttcttatctctggccaggggcttcagccatttgggtgtgatgcttctcttgtaactccaaggtaacctatgctgtgttgctcagttctacatgccaagaaatagctcctcttttcagcaagtaaaattatctcactgcttttcagtttcttttttatcgaagtgttgtcaacaagttccttgaagctgtaaaatccagaagcraaatggatcacttccatttgatctgtattccccattgcttagtatacacaaggagcttaatgggcatcggagacttagttgtggaatgaagagagaaggagagagtggaaaggaaagaaaagaggacagggaagagaaggaggaggaagaaaaaggggaatggagaaggacagaaagtgagaaataaaactattacagaagggaccctatatcagctgtcagaaccatccgtaactaaagcagaaggaagaccctgtttttctttccatagagggtaatagggtggtgtgcagggctggg

SEQ ID NO: 86410 - DNA, 601 bp, Human
gaatgtggccaactagtggtacataaaagggaatagcgtgcgggtcactttaagtttgcaggcaaatgcctgaatgatccatttaaaggaagcagtgggaaagcatggagcctggtctcccaggttggggagatgcctctgagttcttatctctggccaggggcttcagccatttgggtgtgatgcttctcttgtaactccaaggtaacctatgctgtgttgctcagttctacatgccaagaaatagctcctcttttcagcaagtaaaattatctcactgcttttcagtttcttttttatygaagtgttgtcaacaagttccttgaagctgtaaaatccagaagcgaaatggatcacttccatttgatctgtattccccattgcttagtatacacaaggagcttaatgggcatcggagacttagttgtggaatgaagagagaaggagagagtggaaaggaaagaaaagaggacagggaagagaaggaggaggaagaaaaaggggaatggagaaggacagaaagtgagaaataaaactattacagaagggaccctatatcagctgtcagaaccatccgtaactaaagcagaaggaagaccct

SEQ ID NO: 86411 - DNA, 601 bp, Human
aaggcacatgcatttgtgagcacaaatgaattcatagtgactttttgccattgcatattttctcaatcaatagtcctcaaaatctgatgacttatcatgggaaggttatgaggactttttaatatcacaaaggagttcttgtgttttaaacacatacagatttaagaaaaaaaaggatagcaataacttcagatcccgtgctgttttgagagccactggctaaactgggtttccagtactacagcagctaacaaccctgccctaatgaccaacgaggggaagtaaatctgggtgtttacaygtgcctttcacaggatgcttcttttacctagtagacaacctcatgcctagttttcctatccatgaccaggggatctctcccaggaggaacttatttataactgctgatgcccttgcagctcttgtctgacccatgtccagtttatgtctgcctgatcatcgctctggcactggaagcccaaccttgtagtctccccgagggaaaacccagtctgcggtagttcctaggtcttcagatgaaaggtgcaaattcaatacaccaccatatagaaaataagctcaaagatttattacttacaca

SEQ ID NO: 86412 - DNA, 601 bp, Human
taaagacggtcaagctgacatggcttaaaaggcacatgcatttgtgagcacaaatgaattcatagtgactttttgccattgcatattttctcaatcaatagtcctcaaaatctgatgacttatcatgggaaggttatgaggactttttaatatcacaaaggagttcttgtgttttaaacacatacagatttaagaaaaaaaaggatagcaataacttcagatcccgtgctgttttgagagccactggctaaactgggtttccagtactacagcagctaacaaccctgccctaatgaccaaygaggggaagtaaatctgggtgtttacacgtgcctttcacaggatgcttcttttacctagtagacaacctcatgcctagttttcctatccatgaccaggggatctctcccaggaggaacttatttataactgctgatgcccttgcagctcttgtctgacccatgtccagtttatgtctgcctgatcatcgctctggcactggaagcccaaccttgtagtctccccgagggaaaacccagtctgcggtagttcctaggtcttcagatgaaaggtgcaaattcaatacaccaccatatagaaa

SEQ ID NO: 86413 - DNA, 601 bp, Human
aactctggccgggtgcagtggctcacgcctgtaatcccagcactctgggaggccgaggcacgcagatcacctggggtcaggagtttgagaccggcctggccaacatggtgaaaccctatctctactaaaaatacaaaaaattagctgggcgtggtcgtgggcgcctgtaatcccagctactcaggaggctgaggcagtagaatcacttgaacctgggaggtggaggttgcagggagctgagatcgcgccattgcactccagcctgggcaacaagagtgaaactgtctcaaaaacaacaacmacaaaaaacccaactacaacttgtgcagcttcccaaccagtgtctctttcagaagaaaaattaaaaagaggattggacaataaaagattggacaactctatcaaacatcaaacaatacacatggtcataattttccattactggatgaagttggagagatacaattctttgaagtaagacggcagaaaccttgtaggaatccaggaaaccttattatataccaagcacttctggaatctgcttaaccaatctgcctcacacaaataaagacggtcaagctgacatggcttaaaaggcaca

SEQ ID NO: 86414 - DNA, 601 bp, Human
cctgtgacctctgttctcacgatctcagagggtcactgaactatttgccgaagtgaaaaaatacttttgatggtggtggtgataggaaatagtacaagattctggacacaaatagattgaatttgggagataaatattccttatttaaatgtcagaatattccatttctgtataatgctgagaagtcacaaaaccaaaataaaaatagggctaggcttaaatgtatccagttagaggcagggacaggctgtctttggcataaatgtttcaccgccaccttccaactgagatttctgctccrtggatgaaacttgagtattgttaagttcattgctacttgtcacattgcaggatttcacaggccacgtgattagtcgcacaagttggatggagttgggggattttatgcacacaggttcccaaccataaaatctcccaactctggccgggtgcagtggctcacgcctgtaatcccagcactctgggaggccgaggcacgcagatcacctggggtcaggagtttgagaccggcctggccaacatggtgaaaccctatctctactaaaaatacaaaaaattagctgggcgtggtcgtgggcgc

SEQ ID NO: 86415 - DNA, 601 bp, Human
ccctgggttcagaaataatattctggagcctgtgacctctgttctcacgatctcagagggtcactgaactatttgccgaagtgaaaaaatacttttgatggtggtggtgataggaaatagtacaagattctggacacaaatagattgaatttgggagataaatattccttatttaaatgtcagaatattccatttctgtataatgctgagaagtcacaaaaccaaaataaaaatagggctaggcttaaatgtatccagttagaggcagggacaggctgtctttggcataaatgtttcaccrccaccttccaactgagatttctgctccatggatgaaacttgagtattgttaagttcattgctacttgtcacattgcaggatttcacaggccacgtgattagtcgcacaagttggatggagttgggggattttatgcacacaggttcccaaccataaaatctcccaactctggccgggtgcagtggctcacgcctgtaatcccagcactctgggaggccgaggcacgcagatcacctggggtcaggagtttgagaccggcctggccaacatggtgaaaccctatctctactaaaaatacaa

SEQ ID NO: 86416 - DNA, 601 bp, Human
cccagatgcagcagtgagaaactcattcctttctctcttccctgtggtgacccaacacccatgttgttttaaagacaaatttaaaaactctcaaaaggacaaaacaaaggcccaataaatctgacaaataagaaaaaaaaatgagctagagaaaaataagacccaagtaaccctgggttcagaaataatattctggagcctgtgacctctgttctcacgatctcagagggtcactgaactatttgccgaagtgaaaaaatacttttgatggtggtggtgataggaaatagtacaagattckggacacaaatagattgaatttgggagataaatattccttatttaaatgtcagaatattccatttctgtataatgctgagaagtcacaaaaccaaaataaaaatagggctaggcttaaatgtatccagttagaggcagggacaggctgtctttggcataaatgtttcaccgccaccttccaactgagatttctgctccatggatgaaacttgagtattgttaagttcattgctacttgtcacattgcaggatttcacaggccacgtgattagtcgcacaagttggatggagttgggggatt

SEQ ID NO: 86417 - DNA, 601 bp, Human
gatgacaacagacttggtcattctgagttctgagttgtggtcctgcaattgaggatggcctgggggacacagaattggggccaaatcctctccttgcccagttgtcctgtagatgaaaggaagttgtgtatcagatttggggatgtggtctgtggccttggagcagagtaagatcagctagaccatctgagctttgaccttgagggcccaacttcattaattccaccatcttgactcaaagccatgtgaggcaagtccaccctcccagatgcagcagtgagaaactcattcctttctctcytccctgtggtgacccaacacccatgttgttttaaagacaaatttaaaaactctcaaaaggacaaaacaaaggcccaataaatctgacaaataagaaaaaaaaatgagctagagaaaaataagacccaagtaaccctgggttcagaaataatattctggagcctgtgacctctgttctcacgatctcagagggtcactgaactatttgccgaagtgaaaaaatacttttgatggtggtggtgataggaaatagtacaagattctggacacaaatagattgaatttgggagataaatattcc

SEQ ID NO: 86418 - DNA, 601 bp, Human
cattcttgctgggaacacacaagctaaatgctctcttgggaacagatggagcctgggaagttttggggttgcagtcaaaccacactgcctttgtctccccaccggagaggactggtccccatgtagcactcaaagccctctccttttgtgtttccacctcctccagtgacagtaagctcatgcacatttgcagaacttctttgcgcccatgggaacttgcacctgttcttcctatatctgttttcaggggagatgtttccagccacaagtatctctactaaccacttagttctgcaccatygtgaggaaagctgtaagttcagtagaaggagcaaggtgtcaaggtcactcttttcctaatgctgacaacattaaaagacagagtaatagagtttcaggagtcaaccgtcagagagatgcagaatctaaaagggaacaggcaaggataattgaggcagtgttgtgtgtgtgtgtctccaacttgcttccattccattccactggctgcttgggtcaggctgtaagaaggctggttagacaaaaggcacagacaggatgcagacagtggaggagtttctcccattacccatccacccactga

SEQ ID NO: 86419 - DNA, 601 bp, Human
cattgcagaagtgttcaaatctgtttagtgagttattctgccatataaatagaaggaatacaaagcaaaggggaacttgcagcgggcttgagagtaaaaggctgggaaatgtgcatcctttaggtagggtgaagcatcaaatgtcgtttttccaaggagtggctctatgatatttattctgctgccagtttctcctattaaaaagaggccgtgatctttgtcagtgtgatcttgtgaaccagagctgataaatggggcaattaaatctctttcctgaagcagactcattcttgctgggaasacacaagctaaatgctctcttgggaacagatggagcctgggaagttttggggttgcagtcaaaccacactgcctttgtctccccaccggagaggactggtccccatgtagcactcaaagccctctccttttgtgtttccacctcctccagtgacagtaagctcatgcacatttgcagaacttctttgcgcccatgggaacttgcacctgttcttcctatatctgttttcaggggagatgtttccagccacaagtatctctactaaccacttagttctgcaccatcgtgaggaaagctgta

SEQ ID NO: 86420 - DNA, 601 bp, Human
gctcagcctcccaaagtgctaggattacaggcgtgagccaccgtgctcagaccctttggagtctgggaggacacaaaaatgggtcttctcactatgactcatcagattcccagaacatcttcctttcggtgttgcctcaaaccaagccaggtttgtaagcctgtaaggagggcagtctgatataagaaacatcatctcgattcttttcaggatgtaaataaaaagatttccttctgccctttgcccaaacaatacctctttttagaggaaatcaacatggtaaagcagacttcaatttcaaaaaaaaaaaaaaaaaaaaaagagcaaatgcacatttctcattaccaattacagcctgttccaatcattttcaaattaatcatttcctgcctcgtggccctctttgactagcgtactgaactgtagttcaaatactttcttatttcatttttaatttactcaagtatattgtaatctcctggagggagatcagggaccatgttttatggttttgatatttttcgtggcctgcagcacgtagtgagcattgaatccatattttctgtttctgtttcttttcttacatccccaggcttaaact

SEQ ID NO: 86421 - DNA, 601 bp, Human
gcgatcataactcactacagtagcaacttcctgggctcaggtgatcctcccacctcagcctccgaagtagttgggacgacaggcacatgccaccatgctgtgctaattttttgtatttttagtagagacgaggtttcaccatcttgcccaggctgatgatctcaaactcctgggctcaagcaacccacctggctcagcctcccaaagtgctaggattacaggcgtgagccaccgtgctcagaccctttggagtctgggaggacacaaaaatgggtcttctcactatgactcatcagattcycagaacatcttcctttcggtgttgcctcaaaccaagccaggtttgtaagcctgtaaggagggcagtctgatataagaaacatcatctcgattcttttcaggatgtaaataaaaagatttccttctgccctttgcccaaacaatacctctttttagaggaaatcaacatggtaaagcagacttcaatttcaaaaaaaaaaaaaaaaaaaaaagagcaaatgcacatttctcattaccaattacagcctgttccaatcattttcaaattaatcatttcctgcctcgtggccctctttgacta

SEQ ID NO: 86422 - DNA, 601 bp, Human
acctgcacggctgcttcctcttctcacaaaaacaccaatgccatccctttggaaatacaatgtgctgttgacgtcccccctccctttggaggtattttgttttgttttgttgagatggggtctcactacagtcgcccaggctggagtgcagtggtgcgatcataactcactacagtagcaacttcctgggctcaggtgatcctcccacctcagcctccgaagtagttgggacgacaggcacatgccaccatgctgtgctaattttttgtatttttagtagagacgaggtttcaccatcttgcccaggctgatgatctcaaactcctgggctcaagcaacccacctggctcagcctcccaaagtgctaggattacaggcgtgagccaccgtgctcagaccctttggagtctgggaggacacaaaaatgggtcttctcactatgactcatcagattcccagaacatcttcctttcggtgttgcctcaaaccaagccaggtttgtaagcctgtaaggagggcagtctgatataagaaacatcatctcgattcttttcaggatgtaaataaaaagatttccttctgccctttgcccaaacaatac

SEQ ID NO: 86423 - DNA, 601 bp, Human
gagtttttttttaaaaaaataggaaatccatccctttccagttcctcacccacaaaaatgggtgctgatcaatcggttgtgtaggtaaagggatgagaagagggtatcttgattcaattccttttcttccaacagcctcccatgctttcgcacagtcacaaagtcatgggagactttgaaataatatctcactgtccaccaacactatctcaaactcatccagatttctctgcccaccatgtacctcagacctgcacggctgcttcctcttctcacaaaaacaccaatgccatccctttgraaatacaatgtgctgttgacgtcccccctccctttggaggtattttgttttgttttgttgagatggggtctcactacagtcgcccaggctggagtgcagtggtgcgatcataactcactacagtagcaacttcctgggctcaggtgatcctcccacctcagcctccgaagtagttgggacgacaggcacatgccaccatgctgtgctaattttttgtatttttagtagagacgaggtttcaccatcttgcccaggctgatgatctcaaactcctgggctcaagcaacccacctggctcag

SEQ ID NO: 86424 - DNA, 601 bp, Human
tggaaaaatttttactttgattactacaccatttaagtagcatacatttgaactcacatgctcatttgggctttaatttcttactgacagcttcaaacagatggtaaacctccttgcattttcttcactttgatggacagagattttcctagttttctttttacagactaagtgactcattaaagttctcaaatgtattaaccagaaaaaaaagcatacatgttaatgagtttttttttaaaaaaataggaaatccatccctttccagttcctcacccacaaaaatgggtgctgatcaatyggttgtgtaggtaaagggatgagaagagggtatcttgattcaattccttttcttccaacagcctcccatgctttcgcacagtcacaaagtcatgggagactttgaaataatatctcactgtccaccaacactatctcaaactcatccagatttctctgcccaccatgtacctcagacctgcacggctgcttcctcttctcacaaaaacaccaatgccatccctttggaaatacaatgtgctgttgacgtcccccctccctttggaggtattttgttttgttttgttgagatggggtctca

SEQ ID NO: 86425 - DNA, 601 bp, Human
ccaaactttcttccaaagtggctgtactattttgcactcccatcaacaatgaatgagagagctcctgttgctccaagtcctcaccacccttttcattgtcagtgttagtgttagtgtttggggttttagccactctcatagggatgtagtgctagctcattatttcaatttgcaattccctaatggtatataatagtcccatctttttttttttttttcctgaaaactttaaaatactgtggaacttttcattctctcctctaggttatttaccttgttttaatatttgcattcttttttstctctgtgctgcatttgggtaatttccaatagatgtattttcccgttaatttattcttttgttggtaatatttagctttatgttttaattttatttattttaattgtgatattcatttggttcttttacagttctgcctgttctttttatcataatatcccatccttttgttatatagtttgttatataaagtttaaaagtttttaaaactttcatatatttaataattttaaacctctagtctttcagattactcccccccacccccaccttagttcttgggattctcattcctctgtt

SEQ ID NO: 86426 - DNA, 601 bp, Human
gacgatgtgcaactcacagctatgtaaccttaagacaagtttctgagtttgctgggtttccatttgctcacttcttgagtgaagataataatgattacatagcctacctaatattgttgcagtgaggacaaaatttatatataaaaatagagaatataatatatatatagagagagagtatagcaaacttattctctattaatatgtatatatattatatattatatacatatataatatatataacttagcacagttcctggttttgttttttggagttttgtctttttttttttttttwttttggtcattattatgtttttctgaccttgctttcccttacccctgcccccaatacccacccaagcttggaacaagacatgggaataaaagggcagaacgtgacaatagaaagacttcattgcaattctgacttgatcatctgctagctgcatggcctcggagctacagttatcctgtctgtgaaataggcataataatagaacatacttcctagagtcgccatgaggattgaatgagatgagaatgtataaaatccctaaaggacccagatcatagtaagttttcataagcagtatgt

SEQ ID NO: 86427 - DNA, 601 bp, Human
gtttctaacaaaatcagatgacattttctctttttaaaaaactagaagacctgataatattgactctacattcccataagacaatactcagcaggagttgaggatggctgccacgctactggtgaggtaaacatcatgcaattggccacagtcctcagtattccctatcgttctctcactttgatactgaggtttagctgccgtttcacgtcatctgtgctatttttctcatgtcccgcctgctgcacccactcccgtttcctttctgccttccttagtcatctaagtttgcaacacctgkcttatgaatgcacaaaatctggatgctcttgtgacatgcccaagaaaggctggtaaggggaggaagtgcagaccccactgagacatcaagaacccaagcgcttttctaaacctgcttgcagtgcaagaaagtagccacccggtgtactgaccctgctgatggagaagagcaacccaggccggtcggagcacacgcccgtgaaacagaagcgcagcttccagtagaagaggtgctcccagatgaaggtgatgaggctaagggccatggcggcagccagcatgtagaatacgcccgccatgt

SEQ ID NO: 86428 - DNA, 601 bp, Human
atctatgtgtttagatgccatcaagctaattaggaaatatgtatttgcacagaacccgagtttggagtgcaagtgaatggagaaaataaatcttcctcactaaactaatgtgtaccttccgaatctccacagttcttgaaactagcaaatgttaagaatatacaaatctgttttaaagcaattagttagctttctcagtaaacaatagcatataaaattagatttttatttatttatttttattattatactttaagttctagggtacatgtgcacaacgtgcaggtttgttacatatgtrtacatgtgctgtgttggtttgctgcaattagatgtttttaaccaaagagttttcaccatttttcaaatcctaattaatgaagttcttccaaggcaaaaaaacaaacaaaaacaaaaaaaaacacaaacaaaacaaaaaaacaaacaaaaaaacaaggtgggcaaataagagagatgagtggataaatagatggatgcatagatggctgaaacgaatgaatggacatatagataagaaggtagatacatatgtattttgtgctgttgtttatgttgagttgaaggtaaactttgttttctg

SEQ ID NO: 86429 - DNA, 601 bp, Human
gtgaggctcatcatactctttgagggggggatagatgtggatgcttggatagaaggagttgcagacttaccatcatgtgggggtgtgagcctatcagtgaagccattgcagtgaaaagtagagcccaagagatagagaaagacatggtttaaacccctggagccactcccttgaacttttttacttaatcgactcaatctattccttgtgtgtttgtttgtgtgtgagtctattcaatgtagttagaactgggttttagttactagtcacagtgaagagttctgatgacacagtgacaccrcctttaaatccatccagggaactgaatgacttaagggctcctgggcagcccaaatacaagcacctccatctatatgtcttctcattttctactctttctttcttttagaaaacaactgtttacgttcacttaaaagtagctgttcaactgttatcaagggaagagcccttgattcctaccacaataacaggcaaaaggacgtctggaacattttgatctgtggcttcccctgcttctccccactcctaccccagatttcagcagccgtacctacaggaaacagtcagatcaaggctgcag

SEQ ID NO: 86430 - DNA, 601 bp, Human
tataagaacagataactgagcctcccagcacccgggtcaccaatccaagctttcattaaagtttcccagcatcatctttgaaagtttaggcaccagagagttaactactgacaaacacagtcagcatgaaaggatcatccattgttaattcttttctggaattacccctactcttatgcaaaagctaacaatcaaagaatgtgtcctaagtggccaatcagaaaatctcttctccatgcacacattgattcatctaaaggaaggcatgaaattcatgtgaggctcatcatactctttgagrgggggatagatgtggatgcttggatagaaggagttgcagacttaccatcatgtgggggtgtgagcctatcagtgaagccattgcagtgaaaagtagagcccaagagatagagaaagacatggtttaaacccctggagccactcccttgaacttttttacttaatcgactcaatctattccttgtgtgtttgtttgtgtgtgagtctattcaatgtagttagaactgggttttagttactagtcacagtgaagagttctgatgacacagtgacaccgcctttaaatccatccagggaactg

SEQ ID NO: 86431 - DNA, 601 bp, Human; identical to SEQ ID NO: 80755

SEQ ID NO: 86432 - DNA, 601 bp, Human; identical to SEQ ID NO: 80754

SEQ ID NO: 86433 - DNA, 601 bp, Human
ctatttcacacactttcagcattccctatgcatagttaattttatcttttttttttctataatttttcaggatataatctgttcctggttgcaactcatgagattgggcattctttgggcctgcagcactctgggaatcagagctccataatgtaccccacttactggtatcacgaccctagaaccttccagctcagtgccgatgatatccaaaggatccagcatttgtatggtctgtgctgcttaaggaagagaagggagatctgggcaggaaaatttcacctgaaatttactgttgttkttttttttctgtttccataggagaaaaatgttcatctgacataccttaatgttagcacagaggacttattcaacctgtcctttcagggagtttattggaggatcaaagaactgaaagcactagagcagccttggggactgctaggatgaagccctaaagaatgcaacctagtcaggttagctgaaccgacactcaaaacgctactgagtcacaataaagattgttttaaagagtaatattttgtcctcataatttgatatgtctcagcatttgctatgttcaaccactgtgatcagaaca

SEQ ID NO: 86434 - DNA, 601 bp, Human
tctgcccatgttcaaggctcacgcctgtaatcccagcactgtgggaggccgaggcgggtggatcacttgaggtcaggagttcgaaaccagcctggtccacatggggaaaccccgtctctactaaaactacaaaaattcactgggcgtggtggcagatgcctgtagtcctggctactcaagaggctgaggcaggagaatcgcttgaaccccggaggcggaggttgcagtgagccgagatcgcgccattgcactccagcctgggggacagagtgagactccatctaaaaaaaaaaaaaaaaaaggcaaagtttagaagttgagccccttcttaaaggccaggtccaagaagagggattccctaattcatgccacactgaatttcctcctgatttctcataagctctgtctgtctgcgccatcatacctgctttttcctctgcctgaaatgatcttccccaactcttgtccttgcctgggaagctcttattccattctttaacatccaaggaatacctcttggtattctcaggctatggtgggaagagtttcttctgagcttggaggcagcacttactgccttgtgttagaattgctcaactgt

SEQ ID NO: 86435 - DNA, 601 bp, Human
aaaaggcctcctttgggggtggaataccgttcagctttagatctcttttgagtagattcttccatgatacacttgcttgggaaagaattggctggttgattctgaagttaggatgtttgacctgtgtgcttccagaataagatgagaaggcaaagaatgtgctgcttcaggttggcttttatgtagctgaagagttgctcggggccttgggttggctcaataagggacgtgaccttgaaaagctcttcctggttccacttggcgtcttttcttagggagctctgtgcccagtctctggccrcttttagttcataaatagcttgcatggttagaggcacagaaggtggaggctttgcgagggggaaggaatggaggaaaggggttggtgagaagagtaaggaggcggaatttggagggatgaaataaaaagctgtctgattaggtaatgcacgtttacaaaacaaaatttgtacaaaagagtatgtggtaacaaatttccttccctctcatgccccctgttcacccagagctcctttccgggtggcatccgttgttatcaatatttttgtatatctttccagaaacagtctatgcatgtaca

SEQ ID NO: 86436 - DNA, 601 bp, Human
ttatgtagctgaagagttgctcggggccttgggttggctcaataagggacgtgaccttgaaaagctcttcctggttccacttggcgtcttttcttagggagctctgtgcccagtctctggccacttttagttcataaatagcttgcatggttagaggcacagaaggtggaggctttgcgagggggaaggaatggaggaaaggggttggtgagaagagtaaggaggcggaatttggagggatgaaataaaaagctgtctgattaggtaatgcacgtttacaaaacaaaatttgtacaaaagmgtatgtggtaacaaatttccttccctctcatgccccctgttcacccagagctcctttccgggtggcatccgttgttatcaatatttttgtatatctttccagaaacagtctatgcatgtacaacatgtatgtacataaaattggaaacttgaattataaatggcttcctgttacctgtagtccctggtatcctgaataatgagattaactttagctctaaattatatttgtgatattatgatggtgaattgttagaaaattacctgaagtatcataatataaaatagatgattacttttt

SEQ ID NO: 86437 - DNA, 601 bp, Human
caaatttccttccctctcatgccccctgttcacccagagctcctttccgggtggcatccgttgttatcaatatttttgtatatctttccagaaacagtctatgcatgtacaacatgtatgtacataaaattggaaacttgaattataaatggcttcctgttacctgtagtccctggtatcctgaataatgagattaactttagctctaaattatatttgtgatattatgatggtgaattgttagaaaattacctgaagtatcataatataaaatagatgattactttttttccaggccagrtgagaaaaacctcattctcctttcacttcaagcgttcttgcagagcaggagagcagcctgatgtagcccccttgtaacttggagagatgctggagcacagttcccttgagatgtggagtccaggcttgtaagagcatcagaatacagtgatcatggatcttggttttaatttgtgttctgtctgagaatgttttctctatgttctgtaaaatgaagttaatggtatgcttaataaattgctttgagacttgggatccacgaggcagatccttatagcaacgaacatcccaaggcaaaagg

SEQ ID NO: 86438 - DNA, 601 bp, Human
ggcagagatagttggagccagctttgttccacccactgtaatggagggacacagggggcagtcttatcataatctggagagcaggtaatccaaaaaataatcgatttgcttttgctatgtatttatgtagtcttttttttaaagcattcgtttaccttcctaattaagttttgctcaggtgaatattaaaatgagtttgcattctttgatctattgataagggaaatggctggcctaaatgtattcagggaaaggcagtttggagtttagaatttgcgacaataattcagatgcagataaytgagagttgataaaaatgtattaaatgttttaaatgaataaaaatgtattaaaacctgggggcattacattgacctttcctccatttatttggatttaaataaatgtgatggaaagtaaaagagagctcactgcatttttggtttgaatattcagggattagtatttctccagaggtggtctgggctgtgggggtgaggcattctctgttgatgagcatgggactttcctatgcattttctaggtatgccagacactgttggcagatggtatagtcagtctagccacgtacatgcaaaaa

SEQ ID NO: 86439 - DNA, 601 bp, Human
ggctggcctaaatgtattcagggaaaggcagtttggagtttagaatttgcgacaataattcagatgcagataattgagagttgataaaaatgtattaaatgttttaaatgaataaaaatgtattaaaacctgggggcattacattgacctttcctccatttatttggatttaaataaatgtgatggaaagtaaaagagagctcactgcatttttggtttgaatattcagggattagtatttctccagaggtggtctgggctgtgggggtgaggcattctctgttgatgagcatgggacttycctatgcattttctaggtatgccagacactgttggcagatggtatagtcagtctagccacgtacatgcaaaaatcaatttccctcaatttaaaatgagccacagttaatttcgacctaatttattggtttatcgacctgtgaaccctgggccttcgaagaagtggcatgggcggccttcgagcgctgaagtggctgatgaagctaaaatccagaaaaggcagggtgggctgctgagcaagatcaagatttgagtttcctcctgtgttattgtgagatgctcagttttttttaactgtaac

SEQ ID NO: 86440 - DNA, 601 bp, Human
cattggaaaggctggtatgatctggttgagcctggagggccctgggttaagagccacctgtggagaaaggctagcttggggactgtggctgggaagactttaataggtacctgtgagatagcaagctatagggttaaggtcccagatagttaaggaccccatttctctattagcccaggagacacatgcgagacagttccacctgtctctgccccagggacctggggagaaaggccagtgctgatctgcccaaggatctcagccaaggagcccgagatggcagggagtggggacagagcakagtggggtgagtgtcctgtgaaaccagaagtgtttggaaggacttgcatgctttgaacctgtgctcaattaattgagtaacctgagactctgtacctatgacttacctcatctgtgtacatttagttccctgaaattctctcactgagtggttaaaaaaaaaaaaaatctgcagttaactgtgcacatggtttgctgaatttggcaaggtgtgctgttggtggtggtggtgatgggtgggctggagggggacggttactgcagaaacaaggccttcaatctctagaggagaaaaatgaag

SEQ ID NO: 86441 - DNA, 601 bp, Human
gaaatgacatccacaggctgcatctcatttgattcttacgacaatcttgaaaaatggggaagataagaatgattattcatctcatttcagagatgagtatcttgaagcttgaaaaggtgaagtgacttacccgtagttagacaggtggtaaaccggagagaacaagactcaaaccaacccgctaacttgtttcagatttatgcaggcatatttgtctatcctaagtaatctagtgaaatttttgatctcaagcagggatccacagcttttttgcagtacttttttttctccacctttaaaacctggagatctcacataattccactttctcctggccacactgatcttgtaatttttcaaacacagcaagtctcaaggcccttctccttcctggcttctgctctgccctgccttaggtctgggtccatgttctctgcctcacttttccatccccttttccctaactcctccctcttcatccttatggtgtcagtacataggtcaggtcttcagtgaagcctcactctctccccgatatgaggttaggtcccctgtgtaacaacagtaattcaatcatcattcctggaattagttgtttaat

SEQ ID NO: 86442 - DNA, 601 bp, Human
gctggcggtggatgctagccttgggcctgcggctgtttctccagctggggacagggaggcctgtgcggatgctgtggctctgcagatgccgctgacagcactttgaaggattggtttggccagagacccagtccacagcctgcctcctgtatgactcattctagctgcatattttggtagcatgagggcttgagatgagataaaaggagcacttcttaagagtggaagctcctaggttcttgattagcacttgagaaatataatgttctctgcaggtcctagaggccttaaaaaaatttgrgtatatttcacattacataaaattagccattttaaagtgaacagttcagtgaacttaatatcgccgcaatgttgtgctaccatgatttccaaaacatttccatcgctctgaaataaaaccccttacccattaagcagtgattccctcctctccaatctcccagcccctcgtaaccactaatcagctgtctctccctatggatttacctattcgggacatttcatataaatggtgtcatgcaatcatgcaatatgtgaccttttgtatctggcttctttcacttagcatattgtttgtgag

SEQ ID NO: 86443 - DNA, 601 bp, Human
ggggaatcaactagattcattgtttcccaaagaagctgcattagaaatacctggggttggggtgtgtctcctttttttttttttgagacggagtctcgctctgtcgcccaggctggagtgcagtggcatgatcttggcttactgcaacctctgcctcccagattcaagcaattctcctgcctcagcttcccgagtagctgggactacaggcacgtgccaccgtgcctggctaattttttgtatttttagtagagacggtttttcactgtgttagccaggttggtctccatctcctgacctygtgatctgcctgccttggcctcccaaagtgctgggattacaggcatgaaccaccacgcccggctgggtgtgtcttttaaaaaagactgattcctgggctccaggcagagggcgacagagccggtaggcgtggagtggggcctcttaggtgattctgaccttcagtggggcatgggacccccctaggccaggtgatctttggggggtggggtgggaggagttatcttgactcttaacgacctgccaatgagccagatgctgtttgttgtttatgatgcagtttctgtgttcagaggtttct

SEQ ID NO: 86444 - DNA, 601 bp, Human
aaacaggtgttttaccaggcttgccttctagaggttttctttttttctttttttttttttttttgaggtggagtctcgctctgttgcccaggctggactgcagtggtacaatcttggctcactgcaagctccgcctcctgggttcacgccattctcctgcctcagcctgccgagtagctgggactacaggcacccgccaccacgcccggctaattttttgtatttttagtagagaccgggtttcaccgtgttagccaggatgggagtttttctttgtagaaaagcccttggatgttttgargcttgcccttggtgctcttctcacctttcacctgccttgggattggtgaggaggtctcctgtcctctgagtagatcgatttcagcaagttatcttcagaccttttgcccactctgatcactgaaagctttgcaacctactcaaagcattatctgagtgttacctgccagagggagcattttgatgtcatctttgaggatgcccaagttgaatatttgaggactttttatcccagatcccaggggaacatgggtgattttttttttctaggttcctagtcctttattgtattgacatttgc

SEQ ID NO: 86445 - DNA, 601 bp, Human
gcttgggctcggtggctcatgcctgtaatcccagcactttgggaggccaaggcaggcggatcacaaggtcaagagattgagaccatcctggccaacatggtgaaaccctgtctctgctaaaaatacaaaaaaaaattagctgggcgtggtggcaggtgcctgtaatcccagctacttgggaggctgaggcaagagaatcgcttgaacccgggaggcagaggttgcagtgagctgagatcgcaccatggcactgcagcccgggcaaaaagagtgaaactcagtctcaaaaaaaaaaaaaaaaaaagaaagatctttctgccagtttctcaccaactctttctttttcatctccttttctctgtattccaggtgtacgtgtcttacgactatggaaaatcattcaagaaaatttcagacaagttaaactttggcttgggaaataggagtgaagctgttatcgcccagttctaccacagccctgcggacaacaagcgggtaaggaagtggccatccctcctgtcccgacttcatgggactgggttttggaaagattgccgcacttaagggggtgctaggagatggcgctctctgtgatctttgt

SEQ ID NO: 86446 - DNA, 601 bp, Human
tttctctgtattccaggtgtacgtgtcttacgactatggaaaatcattcaagaaaatttcagacaagttaaactttggcttgggaaataggagtgaagctgttatcgcccagttctaccacagccctgcggacaacaagcgggtaaggaagtggccatccctcctgtcccgacttcatgggactgggttttggaaagattgccgcacttaagggggtgctaggagatggcgctctctgtgatctttgtagcatgactggtggctagtgagtttttgtgctaacctgggcatttgtgacagrctgctgttctcagggttggtctctgcacaatcaggcaggccaaggactggtcaggcaggatttctagacaaacaatgacaggttaaaccacagaaaatcagccaactcttgtaataccttgcccgacttgcagatggcaaaaatgtttcccaggtacactgagaataaccttgcaatcaaattcatgttttctaggatactatcagtgtgtctgcttgcgtgcttatgcgtgcttgtatgcgtgtgtgtgcatgtacgtgcttgtgtgcgtgtgagtacctgtgtgcgtgtgggtacctg

SEQ ID NO: 86447 - DNA, 601 bp, Human
ctgatgatgattactgtatttacacattgtctcagagctcactcttgcggaggttgtggcctcgaaaatgccttgttgtccctctggaatctgtcttttcagcttcatctcctcctcctcacctcctgctgtggtgcacagatacctataggcaggctccatctcctcctccccagctcctcccctagtgcacagatacctataggcaggcttcatctcctcctccccagcttctcccctagtgcacagatacctataggcaggctccatctcctcctccccagctcctcccctagtgcayagatacctataggcaagctccatctcctcctccccagctcctcccctagtgcacagataccaataagcaagctccatctcctcctccccagctcctcccctagtgcacagatacctatcggcaggctccatctcctcctccccagctcctcccctagtgcacagatacctataggcaggctccatctcctcctccccagctcctcccctagtgcacagatacctataggcaagctccatctcctcctccccagctcctcccctagtgcacagatacctataggcaggcttcatctcctcc

SEQ ID NO: 86448 - DNA, 601 bp, Human
ggcttctgcagagtttagagatttacctgagatgctggggaggaaacgtgagagagcgaatccacaaaatatgtccctgggaagtttatggtctggatttggggagagagtgcaaatgaaaaggagtgagcacatctgaaagcagcatgagacaagtgcaaagtgctggtccacaccgaggctgtggcactgaaaggtttcagagctggagattgatctgggtcaggtggagtccattcgagaaagtgtccttgggcttatcctgcaggattgcttgacttctaggatgtcaatgactggytgtgggtagaactaggtccctgttgctctggtttctgattcataatctcctgagccttcctcattcttccaggagcagggaccggcctccgggtcttgccaggtgtgcatgcgaggccttacatcatctgtgcttcccagccttgttttctggttatttctctcaggccctcaagactgtcactgggtgcagtggctcatgcctgtaatcccaccactttaggaggccgaggcagcctgatggcttgagctcaggagtttgagaccagcctgggcaacatggtgagactctgtttctttc

SEQ ID NO: 86449 - DNA, 601 bp, Human
gtttatggtctggatttggggagagagtgcaaatgaaaaggagtgagcacatctgaaagcagcatgagacaagtgcaaagtgctggtccacaccgaggctgtggcactgaaaggtttcagagctggagattgatctgggtcaggtggagtccattcgagaaagtgtccttgggcttatcctgcaggattgcttgacttctaggatgtcaatgactggctgtgggtagaactaggtccctgttgctctggtttctgattcataatctcctgagccttcctcattcttccaggagcagggacyggcctccgggtcttgccaggtgtgcatgcgaggccttacatcatctgtgcttcccagccttgttttctggttatttctctcaggccctcaagactgtcactgggtgcagtggctcatgcctgtaatcccaccactttaggaggccgaggcagcctgatggcttgagctcaggagtttgagaccagcctgggcaacatggtgagactctgtttctttctttctttttttttttttttttgagacggagtctcactctgtcgcccaggctggagtgtagtggcacgctcttggctcactgca

SEQ ID NO: 86450 - DNA, 601 bp, Human
cctctgcattcatctttaattatcagggcccattactgttgttttcttcctcttttttgtgcgtgttaaaatactcataacgtacaatttgctgttttgacccttttaagcatgcagtgtagtgatattgagtatattcatattgttttgcagccatcaccaccatccatctctagaacacttttcatcttgcaagactgaaacgctacacccatgaaataatacctctctgcccccagcccctggcaaccaccattctactttctgtctctatgcttttgcctactctaggtacctcctragtggaattaatactatttgtcactttgtgatggacttatttcacttagcagaatgtccttaagattaatccatattgtagcatgtgtcaatttttttctttttaaggctgaataatattccattgtatgcatagaccacattttgcttatttgcttatccctcatggacacttggattgcttccacattttagctgttgtgaataatgctgctatctgtgaaaggtttttaaggacactgtttcttcgttgaaaagtgctgagtataatcatcctttggtttttaccattacctagagg

SEQ ID NO: 86451 - DNA, 601 bp, Human
tagattcttaagggtataagaaattgaataatttatggatatagttattaaggagaggtaaggaaagacatttcaggtacgtaacacacattgtgaaagaggcacagaggtaacagacatagtatgagaagctagagagaggatttatccttccagatgggaggatcataaacagctgtgtagaggaggtggcccttgatccaggatgtgcacaacaggtaggatgtccctgtgtggaggtgtggaggacaggaattccaggcagaggaacaaagtgacttgccaaaggcacagggatgcrccaatgtggtgcttgggtagagaacatgaactcttaattttggacagtgtattgggtgaagttttgaaagggaagttggtattagaatctgcatcgcttgataaaggaatttgggctacattctgaaagcaatgaggtacccctgtagttttgtgagaagaggagtgaaataaacaggctgtacttcaagaagtacttctagaagtaaatagtaatatacttatcgtaatttactattacagtgataaagtagtataggatcttgaattatatgaatttgtacatgtgcaggcaaatgtg

SEQ ID NO: 86452 - DNA, 601 bp, Human
gtccctgtgtggaggtgtggaggacaggaattccaggcagaggaacaaagtgacttgccaaaggcacagggatgcgccaatgtggtgcttgggtagagaacatgaactcttaattttggacagtgtattgggtgaagttttgaaagggaagttggtattagaatctgcatcgcttgataaaggaatttgggctacattctgaaagcaatgaggtacccctgtagttttgtgagaagaggagtgaaataaacaggctgtacttcaagaagtacttctagaagtaaatagtaatatacttatygtaatttactattacagtgataaagtagtataggatcttgaattatatgaatttgtacatgtgcaggcaaatgtgtaggacagatttctaggagtgggtatgctgggtcagtgggtttatctaacagctatccattcactcacatggatgactgatagatattgcaaacttgacccctcgcaaattgactcttgatcttcaccaccccaaatcagctccacctataacttttctcatttgctcaggccaaaatctttggagtcatcgttgatttcacatttgttttatgctttacattca

SEQ ID NO: 86453 - DNA, 601 bp, Human
gtcttttagttggtattgcttccttagtaatagaggtaaagatggagctggtatgttgaggagccttacagctgaccatcatcagacacccatagattctgtttatgtttccacagagggtagctgtttctgacccttttgttattttccttgagcaaaagttgtgggatcttagtgaaattataaccacagtctcatccaaggacaccctctgctcaaggagaaccattagaactttcttctgctttatttgaattttaaggggaaaaattgttcttttatctgcttaagaaactataamttaagagggcaaaccagcagaattactagataagggaacatacaatttagaaattttaagttctaaaatcatattgtaccttctgcctctgtgtagatatacagatatcctgggagaaaggactggtttatctcattgaagctaatgacatgtcggttaggggattttaggctatttgtgggatttctccccctaggtttccccataataagtgaaagcgtaatctagtctctcagaataatgatatacatttgttcaacaatgcttggcgagttgggagcagcaggagtgggaaagcta

SEQ ID NO: 86454 - DNA, 601 bp, Human
ccttgagcaaaagttgtgggatcttagtgaaattataaccacagtctcatccaaggacaccctctgctcaaggagaaccattagaactttcttctgctttatttgaattttaaggggaaaaattgttcttttatctgcttaagaaactataaattaagagggcaaaccagcagaattactagataagggaacatacaatttagaaattttaagttctaaaatcatattgtaccttctgcctctgtgtagatatacagatatcctgggagaaaggactggtttatctcattgaagctaatgrcatgtcggttaggggattttaggctatttgtgggatttctccccctaggtttccccataataagtgaaagcgtaatctagtctctcagaataatgatatacatttgttcaacaatgcttggcgagttgggagcagcaggagtgggaaagctaaaaatttacatggtccggagcttgagattggcaagacagaacagtggaagacctggagggggctgaggggactcaaagataccctgtggagcatcattgagggatttcaggtgaggccaggtgaggctggtgactgctcagagataga

SEQ ID NO: 86455 - DNA, 601 bp, Human
ttgggatgaaagtcacagttctttctatctctaggtgttggctgctgcttttggctaggaaggaataatagaggtgagctgggtctcaaaatagctcaataaaggttccttcctctctgccgttttaaaaataccaagcagcctcattttaatttgcatatcctctggctagaggaagtactttaatcagtacttctaattgtggaaaagaagagaacatgccaccacccgcccacacatgcacacagaggatctgataatgaagaatagtgttctcccacactaggaccaaagctgctgktttctccgttgccctaagaatccagattgtagggcaaaactcaagtcttgctcccattgtaaaaagaagctcttttttctttgttttttcaagacagggtattgctctgttgcccaggctggagtgcagtggcacaatcatggctcacccagcctcaaacttccaggcttcaatccacccacctcagcctcctgagtagctggggctacaggtgtacgccagcatacctggctaatttttttaaatttattttttgtagaggtggagtctcactatgttgcccaggctggtcttgaactc

SEQ ID NO: 86456 - DNA, 601 bp, Human
gcctcattttaatttgcatatcctctggctagaggaagtactttaatcagtacttctaattgtggaaaagaagagaacatgccaccacccgcccacacatgcacacagaggatctgataatgaagaatagtgttctcccacactaggaccaaagctgctggtttctccgttgccctaagaatccagattgtagggcaaaactcaagtcttgctcccattgtaaaaagaagctcttttttctttgttttttcaagacagggtattgctctgttgcccaggctggagtgcagtggcacaatcrtggctcacccagcctcaaacttccaggcttcaatccacccacctcagcctcctgagtagctggggctacaggtgtacgccagcatacctggctaatttttttaaatttattttttgtagaggtggagtctcactatgttgcccaggctggtcttgaactcttgggttcaaatggtccccctccctaccctggcctcagcctcccaaagtgttgggattacaggtgtgacccactacatctggcaaaagaggttcttgtttttctgtttcttattttcctttttgggaggggtggggggaa

SEQ ID NO: 86457 - DNA, 601 bp, Human
tgtgcttgggacagattgactgaagggatctcaacattgacaacattgacgaacattccgaaagggcttggcaggtgctaggaagtcagaggagtggagaggcctaggacaaacactcaaagtggctctaggctctaggaatttggttgtttcctggtagccaagcatccttgacaaagacgtatttctttgaaatcccaatgaaaagaacaaagaatggagaggggagggtggctcagtggcttctttcctttaatcccactgcctgatttcctttaaacttatgctgatttctttgagrtttttcaacacatgtcaatttacatggctaataggatgtgtagtcattggctagtgggagttaatgctctaagaaaagcagtaattaagcttccagctgtcagtaagtagcttaactctcagcctttgggaaaatcttccccttgatttgatgtgttggagccagatgccgaaatggtgggcttgctcattcaaaaccagagttgattacttaacaggacttgtcttgaaattgtattgagttcagtctttatcaccctggttgtaaaggaaaaaaccaggcccagtcaagggcaggtgg

SEQ ID NO: 86458 - DNA, 601 bp, Human
cagttctccagggtttataggccttttctgccttaatgccttgggcctggagttattgtgtgattttaattctgaactctaaaacacattgactgactgcctggtttgtcctcctttttgcttgaaccagggcaggatggatagctgttgtgcatttctcttaaccgggttatttctaggtgtcacggtcgagagtttaagttatatcccagctgggccgggcatggtggctcatgcctgtaatcccagcactttgggagtctgaggtgggtggatcacttgaggtcagtagtttgagacragcctggtcaacatggtgaaaccccgtctctactaaaaatacaaaaattagtctggtgtggtggcacatgcttgtaatcccagctactcggaaggccgaggcaggagaattgcttgaatttgggaggtggaggttgcagtgagccaaaatcatgccattgcactccaatctgagcaacagagcaagactctgtctcaaaaaaaaaaaaaaagttatattctagctggagctttctgtgccctccattctagtctaacagctatgtctgttctccagatgtatctgatttacagagtgcct

SEQ ID NO: 86459 - DNA, 601 bp, Human
ctcttaaccgggttatttctaggtgtcacggtcgagagtttaagttatatcccagctgggccgggcatggtggctcatgcctgtaatcccagcactttgggagtctgaggtgggtggatcacttgaggtcagtagtttgagacgagcctggtcaacatggtgaaaccccgtctctactaaaaatacaaaaattagtctggtgtggtggcacatgcttgtaatcccagctactcggaaggccgaggcaggagaattgcttgaatttgggaggtggaggttgcagtgagccaaaatcatgccrttgcactccaatctgagcaacagagcaagactctgtctcaaaaaaaaaaaaaaagttatattctagctggagctttctgtgccctccattctagtctaacagctatgtctgttctccagatgtatctgatttacagagtgcctgtggtgagtttttaattaaacctggccagtggtaagattaggggtcatgtttgttttgatctcaccgatacagtacccagtgccttgcgctatgtttgatacgcagcagatgcgcaatagagttgaatgaatgccatgtttgcccacctaatttaaa

SEQ ID NO: 86460 - DNA, 601 bp, Human
gctgggccgggcatggtggctcatgcctgtaatcccagcactttgggagtctgaggtgggtggatcacttgaggtcagtagtttgagacgagcctggtcaacatggtgaaaccccgtctctactaaaaatacaaaaattagtctggtgtggtggcacatgcttgtaatcccagctactcggaaggccgaggcaggagaattgcttgaatttgggaggtggaggttgcagtgagccaaaatcatgccattgcactccaatctgagcaacagagcaagactctgtctcaaaaaaaaaaaaaaagttatattctagctggagctttctgtgccctccattctagtctaacagctatgtctgttctccagatgtatctgatttacagagtgcctgtggtgagtttttaattaaacctggccagtggtaagattaggggtcatgtttgttttgatctcaccgatacagtacccagtgccttgcgctatgtttgatacgcagcagatgcgcaatagagttgaatgaatgccatgtttgcccacctaatttaaaaagtagtcaatttttagaaatttggtgggagacgtattaaatttttggtacttt

SEQ ID NO: 86461 - DNA, 601 bp, Human
ccagtaagagtgttgaaacctgcaagtgtaactttttatctggggtctgcctagctctaaggctgcctgagcttgggaaattccagctggctttagtgttaaatgaattcaaatcaaattgggaaaatcaaagaactgattttaaagctacagaaagctggttttgcatgattaactcttttgcttccttccagcaccatgaatgattacagtcctttgcaagctactgtttcagccccctggcttctggactggagctggtgtccaggtcttcagaacctcctggtaccctgttggcctygctctggctttataatgtgctttgtattttttgcccttaagttgccttgtttaatttttattccttgctttttgacatgaagttcacttatttgtcttcatagtgtacatcaaaatgatagggccattaaagaaacaatgaggttcctctgtgatttgttaatttggtaatatacaactgttaggctctttcagtagataacagtaattgctgaaaagcttgaggtgggtcagggttagctactcccctacaacctcacaacctcataacctcactaccagattaagattatcatgcaag

SEQ ID NO: 86462 - DNA, 601 bp, Human
tgtacatcaaaatgatagggccattaaagaaacaatgaggttcctctgtgatttgttaatttggtaatatacaactgttaggctctttcagtagataacagtaattgctgaaaagcttgaggtgggtcagggttagctactcccctacaacctcacaacctcataacctcactaccagattaagattatcatgcaagccaggcccagatatttcttgcacaaatgtgtatcagtaagcaaagacatgatctgtggacttgaagtctcttctgtgaccttacagatgatgcagccacccacrccttgcatgctgcagacgctgtgttctagagtggatgctaggaaactatggcccaccacctgtttttgtaaatgaagttttactgggacacagccatgctcattgcttatttgtggtctaaggttgctttcatgcccagtggtagagttgcataggtacctatacagaggcaatatggctccaaaagcctaaaatatctattatctggacctttacagatagttgtctgacttcctgtagttgctgactatgctgatagttgtctgttaccccttcagttggcatcaggtaactggaatc

SEQ ID NO: 86463 - DNA, 601 bp, Human
gggccattaaagaaacaatgaggttcctctgtgatttgttaatttggtaatatacaactgttaggctctttcagtagataacagtaattgctgaaaagcttgaggtgggtcagggttagctactcccctacaacctcacaacctcataacctcactaccagattaagattatcatgcaagccaggcccagatatttcttgcacaaatgtgtatcagtaagcaaagacatgatctgtggacttgaagtctcttctgtgaccttacagatgatgcagccacccacgccttgcatgctgcagaygctgtgttctagagtggatgctaggaaactatggcccaccacctgtttttgtaaatgaagttttactgggacacagccatgctcattgcttatttgtggtctaaggttgctttcatgcccagtggtagagttgcataggtacctatacagaggcaatatggctccaaaagcctaaaatatctattatctggacctttacagatagttgtctgacttcctgtagttgctgactatgctgatagttgtctgttaccccttcagttggcatcaggtaactggaatcgcaatgtcttgacaggt

SEQ ID NO: 86464 - DNA, 601 bp, Human
ttaagattatcatgcaagccaggcccagatatttcttgcacaaatgtgtatcagtaagcaaagacatgatctgtggacttgaagtctcttctgtgaccttacagatgatgcagccacccacgccttgcatgctgcagacgctgtgttctagagtggatgctaggaaactatggcccaccacctgtttttgtaaatgaagttttactgggacacagccatgctcattgcttatttgtggtctaaggttgctttcatgcccagtggtagagttgcataggtacctatacagaggcaatatggytccaaaagcctaaaatatctattatctggacctttacagatagttgtctgacttcctgtagttgctgactatgctgatagttgtctgttaccccttcagttggcatcaggtaactggaatcgcaatgtcttgacaggtcccaggcattatccagaaaagtataggttatgggcctctctaaattgttatgccctgttaatgacaggatggtatctttagaatattatgcccaattcaagtattttgatgtcacaccagtctcccaagtgagggtccatgtgtattttcatgattctgact

SEQ ID NO: 86465 - DNA, 601 bp, Human
taaccactaacctagtatctttatggctttttcaattttgggcaatttgtgtaatggaaatcatacaatttgtgactttattagtccattttcatactgctatgatgaaatgcccgacactgggttatttataaagaaaaagaggtttaatagactcacagttccacatggctggagaggcctcacaatcaaggcggaaggtgaaggaggagcaaaggcatggcttacgtggcggcaggcaagagagtgtgtgcaggggaactgccctttataaaaccatcagattttgtgagacttattyattatcatgagaacagcacaggaaaacccgcccccatgattcagttacctcccaccaggtccctcccatgacatgtggggattatgggagctacaattcaagatgagatttgggtggggacacagccaaaccatatcagtgaccttttgtgactggtttctttcacagtataatgttttcaagtttcatttatgttgtagcatgtatcattactttaaccatttttaatggctgactagtattgtaatgaatataacacattttatttatccatctattagttggtggccatttggcttg

SEQ ID NO: 86466 - DNA, 601 bp, Human
ttcaattttgggcaatttgtgtaatggaaatcatacaatttgtgactttattagtccattttcatactgctatgatgaaatgcccgacactgggttatttataaagaaaaagaggtttaatagactcacagttccacatggctggagaggcctcacaatcaaggcggaaggtgaaggaggagcaaaggcatggcttacgtggcggcaggcaagagagtgtgtgcaggggaactgccctttataaaaccatcagattttgtgagacttattcattatcatgagaacagcacaggaaaacccrcccccatgattcagttacctcccaccaggtccctcccatgacatgtggggattatgggagctacaattcaagatgagatttgggtggggacacagccaaaccatatcagtgaccttttgtgactggtttctttcacagtataatgttttcaagtttcatttatgttgtagcatgtatcattactttaaccatttttaatggctgactagtattgtaatgaatataacacattttatttatccatctattagttggtggccatttggcttgtgtctactgttttactgttacaaacagtgc

SEQ ID NO: 86467 - DNA, 601 bp, Human
agttctttattctatatattctttatatacaagttatatgatttgcaaatcttttctgccattccgtggtttatctttttacttttttctttttcagcactgaagtttttatttttattttatttttttgagttgggggtcttcctctgtcacccaggctggagtacagcggagcgattgtggctcactgcagccgtgatcttcgtgtgctcaagcaatcctcctatctcagcctcccaagtagctgggaccacaggcatgtgccaccatacctgttaatttttttattttttgtagagayggggtttcatcatgttgcccaggctggtctcaaactcctgggctcaagcagtcctcccaccttggcctcccaaagtgttgggattgtaggcacgagccaccatgcccagccgtgtttttaattttgatgaagttcagtttatccatttttttttgctgcctgtgctgttgttatatccaagaaactattgcctaatctgaggtcatgaatatatacttccctttcctttaagagttatgtagttttagttcttacagtctatgattcattttcaattaatttttgtatctagtgtgaaat

SEQ ID NO: 86468 - DNA, 601 bp, Human
tttgggaggctgaggtgggcggatcacgaggccaggagttcgagaccagcctggccaatatggcgaaaccccgtctctactaaaaatacaaaaattagctgggcgtggtggagcgcacctgtagtcctagctactcgggagactgaggccgaagaatctcttgaacctgggaggtggagattgcagtgagctgagatcgtgccactgcactccagcctgggcgacagagcgagactctgtctcaaaaaaaaaaatttcctaagtattctttttggctccattgtaaatggttcttttctaratttcattttcagattgttcattgctaatatatagaacatgattgatttttgtattattgatcttatattctacaaccttgctgaactttattagttctaacttttttggtgtgtggattccttaggattttctgtttacaagatgatgttgtctgctaaaagagacaacatcatcctttaattcttccttttcagtctggaggccttttatttatttatttttttgcccaactgccttgggtagaacctctagtaaaatgttgactaggagtggagagagtaggcatccttgtcttatt

SEQ ID NO: 86469 - DNA, 601 bp, Human
tttcttttttttcctcctttagtctattaacattgaatattacactgatggatctttctcatatgttaaaccaatgcacatttttggaatgaatcccacatgctcttggtttataatcatttttatcctttaatttgtttggcagaatttaccatctttgtgggaagttttctggatactaattcaatcttttcagtttttaaaatttctctttggttcagtttcagcagtttgtatctttctagtaatttgttcatttattctaggttatttaatttttaattattcatagtgttcacaytaatcttttttttatttctgtgaggttgttaatgatgtttcttatttctttcctaattttagtaatttgagtcttctctttttttcttggtaagtctagcttgtagtctagtttattaaatgttgttaatcttttcaaagaatcaatatattgtttgagtaattttctttattatttttctcttctctatttcatttattcctactgtaatctttatatttctttcattctgcttgctttgggcttagtttgcccttatgtttctatgttcttaaggtggatagtcaggttattgatttg

SEQ ID NO: 86470 - DNA, 601 bp, Human
tcacagaatgtactttatatggtttcagttctttttaaatgtattggggcctattttaatacttaacatctgttatccttgagaatgtggctgaacatgtggaatgaaacatgtgctttgagaagaatgtgtattctgctgttattgggtattatgttctataagtgtttattaaatctacttggctgatggtgatgttcagtttatctttttccttttctgccttgttctatattgaaggtgggaaaatcttcaactgttgaaatctttaagtattatcatcttgattatttatttctcycttcaattctgtcagttttccctcatgtgctttggagttctgttgttaggtgcatatatgtttatgattgttaattcttctagattgacacttttatcattattaaatgtccttccttgtctctagtaactattttttgtcttaaattctattttgcctattattatagctattcttttcttctgggtacagtaaacatggtgtattagtccgttttcatgctgctgataaagacatacccaacactgggcaatttacaaaaaaggtttataatggacttacagttccatgtggctggga

SEQ ID NO: 86471 - DNA, 601 bp, Human
acatttaatgtaattactgaaaggtagactacatatctgctattttgctctttgctttctatattcctgataaattttttttggatcctttattacttcattactgcctttttttgtattaaatacagattttctagggtgacatttaaattcccttgtaccttctttcactaaatttttcccaggtgttttcttaatctgtgctttggggattacaataaatatcttaatttatgaaatctaatttggattaataacaatgtaacttcagtagtgtacaaaatctttgtcattatatagmtttattgtgtccctgcttttgtgctattattgtttcatctttatactctttaagcccatcagcacagttttagtctaattgaggactccttagatgagtcatttttctttgctgctttccaaggttctttatctttggctttcagcagttttactgtggtgtgtctgggtatgggtctctgagtttatccttttaggaattcattgagctgactggatttatgttttttatcaaatttggggagttttgggtcattatttcttcaaatattctttctcctttattctctcatctcgtcag

SEQ ID NO: 86472 - DNA, 601 bp, Human
agctatcaaaaatacaaattttgacttaataattcttctaagactgcatcctaccaatggtattgtgcagttctgaaaaagtaataaatacatgcttatttatatgtgtgtgtgtttaagaatgtttctggaaataactaaagtgcccaccaatagctgttaagtggaaagatgtctaagatacattgccaatgataaaattttaaattgtgggacagtaagatacactgttaatggaaaaagttaagtaatacaacagcatttatatcatgatccaaattatatgtgaaaaattaaattrcctctgtcagtttagaactatattaggttgctggtaatagactagaaataaaaattgcttaaccaagtcaggagtttagttttctcccccttgctgcctggaggtaggctgtcttgggctggtatgttggtgtcctgatgttcttggggatccaggtttctgtcttaatgttctgccatcctgactagtgatttccattctcaagattacctcatggttcaagacatccatactagccttcaagtccttattgcagttaagaagaataaggaaagacagcaagtaggacctcttcccacc

SEQ ID NO: 86473 - DNA, 601 bp, Human
acatccatactagccttcaagtccttattgcagttaagaagaataaggaaagacagcaagtaggacctcttcccaccaattctgtctgtttaggcagccttctcagaaatccagcacgaaacttctgtttttatctcattgactagtacttagtcacgtgacttcccataggtgcaaaaatggtagagaagtgcagtcatttattctgggtggtgtcagagtcccactgctcaggaggaaagggataatgggtgttgggggtaggtgtagcagtgtctgtcactatgtacatatgcttgcrtgtggtggcacagtacatttctgaaaggatgcacaagagctgttagccactgggcactctgcagggtagagtgggaggagggatgtggagatcagagcagagcttctgcatttaccttatacccatctgtgctgttggatattttccatgagtatgctttgctttttaataatagtgataaaaaacaaaccaacccaaaacctatggtttattaagaaaaatctcagagccttacaatacatcttataatcactagtgtgccatagtttaattgttaatatatttcttggtggaagtaaa

SEQ ID NO: 86474 - DNA, 601 bp, Human
ggatcgatgcattttgagattttttttttgatgattgtagtattctgtgatttttgcatttatgaggtaagactgacctgtgaaatatattcttaatactcaggcctcccagcagcaatcgttaagtatttttaactaatgatgggcctgggtgtcattgagaaatcactctttttaaagttatactcacagttggaagtcgtaaaaaacaaagcataaaaatgtatatttcattgatatgttcctctatatattcacaaaaatgtatgtgtataggctgacttaaactaatcatctgacwtagccatgacattttatcaacttaatgaaggcttttggaatttatatgtaacaattttgctgggaactgttttcttattcagttaatatgcttttacatttttaatagatccatcatttcctacggccctatgtttagtacaagctattaatatggttttcaggtttccattttggtgggcagtctttcgtacctctctgcctgatttctttaaaacaaactacttttaaccatttgttcagtggtgatttgaatgtctgctgctcaaatggattaaaagtaactttgtctttatcagct

SEQ ID NO: 86475 - DNA, 601 bp, Human
ttaatatctataataaacagcaacctagtcaaggataagtgaagccaaagtaacccctctggctgggaatcccaacatctcaatatgtttaatagtcatttgtatgattatgtccacatgagggtatgcctccctgtgtctttcctgatagatatgcaacatttgccttcagcttctggccatgttcttttagagctggaagaaaccacacagagtttttataatagttcttatccttttttgagtggtggactttcttgagaatctgataaaacgtacggagcctccatagcaaaataartgagtgtatataaaaaaatttgcatatatgtttacagggttgctggaccatttaaacccatctacagggaagtcttgatccaaataagcttctccttttgtatatgaataaactgaaagctagagagatttctatcattttctcagttggtagagctagctcttaatctatgcttttatacacatttccaagattcttgctgtgacttaaaaatctctaaaatgcaatgtgatgtggtcaacatcatgttgaatactctaccaatgaatatgtattctagcaaaagaccttcctcaatga

SEQ ID NO: 86476 - DNA, 601 bp, Human
ctaaatgagagaaactcaggcctcccagatatctagaagaagcccataaccagtgggatgacaggtttatgatgataaccctcagagaggtagagcagaggtcagcagagaaggaggaatcgagaccttcagctggttcctaaggaagcccctgaaaaataactgaactagacctaaggaaaccacatgtcagagaatttggtctcaactccagcatttcattcggcactctgctcagtccctcagcctgaagctgctttggtggggctcctagtgttccttttcctgcctcagaggttgktgtttgggtctttctgtctgaggtggcagggcagtcatccagctgaagagattgtgtggagatggttgatggaggacagcgtttctcggctttattgtgtagccggtggcttagaacccctgaagtaaagggcaagcttccagtcttttttctttttctttttttttttttttgagttggagtctcgctctgtcaccaggctggagtgcagtggcacgatctcagctcactgcaacctccgcctcccgggttcaagcgattctcctgcctcagcctcccaagtagctgggactacaggca

SEQ ID NO: 86477 - DNA, 601 bp, Human
gacctaagagtgcctggcatggagtgggggctcagggcatatatgctgcatgtatcagcaaattatagcgtagtggtattagccctgaaatgggctgctattattattattattttgtatattattgaagttgagatgaagcctgtccttgctgggctatgttgtataggcactttcgtctcactctgtgctatggaagtagactctctttttgccttaaggttgtataactaatatcgatgctgattataccaattcctaagacagggctagttccctagttccaaaatgctaattcatyttcatctttgggcattagagaatttccaaacttgtaaaaaaaaaaaaaagttgttgccagcctcccattgattaaggccaaggaagtgcgtttggtctcgttctgtaggggttgctttcaggggtgaccctctagttatgccaggagccaccagggtaaaacccaacagatcacttgacaggatgagcaccttgtcatcgagcagccccgcaggctgggcagccggaacagcacgtcgggagtgatgtggagttctcagaacagctagcagacatagttcccatccacgtggtgctttac

SEQ ID NO: 86478 - DNA, 601 bp, Human
gtataactaatatcgatgctgattataccaattcctaagacagggctagttccctagttccaaaatgctaattcatcttcatctttgggcattagagaatttccaaacttgtaaaaaaaaaaaaaagttgttgccagcctcccattgattaaggccaaggaagtgcgtttggtctcgttctgtaggggttgctttcaggggtgaccctctagttatgccaggagccaccagggtaaaacccaacagatcacttgacaggatgagcaccttgtcatcgagcagccccgcaggctgggcagcyggaacagcacgtcgggagtgatgtggagttctcagaacagctagcagacatagttcccatccacgtggtgctttactgggaatgcaccatgctcaccttgatatttgaataggtaatatgtaaagcagtaataaaaataccaacattcatttggcaccttgcagttcacagaggcctgtcacaagccttctctcactgtggcagggcttcccatccctcccgaggagagagatgaggctcagacactgtgtactgtatgtggcgaacgcaaatatgtgttcagatgaggcagattgttaa

SEQ ID NO: 86479 - DNA, 601 bp, Human
gcagatgaaggcacagtacactgcacatatttaaagtgtacagtttgatcagaattaattatggtcaccacaattaagataacaaacatttccatctgcaaattctctgatcctcagaattccgtttttgtgctttttttctttttaaaataatttttatttcttttatttttagcttttttctgtaacaaatttattgaagcagataaggggacagtacactgcacatatttaaagtgtacagtttgatcagaattaattatggtcgccacaattaagataacaaacatttccatcaccytccccgaggtatctttgtgcccctcggtaatccatcccactctccagtcttgtccttgtctgcttctgttattcattggcattttctagaataggttattcattggcattttctagaattttgataagtggactcacacagtatatactctttttgcctggcttctgtcacacatcacgatgattttgggtttcatccaagttgctttgtgtatcaattgttcattcctttgctagttgtatcccattgtagggatatatcataatttatttattcattcatctgttgataaacattcca

SEQ ID NO: 86480 - DNA, 601 bp, Human
tgtgagagatacttgtctttaatttgtttttttttgtaaaatctttctaaagttttgatattagtgtttggctagtatcataaaacaagcagaggggtaaacccctcttcctcttttttaggacaaagtttggtgttattttttcttgagtaattccctaatgaaactgtccaggcattgagttttctttttgggaatattttttgataagagatttaatttctctggttgatacaaggctattcagattttcttctttttgtttcaattttgatgagttgtgtgtttcaagaaatttgtyccttcatgtaagttgtgacatttgttggccttatgttatcaatgatatattctctttatctttttaatgtctgtaggatctttggtgatgatttcattcttgatattggtgatatgtgtattttctctatttttcgttcgtttaggtgtttcaatactgttgatctttccaaagaatctgcttttggctcttgttgattttctattgtctgttttctgttttgttgctttttttctttattattattttttcccttatttgttttgttgttctttttgtagcttattaagatataacctt

SEQ ID NO: 86481 - DNA, 601 bp, Human
ttttcttgagtaattccctaatgaaactgtccaggcattgagttttctttttgggaatattttttgataagagatttaatttctctggttgatacaaggctattcagattttcttctttttgtttcaattttgatgagttgtgtgtttcaagaaatttgtcccttcatgtaagttgtgacatttgttggccttatgttatcaatgatatattctctttatctttttaatgtctgtaggatctttggtgatgatttcattcttgatattggtgatatgtgtattttctctatttttcgttcrtttaggtgtttcaatactgttgatctttccaaagaatctgcttttggctcttgttgattttctattgtctgttttctgttttgttgctttttttctttattattattttttcccttatttgttttgttgttctttttgtagcttattaagatataaccttgggttattgattttatatcttcttttctaatgtaagcatttaaagctgtaagttttcctttaagtactaatttagctatatgccacatatttagatatgtttttagtgtttttaagttcagagtatatttaatgtccccc

SEQ ID NO: 86482 - DNA, 601 bp, Human
agaccagcccaggcaccatagcaaaactttgtctctacaaaaaataaaaaaattaactgggcatacctgtgatcccagttactctgggggctgaggtgggaggctcacttgagcccaggaggtcaaggttgcagtgagctgtgattgtgtcagtgcactccagcctgggtgacagagcaagaccgggtctcaaaaaaataaaaaaacagataaaattgagatgtaattcacatattataaagttcaccattttaaagtgtacagttcatatgtttttagtattattcagtcatcatcattwtctgattccagaacattttcatcaatccataaatatctcttgatttttatcttcgaatgataagttacttagcaaagtgttatttaatttgcaggtatttgggggtttcatagatatcttgttattgatttctaatttaatttcctatagtcagagaagacactttgtatgatttcagtccctttagatttgttgagatttattttgagatccagcctgtggtctatattgttgaatatatcacgtgcactgggaaggaatatgtattaagcagttgtttgaggtagtgttctgtagata

SEQ ID NO: 86483 - DNA, 601 bp, Human
atgggacatggttataatagctattttaaaattccagccaggtatggtggctcatgcctataatcccagcactttgggaggccgaggcaggtggaagcacttgaggtcaggagctcgagaccagcctgaccaacatggtgaaaccctgtctgtactaaaattataaaaatgagctgggcgtggtggtgcatgcctgtaatcccagctacttgggaggttgaagcaggagaatcacttgaacccaggaggcagaggttgcagtgagctgagattgcaccactgcactccagcctgggcaacmgagtgagaatttgtctcaaaaaataaaaaattaaaaaaatattccaatatatgggtcacttgggattggcaccttttgactatcttttcctttgagaattggacacatcttatggatatgtttgtatgctgtatgttaagtaattttggtttgtattctgcacatatgaatgaaattcatgaaattaagccttctggaggatattgatatttttgtctcagcatgtaatcagcctgtttaggttctgaccctgagttctgtcttgctttctgtaggtggtagtttaactctcagttcagt

SEQ ID NO: 86484 - DNA, 601 bp, Human
agagtgagaatttgtctcaaaaaataaaaaattaaaaaaatattccaatatatgggtcacttgggattggcaccttttgactatcttttcctttgagaattggacacatcttatggatatgtttgtatgctgtatgttaagtaattttggtttgtattctgcacatatgaatgaaattcatgaaattaagccttctggaggatattgatatttttgtctcagcatgtaatcagcctgtttaggttctgaccctgagttctgtcttgctttctgtaggtggtagtttaactctcagttcagyatgctaagcctttgttacactggtttgtgtctgtttcatgcacgtacacttcaggggttaggctgcgacttgcgtaagttcatatacaaaattaggggatttacttttttgacactctctgctatgggattccatccacactttacctaccctataggggctcctttctctggttcctttgggggaaataatatctattgcagttttagctgtgactgagactgaggtgcaccccatgactgggacttttccttcgggcaaagctttaccaggatattcatgacttgtgtgtgtagcttc

SEQ ID NO: 86485 - DNA, 601 bp, Human
ttctgtcttgctttctgtaggtggtagtttaactctcagttcagtatgctaagcctttgttacactggtttgtgtctgtttcatgcacgtacacttcaggggttaggctgcgacttgcgtaagttcatatacaaaattaggggatttacttttttgacactctctgctatgggattccatccacactttacctaccctataggggctcctttctctggttcctttgggggaaataatatctattgcagttttagctgtgactgagactgaggtgcaccccatgactgggacttttccttcrggcaaagctttaccaggatattcatgacttgtgtgtgtagcttctctaggttttaaatctccacaagcggcttgctttcgtttacttttcagcatccactggtagttgttttttgtccagagttttcagctgtaattagcaggaaggatgggctatagagggctaatactgtcatagtagaactgaaaccccagttacttaatttttaatcaagggttggtgggagtcatagatttggatttgagtcctacctctgctgttcacagtctaccattttaatattaagcccgtgtttcttca

SEQ ID NO: 86486 - DNA, 601 bp, Human
ctgtcttgctttctgtaggtggtagtttaactctcagttcagtatgctaagcctttgttacactggtttgtgtctgtttcatgcacgtacacttcaggggttaggctgcgacttgcgtaagttcatatacaaaattaggggatttacttttttgacactctctgctatgggattccatccacactttacctaccctataggggctcctttctctggttcctttgggggaaataatatctattgcagttttagctgtgactgagactgaggtgcaccccatgactgggacttttccttcggrcaaagctttaccaggatattcatgacttgtgtgtgtagcttctctaggttttaaatctccacaagcggcttgctttcgtttacttttcagcatccactggtagttgttttttgtccagagttttcagctgtaattagcaggaaggatgggctatagagggctaatactgtcatagtagaactgaaaccccagttacttaatttttaatcaagggttggtgggagtcatagatttggatttgagtcctacctctgctgttcacagtctaccattttaatattaagcccgtgtttcttcatt

SEQ ID NO: 86487 - DNA, 601 bp, Human
taagttatgcatgtctttctctccctgattagcacagatatctaggagttgactgttatttgtttcagcttctgccttgagtctcctctgagactgttacctttgttattgttaattgaaattgagagcaagaagtggaacactttgttttgctcttgtgtctacatgtctgaaatgggtaaataagaacctgcactggggatccacttattcgttcattcagcccgctgctcctgtgaacctgctcacgggaggcataggagcagtggctttttcgtcagagaaggggctgttgcatttytgcaccctgaccgaagaagattcaaacacgtttgtcagcttgatcacggaagagaagatcaatttctgtttcttcgctgcggtttgcttgtcagcatgatgatatttttcgtagtcagtaataatattttgaacttgccccaaagcatcttttttttctaagacatccaatttcataggggcttctctctggaaatcctgaaaagcccctgaaaagactccacgcagcagagcagctgtcttttctggacctgggctctggaagcagccccacagttccagaatgtgggaggcagtggtt

SEQ ID NO: 86488 - DNA, 601 bp, Human
ggtgggagccagaatgagggccaggtgatgctatctgggggacaaaggaggacttctgagagaggaaaccccagctgaacctaaaaggatacaaagcaaggtcggaatgcttttccaggtctagagagaccttgagcaagggccaaagcatgatcagtggggaatgtgcacggctcttgagtattaatagaatgcaaatttccaggtgggaagtagtgagaaacgaggctggaggaaggtatctatgtagaggccaggtcctgggggacctcacctgtgccttactaaagagattaaagtytgctttgaggtgatagggtccctttgaaggattttagtaggggaatgacatggctagacttgcattatagaatgatggatctggcagaatggagaggatggattcagtggagagagactggaggtgagagctgatgctggggtgtgtttgaggactaagtctgcagggcatggtttctgattcacctgggatgatgggagaagtgattataccgctcatagaaaggcagaggtaaaggagtaggcttgcagggctgtatattaaatgcagacatggacaggttgaattgaagcctctgtt

SEQ ID NO: 86489 - DNA, 601 bp, Human
ttatatgaccttttttcccatcttgaatatgttctttagaaacctgaactcatcaggaacttttctgggtagctgcctgctagagtcctaagttgggtatctaccacacttcttccttttagagtatctgtggttatattatgttttattattatattatctgaccttcccatcttcttgagagtttttggccctgggattatgtctatatttttatctgaacagtttgatttcttcattcctaaaggctagtgccctatatcctctttcataacttaagaatgcaaagatgggccagacrcggtggctcacgcctgtaatcccagcactctgggaggctgaggtgggtggatcatttgatgtcaggagtttgagaccagcctggccaacaaggtgaaatcctatctctactaaaaatacaaaaaaaaaaaaaaagaatgcaaagatgactttgtttcttcacaaggttcttgtcacttacttttaccaatacaagttctcctttgggggtcagaattcagtccaaaatgcgtgttctcttaactgttgctgttgataagacaagagccttttccccaaaattctgaagagcaccattttc

SEQ ID NO: 86490 - DNA, 601 bp, Human
aatgtaaaatcagtgcagttactcaaatgctgcttagtttttcaagggctggcttcctgcttctgttatagtctgtcttggagactttcctcagtatatactttccttcaactttttactttttaatttctaagaccacgggaaagttggaaaaaccgtataacgaacacccatgaaaccttcacctagagtcacaaattgttagcatttgccggtttgctctacttctatcattggtctatttatctatcctgtgtatccatccattattttttagctgaatcattttaaagaaagttgmagacatcatgctccctcacagctacttaaatgtgtatctccaataaataagggcattttcctatataatcacaatgccattctcacacctaagaaaattaacatgaactcggtatgacttatagactatattttctcagttgtctcaaattatttatggccacttttccccttcaatccgggatttagccagtcctgaactaaatcctggattggatttacacattgcaaatttgtttagtcattgcatttggcttttatactcctttagtcttttaaaatctataacacattatctgcc

SEQ ID NO: 86491 - DNA, 601 bp, Human
ttctcacacctaagaaaattaacatgaactcggtatgacttatagactatattttctcagttgtctcaaattatttatggccacttttccccttcaatccgggatttagccagtcctgaactaaatcctggattggatttacacattgcaaatttgtttagtcattgcatttggcttttatactcctttagtcttttaaaatctataacacattatctgccttttttctttatttatttggtttttgtggccttgatttttttttgaagaatctggagcagttatcgtgtagaatatcccrcattttggatttgtccaattgtatagaatagtacacagaggatgtgttattctcaatgctttattcaggaggcacctaatatcaagttgtcctgctattgatgatgtttagttaagattgtgactctctgatcattcattgtaagattatgttttgtaaaattttatttccccatttgtagtgaatgatttgtctgttcagatcatctgaacatcctggccccaacactttcaccgaatggttttagcatccagtgatgatccttgtgtgatttagttattgcagtggggataatttttc

SEQ ID NO: 86492 - DNA, 601 bp, Human
atatgtgtgtgtgtttgcatcatttattattccttaagcaaaatatccaaggcactgctgcgaatgctaaaagtaggagaagtgatttgtgcatggctaattggcacaggagatagaagagagcaagtgcctcagaggaggaactggtacttttattgtgactattgaaaggaaggagagggctgtggattgctgttggagaatgaggagatttttggaagaagtgctgtttgagctgggctctcagggagcatcaatatttgcagacagcagtgttttgagaccatgtgtctgcaacagkcaggtgtagaggcagcagggtgtggttgggagttgaattgggatgccttgttgggtgtatgacatggggatgacaattggagatgaggctgaaaagatagaatacagtaggggagaaagaccttagaggggatgaaccttattctataattaggaggaggccttcagcggcttttgaggagagttgatgatgagaacagagcttagctgtaggagcttttgaggagagttgatgatgagaacagagcttagctgtaggaagaggattctagtggcagagtacagaggatctcagagctcc

SEQ ID NO: 86493 - DNA, 601 bp, Human
ttggactatggcactgagaaggaaaatggtcccaagatggacgtcaggaaatgagatgagaatgagcaagcttatagtatctttccattagttcaggtactggttgacaactgtgtttgaacaccaggttatttctgatagtccttttagaccacactgggaagcccagctattggcccatgtttcctgatttccatggtagattcttttatgttcttatatttctcgacattgccaagtcatacagctttcacattcttgactgcaacccctagtaaataatacattttctcttatgacyctgtacttacatatgtacgtgtagatacatacacacatataattaaaacacaagttttaggagacaacattgacttttaaatgtatgatggggccttttgcaatcttttgcacttttttgggaggggaagaatctagtcttgggcctcccaagtactctcagagtccactaggtcatgacctatggtcaaagaaagctgcccaggaagagtgctttgctattggaggcaaataagtaattagctaatgctttatctggttcctaaaaagatttaaagtggccgttcagtaataacgaact

SEQ ID NO: 86494 - DNA, 601 bp, Human
atccccacaggcttttgtgtgttccttaatctgtttgtcaaagttgagtataaagaggtgtgtgacttcttaggaagtagctaagtagtctatgttaattttataataaaactaactgtaactaaaattttaatggaattttatagatttcagtgtactttttatgtgttgccagtttaacccttttaacaactcagggaagcagatattatcaattttgttttttactttttcacgaggaagcatgttcagaggaggttaaatggcttaaggtcacacatctagtaagtgacaaagttgmaattcagactctaagccccatgctcttcattggacattgcccaaatggcaaataaatatcattctcactattttagataatcattatgcatgctaattaagaaaaacttctctgaaatgattcacatgctataaaggtatagtgtgttctaaaacacgtttctgctagatttagtggtgatgtaacatggggtctttaccacagagacatgaaattatgatactttgaaaaataatctcttagttgcttttcttcactctgtttccagttcttattcatttaaagcttctttattccctc

SEQ ID NO: 86495 - DNA, 601 bp, Human
atgtccctataccttagctggccccctccctgggaatgacagcgggaaggtttccttgacaaccaaaaggggaggtaggttaccatgtgatggtaacatagatacttctaaagtgacctggaaccaaaggaaaagaaggaaaacttaccttattaaaaattgtaggtagatttattttttgatgcattatctatattacagcttttataaagaaggtgagtggtacatgttaagtcactgagtgtatggaatcaggaagtgggcaggaatggctaacccaggcatgcagcaaaagaattcygatttgcatcttggtcccatatgcaacacactgtcaagatgcacactttagacacagatgctggtgtgctgcttgtgtccactcctggggaagaatctggatgtttcccaagccgttccctaagtggacaagacagtgtactgggtcttcctatttccagttgtctgacattaggtaagtatcttcagcactcaggaccttcatttctacatcttaaaaatcatccacggtagcgtctgtatcataacaggcagcacagtgtagtggttaaagcatagactctggatccagagtgcctgg

SEQ ID NO: 86496 - DNA, 601 bp, Human
ctcagtgtcagtagcctcatttcagggtggtgtcttcattttttgtgcgctttgctcactttattctctgatgacttccggtgagctctgcaccacctatagtgccttgcagttctttttcgactctggagagcaacatggctcttcccaactctgggaaacagatttcaaactgagggggttgggtttgtgtcataaacttgaatgcttatcagatagtttcttttgggcagtttcttctgtggggttatatggtgaggtttggataaaattgctgtcctttgcatttaagtagaatctygatcaggctagtcattcagccaataaatgttagttgtctcctgcctgggggaactcttacccttagagagaaccagaataaagaacgaaagagctggactaatgggcaaaggttttctttttagaatgaaatctactgggatgactggtcacagctcagcatattccgagcttccaaatacagtgggtcccagatggagattctggcaaaccagctcacggggctcatggacatgaagattttctacaaggggaagaacactggtaagccagagtctcttcttttgtctctgtagagttg

SEQ ID NO: 86497 - DNA, 601 bp, Human
cctagagtgttggtgcttggtgggtaattacaccctcctcctgcccttggcccctgactgattggtggcgcggcttctgttgcagctgggagagtcctaacatgtgcttaatccctgtttggcatgcttgcaggaagagactctgtgctgggtgctcagatagttgttgcttcctgacagggcctcttgcttgttctctggttgcccagatgacctattgctcattgaccgtacctacctctgctggaatggcactgtgtagttaggtgttgttttaattaacttttcccaccatgaaacyctaaaccccatgaagaaagagatggtcttttttattccccgatagttttaccagtgtctagcactttgtaggtgctcaattcatatttgttgaaagaataagggatgaaaagggaggggaagaattgcagtgggtgcagacagtagctgtcttagagatctactgggtgaggcttcaagaactgctatgaggctttgacctgctagtcctggagtctgagactattcagtggaaagcctttatcatttcatgactgctctttgattttgcttatctcccagccatactattgattctaga

SEQ ID NO: 86498 - DNA, 601 bp, Human
acttcatcccaagaacttgggcacagctgacatgcagtcacacctgtgactgaggagcagtgcgggaggagagagtttgtggtctcagcacatgcaaacgtggtgtcttggtgccagtcagacaggtctgcaatcctcaccttaggtgtagtttccctttcatgcctcaaagagtcatcttcatttaagttagccagagtcattttggggcccagagtgaggtctggatagatgacaggctggtttaaaagggagatatgtattagcagggcatagtggcacatgcctgtagtctcagctmctcaggaggcggaggtgggagcatcacctgagctcgggaggttgaggctgcagttagccaaggtcgtgctgctgcactccatcctgggtgacagagtgagaccctgtcaccgaaaaaaaaaaaaaaaaaaggctgggggagatctgtgttggtgagtagaacacagacctggacctgtgcatgggcggctgtgactctccctttggccatggccagttgtcgcctctctgctcctttctgtttgcctttgggattttctcttgctgtcctttggttgtgagcaggatacttccaggagac

SEQ ID NO: 86499 - DNA, 601 bp, Human
caccatgcctggctaattttttgtattttagtagagattgggtttcaccatgttgcccaggctggtcttgaactcctgagctcaggcaatctgcacgccccggcctcccaaagtgctaggatttacaggtgtgagccactgtgtctggccactagctggtttttaaatggtataactggaatttattctttgtaaagtgtgttttttctttaaagaggttactttacaagattgttgatgtattcagttgctcctgcgatggctcttggagctttggaattcttttgcagttttggaattytcctttagagcctgcagtaagtatgtgcttttaagtatctataatgagggcacatatttattatttgaggtagatttgattttgataattgccaagtgtatagatacttgagatgatgacatttttggctcctaaagtattcctggaggaattttccaaacaggaaatgtgaaaatgttctgaacatgcccagtgaagacatcacggggctatgtgtttgatcttctaagggaatgtctttgaagatgattgtccactcttcacattgagataacggttttcatattgcctggtccactc

SEQ ID NO: 86500 - DNA, 601 bp, Human
aagtgtgttttttctttaaagaggttactttacaagattgttgatgtattcagttgctcctgcgatggctcttggagctttggaattcttttgcagttttggaattctcctttagagcctgcagtaagtatgtgcttttaagtatctataatgagggcacatatttattatttgaggtagatttgattttgataattgccaagtgtatagatacttgagatgatgacatttttggctcctaaagtattcctggaggaattttccaaacaggaaatgtgaaaatgttctgaacatgcccagkgaagacatcacggggctatgtgtttgatcttctaagggaatgtctttgaagatgattgtccactcttcacattgagataacggttttcatattgcctggtccactcaagacaattgtcatcctgtataaagggtctgtggctgtggtagaactgccatcataggagttggtgaattacccttccatcttcttccagcttctctctgatgcagctctcccattttccattctctggcttcagactagcctagacattcctgcccctgcctacctcttaggatcagtgacttggttagcttg

SEQ ID NO: 86501 - DNA, 601 bp, Human
tctttttaaaaaaaaaattattcggaattttgaaggcaatgttcaactatattatagccactagtgttgtaattgagaagtccaaagacattctggttcttttttaaattaaaaaaaaaaattttttttaagggataggatcttgctatattgcccaggctggattcgagctaccaggctcaagtgatcctcctgcctcagcctcctgagtagctggggctacaggtgcgtgctgccatgcctggcctccttaagtctcttttagtctcctgacggtctgcagactgagcttatctgcatwcccagagttttgacttccacacggttttggcttgccatgtgccacttcaacacccatgctctgtgaccctttccctggctccagctccttggttgctttcttgtctttcagtgacccaattacaaattcccaggaggaaccctgctgcctggcttggctctggggcagtctgatctggctgaagacaggatgcaagtcactggttatactgagcagaagttttcagcacagtaggcgccccaaagcttgccacttgacccttgagagcttctcgctgtcctttccgtaagacgaggaggt

SEQ ID NO: 86502 - DNA, 601 bp, Human
agagttttgacttccacacggttttggcttgccatgtgccacttcaacacccatgctctgtgaccctttccctggctccagctccttggttgctttcttgtctttcagtgacccaattacaaattcccaggaggaaccctgctgcctggcttggctctggggcagtctgatctggctgaagacaggatgcaagtcactggttatactgagcagaagttttcagcacagtaggcgccccaaagcttgccacttgacccttgagagcttctcgctgtcctttccgtaagacgaggaggttgcrgtgggtctccttcttgtattcagtacctccctcatggtgtgtattaacctacctgctgctgtttgtcttccctccaggaagcaatgcctgtgtgcccaggccatgcagcctgctgtgcctgcccaaggccaacaacagtagaagctgcaggtgtccagaggatgtgtccagcagtgtgcttccatcaggggacctgatgtgtgactgccctcagggctatcagctcaagaacaatacctgtgtcaaagaaggtacttccctttttcttttttgcctgtcatcctccttcctttgtttcct

SEQ ID NO: 86503 - DNA, 601 bp, Human
acccaaagcaaacttgggcaggccctagcaaagagctctggagagtgtctggggtgaaccaagcagaggtggagggaatcaattcacaggcaagggagcagcatgtggggaagctggcatggccaggaaactggtttgagttatggagaatgggcatgggcacaggggccaaggtgaagttagatgagtgggcagcgcccaggacagcaagggctttgtggactttatcggagaagcagttgggaaccactgatgtcatgtgatgaaagttcatctttggaaggataagtagtgggcagartgcgtttgatggagagagaccagaagcaggaaccaagtcagaggcttctcttttatatattttacctttggcaacccaggggctcatttacccatttgtactgtaagaacagattaatgggaagctctagatactcatttagccagtcatccgtggggcctgtgcccggctcccctgccacttcacccagaaagcaacttgtgaaatatccagctcattaaacacatctgggccctgcaatcctatagactcccccttttggctgatagagggttatttacaaagcctttccttaatcgt

SEQ ID NO: 86504 - DNA, 601 bp, Human
tgggatagaagatgcttcttagaattaacaagttacaaggaaattgcccagacataattaggcacagtggaagcagggagatacaaaccagatgacctcatatccaagagtgagggacacaggtggcagagcattcctccttgtgcccttgggcttggtttctactaaatggacaagctgaatcttgtattggctccgagttttgagaggaatgaagacctgcatcttttgggaggcacctgctgcctccaatggcttcctcccacccagcccctgagctctgttgcagactgcacagttrtgcatgaaggatggagctggccctgccctcctcccagcttggcgtgaatgtcagctgggattcactttccagagaccccgagacctactttctgctccgtcgtctccctgtttcacctggctcaggtctacacatgtcagatggagctgaggcgtggagaggaggaaccagaaggatttaaaactcagagactgggagtcaagagagaggggcttatctgtgcctgcatgtgtgtctccctcatcaaggaggttgcgtgtggaggagagaggttccctgtttctaagcagggctgcagga

SEQ ID NO: 86505 - DNA, 601 bp, Human
ccatgtggggagttaagtgaggcaccctgccagctgccagggagcagtggaggaggggggacaccgggatgcaggagggtgttgtcagtgggtttccctccctcttacacagattcctctagctgggtgactgtcaggcactcagggttttgacgcgaatccctgcagtcttgtcattttgcattcatcccctgcctcccaccacgagctcaattacagagaagaaatggagcctcaaataagagctgccaggatgtctaacggcagcattgctatttggcatttcgtgcacgacaacccytcccccgtgccagcattctgttctgccacattttacctcctgggtcagcctttcactctcctgagagcagcctgccttcccctcgcctttcctggagggtgtttcacggggtgccagggattgtgcttaagcacaggaaatatctacttaggagaggaagaaaaatctaattctgtatccattctaatgccagaaggacatgaggaatgatgaggaagagaagtgacatttgtttagagcccattatatttacatcctatttaataggctctggttccaaacttgttccctggtttatct

SEQ ID NO: 86506 - DNA, 601 bp, Human
tgtcaggcactcagggttttgacgcgaatccctgcagtcttgtcattttgcattcatcccctgcctcccaccacgagctcaattacagagaagaaatggagcctcaaataagagctgccaggatgtctaacggcagcattgctatttggcatttcgtgcacgacaacccttcccccgtgccagcattctgttctgccacattttacctcctgggtcagcctttcactctcctgagagcagcctgccttcccctcgcctttcctggagggtgtttcacggggtgccagggattgtgcttaarcacaggaaatatctacttaggagaggaagaaaaatctaattctgtatccattctaatgccagaaggacatgaggaatgatgaggaagagaagtgacatttgtttagagcccattatatttacatcctatttaataggctctggttccaaacttgttccctggtttatcttcataataatgctaccaagtaaaggcaggttaagtaagttgtaggttgcagactcaattcaaatctagtctttctggctgggcgtggtggctcatgcctgtaatcctagcactttgggaggctgaggcagg

SEQ ID NO: 86507 - DNA, 601 bp, Human
tttccctgttatactacttatttcatccattctactctgctcatgtttggttaatgcttttaatcaggcattccagcaggtcttgatgaatcaggaaagttctgcctgagtcaaagattaagttgtaggatattgacctatattagaaactgatgttagatttccacgattgtttaccacacgaacttcaccattcttatagttacaatgaatcctaccatgcagaggattctttttcttccctaaattcttcagtctggattaaagtccatctcttccatccttgtaattaaaaaaaaaatatgtattaagcatgcagtatttaccgggcactcaaaatcagagctcataagttactaagaagatagaaaaatctagaaaaagataatgcgttatgtattccagccatacctggccacttgaatgcaaactgattactctttctgagctcagcttctgtgatagaatctggagatctcagccatgcctcccagaattgtcatttggaaacttcactagcactctgaaatggttttcaattaaaaatgaaatgcagaggctgaataataactagattagtatggcaattggtttaggcaac

SEQ ID NO: 86508 - DNA, 601 bp, Human
gttaccaaattgggtttccaagggattacatcaaatgtgtctctaccagtaaaacgttgcatgtttccccaagtctccttgatattagatttgtatctttttagttgcttccactaatgtaatatgtgtgtttgcctcatgtagttttgatttatacctcttttaaaatactttttctacctagtgacattaaccatttctccaaatagtggtgcttgtttactgtttctgtttgatatcctttggctaatttcccagaaatgattactttttacaggattaaaacacattttcatacttatacctaatcctcaaggaactattctacacagagctcagtttgcaaaggctatctatgactgcctcattagaagtgattttcttttttttttttgagatagggtctcactctgtcacccaggctggagtatagtagtatgattgtggctcactgcagctttgacctcctgggcgcaaggcatcttcctacttcagcctcctgagtagctgggaccacaggggttggccaccacgcccagctaatttttgtatttttttgtagagatgaggttttcgccatgtggctcaggctggtctcaaa

SEQ ID NO: 86509 - DNA, 601 bp, Human [sequence omitted]

SEQ ID NO: 86510 - DNA, 601 bp, Human
agaaattctgattctatgttttttataaaacattataaaaatgatgtttttactagggtggtctttttgccatattgagtttcctcttgttctcctgtctagaagatcaatttttgacaatttctattttccaggccctctgtgagctgattcctccttgcctccctggattccttacatcagccaagctagattcctgatcttcttcagatagacttgcttctttcctgcctgtgcacctgcagcaaggttttgccctcagcaggaactcctgtaccctcaaccttgtcttcctactttycttatcactgaaacccaccatccatcagtgcaaacagaagcatggattttatagcaaaagagaccttgatatattcatatcatcagaacttctcaaaatgtgatgcaaagaccaccctaatggaatcgcctggggtgtttataaaaaaatgtagaatcagaatttctgggtggagcccaggagatccccatatgattcttaggttcacaaaagtttgggatttctgctttgaacaagtagggtattattctcctttcaagctccacctctgtggcgctttcactgattcctttaaatgat

SEQ ID NO: 86511 - DNA, 601 bp, Human
caaattctgactaatccagtgagcagatctctgtttatatatcctgttcagcttttgtactttcttttttgtgcgcagtgctgggacaaatttaaactcattgttatctgtagctcgtggatcttctttgtttagtgtagaagtcttctaactggcttattaacctcatatttctccccctttcagtttttcttctgataaggcccatactgatgaatgctcatgtcctccccagtattggagccctctgatgcctcccttattgtccagggcatgatttgccttggcctggcattctccscctttttattttttatcacctgtctccatgtaccttgtgtttctgcagagtggttctgagatatagggaaagcccctttgaaaatccaatgaaaactatagaatatgcacaatatcctgaagttaataattgcttttttcatttgtttgcttaggttgttttgtaccatttgccaatgctttctgcctttcagtcgccactcaggataactttccacaggtcaacatgtccagggatttatcaagtccagtttttctcttggagatactccttctaacaacgtggattctcctttcggga

SEQ ID NO: 86512 - DNA, 601 bp, Human
atttaaactcattgttatctgtagctcgtggatcttctttgtttagtgtagaagtcttctaactggcttattaacctcatatttctccccctttcagtttttcttctgataaggcccatactgatgaatgctcatgtcctccccagtattggagccctctgatgcctcccttattgtccagggcatgatttgccttggcctggcattctccgcctttttattttttatcacctgtctccatgtaccttgtgtttctgcagagtggttctgagatatagggaaagcccctttgaaaatccartgaaaactatagaatatgcacaatatcctgaagttaataattgcttttttcatttgtttgcttaggttgttttgtaccatttgccaatgctttctgcctttcagtcgccactcaggataactttccacaggtcaacatgtccagggatttatcaagtccagtttttctcttggagatactccttctaacaacgtggattctcctttcgggacagattgttctctagtcctgctgtgtgcctgttacccagggactttcactgcctccttggaattctctttgcctttctcccagtttaga

SEQ ID NO: 86513 - DNA, 601 bp, Human
tctgataaggcccatactgatgaatgctcatgtcctccccagtattggagccctctgatgcctcccttattgtccagggcatgatttgccttggcctggcattctccgcctttttattttttatcacctgtctccatgtaccttgtgtttctgcagagtggttctgagatatagggaaagcccctttgaaaatccaatgaaaactatagaatatgcacaatatcctgaagttaataattgcttttttcatttgtttgcttaggttgttttgtaccatttgccaatgctttctgcctttcartcgccactcaggataactttccacaggtcaacatgtccagggatttatcaagtccagtttttctcttggagatactccttctaacaacgtggattctcctttcgggacagattgttctctagtcctgctgtgtgcctgttacccagggactttcactgcctccttggaattctctttgcctttctcccagtttagattccttgtttcctggatcttgtgtgttgctttttcttggtttactcccttgtttgggtggagtgcatccttcagtagccttgtcaggtgaatatgatgacgcag

SEQ ID NO: 86514 - DNA, 601 bp, Human
ggaggcctgtgtgaggtcttgcttgtcttaaagtgttttaattctgtcttcagacttaattgatagttgggctgggtttggcgtgctagattgtaagtaattttccttcagagttttgaaggttttgttccactgccttcaagcagcttttcggaaatccaaaagccattttgattctgattttttttttttgtatgtaacctgtttttaatcctctagaagcttgtagaatcttccctttggcaccagtgttttaaaatttcacaatgatgtgctttgctctgagaccctttccatccarcatagcggacacttgcatgctttttgatatggaagtttatatattttagttcaaggaatttttcttgaagtttttattaatgatatttccctctctgttttctcttatttcctggaactcttgtcattcatatattgtctcctgatctggtcttcttccttatttttttgtttaatcttttatagttttgaaaattcccttcccccacccccccaattttctaggagatttactcaactttatatttcaactctttgctgagtttttcatctttgttgtcatggttttaactttaagagc

SEQ ID NO: 86515 - DNA, 601 bp, Human
ttagagatggaatagaatctgaggtggaggttagtcatctcttaattcctctaattcagtatttacaaaatttatgggacttagcaggatcatgtggaagtgcttataagagatgtgaatttggtgatctcacctcagaccactgaatcaagagcaatggtggaggagatgctcgggaacccaagccttttcagaggtgccctgtctgattcttagcatcagacaagattggcaaatactgctctgtcctaaatagttcacccagtaaggctcagggggaaagggaagagggagtcggccrtcccttctctgtctgtagcgttgttctccacagggtgcccgactgggctctccctggagaggcttggttaagaggaaggagtgtggatccagtaacatcttcagtttggttggacaaatttttgttgatcatgcacagcgtggcaggcattgatcaggtttctggcaatacaaattctttgtgttttttttctggcaggcattgatcaggtttctggcaatacaaattctttgtgtgtttgtttgttttttttttttttcttttgagatgtcatctcgctctgttgcccaggctggagtg

SEQ ID NO: 86516 - DNA, 601 bp, Human
tgcccgactgggctctccctggagaggcttggttaagaggaaggagtgtggatccagtaacatcttcagtttggttggacaaatttttgttgatcatgcacagcgtggcaggcattgatcaggtttctggcaatacaaattctttgtgttttttttctggcaggcattgatcaggtttctggcaatacaaattctttgtgtgtttgtttgttttttttttttttcttttgagatgtcatctcgctctgttgcccaggctggagtgcaggggcgggtgggatctcagctcactgcagcttcygcctttcgagctcaagtgattctcttgcctcagcctcccgagtagctgggacgacaggcatgcggcaccatgcctggctaattttatgttttcagtacagacaggttttgccatgttggccaggctggtctcgaactcctgacctcaagtgatctgcccaccttggcctcccaaagtgctgggattacaggcctgagccaccacgcccggtgactggcaatacagattctagtgggagggacatcaagtcagcagctatcctacagtgtggtgtaggcagtagcagaagttatccaagga

SEQ ID NO: 86517 - DNA, 601 bp, Human
ctttgagtctttccaattcttcaatttccaaggtagggtgatttctttttgttttgtttatttatttgtttgtttattttagtttaggaaaatcataaggaatctttcattactaaactattcctgttggaactcagatccattttggggttggatttctctctgtccagaacatgccacttgttatctggaacccaagaaccaaaaagattaagataatttgatatctcttgatacttgtgtataaatccatataaataaataaatgaatctatataaataaaccaaataggccaggcgyggtggctcacacctgtaatcccagcactttgggaggccaaggcgggtggatcacctgaggtcgggagtttgagaccagcctgaccaatatggagaaaccccatctctactaaaaatgtaaaattagctgggcatggcggcgcatgcctgtaatcctagctatttgggaggctgaggcaggagaattgcttgaacccgggaggcggaggttgcagtgagctgagatcgggccattgcactccagcctgggcaacaagagcgaaactgtcaaataaataaaaaaataaaccaaataaattca

SEQ ID NO: 86518 - DNA, 601 bp, Human
taggccaggcgcggtggctcacacctgtaatcccagcactttgggaggccaaggcgggtggatcacctgaggtcgggagtttgagaccagcctgaccaatatggagaaaccccatctctactaaaaatgtaaaattagctgggcatggcggcgcatgcctgtaatcctagctatttgggaggctgaggcaggagaattgcttgaacccgggaggcggaggttgcagtgagctgagatcgggccattgcactccagcctgggcaacaagagcgaaactgtcaaataaataaaaaaataaacmaaataaattcagatggtgggggatattttaatctccttggttaacatttccatattacatctctttctcatttctttgtcatgtctttcagttgtaaggttgagctttgtcatttactttcaaagttaatgcaagtttgcacaaataagtgtttggatttgctgatggagtttgtcttcaatataattaattctcctgctgtgtacttttttttttttgaagttcttcggtgtttagcaggatgcggcagcctttgataaaccttaaaagattcttatttctctttctgtcgccttatgc

SEQ ID NO: 86519 - DNA, 601 bp, Human
tccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttccagttccagatccctgaggaatcgccacactgacttccacaatggttgaactagtttacagtcccaccaacagtgtaaaagtgttcctatttctccacctcctctccagcacctgttgtttcctgactttttaatgatttktttttttttttttttttaagaaacagggtctggttatgttacccaggctggtctcagactcctggactcaagcaatccagcctcagcctcccaagtagctgggattacaggtgcacactaccgcacccagcttacttccagagtctaaagcccatgcttttttgctcttaaaattttgagacatactttataaagaaacctccaacgtcctcagctctactgcttagctgttgtttgattatatttgaccacattgttacccagtagaatacttctgtgatgggggttttggtatttttc

SEQ ID NO: 86520 - DNA, 601 bp, Human
ggacatttgggttggttccaagtctttgctattgtgaataatgccgcaataaacatacgtgtgcatgtgtctttatagcagcatgatttatagtcctttgggtatatacccagtaatgggatggctgggtcaaatggtatttccagttccagatccctgaggaatcgccacactgacttccacaatggttgaactagtttacagtcccaccaacagtgtaaaagtgttcctatttctccacctcctctccagcacctgttgtttcctgactttttaatgatttgtttttttttttttttttaagaaacagggtctggttatgttacccaggctggtctcagactcctggactcaagcaatccagcctcagcctcccaagtagctgggattacaggtgcacactaccgcacccagcttacttccagagtctaaagcccatgcttttttgctcttaaaattttgagacatactttataaagaaacctccaacgtcctcagctctactgcttagctgttgtttgattatatttgaccacattgttacccagtagaatacttctgtgatgggggttttggtatttttcaaaataatcccctctgg

SEQ ID NO: 86521 - DNA, 601 bp, Human
ctttttaatgatttgtttttttttttttttttaagaaacagggtctggttatgttacccaggctggtctcagactcctggactcaagcaatccagcctcagcctcccaagtagctgggattacaggtgcacactaccgcacccagcttacttccagagtctaaagcccatgcttttttgctcttaaaattttgagacatactttataaagaaacctccaacgtcctcagctctactgcttagctgttgtttgattatatttgaccacattgttacccagtagaatacttctgtgatggggrttttggtatttttcaaaataatcccctctgggcatagtctctccctggcaatcctatataaaatggcataacctgatcagattaatgtacttgtttgcagtttctctcaatagaagataactccctgaggacaggtccttcatctgttttacatatccccatatttttaacatctggagcagtgcccgagtcatggtaggacctccatgaatgttcacagaattccatcttgggcttctgagactattacagtagtggttctcaaacctttctctaattcttgaatacacgtttatttgt

SEQ ID NO: 86522 - DNA, 601 bp, Human
agataactccctgaggacaggtccttcatctgttttacatatccccatatttttaacatctggagcagtgcccgagtcatggtaggacctccatgaatgttcacagaattccatcttgggcttctgagactattacagtagtggttctcaaacctttctctaattcttgaatacacgtttatttgtcatgagcttccccccaccatggcaaaccaatttcagctcagtatataatagaattctgaaatgcaatgatcttcctggagaatgggggattatagtttgtgaaaagcctcataartggttttgatagttcccttctattgacaattttttatcaggattgtttttgaataagtagtgaactgaagtctgtacctccatcctagagactcgtgcaaagaagtcttaattcttctttctcatgaaaactcatcagtggagaacacttgtcagagtggtctgcatgtcttctcaccacctcccccatccttgtatcttttcacctctaggaaaatatccctggatcctttatccattcctcttgaccatcctggttgctctcatgggaacattatccagtttctctacctatatctca

SEQ ID NO: 86523 - DNA, 601 bp, Human
caaagaagtcttaattcttctttctcatgaaaactcatcagtggagaacacttgtcagagtggtctgcatgtcttctcaccacctcccccatccttgtatcttttcacctctaggaaaatatccctggatcctttatccattcctcttgaccatcctggttgctctcatgggaacattatccagtttctctacctatatctcaaagtgtggttgtttatgttaggaggaaggagaagagggagggggtcgaggtcaagaggtgacccatgaccacatgcctgggtctgaagtggggcgtaygaagcttccttgctcaggtcacaatgctcatatcacctttaacataactttgttacttgtgtgtacactctctttatttcctcagggcttagtttcaggaagggactattatcatccttgctttaaaattaaactataaacaaaattccttccatagttagcttggcctacgtgcagagataggcagaggccgttaacctacaagatgtcaccatgggcagggggcagggtgcggggagcagaatggagccactcatgttcagcctccttttgtctgttataatttccccattttcaaag

SEQ ID NO: 86524 - DNA, 601 bp, Human
catcagagactgttcttgtaccttaagttaatttaagattctctccaccattgccctcttgcattttttgtctagtttctacctctacgttcctcctctagatatttcctagtacttggtacttaggaggaggtcatcgtcattaaaatatgaggcatatcagcaattttgtggctaagtttttttctttttggagacaaggtctcactctgacacccacactggagtgcagtggaggcgcaatcactgctcaccacctcagtcttcccaggctcaggtggtcctcccgcctcagcctctygcatagctgagactataggtgtgtgccaccatgctcagctagctttttgtatttttgtacagaaagggttttgccgtgttacctaggctggtcttgagctactgagctcaagcaatccacctacttcagcctcccaaaatgttgggattacaggtgtgagccactgcacctggctttgtggctaagtttttaagaaatttaccaaatttatgtgtctaagagagttcctcgcctcctccctacttcaaagtagttgacatgagcaactgtctgcttgaatgtcatcttttttcattgcct

SEQ ID NO: 86525 - DNA, 601 bp, Human
tcttagaactgagcgaaattgctgctgttttgtgagaactctctactcacctttgtgagatgcatattagtaatctgcaaaatacccaacttcttgccctgggacgggggagctcagagtttctttcagtctcttaaatggacaccacaaagagcttgacatcagagtttctgtagataaccgggcgtttatgggaatgccgctttccctgcttttaactccggtattctgctagctttccagctcctatacttttgcagtcagctctttcctgcttatctttagctgcaggatgatgcagagctatgataagtagtctttctaaactgattttatgaggttcttatgaaatatatttttagtatttttagcagaaagagatagattttgtgaacaacatgtttgctgagaccattaagtgtacacattcatgactctcacactgataattttgtcagtaccctttttgtatatgtgtgtatttatgaacacacccccccatacacctgccctttagaagaaccttgatatttgtggatcaatagaaattttctgatctcaggactgtcataatgccctttacccaagctccttcccttgg

SEQ ID NO: 86526 - DNA, 601 bp, Human
tcgggagttcgagaccagcctggccaacatggtgaaaccccgtctctactaaaaatacaaaaattagccaggtgtggtggtgcatgcctgtaatcccagctacttggaggctggggcaggagaatcgcttgaacctgggacgcagaggctacagtgagtcaagatcatgccactgcagtccagcctgggcaacagagtgagactctgtctcaaaaaaaagaaaaaaagaaaagaaagaaaaaagaagtgggcttatatgcttcttgtcttgtagtctttgatcttgaaaatatttttgttmgttgtcccatatttaacgatcttcagatcaaatctttttatgagctcaggacttggaaaaggtagtctttcctgatgggtggatgtattttctgtagttagacaatgagatctaaccagcctgttttgtatggattgtcttcttggccttgactgcaaggatttatccttaatttccatggcctaattatctttccagtgtttcctctttctacctttattaattggttctcgtccttttattcttcattcacttttttgtttcattgaatctataaattaaatatggtctcgtttgttt

SEQ ID NO: 86527 - DNA, 601 bp, Human
ttatccttaatttccatggcctaattatctttccagtgtttcctctttctacctttattaattggttctcgtccttttattcttcattcacttttttgtttcattgaatctataaattaaatatggtctcgtttgtttttagaagtaggtggagtacaactaaatattagctaatggtagcacaagtagaacctgtttaaaatttttaaaaaacaacctgttcactgtaagaatgagatacccaaggaaagaacaggaaagaggtgtatttttaatcctgccttttgtatttagtgtgccycatgactagctgttcatctaacatgcttcttggttctcggcaggtgaatggctatgtggtgaaccttttctgggcatttgacacccacaagcaagagaggagaactttgaacttccgaggaagcatattgtcacacaaaggtaacactttggtgctggtcagtgtgtgtgcaggaaggggtaaggctggaccaatgctttcccgctgtagagcttgactgggggtgccagggaaggggaggtattctctggaagctgttctgtgttgacaggttcttgtgcattgaggatcctataagtg

SEQ ID NO: 86528 - DNA, 601 bp, Human
agcttgactgggggtgccagggaaggggaggtattctctggaagctgttctgtgttgacaggttcttgtgcattgaggatcctataagtgtgctgctgattctaggcagagggattcactcagtggcccctcgagccctcctccaacctcatgacccttagtggaagttgggggccataaggaggaaaattggacagaggcaagactaattctctgcagatgagttttgatttccaaaagaaagagttcttagatatagacagttacctgtctgtcctttctagtctggttcactctcccrttgctaatgagagacagcagaaggccttatgcataactggtgttcagtaaatacatgttgactggagaaatggacaacaaactaagggaggagtggtccagtccctgttacgtatgtaccagcagcaagtctcagctaaaattcctctatctaagcacgtgctaaaggatggattttaatttatttctaagtggcgaaagctgcctgtaactgttgagaatgacttgggagcttcttcctgtctcctccttctaggctgtgaagcactttcagtcatgtttttattgagtccttgtcata

SEQ ID NO: 86529 - DNA, 601 bp, Human
taataaggaattagtaaatccttagtgatgagcggaggaactagcctaggtctggtcttctgaggatatcttcagcgtgcatttgtcacagggctgagtcatagggaaataaccaaagtttgcaagtagctgtctgtaaaatcagtgaagaagaaggaagaagtaagatttactgagcagccagtaagtgccaggaacaatataaaatccgataaacccatgttcccccttattcctttcattggttctgtgggtaaatattcccattttgccagcaaggaaactaaggctcagtgaggcraagtaacttgccagagttaaagctctcacaagcagtagactgagtttcagctcaggtctggctaatttaacagcctctgctcttttgtgtgtcccagcacctgacgctgaggcagggacagtgatgagaagccctgacctatccccggagctctcttttacctggaagttgagtctactcgtaaagaaccctttctttccatttatatacctggcagcacatgaccgcctcatcacccccaactatctctccagagtagggcaattgcacagaacactgaagcctgacttgatttagggt

SEQ ID NO: 86530 - DNA, 601 bp, Human
gaagctctctgcttctgcccctctttagttcattgaggaccctggcagctctcatgattttcctgtctactgtgagaagtgccattgtcactgtgcatgtggggaacctctcatcccttggctcccgtggctctgtggacccctttcctctccagagacaccccatccctggcggtcaccagccttgtcctcggtgatgtcatcctccctctgtactctaagccccgacttggcctactcccatctcatgctttgcagctccacctgcatttgctttgggacccctttgagtccctcagcrcttctctttcctacatcctcccaggcgatcacccccttcggggcttcccttcctgtttctctgtctgtgttctcccatctgtctgtcctttctcatctgtcaacaaaaagagtcaaactctgtaaaatatatgaaaagatttattctgagccaaataggagtgaccatggcccgtgacacagccctcaggaggtcctgagaacatgtgcccaaggtggccgggatgcagcttggttttatacattttagggaggcatgagacatccatcaaatacatttaggaaatacactggtttggtc

SEQ ID NO: 86531 - DNA, 601 bp, Human
agttcattgaggaccctggcagctctcatgattttcctgtctactgtgagaagtgccattgtcactgtgcatgtggggaacctctcatcccttggctcccgtggctctgtggacccctttcctctccagagacaccccatccctggcggtcaccagccttgtcctcggtgatgtcatcctccctctgtactctaagccccgacttggcctactcccatctcatgctttgcagctccacctgcatttgctttgggacccctttgagtccctcagcgcttctctttcctacatcctcccaggygatcacccccttcggggcttcccttcctgtttctctgtctgtgttctcccatctgtctgtcctttctcatctgtcaacaaaaagagtcaaactctgtaaaatatatgaaaagatttattctgagccaaataggagtgaccatggcccgtgacacagccctcaggaggtcctgagaacatgtgcccaaggtggccgggatgcagcttggttttatacattttagggaggcatgagacatccatcaaatacatttaggaaatacactggtttggtccagaaaggcaggacaactcaaagtgg

SEQ ID NO: 86532 - DNA, 601 bp, Human
gaccactttcatgcaatgatcagcagagttgttgtggtggagactatctggccctcaacacctacagtattactgtgtgtggacccttacaaaaagtttctgacccctctttaaaaggagcattgatcctaaacaaaacaaaaaaactgccattttttccttgctctgggttgctcttccctctctcctctctccactccccttcatccagcggtggttggtttaaaatgcttggttgctaatactcctctcaactctccacttccttgtcatgattgaatttcctgtgcttactatatgmcctgttattttccccttgcccccctatacccagaagcagcctgggagaaagtaagtagagccttgccctttagagccaggattgaacactttggttcattctctctccaccaacaacatccatgaactattgcagtggtggagatgtggaagttgagtactgagtttggatgtgcttgcttgttccaacctacctgctgatgtcacgataaatgtggccctccctagagggttaaaaaaattttagttgataactctatgtgcaattctatgagtgaatagttattttaagattggatct

SEQ ID NO: 86533 - DNA, 601 bp, Human
atcagcagagttgttgtggtggagactatctggccctcaacacctacagtattactgtgtgtggacccttacaaaaagtttctgacccctctttaaaaggagcattgatcctaaacaaaacaaaaaaactgccattttttccttgctctgggttgctcttccctctctcctctctccactccccttcatccagcggtggttggtttaaaatgcttggttgctaatactcctctcaactctccacttccttgtcatgattgaatttcctgtgcttactatatgccctgttattttccccttscccccctatacccagaagcagcctgggagaaagtaagtagagccttgccctttagagccaggattgaacactttggttcattctctctccaccaacaacatccatgaactattgcagtggtggagatgtggaagttgagtactgagtttggatgtgcttgcttgttccaacctacctgctgatgtcacgataaatgtggccctccctagagggttaaaaaaattttagttgataactctatgtgcaattctatgagtgaatagttattttaagattggatctggtcactccaaaggcctt

SEQ ID NO: 86534 - DNA, 601 bp, Human
ttgctaatactcctctcaactctccacttccttgtcatgattgaatttcctgtgcttactatatgccctgttattttccccttgcccccctatacccagaagcagcctgggagaaagtaagtagagccttgccctttagagccaggattgaacactttggttcattctctctccaccaacaacatccatgaactattgcagtggtggagatgtggaagttgagtactgagtttggatgtgcttgcttgttccaacctacctgctgatgtcacgataaatgtggccctccctagagggttaraaaaattttagttgataactctatgtgcaattctatgagtgaatagttattttaagattggatctggtcactccaaaggccttccaaagaatggagtcagatttcgggactcaaactcttgttgctgtgggtcccagctattaatatactacattgtccaccattgaactacaaagagtgaaaaatgtcaactttctgattatcattcacttgttcttttttggtcctagttgtatgcaattgcagtcaaagatctcataagaaagactgacaggagctacaaagtaaaatcccgtaaca

SEQ ID NO: 86535 - DNA, 601 bp, Human
aagaatatctaccatgtgctaggttctgtactcagcaatctatgtgttttattttttctgtaacccagccctccaaggctagcattatttaatctctctttgatagacaagaaaatagagtttcaaatgtatatccactaaccgcatcccatctcatctttaattttcagtttcattatcagcacctgatgccttaaaaatcataacagaaaatgatcatgttcttctgttttggaaaagcctggctttaaaggaaaagcattttaatgaaagcagggtaagttcctccctcattctcaakgactttggaaatttaattgaaatgctgtttcagagatgagcttgttgacagcatgctggcatagatagtgtaaaaaaaaaagaaagaaaaagaataggacatggacatgaacttgagaattaaaggaccattttcagtgggattgctaattagcgaaatgcttatactgcccgttaaagatgagaatctctgcactaagcacttttcaatcctgacttgtcttcccctgaagaaagacaaatgggctggaggccatgctgtgcttcccgcagaagctgcagctgggctggggctcagggt

SEQ ID NO: 86536 - DNA, 601 bp, Human
aattggaaaattctcaccacacactctgtgagaattctcataactcttgtaactatgacatctaaatggctaatatccttaaatagaaggaaagctttcaagtaagttcaaaatggaaatattctaattttgaagaagggacatgtaacaaagcggaaaattccagcagcagtaagcaaaaggagaaaagttcaacctcaccggtaatctaaataacaaagaggtaaccctctcatgttaaattggtaaagatttgcagggaagagtataactggtatgaatagtagttggggaagtaaaygttctgggaatatgaattggttcaaactcaagtaaggttcttgggtaatacctatcaaaaacgttgaaagtgttcacacccattgatccagcagttgtaggattttactctaaagcagcaacgtgcatgaagaatttgtgtgtagtatttatgacagcaagaaagaggaaacagccgagatgccgaacagaagaggatgggttaaataacgtatgggtggttgatgttgtgtaatctcaattattttctttataacctttgtgtattttacaaatgatcgacaccagatatctattaggt

SEQ ID NO: 86537 - DNA, 601 bp, Human
cgggtccctcccacagcacaggagaattataggagctagaattcaagatgagatttgggtggggacacagccaaaccacatcaagaatagatgggtcagtggtattgggatcaagagactgtgattatgcaagggggcccaatatgtggctagagaaaagtgatggagtcttttcagggggatggtggagagtgtcagtagctttgacactggaatagttggggatcagcagagaagtcaggttgtcagccctcatcccagctagtatcctgggccagggctgtccccaggatggcttttyccagcaccagagtccagggctgtaactaggaagacatttcatcctctcctccagtgaacaggggcctgagctggcttcagtgcttctgatttcaaggccaggttgttggggggctgagatcggctcagaaggagctagagagcagggagacaggaagtgagccgacaaggtcattcctacatattgttctggggacaaatgtcttgtcttttctaattgcaagttctcctttctcaccccattgctggagtccactgcgacctggatttattattagtcaaattccattatggcaaactg

SEQ ID NO: 86538 - DNA, 601 bp, Human
ctgagatcggctcagaaggagctagagagcagggagacaggaagtgagccgacaaggtcattcctacatattgttctggggacaaatgtcttgtcttttctaattgcaagttctcctttctcaccccattgctggagtccactgcgacctggatttattattagtcaaattccattatggcaaactgttcagattcttggtggcatttaatattgcttgagacaggcagactgctgagcaaatctctgagtgtggctttggtaaaatgactttcctgagggccacagttttcatttccacratatagcttgttgtgggggggtggtgtggcagttatttgagatattggagatgagaaaaattttcattttctgaatccagtatctcagtggtaatgtaaaaagaacaaggagaaacccagggcgctttcgcgtctgtagcagcccacagtgaggagctcacataaagatggaaccagtaatagaggctgtcagtttccatattcgacttcctgagcaatctcttgtgtttgttttcagggctatgagatacacatgtttgatagtgccatgaatatcacagcttaccttgggaatactac

SEQ ID NO: 86539 - DNA, 601 bp, Human
agtgctcaagccaaaatcttgtgttagagttgttaaatgttccgtctcatagtgtttctcagggtgagatcttgtgcaatatttatccttggcaccccccactaagagagggaaacactgcctgccacttcccttgggagaatcttaacatattagaggttctaagaaggtcctacaaaaaccagcccaactcttgttgacctagtatttcctcaacagagccccatttttaggcaaaactaattggcaacctgtgaaatatgctttgggaaaaattcctgtgcagacccctcccggccayctttatggaaccaaggttgtcaggcagaagggctcttggccaacatcttgccccttcacgttcaccttccccttggaagtggggtgggggagggagggcactccttcctggagctcccagccttcattgtgccgacttcctcttcactgctccagccgcacacacccccttcattaaccactgcacagttggaataggttggaacatattaaataagatgttgctagagtttttttttttttctggcaaggaaataatgaaagaaatgtaaatacagacacgaatattgaattgttagat

SEQ ID NO: 86540 - DNA, 601 bp, Human
tctattagtgaatcatcacagagcctgtttgtttaagtcaataggaaggggccatgtttgttaggttataaatgccgaaacggctttgcaaataactttaaaaaatgttaaatgtatatggaaagttgtttttctccctcactctctttttcacttaagtgaaaaacctcataaaacttcatgagctgttaagtctgtattgtggtgtaggaatctcgtttgtatcacttaatggagcttcaggtaattgcagttcagagtgactttggtgccaagtagggggaaataattgcaatctcgytaattagtggtctgatttcacatcctcttatgtaaggcaagcaagtggtcttaagtaataatgctaatgaaatcaatgttgataccccaacaaaggtctcccttccaagagattatctaaataaccaacaaggcagtgattaggagtctaatgtaattaccatatttgcatgcacaaggcccttggtctatcagctcatggcaagtagtggggaagcaatcaggcatcacgcacatgcagaaacgtctcacaccagacaggcagtttgtgtagctgtggctatcgcccagctttttttgg

SEQ ID NO: 86541 - DNA, 601 bp, Human
gggggatgatttcaggatgagactgttccacctcagatcagcaggcattagattctcatagggagcgctcagtctggatcccttgcacgctcagttcacgatagggtttgtgctcctgtgagaatctaatgctgccctgatctgacaggaggcgaggctcaggctgtaatgctctgactcaccactcacagcctgctgtgcggccccccattcctaacaggccatgtactggtactgatggccctcggcccgggcattggggatccctgtcttaacacatagcaagggaaaaagtaagaartttcccgttttgaaatctttgcacaatgaaaaccctaaatgctaatagagatagtaagatagtaatataataaagtgggtgtgttacgaggcttccccaaacttagactaatcactgtgaatgtacaagtttatttctttccgttaactagttacaattatatatctatgtttataaagacatttgtatattccccttcactgatcatatgatgttagctctgttccctttccttgtcagtttcctttcttgcctaataagccggcacctggactgccttgtgtgaatggggcggcttct

SEQ ID NO: 86542 - DNA, 601 bp, Human
ttaacaacagcaggagcactagagtttgttcatttattctctctgtaaaacaagctgtgctttttttcttctgcctttaaaatgccacccgtgtattcaaaccatggccacttgatacttatgtagaatccatcgtgggctgatgcaagccctttatttaggcttagtgttgtgggcaccaatgtcgagcatcgttgtgacttgtgctgtatgattctcactgaagaatttcctttcagccaagaagcagtgaggtctgggaatattccaaagtcatgtctctgaatatgtgtccttgacrtgcaagctttgtaaaaccccatccccgcttaggtgcgaggcatcaccttctcacaagtgtttagtttcttttaaccacaagtatcattcttgggtgataatatagtttcattctacttagggattgtttagaaaacaaagaaagagccaattaaattttttagtttttgaaatttttatttatatgtatacttagatgagtattttaagctgtcgacctttagtttgccatacgggtaggactgtatttcatgttaacaactggtggtaatgataagccttcttctagcgtattttctct

SEQ ID NO: 86543 - DNA, 601 bp, Human
ccatccccgcttaggtgcgaggcatcaccttctcacaagtgtttagtttcttttaaccacaagtatcattcttgggtgataatatagtttcattctacttagggattgtttagaaaacaaagaaagagccaattaaattttttagtttttgaaatttttatttatatgtatacttagatgagtattttaagctgtcgacctttagtttgccatacgggtaggactgtatttcatgttaacaactggtggtaatgataagccttcttctagcgtattttctcttctttcctgtcactttcctaagtttttttttttaaagactggaattttttttggctttatcttgtcttaccgtagagatttgttcaaaactctaagccctaccacctcccctttaataagctctttaaatagttgaatcattaacaacctggtgggaggcaagtcatttaattgaaccactaggaagtgtattttcttttctttttctgccaactttttggtggcatttgtaaaagctgatataaaaggctctgagatgttattttcagttattccataggcaagcctttttacagagcatatgtctccagttggcagc

SEQ ID NO: 86544 - DNA, 601 bp, Human
acagagcctatacaaggaaagtcgttaaatgctatttattattattagaaatagatattaggggccgggtgcagtggctcacacctgtaatcccagcactgtgggaggccaaggcaggtggatcacttgaggtcaggagttcaagaccagcctggccaacattgtgaaaccctgtctctactaaaaatacaaaaattagctggcggtagtggtgcaagtctgtaatcccagctatttgagaggctgaggcaggagaatcacttgagcctgggaggtggaggttgcggttaggcgagattgygccattgcactccagcctgggtgacagagtgagaccctgtctcaaaaaaaaaaaaaaaaaaaaaaaagaaaagaaaagaaagaaaagagaaaaaaaaaaaacaactaaatggttttaagtcaaagattgtatttcttactggaagattgctcctttagtgtaagaactgtctggtgaattccccactgcagtattttttgacatattgtttctgccttggataactttcatttgtacaatagtctccaatgatgaataataatgcatttttaagtaagataagctgtggttaagtgcaat

SEQ ID NO: 86545 - DNA, 601 bp, Human
tctttggaaaaatccgttagaaagcatttcactttcactgtctatccattggccctagttctgtacttttaatcactcttccccaagacagcccttcaagtgtttgatgacagtcaccatgagtctctgaacctttacttcactagattcagcctctttagcttcttttactcattcttcatttgtattagcgaaatacttttaccattctggtcactctcttgaatctgctttaattaaagagtttgaattagtcctcaaaaatggagttaggggagagaagatatagggcacataaaartgtgttgacttgaacaacatattttggggggggacaagggaggggtgacagttaagtaggaatcaaaggagaaggggaggaaaatgaattatatctaaggataaagctattaaagctctgtttttacagagaggcacacagccaagaaggggtcaaaaaacctccaggctaagttgcccaaagctatgaaaccttccatttctagaaaaataaatgaagaatgaagaaaattatttgaaattttttccagtaatatttgatttcctaaacatgaaaaaaatgtggtcaatgttagagtat

SEQ ID NO: 86546 - DNA, 601 bp, Human
tgcaacctccacctcctgagttcaagcaattctgttgaaggccttttgatcctagtttttgctaatcagttttaatatggaagtatgtcatgtaacattgtttggcctcttagccattttggtcacacagttttcttctctatgaatgagaataaccaagtagcatcattgttagaaaagaaaaggaccattgtctgctgatgattaacttttttctcaattaataaatgacaagagggtgatcctggacaaaaccaatgtcgagggccaagaataataaactctttagtctttaatcatkcctgttgatcattcatgtgggccaaagctcttaaatatttaattatacatggttatagtcactggaagtccttttttgctttattgagttttacacttgttttcttaactaaatgttcaattcttgatacagatctttaactagtatttctctcttacatgcttcaaagtaccaaacccacttagtaaatgtgatgaatgggctgattaagtgtattctgagtgatctaaactttgtctatagcaggatttctcaatcttgtcactactgacattttgggcttgataattctttgtcgtt

SEQ ID NO: 86547 - DNA, 601 bp, Human
acataccacctatgaatacttcttaattcacagagagaaaaaccagcttaacacccttcttgcctagttgaaagagaaaaaaagcacattccaagggtaggctctagcatgctgtgaagagaatgttacactttttcttctagcctttcattttatttttcactttgaatagttcattaacacataacaatgaagttccaaggacctgtgggaccttagtctaactgggctctaatgatgggtcctagccaacaaccatatttgcattttgattggcagtaagtagaagttaatttggtgyttcgtctaaaaacctctttccaaatggcaaaatatactactttggaggtaatcttttgcccaaatgtttggtcatacagattaagccgctccattcagggatcatttttatttttattattataattttgggggtttataccctgacttcccaaaaaggacttttgcaagatcaaaactgttattcttacatactggtttgtactttcccaaaacattttcttcctttatgtgaatagcagcttgatttgttaatgtgtttcccccaccccccgcaaaaataactgcttttaaattacac

SEQ ID NO: 86548 - DNA, 601 bp, Human
acaagaaatttttgagtggtaaattcctagtgtttaatatactaaattagaaaatcttaaaagaagccatagtcaaaatgcttatttctcacattatatccaatgtattttaaatcatatcttcctgatgtataaatcaccctgtgggcataagttagaattttacacaggcttctgtgtatggtggagtttattatcttgagtgaacaagacccaatgtatccccacaggattagccgctcaccctttctgttcatataatagggggaaaacattatactgaagagctttttgtattttsttcctggtatttttgtagtactgtcttgtgtggttccccacaatgttaatcagataagctgctggaggtatttttcagtgttttacacttcatattaatttacttagactctaaaagagttgatctcactttattttttcttagatgcatacagttcaatcgttttaaataagattttcttcaatttcccatttaattttaataattacagaaaaacacacttgattaaacagcagttaatgtgttgtttattaaactgtagaattagaaatcaagggctaggtaataggaaatatgaat

SEQ ID NO: 86549 - DNA, 601 bp, Human
ggtatttttgtagtactgtcttgtgtggttccccacaatgttaatcagataagctgctggaggtatttttcagtgttttacacttcatattaatttacttagactctaaaagagttgatctcactttattttttcttagatgcatacagttcaatcgttttaaataagattttcttcaatttcccatttaattttaataattacagaaaaacacacttgattaaacagcagttaatgtgttgtttattaaactgtagaattagaaatcaagggctaggtaataggaaatatgaatgaggattttttttttttttttttttgagacggagtctcgttctgtcgcccaggctggagtgtagtggcgcgatctcagctcactgcaacctccacctcctgggttcaagcgattctcctgtctcagcctcccaagtagctgggattacaggtgcctgccaccatccccagctaatttttgtatttttagtagagacagggtttcgccacgttggccaggctggtctcaaactcctgacctcaggtgatctgcccgccttggcctcccaaagtgctgggattacatgtgtgagccaccgtgcccagt

SEQ ID NO: 86550 - DNA, 601 bp, Human
ttttttttttttttttttttgagacggagtctcgttctgtcgcccaggctggagtgtagtggcgcgatctcagctcactgcaacctccacctcctgggttcaagcgattctcctgtctcagcctcccaagtagctgggattacaggtgcctgccaccatccccagctaatttttgtatttttagtagagacagggtttcgccacgttggccaggctggtctcaaactcctgacctcaggtgatctgcccgccttggcctcccaaagtgctgggattacatgtgtgagccaccgtgcccagyctgaggactttttttcctgtaattattacaggaaaagtgacatcacctgcacacacacacatacacaatgttcttgtaagaaaatgatggccgtgcttttcagattatttgtcactcatattacaccagtcccatcatgatttcaccccatttgtgagaactcaggactgatctgataacctgagggtacttgttaccagcaaaaccgtggatcattttaaagttctcagtctaagcttacattgactgtgttatgaaattagataacttactggtggattctgaattacagaatcaaga

SEQ ID NO: 86551 - DNA, 601 bp, Human
gaagttcatacacattaaactatgtcaatttatgttctttcttatatcaaaacaatctaagatgtactatccaagatgcatatacagttggtaattgaaaaagggaagacaccttagaatccatatgattttgagtcaaaaaacattgctgaatttagtatggcatctggcactctgcttccggtctgacaacttttcaaatcatgggtttgcttctgatggtaaataaatgcctaacccattactgcactgatgcagactctggagaaagagagaaattagatatcactcaagtgtcccmttggtttgaggatggtgctgcagatgcttgaaagaggctttctaccagtataatctacttggaaacaactccattataactgggagatactaacttaagtactataaatacatccagatgacataaggagatagaaaactaactgatgtcatagcaccaattcctaaatttcatttaagattaatatggttatttcatatattagtctaggcaaaaatttatcccctttttgataaaaacatgaattcttagctattttattgggagtatatctcctctaagtattaggacgatctatca

SEQ ID NO: 86552 - DNA, 601 bp, Human
ggggaagagtaaggagagaaatgagattttagaactaagtttcttttacttacattctacttcttgattcttatgaacaaactgattagcatgatgaaaaataacttggcaatattttatgtgtaagatgagtggagaccagaaaaataatgtctttctataatcattcattttaataatattctccatcccaatatgcaagaactgactcctagtaaaaaattaattctcacaagtttggttttattttctccccaacagaaaatcaacacagcacacataatctaaaaaatcattcatycacaattaagtcagttgccgttttctctctcttttttcaactgggtaaaatggccaagggtagaatcagttgaacgtaagagcatactgatatccaaacatatggcttttacaagcagtcaagattctctgtgatctgtgcatcaaaaatggtgaaattctgctgggtgcggtggctcacgcctgtaatcccagcactttgggaggctgaggagggtggatcgcctgaggtcaggagctcaagaccagcctggccaacatggtgaaaccccatctctactaaaaatacaaaaattagctg

SEQ ID NO: 86553 - DNA, 601 bp, Human; identical to SEQ ID NO: 36290

SEQ ID NO: 86554 - DNA, 601 bp, Human; identical to SEQ ID NO: 36291

SEQ ID NO: 86555 - DNA, 601 bp, Human
cagggtcacacggatggtaaatggcatagtcaggatttgaactcagatcgtctagctctgaagcccgagaacttaactactatataatactgtatctactgacttttgaatacagaattgtattactccattttcacactgctgaaaaagacatacccaagactgggaagaaaaagaggtttagttggactcacagttcaacatggctggggagtcctcagaatcatggtgggaggcgaaaggcacttcttacgtggcagcggcaagagaaagataaggaagaagcaaaagcagaaacccytaataaacccatcagaggttgtgagacttattcactatcacgagaatagcatgggaaagattggctcccataattcaattacctccccctgggtccctcccacaacacgtgggaattctgggagatacaattcaagttgagatttgggtgggggcatagccaaaccatatcaagaattattgataaatcattggaaaatcatcacagtacaatccatcatctgcctcccaaggctggcatgcttgtaatacatatcagatctacaaataatacatatcaaacaattcagataaaaaatgc

SEQ ID NO: 86556 - DNA, 601 bp, Human
tgaagttagtgtgtcttagcacttgctagaagaagggctcagattctgatcagggaaaacaaactaaaatcaggctccttggaataaccagctagagcaaaggtcccccaccttttctgccccaggcactggtttcacagaagacaaattttccacaggccaatggggtggtggggtgggggatggttttgggatgactcaagtgcattacatttattgtgcactttacttctattattattacattgtaatatataatgaagtaattatacagctcaccataatgtagaatcagtgggarccctgagtctgttttcctgcaactagacggtcccatctggggtgacgggagacagtgacagatcatcaggcattagattatcataaggagctcgcaacctagatctctcacatgcacagttcacaatagggtttatgctcctttgagaatctaatgccaccactggtctgacaggaggtggagctcagacagtaatgtgagggaaggggagcagctgtaaatacagatgaagcctcttttgttcactgttgctcaccttctgttgtgtggcccagttcctaacaggccacaaactggtag

SEQ ID NO: 86557 - DNA, 601 bp, Human
taaaacaggtagataaagcacatattgcctgacagataatgaacaactgaggccatcagcccctacccctctttccgtcggcgcagcatgtcgagagacaccccgtacacccaaccctgtttcactttcttctccccagataggacctgatggcaagcacactgaccacacactcatctgcaccctcacctcctttgatcactggtcatttagaagagcctcccctgagtgtccccaggcactgacacagacttaggttctttccactcctgctctgggaagctgagcactacagaaggaractctcctacgatatattagtgggggaccatttcacatttatcatttttcaaccctcaacaaagcttcaaaacccttttacttgccccctgatcatttcctttagcaatgactatgcccagttttcaccaggatgctccatccccttcttctttctccccgctgtccactttgtatctggagtacttgagtgagtgaagttagtgtgtcttagcacttgctagaagaagggctcagattctgatcagggaaaacaaactaaaatcaggctccttggaataaccagctagagcaaaggtcc

SEQ ID NO: 86558 - DNA, 601 bp, Human
aggagtgaccttagtcaataagaggcgggagttggtggataaatacttcagcttcctgcccgttggtgggtccactgagttctatacagttcctcaaagggtcctttgtgaaactgagccccagtggtctgtggtggctttcttccctctctggtctcatgtcctcactcccttaccatgctttctagaatcacctccaaaaaaaaaaactacttgcaccctaaggaaaacatgtctcaggaattgcttttggatgaacccaactaaaacaggtagataaagcacatattgcctgacagawaatgaacaactgaggccatcagcccctacccctctttccgtcggcgcagcatgtcgagagacaccccgtacacccaaccctgtttcactttcttctccccagataggacctgatggcaagcacactgaccacacactcatctgcaccctcacctcctttgatcactggtcatttagaagagcctcccctgagtgtccccaggcactgacacagacttaggttctttccactcctgctctgggaagctgagcactacagaaggaaactctcctacgatatattagtgggggaccatttcac

SEQ ID NO: 86559 - DNA, 601 bp, Human
tcctactcatgtttttacctccccaatctggaggtgggtagcagattctgttggtttccttctcacaccctctaacctggagctcactcacctgcagacagtcctcgtgcactcccactgactttctgtggctctctgcctgggagagaccaggagcaccagggggtgaatgccccaggagtgaccttagtcaataagaggcgggagttggtggataaatacttcagcttcctgcccgttggtgggtccactgagttctatacagttcctcaaagggtcctttgtgaaactgagccccagyggtctgtggtggctttcttccctctctggtctcatgtcctcactcccttaccatgctttctagaatcacctccaaaaaaaaaaactacttgcaccctaaggaaaacatgtctcaggaattgcttttggatgaacccaactaaaacaggtagataaagcacatattgcctgacagataatgaacaactgaggccatcagcccctacccctctttccgtcggcgcagcatgtcgagagacaccccgtacacccaaccctgtttcactttcttctccccagataggacctgatggcaagcaca

SEQ ID NO: 86560 - DNA, 601 bp, Human
gtttgctgacaaaagagtcccaaactctactcgactttagctttgctctggacattgggctccctgacctcctctgctgtgaggaccttcttttgcctcttcttcactttggtgaccactcccacaaacacagcttggatctggtcactaccaagaataggtccatctccaaaacttggattttgcactctataaccactacctctcctattctgcaatcttccctcatctaactttcactaactgttttcttttgttgttgtttttaaatatatattttcctctttttaaaccctgtttsttgaacccaaactttctgctcctcaatcttcctattgggactgacttagctcagctttaactatccagacggtttctttgctgccttccagaattaccctcttcaaggtgataggagaccctcttcaagtcccagactgaacatggcacttctaaacttaaacatgcaatctggttcccctttgtgcaaacccacagggcccttctcagcagtacccaattcactcagccagactttttccagaagcagggtgcctccaaccaaactcttcctcatctctctcatgcttccaactataga

SEQ ID NO: 86561 - DNA, 601 bp, Human
gaaaagagttagaggcttaacaagaaagagtaaataggaccagaaaaactggacatctatgctgactcacaaaggcttgccaggaaaggagccaggcagagaaggtaggatgagaaaagtatgaaggggaagaaatgcgagggatgacaaacagaaatgggagaaacggagtcaagaaggctggcatgattcagggccaggaagggcagctaaaccactatccgatcacgcttttactgaaattccgtttccagattagtagaatggctcattgcctagggacatcagaattgcctagaasaatacataaatcagtagctttgcacatttctgctttaggaaaatatcactcccacatgtggaaggaggggtttggaaaaggaggagttgcagagaacaagaggctggcctcctattcttcctgctgtgaaaccaaatcgcatgcttctgtcatgcagcaggatacagaatgaaccacaccatggggtcacaaggctattcagggatcctttgcattagtgcagagtgcttggttcgaatccccatgctgcaagctcctgtgggcacaagttacttaacccttcttcatctgtaaaagaag

SEQ ID NO: 86562 - DNA, 601 bp, Human
tgtgttggaacatctccaaaaggctctcaaggataatttctaaaaaaaaatggagggaagggtttataaatgtcttaaatcaattactttgatagattacatgaggatttgcagcattaggattgagttcagaagaggcaacacaaggggaccgtttcttcagaaaacttgatataaataagcagattgttaggtcaaagaaggggagctgcagggacaactaagctatctgtgtggccccatctttcctgtgatgggcttggaacctgcattgtgtggcatcagttactgtgacaaccamcaataggaaaagagttagaggcttaacaagaaagagtaaataggaccagaaaaactggacatctatgctgactcacaaaggcttgccaggaaaggagccaggcagagaaggtaggatgagaaaagtatgaaggggaagaaatgcgagggatgacaaacagaaatgggagaaacggagtcaagaaggctggcatgattcagggccaggaagggcagctaaaccactatccgatcacgcttttactgaaattccgtttccagattagtagaatggctcattgcctagggacatcagaattgc

SEQ ID NO: 86563 - DNA, 601 bp, Human
ctctttgtcctgtctcagaactttcttctctttccctgtcctagcattgtccttaactcttagccttctttattctcctacagcttctgaacctagataatcaccatctccacagggccgtggaccgctcttgctaaatctttttacatgttctcttccattttctctctaatctcacctaattgcctctccaagtttcatgaggcacacaatagtctttctcacatgagggaaaaatgaaacccagcataatcagtgccaccggactgcagttctgtgaggcttcaaattgtctgttacyaacccctgtgccaggaggggttaaccctttcagactgtccttgccactccctggccattcccgttccctcctctgtcctcctgctctgtcctcatttagcagttgctgaccctggcagaaaatctctcttccgtgattctttgctagacctctgtatcttaccaatgaatttttaaactgagttgaaaacatttttcttccttttagcttttagtctattctcccattgttttgcctttatttaactggaaagtacttaacaaacattgctggtataaaaatcattattcacaacagctc

SEQ ID NO: 86564 - DNA, 601 bp, Human
atttttaacaaaaaacactttaaagaaacaataaaacaacaattttaatggtggcattttaggcaaacaaaggactttctggtattcaataaattacaccatgaaggtgttcacctaatccaactatacacataaagtcagtctctgtgctgctccattaagggaactggaaggaaaagttccagtgcatggttcacatcaagtgcaatgcttaagacaagctattagaaagccacagcatgcaggctgcaacccaatttcaatctcctaccccagtccataggtttgaaattgcttctaytccatctacccacagagctagtgctgggctcaagcccttcctgcccggcagcctgtcttgactctgtccatttccttgctgttctgacattattaggtttcagcagggatgcagtccagaaggaaatggggagggcatctctcctctgtaaccaatctggaggtgagcagcttctctcttgagatgtactgaccttttccagcttcacaaatttgggtttgtctttatctgttccatctagtgaacaatggattcagagctgattacgttcctaagattactctgtagcaggaaggaata

SEQ ID NO: 86565 - DNA, 601 bp, Human
agtgttccctttagctttagacagctcttctcttagaactagctgagtgaaggtttgaagtgttaaagtgagtaagataagatttgtactgttaagcctttgtgaagtttccgcatttttaacaaaaaacactttaaagaaacaataaaacaacaattttaatggtggcattttaggcaaacaaaggactttctggtattcaataaattacaccatgaaggtgttcacctaatccaactatacacataaagtcagtctctgtgctgctccattaagggaactggaaggaaaagttccagtkcatggttcacatcaagtgcaatgcttaagacaagctattagaaagccacagcatgcaggctgcaacccaatttcaatctcctaccccagtccataggtttgaaattgcttctactccatctacccacagagctagtgctgggctcaagcccttcctgcccggcagcctgtcttgactctgtccatttccttgctgttctgacattattaggtttcagcagggatgcagtccagaaggaaatggggagggcatctctcctctgtaaccaatctggaggtgagcagcttctctcttgagatg

SEQ ID NO: 86566 - DNA, 601 bp, Human
acctgcacatcctgcacgtgcatcccagaacttaaaacaaaataaaataaacaattattttaaaagatttaaaaaaccaagtgataacaaataagagaaagaaaataaacccaaatttaagaccctgaactggctcttcaactgatgtcacatgtgaggtggacaagacccctcagtgtcaccagactctgagcggggagtgtgcacacacatgtacttgcccactttctagggaggacaaagcagggcagtgctggaaggaagacgggtgtggcagaggagactcacttcacccataaamcctgaaccgtgaacttcagagctggatggaactgtaaagattatttaactgaaccactctttcacttttttttttccaaatccatttttgtcttagaagttttatatctatctactatattcagtccaggtgtagctttatttacatgcattcatttataacttagaagaaaataaactgctatagattgttgccaaacattttgaagtaggtgacttgaaatttcagacaacaaagatctatcaactgcttgatgtggcatggtttaggaaccctgcagacagaaggatatatatgtca

SEQ ID NO: 86567 - DNA, 601 bp, Human
aacctactaatcactttctagctaacctagagttcattaatttttcattaaaggataattattttactataatggttttgtagttcagcttctacctaatatatatgttcaaatgtattataagctctgcaacgtactgactgtgcctcagtttatacacctcagataggtgtgtagacgacctggctagtggttgagagctctggagtcacgtggagctgtcacagacctgctgtgtaactttgggcagattgctccatctcagtgagcctcatctttcctccttgaactgggaatatgkatggtactgacctcttagggatgttaaggatattccattgagtaacccatgaaaagcacaccacatactaccatgaaaagccttaggaaatgggagctatcattattactttattcctctgacttcctgattcttggtctatagatccagctgcagacctggttgaacctacagagtgctaatctcatcatccctcaaaggcttctcttcttacactgttagcacaaaagcttatttttactgcagtttctgcagcacacagtgggtgcagacattttagttttaaacaatcctgagaca

SEQ ID NO: 86568 - DNA, 601 bp, Human
attagtaatagtgattcaaaatcaaatccacctctcgtcaatgtgatatggagtccgataattaaccttctgtccaactctccttttcactttttcatgcctgggtagaatgtttaccttaatttctgttgtaacctactaatcactttctagctaacctagagttcattaatttttcattaaaggataattattttactataatggttttgtagttcagcttctacctaatatatatgttcaaatgtattataagctctgcaacgtactgactgtgcctcagtttatacacctcagatargtgtgtagacgacctggctagtggttgagagctctggagtcacgtggagctgtcacagacctgctgtgtaactttgggcagattgctccatctcagtgagcctcatctttcctccttgaactgggaatatgtatggtactgacctcttagggatgttaaggatattccattgagtaacccatgaaaagcacaccacatactaccatgaaaagccttaggaaatgggagctatcattattactttattcctctgacttcctgattcttggtctatagatccagctgcagacctggttgaac

SEQ ID NO: 86569 - DNA, 601 bp, Human; identical to SEQ ID NO: 36292

SEQ ID NO: 86570 - DNA, 601 bp, Human; identical to SEQ ID NO: 36293

SEQ ID NO: 86571 - DNA, 601 bp, Human; identical to SEQ ID NO: 36294

SEQ ID NO: 86572 - DNA, 601 bp, Human; identical to SEQ ID NO: 36295

SEQ ID NO: 86573 - DNA, 601 bp, Human; identical to SEQ ID NO: 36296

SEQ ID NO: 86574 - DNA, 601 bp, Human; identical to SEQ ID NO: 36297

SEQ ID NO: 86575 - DNA, 601 bp, Human; identical to SEQ ID NO: 36298

SEQ ID NO: 86576 - DNA, 601 bp, Human; identical to SEQ ID NO: 36299

SEQ ID NO: 86577 - DNA, 601 bp, Human; identical to SEQ ID NO: 36300

SEQ ID NO: 86578 - DNA, 601 bp, Human; identical to SEQ ID NO: 36301

SEQ ID NO: 86579 - DNA, 601 bp, Human; identical to SEQ ID NO: 36302

SEQ ID NO: 86580 - DNA, 601 bp, Human; identical to SEQ ID NO: 36303

SEQ ID NO: 86581 - DNA, 601 bp, Human; identical to SEQ ID NO: 36304

SEQ ID NO: 86582 - DNA, 601 bp, Human; identical to SEQ ID NO: 36305

SEQ ID NO: 86583 - DNA, 601 bp, Human; identical to SEQ ID NO: 36306

SEQ ID NO: 86584 - DNA, 601 bp, Human; identical to SEQ ID NO: 36307

SEQ ID NO: 86585 - DNA, 601 bp, Human; identical to SEQ ID NO: 36308

SEQ ID NO: 86586 - DNA, 601 bp, Human; identical to SEQ ID NO: 36309

SEQ ID NO: 86587 - DNA, 601 bp, Human; identical to SEQ ID NO: 36310

SEQ ID NO: 86588 - DNA, 601 bp, Human; identical to SEQ ID NO: 36311

SEQ ID NO: 86589 - DNA, 601 bp, Human; identical to SEQ ID NO: 36312

SEQ ID NO: 86590 - DNA, 601 bp, Human; identical to SEQ ID NO: 36313

SEQ ID NO: 86591 - DNA, 601 bp, Human; identical to SEQ ID NO: 36314

SEQ ID NO: 86592 - DNA, 601 bp, Human; identical to SEQ ID NO: 36315

SEQ ID NO: 86593 - DNA, 601 bp, Human; identical to SEQ ID NO: 36316

SEQ ID NO: 86594 - DNA, 601 bp, Human; identical to SEQ ID NO: 36317

SEQ ID NO: 86595 - DNA, 601 bp, Human; identical to SEQ ID NO: 36318

SEQ ID NO: 86596 - DNA, 601 bp, Human; identical to SEQ ID NO: 36319

SEQ ID NO: 86597 - DNA, 601 bp, Human; identical to SEQ ID NO: 36320

SEQ ID NO: 86598 - DNA, 601 bp, Human; identical to SEQ ID NO: 36321

SEQ ID NO: 86599 - DNA, 601 bp, Human; identical to SEQ ID NO: 36322

SEQ ID NO: 86600 - DNA, 601 bp, Human; identical to SEQ ID NO: 36323

SEQ ID NO: 86601 - DNA, 601 bp, Human; identical to SEQ ID NO: 36324

SEQ ID NO: 86602 - DNA, 601 bp, Human; identical to SEQ ID NO: 36325

SEQ ID NO: 86603 - DNA, 601 bp, Human; identical to SEQ ID NO: 36326

SEQ ID NO: 86604 - DNA, 601 bp, Human; identical to SEQ ID NO: 36327

SEQ ID NO: 86605 - DNA, 601 bp, Human; identical to SEQ ID NO: 36328

SEQ ID NO: 86606 - DNA, 601 bp, Human; identical to SEQ ID NO: 36329

SEQ ID NO: 86607 - DNA, 601 bp, Human; identical to SEQ ID NO: 36330

SEQ ID NO: 86608 - DNA, 601 bp, Human; identical to SEQ ID NO: 36331

SEQ ID NO: 86609 - DNA, 601 bp, Human; identical to SEQ ID NO: 36332

SEQ ID NO: 86610 - DNA, 601 bp, Human; identical to SEQ ID NO: 36333

SEQ ID NO: 86611 - DNA, 601 bp, Human; identical to SEQ ID NO: 36334

SEQ ID NO: 86612 - DNA, 601 bp, Human; identical to SEQ ID NO: 36335

SEQ ID NO: 86613 - DNA, 601 bp, Human; identical to SEQ ID NO: 36336

SEQ ID NO: 86614 - DNA, 601 bp, Human; identical to SEQ ID NO: 36337

SEQ ID NO: 86615 - DNA, 601 bp, Human; identical to SEQ ID NO: 36338

SEQ ID NO: 86616 - DNA, 601 bp, Human; identical to SEQ ID NO: 36339

SEQ ID NO: 86617 - DNA, 601 bp, Human; identical to SEQ ID NO: 36340

SEQ ID NO: 86618 - DNA, 601 bp, Human; identical to SEQ ID NO: 36341

SEQ ID NO: 86619 - DNA, 601 bp, Human; identical to SEQ ID NO: 36342

SEQ ID NO: 86620 - DNA, 601 bp, Human; identical to SEQ ID NO: 36343

SEQ ID NO: 86621 - DNA, 601 bp, Human; identical to SEQ ID NO: 36344

SEQ ID NO: 86622 - DNA, 601 bp, Human; identical to SEQ ID NO: 36345

SEQ ID NO: 86623 - DNA, 601 bp, Human; identical to SEQ ID NO: 36346

SEQ ID NO: 86624 - DNA, 601 bp, Human; identical to SEQ ID NO: 36347

SEQ ID NO: 86625 - DNA, 601 bp, Human; identical to SEQ ID NO: 36348

SEQ ID NO: 86626 - DNA, 601 bp, Human; identical to SEQ ID NO: 36349

SEQ ID NO: 86627 - DNA, 601 bp, Human; identical to SEQ ID NO: 36350

SEQ ID NO: 86628 - DNA, 601 bp, Human
aatatttttgttgaaaagtggatgtaatatattgggtaaaagaaactgcagtaaacaggcctttgtgatggaatggtaaggtgtgagaggaggggaagcgttctacaattttaccattaggtctcagccttttggtgagcctgtgttcctggactgcacccttgaccagtgaatgcttctcagttatttttccctgcttggtgggacaggatggctagagagctggagcggggtatttcctttccatcacgtgaaaggatagagctggctggagttgcagatttcccttcctccagataarttaggctctgataaaactccagtagcagtctctggtaaaatagcctttcctgaggtggggccttgttaagaacagaatgctttgctatatttcaaaatggttatttttcctctccctctgctggaagcattaggcaatttttctctgatatttcactgtgataacctgatagatcacctggagctagaactcacaaaagtgtgggggtcccttatgactgagtcccctacagtttttaacccttagagttgtctgtgttgagcctccagcagttttatcaatgacagttcagatgttcct

SEQ ID NO: 86629 - DNA, 601 bp, Human
caaacgtagtgggcttgctccaggatttgaaaccagatttatttgggtctactgtgagacaggcactgtgctaggcaatttatatggtcttttccctatttaacttcagaaactctttgagacaggcattagtgcctgattgtgcagatggaaaaattagggcacagaggcttagtaacttgccaaaggccacaaacgtagtaggcttgctccaggatttgaaaccagatgtatttgggtctgtgagacagtatcaaggtacagagtgagtgggtgggcattcaataagcagttgaataamtgaatgaatgagttcccctaaaattatgctcctgtcccatggagctctcttgcatccctctgatcctgtttctctcctgtgtgtggccacagcatttccttgaagatctactgtcacattttcactttgcatgacagttacttatatgattatgaggagatatggaaatgttctaagggctctcagaaatgagactgggtttatccttatttatatggtggctcatttcagagctctgatgagccttaaaatggattggcctctctagtgtctactgatgggacaggctgaaagtgcagg

SEQ ID NO: 86630 - DNA, 601 bp, Human
cattgtgcttgtcatctatgttctgattgttttatgctcatggaaagacacaagagagggaaaatgaagagtgcaaaggagaagaaagaagacaaaggaagacatagagcatctctttaggaatggaataatttgctaaagaatgagtgtatgagtgtttgtgtcttcaacagcgctggctgcacaagtgtgttaggcaccagcatcgccatggcaagatggttctgatctggaagaaccccctgggcctctgtgatgaatcagagaccctcaaaggtaaaaatgtccagtggtaaaagasgaaacacgctatccctcacatagaagaaaagaaagtcaaggaagagttggtgcatccaaaggccatcggatggctctactggcccagaacagctagctggtgttaaagatgcaaggttgtgggcaggcaagggggagaaattatagtatgcaactgcccctgccattaatggagctttgcaggcctgttgaataatttcagaatgcagctcacagtccagctggatcatgaacagtacaagagatgctgcatgctctgtgcaataaaactgaactggagaaatccatgtggaagccccaa

SEQ ID NO: 86631 - DNA, 601 bp, Human; identical to SEQ ID NO: 36351

SEQ ID NO: 86632 - DNA, 601 bp, Human; identical to SEQ ID NO: 36352

SEQ ID NO: 86633 - DNA, 601 bp, Human; identical to SEQ ID NO: 36353

SEQ ID NO: 86634 - DNA, 601 bp, Human; identical to SEQ ID NO: 36354

SEQ ID NO: 86635 - DNA, 601 bp, Human; identical to SEQ ID NO: 36355

SEQ ID NO: 86636 - DNA, 601 bp, Human; identical to SEQ ID NO: 36356

SEQ ID NO: 86637 - DNA, 601 bp, Human; identical to SEQ ID NO: 36357

SEQ ID NO: 86638 - DNA, 601 bp, Human; identical to SEQ ID NO: 36358

SEQ ID NO: 86639 - DNA, 601 bp, Human; identical to SEQ ID NO: 36359

SEQ ID NO: 86640 - DNA, 601 bp, Human; identical to SEQ ID NO: 36360

SEQ ID NO: 86641 - DNA, 601 bp, Human; identical to SEQ ID NO: 36361

SEQ ID NO: 86642 - DNA, 601 bp, Human; identical to SEQ ID NO: 36362

SEQ ID NO: 86643 - DNA, 601 bp, Human; identical to SEQ ID NO: 36363

SEQ ID NO: 86644 - DNA, 601 bp, Human; identical to SEQ ID NO: 36364

SEQ ID NO: 86645 - DNA, 601 bp, Human; identical to SEQ ID NO: 36365

SEQ ID NO: 86646 - DNA, 601 bp, Human; identical to SEQ ID NO: 36366

SEQ ID NO: 86647 - DNA, 601 bp, Human; identical to SEQ ID NO: 36367

SEQ ID NO: 86648 - DNA, 601 bp, Human; identical to SEQ ID NO: 36368

SEQ ID NO: 86649 - DNA, 601 bp, Human; identical to SEQ ID NO: 36369

SEQ ID NO: 86650 - DNA, 601 bp, Human; identical to SEQ ID NO: 36370

SEQ ID NO: 86651 - DNA, 601 bp, Human; identical to SEQ ID NO: 36371

SEQ ID NO: 86652 - DNA, 601 bp, Human
tgaggccctcaccagtagcaggtgccggcaccatgcttcttgtacagcctgcagaactgtaagtcaaaataaacctattttcttcatcagttacccagtctcaggtattcctttatagaaatgcaagactggtctaatacaatatctttccccatcattctttaatttccaaatttttcagttctccaccccttccccaccatcatacaccccttaaaagcagagagactaagtcttactcctctttgaacatcacaccagagaaggcccctagtaaacatttattaagcaaaataaaagmcaacagaccctaaaatggttgtcaaatgacattgtcagtcattctaaatttagctcagtggttctccaacaggacaattttgcccctcagggtatattttgataatgcctgcagatatttttcactgttacagttggggaggggattgctattggcaactaatgggtagagacaaagatgctgctaaccatttgcaaagcacaggtcaggtcagtctttcaaaagaaagaattatctgaccccaaatgtcaatagtgtaaggtaattctttttaaaactcagtcctgatcatgtcaccct

SEQ ID NO: 86653 - DNA, 601 bp, Human
tgtgacatgctggttccctgttatcttctgccatgattgtaagctccctgaggccctcaccagtagcaggtgccggcaccatgcttcttgtacagcctgcagaactgtaagtcaaaataaacctattttcttcatcagttacccagtctcaggtattcctttatagaaatgcaagactggtctaatacaatatctttccccatcattctttaatttccaaatttttcagttctccaccccttccccaccatcatacaccccttaaaagcagagagactaagtcttactcctctttgaacaycacaccagagaaggcccctagtaaacatttattaagcaaaataaaagacaacagaccctaaaatggttgtcaaatgacattgtcagtcattctaaatttagctcagtggttctccaacaggacaattttgcccctcagggtatattttgataatgcctgcagatatttttcactgttacagttggggaggggattgctattggcaactaatgggtagagacaaagatgctgctaaccatttgcaaagcacaggtcaggtcagtctttcaaaagaaagaattatctgaccccaaatgtcaa

SEQ ID NO: 86654 - DNA, 601 bp, Human
agtgaattaaaaatttcccaaagacactgaatatcagctttgaaaattctttataattttcttgggcagaaagaactcatttttctttcacctcctccaaaggtgttacagtaaaacaaagaggagcagcttttagggtgagttaatgacttgcctgcatttgcagcaggcaggaacagaagcagggatgcgttttgtcttgtgaaatgtcagaacagtgccttcagcacaatgaaaagtagtattcttcctaaaaaggagccactctgattgcaaagtttacatgggcacatttaatctaaaaaaaaaaaaacaaaaacattctgggggtggcaatgaacagcttagttcaattttatttacaaacacacttccttactttaagtgagagagaaataatggggagtcaaacacatcaggtgtttaaattcactaaatacttgagtcagccatttggtcactaagtctattgggaagagccagagaagaaaaataaatgatcccagtgggacagaaagcaagggtatgaccaaagaaacctgggaagaagtagaaatgaaggggaaggttggccatcaatgttagagggaacacagaaaag

SEQ ID NO: 86655 - DNA, 601 bp, Human
tgggggggatattttaataaatacttgaataaaaatggttatcttggcctggttggatcttgagtactctaccttgctccacctcactttcaatggcgaccagggtccccccttcttcagcacagaaatgttgagcatgcgtccagttcttccaactgcttgggtctttggggatattcagcagaaggcactatcaaaaaatgtcaaaacaaaacattcatttctgtatctttctaagtgaattaaaaatttcccaaagacactgaatatcagctttgaaaattctttataattttcttgrgcagaaagaactcatttttctttcacctcctccaaaggtgttacagtaaaacaaagaggagcagcttttagggtgagttaatgacttgcctgcatttgcagcaggcaggaacagaagcagggatgcgttttgtcttgtgaaatgtcagaacagtgccttcagcacaatgaaaagtagtattcttcctaaaaaggagccactctgattgcaaagtttacatgggcacatttaatctaaaaaaaaaaaaacaaaaacattctgggggtggcaatgaacagcttagttcaattttatttacaa

SEQ ID NO: 86656 - DNA, 601 bp, Human; identical to SEQ ID NO: 36372

SEQ ID NO: 86657 - DNA, 601 bp, Human
ttggtctcccatctgtctaaatcataaagtcataattaatatggtaataatttgcataggtttctctaccttccaccgtcgtttcccatgtcagctacttagattgaccctaaaatgctaataaaactttctagactgtggtacttctcaacctttaggttacatttgaccatttgcatgtgtgtgtctcttttcttcctactagacccccttgagttagtgcttttttttttttttttttttaaatgtagatggagtctcactcttgttgcccgggctggagcgcagtggtgcaatctcrgctcactgcaacctccacctcctgggttcaagtgattctcctgcctcagcctcctgagtagctgggattacagatgtccaccaccacgcccggctaatttttgtatttttagtagagatggggtttacctttgttggccaggctggtctcgaactcctgacctcaggttatcacctgcctcagcctcccaaagtgctgggattacaggcatgaaccactgcgcctggcctaagttagtgcttttgatgtcacaaaaacttgggtgagtttgtttcagtagaattttctgaaaatacatga

SEQ ID NO: 86658 - DNA, 601 bp, Human
ttactgacacacatcaccatgcccaggtaatttttttgtatttttagtagagacggggtttcgccatgtcggccaggctggtctggaactcctgacctcaggtgatctgcccgcctcagcctcccaaagtgttgggattacaggtgtgagccactgtgcccagctgaagtatagttttgactttcaagaattcttatgaacaagacatagccagttgtttatataattgcattttctaccgtttatttctagagaaagaaaatagattttgtctatcataatccctttagtgctagccactttttttttttttttttttgagttttcgctcttgctgcccaggctggagtgcaatggcatgcagtacactcacggctcactgcaacctttgcctccccaggttcaagtgattctcttgcctcagcctcctgagtagctgggattacaggcacctaccaccatgtccagctaattttttgtatttttagtagagatggggtttcgccatgttgggcaggttggtctggaactcttgacctcaggtgatcgcctgccttggcctcccaaagtgctgggattacaggcctgagccaccatgctc

SEQ ID NO: 86659 - DNA, 601 bp, Human
gcagtacactcacggctcactgcaacctttgcctccccaggttcaagtgattctcttgcctcagcctcctgagtagctgggattacaggcacctaccaccatgtccagctaattttttgtatttttagtagagatggggtttcgccatgttgggcaggttggtctggaactcttgacctcaggtgatcgcctgccttggcctcccaaagtgctgggattacaggcctgagccaccatgctcggccagtgctagccactttttaaaaaagtgacattaagcctaaaaagacacattctaacrtgccatttctcttctaggttttggcttggtttgaagaaggtgaagaaacaattacagcctttgtagaaccttttgtaattttactcatattagtagccaatgcaattgtgggtgtatggcaggtaagcaaaaattcctgtactgcaaaatttcaataagttatgtaagtgattagggctgtattaatctttctgttatctgtttttcctgatgtgttgagtaaaaatatgtttgcgggaagtttacatgtattttccctttattccataaattaattgttttctgacacagtctcactct

SEQ ID NO: 86660 - DNA, 601 bp, Human
tattcttactccattgatctctgtctttaggtcagtaccatactgtcttgatagctagctgtcgttttgtattttttgaaattgggaacttgggagtgtaactttgttcaagataattttgggcattctgggttccttacatttacatataaatttttaagagttgcttgtcaatttctgcagaaagcaagctggtattttcagtaagaattgtgttgtatctatagatgagtttgggaaatatggtcgtaatatcaagtctttggatccatgagcatagggatgtctgttttttttttgttttttttttttaaggtctgtcatttctttcaacactggttgtcagtgttcaagtcttgtgcttcttttgttattgcatttttggcggggggaatatttgtaattggaataattttttgtaacttgaaattggcctattggtgatatttatttatttatttatttttgagacggagtctcgctctttcaccgctatgacaggctggagtgcagtggcacgatctctgctcactgcaagctccgcctctcgggttcacgccattctcctgcctcagcctccccagtagctgggaccacaggc

SEQ ID NO: 86661 - DNA, 601 bp, Human
gaagtgtgacataggtgtgggtctcataggcgggtgccctttatcatgttgaggaagcctagttacagctgtaatatttaggttgtcagtatactctggtgacctttcatggtgtttgtaaacttatatgcaaatcagaaatgatagtttgctgggttactaggaccagcaggtcattgaattgggtaagatataattctaaggcatttgcaactattatatggaacattttggaaaagcataccgtgactgtataacctgggccagataaataggtatttattttattaagactatacaygttgagccttttaaacttccacctcttttagaattagtaatcaaattgactgtgcaatctagcatttagcctgataattcagttttgtgaaaactatagagtgaactttaattctgaattttttcttgtcagtcgaaggtactatttgcgtagcctgaaagattaaatggcataaattgtgcttttagacatggtgacttttatattttcatttacattatgaaattggatgtgaaggggtttttcagatgtgttggaaaactggagagtgttgtaaactaattcgaagctgaaaataaa

SEQ ID NO: 86662 - DNA, 601 bp, Human
tttgaaaactgaagtacaggccgggcatggtggctcatgcctgtaatcccagcaatttaggaggccaaggcaggcggatcatttgagcccaggagttcgagaccagcctggccaacactgtgaaatcccatcttcactaaaaatacaaaaattacccgggtgtggtggtggatgcctgtaatcctagctacttgggtggctgaggcacgagaatcgcctaaacccaggagatggaagctgcaatgagcctagattgcacaactgcattccaccctgagggacagagcgagactctgttgcaaaaaaaaaaaaaaaagaaaacaaaacaaaaaagaaaaattgctttagttgttctgtaaatcctggaagctatacctctgtttccaaagccaaggtataaattattactctagaaaacggataagcagaagagcaaaatagtctaaaacaaaaatcagcatagagagtttttgagtttgagagcccctgagcactgtcagaatagctaagacattaagaactgtgagaaatgagagttctcctcaaccatcagaccatgataggccagttgatcttgaagcctgacctgatttcatggggc

SEQ ID NO: 86663 - DNA, 601 bp, Human
caaaagttaaatgtgtatcaatacagtttctgcacagcaaagaaacacctttcatatattttagtagacctttataaagggaaagagtacatgttggtttccttataatgccagtataaatataatctttcatatacataatatatactatattatatattaatactatatataataaatctatactacacatattgtatatttatactataggaccaataggtaagacctatagtcctgtactacctgttggtcctgtaggtgtatctattagtgttaggtaggaccattactaaatacrgtgtgtatatatactaaatatgtatatttagtattggtcctacctaatactgttagataacgattggatatccctaatctgaaaagctcaaagatcagaaactttttgagcaccaacatgatgctcaagggaaatacttactggagcatttcagattttgagttttttgtgtagagatgttcaacagtaagaatataaatcaaacactccaaattttaattttaaaatactgtttccaagcattttgggtaagggatactcaacctgtaatatgttggcagtgttacccaggaaatttaa

SEQ ID NO: 86664 - DNA, 601 bp, Human
atatgagagtatgagctagggtttatatattgaattgtttaagtctgttcagcagttacaatgcagaagtaaaatagtgcttatagattgacgaccgctatctcacattggacagaagtcttctactccataggatcatgacattgacgtaaatcaaatcctcagacaccaaaggaacatttggaaataaattttccatttagggtcataatattcatcattgaacttgtcctctttttgaaatgttcgagggcatgtaggatcaggttaatcatgacaggcagaaatagtgcagtatagrgcatgttagctgttaaagaccactaaagtttagaatatagttactttgttgtcttaaatcatctgttagatgtactctcttcaatgtagttagagcagaattatattaaaatgaaaggttctcgttgattcagtctgaatattgctgttcattgcacaagcatttccagcaggaatttcaccttagcttgtgtgtccctgcagtcaaatgcaagggtgatctttgcctgttgagattatatattgacaaactgtgccgccttgtgaccacattgcttacttaggctatagcattgttttt

SEQ ID NO: 86665 - DNA, 601 bp, Human
taaatgtgtgtcagtgggagcaaatataattaactcaccacattaaccaaattaaggtggaaaaaacaataaggtcacctcagtaggtgcatatgatgaaacgcatcttatcacaccaaactaagactataaaagtgtgtctttaacgctgacagtgtgtttacacagagaccatgctaacataacagaattctcaccatttctatgcagtattatactggcattcctggtctgtgtaataggcaagaaaagtacaaaaactggaagagaaggggtatctttagttgtaggtaacgatatmaagccaaaggtttattctcagtcttcgtcttcctattttgttggtgctgtcactcgctccctctttgaagcacctcttcacttggcttccacgatcccatacttgctctccctccctggcctctcattcgaggtctttgtagctgggtctttcacaaggcaccaggaggtgaaggctccatagtcctcagccatttctgtctatagttactcccatgatctcttctggtctcattactataatcagtagccactagctatctaaaactacttagaatacctaaaaacacttccttagatg

SEQ ID NO: 86666 - DNA, 601 bp, Human
cctcttggctggctctgcattcaggctggtctgtgctaggcttggtatggggttggagcctggacttgggaaatatactgggctgataggaatttgattggattttcttgcagagtcatttcctacagtgtaaagaggacaacccggactttgaaggcgtggattgtgcaatctttgaatccccatacccgatgacaatggcgctctctgttctagtaactatagaaatgtgtaacgccctcaacaggttagtgcaccttcacggcaggctgaggcgagcatggtgactgccagggcaccrgggaattgtgtgtagtcacggttgattgaggatcacaggacagttcttcccttcccaaaagaaaggagaacaggcaataccagttttaaaagcatgagctgtcgtcacctccaggaagtagtgggagtgcttagccctgtgtttcttaggagctcttccttaaaagaaaccgtgggggccaaaaataggaactttggtacccctgtatgccagcacccacagggaaggaacctcaccctttcacacagacaaatggtaccatccagttaagcccgtgacaaaaatggaaatttctaaata

SEQ ID NO: 86667 - DNA, 601 bp, Human; identical to SEQ ID NO: 18782

SEQ ID NO: 86668 - DNA, 601 bp, Human; identical to SEQ ID NO: 18783

SEQ ID NO: 86669 - DNA, 601 bp, Human; identical to SEQ ID NO: 18784

SEQ ID NO: 86670 - DNA, 601 bp, Human; identical to SEQ ID NO: 18785

SEQ ID NO: 86671 - DNA, 601 bp, Human; identical to SEQ ID NO: 18786

SEQ ID NO: 86672 - DNA, 601 bp, Human; identical to SEQ ID NO: 18787

SEQ ID NO: 86673 - DNA, 601 bp, Human; identical to SEQ ID NO: 18788

SEQ ID NO: 86674 - DNA, 601 bp, Human; identical to SEQ ID NO: 18789

SEQ ID NO: 86675 - DNA, 601 bp, Human; identical to SEQ ID NO: 18790

SEQ ID NO: 86676 - DNA, 601 bp, Human
tatctggcaaccctattcgaagagagttcctaaatttcagtcgttcaaataccacattcacaatttttgccctgtgcctgtgctagttgcataataatttcttaaggcttttcttagaagaacctcactttttaaacttaaaaacatgtattaaattaaaaattattttgttaaaagagtgagatccagtatcttgaataaaaagtagtcagaaagcaaaatgaaggcaaagcatttcgatttaatattaataaattctgacttgatacttttatctaccaagtcactgagcccctaaaakgggcttagcaagtgttgagtactgaagacgtagcagcaaactgagaatttctttttttattcattcaacaaatcaccttttgagccacttccatatgccagcactgttcttggcctggagaatacagctgtgaatagaacaaataaaaatctctgctctcatggaactcaagtagggagagatggacaataaacaacataaattaagcaaggtgaacaatatgttagagagtaataagtatgatggagaaaaattagggatgaagaattgagggaagtttttattttattttatttgaga

SEQ ID NO: 86677 - DNA, 601 bp, Human
aacttgggaaggtcttttggttgtgtctgttttcagagtgaagtaggaagaaaggtcatcagctaagagtgaatgtagagacagaagacatgaaatactctagtgaataagcaagagaaatgttgaattactgggtaccatttaggacccacttggagttagtggtcatgaatttaaagtgagaccagtcaccatggctgtgtgtttttctccagccaaatccgaaacattgaaaggaatgggaagggagagtcctgctatttgcctgatgatgttattatttaaatatgatgttttgtaytgtactttgagaaacacacccctaaaggaagctctgtcctcaaatcccagagagagaacagggtatgtcacaaagtaagtacttaggacaggtcatcagataaggtttgaactccctctattttcctgacttttgcttcttaaccttgtcaaatttctctgcttcttccttgctttcttgtgcaacagaggcttactgagtgaggactaagagtccactctcatgctgagcacagcagtgaatgggatacagctcctgtccttcaaggagctcacaactcacaactaagtaggagaaaac

SEQ ID NO: 86678 - DNA, 601 bp, Human
ttcttttttttttttttttttttttttttgagacagagtcttgctctggcacccaggctacagtgcagtggtgtgatcttggctcactgcagcctccgcctcccaggttcacgccattctcctgcctcaggcctccaagtagctgggactacaggcgcccgccaccatgcccagctaatttcttgtattttttagtagagacggggtttcaccatgttagccaggatggtctcaatctcctgacctcgtgatccgccagcttcggcctcccaaagtgctgggattataggcgttagccacygtgcctggccgactcgacataattttcatactgtgtggtgagatttgtgattgggcatggaaagccagaatctctggggtaggaattcccaagaggaagaagagggaaaagtgtttcagccatagaaagcaacatgtgccaaggtggtgaagcctgaagaaacacatgcagttttttgggggtttttttgtttgtttgtttgtttttttgatggagtctcattctgtcacccaggctggagtgcagtggtgtgatctcatctcactgcaacctccgcttcccaggttcaagtgattctcc

SEQ ID NO: 86679 - DNA, 601 bp, Human
tttcaccatgttagccaggatggtctcaatctcctgacctcgtgatccgccagcttcggcctcccaaagtgctgggattataggcgttagccactgtgcctggccgactcgacataattttcatactgtgtggtgagatttgtgattgggcatggaaagccagaatctctggggtaggaattcccaagaggaagaagagggaaaagtgtttcagccatagaaagcaacatgtgccaaggtggtgaagcctgaagaaacacatgcagttttttgggggtttttttgtttgtttgtttgtttktttgatggagtctcattctgtcacccaggctggagtgcagtggtgtgatctcatctcactgcaacctccgcttcccaggttcaagtgattctcctgtctcagcctcccaagtagctgagactacaggcatgtgccaccacgcctagctaacacatgcagttttaatgaaagagaagtagttggatgtgcctggagttgaagggacctgtgaaagggtggcagaacaagaggttggaagggtgggatttgccatatgtcgaagagccttgtggaccatgctagtttatcctgttggcagtg

SEQ ID NO: 86680 - DNA, 601 bp, Human
acacctagcctgtcttttaagactgttcatccctacagtgtattatcatcttcttgtgattatcttacgattacaagcgtaaattgaagaaaagattgctgtatgaaatctcactgtcagtgagtcatctcagcatttttaccttattttcaaagacccaaccagaaaagaggaaactcttttgcacttttcaatcaagaaacttaaacataaagcagtagagggcttccctaataacatgtttcctccagcattcaaaattagtgacttcacatcactaatatgtgtcttacttattttragtataaatgattgggcaaagaatccttgggaaaaaatagcctatttatttcaaatactgtatagtggattctctgtgcctgtgactcacctccttccctccatcactgttctcatactcaggatgcaaaggttcagtctctgtcttcaaaagtgagctcccagtctagctggagggagtgatgagtgaacaaataattacagcgtaatcctttggtaaaccagagcaggcagtaattaactctgcctagagatgaagtggcgctggagagagttcaaggaggcttcacagagaaggtgg

SEQ ID NO: 86681 - DNA, 601 bp, Human
tcaaggaggcttcacagagaaggtggcagtggaaagctgaatcacctggtaggcaaggcgggaggaggggatgtcagatcagtgagggtcttttgtgctgagcagatgagtttggatcataggaaggtgtgagaaaattttttgccttttttttttcgtaaacagtttttcatgaaaaaaggtcatcaaagtaaaatgtattaagttttttttaagcctgctgactgatttttattaactttgcctagaatgcctttaagcttggagcctgtatgatcctgggtactcagtcttggggttrgaatataacttgagggcaagctctcagcctagatcatcatttcagttatagtacttacctctgagtagctactccataaacatttgttgattgaatgagtgagtgaatgaatgcagcatcaaatacagtatctgaaataaagacttcaattttttttggaaggactttttaaaaaagacattagacagttttatatgttctgactttgttggattttggtaaaagatttcagaattggattttttttctcatgtttttcatcttgttcaggagatgaaaatgcctagaggtgataaatat

SEQ ID NO: 86682 - DNA, 601 bp, Human
actttttaaaaaagacattagacagttttatatgttctgactttgttggattttggtaaaagatttcagaattggattttttttctcatgtttttcatcttgttcaggagatgaaaatgcctagaggtgataaatataggctcctatgaaatacagctgtattagacgtaaaataatgggatctgttattttgggtattacatcatatgctatcttgctgctagattttagcattacatagctatggtaggcattgtcagtttatagaaaattttgtggggagaaaaaaacatgccttagraaaagatgagtggtaacaacagaactctttgtcccagcttgtggaatgagaatagtggagctaatgaaaatcaacatgttgaagtaatatactcttaagaaagtaccttccacctttttttaaggttgtggcaatataacaacagagaacactggtggccagggtcctaagggaaggtttgatgctgcttgtaagttctgataccttccaaaattcataatactgagagtatattgaaagacaggccgggcgatgtggctaacccctgtcatcccagcactttgggaggctgaggcgggc

SEQ ID NO: 86683 - DNA, 601 bp, Human
agagaggagttggggtggcatgtagtaaatgtcatctattaaatgtgtgggttcttatgctgagacatcagcaccccaatcagtaaccataagtggaaggatgccccccttctttcccttgagaaagattacttctgatagaggagattgaggtccagatacagtcttaagatttattttttatttttcacaaatgtaggtttcagagggaactgaaattagtaatatattgtgtattttattcattcagctaggtcattaggttgtaatttgttttctaccctggaggagccccatcctstagctggagaaacacaatgacaattgcagtgatggagtctcacccagaataccaaccatgcagaaaggaggactagctaatccagcttagaggtgtcaggatctggaaaggcttcacacaggaggttcatctaaacagaaccttgaggattgagtaagagttggtcaggtgaggagaggaggcgcttcaggaaatgggaaagcatatgcaaagtcatatttgcaagagaacatggcatgattggagtttggtcctgcaggagggtaggctacctaaaggaaagccaaggccagagaggca

SEQ ID NO: 86684 - DNA, 601 bp, Human; identical to SEQ ID NO: 23652

SEQ ID NO: 86685 - DNA, 601 bp, Human; identical to SEQ ID NO: 23653

SEQ ID NO: 86686 - DNA, 601 bp, Human; identical to SEQ ID NO: 23654

SEQ ID NO: 86687 - DNA, 601 bp, Human; identical to SEQ ID NO: 23655

SEQ ID NO: 86688 - DNA, 601 bp, Human; identical to SEQ ID NO: 23656

SEQ ID NO: 86689 - DNA, 601 bp, Human; identical to SEQ ID NO: 23657

SEQ ID NO: 86690 - DNA, 601 bp, Human; identical to SEQ ID NO: 23658

SEQ ID NO: 86691 - DNA, 601 bp, Human; identical to SEQ ID NO: 23659

SEQ ID NO: 86692 - DNA, 601 bp, Human; identical to SEQ ID NO: 23660

SEQ ID NO: 86693 - DNA, 601 bp, Human; identical to SEQ ID NO: 23661

SEQ ID NO: 86694 - DNA, 601 bp, Human; identical to SEQ ID NO: 23662

SEQ ID NO: 86695 - DNA, 601 bp, Human; identical to SEQ ID NO: 86676

SEQ ID NO: 86696 - DNA, 601 bp, Human; identical to SEQ ID NO: 86677

SEQ ID NO: 86697 - DNA, 601 bp, Human; identical to SEQ ID NO: 86678

SEQ ID NO: 86698 - DNA, 601 bp, Human; identical to SEQ ID NO: 86679

SEQ ID NO: 86699 - DNA, 601 bp, Human; identical to SEQ ID NO: 86680

SEQ ID NO: 86700 - DNA, 601 bp, Human; identical to SEQ ID NO: 86681

SEQ ID NO: 86701 - DNA, 601 bp, Human; identical to SEQ ID NO: 86682

SEQ ID NO: 86702 - DNA, 601 bp, Human; identical to SEQ ID NO: 86683

SEQ ID NO: 86703 - DNA, 601 bp, Human; identical to SEQ ID NO: 23652

SEQ ID NO: 86704 - DNA, 601 bp, Human; identical to SEQ ID NO: 23653

SEQ ID NO: 86705 - DNA, 601 bp, Human; identical to SEQ ID NO: 23654

SEQ ID NO: 86706 - DNA, 601 bp, Human; identical to SEQ ID NO: 23655

SEQ ID NO: 86707 - DNA, 601 bp, Human; identical to SEQ ID NO: 23656

SEQ ID NO: 86708 - DNA, 601 bp, Human; identical to SEQ ID NO: 23657

SEQ ID NO: 86709 - DNA, 601 bp, Human; identical to SEQ ID NO: 23658

SEQ ID NO: 86710 - DNA, 601 bp, Human; identical to SEQ ID NO: 23659

SEQ ID NO: 86711 - DNA, 601 bp, Human; identical to SEQ ID NO: 23660

SEQ ID NO: 86712 - DNA, 601 bp, Human; identical to SEQ ID NO: 23661

SEQ ID NO: 86713 - DNA, 601 bp, Human; identical to SEQ ID NO: 23662

SEQ ID NO: 86714 - DNA, 601 bp, Human; identical to SEQ ID NO: 23663

SEQ ID NO: 86715 - DNA, 601 bp, Human; identical to SEQ ID NO: 23664

SEQ ID NO: 86716 - DNA, 601 bp, Human; identical to SEQ ID NO: 23665

SEQ ID NO: 86717 - DNA, 601 bp, Human; identical to SEQ ID NO: 23666

SEQ ID NO: 86718 - DNA, 601 bp, Human; identical to SEQ ID NO: 23667

SEQ ID NO: 86719 - DNA, 601 bp, Human; identical to SEQ ID NO: 23668

SEQ ID NO: 86720 - DNA, 601 bp, Human
actggcattcttttctcctgtgggagtttgccagccggatcacattacatggcttcatctacctccaggcttctccccaggtaacactgaacctacaaccttagactttagggccatatgaaacctaagaagtgacattctccaagcccctgattttctggttggagagattagagcgtagacattacctgcagcacagagagcagtgggggacaccctcctgtcccagcgttgagcaccctgttccccactggcttcgtgtagcagagtgctaaagccattgactatgcataaaaggatygctgttgatgtaggaacaacagagcaaatcgagtgtcatctttatgatgacgcttagggtttgcaggtgggacgctctgacctgtagccacttgcctcagctcctcctttactctgactgggtcatcagagtgtgtagtctcagtggtttccttagtaagatgtgaggaggaagaggagaattttctcacctcatcatgatactgccctaatttatagcccttttttgaactgtgatgccattgggaaggcaggatggactatagcagttccattctgtgactctctggctggtgccatc

SEQ ID NO: 86721 - DNA, 601 bp, Human
aagatgtgaggaggaagaggagaattttctcacctcatcatgatactgccctaatttatagcccttttttgaactgtgatgccattgggaaggcaggatggactatagcagttccattctgtgactctctggctggtgccatcctacatgaagtaggatgatgtcacggcaggagcaccagagtctctggagatagaagtgagctgtggcttctgctgactggtagtgaccttgggcagcccctggagacctttccactggagagatccttgcctgtaaaatccactggttcaatctagaygatctctaagggctcttctggagtgggattctgagtcaaggtgagttttttttttttagagatgtactgctctcagcttttgagatatacatccaatatatagtcaaatgccagatataccacatactgttagaaggaaggaaagctgtctccaagctagaggctatgctttttagagatggaactgagacttgtgggcagaaaggagccgagaacagactgagcagaaccagaggatgagtgggagagctcccatcacagagcctcacaccagccaacgaggagaggactggaaggaag

SEQ ID NO: 86722 - DNA, 601 bp, Human
tggaactgagacttgtgggcagaaaggagccgagaacagactgagcagaaccagaggatgagtgggagagctcccatcacagagcctcacaccagccaacgaggagaggactggaaggaagggtcttgccttaagaaggtggcaaccaggaaaaaaggcccttgaatgtgactggggccagatattggggatctttgtgttgagagtttctggacattttgaggcaaaagctagatcgtacgagggaataagagattctacagaaataaataagggttaaagtttaaaatgaaactgggcyggtgcagtggctcatgcctacaatcccagcactttgggaggctggcgtgggaggatcacttgaggccaggagttcaagaccagcataggcgatatagtgcgactccatttctacaaaaaagtttaaaaattagctgagtgtggttatgtgtgcctgtggttttagctattggggaggtgagacaggaggatcacctaagtccaggagctcgaggctacagtgagctgtgatcgtgccactatactccagcccaggtgacagcgtgagaacttgtttctaaaataaaataaaactgaacta

SEQ ID NO: 86723 - DNA, 601 bp, Human
agttcaagaccagcataggcgatatagtgcgactccatttctacaaaaaagtttaaaaattagctgagtgtggttatgtgtgcctgtggttttagctattggggaggtgagacaggaggatcacctaagtccaggagctcgaggctacagtgagctgtgatcgtgccactatactccagcccaggtgacagcgtgagaacttgtttctaaaataaaataaaactgaactaaagattcagtgaggccagagggctaataatcttccatggaaagaaccacactaaagttagatgcattgatygcaagttgacaaggtgggtcatgtttatgtgacttctttcaatagtcttcattgcctgagagccagaatagaagaaggggattatactttaggggtagagattagtgtcagcgattgtggggagaggagtcccctctcaaagaggacagtttgaagtgtcaaagtgtagggttcaagttgggagagaagtcctgagccccaggaaggcttgtggcctgggccaaagaggagtgagagtgctgtgaggttggattgagtaaagatcctggttggaatttgaagaagtgacaggtttcctat

SEQ ID NO: 86724 - DNA, 601 bp, Human
atgcaggaggtgcatgggacaaatggcacctgggtttgggcttgagaggcatagtgaaaagacccactagcagtcactttccattttctgtttctgactccaagcaagcagagcagcagttcttcttcctgggtgggacaggttaagaagaccagtaaagggtctctccctcgccacttgtagctacactatctttcctgttcacattcaggtgtgtcttcctcatgaggactgagatgaagaggggtcagactaaagcactgtttgcacgggatttttttaaatagaatttgttatagcsatatcagtaaagcaagagttatgccaaatgctcatagtaggagtttacttcgacctctttttttttccccactcaatactgccaccagttaagacttagacttctcagggaaatccatttgctctgttaaggaaattaatagtaaatagaaatatgttagcttattttaatagatcaatgttagtgtcaaggtttgtctgcaagcagtgaatgaataattataaatagctttcctaaaaagaattgttctgcctttgtgtgtgtacttggaaacataaagtcacattttaaaaaaattta

SEQ ID NO: 86725 - DNA, 601 bp, Human
gctgagatcgcgccactgcactccagcctggcaacagagcaagactctgtctcaaaaaaaaagagtgaagtcctaaatcagtgggttaatccatctgttcttccaggacagatgatattgaataatgaaatgtttgtcaagcagagagaggactgaggataattcagtcaaaacaaacatttggagcaaaaattttgaggtgtgaaagagcctggcctgttccccaggaaagaggtcaaatctggctaaagcagtgagtccaggggaagagctaaggcagttgagaagtaggaggggtagytttgtgtgacaggtaaagaagatgtcattttctgagccagtgtgcatcaaacttcactaccagatgaatgcagaatagaattatgtacactctgcaaagcagcgggggaggagagttagtctcaagcctcacttgtttttccacttctttgttttatctttgacctgtgcaaattttacattctattcctgagtgaatgtttggtatgacatgaaagagatatttcaaattacctaacattttataaatgcaatgctattcatacatactgctttgaaccctggggctatggctgtaggc

SEQ ID NO: 86726 - DNA, 601 bp, Human
gcctcacttgtttttccacttctttgttttatctttgacctgtgcaaattttacattctattcctgagtgaatgtttggtatgacatgaaagagatatttcaaattacctaacattttataaatgcaatgctattcatacatactgctttgaaccctggggctatggctgtaggcggtaaagagcctgtgaagtattttcagcaaggaaagtcatgtcattatattgccgtactacagacgggtggagtgaaggggaaaaactggaaggagggaacagcttttgccaggagctcaatacarcttacctcagtgacctgtggatgggtagacaatgaggaaatagaagcccacaaggactgcactgctagtaccttatgaaggcaggaatttactcctggactttctgaccttaaggcctgtactctgtccatatgcttccctgcctccaggaggcagaaccagaaggctcttgccataatccaggtaagaagtaaagaggacccgaccagggcagaggtgagaggagaggcaaggagagaacattctagagagatgaaagagaattgagtgacttcccagatatagtagggagaaggaaaa

SEQ ID NO: 86727 - DNA, 601 bp, Human
ctagagagatgaaagagaattgagtgacttcccagatatagtagggagaaggaaaaacaaggaaaattccaggtccgtggcttggatgactggatggatgatgttcatcattaaccgacttaggatacttcagaggaagagcaggtttaaggtggagatgggaaaagaatggtgtagatcctctgattgcataagaaaacaagacagcagaagcaaaggcatggcttgtaatgcccaagatagacattatgggtgggcctcagagcccccgaagactgcattgtagcagccaaaacagcaragagctcatcagggcttggggactgtcttttaggtttgtttgaagagactgtaccagagggccagggaggaggagaaaggaattgagctggcctatctagagcagctgcatggccaacacgaagcctggcttattcacaagacaacgaagtaagtggggagaaaagaatgtatcagagacagagacctggctcccaacagccagttgttaaaaacaagttcagcatgcagccccctgtaggaaggttcagaatatactggaaatggttggaaatgtcaagcattttccaactcagaagtt

SEQ ID NO: 86728 - DNA, 601 bp, Human; identical to SEQ ID NO: 23669

SEQ ID NO: 86729 - DNA, 601 bp, Human
gccagtggcatgcggcagggaccaatgggtggcggagggaggcggggcctgccacgaggccgcagtataaccgcgtggcccgcgcgcgcgcttccctcccggcgcagtcaccggcgcggtctatggctgcgacttctctaatgtctgctttggctgcccggctgctgcagcccgcgcacagctgctcccttcgccttcgccctttccacctcgcggcagttcggtaagagggtcacagagctcggtcagcgcggaaagctgaggggaacggagggcgaggggcacgccgggcccccgaggkacaccgagggaagtccttcccgaacatctccgccccggcggtggtggccgctgaggggtgtggcggggcgacgtggcaccgagcgccgccgcagctctcgactggggcgcttcctcggcgcggagggctggtacccgaagcccgcctttcggagggagccgctctcctgcgactcggggcgtcgccggggcccgtggccagtcggcgggcgggacgggggtggcgtgcggaacgcgaaggcatcagtttacgcggagccttccgacagcgccggccgcctctggctgggatgctgagagt

SEQ ID NO: 86730 - DNA, 601 bp, Human
aaagctggagaattgcatgaacttgggaggctgcagtgagctgagattgctccagcctgggcaacagagcaagactctgtctcaaaaaaaataaataaataaattagcagttatcttgagaattaattttatctgaccctacaggatattcagtaccttgatgttaggttttagaatataagaggagattacttcattggtcttgaggttagagcagtcttcatgacaccaaggacagagatctaaagggaaaggctttttttaatgggatcattttacttaaggaagagatgctcatctgttttattttagtttagtttagtttagtttagtttagtttagtttagtttagtttagttttttgagatgcagtctttctctgtcgcccaggctagagtgcagtggggtgatatcagctcactgtaacctctgcctcctgggttcaagcaattctcctgcctcagcctcctgagtagctgggattataggcgcgcaccaccatgcctggctaatttttgtatttttagcagagacggggttttgccatgttgaccaggctggtctggaactcctgacctcaagcaatccaccctcctcggcc

SEQ ID NO: 86731 - DNA, 601 bp, Human
aagctggagaattgcatgaacttgggaggctgcagtgagctgagattgctccagcctgggcaacagagcaagactctgtctcaaaaaaaataaataaataaattagcagttatcttgagaattaattttatctgaccctacaggatattcagtaccttgatgttaggttttagaatataagaggagattacttcattggtcttgaggttagagcagtcttcatgacaccaaggacagagatctaaagggaaaggctttttttaatgggatcattttacttaaggaagagatgctcatctaatttattttagtttagtttagtttagtttagtttagtttagtttagtttagtttagttttttgagatgcagtctttctctgtcgcccaggctagagtgcagtggggtgatatcagctcactgtaacctctgcctcctgggttcaagcaattctcctgcctcagcctcctgagtagctgggattataggcgcgcaccaccatgcctggctaatttttgtatttttagcagagacggggttttgccatgttgaccaggctggtctggaactcctgacctcaagcaatccaccctcctcggcct

SEQ ID NO: 86732 - DNA, 601 bp, Human
tggagaattgcatgaacttgggaggctgcagtgagctgagattgctccagcctgggcaacagagcaagactctgtctcaaaaaaaataaataaataaattagcagttatcttgagaattaattttatctgaccctacaggatattcagtaccttgatgttaggttttagaatataagaggagattacttcattggtcttgaggttagagcagtcttcatgacaccaaggacagagatctaaagggaaaggctttttttaatgggatcattttacttaaggaagagatgctcatctattttgttttagtttagtttagtttagtttagtttagtttagtttagtttagtttagttttttgagatgcagtctttctctgtcgcccaggctagagtgcagtggggtgatatcagctcactgtaacctctgcctcctgggttcaagcaattctcctgcctcagcctcctgagtagctgggattataggcgcgcaccaccatgcctggctaatttttgtatttttagcagagacggggttttgccatgttgaccaggctggtctggaactcctgacctcaagcaatccaccctcctcggcctccta

SEQ ID NO: 86733 - DNA, 601 bp, Human
ggagaattgcatgaacttgggaggctgcagtgagctgagattgctccagcctgggcaacagagcaagactctgtctcaaaaaaaataaataaataaattagcagttatcttgagaattaattttatctgaccctacaggatattcagtaccttgatgttaggttttagaatataagaggagattacttcattggtcttgaggttagagcagtcttcatgacaccaaggacagagatctaaagggaaaggctttttttaatgggatcattttacttaaggaagagatgctcatctattttaatttagtttagtttagtttagtttagtttagtttagtttagtttagtttagttttttgagatgcagtctttctctgtcgcccaggctagagtgcagtggggtgatatcagctcactgtaacctctgcctcctgggttcaagcaattctcctgcctcagcctcctgagtagctgggattataggcgcgcaccaccatgcctggctaatttttgtatttttagcagagacggggttttgccatgttgaccaggctggtctggaactcctgacctcaagcaatccaccctcctcggcctcctaa

SEQ ID NO: 86734 - DNA, 601 bp, Human
tgagattgctccagcctgggcaacagagcaagactctgtctcaaaaaaaataaataaataaattagcagttatcttgagaattaattttatctgaccctacaggatattcagtaccttgatgttaggttttagaatataagaggagattacttcattggtcttgaggttagagcagtcttcatgacaccaaggacagagatctaaagggaaaggctttttttaatgggatcattttacttaaggaagagatgctcatctattttattttagtttagtttagtttagtttagtttagtttattttagtttagtttagttttttgagatgcagtctttctctgtcgcccaggctagagtgcagtggggtgatatcagctcactgtaacctctgcctcctgggttcaagcaattctcctgcctcagcctcctgagtagctgggattataggcgcgcaccaccatgcctggctaatttttgtatttttagcagagacggggttttgccatgttgaccaggctggtctggaactcctgacctcaagcaatccaccctcctcggcctcctaaagtgctgggattacaggcttgagctaccacgctgg

SEQ ID NO: 86735 - DNA, 601 bp, Human
catgtgttggccaggctggtctcgaactccttaccttgtgatctgccctcctcggcctcccaaagtgctgggattacaaacgtgagccatcgtgcccggcctatattgtttgtttattcaactacagaatataatttatcgatttaaaccaccataaaaatgaagtcagttgactgggaaatgatttgaaatacatgcctggctgctaacaacagggacaaaacacgaactacaaatggcatataagcagataagaaaaactatttaacctcatggtgaggggtcaaacaattgcaaattraaactgtaaaacacttagtaatgatcagggcgcagggtggtgtagcagttaagagcccagactgatgtgagactcagcttgaccaagcgctgtcagtcacttaaactccctgagcttcaaattaatgataataatgatttctatcaactttatccccctccatatgtagctggatatattcattcatttatttatttatttagcagagacagggttttgccatgttgcccaggccagtctcaaactcctgggctcaagccatcctcctgccccggcctcccgaagtgctgggattacagg

SEQ ID NO: 86736 - DNA, 601 bp, Human
ttgtgttctaggtctcacggtaccacagattactgtgtctctgtggacaagaggtgggtgggcaggctcagatatgcctctgcctgcccatctgtgggcctgtggtctgagcagcaggtggcctttccttcgaagggctgtgaaaccactcgcgtggctgggtggggttactggcctgtaagcctgtggttttctctgttctttattattgaggagtgaggcctcctgctcttttaattgaaagcctttagaaacctctagataatggcaagccatggcattttgttttgttttttgagayggcatttcgctcttgttgcccaggctggagtgcaacggcgtgatctcggctctccgcaacctccgcctcccgggttcaagtaattctcctgcctcagcctaccgagtagctgggattataggcatgggccaccatgcctggcgaattttgtatttttagtagagatggggtttctccatgttggtcaggctggtgtcgaactcccgaccttaggtgatccacctgcctcaggtgatctgcgcctgcctcagcctcccaaagtgctgggattacaggcgtgagccactgtgcctggccaag

SEQ ID NO: 86737 - DNA, 601 bp, Human
gggcctgtggtctgagcagcaggtggcctttccttcgaagggctgtgaaaccactcgcgtggctgggtggggttactggcctgtaagcctgtggttttctctgttctttattattgaggagtgaggcctcctgctcttttaattgaaagcctttagaaacctctagataatggcaagccatggcattttgttttgttttttgagacggcatttcgctcttgttgcccaggctggagtgcaacggcgtgatctcggctctccgcaacctccgcctcccgggttcaagtaattctcctgcctyagcctaccgagtagctgggattataggcatgggccaccatgcctggcgaattttgtatttttagtagagatggggtttctccatgttggtcaggctggtgtcgaactcccgaccttaggtgatccacctgcctcaggtgatctgcgcctgcctcagcctcccaaagtgctgggattacaggcgtgagccactgtgcctggccaagccatggcattttaagacattgggaggtagtgtggtgcagaaaaaaagaacatggattttggaaccagaaagactggctgtattattagctcgctt

SEQ ID NO: 86738 - DNA, 601 bp, Human
ggcatttcgctcttgttgcccaggctggagtgcaacggcgtgatctcggctctccgcaacctccgcctcccgggttcaagtaattctcctgcctcagcctaccgagtagctgggattataggcatgggccaccatgcctggcgaattttgtatttttagtagagatggggtttctccatgttggtcaggctggtgtcgaactcccgaccttaggtgatccacctgcctcaggtgatctgcgcctgcctcagcctcccaaagtgctgggattacaggcgtgagccactgtgcctggccaagycatggcattttaagacattgggaggtagtgtggtgcagaaaaaaagaacatggattttggaaccagaaagactggctgtattattagctcgcttatttatttatttatttatttagagacggagtctcgctctgttgcgcaggctggaatgcagtggtgcgatctcagctcactgcaacccccgcctcccaggttcaagcgattctcctgcctcagcctcccaagtagctgggactacaggcgcgttccaccaagcctggctaattttttgtatttttagtagagacgggttttcaccgt

SEQ ID NO: 86739 - DNA, 601 bp, Human
gtgcagtggcgtgatctcgactcactgcaagctccacctcctgagttcatgccattctcctgcctcagcctcctgagtagctgggactacaggtgcccaccaccatgcctggctaactttttttttttctcgtatttttagtacagacggggtttcaccgtgttagccaggatggtcttgatctcctgaccttgtgatccacctgccttggcctcccaaagtgctgggattacaggtgtgagccatcgcgcgtggcctctatttttctttttaattttttctttaagagtcagaggtttcrtcatgctgcccaggctggtctcaaactcctggcctcaagcaattctcctaccttagcctccctggcctcaagcaatcctccctcctgctgggattacaggtgtgagccaccgccccagccctcagtgaaggaaatttaagatttgatagtggtgacagtgcacattcctgtaacattttgtagcctgtagtatgctttctcctgttttcttttagcccttattatgtgtagcaagttacagctccagttgactgatgaggcaaaattgggttcatgttctaggccatctgactttgtttt

SEQ ID NO: 86740 - DNA, 601 bp, Human; identical to SEQ ID NO: 27202

SEQ ID NO: 86741 - DNA, 601 bp, Human; identical to SEQ ID NO: 27203

SEQ ID NO: 86742 - DNA, 601 bp, Human
catttttgctctgtcttttggaggaactcggctagtaccctccccaagaccaagtctgctgtcttcagggcttgttcctgcagaatcggagcgcggttttccaggagctgtgctttatccccttctcttttggccctgacattgtttccctttagatggagacactatgaattctcttctgggagagcacaataaaatgtcaactgattaactaaataaaatgtttcaaaaaatatgaaatttttccactagtctaatatttacatgttcatgggggaactttgatgcagaaaaaaaaaaatcctgtaatccccagtagcttggtgctgtcgcggtagagcaggtcgtggagttgctaatttggcctgggtgtccccacttggttccaccacagagggggcagcattatcttccacctacttgtgagatctactggttccaaactttccaaatccccaaaccaatgacttatttttctctcttttctatttctgtttcctaggaacgagtggaatatctctttctcataatttttacggtggaagcgtttttaaaagtaatcgcctatggactcctctttcaccccaatgcctacctccgc

SEQ ID NO: 86743 - DNA, 601 bp, Human
cagggcttgttcctgcagaatcggagcgcggttttccaggagctgtgctttatccccttctcttttggccctgacattgtttccctttagatggagacactatgaattctcttctgggagagcacaataaaatgtcaactgattaactaaataaaatgtttcaaaaaatatgaaatttttccactagtctaatatttacatgttcatgggggaactttgatgcagaaaaaaaaaaatcctgtaatccccagtagcttggtgctgtcgcggtagagcaggtcgtggagttgctaatttggcytgggtgtccccacttggttccaccacagagggggcagcattatcttccacctacttgtgagatctactggttccaaactttccaaatccccaaaccaatgacttatttttctctcttttctatttctgtttcctaggaacgagtggaatatctctttctcataatttttacggtggaagcgtttttaaaagtaatcgcctatggactcctctttcaccccaatgcctacctccgcaacggctggaacctactagattttataattgtggttgtggggtaagtatcactgtctgtttcttt

SEQ ID NO: 86744 - DNA, 601 bp, Human
atttggcctgggtgtccccacttggttccaccacagagggggcagcattatcttccacctacttgtgagatctactggttccaaactttccaaatccccaaaccaatgacttatttttctctcttttctatttctgtttcctaggaacgagtggaatatctctttctcataatttttacggtggaagcgtttttaaaagtaatcgcctatggactcctctttcaccccaatgcctacctccgcaacggctggaacctactagattttataattgtggttgtggggtaagtatcactgtctrtttctttccctttatcttaccagtgttgcgggacttttccttaagtcagctgaagacagggtcgttgtcagacggccacaaagatttaggctcgcagatgatctagagtgagaaaaatgagatttattttgctaaaaggaacagaaagggaaagagagactcagcaaagtgagagagtgcgcttcctgcccatgggcttcccgcctcgcaggttgaatccaaggttctacccaggaaaaggaggggtcaggcttctccctgctgcagttggtggcgtgaacttccgtggttccaccctag

SEQ ID NO: 86745 - DNA, 601 bp, Human
ttggcctgggtgtccccacttggttccaccacagagggggcagcattatcttccacctacttgtgagatctactggttccaaactttccaaatccccaaaccaatgacttatttttctctcttttctatttctgtttcctaggaacgagtggaatatctctttctcataatttttacggtggaagcgtttttaaaagtaatcgcctatggactcctctttcaccccaatgcctacctccgcaacggctggaacctactagattttataattgtggttgtggggtaagtatcactgtctgtytctttccctttatcttaccagtgttgcgggacttttccttaagtcagctgaagacagggtcgttgtcagacggccacaaagatttaggctcgcagatgatctagagtgagaaaaatgagatttattttgctaaaaggaacagaaagggaaagagagactcagcaaagtgagagagtgcgcttcctgcccatgggcttcccgcctcgcaggttgaatccaaggttctacccaggaaaaggaggggtcaggcttctccctgctgcagttggtggcgtgaacttccgtggttccaccctagtg

SEQ ID NO: 86746 - DNA, 601 bp, Human
aattgtggttgtggggtaagtatcactgtctgtttctttccctttatcttaccagtgttgcgggacttttccttaagtcagctgaagacagggtcgttgtcagacggccacaaagatttaggctcgcagatgatctagagtgagaaaaatgagatttattttgctaaaaggaacagaaagggaaagagagactcagcaaagtgagagagtgcgcttcctgcccatgggcttcccgcctcgcaggttgaatccaaggttctacccaggaaaaggaggggtcaggcttctccctgctgcagtyggtggcgtgaacttccgtggttccaccctagtgtgcactcctcccagtgcgcaggctggctggagtttctctggggacccctccccacctggctgtctcaccagtacatccctcttcttccttctgtgttatctcttttcaatttggtcctaactatgctgggcttcaggcaagaagaaaggatctgtgaaaatcactttgaattcagacttccccagagggacaggggctatgacccaagagcacccctctccaccactcccacacagcatgcacacacggttggacctgagtgctcct

SEQ ID NO: 86747 - DNA, 601 bp, Human
ggctaacacggtgaaaccccgtctctactaaaaatacaaaaacttagccgggcgaggtggcgggcgcctgtagtcccagctactcgggaggctgaggcaggagaatggcgtgaacccgggaggcggagcttacagtgagccgagatcatgccactgcactccagcctgggcaacagagcgagactccatctcaaaaaaaaaaaaaaaaaaaaaaaaacgcaggtgatgaagttccatcaacacatctgtcttgtaataggagggagcccattgcagcagattttaccttgagaagaagccrgttcctttgggctaatcccttgttactctgagcccagtgagtgctcaagtggctgccaccttggactctccctctcttgaagtcctggcagtctgcagagtcaaggtcagaatgtcaggagctctttatcccagaggcctatttttggaggatccttttgtgccatcccggaggagacacagccattgtggacgtctccagagcacccgccgttcaccatcttgtgagagtgcctggtctttactgcaggaaatgacgcaggaggacgtcgagatcatttgcaagttatttccttgtctc

SEQ ID NO: 86748 - DNA, 601 bp, Human
caacagagcgagactccatctcaaaaaaaaaaaaaaaaaaaaaaaaacgcaggtgatgaagttccatcaacacatctgtcttgtaataggagggagcccattgcagcagattttaccttgagaagaagccggttcctttgggctaatcccttgttactctgagcccagtgagtgctcaagtggctgccaccttggactctccctctcttgaagtcctggcagtctgcagagtcaaggtcagaatgtcaggagctctttatcccagaggcctatttttggaggatccttttgtgccatcccrgaggagacacagccattgtggacgtctccagagcacccgccgttcaccatcttgtgagagtgcctggtctttactgcaggaaatgacgcaggaggacgtcgagatcatttgcaagttatttccttgtctctggccatctggatggctcataaggttgcttggaaccacgttagggtttttgttgttgttgttgttgccttattttgcctggccaatgaatgacgcactttggccacatgaacctcaggaatatttgggtgatacgaggtgcactaaggttattagcatcattagccaggt

SEQ ID NO: 86749 - DNA, 601 bp, Human
agagggaggcatccagttgtgtgctcctgtttctaagccacagaggttaagatgccagcagttgcccagctcgtggttggtcttgcactgggacatatttggcacctagtctctcttctcctaagggctcttcatcctgtctaaatcagcccattcttgtaacaatcccccatcgctgcagggtgcagcttaccacctctcttcagctcatctcctttttctgcttcctttgcaatattaaatgggtagccctttgcttccctgtgtctcttggaaaatatctgctatccttggcccctcytctgtagctgtaggggaaggtttctcctggcctcccacaaagctgggggagcctaactcaccctagagaaaggtggacctgcctgcctactgcctgagtgccaggctgagagcctcatctctgcattgctattctggtggcacaagacacgtggcatttctttccttcctaaagcagaggcctcttggtggtgggattgctgaataaacacagagggactgtggcggcctcagatccacgtgcccctaccgagggaccgtggaatcctcagtggatcctcaggaggttccacgccagcca

SEQ ID NO: 86750 - DNA, 601 bp, Human
gttgcccagctcgtggttggtcttgcactgggacatatttggcacctagtctctcttctcctaagggctcttcatcctgtctaaatcagcccattcttgtaacaatcccccatcgctgcagggtgcagcttaccacctctcttcagctcatctcctttttctgcttcctttgcaatattaaatgggtagccctttgcttccctgtgtctcttggaaaatatctgctatccttggcccctcttctgtagctgtaggggaaggtttctcctggcctcccacaaagctgggggagcctaactcrccctagagaaaggtggacctgcctgcctactgcctgagtgccaggctgagagcctcatctctgcattgctattctggtggcacaagacacgtggcatttctttccttcctaaagcagaggcctcttggtggtgggattgctgaataaacacagagggactgtggcggcctcagatccacgtgcccctaccgagggaccgtggaatcctcagtggatcctcaggaggttccacgccagccagtgaggctttgttgcatccctacctccctagcagggtggaggccctgcctttcccattct

SEQ ID NO: 86751 - DNA, 601 bp, Human
ttgtaacaatcccccatcgctgcagggtgcagcttaccacctctcttcagctcatctcctttttctgcttcctttgcaatattaaatgggtagccctttgcttccctgtgtctcttggaaaatatctgctatccttggcccctcttctgtagctgtaggggaaggtttctcctggcctcccacaaagctgggggagcctaactcaccctagagaaaggtggacctgcctgcctactgcctgagtgccaggctgagagcctcatctctgcattgctattctggtggcacaagacacgtggcrtttctttccttcctaaagcagaggcctcttggtggtgggattgctgaataaacacagagggactgtggcggcctcagatccacgtgcccctaccgagggaccgtggaatcctcagtggatcctcaggaggttccacgccagccagtgaggctttgttgcatccctacctccctagcagggtggaggccctgcctttcccattctctgggcctcacgatcattccacagcctcacggtccttttcttctaaaagctccactgccggactacagatctgccagacacagctcccagagcagt

SEQ ID NO: 86752 - DNA, 601 bp, Human
ttccttcctaaagcagaggcctcttggtggtgggattgctgaataaacacagagggactgtggcggcctcagatccacgtgcccctaccgagggaccgtggaatcctcagtggatcctcaggaggttccacgccagccagtgaggctttgttgcatccctacctccctagcagggtggaggccctgcctttcccattctctgggcctcacgatcattccacagcctcacggtccttttcttctaaaagctccactgccggactacagatctgccagacacagctcccagagcagtccttcrgccaggcgtccacaccagagcccaaccctcagggaccagtgggcaccaagcagtggttttgcctttagaatgtctcattgaggagaaatacaccagccactcctacacccatgtttgaattttctaccctttcagaattaaaagcggatacttaataaagagtctcaacttgaggcaggagttaaaggcaagttgtctaatctccactcccttcaccgaatagtattttgtgaacctcttttactccgatcagcatattactttcctgcaggaaatactgggaacaaaatctggtttgca

SEQ ID NO: 86753 - DNA, 601 bp, Human
tgtggagaaagaagcccactcccccatcctggcaacttctgcctgggattcaaggcctcaccagctaacataggaagccatcaagttgccaggctgagagacactgcagatacggcctggacagggttctcaaacttcgttcggctgcagaacccactgttgagagtctcgctcagaggtccaagacacagaccagatagaagggaagctcctctggactagaggagccagaacgccagtcacgcagccagtctgtgcctgggggcctccatggagcgtttctagaccaatcccctcatcrctcagccctgcctggccctgaacttctgctaatgcatctggctaatcccccagctgcagcttcccatttctagatccagatacctggggcataagtcacttaagagctcaagcctattgctcctgaatgaaagctgccctggttcatagtttagatctgatatggagacccactcctaatacctgggctccctccttgatcccacgcccctctgttgaagaaacacgacccagcgtgtagtgcactctgtggcaatgaatctgtagcatcctctctgggtataaaggacagaaatcaccc

SEQ ID NO: 86754 - DNA, 601 bp, Human
aaccaactcaagacatgcattcgatgtccaagcaacaactcaaacttcaagaagttctcagcagaacgcttaatgtccattccgccatatctcatcattcctgttgctcatgcccaaactgttggaatcttctctgattcccctctctttctcacacctcacatctagtccatcagccagtcccactaactttatcttaaggtaaatctggtatctaacttttcctcactacctctaacaccaccacttgttctgagccacccagtgtctcgcgcctggatgactgccgcagctggtctcyggcctcgcccccgacaggggagtctcccacaacagcagaatgattcttttagacctgtagttagatcatgtcactctcctgctcaaagtcccccaatggcttctgtctcagagaggataccagcacccggtggggttccctatttcctctccgacttcctctcccacagttctcccctttccctgccctgctccagccacactggtcgctgctgttcctctaacgcacaccctgcccctcccttgggcccctggcttacctgcttcctctgcctggaacagtctccagatagtgaagtgg

SEQ ID NO: 86755 - DNA, 601 bp, Human
tggtatctaacttttcctcactacctctaacaccaccacttgttctgagccacccagtgtctcgcgcctggatgactgccgcagctggtctctggcctcgcccccgacaggggagtctcccacaacagcagaatgattcttttagacctgtagttagatcatgtcactctcctgctcaaagtcccccaatggcttctgtctcagagaggataccagcacccggtggggttccctatttcctctccgacttcctctcccacagttctcccctttccctgccctgctccagccacactggtcsctgctgttcctctaacgcacaccctgcccctcccttgggcccctggcttacctgcttcctctgcctggaacagtctccagatagtgaagtgggtcccgccctcacttcccataggcctctgctcaagtgtcacctgcagggagttctttgtgcagatttctcaggtgggaaggaaggcggccctcaccctgtctctgcagagcccctccccgctcctcctcctcagcactcatcactctaagctgcagtgtctgtttactgattgctcagtttattgtctgtctccctgctagaatgcaa

SEQ ID NO: 86756 - DNA, 601 bp, Human
ctcactacctctaacaccaccacttgttctgagccacccagtgtctcgcgcctggatgactgccgcagctggtctctggcctcgcccccgacaggggagtctcccacaacagcagaatgattcttttagacctgtagttagatcatgtcactctcctgctcaaagtcccccaatggcttctgtctcagagaggataccagcacccggtggggttccctatttcctctccgacttcctctcccacagttctcccctttccctgccctgctccagccacactggtcgctgctgttcctctaaygcacaccctgcccctcccttgggcccctggcttacctgcttcctctgcctggaacagtctccagatagtgaagtgggtcccgccctcacttcccataggcctctgctcaagtgtcacctgcagggagttctttgtgcagatttctcaggtgggaaggaaggcggccctcaccctgtctctgcagagcccctccccgctcctcctcctcagcactcatcactctaagctgcagtgtctgtttactgattgctcagtttattgtctgtctccctgctagaatgcaagttccatgaggggaag

SEQ ID NO: 86757 - DNA, 601 bp, Human
ccagcacccggtggggttccctatttcctctccgacttcctctcccacagttctcccctttccctgccctgctccagccacactggtcgctgctgttcctctaacgcacaccctgcccctcccttgggcccctggcttacctgcttcctctgcctggaacagtctccagatagtgaagtgggtcccgccctcacttcccataggcctctgctcaagtgtcacctgcagggagttctttgtgcagatttctcaggtgggaaggaaggcggccctcaccctgtctctgcagagcccctccccrctcctcctcctcagcactcatcactctaagctgcagtgtctgtttactgattgctcagtttattgtctgtctccctgctagaatgcaagttccatgaggggaagggctttgtccattttgctatagccccagtgtctggaacagtgcccggcacaccgcaggtgttcttgtttgttggaggagtgaatatgccagctcagacctaaagtggcagggctgaaagccctgtgtctcagttacgtgcacgtgtggttctaccccacttgagaccttcttgtttaaccactcaaccattcattc

SEQ ID NO: 86758 - DNA, 601 bp, Human
gaatgcaagttccatgaggggaagggctttgtccattttgctatagccccagtgtctggaacagtgcccggcacaccgcaggtgttcttgtttgttggaggagtgaatatgccagctcagacctaaagtggcagggctgaaagccctgtgtctcagttacgtgcacgtgtggttctaccccacttgagaccttcttgtttaaccactcaaccattcattcatttgcgcagcacgcacctcctgagcagccaccaaggccagcacaaaggagatttccatgggccaggaacaagtcaaagakggggggtatctagaaggaaggaggtggggaaacagagcacatggttgctggcacacctgggaggggcgctaggataccatggagaagccggagggctcctcaaggagataaggactggcaacagacttcacctgcttcccacgtttgtccagcgcttgtccagctcctgcctttatgacggcagagggcctgcccctcagctcgctcaggcctccctgggccatggtggcaccctgggcatggccaccacccacactgaggggatgtcagcttacaaccacccacagactccacgcacac

SEQ ID NO: 86759 - DNA, 601 bp, Human
tagatatgtagggtttttcttacaacaaataggttcattgggccatttttgacatctgcaattctagaccaatagtgttagaggccccaaaagttgcattttttttttttttttttttgagacggagtcttgctctgtcgcccaggctggagtgcagtggtgtgatctcggctcactgtaagctccgcctcctgggttcacgccattctcctgcttcagcctcccgagtagctgggactataggcacccgccaccacgcccggctaatttttgtatttttagtagagacggggtttcaccrgttagccaggatggtctcgatctcctgacctcgtgatctgcccgcctcagcctcccaaagtgctgggattacaggcgtgagccaccgcacccggcctaaaagttgcattttttaaatgcacatatatgtactaaatgtcattgaaatcttatgatcacaggttatggaaatagatgattgcgagggtacaagtccatgagtcatttatcaatttgttcaacaaaatcgactgagtacttactttatgtaagattttgttagccattatagcagatacagaagtgagtcagatgctaagtg

SEQ ID NO: 86760 - DNA, 601 bp, Human
cccggctaatttttgtatttttagtagagacggggtttcaccggttagccaggatggtctcgatctcctgacctcgtgatctgcccgcctcagcctcccaaagtgctgggattacaggcgtgagccaccgcacccggcctaaaagttgcattttttaaatgcacatatatgtactaaatgtcattgaaatcttatgatcacaggttatggaaatagatgattgcgagggtacaagtccatgagtcatttatcaatttgttcaacaaaatcgactgagtacttactttatgtaagattttgytagccattatagcagatacagaagtgagtcagatgctaagtgtgttctagagagcttgaagtgtagtagaagaaaaaatattcataaaaatgattatataaataaaaattggagctgtcaaaaaggaaagtttaggtaagatgtgcaatgtgatgaattctgtgacaagccatgcattggggacaccatactttggggagtggtgatagagaatcaggagagccttcttggagaaggtagcatttgggatggaacttgaaggatgagtgaggagaggcattccaggaaatcacacaaagg

SEQ ID NO: 86761 - DNA, 601 bp, Human
tagagaatcaggagagccttcttggagaaggtagcatttgggatggaacttgaaggatgagtgaggagaggcattccaggaaatcacacaaaggaaggagagtggccgtggccctggagatgcacactgtgaggctgcaaggctaacggcttgattacactgcagaggtgaaaatcagattggctcttccaatggggttctgtgtagttgaaagatttggccatttggcttcatagagactcttctacagtaacagaatcagttctctctgctgtgagcatccactctcccactgcagccrtgctgtggagcatgcgtattacaccaaagactaagccatatggaggaatcaacgttatacagccagatgaaccatagggagagttgtggttaaatatttgcaatgtatatgcaaggagtacatttgcttgtgaagcagtaagcaaggggtcgtttcctgctttccatttcatctcatatgccttctggagaagaactttcaggagggacttgataaagggagaagtcaaatggagatgagaaagatgtgtagggtctttgacgaaaactcagagcaacctagacttgatctgatgatgaa

SEQ ID NO: 86762 - DNA, 601 bp, Human
gctcagttaagtggtagctgttacattatattatattacatatgtagactgaaatagaggacaagatcattctcaagagacaacaaatatactttaaaagataaggaatattcaagagttaaatagcagtttgagaccaaaaatcaccagagaggcatgtgtatgattatttgacttgcatagtgtagatgatgaaatggattcaaggggagagtttaccagggactgtggcagtctgaaaagttttatgaaggaggacataccggagataagccctgaggtttatgtggaacaggcaggratggggatggaaggacatctgagggtgaaaaccttgtttgtttaggtcaccaatgtgggccagtctcggccagcacataggtgtggggtgcccaaacccattaccgaaaaggaagtatgggtcgtgagagccaggagacaaaagtccgcagtgagcagactgagctgggtcttggatggcacaccaagaggcagttttctaaacagccactgctgttcactctccatacaaaacgttcaaaaaaaccgcactgcagagacagctaagtgtcttggaaatctacaaaagaaggtcagaact

SEQ ID NO: 86763 - DNA, 601 bp, Human
cttgacaccaaacactcttttttaaaacattcttactgatacgatgaatattgacttaaaaattgctgctgcagaagttgaaaactcacctgagtgccaagtccccaggtgaaccacacgcatcccgagatgtagttttcctcccaggatgggttctcccctcctggggattagtcaccgtgaaactggccacactgattagcaagcggtgccagttaatcagacccactgagggcacattagggctgctaaaagcggcttttctgagtgttttcacactttgatggtttaaagccactcwtgctgtcctgtctgaaatttgctgttggtaaattgagccacagcagatttgcaatcccatcgtggctcccaggaaagtgttttctggcccagttggtgccgcattgtgcaagagaggaggctaggcagcaggcatggtccctgcaaacagctcctgaacctcgcttgcagttaaggacacctcccagtctggactgataagagaacatctttctggagcagatattcaaaatcctgtaactcagcccctgaaactgacatatcttggagtcccagagaagatcccagagtcagggaagag

SEQ ID NO: 86764 - DNA, 601 bp, Human
cctgaaactgacatatcttggagtcccagagaagatcccagagtcagggaagaggctcaaaccacagtgcttcactccccatcccttgctttttccactgcctgtgtcctcatgttcccagacttcctttaattctggttgatgtgatttaacactgaagtacccacaggatgctgctggtgcagctgagcacaagcctgggtaggcagaggacccagcctccagccctgcattcacccggacaagcctggagaccttgggcaggtctgccctccctctggactttgtcctgcatctgggrcttgaagggcctggactggctggcctctgcatccccttccctctcccacatgctcatccccaccgcaccaggctgtaccctcactgcttgcagaccttcagcctctccacccctgttctcaccccctctcatgtccttggacttggccctcattctcccctcactttctattttgcttcctcttgctttttatcccctttgtcttataggggtcttacaggccacatacccttaaacaacatgaggggacacttacaaagctacttatgaggacaggggcatgtgcagggggccacccct

SEQ ID NO: 86765 - DNA, 601 bp, Human
ccccgccttcccacccaggcagcctggggttgtgctctgcagatggggcagagcaccctggagggcagccagagacagcagggggtggcggggggcccttcacactgcaggaggcttgcctctaagaaacagaatttagaacagggtgggtcccacgcccagccccgccctgccccttagcacctgccaggcccaccctctcccccggtgtctcctgatctcccagtgtggacggtctttccccttgactgctgcatccccagttaagcaactctcttcccggcatcctcccaggtgcccmtgaaagacgcctgggccagcagctcaaggcccactcagagtcccgaccctgctgcgacttctctgttgccctgccaggtgctttgcctcggtttctcaatctacaaagagtgagtgatgggggtgccatggataaggaggagattctacctgtgcagccctgtgagctcccagcatccgagacctcttggagagggaccctgtgggttggcaggagccaccgcaccagataggaagggaagaggcccgccatgcggcaaagtgagctgatggacacagtaagcacactcacaggttcccg

SEQ ID NO: 86766 - DNA, 601 bp, Human
acagaatttagaacagggtgggtcccacgcccagccccgccctgccccttagcacctgccaggcccaccctctcccccggtgtctcctgatctcccagtgtggacggtctttccccttgactgctgcatccccagttaagcaactctcttcccggcatcctcccaggtgcccctgaaagacgcctgggccagcagctcaaggcccactcagagtcccgaccctgctgcgacttctctgttgccctgccaggtgctttgcctcggtttctcaatctacaaagagtgagtgatgggggtgccrtggataaggaggagattctacctgtgcagccctgtgagctcccagcatccgagacctcttggagagggaccctgtgggttggcaggagccaccgcaccagataggaagggaagaggcccgccatgcggcaaagtgagctgatggacacagtaagcacactcacaggttcccgcctctgctatagtggagtttcactgagaggttactgagtatcaacaacagtatgtggctgaactgggaacatctctattatttagtgttctagatacagcaggtaaaaagtcctcatggcaaagaatg

SEQ ID NO: 86767 - DNA, 601 bp, Human
tgtttgtcagggcagagaagaggagagtaacgtggcacaagttgtagacatcttccttctgaagacatgggtgattggaacagcatgtcatcaggtgagttttcagtgttgcttccagttctaagctgggataattctgagtattcttaaaatgtactgctgttggaggataatggaaaagcgctgaactcagaaaaagccttgggactgtgagcaccatcaactgcattgaggagacatccaaaagtataatgccttcttcaggctgtttttactagaccatatagtcctactaataaayacttgtgcaaaacagaaatacttttaaaaaaataatatatttattcacttaattttcccagaaataatgccttgatcatatgttttccccagaaattgttagacttaccttctatggtcaacaagagctttcctgaatttcttgagatttagtgaaagcaggtagatgtaaactatattaattacattgcattttccagaaataaaaaaaagcttgaatacccctgaaattcctctgagtattatcatcctgtgctttgttgatagagaatagcagtgacctaataatttcttttttaac

SEQ ID NO: 86768 - DNA, 601 bp, Human
gaggtgggagagtaggtcctaaaataagagcaggtatttattaagcactcatcttgagcccaggactgtggcaggtggtataatcatcacaagagacaagagggcttcttaaactcaggaagctccataatggattcctttttgtgtctggagacctccaaacatgaaatcacagacaaggtgatgactgattaaaaataatggcaataataaaggccacttaggcttataagtgacccaggctttctaaatgttggaaagaaaaatgaggggggaatgaaatgaagatccagtgaggccrgcgtcctgtgaagtgatcaatacgcagaacgtgagccccatgtgcctgttattattggttgattctctcgtgctgattcatgacacttagtggttaaagactcagatggtggaatcccactacctaggttcaaattcccagagccaccatttattagctgtgtgcctcgatttcctgatctataaaatgggggctaaaattacacctgcctgcttcctggagttgttgtgaggattaaataagtaaatgcttttaaagcaatagaattgtgtgaaacacacaggaagcactcagcaaata

SEQ ID NO: 86769 - DNA, 601 bp, Human
ctctcgtgctgattcatgacacttagtggttaaagactcagatggtggaatcccactacctaggttcaaattcccagagccaccatttattagctgtgtgcctcgatttcctgatctataaaatgggggctaaaattacacctgcctgcttcctggagttgttgtgaggattaaataagtaaatgcttttaaagcaatagaattgtgtgaaacacacaggaagcactcagcaaatactagctactagtactctgtgggtccaactccctatctgtctacctcaggctccaagttggactgrtcagagaaggggaccttctatacttgatcttttttttttttgagaccgagtctcgatctgtctcccaggctgcattgtcaagatctcggctcactgcaaccaccccctcccgggttcaaatgattctcgtgcctcatcttccaagtagctgggattataggcatgtgccaccacgcctggctaatttttgtattttttggaaagacaggatttcaccatgttggccaggcaggtcttgaattcctgacctcaggttatctgctctcctcggccttccaaaatgctaggattacagttgtg

SEQ ID NO: 86770 - DNA, 601 bp, Human
gtctgctgctggagaattagctaagcttttgtttatctgaacatgtcttttgccatcctcttttgacgaatatttttgctggtatagagttcttgattgacaggtttttttttctttcagaactttaaagatgttccattttctcctggtttccactgtctctgatgagaagtcattgatttttttttttctttctgagacggagtctcgctctgtcgcccagactggagtgcagtggcacaatcttggctcactgtaacctccgcctcctgggttcaagcaattctctgcctcagctccygagtagctgggattacaggcacctgctaccacacctggctaatttttgtatttttaatagagacggggtttcaccatcttggccaggctggccttgaactcctgacctcgtgatccacctgcctaggcctcccagagtgctgggattacaggcgtgagccaccatgcccggcctgatattattgttattatttccctgcacataatgtttcttcctttgctgactgcttttaaaattttctctctcagttttcagcagtttgactatgatgtgcatcattattatattcattatatttgt

SEQ ID NO: 86771 - DNA, 601 bp, Human
tttgtttatctgaacatgtcttttgccatcctcttttgacgaatatttttgctggtatagagttcttgattgacaggtttttttttctttcagaactttaaagatgttccattttctcctggtttccactgtctctgatgagaagtcattgatttttttttttctttctgagacggagtctcgctctgtcgcccagactggagtgcagtggcacaatcttggctcactgtaacctccgcctcctgggttcaagcaattctctgcctcagctcccgagtagctgggattacaggcacctgcyaccacacctggctaatttttgtatttttaatagagacggggtttcaccatcttggccaggctggccttgaactcctgacctcgtgatccacctgcctaggcctcccagagtgctgggattacaggcgtgagccaccatgcccggcctgatattattgttattatttccctgcacataatgtttcttcctttgctgactgcttttaaaattttctctctcagttttcagcagtttgactatgatgtgcatcattattatattcattatatttgttctgcttggagttttctgagcttctca

SEQ ID NO: 86772 - DNA, 601 bp, Human
tctctatatatatatatctctctacacacccacatatatatagctgttttcaaatcgttgtctgccaagtccaacatctgaacaatctcattttttgtttcctattgactgcttttttccttgactatcacattttatatttctttatatgtctagtgatttctttttaccgaatattagaatcatggataatatgttgttgtgactctggatcttttcatattcctaagagtattggttcatcagcagacagtttaccatgaacgtgtgtaggcttggttttatgcttgttggtgctgasacattgaaagcccaaacccctcaacctccacatttaattttcccctcctgatgttgtcagggcaatgattttggctttgccaggatggatctagagtgggtctcactgtagacaaagggccttactcccaggaggtgcccttgcagtgtcagagtcatctgtccagggtggtaatgagatgttaactaggtctctccacaatttcagggccgtaagtccaacctcctgacactgctttttccccagcactgattaacctgtaccatctcttttctgctgtcaaccctaaaccagctgcta

SEQ ID NO: 86773 - DNA, 601 bp, Human
acattccaacctgatttctgccttctcaattccatggggctgcagtgttgtgcttgaactgtagctctttgtgctgtcctcgggaaactgttcttaattatagtatattagataatataatgttatatgttatattttactttatatgtcacacatttactgaggacttattgtgtataaggcacagtagtaattggaagaaggaaaggtactagaatcttgctttatttggaaaataacaacttagaaaattttagagccagattgcattttctcatccaatgtccaccttttaaagatrttgaaacctggacccaaaaggtgacatgacttgtcaaggtcacacagttattgatagcagaagaggaaatagcctggcattttcccccactaaatccctccaaaaatatattttaaaagaaaatctaagcatgatgtttagaaatttttaccactatagaaaatttggttagtgccaaagtccctattgatgcaatagtgatttgagccagaattagaaaataagtaagtatgtgaccctaagagcattttgttcgagttacatagaaagattagcttatggcgtagagttaccgtaagt

SEQ ID NO: 86774 - DNA, 601 bp, Human
aggccaggcgcagtagctcacgcctataatcccagcactttgggaggccgaggcaggcagatcacttgaggccaggagtttgagaccagcctggccaacatggcgaaaccccgtctctactaaaaatacaaaaacttagccagacatggtggcacacgccggtaatcccagttgctcgggaggctgaggcaagagaatcacttgaacctgggaggcgcaggttgcagtgagctgagatcacgccattgcgctccagcctgggcaacaacagcgaaactccatctcaaaaaaaaaaaaaaaagaaagaaagaaaaagaaaaaaagaaatgcaggccactttttctttcagaattggcagttgagatgattcagatcaactgtcctgccgaggacaattagaaatgctggacaaaatattctaaatcttctttctggagcttggaaaagatgcctgatagaaacaaatgtgaatcctctgtggagaaagataacatcatcaacattttcaaattactttgaaaaccaattgtgtgaaaataaggttttggctgggcgcggtggctcacgcttgtaatcccagcactttggtgggccgaggcag

SEQ ID NO: 86775 - DNA, 601 bp, Human
gaaagataacatcatcaacattttcaaattactttgaaaaccaattgtgtgaaaataaggttttggctgggcgcggtggctcacgcttgtaatcccagcactttggtgggccgaggcaggcggatcacgaggtcaggagatcgagaccatcctggctaacacagtgaaaccccgtctctactaaaaatacaaaaaattagccgggcgcagtagtgggcgcctgtagtcccagctactcgggaggctgaggcaggagaatggcgtgaacccggtaggtggagcttgcagtgagccgagatcmcgccactgcactccagcctgggcaacagagtgagactccatctcaaaaaaaaaaagaaaagaaaagaaaagaaggtttcattcatgataccaaataactatatacacaaggagacaaagtaacctgagtgaaaacggggagaaactatagaccatagaaatagacccacagggaattgagatattggaattgtcagatatagacttgaaaataactgtatttaccacattcagagatatcaaagacaggactggtaattttccaaagaaccagatatggaaaagaaccaaatgtaaattt

SEQ ID NO: 86776 - DNA, 601 bp, Human
caaattactttgaaaaccaattgtgtgaaaataaggttttggctgggcgcggtggctcacgcttgtaatcccagcactttggtgggccgaggcaggcggatcacgaggtcaggagatcgagaccatcctggctaacacagtgaaaccccgtctctactaaaaatacaaaaaattagccgggcgcagtagtgggcgcctgtagtcccagctactcgggaggctgaggcaggagaatggcgtgaacccggtaggtggagcttgcagtgagccgagatcacgccactgcactccagcctgggcracagagtgagactccatctcaaaaaaaaaaagaaaagaaaagaaaagaaggtttcattcatgataccaaataactatatacacaaggagacaaagtaacctgagtgaaaacggggagaaactatagaccatagaaatagacccacagggaattgagatattggaattgtcagatatagacttgaaaataactgtatttaccacattcagagatatcaaagacaggactggtaattttccaaagaaccagatatggaaaagaaccaaatgtaaattttagaaatgaagaatacaatcactg

SEQ ID NO: 86777 - DNA, 601 bp, Human
tacagtttgccaccaatagggaggcagcacagagggacggccatcgtgatgcaatcacttccaatggattagagctgtcatgagagatgcactgttgagaaggattgtgaggccccatctggaccagagggaaggagcagcatctgccatgacgcgggccaacaagtggcacatgtgtgcagtgtagttgtcattttgcctggataatggctaaggaatggaagtggtagcttcaagttggcttggcttctaactccaactctgccatttaccaagtgtgtaatctgggacaatttatctrtcttacctaagcctcatttcttttatctgtattaagacggctggggaattaaatgaaacaatgtatgtaaagcacttatgtggtacccagcaggtgccgagtcctcgggaaatggtagttaatactattattgttgttgtttgctttagatcatcttgtctgcctttcaccatatgcagttttcttctaacacagggtttcttttatatctttttctctgaatttctcttttcaatccacattggtaatataaaaaattaattcaacttgaaggctgatattttaattactcctaaagtt

SEQ ID NO: 86778 - DNA, 601 bp, Human
accatatgcagttttcttctaacacagggtttcttttatatctttttctctgaatttctcttttcaatccacattggtaatataaaaaattaattcaacttgaaggctgatattttaattactcctaaagttttaatttattggggaaccagttacccaccatccctttgctaagacaagaaccctcctttagtgttcctcataccatgtgtgggatgcagaatttattaatctggaaaggctaaattaaaaataaatgaaaatctctaatgaataaggacactctaatgagaacatgcaraaatcataaaacttgaggctgtaggaaagctatccaggcaatagttctttccccgtttataggaagcttcttttcccagtaagaaaatgcattagtcacttttgaagctcagcttgataaacttactcctttccccaagagagaactatctgccttcctagttctagacctattttcttttgaaagccattaagcctgtgagaccattaaaagtgtctgttacttcatcagccaaatgaaggcagaaaacatgatctgtgagattcatcacgtctccagcttctagccagtgcaacatga

SEQ ID NO: 86779 - DNA, 601 bp, Human
tttctctgaatttctcttttcaatccacattggtaatataaaaaattaattcaacttgaaggctgatattttaattactcctaaagttttaatttattggggaaccagttacccaccatccctttgctaagacaagaaccctcctttagtgttcctcataccatgtgtgggatgcagaatttattaatctggaaaggctaaattaaaaataaatgaaaatctctaatgaataaggacactctaatgagaacatgcaaaaatcataaaacttgaggctgtaggaaagctatccaggcaatarttctttccccgtttataggaagcttcttttcccagtaagaaaatgcattagtcacttttgaagctcagcttgataaacttactcctttccccaagagagaactatctgccttcctagttctagacctattttcttttgaaagccattaagcctgtgagaccattaaaagtgtctgttacttcatcagccaaatgaaggcagaaaacatgatctgtgagattcatcacgtctccagcttctagccagtgcaacatgattcatggagatcagaagtaagcgtgggctagtagtcacaacctg

SEQ ID NO: 86780 - DNA, 601 bp, Human
aataaatgaaaatctctaatgaataaggacactctaatgagaacatgcaaaaatcataaaacttgaggctgtaggaaagctatccaggcaatagttctttccccgtttataggaagcttcttttcccagtaagaaaatgcattagtcacttttgaagctcagcttgataaacttactcctttccccaagagagaactatctgccttcctagttctagacctattttcttttgaaagccattaagcctgtgagaccattaaaagtgtctgttacttcatcagccaaatgaaggcagaaaacrtgatctgtgagattcatcacgtctccagcttctagccagtgcaacatgattcatggagatcagaagtaagcgtgggctagtagtcacaacctgatgatgacagtggtgattgtcaccaccacaaatgctgaaaggagcactcatttttagaagcagtcaggtatgactttggaagatgaggacccagagttggctagtgagttatagtaagaggatatttatctgatcactatccctgggagggaacttgttggctcacaaaacttagaagccctccaggtggaatacctcctcctggct

SEQ ID NO: 86781 - DNA, 601 bp, Human
atggagatcagaagtaagcgtgggctagtagtcacaacctgatgatgacagtggtgattgtcaccaccacaaatgctgaaaggagcactcatttttagaagcagtcaggtatgactttggaagatgaggacccagagttggctagtgagttatagtaagaggatatttatctgatcactatccctgggagggaacttgttggctcacaaaacttagaagccctccaggtggaatacctcctcctggcttaatggaaaggtgatggtggcacatagaaagccactctgtcttatctgcgagycatcctacagttgcgctaccacatctgctctccacccttccccactctgctctctggctggggagtcgaccagatggcctccatcaacaggctgcctcatctccagtctgtagttgggttcagtcgatggggagccgagcaagagatcagcaggtgggagtagggtgaggtcaggttcttctgtccccagatccttccctgcaggtctgggctggcattgtcacagcctctccgagtggtcctttatacagaatgctgtccttcccactttctgtaaccactctttccacttgcttcttc

SEQ ID NO: 86782 - DNA, 601 bp, Human
ggaaaacttcattctagattcccctgtgggagaagctggtgtttgatctacattttcttagaatctgcatcgcaaatccaaggatagtgaggttcaagggcagttatggggctcggtgggcacagtaaggacagtgcccttcacttgaacacctgttttttttaagtttttaaaaattgttttaaattttctttttgttttttagagacagggtcttgttctgtcacccaggctggagtgcagtagtatgatcatagttcactgtaaacttgaactcctgggctcaagtgatctgcccacytctgcctcctgaagtgctgggattacaagcctaaagccactgtgcctggccttgaacacctgtcttaagagaaatctatttctttcagatgacatccaattctaagaggaaggacttgtagcgaagcttagaatttgcccaccatctagtgactctttttgtttggatttggctaaagtttatttggaaatacagaaggcataacttgctttggtagggccagcctctcagtcagccatcattcagctaatcagacatctggattaagcagtatggctttctcttccattctgcaaggac

SEQ ID NO: 86783 - DNA, 601 bp, Human
ttctgcagcctccatgccaaaggaggaccctcgtggtaccctattctgcttctttaaggctcttcacagagtttattatacatcagttgcatgattatttgactaatgtttggctgcctacaagctctgtgagggcaaggcctgcagggcttgtagtcaccaccgtattcccatctctagcacgcaagcatggctcatggcctgtagagcttagctcagtaaatagtctttgagtgaaatgaaggtattgggttaggtgatcccaaagtcctcttcctgtcatggcaaactctgagtccayctatgagaaacttgtacccaccaaccccctaaacccaaacttctcttttcctagttcagtgattctcagcactgtcttctgatgaattctgtcatcaagcctccttgatcgttttcatactttcctaaggcttggctggaatctttgagtttgaataattgggaatgtgaaatgttcatgcctaaacaccaacagaaaagcagagcgtcaatgtggaatccaaacaatggaatctaacgttggcaatgatctccaattctagggtcttcaacagtttctccctgtgccctcccatctcat

SEQ ID NO: 86784 - DNA, 601 bp, Human
ctcagcactgtcttctgatgaattctgtcatcaagcctccttgatcgttttcatactttcctaaggcttggctggaatctttgagtttgaataattgggaatgtgaaatgttcatgcctaaacaccaacagaaaagcagagcgtcaatgtggaatccaaacaatggaatctaacgttggcaatgatctccaattctagggtcttcaacagtttctccctgtgccctcccatctcatgtgaaatgactcaaaatatgaattcaaaagagggaagtatgggttgaagattacatgaaaagaayagagtccttaagaggagccttgaatcaggcacattaccttccagccccaggaagttctcattttcctctgctcataaaggcattttcatactcttttgtgatagtatctctggggccctgagcagaacacttcatcccaaaagtagggcttggtgagatgctgttttataaagcaaaagaggatgtgatctgttgtcagccctcgtcagtcatggtggacaatatggaccaggtaatggaagcaccaactttggccaatctgggcatctccaggctaacctcaaaaccaccgtagagaaa

SEQ ID NO: 86785 - DNA, 601 bp, Human
agcactgtcttctgatgaattctgtcatcaagcctccttgatcgttttcatactttcctaaggcttggctggaatctttgagtttgaataattgggaatgtgaaatgttcatgcctaaacaccaacagaaaagcagagcgtcaatgtggaatccaaacaatggaatctaacgttggcaatgatctccaattctagggtcttcaacagtttctccctgtgccctcccatctcatgtgaaatgactcaaaatatgaattcaaaagagggaagtatgggttgaagattacatgaaaagaatagrgtccttaagaggagccttgaatcaggcacattaccttccagccccaggaagttctcattttcctctgctcataaaggcattttcatactcttttgtgatagtatctctggggccctgagcagaacacttcatcccaaaagtagggcttggtgagatgctgttttataaagcaaaagaggatgtgatctgttgtcagccctcgtcagtcatggtggacaatatggaccaggtaatggaagcaccaactttggccaatctgggcatctccaggctaacctcaaaaccaccgtagagaaaggt

SEQ ID NO: 86786 - DNA, 601 bp, Human
gaaaagcagagcgtcaatgtggaatccaaacaatggaatctaacgttggcaatgatctccaattctagggtcttcaacagtttctccctgtgccctcccatctcatgtgaaatgactcaaaatatgaattcaaaagagggaagtatgggttgaagattacatgaaaagaatagagtccttaagaggagccttgaatcaggcacattaccttccagccccaggaagttctcattttcctctgctcataaaggcattttcatactcttttgtgatagtatctctggggccctgagcagaacamttcatcccaaaagtagggcttggtgagatgctgttttataaagcaaaagaggatgtgatctgttgtcagccctcgtcagtcatggtggacaatatggaccaggtaatggaagcaccaactttggccaatctgggcatctccaggctaacctcaaaaccaccgtagagaaaggtgccagacattgctttctgcaatggacggcttctcttgactttttaaggagaaacagtgtgatttatagatgcaggtcctctaagcctttcctaaccggaattgtcaagttgcaccccagagggaatg

SEQ ID NO: 86787 - DNA, 601 bp, Human
ctcccatctcatgtgaaatgactcaaaatatgaattcaaaagagggaagtatgggttgaagattacatgaaaagaatagagtccttaagaggagccttgaatcaggcacattaccttccagccccaggaagttctcattttcctctgctcataaaggcattttcatactcttttgtgatagtatctctggggccctgagcagaacacttcatcccaaaagtagggcttggtgagatgctgttttataaagcaaaagaggatgtgatctgttgtcagccctcgtcagtcatggtggacaatmtggaccaggtaatggaagcaccaactttggccaatctgggcatctccaggctaacctcaaaaccaccgtagagaaaggtgccagacattgctttctgcaatggacggcttctcttgactttttaaggagaaacagtgtgatttatagatgcaggtcctctaagcctttcctaaccggaattgtcaagttgcaccccagagggaatgcgggcagcactgtaagaggaagaaaggaaatccatgtctgccggctaaactccatcctccccttttcccgagcccagcactgaatgatgccact

SEQ ID NO: 86788 - DNA, 601 bp, Human
agcaaaagaggatgtgatctgttgtcagccctcgtcagtcatggtggacaatatggaccaggtaatggaagcaccaactttggccaatctgggcatctccaggctaacctcaaaaccaccgtagagaaaggtgccagacattgctttctgcaatggacggcttctcttgactttttaaggagaaacagtgtgatttatagatgcaggtcctctaagcctttcctaaccggaattgtcaagttgcaccccagagggaatgcgggcagcactgtaagaggaagaaaggaaatccatgtctgcyggctaaactccatcctccccttttcccgagcccagcactgaatgatgccactgcccaaggccccatctccctggaaggtcttcctggtaccttgagagtctttccacccgccaagaggcagtcacttgacatgaactccaaactagcgagactgaatttctaggttatgtgctgtttgatctttgcatggaaccgtatgttccaaattttccagtagagctctcctgtcacatactcagtcctattggtcccataagtacacatgtgtttgtcagatcttaccctgatgtagggctagaa

SEQ ID NO: 86789 - DNA, 601 bp, Human
ggtggacaatatggaccaggtaatggaagcaccaactttggccaatctgggcatctccaggctaacctcaaaaccaccgtagagaaaggtgccagacattgctttctgcaatggacggcttctcttgactttttaaggagaaacagtgtgatttatagatgcaggtcctctaagcctttcctaaccggaattgtcaagttgcaccccagagggaatgcgggcagcactgtaagaggaagaaaggaaatccatgtctgccggctaaactccatcctccccttttcccgagcccagcactgartgatgccactgcccaaggccccatctccctggaaggtcttcctggtaccttgagagtctttccacccgccaagaggcagtcacttgacatgaactccaaactagcgagactgaatttctaggttatgtgctgtttgatctttgcatggaaccgtatgttccaaattttccagtagagctctcctgtcacatactcagtcctattggtcccataagtacacatgtgtttgtcagatcttaccctgatgtagggctagaaaaacaggctcatcacatgcgtgggccaatagtgatcttgtgt

SEQ ID NO: 86790 - DNA, 601 bp, Human
cctcaaaaccaccgtagagaaaggtgccagacattgctttctgcaatggacggcttctcttgactttttaaggagaaacagtgtgatttatagatgcaggtcctctaagcctttcctaaccggaattgtcaagttgcaccccagagggaatgcgggcagcactgtaagaggaagaaaggaaatccatgtctgccggctaaactccatcctccccttttcccgagcccagcactgaatgatgccactgcccaaggccccatctccctggaaggtcttcctggtaccttgagagtctttccamccgccaagaggcagtcacttgacatgaactccaaactagcgagactgaatttctaggttatgtgctgtttgatctttgcatggaaccgtatgttccaaattttccagtagagctctcctgtcacatactcagtcctattggtcccataagtacacatgtgtttgtcagatcttaccctgatgtagggctagaaaaacaggctcatcacatgcgtgggccaatagtgatcttgtgttcacagaacgtttgtcagcagttgcttcaccaggcttgtctagggcccattttctttcaccaaca

SEQ ID NO: 86791 - DNA, 601 bp, Human
ctccctggaaggtcttcctggtaccttgagagtctttccacccgccaagaggcagtcacttgacatgaactccaaactagcgagactgaatttctaggttatgtgctgtttgatctttgcatggaaccgtatgttccaaattttccagtagagctctcctgtcacatactcagtcctattggtcccataagtacacatgtgtttgtcagatcttaccctgatgtagggctagaaaaacaggctcatcacatgcgtgggccaatagtgatcttgtgttcacagaacgtttgtcagcagttgyttcaccaggcttgtctagggcccattttctttcaccaacatgagcagccagccctgaagaaggcccgacactcgcttatcagcggtgagcatggcctatctgagaacacttgggtggagaaatgtcgtgtattttccaaattagaacttgagttggaggagctgtttctggggcagctgtgagccaatcccaagaagctgttaaacatccaggccctgagagccaaactctacatggcagggtagagaggaggatgtctggccgcacgccttcacaagccagcctggctctgccacccca

SEQ ID NO: 86792 - DNA, 601 bp, Human
tcattcttgtggtttctgtcttctgaaggcaccccgtgctcacgcacgtgacttggctccatgtgcatggagtccctccccacgtgcctgagacacaaagataagaagatgtgatgagactcaaggagctctcagcgaggcagggaatggctttccaggcaggggagccgcgtgcgctgggattggaggcacgaagccagagaactgcggggtgtattgctcaagcctagggtaaaaactgggagtcatttgagaccaaactggggaaggaggcaggttagtttacctgcaggtgacaggragtcactgggtgactttcagctacaaagtgacatgttccagtgtgtactttaggaagagcattttaagtgtagcttgaagactgggcaacactggaacccgggagaccagttgacaaaatgacgagcaccaaggggacagagaggaggaaaacgagtcatggatggaaaagctaacagtggctcttctcctgggggcaggacaatgagtcattgcttttttcttcttccctgtgttctgcaatttctctataataagtattttctgttttctctataattagcatgtattatttatacag

SEQ ID NO: 86793 - DNA, 601 bp, Human
atccttccttttattcaggttgatttatagctagctcagaaccaataaatttatatgaattgtgtggccctgtgagagctcattttaagactccttaaaaactgactgtggtatgtctgaagttcatgcagttgtattgaaattatcaatgacccatttgacccaaactcctcaggaagtctcagacatgtggagtctcaaagattccccatcagttcagcagtgaatgatggtgaggccctcactaacaaaatgggggagagcgaaatggtagaattcagccatcgagccaaagatggcrgccctgctgtgcaatcagaggtctgtgcaccacagagtaaggagaggggctccaaagctgcaggcaatttccatcatcctaacgagaaagcagtccaagagtgttttctgccggtggtgggctcctgcaagggcgggtgaggataagcggccctgaatactggttggaagcccaaggctttgttaccaggcctcagaggccctggatagtcagaaaatggtgagcatggtagacaaagaaagcatggcacggggagggagccgtcctgaaggccatagccgtagggcccagtgaagaggt

SEQ ID NO: 86794 - DNA, 601 bp, Human
cacaatcgggcatatattttcaagtagactctattctcctaagaattatctcttacttaaggattaatatttctcttctggtcttcctcttgggagtgaacagtttcagatttaaagccaccgactgagaatcagcccaccggccagtcctgttcaatgcacagcctaacgtaggcaaagtaatcacacttacgattgttttgatatatatgaaaccagaaaataatcctgggttatctgttgtctctaaatgaagaactataagcaaattctctctctctctctctctctctctctctccctttggaagtgtattttcattgttataggcaatcatttatttgttggaactggggtctcttctgtctgttattgtcattactttgtctaaggacaggacaatgtccttgatttcacaaacttttgtgaattccacaccgttaccttccatagccagagccaagactttctcagtgttttcccataatggaaattcttagatcagtcaggtcttgtttaaatttaccatcaatctccacactcaaaatataagtcacatcttcattcattaatttgctgggagctattcccagcacgtgaa

SEQ ID NO: 86795 - DNA, 601 bp, Human
agtctttgcattggtattgtccttaccctaaattctggtattccaatacaagtgtctatagaactctaccaccagaaaaagaaaatatggacttctaatcgctttctgggtcagtttccacttgcagtggtggcatcatcattattttttgattggccatttgattttgaggctgacatgttgcagcagaatgggcaatagaaatcaattactaagattaaaatacagcttttacaacagtgagtggaaaggactgaccttctaaattaacagcagcctaaatggaaagcctactttcttrtgttgcttaattcacatctggggacctgatttaaacatgtcttgcgctgttgttgccatggttgctttgcccatcccatcaacctcatcctgtcacttttctctctgacttctttctctgcccacatctctccctccctgctgctcccgtctcctgtcttcttctggccatttgagatgttccagcagaagatgacccttccccttgtgcgctggaaacgggccacgggcggcagtgccagaacggcacggtgtgcaagcccggctgggatggtcccaagcacggcatcaccaactttga

SEQ ID NO: 86796 - DNA, 601 bp, Human
ctgatttttttttacaagttaaaaattaaacttaaaaattaggttataaaaaatacttaatgagaaatcatctaaaagaaagatttttttagagtcacaaatagtgtgttctctagaacctggaatttgttttggttcagccaacaggagactcttggaacaaaaatctaatgagttaacttttcataagtcacttgtcagctccacccttcatcttgccatcccactatgtgtctggatgtgcggagaaggtatttctattaaattcacacacacacacacacacacacacacacacaccacagctattaatctcttggtattggtgctgctgaaatatccctcgtttatgacaaagaccttttgcatccaagcaggttgaattgggtgttttaccctatttttgtctactccatcttcacaaagccacctcctttcactgcagaatatagagttgctgaaggcttcataaaagttagagctgaattctgctgatgacctaggagtcattctaagtgaggagctgagaaaccctcaagtaacccagaaacagtgtccagggccctttctcaggtatcggagtagagaccgtgttaggacc

SEQ ID NO: 86797 - DNA, 601 bp, Human
tagtgaggctgtttcagccaaggcaggggccgtcctgccagtacttgggcctggaggccctcaaggctacagacaatgagctgactttccttaggaaagtcaggagacctgaggaacacggcttaatggctctagaagacctatcccttatttcacctctaaataagggtgtcagcaatctgggtcatttttttttttaaatctgactttattctttgtcttcttaatagctccatttcagctgctttaggacatcaatctcatgactccaggcatcgccctacttcagagccacccagcyttgtgtgctctctactcagctgtccccccaaagtaggtggaccagaataaagaggagaaagtaagagggaagtgaaaggagaactttcctttcagaccagagccaggcaggccagagaatcaccttctgtggcagccgagcattgctcacccaggcagtggggttctgaggaccaccctggcctcgtccgtctccatctctcatctgtcctcctgcttcctgccctcgcctgctgttccccatctcgaacctctaaaaaaccagcccacagcccaggggggaccaaagcagcagtgtggg

SEQ ID NO: 86798 - DNA, 601 bp, Human
ttttttttaaatctgactttattctttgtcttcttaatagctccatttcagctgctttaggacatcaatctcatgactccaggcatcgccctacttcagagccacccagctttgtgtgctctctactcagctgtccccccaaagtaggtggaccagaataaagaggagaaagtaagagggaagtgaaaggagaactttcctttcagaccagagccaggcaggccagagaatcaccttctgtggcagccgagcattgctcacccaggcagtggggttctgaggaccaccctggcctcgtccrtctccatctctcatctgtcctcctgcttcctgccctcgcctgctgttccccatctcgaacctctaaaaaaccagcccacagcccaggggggaccaaagcagcagtgtgggacggcgagggggacccatgagtttcctcttatggtcctggctgtctgtggggccatgaccttgaggtctgtagctccccctttgaagtccttcatatgctggaagcctctcaccttgtgtgtggcgcagaagaaaggattcccagactaagctcgggccttaggaaatctccaaggcgcgtgggtttgtg

SEQ ID NO: 86799 - DNA, 601 bp, Human
ctctctactcagctgtccccccaaagtaggtggaccagaataaagaggagaaagtaagagggaagtgaaaggagaactttcctttcagaccagagccaggcaggccagagaatcaccttctgtggcagccgagcattgctcacccaggcagtggggttctgaggaccaccctggcctcgtccgtctccatctctcatctgtcctcctgcttcctgccctcgcctgctgttccccatctcgaacctctaaaaaaccagcccacagcccaggggggaccaaagcagcagtgtgggacggcgasggggacccatgagtttcctcttatggtcctggctgtctgtggggccatgaccttgaggtctgtagctccccctttgaagtccttcatatgctggaagcctctcaccttgtgtgtggcgcagaagaaaggattcccagactaagctcgggccttaggaaatctccaaggcgcgtgggtttgtgtggcctccaaggctgcattttctgtgaggttaaatgttcacaaaatttaaggggtgtgaggaactagtgaggaaagatttcattttgaggaagttgcctgggcgccatcgagcccaac

SEQ ID NO: 86800 - DNA, 601 bp, Human
cctccagcctgggcgacagagtgagactccacctcaaaaaaaaaaaaaaaaaaaaaaaaagtaaagcaatactcatttagaggaaaagaaagggactgcttctgaccctccttagcaggacttactctgagagaggaaaagctacaaggacacccacaggctccccctgaccttggatccaggtttccctcttcctcagcaggtgcctgggactcccattccagggctgtctcaaccccattgccttccctgtatcagagagtccgatacacaacagaacccttacacaagtaggcgctcrgtaaatacttgttgaacaaacgtggactctgatgtgaccactgctaagaatagtcaaagaatgacctcacggttcccatcgtcaaatgggacctgcagaccacagcccatcgtggccagcacggctgtcagtgtggcctgtggtcaggcagctcatgtggctctcatgcctttctctccctaatctcatgtcaccaatcccacccatcctgtattggctcgggtttgtttttcttctcctggtgctgaagtctggtgtggtttcctttgcactgttggttcagacagttaccttatcgct

SEQ ID NO: 86801 - DNA, 601 bp, Human
aaatgggacctgcagaccacagcccatcgtggccagcacggctgtcagtgtggcctgtggtcaggcagctcatgtggctctcatgcctttctctccctaatctcatgtcaccaatcccacccatcctgtattggctcgggtttgtttttcttctcctggtgctgaagtctggtgtggtttcctttgcactgttggttcagacagttaccttatcgctaaaggaaagctcccaggctccctgggatggggacagtgtctgacacacaaggacctttcaccccgcctctcctaacagatgctmttttgctggatattttagtagttcagccactgggagaatctttgcagccaggatggcctcacagccataggctctatttttaacaattgccgacttctgcaaacctccattgctatcataggaccacatggactctggggcttccttcctgctctttatctccgttgccttcagtggctgtgcagtgcaaggttgacacaggcctgctgagcctggcccttgcccccctcagcctcacgcagacactcttccactggtggaagccttctgggaccctgcgtgcttccttctgcagttgca

SEQ ID NO: 86802 - DNA, 601 bp, Human
atattttagtagttcagccactgggagaatctttgcagccaggatggcctcacagccataggctctatttttaacaattgccgacttctgcaaacctccattgctatcataggaccacatggactctggggcttccttcctgctctttatctccgttgccttcagtggctgtgcagtgcaaggttgacacaggcctgctgagcctggcccttgcccccctcagcctcacgcagacactcttccactggtggaagccttctgggaccctgcgtgcttccttctgcagttgcagctgccagcmtgcactgtagctgcctggtcatttcctgtctcccctccagcaaggatttcgtgtttacagcacagtacctagcacatatcaggttcactcattcactcaaagagcgttagctgaggacctactatgtgcgaggcatcgttgtaggcacctggggtacacccgtgaacaaagcaggccagaaccaactgtcctcggggagctcacattctagcatggaagacaaacagcaaataatacacgtaataaataggtaatgatacagttaccaagtgagaagtgctctgggaaagcaaaccagat

SEQ ID NO: 86803 - DNA, 601 bp, Human
cccagccggtggcccgcagtacgtgtgaagcactggggtttagcctctaacttccgggcttggcccacggtccaggtggccaaggttatcttctgaggaaggttatctttcctcacacctcctctgtggtttcagttctccaggcctgtcagcaggagctgacgcacttcatacaccaaggtcaggggcctccgggtgcaacagaaggcttaatgtccaggcaaacccaagtgagttaaaccatcccatgctgaagaaattattttttgaggtgacccattttctcagacaagtgaatagraaacattggagaaatgtttctttttcagaaaataaaaccacagagagacagagtgattcctcttgaggcagagcgggccgaggtccccttcggtcacaggagttcctttgaacatgggcgatgccctgggtaacacgggtaacctggtgcacatgaacaaagcccacgttcagccccgtctgtcccctcccaatctgctcacacctgctgcctgcctctttgctgtaacccaattctgcttcttctttcctaactttccttcgtctttccagatgcaggacgctatgggctatgagttac

SEQ ID NO: 86804 - DNA, 601 bp, Human
cgggtgcaacagaaggcttaatgtccaggcaaacccaagtgagttaaaccatcccatgctgaagaaattattttttgaggtgacccattttctcagacaagtgaatagaaaacattggagaaatgtttctttttcagaaaataaaaccacagagagacagagtgattcctcttgaggcagagcgggccgaggtccccttcggtcacaggagttcctttgaacatgggcgatgccctgggtaacacgggtaacctggtgcacatgaacaaagcccacgttcagccccgtctgtcccctcccratctgctcacacctgctgcctgcctctttgctgtaacccaattctgcttcttctttcctaactttccttcgtctttccagatgcaggacgctatgggctatgagttaccctgggtgtattttgtcagtctggtcatctttggatcctttttcgttctaaatctggttctcggtgtgttgagcgggtaagctgaccgtttctatgtcctctccacaacgcagccgagcaaggtctcaggttccactccgtacatgcccggggtcctcagggatgggaccctgacaggcccaggaaaaccac

SEQ ID NO: 86805 - DNA, 601 bp, Human
actgagcagtctatctctgagtttccttttctgaatggaaaggacccttaactgtttaaagccatatattatttaagaatagaggagatgggatgcaatttcctctaactttatatctagttggctgcaagtatcacatctacctaatttcagcccttgctcagatgaagttagaagtggtagaagtaaccgggcatggtggtgcacacctgtagacccagcaactcagaaggctgagacaggaggatcacttgagcccaggagttcaaggctgcagtgagctatgatcgtgccactgcastgcagcctgggcaacatagcgagaccccatggtagaagtagcacgtggttggaaggaagcacctgaggatggccaccttttcaccatggaaacgcataggatatttcctcaacccactttcttcttcagaagtccacaccagccatgccaaggcctaacacctaaatgctcctggtgacctgctcatgggtaacccactctgctgcctttgccacttgggggaggggggtaatctacttctactctgcttgagactggtcagctgctttgcagagtcttccctaaatgtctagagaggtt

SEQ ID NO: 86806 - DNA, 601 bp, Human
tgaaaccctgcattccaacaattaaggataatatgattttatagccctgcacagtaactcatcctcataaattatgtccttcagtcactaaggaaagattgaacggtgcttggtgtgttgtgcttgtgaaggtagagaagatgactccataaagcttccatttaaagtgtggaaattcagggctgcgcatggtggctcatgcctataatcccagtgttgggagactgaagcaagagaatcatgcgaagctaggagtttgagatcagcctgggcgacatagtgagaccctttctctacaaaraaaatattttttaattagctgggcttggtggcagcacctatagtcccaggtattcgggaagccgaggtgggaggatcacttgagtccaggagtttgaggctgcagtgagccatagtcatgccactgcactccagcctgggtgacagagcgagactctgtctctaaaagtaaaaaagaaaaaatttttaatggaaattcaaagacttttggccctgagagggttagacctcttctatctggatcatgcacacatccagaacacctatttctgatgaggccagataaagtcaatataaagaa

SEQ ID NO: 86807 - DNA, 601 bp, Human
gcgaagctaggagtttgagatcagcctgggcgacatagtgagaccctttctctacaaagaaaatattttttaattagctgggcttggtggcagcacctatagtcccaggtattcgggaagccgaggtgggaggatcacttgagtccaggagtttgaggctgcagtgagccatagtcatgccactgcactccagcctgggtgacagagcgagactctgtctctaaaagtaaaaaagaaaaaatttttaatggaaattcaaagacttttggccctgagagggttagacctcttctatctggakcatgcacacatccagaacacctatttctgatgaggccagataaagtcaatataaagaatagatattaaaggattttttcaaaatactttattatctgatggtcctcacattaaccctatgcaagacataggactggtgctcttatggataataatcagattatgattacttcccctcagaaagctcaatctccagtcgactagaataaagacaacggtgatgatgacattcttgaaattgcacttgaagctgtaatgaggtggaagcctctggactctggttgctttttgttttaagcga

SEQ ID NO: 86808 - DNA, 601 bp, Human
tgagaaaacatggcactaagtggacggtgaaaaggacacctcacagtatgagagctgaattgggaaggcagaactctacatgccccttgtttggcctcagcgggaacatgtagagtttttgtcatctgcacatgtccacagatgactgaaagtgccacgagtattgattctggagttacaaacacattttagtgagtaggcgcatttgtagatgtgggatccacaaataaggagcctgggtggtatcgatgatcaaagggcctagcacacctcaggctattggttggattccacacacacygccctgtgcatgcttcacatcgctgagccctggcccctggctctccacaccacccctcatttttcatgttggccattgctggcgagagatgcagtcctgtctcgtgacaaatcccacagctgtgactgattgtcttgccggcttcagtccctgggcccagtgcagactgtcaggctggggctccatgtcttcattagctcagtccccagagcaggaacatggctggcatccaggcaaggagataaagagagccaggcactgccaccagcagatcctttaccgtgggaaaccttggctcat

SEQ ID NO: 86809 - DNA, 601 bp, Human
ttggattccacacacaccgccctgtgcatgcttcacatcgctgagccctggcccctggctctccacaccacccctcatttttcatgttggccattgctggcgagagatgcagtcctgtctcgtgacaaatcccacagctgtgactgattgtcttgccggcttcagtccctgggcccagtgcagactgtcaggctggggctccatgtcttcattagctcagtccccagagcaggaacatggctggcatccaggcaaggagataaagagagccaggcactgccaccagcagatcctttaccgygggaaaccttggctcatcttccatccagcctcaagcctgtctgtgcctcatactccatgggatccagccatgctccagatctgactaaagcccttctccatccctctcacactcccaaaacacatccttcctctatgaggaaaattatcttcaagccaggcagaatcaccagcatacctcgtgttctgtttctccccctgtaatgtttattttagatccccagaggccttggggtatagatggtgagcttcattccatgggactgttgctgtaaaacaggattgggccaattgtccctat

SEQ ID NO: 86810 - DNA, 601 bp, Human
ccgccctgtgcatgcttcacatcgctgagccctggcccctggctctccacaccacccctcatttttcatgttggccattgctggcgagagatgcagtcctgtctcgtgacaaatcccacagctgtgactgattgtcttgccggcttcagtccctgggcccagtgcagactgtcaggctggggctccatgtcttcattagctcagtccccagagcaggaacatggctggcatccaggcaaggagataaagagagccaggcactgccaccagcagatcctttaccgtgggaaaccttggctcrtcttccatccagcctcaagcctgtctgtgcctcatactccatgggatccagccatgctccagatctgactaaagcccttctccatccctctcacactcccaaaacacatccttcctctatgaggaaaattatcttcaagccaggcagaatcaccagcatacctcgtgttctgtttctccccctgtaatgtttattttagatccccagaggccttggggtatagatggtgagcttcattccatgggactgttgctgtaaaacaggattgggccaattgtccctattccagttgagtcccag

SEQ ID NO: 86811 - DNA, 601 bp, Human
aaattagtgctctcccaagtggcacaggccaaatgcaagcactaggcagtgcaggtagtgatggagctgccccacatgacagtagactcagaagcagagccctttgccctcttatggtttgtggtgctgtccctccttccatggtgcctttcctagagtgtggcttcagcaaaaaattctccaaggtgcttccagcagcctcgtgccctgaactgggccttcatgggtgagagaggaagacatcatggctccaagaattaaccaagatgtcctatgcatgtacacacacacacacacacaaaaatacacacatacatgcaccaccaagggcctcattccccaaagactgcatatcaaaaccaaaaatactcccctatgcctattttgcaagaaaaggcacagacttgctttgagggttgagaattcactttgttgatgattgccttctcctgccagcctcctccttgctcagaaagtgaattcgaagtcagagagaaaattaggacagaatcatagaaaagaaatagttattgtgtcagaaatttttcaataggccattcttccagcaaatcccaccccagtttcaatttctactcattat

SEQ ID NO: 86812 - DNA, 601 bp, Human
atgattgccttctcctgccagcctcctccttgctcagaaagtgaattcgaagtcagagagaaaattaggacagaatcatagaaaagaaatagttattgtgtcagaaatttttcaataggccattcttccagcaaatcccaccccagtttcaatttctactcattattactttaaatcaaatgcatcatttaacttttatatcatcttgattttatgtatttttctattctgattggatttctttaaaccaaaagggcagcccccaggacattttcttgtgtttggaatcttcatttgtctycatgtgggagagaaccttctctagattagaaatccttccaggaatgctgagtggcaggttgagctcgtcataagaatagagattgaggacattaaatctcctgggtcccaaatcagtggtatactggtaaatatttaacaattggctctctatggggaaagccctggttttcagcatttgccagttaccatggtgtaaatattcccactgtggccgatctcaagctaccagcgagacatccctgaagccagagttgggaagagacatgaatgattggctctcaggacctggggcgagtga

SEQ ID NO: 86813 - DNA, 601 bp, Human
gctgggttctgggggagaggagacagcatcggggtcagcacagaactttgaccgccaccctttcttagaagcccacggggtgccttcctggagcagcagttatctcactgatggcagtcacttgctgcacacagacatcggtcacatgtgggaaatcatagctgtcgatctagaaaacctcatgctccttttagaatatttcaccttgaaagactgttgagattttgctaaggcagaggcttttttaaaatcagagatccttctcctccaggttccacctctttgggcaggggcacaggcytcccgtttgaaagcgcaggcttgtttaaaaggaacaatgtgtgccaagcagctgcctggaaaactttatacctgctcaggattccttccccctttgcagatttccatgcaccactgagctttctcataggaaaggtagtgaaaggttttccttaagggggttagattcaaagacctggggaagtgctaagtgggagtgttgggggaagcccagaggaattcggcagaatgcaattaggtgatggaagttgagccaattcccttccttgggggttcacgtggccccttgttggataggctg

SEQ ID NO: 86814 - DNA, 601 bp, Human
caggagcagaaacaggtgcaggaagaaaggacgaagatagccaaagatgttcacgggagcagaatctctgctccctcatttcaaagatagctttaataaatctatcaactgctccctttctgataacgctgctcaaggagcaaatacaaaattaaagcacacaaacaacaagggactgttaacaacataatgtagtaacctaaggaggcctttgtgctccattaagtggttttgcaagttggaatacagggcctttgatggattataacaatgagggtcttcctggaaaaatgcctgacascttctattacactgttgatggaactgaggagtagttgattagtttgtggcactgagtggtatggtaaataaataagttggcctgtgagccacggagaagcctacctctaaaatgcaggaatttgtatgctggctcctggctccaccctaagtcagagcactggtgctaccttgtgactgacggtgatgagcatttctgtagcgcgtgttattgaaaacctgcagtagccactacacgcttagcagccagtggttatccaccgagataacagaacgttgctattctgttctccgcctaaaa

SEQ ID NO: 86815 - DNA, 601 bp, Human
acaagggagtcaaaagtccctgccctcgtggaacttagattctagtagagagacaggtggtaaattaaatagcatgccagagaggggggaagcagtgaagggggaagagtgttgagaggttgtgattttaaggggtcagccaaggaatgtctcacgatcgaggcagcattggaataaagacgtggaggctggaaggaaaagcaccatgcagatagttgggaaaggagccttctagaggctagcgagaaggggccaatgagaaggggccacgctgatgaatccggagctgaggaggcttgtrcagctggagaggagggagtaagggggtgaatggtgtaaggtgaggctgtgggacccaaggagtagggtatataaactattgtgagaacttggctcttactgggagtgaaccaaagagcctctgggtatttaattgctattgagcagagaagcaacacgatctgacagacacttatcaggatccgtctgcctgccatgtgcagaatggaatgaaggtgggccagggagaggcaggggtcccgtcaggtgcctgctgcctcaggagatgctgggcctggtcttgacacccatggaagtgata

SEQ ID NO: 86816 - DNA, 601 bp, Human
tgctgtgctatctggccccgtaagtgtacaaatgccattttcccagccaggggagcagtggaagagctatggaaaggctgtattgtgtatacagtgcgaagtaggcacgtcagcctgtttcagtgagctgtcggacacttcccaaagcaaaaccaccagctctgggcaaggcttgctaggttaagctgttgggaagccatgacagtcttctcattgcccaatggccgtgtgcttcagaggagggaagccgtgacagtcttctcattgaccaatggccgtgtgcttcagaggagggaagccrtgacagtcttctcattgaccaatggccgtgtgcttcagaggagggaagccatgacagtcttctcattgcccaatggccgtgtgcttcagaggagggaagccatgacagtcttctcattgcccaatggccgtgtgcttcagaggagggaagccatgacagtcttctcattgcccaatggccgtgtgcttcagaggagggaagccatgacagtcttctcattgcccaatggccgtgtgcttcagaggagggaagccatgacagtcttctcattgcccaatggccgtgtgcttcagaggaggg

SEQ ID NO: 86817 - DNA, 601 bp, Human
cgtaagtgtacaaatgccattttcccagccaggggagcagtggaagagctatggaaaggctgtattgtgtatacagtgcgaagtaggcacgtcagcctgtttcagtgagctgtcggacacttcccaaagcaaaaccaccagctctgggcaaggcttgctaggttaagctgttgggaagccatgacagtcttctcattgcccaatggccgtgtgcttcagaggagggaagccgtgacagtcttctcattgaccaatggccgtgtgcttcagaggagggaagccatgacagtcttctcattgmccaatggccgtgtgcttcagaggagggaagccatgacagtcttctcattgcccaatggccgtgtgcttcagaggagggaagccatgacagtcttctcattgcccaatggccgtgtgcttcagaggagggaagccatgacagtcttctcattgcccaatggccgtgtgcttcagaggagggaagccatgacagtcttctcattgcccaatggccgtgtgcttcagaggagggaagccatgacagtcttctcattgcccaatggccgtgtgcttcagaggagggaagccatgacagtcttct

SEQ ID NO: 86818 - DNA, 601 bp, Human
tggaaaggctgtattgtgtatacagtgcgaagtaggcacgtcagcctgtttcagtgagctgtcggacacttcccaaagcaaaaccaccagctctgggcaaggcttgctaggttaagctgttgggaagccatgacagtcttctcattgcccaatggccgtgtgcttcagaggagggaagccgtgacagtcttctcattgaccaatggccgtgtgcttcagaggagggaagccatgacagtcttctcattgaccaatggccgtgtgcttcagaggagggaagccatgacagtcttctcattgmccaatggccgtgtgcttcagaggagggaagccatgacagtcttctcattgcccaatggccgtgtgcttcagaggagggaagccatgacagtcttctcattgcccaatggccgtgtgcttcagaggagggaagccatgacagtcttctcattgcccaatggccgtgtgcttcagaggagggaagccatgacagtcttctcattgcccaatggccgtgtgcttcagaggagggaagccatgacagtcttctcattgcccaatggccgtgtgcttcagaggagggaagccatgacagtcttct

SEQ ID NO: 86819 - DNA, 601 bp, Human
tcggacacttcccaaagcaaaaccaccagctctgggcaaggcttgctaggttaagctgttgggaagccatgacagtcttctcattgcccaatggccgtgtgcttcagaggagggaagccgtgacagtcttctcattgaccaatggccgtgtgcttcagaggagggaagccatgacagtcttctcattgaccaatggccgtgtgcttcagaggagggaagccatgacagtcttctcattgcccaatggccgtgtgcttcagaggagggaagccatgacagtcttctcattgcccaatggccrtgtgcttcagaggagggaagccatgacagtcttctcattgcccaatggccgtgtgcttcagaggagggaagccatgacagtcttctcattgcccaatggccgtgtgcttcagaggagggaagccatgacagtcttctcattgcccaatggccgtgtgcttcagaggagggaagccatgacagtcttctcattgcccaatggccgtgtgcttcagaggagggaagccatgacagtcttctcattgaccaatggccgtgtgcttcataggagggaagccatgacagtcttctcattgaccaa

SEQ ID NO: 86820 - DNA, 601 bp, Human
gccgtgtgcttcagaggagggaagccatgacagtcttctcattgaccaatggccgtgtgcttcagaggagggaagccatgacagtcttctcattgcccaatggccgtgtgcttcagaggagggaagccatgacagtcttctcattgcccaatggccgtgtgcttcagaggagggaagccatgacagtcttctcattgcccaatggccgtgtgcttcagaggagggaagccatgacagtcttctcattgcccaatggccgtgtgcttcagaggagggaagccatgacagtcttctcattgcmcaatggccgtgtgcttcagaggagggaagccatgacagtcttctcattgcccaatggccgtgtgcttcagaggagggaagccatgacagtcttctcattgaccaatggccgtgtgcttcataggagggaagccatgacagtcttctcattgaccaatggccgtgtgcttcataggagggaagccatgacagtcttctcattgcccaatggccgtgtgcttcagaggagggaagccatgacagtcttctcattgaccaatggccgtgtgcttcagaggagtgggaaggtgacagccacata

SEQ ID NO: 86821 - DNA, 601 bp, Human
ggccgtgtgcttcagaggagggaagccatgacagtcttctcattgcccaatggccgtgtgcttcagaggagggaagccatgacagtcttctcattgcccaatggccgtgtgcttcagaggagggaagccatgacagtcttctcattgcccaatggccgtgtgcttcagaggagggaagccatgacagtcttctcattgcccaatggccgtgtgcttcagaggagggaagccatgacagtcttctcattgcccaatggccgtgtgcttcagaggagggaagccatgacagtcttctcattgmccaatggccgtgtgcttcataggagggaagccatgacagtcttctcattgaccaatggccgtgtgcttcataggagggaagccatgacagtcttctcattgcccaatggccgtgtgcttcagaggagggaagccatgacagtcttctcattgaccaatggccgtgtgcttcagaggagtgggaaggtgacagccacataacattttgacaggagacattcatagcttcctgggcctggcattagatcagcataaaggtgcctggcagctctgccaagccatcagctaataaaggctctgc

SEQ ID NO: 86822 - DNA, 601 bp, Human
ggaagccatgacagtcttctcattgcccaatggccgtgtgcttcagaggagggaagccatgacagtcttctcattgcccaatggccgtgtgcttcagaggagggaagccatgacagtcttctcattgcccaatggccgtgtgcttcagaggagggaagccatgacagtcttctcattgcccaatggccgtgtgcttcagaggagggaagccatgacagtcttctcattgcccaatggccgtgtgcttcagaggagggaagccatgacagtcttctcattgaccaatggccgtgtgcttcakaggagggaagccatgacagtcttctcattgaccaatggccgtgtgcttcataggagggaagccatgacagtcttctcattgcccaatggccgtgtgcttcagaggagggaagccatgacagtcttctcattgaccaatggccgtgtgcttcagaggagtgggaaggtgacagccacataacattttgacaggagacattcatagcttcctgggcctggcattagatcagcataaaggtgcctggcagctctgccaagccatcagctaataaaggctctgctccccttggggagacgccta

SEQ ID NO: 86823 - DNA, 601 bp, Human
cagccgactgtgtcactcccttgttcaaaagctttgaatgtgtctccatgggtacagaataaagcctgaacatctctcagtatttcaggcatctccaacctgtcccagccaatagcttgaaccttatcactccctactgccctgccgcaaagccagactgcatcttgttttccagaaacgcctgctgctgtcctgtttctgcacctttacccatctcccatccctctgcctacagcacctgtttcctcccctgctcctccgtggcctcctagcccaggtcgaagagcacgtcttggctcakgcctcccagagcccccatctcaggacaggcactgtcagcactcaaccctcacctacccaccagtcggtgggggtggcccagccgtcttgttatatagaaagctcttgggaggcagcagcgtgcattggtaacttcttattcactctcccactcagtatgtagggcaatgatttctatttcacagacttcccccaaaaacacataatgaattgaattgaattctcttcggatcagagaattaaggtctgatagccctatattcatacctagttggccaaataccatttttccagtcttagc

SEQ ID NO: 86824 - DNA, 601 bp, Human
ccgtggcctcctagcccaggtcgaagagcacgtcttggctcaggcctcccagagcccccatctcaggacaggcactgtcagcactcaaccctcacctacccaccagtcggtgggggtggcccagccgtcttgttatatagaaagctcttgggaggcagcagcgtgcattggtaacttcttattcactctcccactcagtatgtagggcaatgatttctatttcacagacttcccccaaaaacacataatgaattgaattgaattctcttcggatcagagaattaaggtctgatagccctayattcatacctagttggccaaataccatttttccagtcttagccatgctcatggtagcccccagagagtgtattgtggttgacagaatgggcagaaatgatttggcgttgagaaagtgggccgagaggaaagtttggaaggagttagaattatatagtcccaggagaagagaaagccgggagtcgacagaacagggacaaagctgcctcatgcccacatactccccgtaggaggggtcattgtttcactgtatggcgtcaacttttagattctgagtttggatcatggatacatttcagcc

SEQ ID NO: 86825 - DNA, 601 bp, Human
catggaaggtgaagaaggcctggatggtctcctttcatcttgcccaagatcatctcacatgggtattgtttgccccattttgcagatgggaaaagtgaggctcggaaaagttaacgtattcacattgttcagcttgtaagttgcacagttatgtggccgttgctccctccgtaccatgctggtctctaccacaagccccctcacgaatgcccttctcttccaaccaggggaaccagaagtgggccctccagtcccccagccggaacagcctgtgaattttccttggttgttgcatttatcscttcagcctaatatgcaaagcaggtggacggagaaaggaggaaaagagcggagatggggcgggagggcgggggcggtggtgctggtagtagggcatgggtttgatttttttttaagttgaactttatgattctgagaactctgtttgaagcatggaaagaagttatggcattatcttgctcacggaaagaaaaagcgaactgaggtcaagcgccatccctttggaatggtttaagaggcagttttgtttggaaggagatgtgtcaattccgtgacctatccgatttccttcagttcaggg

SEQ ID NO: 86826 - DNA, 601 bp, Human
tggaagagcaggtctcagatccacttccccaaagatggggttttagggatatttatgggatagaggagcaaggtccaaggcatggggaaaggtgattgggggtaaggaaaagtgaggccgtcggttatctgcgcaagtatagtcaagcttcacagctcttcctgggattcaagttcacaaaatggcatcgttagcgtgatctgaggatggatgtttgggccctctgatgccaaaaggtcgcccattggacactcacgcaggcccagttggaggattagtggtctgagctagcttgaactgkacaagagctgaccccaagctcttgaaaaatgacttaagcaaccattatcatggtgacttatacatcagagatgttatctgtaaggaggcttgtagaagtttagttacatattccttaactacatgacttttagctgcatatgttttaaaatcaactagaaaccagtgaggcaagttaggtttggtgacctcattaggttagcccttggtttcaccaccccaccttcaaagccccatcaaccatcccttccttttctgccttttctatcctcaccacctcttctccccagcagggtcttac

SEQ ID NO: 86827 - DNA, 601 bp, Human
ggttggaaaagggtttggaaattgggggataaaagtagggtcttggcttggaagtccttggaattctgcctctgggaatggatcacttaggcctgctttgtcactttgtcagatctaaaacgaggttgggccagatctgatccagcagaggatatgtaattaaccaggcacataaattaatttttaatcttccattccttgcctgtcaacatttctttttcacttctcaaggaggacatgattatcccatgatgtttttcttcatgtactaatttctcctcctctttcttcttcaaacctstccacggaagtgtcagaaatacttctcattttatcctttctcaggaaggccagctagccagctaagaatagcagtcaggaaatggttaagagaataccaagaataaattctgagttgcttctttacaactagaaagctgaatacatttaaggcttgaaaggtcaactcccttcaaagggggcagaggtttgatttcgtccattatgtggtcttcagcacaatgctcatttcattcactggctgcaatggagatttatggagtaaatgttatcacaagctgagacttaatgagaactcagc

SEQ ID NO: 86828 - DNA, 601 bp, Human
tgtccacggaagtgtcagaaatacttctcattttatcctttctcaggaaggccagctagccagctaagaatagcagtcaggaaatggttaagagaataccaagaataaattctgagttgcttctttacaactagaaagctgaatacatttaaggcttgaaaggtcaactcccttcaaagggggcagaggtttgatttcgtccattatgtggtcttcagcacaatgctcatttcattcactggctgcaatggagatttatggagtaaatgttatcacaagctgagacttaatgagaactcarctgtatctcctggatgtagtggaaagcaaccattttggtaataaatagagaacagcatctaatttgtaaattcctttttccgttgctaagtttaatcagatcagtgaaactgaagggaattgttgatgaccaaaaattattttccatgccttaatctggccaggaaacattactcctaatggaaatggcctgttgctctggcgatggaaggggatgacatttgtcattagactaacccaattgttgcatattgataaatatgtttaggccaaaatctatttaaaacccaatagaagctga

SEQ ID NO: 86829 - DNA, 601 bp, Human
gttaaaacaaattcaagggggcacaaaagggagttgaatgcagctctcttttttccagcggtgcttcagtttttttcgtgatgaatcataaagatcatttccaggatagggaccatgccatgggtaagtgaccgttaacacgcagtaggaactttatgaatactgcatgacgagaatgacagcaatgaggaacacatctgagaagctgatggccccagagggaacacggctaactgtgacatctttagggggtggccctgagaatgctgtatcccttccagtaagagtaccgcctccaggygacctttagacgcacagcaaggggtcccgaggacattcttctcttggcctgcacttgcttttatattcatgtgcttttgtatacatgcccagtgtccaggcatcctacacactcagagctctaatactgaatattaggaacgacagctactgctcatcaagcacctccttttgcccatattatctttgccctcacttcacattttcagatgagaaaagtgaggttcagatcattggcctgaggccagttcgctaacaggaggtttacccaggcttacacccaggcacgccccatctgact

SEQ ID NO: 86830 - DNA, 601 bp, Human
gccctcacttcacattttcagatgagaaaagtgaggttcagatcattggcctgaggccagttcgctaacaggaggtttacccaggcttacacccaggcacgccccatctgactcgaaagccttccctctttctcttttgtcagagaggcaagcacatggtaaccccccagaatcatgagcctggtgataggagaagtggagtggaaagaagccctagaaagggagtatggagacctggttcctagtcccagctctgatactaactggccctgtaacctaaacaaccctttcctctctgggyctcaatttcctcataggtaaaagtaatacccaaaggatctctaattgtctgttaatctttctgcattccaatccccttgaagccccatccagccctgtctttctcttggagtttcacattccagaacaagtctgtggctaagctgaggagaggatgccctcattttgcaaagagacgcttctcccatcttggccaggcagcagaggtcacaagagaggaagtgtccactgcataaggactctggacagcttctctgccagcacgcatccagcagctgactctttcctcggggcccacgct

SEQ ID NO: 86831 - DNA, 601 bp, Human
tgagagtgacagaggcaggcgttcatccccgtctgttctttttgcacttttggtttggggtcggtttctccttcaatgtgcttggcttagagctgccccagctgctgtgggcatgaaaaccactgctcaccagtctccacatcttggcccttacccaaaataacccaggagggaggaaggagctcatgggtgggtggctggataaatggctccagaataatggatcaaacattgaatgagtgaaggagtacacaccccgtcccttggccccaagatgctcattcatacccctctctgagcrtgaaggagaaacagcaaaagctgaatttggggtgtgtgccccagtgccagccagtctttccagggtgcttccgatgcctccagtggaagtccccagccatgttccctccctggggcattcccatctgccctcccagggaaggctgcttggtgcagcagaggtgtgctctctgggagcttcggtggagaggaaaggacaggggagtcaggatacgagggctggtggagtctgccaggtggggctagggcagcctcgctcttccttgtcccaggagcacatgtcaaaagcgccagggctggg

SEQ ID NO: 86832 - DNA, 601 bp, Human
cagctgctgtgggcatgaaaaccactgctcaccagtctccacatcttggcccttacccaaaataacccaggagggaggaaggagctcatgggtgggtggctggataaatggctccagaataatggatcaaacattgaatgagtgaaggagtacacaccccgtcccttggccccaagatgctcattcatacccctctctgagcgtgaaggagaaacagcaaaagctgaatttggggtgtgtgccccagtgccagccagtctttccagggtgcttccgatgcctccagtggaagtccccagcyatgttccctccctggggcattcccatctgccctcccagggaaggctgcttggtgcagcagaggtgtgctctctgggagcttcggtggagaggaaaggacaggggagtcaggatacgagggctggtggagtctgccaggtggggctagggcagcctcgctcttccttgtcccaggagcacatgtcaaaagcgccagggctggggaagcagcagggagcagaggctggagaaggcctgcgtccctgtcccggttctgctctcggcagcctcagttttctcatctccacctgtggctggagac

SEQ ID NO: 86833 - DNA, 601 bp, Human
cgtcgcctgatggggctgaaaaaggcctggactcaagacctgtcattctctgccatttactagctctccccttgggcacctaacttcagcctttggggactacactttcttttgtcagtggggataataatatctaccttgcctgtgccgtaggggtatgtcggtcagtgtccccatggaaacagtaggtactcttaaactaggtgacttgaggagggcttcataaagatgcaggcagggtttaaggacttaaggagggcttcataaagatgcaggcagggtttaaggacttaaggagggyttcataaagatgcaggcagggtttaaggacttaaggagggcttcataaagatgcaggcagggtttaaggacttaaggagggcttcataaagatgcaggcagggtttaaggacttaaggagggtttcataaagatgcaggcagggtttaaggacttaaggagggtttcataaagacgcaggcagggtttaaggacttaaggagggcttcataaagatgcaggcagggtttaaggacttaaggagggtttcataaagatgcaggcagggtttaaggacttaaggagggtttcataaagatgc

SEQ ID NO: 86834 - DNA, 601 bp, Human
gctctccccttgggcacctaacttcagcctttggggactacactttcttttgtcagtggggataataatatctaccttgcctgtgccgtaggggtatgtcggtcagtgtccccatggaaacagtaggtactcttaaactaggtgacttgaggagggcttcataaagatgcaggcagggtttaaggacttaaggagggcttcataaagatgcaggcagggtttaaggacttaaggagggcttcataaagatgcaggcagggtttaaggacttaaggagggcttcataaagatgcaggcaggktttaaggacttaaggagggcttcataaagatgcaggcagggtttaaggacttaaggagggtttcataaagatgcaggcagggtttaaggacttaaggagggtttcataaagacgcaggcagggtttaaggacttaaggagggcttcataaagatgcaggcagggtttaaggacttaaggagggtttcataaagatgcaggcagggtttaaggacttaaggagggtttcataaagatgcaggcagggtttaaggacttaaggagggcttcataaagatgcaggcagggtttaaggacttaa

SEQ ID NO: 86835 - DNA, 601 bp, Human
atggaaacagtaggtactcttaaactaggtgacttgaggagggcttcataaagatgcaggcagggtttaaggacttaaggagggcttcataaagatgcaggcagggtttaaggacttaaggagggcttcataaagatgcaggcagggtttaaggacttaaggagggcttcataaagatgcaggcagggtttaaggacttaaggagggcttcataaagatgcaggcagggtttaaggacttaaggagggtttcataaagatgcaggcagggtttaaggacttaaggagggtttcataaagaygcaggcagggtttaaggacttaaggagggcttcataaagatgcaggcagggtttaaggacttaaggagggtttcataaagatgcaggcagggtttaaggacttaaggagggtttcataaagatgcaggcagggtttaaggacttaaggagggcttcataaagatgcaggcagggtttaaggacttaaggagggcttcataaagatgcaggcagggtttaaggacttaaggagggtttcataaagatgcaggcagggtttaaggacttaaggagggtttcataaagatgcaggcagggttt

SEQ ID NO: 86836 - DNA, 601 bp, Human
gacttaaggagggcttcataaagatgcaggcagggtttaaggacttaaggagggcttcataaagatgcaggcagggtttaaggacttaaggagggtttcataaagatgcaggcagggtttaaggacttaaggagggtttcataaagacgcaggcagggtttaaggacttaaggagggcttcataaagatgcaggcagggtttaaggacttaaggagggtttcataaagatgcaggcagggtttaaggacttaaggagggtttcataaagatgcaggcagggtttaaggacttaaggagggyttcataaagatgcaggcagggtttaaggacttaaggagggcttcataaagatgcaggcagggtttaaggacttaaggagggtttcataaagatgcaggcagggtttaaggacttaaggagggtttcataaagatgcaggcagggtttaaggacttaaggagggcttcataaagatgcaggcagggtttaaggacttaaggagggcttcataaagatgcaggcagggtttaaggacttaaggagggcttcataaagatgcaggcagggtttaaggacttaaggagggcttcataaagatgc

SEQ ID NO: 86837 - DNA, 601 bp, Human
ggcttcataaagatgcaggcagggtttaaggacttaaggagggcttcataaagatgcaggcagggtttaaggacttaaggagggtttcataaagatgcaggcagggtttaaggacttaaggagggtttcataaagacgcaggcagggtttaaggacttaaggagggcttcataaagatgcaggcagggtttaaggacttaaggagggtttcataaagatgcaggcagggtttaaggacttaaggagggtttcataaagatgcaggcagggtttaaggacttaaggagggcttcataaagaygcaggcagggtttaaggacttaaggagggcttcataaagatgcaggcagggtttaaggacttaaggagggtttcataaagatgcaggcagggtttaaggacttaaggagggtttcataaagatgcaggcagggtttaaggacttaaggagggcttcataaagatgcaggcagggtttaaggacttaaggagggcttcataaagatgcaggcagggtttaaggacttaaggagggcttcataaagatgcaggcagggtttaaggacttaaggagggcttcataaagatgcaggcagggttt

SEQ ID NO: 86838 - DNA, 601 bp, Human
ggcttcataaagatgcaggcagggtttaaggacttaaggagggtttcataaagatgcaggcagggtttaaggacttaaggagggtttcataaagacgcaggcagggtttaaggacttaaggagggcttcataaagatgcaggcagggtttaaggacttaaggagggtttcataaagatgcaggcagggtttaaggacttaaggagggtttcataaagatgcaggcagggtttaaggacttaaggagggcttcataaagatgcaggcagggtttaaggacttaaggagggcttcataaagaygcaggcagggtttaaggacttaaggagggtttcataaagatgcaggcagggtttaaggacttaaggagggtttcataaagatgcaggcagggtttaaggacttaaggagggcttcataaagatgcaggcagggtttaaggacttaaggagggcttcataaagatgcaggcagggtttaaggacttaaggagggcttcataaagatgcaggcagggtttaaggacttaaggagggcttcataaagatgcaggcagggtttaaggacttaaggagggcttcataaagatgcaggcagggttt

SEQ ID NO: 86839 - DNA, 601 bp, Human
aaagatgcaggcagggtttaaggacttaaggagggtttcataaagatgcaggcagggtttaaggacttaaggagggcttcataaagatgcaggcagggtttaaggacttaaggagggcttcataaagatgcaggcagggtttaaggacttaaggagggtttcataaagatgcaggcagggtttaaggacttaaggagggtttcataaagatgcaggcagggtttaaggacttaaggagggcttcataaagatgcaggcagggtttaaggacttaaggagggcttcataaagatgcaggcarggtttaaggacttaaggagggcttcataaagatgcaggcagggtttaaggacttaaggagggcttcataaagatgcaggcagggtttaaggacttaaggagggcttcataaagatgcaggcagggtttaaggacttaaggagggtttcataaagatgcaggcagggtttaaggacttaaggagggcttcataaagatgcaggcagggtttaaggacttaaggagggtttcataaagatgcaggcagggtttaaggaagccagcaagtacagtaccccagggtagcagctgtgtggatctg

SEQ ID NO: 86840 - DNA, 601 bp, Human
gacttaaggagggtttcataaagatgcaggcagggtttaaggacttaaggagggcttcataaagatgcaggcagggtttaaggacttaaggagggcttcataaagatgcaggcagggtttaaggacttaaggagggtttcataaagatgcaggcagggtttaaggacttaaggagggtttcataaagatgcaggcagggtttaaggacttaaggagggcttcataaagatgcaggcagggtttaaggacttaaggagggcttcataaagatgcaggcagggtttaaggacttaaggagggyttcataaagatgcaggcagggtttaaggacttaaggagggcttcataaagatgcaggcagggtttaaggacttaaggagggcttcataaagatgcaggcagggtttaaggacttaaggagggtttcataaagatgcaggcagggtttaaggacttaaggagggcttcataaagatgcaggcagggtttaaggacttaaggagggtttcataaagatgcaggcagggtttaaggaagccagcaagtacagtaccccagggtagcagctgtgtggatctgttaccggtaaaggctggaggaa

SEQ ID NO: 86841 - DNA, 601 bp, Human
gacttaaggagggcttcataaagatgcaggcagggtttaaggacttaaggagggcttcataaagatgcaggcagggtttaaggacttaaggagggtttcataaagatgcaggcagggtttaaggacttaaggagggtttcataaagatgcaggcagggtttaaggacttaaggagggcttcataaagatgcaggcagggtttaaggacttaaggagggcttcataaagatgcaggcagggtttaaggacttaaggagggcttcataaagatgcaggcagggtttaaggacttaaggagggyttcataaagatgcaggcagggtttaaggacttaaggagggcttcataaagatgcaggcagggtttaaggacttaaggagggtttcataaagatgcaggcagggtttaaggacttaaggagggcttcataaagatgcaggcagggtttaaggacttaaggagggtttcataaagatgcaggcagggtttaaggaagccagcaagtacagtaccccagggtagcagctgtgtggatctgttaccggtaaaggctggaggaacaaagtgaggggcagcctcagagtcagagagcagctatgtg

SEQ ID NO: 86842 - DNA, 601 bp, Human
gacttaaggagggtttcataaagatgcaggcagggtttaaggacttaaggagggtttcataaagatgcaggcagggtttaaggacttaaggagggcttcataaagatgcaggcagggtttaaggacttaaggagggcttcataaagatgcaggcagggtttaaggacttaaggagggcttcataaagatgcaggcagggtttaaggacttaaggagggcttcataaagatgcaggcagggtttaaggacttaaggagggcttcataaagatgcaggcagggtttaaggacttaaggagggyttcataaagatgcaggcagggtttaaggacttaaggagggcttcataaagatgcaggcagggtttaaggacttaaggagggtttcataaagatgcaggcagggtttaaggaagccagcaagtacagtaccccagggtagcagctgtgtggatctgttaccggtaaaggctggaggaacaaagtgaggggcagcctcagagtcagagagcagctatgtggagagggccatggggcagacatgtggccttgggcagcaagaagcagccagtctacaccaaccctgtgtgctgcagttgggga

SEQ ID NO: 86843 - DNA, 601 bp, Human
gacttaaggagggcttcataaagatgcaggcagggtttaaggacttaaggagggcttcataaagatgcaggcagggtttaaggacttaaggagggcttcataaagatgcaggcagggtttaaggacttaaggagggcttcataaagatgcaggcagggtttaaggacttaaggagggcttcataaagatgcaggcagggtttaaggacttaaggagggtttcataaagatgcaggcagggtttaaggacttaaggagggcttcataaagatgcaggcagggtttaaggacttaaggagggyttcataaagatgcaggcagggtttaaggaagccagcaagtacagtaccccagggtagcagctgtgtggatctgttaccggtaaaggctggaggaacaaagtgaggggcagcctcagagtcagagagcagctatgtggagagggccatggggcagacatgtggccttgggcagcaagaagcagccagtctacaccaaccctgtgtgctgcagttggggagcgaacgccccacctctctctcctcgggtccacccacggacgtcctgctagtgctgcccatgggccggcccaagcaggaagc

SEQ ID NO: 86844 - DNA, 601 bp, Human
cttgacactgaccatcttgtctgtgaaaggaggcactccggcgggcatgcttgatcagaagaaagggaagtttgcttggtttagtcactccacagaaacccatggtaatgttcccctgtgctctgtgtgtgtaaatgcgtgtgggtgcataccagactgaatgggaaggtgtctctcttgatggcttgtgccgcagtagttctgtgtgtgtgcatatatgtgtatgtatatatgttgtgtgtgtgtgtgtgtttgtgaagggatggcaacctgtccccctcaaagccactgccttatcatkgcttcatatgtgtaaagtcagtgggtgtgacaaacaggcagagctattcctccaggagctcttcctctgggcagtgctggcctagagtaagcacactgtgaatgcacggttggaaccagcacaggcagtgccttgatttagaaggtgctgtcgttatttccagtgcccaggcctgcccctccgattttgtctgtctttccaggcctagcaccaccacctccacagcactgtactcacacataaggctctgggaacgaagtgtcacaaagtcacagaactttttctacgtggcctagccct

SEQ ID NO: 86845 - DNA, 601 bp, Human
cagcttcttccagtccacagagtggagaggagagattcaatggtcagttttttcaggatgtgtcctatgaggtaaaatgctcttattaccagatgtcctcccatacttccattagtttacagtgttcttggcggcaaaacctgcctggacaaccagcagatgtgtccatcaaggggatctgtgcagatcagccagccagcgtgctcagcctctctttctgccaacccgcactgggtcttgcggtgggcgtgttgcaaactactgctcttctgttcccttgtctccccaccctcaatgcctkgctctgcttccctttgactcttgcagtgagcatgcccaccagtgagaccgagtccgtcaacaccgaaaacgtggctggaggtgacatcgagggagaaaactgcggggccaggctggcgtgagtaggcacggcgagcccaggggctggggctttttctggagcatgggtggaaaagctgcatctggaaatcacagtgggctggctcatcactaggaagggcagagattagagccggtggcaagaaacaaacctcaggtgggaaccaagatggggagcagagggccctggggtgagggtggc

SEQ ID NO: 86846 - DNA, 601 bp, Human
atttcaggagagcatgaggctctgttaggaaggaaacatgatattcccccacggatggagcctggcagtctccagtggatctgtcgtttgctcagagcacatgctctgcagcctggagagctctgcagaaatggtccccgttatccccatgtttagccacattcgtactctgtgcatacaaaacgctgagtcacagtgccagaattataatatgccccgaataaaatgtggtctttccccatctccctacctcccaccccgccccagacaatgatgagccaagactgccagcattcctggygggagaagcagcatgggaactgagattgcgtgtgatggtctgaggggaagtgagtgaccgggatctttaaagctaagggttaaaagtcttatgtaatgagattaggtcacgatgaggactgctgtgtagtaaggaggcctggatgaagacggttcctgttgggggaagggaggaaggaactacggcatgttacttcatggcagcaggggcaggcgggtgcaggtaatgaagaggaaggagccgtcacagtcagggaagaggataatgaggcagaagtgaaatctgaagcaggagcccagt

SEQ ID NO: 86847 - DNA, 601 bp, Human
ttgtctctaattctgaacctgaaaagcacgaaggaaaatcatggtctcccagaaggtttgtcttggagtcctgggtggagaaagtatctggggttgcatgaacttcagttcctacccagtggatctgttctgatggtctcatgttccttaccagccttctctccctcctcgctcttcttcaagaatccgctcaacctgaggtaggaattgtgcctcattggaacaacaacagtggagacaaccaggaagccttccgagtgtgctgtgcgtagagaagccagagcccccagctgttctcagagttctttggagattgtgaagatcggtagcagggaggcattggccacagtgaaccggcctagggtgtggaccagcaccatggcaccaaggcatctgggctcctgatggcaccaaggcacccgggctcctggcttgcgtcctctcactgcaggagcacctttccagcccagaaccctgggccacctcccaggaggcaaagaggtcctatcattaacgccaaggtgtgcaaagggagcagaaagaaccaaggcgttcagacgtcacagagttctcacctcagctccccatgggcatggagttt

SEQ ID NO: 86848 - DNA, 601 bp, Human
tcctctcactgcaggagcacctttccagcccagaaccctgggccacctcccaggaggcaaagaggtcctatcattaacgccaaggtgtgcaaagggagcagaaagaaccaaggcgttcagacgtcacagagttctcacctcagctccccatgggcatggagttttccctggcctccagacaaaagccgctgagcagtgtcctccccttcgcaaggagtggagcctgcctgacatggaacttagccatttggcggttgcttgtcaaaagtgccagcctttaaaagcggatgaggttttgatycccatgaacctaaaattctgctcacaatcccggaggatagcaacaatagcaacaaaatcagtcttcaagtgtggtgcccaggcttatccatccagacctgtaacaaagcagacaagaaggctctgtccatttcgtgctcagaatgtgcccggatgccacagaaggacctgtagtccacgactgtgcttgaagcaggacctcctttcccagcacccccagcgccaatcctgcttcccagggtcatttcccttggagacgaacactcaggattaggtttccccagaggggagcttttcagag

SEQ ID NO: 86849 - DNA, 601 bp, Human
cacctgtcacatcttctggcttaatttttttaataagaaataacgagaggggctggcgttttcttgctctgcgacacagctagctgtgtgccgcgctgggacgtcgcaggcctgcggcggttgcctcccagactcccttctcctgtttcctccccatgcctctccttgttgctccaccactgtctccatccctttcttcatctctaacttgcgttctgtccttctgcttctccatctgaacattgtcaccacctgcactatccccagcgttcatgcccttctcctagcaccaaagccaagctgacaggtgccttctaatggtctcaactgcttacattctctcactctccctgtctctctctctttggctcagccttctctcctccacacttctcttttacagtctgtccctcctgccctcttctccagcctcctgcctcccctggactcttccctacatgaactagggagcctcaggacttccttgaaggttctgcctttccatggaacctcctccctgttccatgacccttccaggcagccaccctcacacccaccctgagcttctgcccagaggtccccaggtcttcagggctgcgtg

SEQ ID NO: 86850 - DNA, 601 bp, Human
ccaggggttcccgtgcaggatggactgtgctgagtcccatgggtctgtaaccaagtgtaagacacaacccgattccttcgtgggtcttgtgagctccgcggagaggcaggaaccatacaaatgaaacgtaactgacagtacaaggaaatgggaactcatttcctctggggacccttctcgcctaaggtgtcctttcgtgtgctccctggtggacccgcccagcactcaggccctgctgtgactgctcacttagtggtctgtgtctccgtgtagcttttacgcagaggaggcctgtgagcgytgtgctagctactgagtatctggtgcctagcccgtggtcagtgtttagtaactatttcttggatgtgtaactaaaatgagtaatgcagacagtaagcgctgaagagtgccaaggctgagaagactagaagcatgcatcgtggagaagctgggactcagtgtgagccccacaggaggggcaggacagacaggatgaagcaacggtggagtttccggtagctgggaggacttgccttgcagctggacaggcaagaggaaggcccagtgtagggagaagggcaggtggagctggggctgcgag

SEQ ID NO: 86851 - DNA, 601 bp, Human
agtgtttagtaactatttcttggatgtgtaactaaaatgagtaatgcagacagtaagcgctgaagagtgccaaggctgagaagactagaagcatgcatcgtggagaagctgggactcagtgtgagccccacaggaggggcaggacagacaggatgaagcaacggtggagtttccggtagctgggaggacttgccttgcagctggacaggcaagaggaaggcccagtgtagggagaagggcaggtggagctggggctgcgagagcagaagtttagaagcagtgatcccgaagtttagagacrtagatgagacccattcgtatccatccctctctcctgtgtctacatatggaaggttctatttctagagaaaatgacttccagttagtgtgaagggaacatgaatagcaggcaaatttctcctccctattttatcatttaatttctgtatcctccatgcatatgtaaacataaataaatttacacattctaataaaccattacatttattatacagtaggaagtgttgccaggaaaccagttgtcaagcaaagctatattttgaagagtgggaggtgcataattatctttaaatactttctc

SEQ ID NO: 86852 - DNA, 601 bp, Human
gtgtttagtaactatttcttggatgtgtaactaaaatgagtaatgcagacagtaagcgctgaagagtgccaaggctgagaagactagaagcatgcatcgtggagaagctgggactcagtgtgagccccacaggaggggcaggacagacaggatgaagcaacggtggagtttccggtagctgggaggacttgccttgcagctggacaggcaagaggaaggcccagtgtagggagaagggcaggtggagctggggctgcgagagcagaagtttagaagcagtgatcccgaagtttagagacayagatgagacccattcgtatccatccctctctcctgtgtctacatatggaaggttctatttctagagaaaatgacttccagttagtgtgaagggaacatgaatagcaggcaaatttctcctccctattttatcatttaatttctgtatcctccatgcatatgtaaacataaataaatttacacattctaataaaccattacatttattatacagtaggaagtgttgccaggaaaccagttgtcaagcaaagctatattttgaagagtgggaggtgcataattatctttaaatactttctct

SEQ ID NO: 86853 - DNA, 601 bp, Human
gatatgagtttgtcctgaaaattcattttttaggggaataaactacttgccaaatttctgtacagtattaataatcacaatcacaggaaaaaagcagaggcatgccctgcaagataagactgtttagtatcaagatctggcaaacttcagaggtcgcctctcaagaggaccatctgggactcattgtctcatttctttgtccctctgtccaccctccaccatcctccctcggatccagggcagtatgtctgggggtgcaagaatcccaaagtgcatttagaaatcataacgttttaaattrttaatgtttatgggcactaatgggtgtatatatttatgaggtgcatgtgatgttttgatccaggtgtacaatgtgcaaaaatcaaaccagggttatcagggtgttcctcacatcaagcacttatcatttctttgtattacgaacattccaattccagtcttttagtttattttaaaatatgcaataaattatcatgactgtagtcaccatccttctctcctatgttgtatgatcaaatattacatcatatttattctatttaactatattttttcacctatttaccatctccactaccct

SEQ ID NO: 86854 - DNA, 601 bp, Human
tttaaaatatgcaataaattatcatgactgtagtcaccatccttctctcctatgttgtatgatcaaatattacatcatatttattctatttaactatattttttcacctatttaccatctccactaccctttccagcttctggtaaccatcattctactctctgtatccatgagttcaattgctttaatttttagctcccacatatgagtgagaatatgtacaatttgtctttctgtgcctggcttatttcacttaatataatggcctccagttccatccatgttgttgcaaatgacagartttcattcttttttatagctgaacaatattccattgtgtacatgtaccacattttcttcattcatttgctgatgggcgcttaggttgattctgtatcttggctattgtaaatagtgccgcagtgaacataggagaacataggagtgcagatatctcttcagtatacagattggaaaccatgttttccacctggtggcctgcttccctgtgtagtggattttcccccaagtggtaggccagtgtcgcatgttaaggtgtggccctcactggagatggccttcaagctagagcagaacactg

SEQ ID NO: 86855 - DNA, 601 bp, Human
gagtccatggagcatggatgagctttgaggggtctgtgtgctgtgtgggctctcaagtaaaggtgtgtgtgtgggcatgtgcccatttttctgaaaggcagatctaaacattcatcagattctggaaagattctataacccagaaaaacaaagagcctgtgctccagatgaaccccttctaccatatggatgtggcacacacagtcagggccaagaggctgggcagaaaactacggatggctctgcctgctgtgatattggtcgagtactcaacctccccagccctgagttttctcctccmcaaaaatcaggataatgcgtgctttgcagagttactgaaagaattggagagaaggcatgagaagtgcctgatgtggtactgggcccctcctccactgttactaataatgctcttattgcttacaacactatttctaagaatgctgtttcacaaaaattaaaaaaacttccatttattgagcatcttcaacttcaaagcagccagatgcattataaggtatttgatccatccccacaataaccccatgaggtcggccctcttcccgggagaactgaagcttggaggagttcaggggcatcc

SEQ ID NO: 86856 - DNA, 601 bp, Human
cagtaatgtaagcaagctagggacttattcagccatggaaaaaaagtccagaggcagctagctgaggtgccttcaagaagagggtcagggactcagtctcttctcctgtgcttcaccagccttggtgctgattcttctccagggtcataagatgacttctggagactgagccatcacattcaaattggaggtgggaagaagagaaaggagcaaaagggccgaccaccccggccaagtcagcttctccactcccagaagtcactcccagacacacccattaggactgctgctgtcaaaaaaactgaaaatcataagggttggcaatgacatggagaaattggaacccttgtgcactatgggtgggagtgtaaaatggtgcagccaccgtgggaaatggtatggcagttcctaaaaacgttaatgataggattaccctctcatccatcaattccacttctgggtatatgcccaaaataattgaaagtaggatctcaaagagatatttgcacacccaagtgccttagacagatgaatgtatttttaaaatgtggtctacacatacagttcaatattattcagtcttaaaaaggaaggaaatcct

SEQ ID NO: 86857 - DNA, 601 bp, Human
tcctcctccttctcttcttcttctcctctcctcctcttcttcctccttctcctcctcctcttcctcctcctcctctcctcctccttctcctcttcctcttcctcctctcctcctcctcctcctgtcctcttccttctcctccttcttctcctcctcctcctccttcttcttccttttcttcttcttcttctcttccctcttcttttttcaagacaggatctcactctgtcacctaggctggagtgtggtagcataatcatagctcactgtagcctcaaactcctgggctcaagtgatactscagcctcgtctcagcctcccaagtaactgggactataagtgccatgtctggctaatatttttattttttgtagagatggggtctcactatattgcccaggcaggtctggaactcctggacttaagagatcctctcacttggctgaccaccttgcccagccaaaaaacttgattcttacatctccactgtcttctccatactgtagtctctaattctgtcaagatggtacttttgatagtttttgactgagaaaacacatcaaggtaagaactactatgaattcagcaaagcttttaaatt

SEQ ID NO: 86858 - DNA, 601 bp, Human
ttacaactcatccatgatgcctgaagggagcagatgtctttgatatatcattatgaggaaaatgaattatttacatactgacattttttgtgttttgtcaaaatctgagaacaccttagggagtatgctacatgtatgaagatcattcatcctcttgttgagaacaccttagggaatgtgctacatgtatgaatatcattcatcctattgtttcaagacaaaaaaaaggccaggaagcctgtactagactgtaagaaaattactttatagaaaagattgaggaagacaagattcctgctcrttgaaaacagtggggcacacgcatggccggaatctttgtcatctttgagtaaatgccccagtacggtgggccttccagcctcatgatggattgggttcttccacctgtggctcttggtgctgcccagattcaatatccagtttttctactctttgtcagcccagtctgacatattctgtggggtgggagaagggctccagacagattcaatccggacgtgataccagtttactgattgcatctcatttttgacacacttggttttcaagtgcagtgaggcccctctagcacttgctgttt

SEQ ID NO: 86859 - DNA, 601 bp, Human
cacgcatggccggaatctttgtcatctttgagtaaatgccccagtacggtgggccttccagcctcatgatggattgggttcttccacctgtggctcttggtgctgcccagattcaatatccagtttttctactctttgtcagcccagtctgacatattctgtggggtgggagaagggctccagacagattcaatccggacgtgataccagtttactgattgcatctcatttttgacacacttggttttcaagtgcagtgaggcccctctagcacttgctgtttcccctctcacaccttcartccctctttatttctcctgctgctcctcccctgcagctcccttcccaggccttgaaatgggagctggggctgattcagcacagacagattggctcataaatcttggccacatatgggccccacagagctccaggtgagagccgttagcacatctcccaggctcgaaatgtctccatgtccctaccagcatctggccttgagcagcagatccagccccacaccttcccagctcttccatcaccttctagcccccactcttctcaggccccctggagcctctgagctcattgagggccatta

SEQ ID NO: 86860 - DNA, 601 bp, Human
aggccttgaaatgggagctggggctgattcagcacagacagattggctcataaatcttggccacatatgggccccacagagctccaggtgagagccgttagcacatctcccaggctcgaaatgtctccatgtccctaccagcatctggccttgagcagcagatccagccccacaccttcccagctcttccatcaccttctagcccccactcttctcaggccccctggagcctctgagctcattgagggccattattaaggaagtctgtttggcagatgcccagttccctggcaggggtctrtggcaaaggtagctcagactccagagcctgcaatgtggctgtcaacacaatgggtggttctcctttggtatgggaatggactggtgtcacctactaggagaaagattaaaaagatgcaggtgaggatgactccctagccctgacacaactgtggttggaggggccaactaggtgacactgagtagccccgtggcccagaagctcagagaagcatgctgctaaggccatccccaggtccaggccagaccaccttgcccgcttgaccaggttacactccccatgcaggttccgttcttaatg

SEQ ID NO: 86861 - DNA, 601 bp, Human
gctagaatggacgggagcaggggcaggtaccagtagaaactgaaccggtagttgaggccttggggcccaggttgtcccagaccaaaatactctagaattctgcttgactcctcctggcccagcccagcatatacggttctgcctctgggcatcctaatccctcccagctctattgtgtcttaaggggctggggctcaatttgacggaagctctgctctgaggacaccccctcctgtgctcacttgctggatggattctacctgcttccccaggtggcctcagccaattctcactcctcttyactccattgcctcccatgaagccccagccacacagattcaccacaggggactgctttataactgctcttttaacaatagatcacttgccaccgaaactaagaatttttttttagccttcaggatgagaacattttgggcaggtatcaaactcagttatgaccttctctggaacacagagagaatagggtggaacatttgcagagcatccgaaagtggtgggtactgttattttgaagatctcttatttatggcaagctcaatgctctgctctatacctagaataaaggtaaaggacctgg

SEQ ID NO: 86862 - DNA, 601 bp, Human
cattttgggcaggtatcaaactcagttatgaccttctctggaacacagagagaatagggtggaacatttgcagagcatccgaaagtggtgggtactgttattttgaagatctcttatttatggcaagctcaatgctctgctctatacctagaataaaggtaaaggacctggccctgagctctttgaagcaaaaggttcatgagatgaaagttccagttcaaggaaggctcgggtcactttatattatagaagaggaggaagaattccacagagccccaaacccagagacagacctagagamggggaaacaaatggagataaaaggatttctgaacagatggtggtaacttaaatcaggagaggcagagggaaaaggtaacagaagtgacatggtggtcggcaagtgagagagcttaaagggaggctgggagtaggaaggtagagggaaggagagaatttaggtggcagagaacttgatgtgatgaaaagccctcagatgtgctgtacttttaaggataaaacagggagccgagtgggtcagatgggggatggggtgagcagggacgcacagtttggagagaatgattccagcagctggaga

SEQ ID NO: 86863 - DNA, 601 bp, Human
cccaaactacagctaatgaatcacaatctcaagaggaaaggcccttaaagaaacaattcttaggacagcgtaaacttgggaaaccaccaagccatgaactctctcttacccgtgggtgacctaattcctgcctctgctagaaggctgctgcctataggctgagctcagactggcattcatggcgggggaaaaaaagctttctttctgtttagagaccaacagtgacaacaatgattaccaacctttatcaactatgtgccaggcactctacagggggctctttggggaaaggtggatcatrtcacgcaatcctgccatagcctaatgaagcaagggctacaacaatctccatttttttgatggggatgcagaaggcagggaagtgaaatgtcttgcccagaggcacatgcagcaggtagccggcagagctaggtcgcgggcttctgaccactgtccccctctcttccccaacagattaatcatcttgagaccttgaattaactccctccagggtggcaactcacaccaccaccaacacgcatcccccacgggcagggaaaaagagcatagagtggcagctcctctgagaacctgcagtggg

SEQ ID NO: 86864 - DNA, 601 bp, Human
aactacagctaatgaatcacaatctcaagaggaaaggcccttaaagaaacaattcttaggacagcgtaaacttgggaaaccaccaagccatgaactctctcttacccgtgggtgacctaattcctgcctctgctagaaggctgctgcctataggctgagctcagactggcattcatggcgggggaaaaaaagctttctttctgtttagagaccaacagtgacaacaatgattaccaacctttatcaactatgtgccaggcactctacagggggctctttggggaaaggtggatcatgtcaygcaatcctgccatagcctaatgaagcaagggctacaacaatctccatttttttgatggggatgcagaaggcagggaagtgaaatgtcttgcccagaggcacatgcagcaggtagccggcagagctaggtcgcgggcttctgaccactgtccccctctcttccccaacagattaatcatcttgagaccttgaattaactccctccagggtggcaactcacaccaccaccaacacgcatcccccacgggcagggaaaaagagcatagagtggcagctcctctgagaacctgcagtgggcagt

SEQ ID NO: 86865 - DNA, 601 bp, Human
ctaatgaagcaagggctacaacaatctccatttttttgatggggatgcagaaggcagggaagtgaaatgtcttgcccagaggcacatgcagcaggtagccggcagagctaggtcgcgggcttctgaccactgtccccctctcttccccaacagattaatcatcttgagaccttgaattaactccctccagggtggcaactcacaccaccaccaacacgcatcccccacgggcagggaaaaagagcatagagtggcagctcctctgagaacctgcagtgggcagttgtgagaatgaggcacratggggaggacagcaaggggcagagtgctgacctccctcctgttggctctcaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcaggtatggactcttctctgctgggattcggactcggggtgg

SEQ ID NO: 86866 - DNA, 601 bp, Human
aagaaaagcagactgctcttactgggggaggggagggtgacgaaaccctggctttcctaccatgcttgtctcttgaaaaaaatattactagcccatcaaatttgtgatttcatagatattttggcttagggcaaactcaaagtggcatctatttaagtttaaaagcagatcgattgagaggtaaaaatgaatcacatgtagatgttgtcaaagtcttgaagatgatgccccagtgacgaatgtttggggaaagctggtgtagcctgtggctgtctcagcaaacacacaactgcaaaagggycctgacgccttacccccaggaatggctgacggtcagctcaagcatgtgtggggaaagtcagagatctttgggccaaaaagcccttttagtcacccttcaaataatattatgccaatagccaggcattttgtctaaggacagttcaatagctcagagcccctggggaggagaattgggggccaggaggagggaaagaagtgaaagggaaattttggacaattttgttgacgtagtggggcagggcagggtggttttgggtttgctgttggtctaacgctgtgtcccttattggtgggaatg

SEQ ID NO: 86867 - DNA, 601 bp, Human
attttggacaattttgttgacgtagtggggcagggcagggtggttttgggtttgctgttggtctaacgctgtgtcccttattggtgggaatgtgtcattcagatcctgaccggggaggactggaattcggtgatgtatgatgggatcatggcttatggcggcccctcttttccagggatgttagtctgtatttacttcatcatcctcttcatctgtggaaactgtatcctttgctgctgccccccacccctgcggcccccagcccccagcctgcagcacagtgccaaacgggcacgcccckcaggtccgggcggtcctgctcgggctcacaccacccagcctagaaccccatggcggcggaggtgggtctgggtggaaacctgcagctttggcatgggtgaggttcaccttcctgaaccctccgggcccgcagcggcgccgcgctccgggcgggctgtcgccgtaatctgggtgagcggcgccccctggcgttgcggcgtgtgcggccactcacaccgcctgcgatagggacgcgcgggagcgggccggctgccctggggccgcggcgtctgctcagaggcgggacgctccgggagggagg

SEQ ID NO: 86868 - DNA, 601 bp, Human
cggggccctatgttgtatcctatcattatctagacgggacagttccaggccacacagctgccgggcactgagcagagctcctccaggagccaatcctagatgagatccaccatccttttctgctttggcgacccaggcatctctggagctgcaagaggccaattgcgtgtcaggcagagcaggtgtagctcagccccatagcacttgtgactgagctgcacacgagaagcgtcctggagaaaggaagatggactcagacccaggggatctgtcccctctggccccaacaggccacagggcrgttccctcctacactgttccctatcactccagtaaacagccatttatttttttctgctgctgactggccaggactgccagcccagagaagaaacaagagttggtggagaagccggcagtgggggaatccaaggaggagaagattgagctgaaatccatcacggctgacggagagtctccacccgccaccaaggtgaggagctgtctccttcctggagctgtgaggccggtgctggggagggagggccacagccttcccaggccagaaccctgtggagaagaggagagaaagaaagacacc

SEQ ID NO: 86869 - DNA, 601 bp, Human
gtcaggcagagcaggtgtagctcagccccatagcacttgtgactgagctgcacacgagaagcgtcctggagaaaggaagatggactcagacccaggggatctgtcccctctggccccaacaggccacagggcggttccctcctacactgttccctatcactccagtaaacagccatttatttttttctgctgctgactggccaggactgccagcccagagaagaaacaagagttggtggagaagccggcagtgggggaatccaaggaggagaagattgagctgaaatccatcacggctgayggagagtctccacccgccaccaaggtgaggagctgtctccttcctggagctgtgaggccggtgctggggagggagggccacagccttcccaggccagaaccctgtggagaagaggagagaaagaaagacacccagtggaaagaaagccagtggggatgaacaggagagctgggagggggaagataaggcagattggctggatcccagccatctgctgatgtcttgaaggagatatgcaaagtgacaagtacctatttttgagctaagtcactgactaaaatgcaacttcaaggctactgc

SEQ ID NO: 86870 - DNA, 601 bp, Human
ttctctgcttagaacactcacaggcatccttgggaaccagactccctgtggtcacaccatcctcactcccctcctcctgcaagggaataggatgtggtttcctggagcttggatagaaagaacaggaagggcgttttcatatgcccggcattaaggctttgaagttcttaaaaccccttctagggtgaaaccgttagggaatttcaacgacgtactagaattattgaacaaatgcaatgggaggatcttgccttgatcctgaagcaacaaatacactttaaaatgacgttttagagggaawtgggggaaattgaatatggactgggaactaaatgattgaaagtagttttgttaatcttgttggtataatattttgtagttctgtttttaaactgctgcagtgtttatggccagagtctaaatgtttacgagttgctttgcttttaaaatattccaacaaaaaaaaaatggggacagagaagataaatggaacaagattagcaaaatgtccaaagttgttgaagctggttatatatatgaggtttagtatgtgagactgtactcttgtgtaaatctttaaggtttaaaatgaaagacagta

SEQ ID NO: 86871 - DNA, 601 bp, Human
agactgtactcttgtgtaaatctttaaggtttaaaatgaaagacagtaataaaacaaattccttagagccctgagaagagccctcccatggggccagcctccaggatgggcctccctgcacacacaacagggcagatctagcatgagggtcttttcacacaggcacccagctgcagccaggcctgtacggcagatacacctcttgcatcttcaacaaaaatctcaaattctattaatctatactcttggcttttcttttctttgttgctctaatgaaatcaaagagaagaatgttaatttwaaaaaaaaagggctaatgaggattttgtcaccaggtcggccatcctagaaatgcctctcacgtagctacccagtggctctgaggactgggggatgcttacgctttccagctgaaaagctcttcccaccctctgctgaggcctcaggattcttgagatttttgagtgtacggcccgctccccgtcatttctgttggttacatgtgtctctttactttcgtgttgagacctctggtccataccctgaggctgccctgactgccccaccacgtacaccagccaccactccggcctctgaagcc

SEQ ID NO: 86872 - DNA, 601 bp, Human
taccaaccaggcactcccttcagctggtagcagactcttgcgccctgctagaaactaagctccttgaggacaagaaccatggctttgtcttctcagccttgggctcaatactctgtaggcactagatcctacaaatgtctttactttatgtggccaagagcaaaatcacagaagtgaggatgagcatcagatggaggggggcaagggttgccaaggaccaagggtggggctttgagtgctaccctggttttactttggaatcctctgacctgccttctgaaatgcagcagcaactccagcrtgcagcagcacctcacttccgatgcttttttccaaacctccaagaacaaaaattagaaaagaaagatccctaatgtattctactggcatttgggagtaggaggctaggtggttcagttgccaaccccaaaatgagccttgcctgactttccctgatctgtcagcatccctcctcatccataatacctgctaagcatcacgtgctgtcaaagttgtgttcctttacaaatctgagtttgtccttcagaaatcgtttcctcttaagtactgtgcctgaggttcagctgctgtgtgtctgaat

SEQ ID NO: 86873 - DNA, 601 bp, Human
tgaaatgcagcagcaactccagcgtgcagcagcacctcacttccgatgcttttttccaaacctccaagaacaaaaattagaaaagaaagatccctaatgtattctactggcatttgggagtaggaggctaggtggttcagttgccaaccccaaaatgagccttgcctgactttccctgatctgtcagcatccctcctcatccataatacctgctaagcatcacgtgctgtcaaagttgtgttcctttacaaatctgagtttgtccttcagaaatcgtttcctcttaagtactgtgcctgargttcagctgctgtgtgtctgaatggaccagctaacttgcttctccccaggaatggagctcagcatggagcttcataaacgggggggagctcgtgcagatgtaagagcctgcaccgttttccattaggaagttcgaatggcacaaagctatagtaaatatgggtttctgtaaacacaaatgattaaaataagcataaaattacctgttatcaaattatcatgaagaagaaagtgttgggtcatttcgagcaaaactgaaaagaatacaaacacctaggcaggaatttaagatccttctcaa

SEQ ID NO: 86874 - DNA, 601 bp, Human
aaagctatagtaaatatgggtttctgtaaacacaaatgattaaaataagcataaaattacctgttatcaaattatcatgaagaagaaagtgttgggtcatttcgagcaaaactgaaaagaatacaaacacctaggcaggaatttaagatccttctcaattaaatttcacttgaaataccatgatttaggccaattctggttttacttattcgactttaagtagaagacttttcttttacataccaagggttgggtgtcacaagaactccaactcttgtcctgtagacagtttttcatcttrggcctctcttctgctgaaaaaatattaattgtcttgctggtcagctctaattaccctagggaaagaatctgattgatgtctgtatggtactggccctccaaaaaagccttgggtccctaaatgcttgaatgctttttgcttgataaagaattgctttctgtgccaggcattttttttttctttgcagtacctggctttgtttgaaccagaagagggagaacatgcagaggcacagctgtgtccatgagacgagcatcccataactatctttctccagccagactagtatccccttcacct

SEQ ID NO: 86875 - DNA, 601 bp, Human
aatgcagactatgtcttcactagtatctttacattagaaattatccttaaggtaatgcaacctgggcaatgcatcctctgtcgctttctttgtctatctctgctctgtctggctggatcttttgtcttttctgtttctttcactctctcttttctttactcccaagcctgaaattggaaaaatgagtgcccctcactttgtgtgatgcactttgcccagacttagaagccaggagcagcctaccccaccacagctcctccctccagccacccctaagcagtccgtggcctggaagggacaygtgttggctgtgccaacattaaggctgccatttcactggttggggctgcagccgtcagcagcgccagacatacatgcccacatgcaccagctccggttaactgatacctgagcccacgtaggactctccttccctcctcctgcttcatacactctgaaagtgggaaacctcctggggcgtgaaagaatcacttgagctactctctttggatgcccatccttagcaccttcctcagtacttgcagcagatattgggtctaagctggagttggggctgtgtcacagtgatcacaggcctact

SEQ ID NO: 86876 - DNA, 601 bp, Human
gagagagagtattcctccatttttcgggtatatttctgagtctctaaaccaatgcgtggcaagccagttcatctgagagtcagggtgtgagttccatgacctcagggaacgtgtgctcctctctgagcaagggggtagattctaccctttccccaaacagaaggactaaggctctgaagcccatgcttcagctttagcttcttcctgggagactagcctgggactccccctcccaaggagtccaggctcccttgtcatcctatcgctgtggccaatgcaagctgaagtccacacctaaccratgccactgccagctgcaggcctctccttccctgatgagactccctcatcatggcccagcctgttgatggacaggacagttcagtcacatccagatacaaattgaatggggcagtttttatgtgccttcccctgtgtccttgtccccaggacactcaggtgcccccagctgccatccctggttcctgctaaccaagtatgtggctcagatttttcttttctgctcgtggagagtagatctgaccaggccttggttcctggaggtcgggagagggaaccgaaagttgcgtggctgcactaa

SEQ ID NO: 86877 - DNA, 601 bp, Human
ggaccctccttctccctttctctcccctctctctccagccaaagcacctcatgtatgagtgtatgtgtgaatgtgtgtatatatatgtctgtgtaagtgtggggtgtatgtgtgcacgtgtgtggatgtgtggggtgtgtgtatatgtggatgtgtgtttgtggctgtgtgtatgtgtgtgtatgtatgtgtttgtgtttgtgtctgcatatgtgtctatggacgtgaatgtatatgtgtatgtatgtgcatatgtatgtgtgagtgcatgtatgtgtgtgactgtgtatatttgtgtctgttgtgtgtgtgtgtgtgtgtgtgtgtgtgagtttttcatttcactggtctggggtacagtctgggtgtgagttctaagagctttccaggtgactcccctgtacagccaagcttgcagtcctcgttcaggtgtggaggatctgattaccagtttctaccaagttctaacagctgatagtgtgaatcctacactttaactttcaaagcacttccacatacacattcttctgtggtcctcacacacacaaaacgatgggggagacggggcaagtgttatcatgattgtatagatgggaaattt

SEQ ID NO: 86878 - DNA, 601 bp, Human
gaccctccttctccctttctctcccctctctctccagccaaagcacctcatgtatgagtgtatgtgtgaatgtgtgtatatatatgtctgtgtaagtgtggggtgtatgtgtgcacgtgtgtggatgtgtggggtgtgtgtatatgtggatgtgtgtttgtggctgtgtgtatgtgtgtgtatgtatgtgtttgtgtttgtgtctgcatatgtgtctatggacgtgaatgtatatgtgtatgtatgtgcatatgtatgtgtgagtgcatgtatgtgtgtgactgtgtatatttgtgtcttgtgtgtgtgtgtgtgtgtgtgtgtgtgtgagtttttcatttcactggtctggggtacagtctgggtgtgagttctaagagctttccaggtgactcccctgtacagccaagcttgcagtcctcgttcaggtgtggaggatctgattaccagtttctaccaagttctaacagctgatagtgtgaatcctacactttaactttcaaagcacttccacatacacattcttctgtggtcctcacacacacaaaacgatgggggagacggggcaagtgttatcatgattgtatagatgggaaatttg

SEQ ID NO: 86879 - DNA, 601 bp, Human
tctctccagccaaagcacctcatgtatgagtgtatgtgtgaatgtgtgtatatatatgtctgtgtaagtgtggggtgtatgtgtgcacgtgtgtggatgtgtggggtgtgtgtatatgtggatgtgtgtttgtggctgtgtgtatgtgtgtgtatgtatgtgtttgtgtttgtgtctgcatatgtgtctatggacgtgaatgtatatgtgtatgtatgtgcatatgtatgtgtgagtgcatgtatgtgtgtgactgtgtatatttgtgtcttttgtgtgtgtgtgtgtgtgtgtgtgtgttagtttttcatttcactggtctggggtacagtctgggtgtgagttctaagagctttccaggtgactcccctgtacagccaagcttgcagtcctcgttcaggtgtggaggatctgattaccagtttctaccaagttctaacagctgatagtgtgaatcctacactttaactttcaaagcacttccacatacacattcttctgtggtcctcacacacacaaaacgatgggggagacggggcaagtgttatcatgattgtatagatgggaaatttggagttcaggacatcatgacacttgctca

SEQ ID NO: 86880 - DNA, 601 bp, Human
tgcactttttatcccactgtccctagcacagtgctgggctatggagatgctcactaattgcttttggattgactcattgattactgaacatctctgatactctgttctctgccttccagggaaagctgtacacctgttcagacagttccaagcagacagaggcggaatgcaagtgagtagaggtgggagggcagccagggccacggccggtcagccccaggaggctggaggcttgaccagaaaggagggacagctcattttctaagactgcagtggcacctgcgctctgcctgtgtgtcayctggcctcacggacacaatgtgtagcattttttgttcctgaagtttctgcccactgaagttcctcccatggctagaacggtgaagttcaagccaggcagtcccatcccacccagcattcaaggtcactggcaggccaggcgtgaaggaagatgggagatcccagagtaaactccttctcctcctctctcaggggcaactacatcacgtacaaagacggggaggttgaccaccccatcatccaaccccgcagctgggagaacagcaagtttgactttgacaatgttctggcagccatgatg

SEQ ID NO: 86881 - DNA, 601 bp, Human
cttttggattgactcattgattactgaacatctctgatactctgttctctgccttccagggaaagctgtacacctgttcagacagttccaagcagacagaggcggaatgcaagtgagtagaggtgggagggcagccagggccacggccggtcagccccaggaggctggaggcttgaccagaaaggagggacagctcattttctaagactgcagtggcacctgcgctctgcctgtgtgtcacctggcctcacggacacaatgtgtagcattttttgttcctgaagtttctgcccactgaagytcctcccatggctagaacggtgaagttcaagccaggcagtcccatcccacccagcattcaaggtcactggcaggccaggcgtgaaggaagatgggagatcccagagtaaactccttctcctcctctctcaggggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagtgagtatgcaaagcaaggccc

SEQ ID NO: 86882 - DNA, 601 bp, Human
gggaggttgaccaccccatcatccaaccccgcagctgggagaacagcaagtttgactttgacaatgttctggcagccatgatggccctcttcaccgtctccaccttcgaagggtggccagagtgagtatgcaaagcaaggccccacgagccctgacattcaagggccagtactgactttccagcccatccccaagttttgttaatgtcccgcactccctctggaggtcatatttacctgggtcctccccaggcagtgaggtgtatttctagaacttacagtccactgtcactgctgaaacygactcttctttctctagaaggtgtcaagaaactcccaccaaaagtgacctttttttagccctctttccaacctcagcatgagccacgatgtcagagatctctgtcattacccttatggcatctgggagttgggtgtggggagagcttctccaggtgtgggccctgtggtcaccataggattcaagattgccactcccagcatgcccttcattgggtaaagatggctgagatgtctttgttttatttgactggatcccggtctccttagaaaaagccttgcctgtatttacagtggaaagt

SEQ ID NO: 86883 - DNA, 601 bp, Human
tgcatcacctctaccaggcagcttcccatcagatccttatatctttgtatagatacctgcttttcccccaatatgtattccagtgaaattagaatctgaaagtcagaaaattctaaatgtttctaagtcaacagcaatgcatggatcttaggtaagagtcacattattatgtggtaagatataggtgatagctggagaataaccaagtgctgtgcagggctacagaggaaggggaagagataatccctgtccatgaaaaataacaagcttcatggggcacacagcccaggctcaaatgaayggcatatgtatgtaaactgcttatgtctaaaaccaggccattggtgatgatcggagtagcatgggtcatgtgagtgtttttatctaagtggatatttgctctcggagagatttattttacattccttctaacattctctgagctcatgccagtttgcaaagctgtctcaatatttaccaatatttccagtgttttaaatcaatgtccatgactcatgttacatttaaatagctcttcacagtttcaaaacaccttcctatacattattctaactaccctgcaaggtaggaaagtcaggaa

SEQ ID NO: 86884 - DNA, 601 bp, Human
tgatgatcggagtagcatgggtcatgtgagtgtttttatctaagtggatatttgctctcggagagatttattttacattccttctaacattctctgagctcatgccagtttgcaaagctgtctcaatatttaccaatatttccagtgttttaaatcaatgtccatgactcatgttacatttaaatagctcttcacagtttcaaaacaccttcctatacattattctaactaccctgcaaggtaggaaagtcaggaattattgtctccaatttacagatgaagaatctgagtctcagagagkttaaacgctttgcccaaggtcacacagccagtaagaggccgagctgggactccagcccagagctgtctcctgcaccctgatccctgggatccctggagcagtggtgccgtccttccgcagaggggaccctgcttctccagttccctctgtgggacctgtctcctcctgcaggctgctgtaccgctccatcgactcccacacggaagacaagggccccatctacaactaccgtgtggagatctccatcttcttcatcatctacatcatcatcatcgccttcttcatgatgaacatcttcgt

SEQ ID NO: 86885 - DNA, 601 bp, Human
ttgatttagttggccaggcacagtggctcatgcctgtaatcccagcactttgggaggccaaggtgggcggatcacttgaggccaggagtttgagaccagcctggccaacatggtgaaaccccgtctctactaaaaatacaaaaaattagctgggcgttgtggcgtgtgcctgtaatcacagctacttgggaggctgaggcaggagaatcgcttgagcccaggagatggaggttgcagtgagccaagatcacaccactgcactccagcctgctggatttaggacaggaaagaaaaactgagsagagaagtacccaaggagggtctgtggcatgggaagtaatcagtgagaagcacagctgtcagtcggtcaggaagcacattcttagcgatgccgactccctgccgaggcacatgccaggcatcaccagggtgaggaaaggaggtgtatggtccctgcctaggaccttgttacggggatttgacaagaaggggctctctccttgattaagggggccatggaaaaatcaagacattttccaaataacacctcccacctgtaagtgagccggagcggccaatgatttctcagacttccggagaa

SEQ ID NO: 86886 - DNA, 601 bp, Human
atgcgttcatttttggttgatcaatggagagaggggaggagatggagaacggagggatgagctggatgtgttcgttgttggttgatcaatggagaggggaggagatggaggagggagggatgagctggatgcattccttgttggttgatcaatggggagaggggaggagatggagaagggaggggaggagatggagaagggagggatgagctggatgcattcattgttggttgataagtggggagaggggaggagatggagaagggagggatgagctggacgcattcgttgtcggtaaggygtggcgtgtggagggaggtgggttctgcatccacctgtcttcagggacagagcttgttcccaagctctcttgagtgccagagtctccataaagttgtcacggccaaccagggaaatgaacacagatgtgttcagagatggcagagcagggaagatcttggaggttctcctgagtcctcctgactgcccacggagaggtgggcggccctctgggggtttggttcaaggaaggtcttgctgaggcgagggcctccgagaaggctgggcaaaaggtggggaggaggagcgacctccctgcccc

SEQ ID NO: 86887 - DNA, 601 bp, Human
gggatgagctggatgcattcattgttggttgataagtggggagaggggaggagatggagaagggagggatgagctggacgcattcgttgtcggtaaggcgtggcgtgtggagggaggtgggttctgcatccacctgtcttcagggacagagcttgttcccaagctctcttgagtgccagagtctccataaagttgtcacggccaaccagggaaatgaacacagatgtgttcagagatggcagagcagggaagatcttggaggttctcctgagtcctcctgactgcccacggagaggtgggyggccctctgggggtttggttcaaggaaggtcttgctgaggcgagggcctccgagaaggctgggcaaaaggtggggaggaggagcgacctccctgccccgtgttcacagctcctcccctctcctgatgcagcactacggccagagctgcctgttcaaaatcgccatgaacatcctcaacatgctcttcactggcctcttcaccgtggagatgatcctgaagctcattgccttcaaacccaaggtaggcctctgagaaagacctttgattcccaggcatcaggggtggacagaacggggagg

SEQ ID NO: 86888 - DNA, 601 bp, Human
gagatggagaagggagggatgagctggacgcattcgttgtcggtaaggcgtggcgtgtggagggaggtgggttctgcatccacctgtcttcagggacagagcttgttcccaagctctcttgagtgccagagtctccataaagttgtcacggccaaccagggaaatgaacacagatgtgttcagagatggcagagcagggaagatcttggaggttctcctgagtcctcctgactgcccacggagaggtgggcggccctctgggggtttggttcaaggaaggtcttgctgaggcgagggcctycgagaaggctgggcaaaaggtggggaggaggagcgacctccctgccccgtgttcacagctcctcccctctcctgatgcagcactacggccagagctgcctgttcaaaatcgccatgaacatcctcaacatgctcttcactggcctcttcaccgtggagatgatcctgaagctcattgccttcaaacccaaggtaggcctctgagaaagacctttgattcccaggcatcaggggtggacagaacggggaggtggggtgcaggtattgaaggcagaatgaggggaagagggaaaaaggcatc

SEQ ID NO: 86889 - DNA, 601 bp, Human
ggccaaccagggaaatgaacacagatgtgttcagagatggcagagcagggaagatcttggaggttctcctgagtcctcctgactgcccacggagaggtgggcggccctctgggggtttggttcaaggaaggtcttgctgaggcgagggcctccgagaaggctgggcaaaaggtggggaggaggagcgacctccctgccccgtgttcacagctcctcccctctcctgatgcagcactacggccagagctgcctgttcaaaatcgccatgaacatcctcaacatgctcttcactggcctcttyaccgtggagatgatcctgaagctcattgccttcaaacccaaggtaggcctctgagaaagacctttgattcccaggcatcaggggtggacagaacggggaggtggggtgcaggtattgaaggcagaatgaggggaagagggaaaaaggcatcggtgaaggaccatccctgctccgatggtcagtgccccaactcctacacctgcccagagctgaaccaggccaactccaggaaacactctcagctctcagtgttgaccctggctggcatgcacaagctgcagattcctcgctgagctgaac

SEQ ID NO: 86890 - DNA, 601 bp, Human
tctaaaagacactccacctaaatcctgccaatcaaggaacaagccagtttcctaggaagtaaccattgcgagtggtctaaactgtaaagtgcctcctaatttcctctgtccctggttttctattgtgagaagatggggcaagataacagagacttttacccaagaaggaagacagccatcctgggcccatttgcatttcacattccagggtacatctatggtgtaaagagaaaggaaaatggatctttccctgtgaatttccctaaaggggctctggcaagagggggataaaggtcaccamccagttaggagcatcatggagcacagctgagtccctggattcttactgagctatgttcttcattcacaaatagactccaggtaaagcagctccaaaattttcaggcagaaaaccaaactggaaaaacttgaagctctggaagaatatccagctggatctggcccaagaaccagtggcttctaaccatgacctgaatccatgacaactttcatttcccaccattaagtaggactctgtgctgcactttttatttcactggcatggttgtttgtgtatgacccagatgagcatcagcatttg

SEQ ID NO: 86891 - DNA, 601 bp, Human
gatctggcccaagaaccagtggcttctaaccatgacctgaatccatgacaactttcatttcccaccattaagtaggactctgtgctgcactttttatttcactggcatggttgtttgtgtatgacccagatgagcatcagcatttgctgtgaaaggatggctaggaaccaaggatgttgaagacagtctgaagttgtcactgcttatgtttcgtctctgcaactggctggttggttggtccatcagccggtcaacttgtattcttgcttcattctttcattgttttcatggtcatggatgktcccaatttcttcatttctgtgtgttctcctcaccactccatggaaaataaatttactcaagtaagtccctgccttaaatctaaccatcccactccttaaattcatactctgttcaaaaaaaaaaaaaaaatcacacaaagaaactaggaatcaacataaaccagtttagattgagtcggtccctgacaaagcctcaggaacctgcaggcatggtttgaagagagtgaggtggatcatgccagcattgatttgaacagtgaacagtgacccagaaggatctccttccctagaagtgagag

SEQ ID NO: 86892 - DNA, 601 bp, Human
actttgctggaggtgaggatggcaggagagggagccacaccgtaaatcctttacggccaacaggatgaggctgggtggtcctgaggcttcagccccttcgggcagctctgaggtcaccaaggagggaatgcacaggagcctggcgcgggaagcagtgtctgtctcagctactccagtgtcggctgctggtttggtagtgggagtgatgatgtcacttagttgcctgaggtttgctgtcgaggatgtctcagcaagggtactgggggggaggagctgcaggaggcgatgagtgagaggctgygctccaagcttctcctcctcagtggaatgtggtatgccaggaaggcaggggttcaccccgtggaaggctcctaactcctcccctccacacaggctccacctgggccgcagaggggtgaagcagctgagactcacctctgcccctcagctgaagccatcccactcagggagtagccagtgatcacctccccaagaggaggacgctggaggggccttgaccctggcagctctctggaatccaagtctcggtctccctttttggctttcccccagcctgagaatggtccagaggggagaatgg

SEQ ID NO: 86893 - DNA, 601 bp, Human
gccctaagaaggcagcaagcgcaggtgaggtctggagttagtcgctgctgcgagcccccatagggcgtgtcccgtgagccatggggcacccagacactcttttccacagtcgattggacttctgtctagacttccccatcagcattttattgccctagtgacagaaatctaacagccgtgagcccctctgggttcttagctgaccccctctggggtgcagagccttgtccagctgctggccagacttgccgcctcatggcctccatgccacttccgaagtggaggcagcctcctcaccacrgctcctctccagacttcctgccggcgcccttgccctgcacgctggtctctgctgggcccgacaggccttaccacagccatctggggctgtggctcctgtctgccaccacacacaaaggacgtggctggcattttcagaggatcagctaagaatggggcagcagttcagttgccacagtcttgtctgctttgaagcccctgttatctttcaggaaagaggaaatgaaggcagtgaagccttggccttggctgcttctcagagagtagagaggcagaaagaggagcggtttctccggtcccc

SEQ ID NO: 86894 - DNA, 601 bp, Human
aacgacgctaccagcatctaaactatcactcccctttcctgtggctaatgcaacccattagtcggcttttcaagccttcagctcagtttttcaccattccctctctttctcggtgcctaggccttgccattcttcgtattctttatttcaagaactctttgtttgtgtgacttgcttagtgttttgctgcaggctaaagttcaccaacaacccccaaaatattttgttgagcagctcacgtgctaggcggtaggcttggtaccagggactcaatcatgaatacaagcaggtaggtaaggcyacacttgcctggggcgactttggcccactcttgagacttgtagcatccccagttcaccctctcatttgtcactaggaaaactcctgtcagctggcattcatatttcaacttaaaagaagcagtcgataatcaatgcctacacctgagatcaagtaacatttagaagcactggagggaagcaaacaacatatattgtcaatgaagaaccagacatgaagctggatattttacttgccttatctcattcaatccataagacgaatattatggcctcccattttacatctgaagaaactggag

SEQ ID NO: 86895 - DNA, 601 bp, Human
aaactggaggtcagaaaaaggctaagtccagagctggctttttgttgttattgtcagtttgtaacaaacaccatcctgcttagtatgcaccctacactgctctaagcaccttaataggaatgcatttaatcattgtaaaaatcctgggattctattgcaggcttaggtgactcaaaagccactctttccacgacaaccctattaaaacaagaaatgtgaataagccatgttgttgctatgcgcttagtgagtcctcagtaaatgttagctgtcttccttctaagatccgagacagaaagaragaaagccattctcgagtcaccaccctctggaatggaaagtgttcactccactcctgtgtcctgccaccttctctgaggccccttgccgtccttccctctcattcagccattctgtctgtggcccctgcattccctagattgctttggacctttgaattttgtttccaaatctgagttgacaagcactttcaggagaggggtagtcagctgacaggtgggctcaggaaagtgaaaccgaagcctactacacactcatctgcatgtgtttccacacacacatgcacacacatttgcaatgg

SEQ ID NO: 86896 - DNA, 601 bp, Human
agtatgcaccctacactgctctaagcaccttaataggaatgcatttaatcattgtaaaaatcctgggattctattgcaggcttaggtgactcaaaagccactctttccacgacaaccctattaaaacaagaaatgtgaataagccatgttgttgctatgcgcttagtgagtcctcagtaaatgttagctgtcttccttctaagatccgagacagaaagaaagaaagccattctcgagtcaccaccctctggaatggaaagtgttcactccactcctgtgtcctgccaccttctctgaggcyccttgccgtccttccctctcattcagccattctgtctgtggcccctgcattccctagattgctttggacctttgaattttgtttccaaatctgagttgacaagcactttcaggagaggggtagtcagctgacaggtgggctcaggaaagtgaaaccgaagcctactacacactcatctgcatgtgtttccacacacacatgcacacacatttgcaatgggaagacttacacattggggacacaaaaattgccaaattcatcaatggcgggagctgtttcatgttcatctctgtgccatga

SEQ ID NO: 86897 - DNA, 601 bp, Human
cctacactgctctaagcaccttaataggaatgcatttaatcattgtaaaaatcctgggattctattgcaggcttaggtgactcaaaagccactctttccacgacaaccctattaaaacaagaaatgtgaataagccatgttgttgctatgcgcttagtgagtcctcagtaaatgttagctgtcttccttctaagatccgagacagaaagaaagaaagccattctcgagtcaccaccctctggaatggaaagtgttcactccactcctgtgtcctgccaccttctctgaggccccttgccgyccttccctctcattcagccattctgtctgtggcccctgcattccctagattgctttggacctttgaattttgtttccaaatctgagttgacaagcactttcaggagaggggtagtcagctgacaggtgggctcaggaaagtgaaaccgaagcctactacacactcatctgcatgtgtttccacacacacatgcacacacatttgcaatgggaagacttacacattggggacacaaaaattgccaaattcatcaatggcgggagctgtttcatgttcatctctgtgccatgagaggcattc

SEQ ID NO: 86898 - DNA, 601 bp, Human
cattggggacacaaaaattgccaaattcatcaatggcgggagctgtttcatgttcatctctgtgccatgagaggcattcagtgaaagtttgatgcatgcatgcatgaatggatgaatgagaattgtgagcccggaaaagaaagtcggaatattagtgtcagaaaggattgagaccattgagcttccatcagtgcagaaatctctacacagtcctactttctgccatacaagtctccttgtttctagaggtagctctgttggaaatccttctttatactgaattaaaatgcacccctctgtracttccacttatccgtacttccttttccatcttttctttctataagtagttcttgagcgcctcagtgatgatgttgaagcatggtaccatctttatagggctcacagagtagtgcgggagacaccaatacacaacaaacaaaggtttcagatggggtaagggctggggtggggaaactaaagagtgtgagtgaagaggcacctgttgaaaataaggaggtcaggaaggcaccatttctgctgagccctggagggtgaaaaggagccagaagaggagcatttcaggcagaaggaagagcaa

SEQ ID NO: 86899 - DNA, 601 bp, Human
tggagtcacttttgaggaagacgttttcatctctatgtagtctttcgatgtacagggaaatgccttaaaatcttttgcaggagcccaggccttcgtcgttcactgctctgtgttcagccctgctctttgggaaggtattcaagaacagtctaagatgttgcctgaagaaaaaaaagtggcagtctagtgggacaagggtttaggatttgggatgaaaggaaagtggctgtgattgggtcacgttcaaacatcgagactgttggttcctgcctggcattctccctcccatccctcccctgcygtagcctctctgggtccctgcagaagcttcgctgttcctcgtggttctgcttggtcctgagtgcccccacgagcctctccgtggttccccattgtccacagaggaagctgctctggccggccccgtcctccagcccttgtctccttttcagagccacccatgctctcaccttttccgtgtaataaataataaacacctctagtgctgcatccttcaagctgcctcccgagatcagcctggctagaagtggtctccaccacctctgagctcccagagcacccttttccctcttttctggta

SEQ ID NO: 86900 - DNA, 601 bp, Human
caggactgtctcttggtggcatccacactgacctccttccaaatgctagcccaggaatgccgtgtgcctgtcatctctgtcagtgtcagctgaatgaaggccaacggaagacaagacaggcagcttcctctggggtgcccctcctcgcaaaagtgactccagcccctggctcacaagctccggcatccagcaaggacacccccttcagttctccacccaccacaggagcttgtcactctctggggtggtctgccggaagagaaagcagagatggaaggcaaagacagtggctccggagccrccatccgtgccgtgctcagcaggacttagcagcatggccacccaggtcagggaaattctggctcaagtgtgctcagacagttcagtgcagaactcagggccagtgagaggtgctgggccctgagactacctcaggccaaagttctgaaattcaaccctcccaggctcattggaggatggggtccttgtttgggggtttgttttgtgtcattggttttttgtaacgccgatgaacacttccacagacctagtgttctacagaacacagttctggaaatctgtagggcgtcaccatgattcg

SEQ ID NO: 86901 - DNA, 601 bp, Human
cgcattcccctgattattatttatttgcagagtgcccacggggcaccgggtgccacgcagtgctccttagacaggcaggccccagctttgccaggaggaccttcccccgctccccccgccccccatggctctgcactcagggatttgcattttgttacaacactgtgacaggtttctttccggccttgtgctggagagcttaaaagtcactatgaagcataaaaaataattatatgacttgcataaagccttcatgtgggaaggctagtattagctattacatttaattatttaatgtagraaattattcacacggtgtaaaaaagcccggtgggaaagtacactgtggtttccgtctctggccctgccacagggaaggaaactggaacacaccggtctggtaggaagaagagggattcccagacctacagggtgcgtcggcgataacccgacccaccaaagcccgaggtgctgccagtgcttccggccctgcgctgggtcagcctgccttaggggcaggaaggaccttctgtgacacaggctgcgggcagtacaggaaggtagcctctcagcaagaaccccaccaacaacagcaatagta

SEQ ID NO: 86902 - DNA, 601 bp, Human
tacagggtgcgtcggcgataacccgacccaccaaagcccgaggtgctgccagtgcttccggccctgcgctgggtcagcctgccttaggggcaggaaggaccttctgtgacacaggctgcgggcagtacaggaaggtagcctctcagcaagaaccccaccaacaacagcaatagtagcaactgtagcaatcagtgagcacgttctcggtgccagacagggcaggtgtgaacttatatcattctcacaaagccctataaggggccaggcacagtggctcacacctgtaatcccagcactttakgaggccgaggccaaagggccgtttgagcccaggagttcaagaccaccctgggcaagaccccatctctaaaaaaaaaaaaaaaaaattctatttttaaattagacagatatagtggcacacacctgtagtcccagctccttgggaggctgagacgagaggatctcttgtgcccaggagatggaggctgcaatgaaatattattgcaacactgcactccagcctggatgacagagttaaaccctgtctctaaaaataaaataaaataaaaaccctacaagggcaagtactctggttattccc

SEQ ID NO: 86903 - DNA, 601 bp, Human
gaggcaagcacccagccccctgcccactcctgccctttgtccaagcagtcctcaagctagctgtgcagcgtgtgtcttggggtgcttctgaattaacacatcacaggatgggagctgacagaggagggcagaaatccccacctcctcccaggctgctggcagctgtgtgctccagttatgccttctccattaggcgccactaatttccatgattactgttatgtctaaatggcatcctggtgtaatacaatttatattatctctgcttggtgtcggttaccattgttttcatgatattcartgggatcaactctgcatagacacacagacacgcactgagacttcaccaccaccgccgccagctgccagtgggacccagctcctctccccggttcattcggctctcatcatttctgggacccagaaaagatcagtgtttccaggagctgggcacagctccctcccccacagccacctctgcccagcgccctgcctggcgcacctgtgctctctccagtgcttgctcactcaagcaggacctctgctctcttgcagggacccccttccctaggtccggtgaagccatctgttgcccctccct

SEQ ID NO: 86904 - DNA, 601 bp, Human
gcgtgtgtcttggggtgcttctgaattaacacatcacaggatgggagctgacagaggagggcagaaatccccacctcctcccaggctgctggcagctgtgtgctccagttatgccttctccattaggcgccactaatttccatgattactgttatgtctaaatggcatcctggtgtaatacaatttatattatctctgcttggtgtcggttaccattgttttcatgatattcagtgggatcaactctgcatagacacacagacacgcactgagacttcaccaccaccgccgccagctgccmgtgggacccagctcctctccccggttcattcggctctcatcatttctgggacccagaaaagatcagtgtttccaggagctgggcacagctccctcccccacagccacctctgcccagcgccctgcctggcgcacctgtgctctctccagtgcttgctcactcaagcaggacctctgctctcttgcagggacccccttccctaggtccggtgaagccatctgttgcccctccctccctcagcgccgccccaccgtggcagcctccagctgcttcctgactgatgttcctacccctgtctcc

SEQ ID NO: 86905 - DNA, 601 bp, Human
gatgttcctacccctgtctccaagggcccttcagaggacccgttgtccttttccactctctgtctcaatctcagcagccccacttctaatccagccccgaagtcctgcagcccctccagccagcacgctccgtgacccatgtgtcctaggaggggaaaccaggtgttcagagtcagcttccccacagggccggggaactcaggagctggctgcctcccctgtgtttcttggggcagataaggaaggcaggcaggaaggaacagagaagagaaagaaatgagtcatggcagtgacagcaccyctgccctccaaatgcctaagactgacagcaccaccccaggcaaggagtgaaaggtgtgcggacttcgtcgtggacgccttcttgccaccagcctgactgaaagctggtgcggcctctgctctgggcagagaaggagcgaaggactcggaattgaagggcaaaggcatgcacccgtcaccccttccacagcagtcccctcgcagctctcctgtaacagacagaaaatgggcccctgccaccacccctctcgataaaagaagagtggcttctaagaacctagcagttaactgtctacatgaa

SEQ ID NO: 86906 - DNA, 601 bp, Human
cgaagtcctgcagcccctccagccagcacgctccgtgacccatgtgtcctaggaggggaaaccaggtgttcagagtcagcttccccacagggccggggaactcaggagctggctgcctcccctgtgtttcttggggcagataaggaaggcaggcaggaaggaacagagaagagaaagaaatgagtcatggcagtgacagcacctctgccctccaaatgcctaagactgacagcaccaccccaggcaaggagtgaaaggtgtgcggacttcgtcgtggacgccttcttgccaccagcctgaytgaaagctggtgcggcctctgctctgggcagagaaggagcgaaggactcggaattgaagggcaaaggcatgcacccgtcaccccttccacagcagtcccctcgcagctctcctgtaacagacagaaaatgggcccctgccaccacccctctcgataaaagaagagtggcttctaagaacctagcagttaactgtctacatgaactcgagtcttacaaaatgcagccgtgacaacctgcaccctgtcgccaatcccaaacagcgtcagccagatttcattcaggagagtttgaatactagt

SEQ ID NO: 86907 - DNA, 601 bp, Human
cttcacccatcctggctgtccagtctccggggtggcgtttctgttttctttcggcagaaatgcctgggaaccgaaaggcccctttccctgtgacctgacctcccacgctaagaataacagccccaggacagcatgtctttcggtccctctggaaagagggcatggctgggaagtgggaagttaagggagctggatagagctgggaggaaagggaagaacacagattcttggctttgtgagtaaaaaatgaagaggaaaagttggcagccttcaagtgagctggggagagatctggggaacstctcggaggacgcttcatgctttcataccccactccgacctcagaattccacctcctggaagcccagagggcaggcaaatactggtcccactgaaaaaatgtggccagccctgtcttgtccccttcgcagaccatttctaaactaaaggcgtgaatgttttttcttaaagaagacaaatctctgtagtactcggtccttccccctccacccatggggaatatgaccgcctgtagctgggggtgtatgggggactatgaccgcctgtagctgggggtgtatggggaatatgatcgcctgta

SEQ ID NO: 86908 - DNA, 601 bp, Human
tatggggaatatgatcgcctgtagctgggggtgtatgcacccattcagtcacagaacatcgctgtgcaggcccctacacctcctacacccaagaaatccatctgctaaagagtccactcatccaggacacctggggtcctatagggcctctgggacagcccattccttggttgacctgttgtccaagtacatgaaaaaagtcttttaagaacattcgtcccttctcttctccaaacatggtgaaaaataaacaaaatccatagctacagaatcaagtggtaaagtcaggatactggtcttycccttctgtgccagaatctctccttcagggcaccactgtcttcatccccttctaggcagccagcctcccccaacctaccagcctatccctagcaaacccatcctcaggaaacgctttgatcaccgcgtgccctctgcgcggcgtctgcattcagcaggaccctacctccaaatgaccatgaaagaacctggggaggggcttagaaagcctcagaaagccctgtcaagagccacataacacactcccggagtaggagcccagccttgcctctgtctcctttcccttaggaaagtctttgcc

SEQ ID NO: 86909 - DNA, 601 bp, Human
ctccagagaccatggcccctctgtctccctgtgtctctgagaactgtctttgtccggtgtgtgtgtatgtgtatgtgtgtatatgtgagtgcatgtctgtgtgtgtgtgagcatgtgtgcatgtgtgtatgtgtgtgagtgtatgtgtgtatgtgcactctctcttaacttctcccagtaaatcctcagatcatttttttaaaattagtcttcctactcgtgctctgagactcctctcccctttctgaatggaccccagttttgcagctggatgagccccaagttgctgttcccactcatrcacataaaggccagagcttctgtgcccagagcttgtgccatgcagtgctcagccgtgggagacactgcagggagagaaacaggaaagacagggcagcagtgggctctgccctcaggaggtttcctttccagacagcagtgcagagccacattaaaatctatgcagaggggccgagagccccacagcaggaaaacgcagaaaggtgaccgcaagctgcccccctgtacagtggcccactgcagctctgggggtcctatgggttcttcctacagtcaccaaggccccatcgctcagtctgca

SEQ ID NO: 86910 - DNA, 601 bp, Human
gggaggaactgtggcacccaggcaaatgacattccttccaaagttactgctggtgtcactcggagggcctagtctccaaccaagaccttttggttagtctaattataacttacaacccacagtcgaaagccctgtttcccagatatgcttagacccatagagatggccaacaggtacaaccagatcaaagccagcacacacacacttaccacggcccataactctgggccttgaggggcctgctctgaaagcacagtccggcttgaccctgggctcacatcgcagccagtgtgagggacarcagcttaattgagcaaggtcgctccctcccactagattctgcctccagggcattagcagcgtatgggcggccccagcattttcttccaatcccatgggatccttcagaaaatcctgcatccctgggccctgctccgggccttcccaggtatttttagtcatcctctcatcacaagacatatattcccagggatatggtctatttggaaagagtctacattgttagcctcagtgtgatccatgagggcgtttcacctgtaacctgccatctttaactcctaaacccctccccagatgcctt

SEQ ID NO: 86911 - DNA, 601 bp, Human
cagtatctgagccatgggccccggcccttctcctgccaatgcatcacctgggtctaaatccgagcttttcttcctctgtgagccggggaggtaagagtgcgatgtcctgctgctctagggaagcctcttgctcttcctcagtgcttgggtctgaaatcatattttcctgtgattgttcgtgaaagttactacagcaccagaaactgctccctaaacatcccaaactggaattaatttgactgcttgggccaacagcctttcccgacacacttctttttcattttgtattttaaaatatacygaacaatagaaagtgctgggcagcctgaattcctgcattatggacatagagaaacattcccaagttgtcaatgaagaagccttgattatgcttccagctctggtgacttagagcaatgaactccattctctgggcctcaatttccttgaatgcaaaagtgaggagtgagaggtttaggatggtctcttgcaactctagcctgcagtgattctgacttgggcattttctgacagctggaggtggatgcttcattgcccccattgccttgctgggttctgaggtggtgtttcctgtcatcag

SEQ ID NO: 86912 - DNA, 601 bp, Human
ctgacagctggaggtggatgcttcattgcccccattgccttgctgggttctgaggtggtgtttcctgtcatcaggcgcccatggtgtcatggggatgcttcctccagggaatcatctgcatagagataatccctgaagccacagtgctgaagggcagcaagggaggacaggctcccttggctttggtggagctcacctggagattctccagagaaaaggagcaggagaaagaccttcggggagcagagcaggcacagggaggggaaagaacactggccctggagcttctgggcacagctckcaggaggaattgctggaggctttgcacgatgcacaggagtgtccagagcagggaaataaagctaagcgaaggtggcactggctgtgaacatgagaagaggaccgacatgaggatgacctgatgagcacggatcaggcatcatgctgaggacaccatacacatgatcggatgaaacccgtgtgcttactctccacatgaggaaatcaaggctcagacaggacgaacatctgcccaaggccacacggtgaatgggaggcaaatcttggattcaaactcatttctgtccaagaattggctctt

SEQ ID NO: 86913 - DNA, 601 bp, Human
aggatgacctgatgagcacggatcaggcatcatgctgaggacaccatacacatgatcggatgaaacccgtgtgcttactctccacatgaggaaatcaaggctcagacaggacgaacatctgcccaaggccacacggtgaatgggaggcaaatcttggattcaaactcatttctgtccaagaattggctcttgcatttcacagtgcccgctggctaaatccctgggccaggctggcctgggcatcactgaagggcagggcccagtggctcctgcactcctcattcagtgcctcctggcaacrggacttggggcggagctgcctgacttgacttctctgtgtcggttgatgctgcggatgctggatccacaaagcctgggatccccctgggatgctcagacagaatgcaggctacacacccggatccgtgtctctggttacagggaacagaaggcaaacgccaggaggcgcagagcagcaccactccctttgcccagttggcatctgcatctgcagctgaagaaagagactgggaggaggggggccagaaggagcaagcagcgacaaggcagggcagagagtgtccagggatcagcatgtcgg

SEQ ID NO: 86914 - DNA, 601 bp, Human
tcctcattcagtgcctcctggcaacgggacttggggcggagctgcctgacttgacttctctgtgtcggttgatgctgcggatgctggatccacaaagcctgggatccccctgggatgctcagacagaatgcaggctacacacccggatccgtgtctctggttacagggaacagaaggcaaacgccaggaggcgcagagcagcaccactccctttgcccagttggcatctgcatctgcagctgaagaaagagactgggaggaggggggccagaaggagcaagcagcgacaaggcagggcagrgagtgtccagggatcagcatgtcgggatactggtcccaagtcttccccaccttcaggccctgaaagcctttctaccttagtatctttccaccataggcccccaggcacaacttcctataactgtcactcactactctccacaacaatcacaagcaagccgggctcctctctggctctgggtcctggaaggatggaggaaaagcagtcagtcctgagtcatagagagagctacttgctgcacgtccaccccctcaggggtgagtcagctcagcctgcacgactccagccctctctctcggc

SEQ ID NO: 86915 - DNA, 601 bp, Human
ggatccccctgggatgctcagacagaatgcaggctacacacccggatccgtgtctctggttacagggaacagaaggcaaacgccaggaggcgcagagcagcaccactccctttgcccagttggcatctgcatctgcagctgaagaaagagactgggaggaggggggccagaaggagcaagcagcgacaaggcagggcagagagtgtccagggatcagcatgtcgggatactggtcccaagtcttccccaccttcaggccctgaaagcctttctaccttagtatctttccaccataggcccmcaggcacaacttcctataactgtcactcactactctccacaacaatcacaagcaagccgggctcctctctggctctgggtcctggaaggatggaggaaaagcagtcagtcctgagtcatagagagagctacttgctgcacgtccaccccctcaggggtgagtcagctcagcctgcacgactccagccctctctctcggcctgcaacccacagtgcttgcgttggacagtgggcctggctgtctctgtctgcctttgtggctgtaaccacgcctcctgccccctgccatggcagagaaggg

SEQ ID NO: 86916 - DNA, 601 bp, Human
tctaggacacatagattaaatcaagttccgtggtctcaggacagctgggtggggcagaggttatccttgacatctccctccagccccccttctcattgctggagcctcctgttgccctcggagtcccttccagcttcttcccactttcggcaacagcccccacccccaacaaacctaatgctaccaagatgccttgtttcaaaatgaagtgattccagcacagtcattcatgctgggtggtagcaactcagtgagctgcccttctaatagatcattgtaccttgaagagaaggcgatgctyaacctgcaggtggaatgtttattgtatctcaggtgagcctttagcaacgtgacccctgagtggggagattacttttgtgaggtccctccccatccccccacaaaggctgttttctactctgcttaagagtatggctggcccttgagagagttagcagagccaccctcattcctagaagtgggatgaagcatctgaccatcagcagtcccctgggaggaggccgaatgccccggatctcaaggtctagggcgaggcttgttgtgtgaactggtgtgatgtggggttgagggggtgcagaca

SEQ ID NO: 86917 - DNA, 601 bp, Human
ctcggagtcccttccagcttcttcccactttcggcaacagcccccacccccaacaaacctaatgctaccaagatgccttgtttcaaaatgaagtgattccagcacagtcattcatgctgggtggtagcaactcagtgagctgcccttctaatagatcattgtaccttgaagagaaggcgatgctcaacctgcaggtggaatgtttattgtatctcaggtgagcctttagcaacgtgacccctgagtggggagattacttttgtgaggtccctccccatccccccacaaaggctgttttctrctctgcttaagagtatggctggcccttgagagagttagcagagccaccctcattcctagaagtgggatgaagcatctgaccatcagcagtcccctgggaggaggccgaatgccccggatctcaaggtctagggcgaggcttgttgtgtgaactggtgtgatgtggggttgagggggtgcagacagagagacgggcctgagaagtggcctggtgcagcaagtcttctcaaaagcttttgccttgagaagtaccctgcaggtttgacccgaaaggtcatgggaacctgtttttttataggca

SEQ ID NO: 86918 - DNA, 601 bp, Human
ggaaggctcaaagatacgtagggtgcctcgagaagcatggccacttctgttgatgcccacttactctcatatttggtgctcccacccagggaatcatctgtttgtttcctttttgagtctctgccccgccctgcctcacccactctgtttctctgcctttcttctctatcttgtgacctctccctctggcataaggaattctttgatgtagttagtactactggcaccttgatttcattcgtttattcttcatgggctttttgttggtggaggttggttggtttgtttgaatgactagacrctgggctgtccttcccaggggaagatgaaactcccaggcaattctgtgatcagtcttgtttagtgtgtgtttctggcaggtaataacaccttgggagccatcaggctgcacatgataacagtgagaccctgaggcttcagccacttccagccagcaaactggtcactgcagccagtagcacagggcatagctctcagccatccacagcttcacacacaaagcaggaagagcaaaagagggccaggagctgcagccccacgctgggagcccggctgccagtccccttggggccaaagaccc

SEQ ID NO: 86919 - DNA, 601 bp, Human
gagaaacacaaaagcccgtgggtttccgacctgggggtggtggcccgggacagagtcctttccatggtccctgtccatctttagctttatcctggtgcgttccctgccctttgtttgtcttcttctgctcagtgctcctcctccatcacttctgtctctccactcacaccaaaccaaaatgggaattctgcttagaattgctttcaactacgcatacctcattcatttgctcttctgtctgaaagccatggcctctaccctcagcttctgtctatcccagctaacgtttgtttaaccttcrcctctcttagcaagtacctgttcattcagctttagaaggcttgcagcttaaaacatgcttgcctttggcctccttaaaatgtcttgccccgctgccatacccagtggctccaagattcagcacctcccgactcctcctgagatgtgcatttctcctggtgggaaggggagataaaaggatcgtgaggatccccccacacacacccttaacctacacctgctggctcctggccatgaagttggcgtcagatgtctccagcagcccctgacccctgccattcccagctctctctctgcacca

SEQ ID NO: 86920 - DNA, 601 bp, Human
accccccaacagaaccagctgttgtgtcttgcaggtcaaattgagattggaggtagtacaagcggagaagcggagcatggggagggggtactggctggatggagaccttcaggtggcttggaatgaaatttatatcagatccacctccctaagttctggacaagacattttaaaaaatatagcaagggttctgtagcaggaccactatttagagactcacactcccatgacattacttttgacatctgtttcagaggtgcgtggaatcttagtgacactgaggtcatagcattgtctcaakggcagccattggaattgggcagccgttttctgtagggctaagaccagccttccctggaggagatcagaggtaatctgcacctttcaaaatcagcctgccaaggagaatgcagccatggcttatgcccccttcacaatgctctctggccacctgaccgcaggagagtattgtggaggacaactgggttgggtattccagcctagagatctactgctcagcccctgaatttctataattcttacccttggctgtgctttaaaaaaataataatttttaaaaaactttttttcgtatggtgaa

SEQ ID NO: 86921 - DNA, 601 bp, Human
attgagattggaggtagtacaagcggagaagcggagcatggggagggggtactggctggatggagaccttcaggtggcttggaatgaaatttatatcagatccacctccctaagttctggacaagacattttaaaaaatatagcaagggttctgtagcaggaccactatttagagactcacactcccatgacattacttttgacatctgtttcagaggtgcgtggaatcttagtgacactgaggtcatagcattgtctcaatggcagccattggaattgggcagccgttttctgtagggcyaagaccagccttccctggaggagatcagaggtaatctgcacctttcaaaatcagcctgccaaggagaatgcagccatggcttatgcccccttcacaatgctctctggccacctgaccgcaggagagtattgtggaggacaactgggttgggtattccagcctagagatctactgctcagcccctgaatttctataattcttacccttggctgtgctttaaaaaaataataatttttaaaaaactttttttcgtatggtgaagagctatttttcaactaccttttaagtctccagagagac

SEQ ID NO: 86922 - DNA, 601 bp, Human
gcccctcagcatcctaaatgtggcctagacctggcactccaatgaaaataagtgcatagtgagtgccttccagaaacaaagacttcatccactgaggtgttacttctcatttgaccctgaacttaattcagaaagacagctttccagagacctccctctcattagctgccctgcaccactcccctcctcactgccagttctgccaaaacaaggcaatctgcataagcatattgaaggaaggaaatcgtctttcctttctgtttgccctgagcctgttatctggaaccactaaccagagctygctgtctctgaaaatgcccgacctctgcctcagatacggaataataacctcatttcatttatatcaattacgtgaacaaattaagttaattgccccaatatcatgaaatcattgaaaattaccagatcattagaaaacaaggatgaaagaattggctgctcagaaatttctccacgcctaccattagtggagacagtgccatatgaaaaatcagccagaatgttcaggttatgtaagcagctctgttggctgccctaaaaggggaatgcagtctccaggcttgggggtgtatgtcttcag

SEQ ID NO: 86923 - DNA, 601 bp, Human
cagaaacaaagacttcatccactgaggtgttacttctcatttgaccctgaacttaattcagaaagacagctttccagagacctccctctcattagctgccctgcaccactcccctcctcactgccagttctgccaaaacaaggcaatctgcataagcatattgaaggaaggaaatcgtctttcctttctgtttgccctgagcctgttatctggaaccactaaccagagctcgctgtctctgaaaatgcccgacctctgcctcagatacggaataataacctcatttcatttatatcaattwcgtgaacaaattaagttaattgccccaatatcatgaaatcattgaaaattaccagatcattagaaaacaaggatgaaagaattggctgctcagaaatttctccacgcctaccattagtggagacagtgccatatgaaaaatcagccagaatgttcaggttatgtaagcagctctgttggctgccctaaaaggggaatgcagtctccaggcttgggggtgtatgtcttcagggaatcctacggcccctttcttccccaagaaagaccacagatgggagaaactacaaactaactcagggca

SEQ ID NO: 86924 - DNA, 601 bp, Human
ggctcgccgcacctatagaccaacagctaagcaaggccatctcctgcctgagcctgagctttcagaacaagccccattatggagtgggttgaggccacctctggaggccctcctcagtgttgacttgaagtcggtctcccctaaacctgagaggccactgcccttgctttgtttaaatatatgtgggcaaggataggctctggggtcagcaaggcctctgtccttcagctggccctgcctggggtaagctaaagtgcacaaagcctaagtcctcataggttaacaatggctaataaaaaamaaattaaaacaggcttggcacagtggcttacaccggtaatcccagtactttgggaggccaaggcaggaggatcgcttgaggccagcccacgagtttgagaccagcctgggcagtatagtgagaccctgtctctaaaaaaattaaaataaaaaatttaaattagccgggcatggtggcacgttcctatagtcctaactactagggaggctgatgtgggaggatcatttgagcccaggagttcaaggctgcagtgagctgtgattatgccactgcactccagcctgggcaacagagctgaga

SEQ ID NO: 86925 - DNA, 601 bp, Human
agtcggtctcccctaaacctgagaggccactgcccttgctttgtttaaatatatgtgggcaaggataggctctggggtcagcaaggcctctgtccttcagctggccctgcctggggtaagctaaagtgcacaaagcctaagtcctcataggttaacaatggctaataaaaaacaaattaaaacaggcttggcacagtggcttacaccggtaatcccagtactttgggaggccaaggcaggaggatcgcttgaggccagcccacgagtttgagaccagcctgggcagtatagtgagaccctrtctctaaaaaaattaaaataaaaaatttaaattagccgggcatggtggcacgttcctatagtcctaactactagggaggctgatgtgggaggatcatttgagcccaggagttcaaggctgcagtgagctgtgattatgccactgcactccagcctgggcaacagagctgagaccctgtctctaaaaccaaaccaaacaaaaaaattataaacctccatccacaaaatcccaaagacctcatctgcttatctaataatattatgaatgtgagttatttaaagggcataggtaggagaatgc

SEQ ID NO: 86926 - DNA, 601 bp, Human
taaacctgagaggccactgcccttgctttgtttaaatatatgtgggcaaggataggctctggggtcagcaaggcctctgtccttcagctggccctgcctggggtaagctaaagtgcacaaagcctaagtcctcataggttaacaatggctaataaaaaacaaattaaaacaggcttggcacagtggcttacaccggtaatcccagtactttgggaggccaaggcaggaggatcgcttgaggccagcccacgagtttgagaccagcctgggcagtatagtgagaccctgtctctaaaaaaawtaaaataaaaaatttaaattagccgggcatggtggcacgttcctatagtcctaactactagggaggctgatgtgggaggatcatttgagcccaggagttcaaggctgcagtgagctgtgattatgccactgcactccagcctgggcaacagagctgagaccctgtctctaaaaccaaaccaaacaaaaaaattataaacctccatccacaaaatcccaaagacctcatctgcttatctaataatattatgaatgtgagttatttaaagggcataggtaggagaatgcctgtgggtccttg

SEQ ID NO: 86927 - DNA, 601 bp, Human
gtgggcaaggataggctctggggtcagcaaggcctctgtccttcagctggccctgcctggggtaagctaaagtgcacaaagcctaagtcctcataggttaacaatggctaataaaaaacaaattaaaacaggcttggcacagtggcttacaccggtaatcccagtactttgggaggccaaggcaggaggatcgcttgaggccagcccacgagtttgagaccagcctgggcagtatagtgagaccctgtctctaaaaaaattaaaataaaaaatttaaattagccgggcatggtggcacgtkcctatagtcctaactactagggaggctgatgtgggaggatcatttgagcccaggagttcaaggctgcagtgagctgtgattatgccactgcactccagcctgggcaacagagctgagaccctgtctctaaaaccaaaccaaacaaaaaaattataaacctccatccacaaaatcccaaagacctcatctgcttatctaataatattatgaatgtgagttatttaaagggcataggtaggagaatgcctgtgggtccttgattgacatgagacccagcaacacagaccccacactcatggg

SEQ ID NO: 86928 - DNA, 601 bp, Human
ttgaggccagcccacgagtttgagaccagcctgggcagtatagtgagaccctgtctctaaaaaaattaaaataaaaaatttaaattagccgggcatggtggcacgttcctatagtcctaactactagggaggctgatgtgggaggatcatttgagcccaggagttcaaggctgcagtgagctgtgattatgccactgcactccagcctgggcaacagagctgagaccctgtctctaaaaccaaaccaaacaaaaaaattataaacctccatccacaaaatcccaaagacctcatctgcttmtctaataatattatgaatgtgagttatttaaagggcataggtaggagaatgcctgtgggtccttgattgacatgagacccagcaacacagaccccacactcatggggacgccccaggacctgccaggcctacgctttcacgtttctttcacttgtttccttttgccctcttctgccactgtgttgctcccgtgtcagccaagacctagaataccgggcatcttcatgggagactcattacagcttatctctatctgcctttctttaaagccagctgaacatacccaatgctctccctcta

SEQ ID NO: 86929 - DNA, 601 bp, Human
acacagaccccacactcatggggacgccccaggacctgccaggcctacgctttcacgtttctttcacttgtttccttttgccctcttctgccactgtgttgctcccgtgtcagccaagacctagaataccgggcatcttcatgggagactcattacagcttatctctatctgcctttctttaaagccagctgaacatacccaatgctctccctctatggtaagaccaaccctcccgaccatgctcccggcttccgtgtccccctctaacacccccactctccccaccccgaactccagagyccctgggagccctgcctggctctcactgcatgtggccactgtgtctgccgtgtgccttgcctgcctgttcccttctcgtgtgagctgtgaagatgctgtttgtgcagtggtggtgttttacccctgagctttccttggggtggtaattcactgtgatcttgactatctaacaagccactgggagagaatgggacccgaggtccatttcctgttaaacaccctgaggactccaccggccaaagcctctaaccttaatctgataggagaaatttgcagagggtacctatgagagccatggta

SEQ ID NO: 86930 - DNA, 601 bp, Human
actcatggggacgccccaggacctgccaggcctacgctttcacgtttctttcacttgtttccttttgccctcttctgccactgtgttgctcccgtgtcagccaagacctagaataccgggcatcttcatgggagactcattacagcttatctctatctgcctttctttaaagccagctgaacatacccaatgctctccctctatggtaagaccaaccctcccgaccatgctcccggcttccgtgtccccctctaacacccccactctccccaccccgaactccagagtccctgggagcccygcctggctctcactgcatgtggccactgtgtctgccgtgtgccttgcctgcctgttcccttctcgtgtgagctgtgaagatgctgtttgtgcagtggtggtgttttacccctgagctttccttggggtggtaattcactgtgatcttgactatctaacaagccactgggagagaatgggacccgaggtccatttcctgttaaacaccctgaggactccaccggccaaagcctctaaccttaatctgataggagaaatttgcagagggtacctatgagagccatggtagggctccagggta

SEQ ID NO: 86931 - DNA, 601 bp, Human
ccccaggacctgccaggcctacgctttcacgtttctttcacttgtttccttttgccctcttctgccactgtgttgctcccgtgtcagccaagacctagaataccgggcatcttcatgggagactcattacagcttatctctatctgcctttctttaaagccagctgaacatacccaatgctctccctctatggtaagaccaaccctcccgaccatgctcccggcttccgtgtccccctctaacacccccactctccccaccccgaactccagagtccctgggagccctgcctggctctcaytgcatgtggccactgtgtctgccgtgtgccttgcctgcctgttcccttctcgtgtgagctgtgaagatgctgtttgtgcagtggtggtgttttacccctgagctttccttggggtggtaattcactgtgatcttgactatctaacaagccactgggagagaatgggacccgaggtccatttcctgttaaacaccctgaggactccaccggccaaagcctctaaccttaatctgataggagaaatttgcagagggtacctatgagagccatggtagggctccagggtaaggagggaagaca

SEQ ID NO: 86932 - DNA, 601 bp, Human
ttttgggtttttttgtttgtttattttgtttttttaactgagcagatccagatgcccctgtggcaccaacttctcaaactcttgacacttgcagctaaagttctccacttaagcttgttcttttttttctcctttctcgaacacggtggaactgacagctgagttataaaatcctaagcctcctctgcatactcctctggggaaacacaacctccttttaaggagtgaaaatagaagttcaagcagatacacaggtgatagaaatacagagattaaggtcatcaaaggcttcagaacacayaggcagggaagagcccagggcaggacagggctgctgcctgcagctcttgacccagcccctcaggtacccgtgcagcaggtcccgagtcccacctgtctgtcccctgccttgaggggaacgggagccttaggaggaactgaggcagctctaattttgaaatataagaaatatttttgctcttctcctgtttggaagatctggaaagcaggagaggtctctggcttgcttctgggcagagtggtggctgccttcgggtctccctgcttccctcataatctcctgtcctgcatagtgagggga

SEQ ID NO: 86933 - DNA, 601 bp, Human
ctttagcgctggatattgccagtgagagtctgacctagaaataattaaagataaaaggcaaggtaaagcaaggagtggggagggcccaggtggccctagtaacaacctgagccctcccacctcgcgggaggtgtggacgggaccagtaacaggaagccccgagggtccattctctcccggtgcccgcaggtctgggtgagctgcactagctccggatttggcagtggcttcctcctgggttcctgctcaccaggccgatgtgggcaggaggagggccaagtggggagtcagctcatgttcycaggtttggaggcagaggaccgcagggcagcccgtcctgccccctgagccctggccaggcatgtgcccaagcccccaggctcccccaggtccaacagcagcagcccaagcacctccagtcaccttggcctgcactccacccttcctccccttcaccttccctctccccttccccagggcccctgagggagaccatctgcagaagcgtcacttgcaagggaggcctcccctcccttacgctgcccctctcccttccagggtcttgtacagcctgaagggttggagcctcctagaggcccca

SEQ ID NO: 86934 - DNA, 601 bp, Human
cccgagggtccattctctcccggtgcccgcaggtctgggtgagctgcactagctccggatttggcagtggcttcctcctgggttcctgctcaccaggccgatgtgggcaggaggagggccaagtggggagtcagctcatgttctcaggtttggaggcagaggaccgcagggcagcccgtcctgccccctgagccctggccaggcatgtgcccaagcccccaggctcccccaggtccaacagcagcagcccaagcacctccagtcaccttggcctgcactccacccttcctccccttcaccytccctctccccttccccagggcccctgagggagaccatctgcagaagcgtcacttgcaagggaggcctcccctcccttacgctgcccctctcccttccagggtcttgtacagcctgaagggttggagcctcctagaggccccagggcagaggggagtaggagggcaacagcttcggagcaagggctgcaaaccagaccctctccagcactgagtagcacccgtaatccctccctttgggacaggggctgtggaaagtagaaggaggtgatacaaggaaagtgctggagtcccaagcagct

SEQ ID NO: 86935 - DNA, 601 bp, Human
tagctccggatttggcagtggcttcctcctgggttcctgctcaccaggccgatgtgggcaggaggagggccaagtggggagtcagctcatgttctcaggtttggaggcagaggaccgcagggcagcccgtcctgccccctgagccctggccaggcatgtgcccaagcccccaggctcccccaggtccaacagcagcagcccaagcacctccagtcaccttggcctgcactccacccttcctccccttcaccttccctctccccttccccagggcccctgagggagaccatctgcagaagcstcacttgcaagggaggcctcccctcccttacgctgcccctctcccttccagggtcttgtacagcctgaagggttggagcctcctagaggccccagggcagaggggagtaggagggcaacagcttcggagcaagggctgcaaaccagaccctctccagcactgagtagcacccgtaatccctccctttgggacaggggctgtggaaagtagaaggaggtgatacaaggaaagtgctggagtcccaagcagctggggcatgaggtccttcagggggcagcccaccaggacccccaaatccac

SEQ ID NO: 86936 - DNA, 601 bp, Human
ggctaggactgcttcctcagcagtgcagaggaggggttcccagggcagctggctctgggcctagaagattccaaagcctatggtagttcctgatggagtcgtctgtcctccatccagggcattaagaactaggaatgaaggggaatcggggagaataaaaacacaggaccacagcccagcggcctgggcacagtctagctctgcagagaccatggggctgggctgtccactcattaaagtgggcggccgccctcccatcggagggggaagtctagtgcagcaaaccctggcctgccttccrccactgccactgaggtctgtatttctcggaggggccctcctgttctcacccccctcttgctgtgctaactgcacctcctgttgccgacgggttccagaacgcagaggaaaactcccgcatctccatcaccttcttccgcctgttccgggtcatgcgtctggtgaagctgctgagccgtggggagggcatccggacgctgctgtggaccttcatcaagtccttccaggtagccgcccctcatgtcctgcggcccggggatcgcagggctgccgcgtggcccagaacacagctgacacaagg

SEQ ID NO: 86937 - DNA, 601 bp, Human
agggggaagtctagtgcagcaaaccctggcctgccttccgccactgccactgaggtctgtatttctcggaggggccctcctgttctcacccccctcttgctgtgctaactgcacctcctgttgccgacgggttccagaacgcagaggaaaactcccgcatctccatcaccttcttccgcctgttccgggtcatgcgtctggtgaagctgctgagccgtggggagggcatccggacgctgctgtggaccttcatcaagtccttccaggtagccgcccctcatgtcctgcggcccggggatcrcagggctgccgcgtggcccagaacacagctgacacaaggaggagccctccactctggggccctgctccttcctctgtgtggcagaactcggccgctctgcctggctccctgtttccgcaccgagaggcctagacgaagcatgtggtttccaaggcaggctcagagccccagaaggccaggtggtaaaggagggatgggagctaaggggaggcagaaagggtctgccttacttttaaccatcgtttatgtctttctgcacaagaatttactggacaaaggggttttgtggtaaggaacaaa

SEQ ID NO: 86938 - DNA, 601 bp, Human
gcttgggtcacttgacttcccccagatgagcgcagaacccgtgaaggcggtttcatgcttccctgggctggcggaacgcaggcttctctccccccatggaggggccgctctcagcctttccaagacgagaatctgtcagggaagatggtctttgtgtgccccaccctggccagtccctgcccggggacagggcatgcctgggcctggtccaggtgaggaaagatgcccgtccccgctctgcccccagcagcctcctgccagggactgaccatccaaggctctcgagggagctcccaatggycaggctgacccctgcctagtgatgagctggggctcctgcactctgagcccagctcagcccaggctctggggattcggaatagtagacaccagcggaagcaggactgccgctgactctgtacttgggtgcacgcggaacccacggctgtgagttgccatactctccctgcccccccgacatctcctggggctgggaagaggcacagaccgggtgactgcgagggcctgatggcggcgcaggcgttcgggccaggcagctggcgcctgctctgacggcaccctctagtgaccggtggccacg

SEQ ID NO: 86939 - DNA, 601 bp, Human
gcaaactgaatccaatagtacatgagaaagatgatacatcatgatcaagtgggtttcattccaggggtggttcaacatatgcacatcaataaatgtaagacaccatattaacagaatgaaggaaaaaagacccacatgatcatctcaatagatgcagaaaaagcatttgacaaaattcaacatcctttcatgataaaaactctcaacaaattaggcatagaaggatggtactgcaacacaataaaggccacgtatgacaaggccacagctaacatcatacttagtggtgaaaagttgaaarcttttcctttaagatgaggaacaagacaaagatgcccactctcaccacttctattcaacataataatactggaagtcctagccagagcaattaagcaagttttaaaaagttatccaaataggaaaggaagaagtgaaattttctctgtttgctgataacatgatcttatatatagaaaatcctaaagaccaccaaaatctattacaactgataaactaattcagtaaagttgcaggacacaaaatcaacccacaaaaatgagtagcatttatttacactaacaatgaactatctgaaaga

SEQ ID NO: 86940 - DNA, 601 bp, Human
agtgacacaggactgtacttagaaatgagggccagggcaccagatcttaaacgtatgagatgcatcaatcagcaccaaagaaaaaattcagagcctgaaatttatttatttatctaaaaagctgtatattaaataagctaatagatggggaaaagaatagtaaaataatcccagaatatgaaggaatgcatttttaaaaataaaagcataaattaataaaatatggattttatcaataaaccctaaagctgatcctttgaaaagaccaataaacagacaaaccatcaaatccaattttttwaaaaaaaaacacaacaacatcagaaatgcaaaaagcaacataattacagatgtggaagtgatttttagaatgataagagaatttcatgcctctgttttgtggcacttcagaggtgatcatctacttcaagatgaagcagaaagtctccttcccagccagtggctgccagaaactcattgaagtggacagtgaatgcaaaccataccttttatgagaagcatatggcctcagaagtcgctggtgccactctgggtgaagaatggaaggcttatgtgggtggaatcaatggtacaaatgaca

SEQ ID NO: 86941 - DNA, 601 bp, Human
gtgacacaggactgtacttagaaatgagggccagggcaccagatcttaaacgtatgagatgcatcaatcagcaccaaagaaaaaattcagagcctgaaatttatttatttatctaaaaagctgtatattaaataagctaatagatggggaaaagaatagtaaaataatcccagaatatgaaggaatgcatttttaaaaataaaagcataaattaataaaatatggattttatcaataaaccctaaagctgatcctttgaaaagaccaataaacagacaaaccatcaaatccaatttttttwaaaaaaaacacaacaacatcagaaatgcaaaaagcaacataattacagatgtggaagtgatttttagaatgataagagaatttcatgcctctgttttgtggcacttcagaggtgatcatctacttcaagatgaagcagaaagtctccttcccagccagtggctgccagaaactcattgaagtggacagtgaatgcaaaccataccttttatgagaagcatatggcctcagaagtcgctggtgccactctgggtgaagaatggaaggcttatgtgggtggaatcaatggtacaaatgacaa

SEQ ID NO: 86942 - DNA, 601 bp, Human
aggcatggcagctcacacctgtaatctcaacaacttgggaggctgaggtgggaggatcagttaagaccaggagtatgagaccagcctgagcaacacagcaaaaccccatctctaaaaataaaaaataaaaatattagccaggtgtggtgccatgtgcctgtagtcccagctacttgagaagctgtagcgggaggatcacttgggcccaggagtttgaggttacagtgagctaagatggctccactgcactccagcctgggtgatgaagtgacatcccatctctaaacacatacacacacayacacacacacacacacacacacacacacacgatttttctaagagtagcagacaaataatatcagacttttaaaaagaagacagagaacatcatgaacaaatatgcaaatatatttgaaaacctaaatgaagcagacgcttttatgtagaaaataagaattataaaattatcttaagaattaaaaaaaaacaactacaacagaaattgaaaaggtagttgaaaatttagcctttgaaaaggcccaaggttcaatatttttatttgtgaggtctaccagactatcaaggagtggatcattcc

SEQ ID NO: 86943 - DNA, 601 bp, Human
tctctaaacacatacacacacatacacacacacacacacacacacacacacacgatttttctaagagtagcagacaaataatatcagacttttaaaaagaagacagagaacatcatgaacaaatatgcaaatatatttgaaaacctaaatgaagcagacgcttttatgtagaaaataagaattataaaattatcttaagaattaaaaaaaaacaactacaacagaaattgaaaaggtagttgaaaatttagcctttgaaaaggcccaaggttcaatatttttatttgtgaggtctaccagmctatcaaggagtggatcattccaatgttatataaactttccaggaacagaaagatgtagaaaacctcttcacccactccataagactaatataaagctaatgccaatgagaaaaagagaaaaaagcaagcagttataaatatgaaaatatgtacacataactgtcattgtttgcagacaacaggctaattcaagtagaaaatccatgcaaattaactaaaaaccctttaggacaatagaattaataaagtggaagattaaaagattaacaaagaaaaataattgctttcctgtactggta

SEQ ID NO: 86944 - DNA, 601 bp, Human
gtaatagacaagatcttatgctatcactttttcaatgttattattttgtaactcttacccaataaaataagacaggaaaggccgggcgcagtggctcacgcctgtaatcccagcacttcgggaggccaaggcgggtggatcacgaggtcaggagatcgagaccatcctggctaacaccgtgaaaccccgtctctactaaaaatacaaaaaattagccgggcgtggtagcaggcgcctgtagtcccagctactcaggaggctaaggtgggagaatctcttgaacccaggagatggaggttgyagtgagccaagattgcgccactgcactgcagtctgggggacagagaaagaccccatctcaaaaaaaaaaaacaagacaggaaaaataaatcaaaggataagaattggagaggaagaaacaaaattaaatgccaaaaaagttgattgcctgtgtatatatacaagaaaaattacagaaaattgctaaaactgataggatagtttagcaaatattctgtaatatgaaatcaattgtattccctctatatcagcagcaaatggacatagcttttaaaatataatgttgaaactataccatttt

SEQ ID NO: 86945 - DNA, 601 bp, Human
acaggaaaggccgggcgcagtggctcacgcctgtaatcccagcacttcgggaggccaaggcgggtggatcacgaggtcaggagatcgagaccatcctggctaacaccgtgaaaccccgtctctactaaaaatacaaaaaattagccgggcgtggtagcaggcgcctgtagtcccagctactcaggaggctaaggtgggagaatctcttgaacccaggagatggaggttgcagtgagccaagattgcgccactgcactgcagtctgggggacagagaaagaccccatctcaaaaaaaaaaaacaagacaggaaaaataaatcaaaggataagaattggagaggaagaaacaaaattaaatgccaaaaaagttgattgcctgtgtatatatacaagaaaaattacagaaaattgctaaaactgataggatagtttagcaaatattctgtaatatgaaatcaattgtattccctctatatcagcagcaaatggacatagcttttaaaatataatgttgaaactataccattttaaatgtacaacaaaataaaaggagagagatgccacgtttctggccaggagacttaatatcataaagatgtc

SEQ ID NO: 86946 - DNA, 601 bp, Human
aaaaaaaaaaacaagacaggaaaaataaatcaaaggataagaattggagaggaagaaacaaaattaaatgccaaaaaagttgattgcctgtgtatatatacaagaaaaattacagaaaattgctaaaactgataggatagtttagcaaatattctgtaatatgaaatcaattgtattccctctatatcagcagcaaatggacatagcttttaaaatataatgttgaaactataccattttaaatgtacaacaaaataaaaggagagagatgccacgtttctggccaggagacttaatatcmtaaagatgtcaggattctgcaaatgaattgacatctcagtgcaattctaataagactcccaacaggattattcacagaggctgaaactgattctacggtgtctatggaatagaaaaggaaactgaatagccaagacaaatgttgaagaacaacaggttggcaggactcctgcactgtgagagggcaggacttactataaggcaacttactatgcagacaacacagtacttctgtaccaagataaacaaataaacctgaggaatgcaatgacaaggctagaacaagacccacacatctacg

SEQ ID NO: 86947 - DNA, 601 bp, Human
tcaaaggataagaattggagaggaagaaacaaaattaaatgccaaaaaagttgattgcctgtgtatatatacaagaaaaattacagaaaattgctaaaactgataggatagtttagcaaatattctgtaatatgaaatcaattgtattccctctatatcagcagcaaatggacatagcttttaaaatataatgttgaaactataccattttaaatgtacaacaaaataaaaggagagagatgccacgtttctggccaggagacttaatatcataaagatgtcaggattctgcaaatgaatygacatctcagtgcaattctaataagactcccaacaggattattcacagaggctgaaactgattctacggtgtctatggaatagaaaaggaaactgaatagccaagacaaatgttgaagaacaacaggttggcaggactcctgcactgtgagagggcaggacttactataaggcaacttactatgcagacaacacagtacttctgtaccaagataaacaaataaacctgaggaatgcaatgacaaggctagaacaagacccacacatctacgcaaatacaacttacggcagaagaaatatt

SEQ ID NO: 86948 - DNA, 601 bp, Human
agaggaagaaacaaaattaaatgccaaaaaagttgattgcctgtgtatatatacaagaaaaattacagaaaattgctaaaactgataggatagtttagcaaatattctgtaatatgaaatcaattgtattccctctatatcagcagcaaatggacatagcttttaaaatataatgttgaaactataccattttaaatgtacaacaaaataaaaggagagagatgccacgtttctggccaggagacttaatatcataaagatgtcaggattctgcaaatgaattgacatctcagtgcaattstaataagactcccaacaggattattcacagaggctgaaactgattctacggtgtctatggaatagaaaaggaaactgaatagccaagacaaatgttgaagaacaacaggttggcaggactcctgcactgtgagagggcaggacttactataaggcaacttactatgcagacaacacagtacttctgtaccaagataaacaaataaacctgaggaatgcaatgacaaggctagaacaagacccacacatctacgcaaatacaacttacggcagaagaaatatttcaattaagtaggtgaag

SEQ ID NO: 86949 - DNA, 601 bp, Human
atacaagaaaaattacagaaaattgctaaaactgataggatagtttagcaaatattctgtaatatgaaatcaattgtattccctctatatcagcagcaaatggacatagcttttaaaatataatgttgaaactataccattttaaatgtacaacaaaataaaaggagagagatgccacgtttctggccaggagacttaatatcataaagatgtcaggattctgcaaatgaattgacatctcagtgcaattctaataagactcccaacaggattattcacagaggctgaaactgattctacrgtgtctatggaatagaaaaggaaactgaatagccaagacaaatgttgaagaacaacaggttggcaggactcctgcactgtgagagggcaggacttactataaggcaacttactatgcagacaacacagtacttctgtaccaagataaacaaataaacctgaggaatgcaatgacaaggctagaacaagacccacacatctacgcaaatacaacttacggcagaagaaatatttcaattaagtaggtgaagatgtactattcaataaatagtattaacaaaatgacttatctatgcagaaa

SEQ ID NO: 86950 - DNA, 601 bp, Human
aggactcctgcactgtgagagggcaggacttactataaggcaacttactatgcagacaacacagtacttctgtaccaagataaacaaataaacctgaggaatgcaatgacaaggctagaacaagacccacacatctacgcaaatacaacttacggcagaagaaatatttcaattaagtaggtgaagatgtactattcaataaatagtattaacaaaatgacttatctatgcagaaaaaataaaagcatatttctacctcatatcaaacatgaaaataaatttcaggtcaataagttattgyggaaaaacaaaactttagaacctttagaagaacacagaaaagaatgtctttatgacctaaaatagagaaagattttttaaacgtgatgcaaaaagcacagaacatagaggaaaaaactataaatttgacctcattgaaataaaaaacttagattcaccaaaatacaccgtaaataataccagagacaacccacaaattggaagaagatatttctgttgcatataactaacaaagggttaagaatagacacgaaaccaccatgagactccaccttcctcctgcaagaatggctgcaattta

SEQ ID NO: 86951 - DNA, 601 bp, Human
tcccactcctgggtatccacccagaggaaaagaagtcattatgtgaaagagacacctgcacacacacatttatagcagcaccatttgcaaaatgatgtaatggactttggggactcggagaagggcaggaggatggtagggatcaaagacgactgcttgggtgatgggtgcagcgaaatgtcagagatcaccactgaagggcttgtccgtgtaagcaaaaaccacctgttcccaaaaaactattggaaattttaaaaaagaatagagaatagagtatcttttttttttttttttttgagayggagtctcgctctgtcgcccaggctggagtacagtggtgtgatctcggctcactgcaaactccgcctcccgggttcacgccattctcctgcctcagcttcccaagtagctgggactacaggcgcccaccaccgcgcccggctaatttttgtatttttagtagagacggggctccaccatgttagccaggatggtctccatctcctgacctcgtgatccgcccacctcggcctcccaaagtgctgggattacaggcgtgagccaccgcgcccggccagagaatagagtatcttaagcaccc

SEQ ID NO: 86952 - DNA, 601 bp, Human
gatataaatctgcatgtttattgcagtgttatttgtactagtaaaagaaaaaatgaaaaacctaaatgttccttaacaggacagtggatttttttacggtaagttcatagagcatactcctgtacagcagttaaggtgaatgaactggaactaaaatacatccaaagggctaagtctcaaaaacatcacatggattgcaaaaacagcaagttttcggaaaaggtgcaatttgttactgtttatataaaattttaataatgctatgtgtttcatatttagcaaatatatcagagcattcagrgaatgatgaacatcaagttcattttagtaactccctctggggaaggaggaaagggacaggtggggagggatgcagagggccctccttggcatctgtaggatgggctgcatgaacgtggctctccctcccctccaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcct

SEQ ID NO: 86953 - DNA, 601 bp, Human
atctgcatgtttattgcagtgttatttgtactagtaaaagaaaaaatgaaaaacctaaatgttccttaacaggacagtggatttttttacggtaagttcatagagcatactcctgtacagcagttaaggtgaatgaactggaactaaaatacatccaaagggctaagtctcaaaaacatcacatggattgcaaaaacagcaagttttcggaaaaggtgcaatttgttactgtttatataaaattttaataatgctatgtgtttcatatttagcaaatatatcagagcattcagggaatgakgaacatcaagttcattttagtaactccctctggggaaggaggaaagggacaggtggggagggatgcagagggccctccttggcatctgtaggatgggctgcatgaacgtggctctccctcccctccaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctggtaagc

SEQ ID NO: 86954 - DNA, 601 bp, Human
ccacatggagagaaaggcagaaagccctgggccagagtgagctccaccagcatcttgcttgtctgttcttggctgttgtcatggtggcattgtcccagaggacaacggggacatgtgggggcctagaaagaactgtacttttttggcatcttgctgaggagtgaggaaaaggggataaagtccccctctgtcctgcacagccctgcccagcagctcggtaggagggaagctgtccagcccacctgtgggttcatcacacacaactctcagggaaactgtgtcaagtttatgtccaagagamccaggttctcaggctggtaggatggatgactggtctttagaaatgttggcttctgccatcagtaggccccagctggcaagggggttccagaggcaggtgtgtaggaaggtcttctcacagcacctcattgtactgttccccacagatcatcaacctctttgtagctgtcatcatggacaactttgactacctgacaagggactggtccatccttggtccccaccacctggatgagtttaaaagaatctgggcagagtatgaccctgaagccaagtaagttcccagagggaaatcctgatt

SEQ ID NO: 86955 - DNA, 601 bp, Human
cttggctgttgtcatggtggcattgtcccagaggacaacggggacatgtgggggcctagaaagaactgtacttttttggcatcttgctgaggagtgaggaaaaggggataaagtccccctctgtcctgcacagccctgcccagcagctcggtaggagggaagctgtccagcccacctgtgggttcatcacacacaactctcagggaaactgtgtcaagtttatgtccaagagacccaggttctcaggctggtaggatggatgactggtctttagaaatgttggcttctgccatcagtaggmcccagctggcaagggggttccagaggcaggtgtgtaggaaggtcttctcacagcacctcattgtactgttccccacagatcatcaacctctttgtagctgtcatcatggacaactttgactacctgacaagggactggtccatccttggtccccaccacctggatgagtttaaaagaatctgggcagagtatgaccctgaagccaagtaagttcccagagggaaatcctgattccccaagctgagagagggtatagctgaccatacctgcaggaggggctcaaggttggccaacactggg

SEQ ID NO: 86956 - DNA, 601 bp, Human
attacaattcaacatgagatttgggcgaggacacagagccaaaccatatcactctgccacggtgttctgcggtcccctaagcaccgcctgccatcatcaccagctttgcttctcttcgcctgcagcgcctggtctccatgaacatgcctctgaacagcgacgggacagtcatgttcaatgccaccctgtttgccctggtcaggacggccctgaggatcaaaacagaaggtaaggtcgcccgtgggcactgggagagacactcagaaggtctagcagacaatcagagaggagctcggcagcctgcaaagtgctcaagggaacttcctgccccagacagcatccgagctgggatacgggggtaacgtgcgctccaggacatcgcagggccccagcctgctcatgacttctttgctcctgaatggtctccctgcctctagctcaggggtttccaatcttttggcttctctgggccacattggaagaattgtcttgggccacacataaaatacactaacgatagctgatgaactgaaaaaaaaaaattgcaaaatactcaatgttttaagaaagtttacgaatatgtgttgggccacattcaaag

SEQ ID NO: 86957 - DNA, 601 bp, Human
tgggcactgggagagacactcagaaggtctagcagacaatcagagaggagctcggcagcctgcaaagtgctcaagggaacttcctgccccagacagcatccgagctgggatacgggggtaacgtgcgctccaggacatcgcagggccccagcctgctcatgacttctttgctcctgaatggtctccctgcctctagctcaggggtttccaatcttttggcttctctgggccacattggaagaattgtcttgggccacacataaaatacactaacgatagctgatgaactgaaaaaaaaaaattgcaaaatactcaatgttttaagaaagtttacgaatatgtgttgggccacattcaaagccgtcctgggccgcatgtggcccatgggctgcaggttagacaagcctgctctagcttattcattttgaactctagctttccatgaaactctgggactcattctgggtggtatcttgaagtcagagggtatagctcacaaaacagaaggagacgggtgttacctgaagcaggaccaacccctgtctaaaagaacttacactggctacaggtgggtgtctcaaatgctcaactcattaaatta

SEQ ID NO: 86958 - DNA, 601 bp, Human
cattctgggtggtatcttgaagtcagagggtatagctcacaaaacagaaggagacgggtgttacctgaagcaggaccaacccctgtctaaaagaacttacactggctacaggtgggtgtctcaaatgctcaactcattaaattaataggactgtgctgggaagacgtgtgggaaaggggacacagtgacaagtggtggccgtggtggaggtcatcgcacacattgtgcgggctgagcctggcttaaggctcttagccagcggacaggtgaggattcagacctcacctgtgccacctagtcrgaccgggctccctcagggctgcgtccacctggaggggcccttctagttttcacaaggcaccctaagggctagcagcagcctgagtgagataatctgcttgctttatgatggataagagtttgcgaaccactatgggaaaggctgtattaaacacacctaacaagataccatttctctccaagagtgtccagccttggagtgtctagtgtttcttagagcgtggtcaaaagaccaccgctgcagaatcagctttgggtacctgtttaagctactgagtcccaggcacccacacagacctgc

SEQ ID NO: 86959 - DNA, 601 bp, Human
aaggaagaaaactgggaaggaaatgtgttcgtatgctaacactgattatcatgagtagaaagatcagcagtgacatccaccttactcctttagtttttttactttccaaatgttctgcaaggaatgttactcccctatgttcagagggaaggagaggcgatataaatgactgccaggaggaatatgctgtaatacttaaagattgatgtaaattaaggatgtgagattttgttccctagaggaacaaaaggcagggaggtatggaagcaagaattcagcagggtcgaaggttcactgtcaragccaaccacatgccaactaaggaagaccaatagctagtaacaatgcgaaagactgaccagtcaaatgcagggacccaattctgaggaaataagagttccagagaaaagaggagaagccagccatgtgggaactacaatcctgtcaagaattacagactatcttttaaacacaaagacatttcagaacagctaccaaagggcccgaaacgcccccacccaagggtgagccttcatcagacatgggccctccataaacttgttaaaatcgaaacgcccccacccaagggtgagccttcatc

SEQ ID NO: 86960 - DNA, 601 bp, Human
cagctaccaaagggcccgaaacgcccccacccaagggtgagccttcatcagacatgggccctccataaacttgttaaaatcgaaacgcccccacccaagggtgagccttcatcagacacgggccctccacaaacttgttaaaatcctaagaaagaaagacaaagtcaagtcttggaagcaactagaaagaaatgtgagaagacatctacatttgtgaagatgaggcttgcatcagtcctcacccttcagacttctcagcgtggaaggaattggggcgaaattaacacctacctcagagaarcagagctgtcatcccaagtccagtaccaagccaaagaagcttctctcttggaacgtagaaggaagagctctcatcccaagtccagtaccaagccaaacaagcttctctcttggaacataaaaggaagatagtgaaaaatacttagatgacatgaaacaattgtcggtgaacttcaacaattacatagaccatcatgagaataaattaaggctgataaaaaaaaatgaaaggtccttttggaaactatgttaatttcttaggtctgctgtaacaaatgatcacaaactgggcagctggaaa

SEQ ID NO: 86961 - DNA, 601 bp, Human
atctgtgcctccatcttcaaatagcctccagggtcttgtgtcctctcctcttcttggaaggacaccagccacattggacttagggcccaccctcatccaggatgacctcaccttaactaattacattggtgaaaatcctatttccaactaaggccacattctgaggttctaggcagacatgaattttgggaggacactattcagcccagtaccgaagctaagtatatttgaataccatgtgtgttaggatcttgcactgcgtgtgtcagaaacctccagctacctctcccgtgatggggaytgatcatctgtgcagctggaaggcccaggagtcgtcccctgccttcaggtcctgtttggatctggcatttggggagctcgggattccgtcaatccctctactgccacctctgcatgctctgccctgtggccccagaggtggatttgaacccaggcagtctgacacaagagccctcaaccacaatactggactgccggtcctatgcgagagcagtaaacatcccgtgttggtttcctactgctgcaaagcaaattactacaagcttttcagcttaaaaagacaccccgttggctgggcacg

SEQ ID NO: 86962 - DNA, 601 bp, Human
cccgtgttggtttcctactgctgcaaagcaaattactacaagcttttcagcttaaaaagacaccccgttggctgggcacggtggctcacacatgtaatcccagcactttgggaggctgaggcaggtagattacctgaggttgggagttcgagaccaacatggagaaaccccatctctactaaaaatataaaattagctgggcatggtggcccatgcctgtaatcccagctacttgggaggctgaggcaggagaatcacttgaacccaggaggtggaggttgcagtgagccaagatcgcgcyattgcactccagcctgggcaacaagagcaaacttccgtctaaaaaaaaaaaaaaaaaaagacaccccgttagtagctcatggttttgcaggtcagaagtccagcagtggtgaagctgggctttcataaggcaaatccaggatattgatcaggccatggtctcttctggaggctctgggggagatcatgttgttggtggaattcatttgttgcaattgtaggcctgagatcctcactttcctgctggctgacagctggggaccccctctgctcctagaggctgcctctctcagttcagccc

SEQ ID NO: 86963 - DNA, 601 bp, Human
gatcaggccatggtctcttctggaggctctgggggagatcatgttgttggtggaattcatttgttgcaattgtaggcctgagatcctcactttcctgctggctgacagctggggaccccctctgctcctagaggctgcctctctcagttcagcccacatgactgtttgctttcttccaggccggctggagagaactctgcctttaaagggctcatgtgactaggtcaggcctgcctaacctccctgtcttaggtcataggtgccgtgtgccatataacctaatctcaggagtaaaatctaygatggtcaggggcccagggctttggcagcatgtgtaccctgatgaggagcatcttagaatcctgtcccctacatctgcccttacagctgtaaggctcagctttcctttttcatcactgtaaggctaggaccccagaggctgcataaggcaggcatctaagtaggggaactcgggacagagccctcatcgacagatgtaccctccaatcatccatgttccctgtgactgccgaaggaggtccatgagaaatgccacccatggggaccagccccccactgcccgtggcagggccatacgtgt

SEQ ID NO: 86964 - DNA, 601 bp, Human
ctgcataaggcaggcatctaagtaggggaactcgggacagagccctcatcgacagatgtaccctccaatcatccatgttccctgtgactgccgaaggaggtccatgagaaatgccacccatggggaccagccccccactgcccgtggcagggccatacgtgttccagctggtgagcgcatggccgccattgttcctgcccaggggctgggctcagtctacaaggaagagcactgagtgccggtggaggggccccctggctggcctgagccacaggcagggggaaggggacaggaatggcaytggacggggcacaagagggaagggggaaggaaggaaggtggacagaggaaggggaagaggaaggaggtggaaaatgggaagactggggagaagtgaagcaagcaagaaagaaactgatgagtcagggttgcgtggggcagatgccaccatctgtggcttcctaccttacgcagagggacccagcccatcagaggcccaccaaggggctgaggatcctttccgccctgcagggaacctagaacaagccaatgaggagctgcgggcgatcatcaagaagatctggaagcggaccagcatgaa

SEQ ID NO: 86965 - DNA, 601 bp, Human
gccctcatcgacagatgtaccctccaatcatccatgttccctgtgactgccgaaggaggtccatgagaaatgccacccatggggaccagccccccactgcccgtggcagggccatacgtgttccagctggtgagcgcatggccgccattgttcctgcccaggggctgggctcagtctacaaggaagagcactgagtgccggtggaggggccccctggctggcctgagccacaggcagggggaaggggacaggaatggcattggacggggcacaagagggaagggggaaggaaggaaggtgracagaggaaggggaagaggaaggaggtggaaaatgggaagactggggagaagtgaagcaagcaagaaagaaactgatgagtcagggttgcgtggggcagatgccaccatctgtggcttcctaccttacgcagagggacccagcccatcagaggcccaccaaggggctgaggatcctttccgccctgcagggaacctagaacaagccaatgaggagctgcgggcgatcatcaagaagatctggaagcggaccagcatgaagctgctggaccaggtggtgccccctgcaggtggtgagtgct

SEQ ID NO: 86966 - DNA, 601 bp, Human
ccaccaaggggctgaggatcctttccgccctgcagggaacctagaacaagccaatgaggagctgcgggcgatcatcaagaagatctggaagcggaccagcatgaagctgctggaccaggtggtgccccctgcaggtggtgagtgctccctggactcccgcaccttggccactgcctggccgtgcccccctctgcctgcctctcctccagctgtggcacccttagaatgcggaagcatcccctgagacttgcttcttgagtcccctaggcttgctggaggtctgccttcagacccttcctgyggggctcagaggccctgttggttagaagggaggcaggtgcaacgccctgcacaaactcagaaacagaaagtcaggttggaaatctggtacaaccctgctttttacatagggtaacaggcaagtccctgatgcttaggggtttggcagaacttctaaagaaactccacaaagtataggtttcccataaacctgattgctgtaggattgctctaaggccctcaaacgagaatcccctgagattcctcccctcttggatgacattctttttgttcttccaagagcagtgtttcttgaccctat

SEQ ID NO: 86967 - DNA, 601 bp, Human
acatataatttccaaaatattaatataatgccttcactctaacataaaatctattaaaagcagatgtttccaatatgtaaatactcaggcataactataccagcaggtacatttaattgatgagatcttctcatgcacccacttacaacacatacggctgggttcacaggaagcaagacaatactgaatactgtcaacactttgatttgccattttgaaataaggggtaaatcagtatattaaataagtgtgtgtataaatagccccccacacataaacacacacacatacttacacataygcagaacaaccgtgatgtgacacttacggtgagtgacccacacaccctaaagagcattgccatcaggaatacagttttccaaaatgcgaacctctcttggccaagtttaaataatccaaagtatagttttcctcaatttacacagcagttgtattcctggaaattgtcaggtgtgttaaaaccatgcaaaacaatgtcctgtgttcatttgcaaaatgaaattatgttccgagcccagagactcctaagcagaatcatggatgtgtggcataagcttgagagccatgcagagtgcaaagc

SEQ ID NO: 86968 - DNA, 601 bp, Human
caaagaaccaggaggtagatccaaggggctcctccccaggcatgaaatgtttcctctaagaacttatggcttctccaccatcaggtttactcccaggaaagggactgatgatgtcacatataatcttgggtatccagcccagcagggatgcagccaagccacctggcacaaaaactcaatcgggtttgaaagaaaaatccaaacttccatgggaagaaagccctccttccaccagcccctccctccgagctaagctgaaccgttttgcacttgcacttggaagagtggccagttgatgagrgacatttgaagctctggaatcaaatgtatcagttcagttaaaaaaaaaaaagcgggaaataattttgatggtaggctaccttttgcataaaaaaaacaggagataatatgtttgatgatttacataactaatttgcactaagaatctctgagaaaatactcaagaaactagatgatctacaggaggtggtgactaggcagataagggctgtggtgggagagacttttgaccataagcctttttatggttttttttctctctttttaagccatgtgaatgtattacctctccaaaaatatt

SEQ ID NO: 86969 - DNA, 601 bp, Human
tcctctaagaacttatggcttctccaccatcaggtttactcccaggaaagggactgatgatgtcacatataatcttgggtatccagcccagcagggatgcagccaagccacctggcacaaaaactcaatcgggtttgaaagaaaaatccaaacttccatgggaagaaagccctccttccaccagcccctccctccgagctaagctgaaccgttttgcacttgcacttggaagagtggccagttgatgagggacatttgaagctctggaatcaaatgtatcagttcagttaaaaaaaaaaaagcgggaaataattttgatggtaggctaccttttgcataaaaaaaacaggagataatatgtttgatgatttacataactaatttgcactaagaatctctgagaaaatactcaagaaactagatgatctacaggaggtggtgactaggcagataagggctgtggtgggagagacttttgaccataagcctttttatggttttttttctctctttttaagccatgtgaatgtattacctctccaaaaatattaaagttttaaaaagttttggatgctgaaaaaaaaaatgaatgaagttcaac

SEQ ID NO: 86970 - DNA, 601 bp, Human
accgttttgcacttgcacttggaagagtggccagttgatgagggacatttgaagctctggaatcaaatgtatcagttcagttaaaaaaaaaaaagcgggaaataattttgatggtaggctaccttttgcataaaaaaaacaggagataatatgtttgatgatttacataactaatttgcactaagaatctctgagaaaatactcaagaaactagatgatctacaggaggtggtgactaggcagataagggctgtggtgggagagacttttgaccataagcctttttatggttttttttctstctttttaagccatgtgaatgtattacctctccaaaaatattaaagttttaaaaagttttggatgctgaaaaaaaaaatgaatgaagttcaactgaattcccctgctcccctcttaccccctctcccctctccatacgtctcagatgatgaggtcaccgttggcaagttctacgccacgttcctgatccaggagtacttccggaagttcaagaagcgcaaagagcagggccttgtgggcaagccctcccagaggaacgcgctgtctctgcaggtgagggcctgggggcgggcccacactc

SEQ ID NO: 86971 - DNA, 601 bp, Human
cacaaaccttccggagggtcgactggctgggtggaggatgccagggccctggagggacaggtcttggcccgaggctgtggctggctggggagcttggaggaaagggagcgtggtcctcaccatcctccccttggattccaggctggcttgcgcacactgcatgacatcgggcctgagatccgacgggccatctctggagatctcaccgctgaggaggagctggacaaggccatgaaggaggctgtgtccgctgcttctgaagatgacatcttcagggtgggtggtgccatggcgcactctygacccctataaagttcagtttggagcaagaggttgggctggggttttgcggggaacgtccaggggaaggagctgcaccagaggaaagggctacttccaggctcttcctgatgagctgtctcctcacccctttgccttttccaagcctgactccatcccaaggcagggctccctggaaacagcagctctcagtgtcactggctctcagagaagcgggaaggaaccgccttcctaagggaaatgtttcctaggagaaacttctgcattagaagttgcagagtggtcacccctggggcacatc

SEQ ID NO: 86972 - DNA, 601 bp, Human
ttgcattcccacagggcagcagagggccggagcctagaggcggtggccctttgagatggagcatagcgtgtgttctccaggtctccaagacccctccagaactcccctttccctctcctttcctggagactgaagctgcccagcagttgcaatagtgaaaattaaaacggctgtaccagaataaggggcgtttatcactcatttgtgttgcctgcctcaccacgctggtgtttggttacaaatccttctatagcaagggagaagctgccagccataattgtgcaggaccctgctcacacckctctctcccggccgcgggcccagttcccaggctgtggaacacacagggggcaagctgagcccatcctgcccctgctccgtctcttcctcatccttattctcgtcactgggagacattcgtcactgagtggcctcagggacatggcatggtggtgacacaacccgacaagacaccagaaaccaaagcctcagtcaccaaggcccagggatgctctgatgtcaagggttggaacaaccgtgcaaatagctacttgcccacttccccaggacaaggaaaagaatactggggaaaaacattggc

SEQ ID NO: 86973 - DNA, 601 bp, Human
ctcccctttccctctcctttcctggagactgaagctgcccagcagttgcaatagtgaaaattaaaacggctgtaccagaataaggggcgtttatcactcatttgtgttgcctgcctcaccacgctggtgtttggttacaaatccttctatagcaagggagaagctgccagccataattgtgcaggaccctgctcacacctctctctcccggccgcgggcccagttcccaggctgtggaacacacagggggcaagctgagcccatcctgcccctgctccgtctcttcctcatccttattctygtcactgggagacattcgtcactgagtggcctcagggacatggcatggtggtgacacaacccgacaagacaccagaaaccaaagcctcagtcaccaaggcccagggatgctctgatgtcaagggttggaacaaccgtgcaaatagctacttgcccacttccccaggacaaggaaaagaatactggggaaaaacattggctcctggttttaaatctctctgagtccccgaggggaaaaagaccatcatgcaggaaattcttcattttcaaaaccgtttggccaaccagcttttagctctgt

SEQ ID NO: 86974 - DNA, 601 bp, Human
ttctccacccacccctccttcttgcctacagagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacrgtcagcactgtggagggccacgggccccccttgtcccctgccatccgggtgcaggaggtggcgtggaagctcagctccaacaggtaagtgggaggctggccaccccaggcggcacacagggcccacgtgctgcaaccctcaggagacagtggaggagacggaggcctcggccagccacttgtccctcaagcttccaggaggttgctgccccagactccagcaagagcaggaggcactatgctgtctcccaagtcctgcccttgatcagacctggcaggctcagggcaagtcagcagtggc

SEQ ID NO: 86975 - DNA, 601 bp, Human
catccgggtgcaggaggtggcgtggaagctcagctccaacaggtaagtgggaggctggccaccccaggcggcacacagggcccacgtgctgcaaccctcaggagacagtggaggagacggaggcctcggccagccacttgtccctcaagcttccaggaggttgctgccccagactccagcaagagcaggaggcactatgctgtctcccaagtcctgcccttgatcagacctggcaggctcagggcaagtcagcagtggcctgcggcgctggttctcccacagggccctctcctctcccacrcttcctgagtggcagaatgtgatcatcagatgtttgtgttccggcttcacaacagaaaccatcccgtctgcccttccccgagtctctgcccaaacctggcctttctcccagccgagatgggaatggtgtttccattgcttccctggagcccctttgccagcctcccggagagggcatcccactgtgggaggcgccatctgtagcactggcccattctgcccagcacaggatcattcctggaggtcttgactgtacctcttactcctgactcactcttttctccttgtcctctcatccctg

SEQ ID NO: 86976 - DNA, 601 bp, Human
agagcaggaggcactatgctgtctcccaagtcctgcccttgatcagacctggcaggctcagggcaagtcagcagtggcctgcggcgctggttctcccacagggccctctcctctcccacacttcctgagtggcagaatgtgatcatcagatgtttgtgttccggcttcacaacagaaaccatcccgtctgcccttccccgagtctctgcccaaacctggcctttctcccagccgagatgggaatggtgtttccattgcttccctggagcccctttgccagcctcccggagagggcatcccactgtgggaggcgccatctgtagcactggcccattctgcccagcacaggatcattcctggaggtcttgactgtacctcttactcctgactcactcttttctccttgtcctctcatccctgtgctctaggatgcactgctgtgacatgctggatggtgggaccttccctcccgccctgggcccccgcagggctcctccctgtctgcatcagcagctccagggttccctggcggggctgagagaggacacaccctgcatcgtgcctggccacgcttcactgtgctgctcttccagagtaggag

SEQ ID NO: 86977 - DNA, 601 bp, Human
gactcactcttttctccttgtcctctcatccctgtgctctaggatgcactgctgtgacatgctggatggtgggaccttccctcccgccctgggcccccgcagggctcctccctgtctgcatcagcagctccagggttccctggcggggctgagagaggacacaccctgcatcgtgcctggccacgcttcactgtgctgctcttccagagtaggagagtggctcccagcaggctgcacagccccccagcatgccaggttcttgacatgctcgccctccagctcagaaaataatagagaagtrggagcttccctctaaacccctggaaaagtgtccatccaaggagcaggcacacctgccgctggcctgcctgtccctgcagagggcccatttcaagagggctgcatgcaagcccatgggactcaggcatttaattgtgtcagacgacaggccagttaaaaggaccatctccctgtctgctttcctttctgcaaggttggctggtttagccacccagaagcagcactgggggcatccttcaattcatgaggcctgcactgctgccttctgtgtgcacagggcagtgtgctgggcactggattt

SEQ ID NO: 86978 - DNA, 601 bp, Human
ctcactcttttctccttgtcctctcatccctgtgctctaggatgcactgctgtgacatgctggatggtgggaccttccctcccgccctgggcccccgcagggctcctccctgtctgcatcagcagctccagggttccctggcggggctgagagaggacacaccctgcatcgtgcctggccacgcttcactgtgctgctcttccagagtaggagagtggctcccagcaggctgcacagccccccagcatgccaggttcttgacatgctcgccctccagctcagaaaataatagagaagtggsagcttccctctaaacccctggaaaagtgtccatccaaggagcaggcacacctgccgctggcctgcctgtccctgcagagggcccatttcaagagggctgcatgcaagcccatgggactcaggcatttaattgtgtcagacgacaggccagttaaaaggaccatctccctgtctgctttcctttctgcaaggttggctggtttagccacccagaagcagcactgggggcatccttcaattcatgaggcctgcactgctgccttctgtgtgcacagggcagtgtgctgggcactggatttta

SEQ ID NO: 86979 - DNA, 601 bp, Human
tccttccactgcggggcgggtggcagtctgcagtcctcctcctcgagagagagaattgcttctaccctgcctgggatgctcagagccagggcactgatttagcactcggctctgagaggatggaccaggatctttctctgatgccctcaggggtctgaggataaagtgggcccagcatgcaaggtctatagaaagcaagacaaagggaggcactgagctgagctcagacaggaaaaggaagaggccttggtccagagctaaagatgacctgaccctgtcccagcagggaaaggcacgttcyggtgtgtgaggatctggagctcaggagggattcaggctcagcagggactcaggctcactgccttctgctcaggagagcaaacccctctaggtgaggcttcctctctgtgcctttaccccagggtgccagtgtcagaatcaagggcaccatcaaaataagaggccaaggacttctcagctatgccaaatgccaaagacccaggtgtcatagctggaggtgagtggggggcagcctctaagttaggcagggcatatgtcattccaatttcatagggaaactgaggcatgaggtggaccaagt

SEQ ID NO: 86980 - DNA, 601 bp, Human
cttccactgcggggcgggtggcagtctgcagtcctcctcctcgagagagagaattgcttctaccctgcctgggatgctcagagccagggcactgatttagcactcggctctgagaggatggaccaggatctttctctgatgccctcaggggtctgaggataaagtgggcccagcatgcaaggtctatagaaagcaagacaaagggaggcactgagctgagctcagacaggaaaaggaagaggccttggtccagagctaaagatgacctgaccctgtcccagcagggaaaggcacgttccgrtgtgtgaggatctggagctcaggagggattcaggctcagcagggactcaggctcactgccttctgctcaggagagcaaacccctctaggtgaggcttcctctctgtgcctttaccccagggtgccagtgtcagaatcaagggcaccatcaaaataagaggccaaggacttctcagctatgccaaatgccaaagacccaggtgtcatagctggaggtgagtggggggcagcctctaagttaggcagggcatatgtcattccaatttcatagggaaactgaggcatgaggtggaccaagtga

SEQ ID NO: 86981 - DNA, 601 bp, Human
ggagggattcaggctcagcagggactcaggctcactgccttctgctcaggagagcaaacccctctaggtgaggcttcctctctgtgcctttaccccagggtgccagtgtcagaatcaagggcaccatcaaaataagaggccaaggacttctcagctatgccaaatgccaaagacccaggtgtcatagctggaggtgagtggggggcagcctctaagttaggcagggcatatgtcattccaatttcatagggaaactgaggcatgaggtggaccaagtgacttggaccagagggtaagtggrttggggtcaggactcctggatccacagcagacatccttctcccaaatgggaccctcaccctaatctgaacacttctatggatccatcagcaatcacaggagaacaaagcaccagcaactgtatgcctgttcacgtgtgtgtgcttgtgtttgtgcacgtgtgtacacctgcatgtgtgtgcgtgtgtgatgctttacttgctgaaggaagtggaggaaggttggcagtttctgatgtttttcttcatcttggatattgtaggtgccactcccgggagagccaggcagccatggcgggtca

SEQ ID NO: 86982 - DNA, 601 bp, Human
aggaaaatttctgaacattgttttataaacattgtaggctgtaagacacagtcataaatatattttctggtgagactcagtatgcacatacatatatagataattaaacaagtgtttcaagacactgcttataatgaagctgcccagaagagggcactggtggcaaagccaggcctgagatttttgtccttgctgccattcttagagtatttttagctgcagttctagatcctttagaaggtggtgacatccatttggtcactaatgactagcccttaaaagcaggtgcagcacagcacartatcagaaactatcagaatgcgtcaaacgtcacaaaggtaagcgctgtgctgggaaacacttgcttaattgccaacagatgtggctatctgggggtctccttgagaaacatctttatgactctgagtcacatccacagaagtttgagacacagagtgacatccacagaagtttgagacacagtgtttccgaagcttttctggctcttttcaccctcaaagccctgtctcatctgttactgtatacatgactcacaacaggcctctgagacagagagggcatatgtcatttcaattttgta

SEQ ID NO: 86983 - DNA, 601 bp, Human
tgctgccattcttagagtatttttagctgcagttctagatcctttagaaggtggtgacatccatttggtcactaatgactagcccttaaaagcaggtgcagcacagcacaatatcagaaactatcagaatgcgtcaaacgtcacaaaggtaagcgctgtgctgggaaacacttgcttaattgccaacagatgtggctatctgggggtctccttgagaaacatctttatgactctgagtcacatccacagaagtttgagacacagagtgacatccacagaagtttgagacacagtgtttccraagcttttctggctcttttcaccctcaaagccctgtctcatctgttactgtatacatgactcacaacaggcctctgagacagagagggcatatgtcatttcaattttgtagaaagggaaattgaggcatggggttttccccagggggtaatgcctgggtcccatgggcttgcgtgcagccacttgaaaatgggccctctggagggacaggcaggccagcggcaggtgtgcctgctccttggatggacacttttccaggggtttagagagaagctcccacttctctattattttctgagct

SEQ ID NO: 86984 - DNA, 601 bp, Human
acatccatttggtcactaatgactagcccttaaaagcaggtgcagcacagcacaatatcagaaactatcagaatgcgtcaaacgtcacaaaggtaagcgctgtgctgggaaacacttgcttaattgccaacagatgtggctatctgggggtctccttgagaaacatctttatgactctgagtcacatccacagaagtttgagacacagagtgacatccacagaagtttgagacacagtgtttccgaagcttttctggctcttttcaccctcaaagccctgtctcatctgttactgtatacrtgactcacaacaggcctctgagacagagagggcatatgtcatttcaattttgtagaaagggaaattgaggcatggggttttccccagggggtaatgcctgggtcccatgggcttgcgtgcagccacttgaaaatgggccctctggagggacaggcaggccagcggcaggtgtgcctgctccttggatggacacttttccaggggtttagagagaagctcccacttctctattattttctgagctggagggcaggcatgtcaagaacctgggatgctggggggctgtgccacctgctggga

SEQ ID NO: 86985 - DNA, 601 bp, Human
tggggacactgtgtgtgctatcttaaaagatttctagaagtcgatttcacctatctgttcttgtcgtactggtaggcacgaaactctcctcttcatctctttctcctcctgtactctgtgaccctagaggtggtctttccccaccacagtgtcgctctctcccgggagcacatcccatcagagcagctcaccctgcagagcctctgccctggcaggttgtcatggcaacagccagacaggcctggtccctaccctcaggatgctcaagaatattcagggacagagggcgtaccgtgtgacttttttttttttttttttgagacagagttttgctcttgttgcccaggctggagtgcaatggcacgatctcggctcaccacaacctccacctcccgggttcaagtgattctcctgcctcagcctcccaagtagctgggattacaggcatgcaccaccatgcctggctaattttgcatttgtagtagagactgggttactccgtgttggtcaggctggtcttgaactcccgacctcaggtgatctgcccgccttggcctcccaaagtcctgggattacaggcatgagccactgctcccagccc

SEQ ID NO: 86986 - DNA, 601 bp, Human
cagagcagctcaccctgcagagcctctgccctggcaggttgtcatggcaacagccagacaggcctggtccctaccctcaggatgctcaagaatattcagggacagagggcgtaccgtgtgacttttttttttttttttttgagacagagttttgctcttgttgcccaggctggagtgcaatggcacgatctcggctcaccacaacctccacctcccgggttcaagtgattctcctgcctcagcctcccaagtagctgggattacaggcatgcaccaccatgcctggctaattttgcatttstagtagagactgggttactccgtgttggtcaggctggtcttgaactcccgacctcaggtgatctgcccgccttggcctcccaaagtcctgggattacaggcatgagccactgctcccagccctgaatcttttaatcacaatacagcaccggatttaacaatggctcaaagacaacctgagctagagactggcagggcattatgaatggccccattaactgtgagaactaaaaccacaaatactggttttcccaactctttgtgaggtgcacagcgcttcttcacagacctcattgcgctt

SEQ ID NO: 86987 - DNA, 601 bp, Human
gagcagctcaccctgcagagcctctgccctggcaggttgtcatggcaacagccagacaggcctggtccctaccctcaggatgctcaagaatattcagggacagagggcgtaccgtgtgacttttttttttttttttttgagacagagttttgctcttgttgcccaggctggagtgcaatggcacgatctcggctcaccacaacctccacctcccgggttcaagtgattctcctgcctcagcctcccaagtagctgggattacaggcatgcaccaccatgcctggctaattttgcatttgtrgtagagactgggttactccgtgttggtcaggctggtcttgaactcccgacctcaggtgatctgcccgccttggcctcccaaagtcctgggattacaggcatgagccactgctcccagccctgaatcttttaatcacaatacagcaccggatttaacaatggctcaaagacaacctgagctagagactggcagggcattatgaatggccccattaactgtgagaactaaaaccacaaatactggttttcccaactctttgtgaggtgcacagcgcttcttcacagacctcattgcgcttga

SEQ ID NO: 86988 - DNA, 601 bp, Human
tctcggctcaccacaacctccacctcccgggttcaagtgattctcctgcctcagcctcccaagtagctgggattacaggcatgcaccaccatgcctggctaattttgcatttgtagtagagactgggttactccgtgttggtcaggctggtcttgaactcccgacctcaggtgatctgcccgccttggcctcccaaagtcctgggattacaggcatgagccactgctcccagccctgaatcttttaatcacaatacagcaccggatttaacaatggctcaaagacaacctgagctagagaytggcagggcattatgaatggccccattaactgtgagaactaaaaccacaaatactggttttcccaactctttgtgaggtgcacagcgcttcttcacagacctcattgcgcttgagcctcacaccagccccacagggcagatggatagacagcattcgttttctggctttacagacatgcaggcctcaccctgctctccattctattgaggacaaaaccaagagcgagagaatgcacagctgacaggtgaccaggccagggctaaaagcaggttaccacgacttcacccaatcccagcttt

SEQ ID NO: 86989 - DNA, 601 bp, Human
gacaggcaagatccaaggtgctcaggcctgactgcccgtgagcatcacctggggagctttggaaacccgggacagattaactgatgattgttaaagctcttcgatgattttaacgtgtagcaaggttgagagccactagcctagaacaagcgagctttcagtcccactgtgctctgcctggtcagagcatctagtgcaatcccggcaccacattattagggacctttgacacactggaacaaacccaacagaggatgaccaggatggcaaggttcctagaaaccatttcctaggagaaccrtttcagggaattcgggaagaaaacctggagaggaggtgactttggagggtgcgatacacctctcacacctgcaacgggtgggatggggaaagggtggcaggctcagcccaccagcggacagatttcagctcacatggggaagaccttcccaaatgagctcttccaagatgagaggggcttgcctgaaaggtagtgagccccccatcatcagacataaccaagcagagactgtgctcatccgggcgtcaggctgtggtgcaggaggtggggcgttaaaccaggtggcttccaaggtttacc

SEQ ID NO: 86990 - DNA, 601 bp, Human
agggacctttgacacactggaacaaacccaacagaggatgaccaggatggcaaggttcctagaaaccatttcctaggagaaccgtttcagggaattcgggaagaaaacctggagaggaggtgactttggagggtgcgatacacctctcacacctgcaacgggtgggatggggaaagggtggcaggctcagcccaccagcggacagatttcagctcacatggggaagaccttcccaaatgagctcttccaagatgagaggggcttgcctgaaaggtagtgagccccccatcatcagacatarccaagcagagactgtgctcatccgggcgtcaggctgtggtgcaggaggtggggcgttaaaccaggtggcttccaaggtttacctctcaaagtctggtattcctgtggcctcgatcatcctgcattcatttcacagaccttccctgagcgcctaccatgtgcaggccctgttctaggtacagggacacagctgagaaacagagcttctgctctcatgagctcacatcatggtgaggagagacagataataaacacatacatatataacacatcaggaaggtcaggagtgccaaagaaaaac

SEQ ID NO: 86991 - DNA, 601 bp, Human
acatgtctggacctgtgctattcactgaagaagatggaacagaattttaagttactgcccttactgatggaaaatacagaggtttcaattcgcctctaaagaataagtctcgtggacccagccttaactgtttaagtcataccgcgcgcagactgtgtcccccaagatttgatgggctcttttttcttcaacaagttggcttttcaaagaagaaatgtgagaccctgaataataatgatcactaacaactattgactactttagatggtcttgatattctaccaagctttttacatgtatygtctcattcccattttatagacgaaaaaaatctgagcaaaaaagaaaaagtgaagtaacttgcccaaagtcatgcagtaagtggtgccaggatttacaaacccaggcaatctaattccagcattcaggctcttgataggattttcatttcctaaatgctgtcatcaccattgtcttttattagccccatatttatggctcatattcttatcagatcaagcactgatatatcaaactgataagtgatgtcatcctcaccattatttcttcaccagcttgttttgtaattgccattttcttt

SEQ ID NO: 86992 - DNA, 601 bp, Human
ttttataggcatgccctccccgaatccagttgatttacatatagtcgattggttcacattatatctggagtcatgaagagttagacatttctgttgccttggggagtatatttacatttataaaactttagtgatacctaacttgtcattatctggagttcaaaaacactaccttagatcatcatcatgatttggttgtttgtcatctttctgttgacagtatgcagttggcagtagatgtgcagataccagaatgttttggaggagtggcaggtgaagcagtttttattgatacagaggraagttttatggttgatagagtggtagaccttgctactgcctgcattcagcaccttcagcttatagcagaaaaacacaagggagagggtaagttagtaaatgatcttctttttttctgtattaataaaagtaatttgcatttgtgcccatctgagacctcagcaacactccatttggaatgtgaagcctaattactggacagttaactagtgttaaactcttttactactgttacaaaatgagaaatgccacagcctggactggcttttttttgttccccttttatggccctcacttcttc

SEQ ID NO: 86993 - DNA, 601 bp, Human
attttaattaattaattaattttttttttgagtcgcccagcctgactaacatggcaaaaccccgtctctacctaaaaatacaaaaattagcctggtgtgttggcatgcacctgtgatcccagctacttgggaggctgagacaggagaatcgcttgaacctgggaagcagaggttgcagtgtgctgagatcgtgacactgcactccagcctgggagacagagagagactctgtctcaaaattaataaataaaaattaaataaataaatacaatagaaattaattttcttagagttctggagmctaaaagttcaagatcaaagttctagctgattcagtttctggcaagggctttcttcctggcttgcagacagccatcttttctctgtgtcctcatatgatagggaggaaaagaaggagagagtgaattccctggtgttttttcttttttttggggggggggtggagtttcgcttttgtcacccaggctggagtgcaatggcgtgatctcagctcactacaacctccacctcccggattcaagcgattctcctgcctcagcctccagagtagctgggactacaggcgcatgccaccacgcct

SEQ ID NO: 86994 - DNA, 601 bp, Human
ctaaaagtcccaggcttcatctaaatattatctaaatcagagattggtgagactcaagttataattcatcctgaagtgaaattcccttccagctgtgaacgtttgaaatcaggcaagttatatgctttcaaaatacaatagtaggaaatgcataggatgaacattcccaaaaggattatgggtgcctagcaaggcaaatttcattggaccataaggctcaagaataatcctttgctggccaggcacggtggctcatgcctgtaatcccagcactttgggaggctgaggcaggcagatcacraagtcaggagtttgagaccaccctggccaatatggtgaaaccctgtctctgctaaaaatacaaaaattagccgggcatggtggtgcgtgcctgtagtcccagctactagggaggctgaggcagaagaatcacttcaacgcaggaggcagaggagattgcagtgacatgagatcatgccactgcactccagcctgagtgacagagtgagactccatctcaaaaaaataataataattaaaaaaagaatgatcctttgctttgatgctctgccttccaggcccactgcagtagcagaatcac

SEQ ID NO: 86995 - DNA, 601 bp, Human
aatgtgctttttatcagtaaagactgtgtacagtggcaagttaaagaaaattataattattcctttttctttttgaattacttttttttttttttttttttgagacaaagtctcactctgtcgcccaggctggagtacagtggcgcaacctctgccaccagggttcaagagattctcctgcctcagcctcctgagtacctgggattacaggtgcctgccactgtgcctggctaatttttgtagttttagcagagatggggtttcaccatcttggccaggctggtcttgaactcctgacctygtgatccacctgcctcggcctcccaaagtgctgggattacaggtgtgagccaccgcgcccagcctttgaattacttttttaaagttgagaaattatcaaagcagagtccgttttaacttttagtgattattgcagaaagcactggctgaacagctttgtaactttccaaaagaaagccatactttagacagttggaaataaagccctgggttttaaggttttttcctgtaatggactatggtttttccaatgctatgtttttttctatctagtaagggttggattaaagaagaggctttt

SEQ ID NO: 86996 - DNA, 601 bp, Human
tatagtaaataagacagaagaatatagtaaataagagagaaggtccctgctctcttggagagagagagcatttttattattattattttatttttcgtaacaaatctaatattatctcttctgtatttaggttcgactagtgatagtggatggtattgcttttccatttcgtcatgacctagatgacctgtctcttcgtactcggttattaaatggcctagcccagcaaatgatcagccttgcaaataatcacagattagctgtaagtattaactagtgaagagagttttataacaaagtsaagactgtataaaatgttaatgtctagaaatgtcaaaatagcgtttgcctgacaaataatatagacatgcagttttgagtaaagttacgtttggttggtttccattaaaaaattctggtcataagtgtcagttttcctggaaaataacaagcataattaatggactttgtggttgagcgcggtagctcgtgcctgtaatcccagcactttgggaggccgaggcaggtggatcatgaggtcaggagtttgagaccaccctcgccaacatggtgaaaccctgtctctactaaaaaaaaaaaa

SEQ ID NO: 86997 - DNA, 601 bp, Human
gctgaggcaggggaatcatttgaacccagaaggcggaggttgcagtgagccaagattgcgccactgcactccatcctgggcgagagagcaacactccatctcaaaaaaaaaaaaaaaaaaaagaaattttaagttatgtatgctttttgtaaaagaaaaaaaaagttctaaacaataaaaaatgtaggaagcgattattcattactcagagattgtgtaaatattgttgtctggtgtaaatatttttgcagacttcatgcatatacaaacttacgttttagaaaatgaggtcataggccasgtgtggtggctcacgcctgtaatcccagcactttgggaggccaaggcgggcagatcacgaggtcaggagatcgagaccatcctggctaacacggtgaaaccccatctctactaaaaatacaaaaaagtagctaggcttgatggcgggcgcctgtaatttcagctactcgggaggctgaggcaggagaatggcatgaacccgggaggcggagcttgcagtgagctgagatacgccactgcactccagcctgggcgacagagcaagactccgtctcaaaaaaaaaagaaaatgaggtcatgc

SEQ ID NO: 86998 - DNA, 601 bp, Human
cacttaatatattgtgaacatctttccatgtatactactttttttttccatgtacactacttataagtctgctttacactaacagctgcatagtattttgctgtatgactgtagcataggttttttttgtatttgtatttgtttttgggttttcttttttatgagacagggtctcgctctgtcatccaggctagagtgcagtggcatgatcttggttcactgtagcctcaatctcctgggcttaagcaatcctttcacctcagcctcttgagtaactgagaccacaggcacacaccaccayacccagccaatttttaaattttttgtagaggctgggcacggtggctcacacctataacccaccactgtgggaggccagggcaagcagatcacttgaggtcaggagttcaagaccagccttgccaacatggtgaaaccttgtctctactaataatacaaaaattagccaggtgtgttggtgctcacctgtagtcctagctacttgggaggctgaggcaggagaatcacttgaactcgggaggtggaggttgcagtgagccaagatcacactgttgcactccagcctgggagacacagtgag

SEQ ID NO: 86999 - DNA, 601 bp, Human
attgcactccagcctgggcaacaagagtgaaactctgtctcaaaaaaaaaaaaaatgtatctgcccttgactagttttcaactaatggcatagatcattctataaacagataatgtagtaaaggttacaatagaaagtacagggtactgtacaaaggacggattctaacctggcccaggtgagcaggatgaaaaggaggaaggttagggaagggagtgtaatagtctgtcatgtttcttccagctgtttttgtcattttctatcacccacttaagcaagagcttcctaatgtttggatccrctcaggggtaatcaaactcagcctttctcaaactcatgccctcagcacactatgataaatcagaaagcaaatttataaatttagtgagaattacagttgtcaagcagaatgaagtttatgttttctagtcagtttattttcttcccagataccaggaagttgggaaagcaggggttcagagttggtaagcagagaagcaaataaatggaaatggatgccctcaggaatattatgcttaagttgtgataattctgatgccctccttggtttactagcagaacgccctttaccttggatatt

SEQ ID NO: 87000 - DNA, 601 bp, Human
caccttttcatttccttgcactgtgtctgcatgatatgataatactcccaagcactattgcttaaatcttgagttacacttaatgcttttttttttggtcttttttctttttaatgtgaaatagaatatacaaatgaaaatgtatatttagaagaacaataataaatgtccaggtgcccattgctcagactgacaaatggaacattactaccccccaggagcctcgtatgctctccccccaagaggcaaccactatcctgaattttgtgtaattgtcacctagcttttatagattttactstctgtgtatccctaatagttgcttatttctagcctttatataaatagaattatactgtatatgactgacaacttttgctcattattattttttgattcatccatgttgatgtgtgacactgtagttcatttcgatgacatgaatatgccacaacttaattatatattctgttgatgtcaaaaaaaaaaaaagaatattctaccagagtttttacttttcttctggaggtcagaaatacgttaggcttgatgatatggaaaattgacacatatatggactcagacaataaagttttctaaa

SEQ ID NO: 87001 - DNA, 601 bp, Human
gttaataactccgaatattgggttaattatactgaatgaacacttacaggtttcttagagctagtcctgtggatgagatatacagtgacccatgaagtgacacttttgttgccttgtctgatatcacctagagcaaacatagaaatgtgttgttattactgcatatttagctacataggaaattctctggaatatttaaatgatggggcgcatgcacctgaaatgagtaggtggccaaggaatgccattttctaaagctcttcgaaataatttattagccatgtagaaggaggtgagtacyctgtgttcctggaagagattgaaaaaaaaaagaataaaatcaggacaaaaggaaaattgttgaggttacctttaaaattaatttatttggaacatacgatggtttctcttatttgcttagtatatttcttgtatgaaattgtgtctgtttttttttttattttgtattttgctgtccagcttttattatccagttacttacctgcatttcacaagtattgttctttaaaagtatggcagcatgaaatctttgtatttgtttttaaagctgctgagcaagtgaacaaaccagcttttattt

SEQ ID NO: 87002 - DNA, 601 bp, Human
tgtagaaggaggtgagtactctgtgttcctggaagagattgaaaaaaaaaagaataaaatcaggacaaaaggaaaattgttgaggttacctttaaaattaatttatttggaacatacgatggtttctcttatttgcttagtatatttcttgtatgaaattgtgtctgtttttttttttattttgtattttgctgtccagcttttattatccagttacttacctgcatttcacaagtattgttctttaaaagtatggcagcatgaaatctttgtatttgtttttaaagctgctgagcaagtraacaaaccagcttttattttcttgaaaatagaccattgaaagctgtgaagtcttttctacacttctagaaaatgtcagatttatgctagcctctccgctttgtgattaattggtataacctagaggtcttggtttggaaatgctctaataaagggagaaattaaaatggcatgtgggcaaagatggaataaaaggtcacttaaatacatattgggcctagccagtgaaaatgtctattttttaatctatatttctttgttgttctacaaactgaaaaaaatcctgcctgaccaagttagg

SEQ ID NO: 87003 - DNA, 601 bp, Human
aggttacctttaaaattaatttatttggaacatacgatggtttctcttatttgcttagtatatttcttgtatgaaattgtgtctgtttttttttttattttgtattttgctgtccagcttttattatccagttacttacctgcatttcacaagtattgttctttaaaagtatggcagcatgaaatctttgtatttgtttttaaagctgctgagcaagtgaacaaaccagcttttattttcttgaaaatagaccattgaaagctgtgaagtcttttctacacttctagaaaatgtcagattyatgctagcctctccgctttgtgattaattggtataacctagaggtcttggtttggaaatgctctaataaagggagaaattaaaatggcatgtgggcaaagatggaataaaaggtcacttaaatacatattgggcctagccagtgaaaatgtctattttttaatctatatttctttgttgttctacaaactgaaaaaaatcctgcctgaccaagttaggttttacggacctgaagctcataacagaatgattacacttctgtatatatcttttgcaactgatcgtgcagtttgggtcttct

SEQ ID NO: 87004 - DNA, 601 bp, Human
tttgtgattaattggtataacctagaggtcttggtttggaaatgctctaataaagggagaaattaaaatggcatgtgggcaaagatggaataaaaggtcacttaaatacatattgggcctagccagtgaaaatgtctattttttaatctatatttctttgttgttctacaaactgaaaaaaatcctgcctgaccaagttaggttttacggacctgaagctcataacagaatgattacacttctgtatatatcttttgcaactgatcgtgcagtttgggtcttctttaaaaatggtatttgyaaagagctcaggtagtgttttttttcccccacaatacgtagtgctttactattgactgtcgccccctaatttaaacacattttttactctaaaccagtatgactggtaaatcctccccctaattttttttctatgatcacaatttaaggtagttcctcctagttttgtaagtaagttgctgtatactagagtcacaaaaggagttattttctcggcaccaaaccttattgtaaagatttggcaacagttctccagctgtcttttgaacatattgcttatactttcccagttttaggttat

SEQ ID NO: 87005 - DNA, 601 bp, Human
acacttctgtatatatcttttgcaactgatcgtgcagtttgggtcttctttaaaaatggtatttgcaaagagctcaggtagtgttttttttcccccacaatacgtagtgctttactattgactgtcgccccctaatttaaacacattttttactctaaaccagtatgactggtaaatcctccccctaattttttttctatgatcacaatttaaggtagttcctcctagttttgtaagtaagttgctgtatactagagtcacaaaaggagttattttctcggcaccaaaccttattgtaaasatttggcaacagttctccagctgtcttttgaacatattgcttatactttcccagttttaggttattctgtaaagcacattccgtcatttattttttcataggaattacgcctgagttagtatacagtagtcttcttcagactataattaaatatttactaataaaatgcatttaagaagaaaaataataggaacagagcaagatatttcatctttttatgaactcaacaggaggaaaagtttgccttctttgtcaagttctagaagttagcattgataagttatccaagagatcagaaaa

SEQ ID NO: 87006 - DNA, 601 bp, Human
tattgcttatactttcccagttttaggttattctgtaaagcacattccgtcatttattttttcataggaattacgcctgagttagtatacagtagtcttcttcagactataattaaatatttactaataaaatgcatttaagaagaaaaataataggaacagagcaagatatttcatctttttatgaactcaacaggaggaaaagtttgccttctttgtcaagttctagaagttagcattgataagttatccaagagatcagaaaatcacgcttaccatgagttaaccattgtatgaattmaccttcttacaaatccttcccaagaaattagaaactaaagtacatggccggatgcagtggctcacacctgtaatctcatcactttgggaggctgaggtaggtggatcatggggtcaagagatcaagaccatcctggccaacatggtgaaaccccatctctactaaaaataaaaaattagctgggcgtgatggcacacacctttagtcccagctactcaggaggctgaggcaggagaatcacttgaacccaggaggcggaggttgcagtgagccaagattgtgccactgccctccagcctg

SEQ ID NO: 87007 - DNA, 601 bp, Human
ccggccgactttaggattcttaacaagcatgtaaatgcttcttaaaagcttttcactttttaataatttcctcaggatagatgtactaggcaccttttttggacatactgttgatatgaggtgatttagataccaatttttcagaaggctagctgattttcatcattcaaaaaatgacttcttaataaggcaggttaaaatacaccttgcctctctttttctgtgaatttttgcattaaagatagattatcaaccctagggaattataaaagtttataattccactcaacacagctgttcttttttttttttttttttgagatggagtctcgccctgtcgcccaggctggagtgcagaggcacgatctcggctcactgcaacctccacctccccagttcaagtgattctcctacctcagcctcctcagtagctgggattacaggtgcgtgccaccacgcccagctaattttttttttttttttttgtatctttagtagagatgggggtttcaccgtgttggccaggctggtcttgaactcctgacctcgtgatctgcctgcctcagcctcccaaagtgctgggattacaggcgtgagccac

SEQ ID NO: 87008 - DNA, 601 bp, Human
ccgcaacctctgcctcacaggttcaagcgattctcctgcctcagcctcccgagtagctgggattacaggcatgcgccaccacacccggctaattttgtatttttagtagagatggggtttctccatgttggtcaggctggtctcgaactcccgacctcaggtgatctgcctgccttggcctcccaaagtgctgggattgcaggcgtgagccaccgcgcccagccaaaaagcagtcttaaaggtttttgtttatatttgttgctgttacagtacttgaatatagttaataagagcttagaawtttatttctcagctacttttagctttcagttttatattaattgtataagacataataaaatcccacctaagcagatcttgttctgtcatgacttatttttgggacataatcattttatattattatttttgtagagatgggggtctcactatgttgcccaggatggcttcaaactcctggtctcaagtgatcctcatgccttgccctcctaaagagctgggattacagacatgagccaccatgcctaggtgcatcattttaaaacaatgtcgtcctagctatttttattgggtgtaatat

SEQ ID NO: 87009 - DNA, 601 bp, Human; identical to SEQ ID NO: 19577

SEQ ID NO: 87010 - DNA, 601 bp, Human
gggtctccgggggccgagggagggggcgggccggggtcgccgttcggcgctggcgagggtctgggtaccaggccggggctgccgcgggctggggtcgccccggagtctcgggccggggtttgggtgtcgctcctctggggcgggggaccttgcggggcgaccttccccgcatcttgtcgccaagggcgttcatgccctccggagcccggcgtttcggacgccccctttcagctcaggtgggcggaagcggctgagccggtgggaaaccgggaggggaaagttttgcactggaggctcctcsagtgtacaggacgggagggcaggggaaacggttggaaagcgtgacagtctgcttggctttgggtcagaaacggtcgctggatttgctcgaacggggagggggccagctggagttcagttcagggtagacgttttaggaaacggcagacgcgacagattgagcaaaaaactccgtggagccgagggtgggagacacgagctgcacccagcacagaggcaagaccggagagccaggtgtgcccggagccaggtgtgctcccgagtgggtcgggtcgatgcgcgtcgtggcccaggtggtctg

SEQ ID NO: 87011 - DNA, 601 bp, Human
cgggccggggtcgccgttcggcgctggcgagggtctgggtaccaggccggggctgccgcgggctggggtcgccccggagtctcgggccggggtttgggtgtcgctcctctggggcgggggaccttgcggggcgaccttccccgcatcttgtcgccaagggcgttcatgccctccggagcccggcgtttcggacgccccctttcagctcaggtgggcggaagcggctgagccggtgggaaaccgggaggggaaagttttgcactggaggctcctcgagtgtacaggacgggagggcaggggraacggttggaaagcgtgacagtctgcttggctttgggtcagaaacggtcgctggatttgctcgaacggggagggggccagctggagttcagttcagggtagacgttttaggaaacggcagacgcgacagattgagcaaaaaactccgtggagccgagggtgggagacacgagctgcacccagcacagaggcaagaccggagagccaggtgtgcccggagccaggtgtgctcccgagtgggtcgggtcgatgcgcgtcgtggcccaggtggtctgtgtctgacgttcggtttcctcttgct

SEQ ID NO: 87012 - DNA, 601 bp, Human
tttgggtgtcgctcctctggggcgggggaccttgcggggcgaccttccccgcatcttgtcgccaagggcgttcatgccctccggagcccggcgtttcggacgccccctttcagctcaggtgggcggaagcggctgagccggtgggaaaccgggaggggaaagttttgcactggaggctcctcgagtgtacaggacgggagggcaggggaaacggttggaaagcgtgacagtctgcttggctttgggtcagaaacggtcgctggatttgctcgaacggggagggggccagctggagttcagktcagggtagacgttttaggaaacggcagacgcgacagattgagcaaaaaactccgtggagccgagggtgggagacacgagctgcacccagcacagaggcaagaccggagagccaggtgtgcccggagccaggtgtgctcccgagtgggtcgggtcgatgcgcgtcgtggcccaggtggtctgtgtctgacgttcggtttcctcttgctggaggaatcgtgtttgttggaaattatttagtggaatacaaatgactgctgggtcatgctgggaattagattttaaaaacagaggaacgtgc

SEQ ID NO: 87013 - DNA, 601 bp, Human
attggaaacagcaacgccaacagcaggggcatggtgaggtaaattatgggaagtttattgaagtattttacaaccattaaaataagcagttttatacatcatggtttaaacaacataaacattggtgacattatggattattttattttctttttatattttccaggtttctggaataagtgtgtatttcagattggaaaaaaaccatcaaagacgtgaatgttttaagtgtatcatttaattcatctcactggaacattcaacaatgaagatttatttattgattgcccatcaaaatgcyagccagcatgttaggtgctggaaaataacttttaacctttattgatttagtttatgactagctttctcccttgctttgtgacagacacttaaaaatatttttggcaatattaggatatttatttttgaaacaggtgaaaagcaaagttttgaaatatgagtgatattgtaattattgtataaactttatgtgcttacatttaactcttggctgttgtaagttttgaagttaacatacctctttacagttaataccgtttagatttttaaatgctttaaaattcatgtttaaaaaaataaa

SEQ ID NO: 87014 - DNA, 601 bp, Human
caggtgctttaggcagtagctttaaaaattacaggcgtgtaaatcctttgacccagcaatccagttctaggaatttaacctgcagatatatttgtacacgtgtgagataacataggtacaagattatttattgccttgagtgtccatcagcaagcaagagacttatcagataaatccatgcccagatggttaatgaggttgtaaagttgtagaaaggaacgaggaagctcttttcttagttgacatggagagatctccaaaatatcttaagttacaagagcaggccgggcgcggcggctcwcacctataatcctagcactttgggaggccgaggcgggtggatcatttgaggtcaggaattcaagaccagcctgggcagcatggtgaaactccgtttctactaaaaaaatacaaaaattagccgggagtggtggtgcgtgcctgtaatctcagctacgcgggaggctgaggcaggagaatcgcttgagcctgggaggtgcaggttgcggtgagtgagattgcgccactgcattccagtctgggcaacagagtgagaccctgtctcaaaaaaacaaaacaaaattacaagagcaaagtgtag

SEQ ID NO: 87015 - DNA, 601 bp, Human
acaggcgtgtaaatcctttgacccagcaatccagttctaggaatttaacctgcagatatatttgtacacgtgtgagataacataggtacaagattatttattgccttgagtgtccatcagcaagcaagagacttatcagataaatccatgcccagatggttaatgaggttgtaaagttgtagaaaggaacgaggaagctcttttcttagttgacatggagagatctccaaaatatcttaagttacaagagcaggccgggcgcggcggctctcacctataatcctagcactttgggaggccraggcgggtggatcatttgaggtcaggaattcaagaccagcctgggcagcatggtgaaactccgtttctactaaaaaaatacaaaaattagccgggagtggtggtgcgtgcctgtaatctcagctacgcgggaggctgaggcaggagaatcgcttgagcctgggaggtgcaggttgcggtgagtgagattgcgccactgcattccagtctgggcaacagagtgagaccctgtctcaaaaaaacaaaacaaaattacaagagcaaagtgtaggaaagtgtgcattgcgtgctcccattcttg

SEQ ID NO: 87016 - DNA, 601 bp, Human
aatcgcttgagcctgggaggtgcaggttgcggtgagtgagattgcgccactgcattccagtctgggcaacagagtgagaccctgtctcaaaaaaacaaaacaaaattacaagagcaaagtgtaggaaagtgtgcattgcgtgctcccattcttgtgttttgaaagaggaggtaatggctgatgcatgcagattccctggaaggtgaaaggaggaaccaataacaatggttacctgattggggaagatgatgggaactgagtggatggggaatataggtgggaaggaaacttttcactatgygcctttttattttttgaaattcaaaaaagtttgaataatctgtcttcactttttctaaaattggaaagcagtttcatagaaaaatagtatgatggtaagaaaatacccattttacaccttttttgagggaatttttatagattaaaaaatacagctgggcgcaatggctcacgcctgtaatcccagcactttgggaggccaaggcgggtagatcatgaggtcaggagttcgagaccagtctggccaatgtggtgaaaccccgtctctactaaaaatacaaaaattagccgggcatagtga

SEQ ID NO: 87017 - DNA, 601 bp, Human
gcctgggaggtgcaggttgcggtgagtgagattgcgccactgcattccagtctgggcaacagagtgagaccctgtctcaaaaaaacaaaacaaaattacaagagcaaagtgtaggaaagtgtgcattgcgtgctcccattcttgtgttttgaaagaggaggtaatggctgatgcatgcagattccctggaaggtgaaaggaggaaccaataacaatggttacctgattggggaagatgatgggaactgagtggatggggaatataggtgggaaggaaacttttcactatgcgcctttttattttttgaaattcaaaaaagtttgaataatctgtcttcactttttctaaaattggaaagcagtttcatagaaaaatagtatgatggtaagaaaatacccattttacaccttttttgagggaatttttatagattaaaaaatacagctgggcgcaatggctcacgcctgtaatcccagcactttgggaggccaaggcgggtagatcatgaggtcaggagttcgagaccagtctggccaatgtggtgaaaccccgtctctactaaaaatacaaaaattagccgggcatagtgatgcgcacctg

SEQ ID NO: 87018 - DNA, 601 bp, Human
aacagagtgagaccctgtctcaaaaaaacaaaacaaaattacaagagcaaagtgtaggaaagtgtgcattgcgtgctcccattcttgtgttttgaaagaggaggtaatggctgatgcatgcagattccctggaaggtgaaaggaggaaccaataacaatggttacctgattggggaagatgatgggaactgagtggatggggaatataggtgggaaggaaacttttcactatgcgcctttttattttttgaaattcaaaaaagtttgaataatctgtcttcactttttctaaaattggaargcagtttcatagaaaaatagtatgatggtaagaaaatacccattttacaccttttttgagggaatttttatagattaaaaaatacagctgggcgcaatggctcacgcctgtaatcccagcactttgggaggccaaggcgggtagatcatgaggtcaggagttcgagaccagtctggccaatgtggtgaaaccccgtctctactaaaaatacaaaaattagccgggcatagtgatgcgcacctgtagtcccagctgctcgagaggctgaggcaggagaattgcttgaaccctggaggcaga

SEQ ID NO: 87019 - DNA, 601 bp, Human
aaggcctctgaggaaatgcccttcgaggtgcaatctataggggtagtggaccagacagaagggaaggcatggagctggcaagagctgagtattctagagaattaaaagcagctttgtgtggcttgaacagacagtgaagcgggagagatagactggggccatgtcaggctttcagtagctaaggaatgcagattttattctaagtacatgaagccgctgaaagatttttaaacggggaaatctcatttgatttacatttcaataattttagctaatatttacttgatgctgtatgtcctgygtactttctgcgtcttaatttattgactcttcatcatattgctattttcagattggaaaatggaggcatagggaagctaagtaattggtctgaaatttcacagctagcaggtgatggagctgtgattggaacccaagccttccatttcagaatccgtattctcaaccactgccccctgctttttaaagaagcatattcttgactcctgagtggagagtggtttggaggagaagggaggacttgggagaagggaggtgttgcagtggttcaggtgagagttacggggcttggtgggttagg

SEQ ID NO: 87020 - DNA, 601 bp, Human
ggctggagtgcagtggagcgatctcggctcactgcaacatccgcttcctgggctcaagtgattctcctgcctcagcctcctgagtagctgggactacaggcgcgtgccaccatgcccggctaattttttgtaattttttttttttaatagatacgggtttcaccatattggccaggctggtcttgaactcctgacctcgtgatctgcctgccttggcctcccaaagtgctgggattacaggcatgagccaccacgcccagccaagcttttttttcataaaagggccggatagtaaacctcrtaggctttgtgggccacatatgatctctgtcacaagtctttttttttttcataaccttttcaatatgtaaaaaacattctgaccttggggactgcccttgactactactctagtcccctgctatctctttgacattgtctgttgctcctctcccgtttcctccctgactctgctctgtctcattggtctccttgccaagcacactcctgcctcagtgcctgtgcacttgctgcccctgtagtggtttcctcttagatacctgcatgtggtgtatccttgcttcattcaagtttgtgctca

SEQ ID NO: 87021 - DNA, 601 bp, Human
tccgcttcctgggctcaagtgattctcctgcctcagcctcctgagtagctgggactacaggcgcgtgccaccatgcccggctaattttttgtaattttttttttttaatagatacgggtttcaccatattggccaggctggtcttgaactcctgacctcgtgatctgcctgccttggcctcccaaagtgctgggattacaggcatgagccaccacgcccagccaagcttttttttcataaaagggccggatagtaaacctcataggctttgtgggccacatatgatctctgtcacaagtctttttttttttcataaccttttcaatatgtaaaaaacattctgaccttggggactgcccttgactactactctagtcccctgctatctctttgacattgtctgttgctcctctcccgtttcctccctgactctgctctgtctcattggtctccttgccaagcacactcctgcctcagtgcctgtgcacttgctgcccctgtagtggtttcctcttagatacctgcatgtggtgtatccttgcttcattcaagtttgtgctcaaatgtttccttatcacagaagtcttccttgaccaaccta

SEQ ID NO: 87022 - DNA, 601 bp, Human
caccacacccagctaatttttgtaattttactagagacagtgtctcaccttgttggctaggctgctctcgaactcctgaccgcaaatgatccacccgctttggcctcccaaagtgcttggattgcaggcatgagccaccgtgcccagcctggtatatatttcatacttcaacagatgtgcgtgtgcctctgtaagcaatgtacaggtctcctttttgtttttttttcttttgagacggagttttgcccttgttgcccaggctggagtgcaatggagccatcttggctcactgcaacctccrcttcctggattcaagcgattcttctgcctcaccctcctgagtagctgggattacaggtgcccgccatcatgcccagctaatttttgcatttttagtagcgatggggtttcaccatgttggccaggctggtcttgaacttctgacctcagatgatctgccggcctcagcctcccaaagtgctgggattacaggtgtgagcaaccgcacccggccctaattggttttaaaaagattataaagccgagatcacactgtatgtaatcttctgcagcttgcattagagattatccttgtgattat

SEQ ID NO: 87023 - DNA, 601 bp, Human
tttggcctcccaaagtgcttggattgcaggcatgagccaccgtgcccagcctggtatatatttcatacttcaacagatgtgcgtgtgcctctgtaagcaatgtacaggtctcctttttgtttttttttcttttgagacggagttttgcccttgttgcccaggctggagtgcaatggagccatcttggctcactgcaacctccgcttcctggattcaagcgattcttctgcctcaccctcctgagtagctgggattacaggtgcccgccatcatgcccagctaatttttgcatttttagtarcgatggggtttcaccatgttggccaggctggtcttgaacttctgacctcagatgatctgccggcctcagcctcccaaagtgctgggattacaggtgtgagcaaccgcacccggccctaattggttttaaaaagattataaagccgagatcacactgtatgtaatcttctgcagcttgcattagagattatccttgtgattatatatagaccttgtttaatttaactgcgatcacgttttgtctatcttgtcctgtgttgaactttttttttttttttcctgaagttagtgtcctcactct

SEQ ID NO: 87024 - DNA, 601 bp, Human
gttgtgagttataggcatgcttcagttttaatagataacagattgctttctcattaggggcttgtgagtagtgtgatttcccagcattctaatcagcacacagtgtttgccttacttttaaatatttacctatctcatgggtaagaaatgatgtattgctttaatttgtgttgctttatagtgacaaaatatatattttaaaagctgttatattaggttcaggggtacatgtgaaggtttctcgtaagtgagctcttgttatgggatggaatgtattttggagaatcagatggacatactktcagcttggagaaggttagaggtatagaaactgtaggaatcaaatatgactttaggtttctggcttggtagtggtgttgcttaatgaacaggggaaaaaactattgtgagggttcatttttttttttggtcaaaaatgcctttactttgcctccacttaaacacaatttttttattagagtcgcgctctgttgcccaggctggagagcagtgacgccatcatagctcactgcagccttgaactcctgggctcaagcagtcctcctgcctcagcctcccgagtagctaggactacaggcat

SEQ ID NO: 87025 - DNA, 601 bp, Human
acctatctcatgggtaagaaatgatgtattgctttaatttgtgttgctttatagtgacaaaatatatattttaaaagctgttatattaggttcaggggtacatgtgaaggtttctcgtaagtgagctcttgttatgggatggaatgtattttggagaatcagatggacatactgtcagcttggagaaggttagaggtatagaaactgtaggaatcaaatatgactttaggtttctggcttggtagtggtgttgcttaatgaacaggggaaaaaactattgtgagggttcattttttttttkggtcaaaaatgcctttactttgcctccacttaaacacaatttttttattagagtcgcgctctgttgcccaggctggagagcagtgacgccatcatagctcactgcagccttgaactcctgggctcaagcagtcctcctgcctcagcctcccgagtagctaggactacaggcatgtgccactgtgctaagcttgcctctgtttttgaaggatagtttcatcaggattatagttggaggctttcaagttaatttattgcagtttttaattttttgtaaagatgggaggtctcactatgttgc

SEQ ID NO: 87026 - DNA, 601 bp, Human
tctgggttgcatttattatttcacattctggagattctgtaaaaccacaatttgataatatgagggttcatcaaagcggtaattattgagctatttttatagttgattcaagaattagggtggctgatagactttaaacaatattttttcgtttctataaaatgtaacttaaataacaactcttgatttgaaaccataaaatgggatgtagatatttgggggacagaagaaggattgaacaaccagtttatttctctgttgcctgttgccttgtagcttgtcgtcattgttacagccatatttgactctgtgtagaagacattgttgatgccctattgcaaatccacccttctttgcttccttgcccacagaaccatgaattgtttacatatttacccatcagggaagaggactttatcaccacaaagggctatatcttaaatagtcttagcaggtgggataatccctctttccttatccataagtggaggagaggtgaaagtgtcacccaagtctggccagtatgcagggcagtttgcagggggatgtctgcaagaagtttcttccttcacaaataaatatatgaggagttgcgtttctt

SEQ ID NO: 87027 - DNA, 601 bp, Human
tgtgtagaagacattgttgatgccctattgcaaatccacccttctttgcttccttgcccacagaaccatgaattgtttacatatttacccatcagggaagaggactttatcaccacaaagggctatatcttaaatagtcttagcaggtgggataatccctctttccttatccataagtggaggagaggtgaaagtgtcacccaagtctggccagtatgcagggcagtttgcagggggatgtctgcaagaagtttcttccttcacaaataaatatatgaggagttgcgtttcttttcttttyttttttttttttgagactgtgtcttgctctgtctcctatgccagagtgcagtggcatgatcatggctctttgcggtctcaacctccttggctccagtgatccccccacctcagcctctcaagtagctaggccctcaccaccacgctgcgctaatttaaaagtattttttggaaaaaaaagaaaaagcaaaccaaagaaacaaaaaatattttttgtagagacaagatcttgctacgttgctcaggctggtcctaaactcctggcctcaagtgatcctcccaggagtgagccaccgtgccc

SEQ ID NO: 87028 - DNA, 601 bp, Human
aatatatgaggagttgcgtttcttttcttttcttttttttttttgagactgtgtcttgctctgtctcctatgccagagtgcagtggcatgatcatggctctttgcggtctcaacctccttggctccagtgatccccccacctcagcctctcaagtagctaggccctcaccaccacgctgcgctaatttaaaagtattttttggaaaaaaaagaaaaagcaaaccaaagaaacaaaaaatattttttgtagagacaagatcttgctacgttgctcaggctggtcctaaactcctggcctcargtgatcctcccaggagtgagccaccgtgcccagccctgttgcatttcttatgctagactttgttggacctggatgagtagccagcttgcattcacaatggctcttaattaagcctgtccatttccaagcccacaccctgaggatgaccagcgggattctagatggtgctgttgctgaatttcacccacccaggaacctccctacctccacacttcctgtcatgtgggacagtaaatacccctcttgtttaaatgattgaacagcagtgtactgtaacttggagctcaaggcatctggtgt

SEQ ID NO: 87029 - DNA, 601 bp, Human
ttatgtgtattttaacgtgtacatttagaagtatgcagtaatcaaaggtggcattggcaatttaatattctgttagaagacaggacttccttttagttctttacagagaggaaataaaataatcaagaatgtccttttccaagtttcagtaattagattaaaatttttttgagttgagaaaggatcagacaaatgaattcagttttgtttgtgttagagtatgggaaaattgaagaattttagtgtcttttgaatgtttggcctgttcacatgatgaggctgtatttcccaggcgtgggargatgagtgattgtagactttgattcagtatatgaccacacttctgagagcatgacacatttcgagaataaatgatgcctttcattgccttatgtaaaaaaaaatcttcacgttggataagtcttcttctaaaatgttgcgttttctcgggaatcacagggtgtctgttatggactatgttcctgaaatttagttcaaagtagtggttaaactgtatactagtcagatggttactaggatgtttcagttttcacaaaagaaagtcaaatgccttctttccttcctttttgtggtcagactg

SEQ ID NO: 87030 - DNA, 601 bp, Human
tggagtgcagtctcatgatctcggctcactgcaacttccgcctcccgggttcaagtgattctcctgcctcaacctccccagtagctgggactacaggtgcctactaccacgcccggctaatttttgtatttttagtagagatagggtttcatcaaattggccaggctggtctcaaactcctgaccttgtgatctgcccgccttggcctcccaaagtgttgggattacaggcgtgagccaccgtgcccggctgtttttaattttaaaatgtgttttggtggctgggtgcgatggatcaggcyggtaatttcagcactttgagaggccgaggcaggcggatcacttgaggccaggagttcaagaccagcctggccaacatggtgaaaccctatctctactaaaaatacaaaaaaattaactgggcatggtgctgcatacctgaaatctcaagctgaggcacgagaattgcttgaacccaggaggcagaggttgcagtgagccaaggttctgccagtgcactccagcctgggtgaacacagtatgactctgtctcaaaaaaaaaaaaaaaaattgttttcgtgacacctttttgaagagtccag

SEQ ID NO: 87031 - DNA, 601 bp, Human
tttttaattttaaaatgtgttttggtggctgggtgcgatggatcaggctggtaatttcagcactttgagaggccgaggcaggcggatcacttgaggccaggagttcaagaccagcctggccaacatggtgaaaccctatctctactaaaaatacaaaaaaattaactgggcatggtgctgcatacctgaaatctcaagctgaggcacgagaattgcttgaacccaggaggcagaggttgcagtgagccaaggttctgccagtgcactccagcctgggtgaacacagtatgactctgtctcaaaaaaaaaaaaaaaaattgttttcgtgacacctttttgaagagtccaggcttattgtctaatatcattatttgcatcctatagactagattgcatgtgtaagcagaattgataagtgcttcagtttctttaattttttaattgtaaatatgttaaaaatcattttgattcaaggtaaaagtgacattcatttttcttgttctttggtaagtgtggattaagttggtaaccagaaggagttacggagtggttcagatgtcagtggaatgtgtgtgtgggtaaatttggaacaagcatccac

SEQ ID NO: 87032 - DNA, 601 bp, Human
ccggtgatgggcacagcaaactcattgtatgaaaagccaataaaggaaagggcagggtgggaaaaaaaatgacactcctctaaaagtattcaagaaatagcaacagggtctcggagtctccctttcagatgactgatttaaattccattctaaagtattaattttgttcgtgactagtctagaaggcattttaattttcccttttaattatgtacacgccacgtaaccagagagtatatgtgaggctgacacattattttccttggaggcagaaaatagtaaagcatgagaacccagagarctaaacgctcctcttgtaaaatagggcaaagattcttcaaaatactgttcatgttcatgctggtatagagatagcaaggatctgtgaaagaaagccagtttctcttaaatttgttcagtagtactcaaatttatgcatttaccatacagcaaataaattcagaatcagtagttcaatcaaactacattccacatttgcctatctgtttcagtgtaatttctataaaagatttgcatcttctgctctgtcttaacaggaccaggtccatatcaccatcctgtagctgaaaatgaattatgt

SEQ ID NO: 87033 - DNA, 601 bp, Human
tctcttaaatttgttcagtagtactcaaatttatgcatttaccatacagcaaataaattcagaatcagtagttcaatcaaactacattccacatttgcctatctgtttcagtgtaatttctataaaagatttgcatcttctgctctgtcttaacaggaccaggtccatatcaccatcctgtagctgaaaatgaattatgttttaaagtggtttttatgatcaatgtaatgatcataagactagtgattttcacatacttatctcaagcattttgtttttcttttttcacattaagggggtsagatttctcatatttcttgtaattgtagccagacgtcctgtttggggactattaaataccaatggtgcctgtgaagaactcatgcgattctgtggtaaccatctgagttattctttgtagatttgattttatggacaggcctctttgaagtcctgtactctatttttagaagctcttttttacgtttccgtggttcagggcatcagtcataaacatatttattattcagcacaaaaatgttgttcagtgtcttaaggctgtttaaactttacggaaataataaaccagtggcacttcagt

SEQ ID NO: 87034 - DNA, 601 bp, Human
taaataccaatggtgcctgtgaagaactcatgcgattctgtggtaaccatctgagttattctttgtagatttgattttatggacaggcctctttgaagtcctgtactctatttttagaagctcttttttacgtttccgtggttcagggcatcagtcataaacatatttattattcagcacaaaaatgttgttcagtgtcttaaggctgtttaaactttacggaaataataaaccagtggcacttcagtggatgtaatatatgagcactactgaacaaatttaagggcggagaattttgcgrtccttcacagattgctgctctgtctgcgccgccatgaacggtattttgaagaatcctttcctattttacactgagagggttccgtctccatgcttctcacacgttttgattttctgcctcccactgaaagaaacgcttttgtagcccttcaagaaacttcctacatgtctcccctccttctctcctgcctcattattactcctttaaagaaaaaaaaaaaaaagaatagtctgatagctttcttttcagatttattttattttatttattttttttgagacggtgtttcgctcttgttgc

SEQ ID NO: 87035 - DNA, 601 bp, Human
aacgcttttgtagcccttcaagaaacttcctacatgtctcccctccttctctcctgcctcattattactcctttaaagaaaaaaaaaaaaaagaatagtctgatagctttcttttcagatttattttattttatttattttttttgagacggtgtttcgctcttgttgcccaggctggagtgcaatggcgtgatctcggctcactgcaacctccgccacctggattcacgcgattctcctgcttcaacttctgaagtagctgagactacaggcgcccgccaccacgtccagctaatttttstatttttagtggagatggggttttaccatgttggccaggctggtcttgaactcctgacctcagtccacccgccttggcctcccaaagtgctgggattacaggcgtgagccactgagcccggctcttctcagatttatgtatgattggtttgctgctctgtgttgtagcagagaccctgtgctctgaagtaatttctgatccagtgaaatattacaggagcgagggactgtgcaccttcagtgtatttggtaataaagcacctattctctttttagaaatcactataatccacatgccatt

SEQ ID NO: 87036 - DNA, 601 bp, Human
ctgggaggccagaggacacacgcggcttcaacacgctcaaaactgctagagcttctcctgggcgccacagtcctccttcctggtgcattgggtggcatcccacccatctggagtggaagccaggtctagacagggagagttagatgcagaaactagaaaacaaaagcaacacgataggctcagagaaggaggctcccagagctgacgttcccttgaagatggaccacatctctgaataggcagtgcagtttatatatgcatcctccagcctataaacttagagttagaaaacagcaacaayaaaaacccaccaacgtttagcagcattctgaggaggaggtccagctattcttttttttttttttggctgggggggggttgggggaggatgggtctaaatactattgttcagaaataaagaataaagcaacatgtttccaaaagaaaataggagggggatataatttttgaggcagaggaatagtataatttagaaaatagtaattatagaaatgagaagtaaatttcagattgaatctactttgtgctgttcttaataaacttcaagaaacacaaataagtggttgaaagatgagataaa

SEQ ID NO: 87037 - DNA, 601 bp, Human
cagtcctccttcctggtgcattgggtggcatcccacccatctggagtggaagccaggtctagacagggagagttagatgcagaaactagaaaacaaaagcaacacgataggctcagagaaggaggctcccagagctgacgttcccttgaagatggaccacatctctgaataggcagtgcagtttatatatgcatcctccagcctataaacttagagttagaaaacagcaacaataaaaacccaccaacgtttagcagcattctgaggaggaggtccagctattcttttttttttttttggytgggggggggttgggggaggatgggtctaaatactattgttcagaaataaagaataaagcaacatgtttccaaaagaaaataggagggggatataatttttgaggcagaggaatagtataatttagaaaatagtaattatagaaatgagaagtaaatttcagattgaatctactttgtgctgttcttaataaacttcaagaaacacaaataagtggttgaaagatgagataaagcaacaggccaagctgaaaactagggcagagagagttataaaatgaggctgggcactaagcttatgc

SEQ ID NO: 87038 - DNA, 601 bp, Human
gggagagttagatgcagaaactagaaaacaaaagcaacacgataggctcagagaaggaggctcccagagctgacgttcccttgaagatggaccacatctctgaataggcagtgcagtttatatatgcatcctccagcctataaacttagagttagaaaacagcaacaataaaaacccaccaacgtttagcagcattctgaggaggaggtccagctattcttttttttttttttggctgggggggggttgggggaggatgggtctaaatactattgttcagaaataaagaataaagcaacatgtttccaaaagaaaataggagggggatataatttttgaggcagaggaatagtataatttagaaaatagtaattatagaaatgagaagtaaatttcagattgaatctactttgtgctgttcttaataaacttcaagaaacacaaataagtggttgaaagatgagataaagcaacaggccaagctgaaaactagggcagagagagttataaaatgaggctgggcactaagcttatgcctgtattcccagcgctttgggaggctgagatggggggatcactggagcccaggagtttaagacca

SEQ ID NO: 87039 - DNA, 601 bp, Human
ctcaccctgcctttggacttaggagttatgtgagccagtacctttccttactgtttaaggccatcagcttttttctactacctgtacctgaaatttttctgtatgccttctgtaaatttttcttaaacaaaacttgttcatggatatattctaaccaactaaaagattgtttgaataactcaagaatgcggaacttgtggtgttaaaaaaaatactgacattgaattgaaatcatgtaaacataaatttaagtctaaattataaacttgattacagatgttacaaatgaaaagtcaaataytgtaaatactgaaagagaagatatgtaatggaaagagaaaaatcccagttattcagtaacaatgccaacaataataaatctgggtcagattcactagtagaaactgagaagtaggtgggggtggggcagggactgttaggagaaagtaaaagcccagcctttattttttactgttttatttttgtttttgataattagaaaaatacaggtagtggtatggttttaaaaaaaaattaaagataatcactagaaaattcaaagtaggatgttcacattccacgtcacacatctacatgtgtg

SEQ ID NO: 87040 - DNA, 601 bp, Human
gtgctggaattacaggcgtgagctgccatgcccggcccccaaactcttttgaggtaattctggacaaacctttgtgaaggtcttggaggtagaaacgcttgggtggtggctggagatgagtgaaagtagggaagaagcctgctcccgctggacacattctctctagggtgcaccttctcccagggtcacgaaggctgggatgaaaaagaaagtagagagcagtgtgagcttccccatcagagtatcagcagtcagtggaggaggagccagaatttgtggggcctgaaactctctaattctsagggccctctttcagaaaaagaatacaaatttaggtatcaaaatgaaaatttagaatgaaaaagaagtcactagttgtacattttgaaaagctaaaactacaaacaactcaaaacctagaaccatataacacagttctttctttggcacacaaccttacactttccccctgcatttttggttacctattctaatctcttcacgtagcaattttgtaacattttatgtaaaaagactagaaggccgggcgcggtggctcatgcctgtaatcccagcactttggaaggccggggcgggtgga

SEQ ID NO: 87041 - DNA, 601 bp, Human
acttatttctctgtccttttgttctttttagaggaggagtaaatcatttcctttagtagaaattgtttaaacctgtagggaggaattgtgcttcaaggttgtttcttttgattataaatgaatgaattaaatgtatactaagattcacaattaaaaaaatattgaagtgaatttaaaaagcaatgcaaaagctcacatctaactcttaaaatagtagtagttcattcttattctggttggagtaagttctgtggtcattttcctggatttcaataataacctctaaggagacttgatgaastatacagattgtctaggatatttaaaatgcattttcttctataaattagaatgttacaatgagtggggaccctggtatctttacctatagctgactctatactcattgcgtaacatctcagccaaactgatttgcaggccagattctagcattatagggtgatacttgcacacgtgttcctcagccttgggtttgccactcctgctatccttggaagttggctgacttttgagacttacaggaagagagtaaacatacatttacaagtagtagtcaagtttctgtgtattgcttggacat

SEQ ID NO: 87042 - DNA, 601 bp, Human
tcttagggagcttcgtgaggatgctgtggaaataactggctgagatgtggtgcatgatctagcaagcactaagcagtttttttttttttttttttgagatagagtctccctctgtctcccaggttggagtgcagtggtgcaatcttggctgactgcaccctcagccaggttcaagcgattctcttgcctcagcctcctgagtagctaggattacaggcatgtgccaccacacccagataatttttgtatttttagtagagacatcggtttcaccactttggccaggctgttcttgaactcstgacctcaaatgatgtgctcgccttggcatcccagagtgctgagattacaggcgtgagccactacgcctggcccactaagcagttcttactgcgtggatcagggcaggtgctgggaaaggtggtcatcgagccttaaaggataagtgacaggcattctgtgaggaggaaatatacatgcgcatggcaaaggagcatgatgctcttggggagtgagtggtgggtgtgagtaaggttttggtgggatatgaaattgggaacatcatttaggaccagatgcaaggcactgaagtgagggatca

SEQ ID NO: 87043 - DNA, 601 bp, Human
agataatttttgtatttttagtagagacatcggtttcaccactttggccaggctgttcttgaactcgtgacctcaaatgatgtgctcgccttggcatcccagagtgctgagattacaggcgtgagccactacgcctggcccactaagcagttcttactgcgtggatcagggcaggtgctgggaaaggtggtcatcgagccttaaaggataagtgacaggcattctgtgaggaggaaatatacatgcgcatggcaaaggagcatgatgctcttggggagtgagtggtgggtgtgagtaaggktttggtgggatatgaaattgggaacatcatttaggaccagatgcaaggcactgaagtgagggatcagaggctctcattttcttgctgagtagctggggaagaaccattgataactgaatgaccttctttaccaacttgggccacgtctcatattcttattattattttcaacaaattactcaagctctcttattaccaattagcaggaagtccagtgtctccttcagggtgacttttcttgaccaagaattgtcctgtagaactccaagggttgatcttgttcaaaggggttagccctgc

SEQ ID NO: 87044 - DNA, 601 bp, Human
atcggtttcaccactttggccaggctgttcttgaactcgtgacctcaaatgatgtgctcgccttggcatcccagagtgctgagattacaggcgtgagccactacgcctggcccactaagcagttcttactgcgtggatcagggcaggtgctgggaaaggtggtcatcgagccttaaaggataagtgacaggcattctgtgaggaggaaatatacatgcgcatggcaaaggagcatgatgctcttggggagtgagtggtgggtgtgagtaaggttttggtgggatatgaaattgggaacatyatttaggaccagatgcaaggcactgaagtgagggatcagaggctctcattttcttgctgagtagctggggaagaaccattgataactgaatgaccttctttaccaacttgggccacgtctcatattcttattattattttcaacaaattactcaagctctcttattaccaattagcaggaagtccagtgtctccttcagggtgacttttcttgaccaagaattgtcctgtagaactccaagggttgatcttgttcaaaggggttagccctgccacgcggtgggagagctggagggcccta

SEQ ID NO: 87045 - DNA, 601 bp, Human
atgtgctcgccttggcatcccagagtgctgagattacaggcgtgagccactacgcctggcccactaagcagttcttactgcgtggatcagggcaggtgctgggaaaggtggtcatcgagccttaaaggataagtgacaggcattctgtgaggaggaaatatacatgcgcatggcaaaggagcatgatgctcttggggagtgagtggtgggtgtgagtaaggttttggtgggatatgaaattgggaacatcatttaggaccagatgcaaggcactgaagtgagggatcagaggctctcattytcttgctgagtagctggggaagaaccattgataactgaatgaccttctttaccaacttgggccacgtctcatattcttattattattttcaacaaattactcaagctctcttattaccaattagcaggaagtccagtgtctccttcagggtgacttttcttgaccaagaattgtcctgtagaactccaagggttgatcttgttcaaaggggttagccctgccacgcggtgggagagctggagggccctagagctacagctctcccagtttgcactcgtgcacccagttcttactcactaa

SEQ ID NO: 87046 - DNA, 601 bp, Human
gctgcagccaccactgctacagtcctggctgttgctggcactggcaaaatgatttccaaattgtctgtttcttgtcacactctttttggtctgagccctgggcagaagttcgggcttctgcgattggccaggttcacaacaggaggctgcagggagaaccaggacctggctcttttgcttctgtgatggcaagtggtccatcattacaggccatgtggtccacctgtcacgatagccttagaaggagcaggggaatagcagttgggagaagaataaatggagaataggaagtgggagtgcygggtagagcatctccaaggccagcagtcagactcagagcttgcttaatctaagagtgtgtcccggggtgcttcttgtagttgcaactcttaaggcctccttgaatctggctgtggtactcccaagattggagaaccaattagcctgctggtttgtttcaataaccagaattgtgcatatgtctggaatgagtttaagggtggttatgcttatcaaggattggggattggcaatgggtctagtggaagggtaaaaggtaagacagccattcaaaaaaaggtgcatcttggtgctgaactgg

SEQ ID NO: 87047 - DNA, 601 bp, Human
agacaggttttcaccatgttggctaggctggtctcgaactccagacctcaagctatcactcaccttacctttccaaagtgttgggattacgggcatgagccacccagcccagcctgagatagataattccatttttttttttttttcttttgagacagggtctctttctgttgcccaggctggagtgcagtggtgtgatctcagctcatggcaaactccgcctcccgggttcaagtgtctctcttgcctcagcttcctctgtagctgggatgacaggcacctcccaccatgcccggctaatttttttttttttttttttcagtagagacggggtttcactatgttggccaggctggtcttgagctcctgacctcaggtgatccacccaccttggcctcccaaagtgctgggattacaggcgtgaaccactgcgcccagccctgagatatgttctatgagccctactcgaccgctgggaaaactgaggcttaagcagattagataacttgcacaggcttgtaagggtgcagttgggcggtggaccactgttgcttgttcctggagtctgccgcagcaagcacgctttcttcattctgtgtgt

SEQ ID NO: 87048 - DNA, 601 bp, Human
ctggatctctcagtgtggcctgacccctgaatcctaccctcccacacaacttgagaacttgattcttttctcacaaagacttctttccaacccctcccctccccctagaagactccatatttggagctgagtattttgaacagggccctggccagagggcatgttacatatgttgttctgtcccatgtacatggaaaagcataagctttaaagcaaatgtatataaaaaatggaaaaggtccctctaagccagggacacatgattttctgttatgaatgtgctgtacttatatgatcattstctttaacttgcctctttgaaactggaaaaaaggtgagcagaaatggctggaggtaatgaaagggaatagagaatcaaggaaataatttctttgaccattcttttgtgagccttgggttagcagagttaaatacttaaataagaacataaaataagggaaagcttcacatttccacattcattattaaatactttttaaataggagaatgagtcagagtgaaccctagcaattatctcgttgttgttgaaatctagcccacctaccacattttcataattaaacacaggcctgaggcaaa

SEQ ID NO: 87049 - DNA, 601 bp, Human
ctctaagccagggacacatgattttctgttatgaatgtgctgtacttatatgatcattctctttaacttgcctctttgaaactggaaaaaaggtgagcagaaatggctggaggtaatgaaagggaatagagaatcaaggaaataatttctttgaccattcttttgtgagccttgggttagcagagttaaatacttaaataagaacataaaataagggaaagcttcacatttccacattcattattaaatactttttaaataggagaatgagtcagagtgaaccctagcaattatctcgttkttgttgaaatctagcccacctaccacattttcataattaaacacaggcctgaggcaaacatcaggttctcattctccagaaagtgagcacttgtataccctggttcagccgaggtccagtaaggttacttgttcacattcactgtggaattctctgcttgggaaaccatcatgttcaggaacattctcaataaagtttatgagatatcgtattggcctggaacatgcacagagaatttgacaacccgtttgggtggaggaatacaaacttcgtaattattgaaaacatagttgttgtaaa

SEQ ID NO: 87050 - DNA, 601 bp, Human
acttagtaatatttgaagagaaaataaaagtagtaatttttaaagcattccttatacacaaaattaagggaaaatgccattaaaatcatttagaaatctgtagagttctctaatagtcaaggcttttaaaatttatttcttatgttttgaattttcaaaatacttttcaacattttagtatgaaaaatttcaagtacacaaaaacgttgaaaggctatacagtggcttaggtgtaaaccccccacctaggctccacgattaacctttcactgtgtgtgctttatcacatggccgtttatcygtctctcatcgatccatccatccatcttactttttagacatttcagagctggaggtgtcagtgtactttaacttttggacctgtttttctcttatttgtgtggtccaagatgggccctataaaaactttgaatcaaaatatgtcttctgagaagctctagttcctcttacaaggtcaggggagtctgtgacactgctttccctgcactccatgagccttcctaaaaggatgctgagaataactcctgtgctctgatgcgttatgtggctgagaagcactgaaacttcatggagccaagtt

SEQ ID NO: 87051 - DNA, 601 bp, Human
ttccttttcatgtgtcaaggataattctgttacttcctagtaatgctttccccaaatatcctgagtgatattgctacagatgttactagccacttaatacctgaaagttttttttttccttttttttttttttttcttaagagtgtctcactctgttactcaggttggagtgcagtagcacagtcatagctcgctgcatcctcaaactcaagggctcaagcgatccccccacttcagcctcttgagtacccgggactgtgggcatgcgtgacatgtctggctaatttcttttctgttttttgtagagacagagtttctttgtgttgcccaggctagtctcaaactcctggcctcaagcaatcttctggctttggcttcccaaagtactgggattacaggcttgagccattacacctggccaaatacgtgaaacttaaatttttttttaacatgaaaaattcaaactcttagactgtaaaatggataatggatcaaatagatttaataattgttataattttgctcaattcttttttttccctctttgaggcagagttccactcttgttgcccaggctggagggcaatggcatgatcttggc

SEQ ID NO: 87052 - DNA, 601 bp, Human
aaccaaccctgctcatctttagggtaggaggagagaaactgtagatagactttcttaaaaaggaaacagaaatgtatgccgatgcttgaattaaagctctccccttgcaggctcttatttttctatatctgcacaggagagctcagcagaagaaaattcttttcgtaaatgttgttgacagacttgatttgaatcttcaggtacatttactttttagtaacaggatagtgtcagtcagctggttactattagatatactttttgccatattgaaataagatgcggctgggcgcggtggctsacgcctgtaatcccagcactttgagaggctgaggtgggtggatcacctgaggtcaggagtttgagaccagcctggccaacacggtgaaaccccgtctctactaaaaacatagaaaattagctgggcatggtggtgcgtgcctataatcccagctacttgtgaggctggggcaggagaatcacttgaatgtgggaggtgaaggttgcagtgagctgagattgtgccattgcactccagcctgggcaacaaaaatgaaattccgtctcaaaaaaaaaaaaaaaaaaaggaaaaaagaaaaaa

SEQ ID NO: 87053 - DNA, 601 bp, Human
tggcctcccaaagtgcttggatacaggcatgagccaccttgcctggcctagtttcttaactttgatataattaaatgtattaatattttcctttgtgatttatattttgtctatcttgtttaagaagtccttccctggctgagtgcagtgaacccaggagacggaggatgcagtgagacaagattgtgccactgcactccagccagggtgacagagtcagattctgtctcaaaaaaaaaaaaaaaaaaaaaagtccttccctaccctgaaattataaaaaaaattctcctgtatttacttstaaaaattgtgtagcgtttccccttcacatttatacttttaatccacttgtaattgattgaaaatatgtgtgattgataacatacaatctgcttttattttttccatataaataactgttttcacacatatttattgaagagtccagtctgtttttgagctgagtgtcagctctgctgtgaatcatattttcgtcggcctgtggtcttttcctgggcgctgtctatgttgatttatttatttatttattttaatttttgtagagaaaggatctcaccatcttgctcaggctggtcttgaa

SEQ ID NO: 87054 - DNA, 601 bp, Human
cacccagctgatttttgtatttttaatagagatggggtttcaccgtgttggccaggctggtctcaaactcctgacctcaagtgatccacccacctcagcctcctaaagtgctgggattacaggcatgagccaccgtgcctggcctgaaaaaatatttttgttggatgggattctattttatgaatgtaccgcaatttattcgtgttcttactgatgaatatttaggctgttttctggttataaagagcgctcctatgagtgtctcagatacagtctcaatgggagcatttctttaggataratacctgcgtatggaattgctgggtggcagcatgtacccacctcaaccttgctggatgttgccaatgtgttctccaaagtagttaattatttttttcttctttcagtgcctgaagacctctcattagaagagagagaagaacttctagacattcgtcgaagaaaaaaggaacttattgatgacattgaggtaaaaaaaaaaaaaaaaaaccaaaaatccaaaactctgttttttgcttttgagtaaaatagtaaaagagtagcctcacaaaaatgtaaaaaaaaaaaaaaacccaaaaac

SEQ ID NO: 87055 - DNA, 601 bp, Human; identical to SEQ ID NO: 29486

SEQ ID NO: 87056 - DNA, 601 bp, Human; identical to SEQ ID NO: 29487

SEQ ID NO: 87057 - DNA, 601 bp, Human; identical to SEQ ID NO: 29488

SEQ ID NO: 87058 - DNA, 601 bp, Human; identical to SEQ ID NO: 29489

SEQ ID NO: 87059 - DNA, 601 bp, Human; identical to SEQ ID NO: 29490

SEQ ID NO: 87060 - DNA, 601 bp, Human; identical to SEQ ID NO: 29491

SEQ ID NO: 87061 - DNA, 601 bp, Human; identical to SEQ ID NO: 29492

SEQ ID NO: 87062 - DNA, 601 bp, Human; identical to SEQ ID NO: 29493

SEQ ID NO: 87063 - DNA, 601 bp, Human; identical to SEQ ID NO: 29494

SEQ ID NO: 87064 - DNA, 601 bp, Human; identical to SEQ ID NO: 29495

SEQ ID NO: 87065 - DNA, 601 bp, Human; identical to SEQ ID NO: 29496

SEQ ID NO: 87066 - DNA, 601 bp, Human; identical to SEQ ID NO: 29497

SEQ ID NO: 87067 - DNA, 601 bp, Human; identical to SEQ ID NO: 29498

SEQ ID NO: 87068 - DNA, 601 bp, Human; identical to SEQ ID NO: 29499

SEQ ID NO: 87069 - DNA, 601 bp, Human; identical to SEQ ID NO: 29500

SEQ ID NO: 87070 - DNA, 601 bp, Human; identical to SEQ ID NO: 29501

SEQ ID NO: 87071 - DNA, 601 bp, Human; identical to SEQ ID NO: 29502

SEQ ID NO: 87072 - DNA, 601 bp, Human; identical to SEQ ID NO: 29503

SEQ ID NO: 87073 - DNA, 601 bp, Human
gaactattaaaacaaatgttatctcttaaaatcagggagaaaagccatacatttaaaataattaaaggcattttgatctattaggtaattctttgttcactaggattctgtagagaagataactttgctatttctggcagtgtggagtataattatggatagaaataaaacttttgctttgtaaaatgtggtaggatttatagccaggaatttcaaaaccctatatttaacttccctgacttgagatgttcactaattagatgattagcttgttttacatctgaaattatcatcttcttgrttacatttattatttttggtagcatgcttggttctctcttaaaggggtgtaacatttaacagtatacattttctggcagatgaactcccagctagcccagatgactcggataatagcgtgtcagagagcctggatgaattcgattactctgtggctgagattagccgctcattccgatcacagcaggaaatatgtgagcaactcaacatcaatcacatgatccaaaggatcttccttattactctggacaacagtgagttacaaacttatagcattattctacccttcctatttgagctt

SEQ ID NO: 87074 - DNA, 601 bp, Human
attacttgagtcagatttgcagttcaagagtgatgctgtcaagatcagttgtctgtataaaacagaagcattatccttaacctatcatattaaaaccatttcccaggtgatcccagcttgaaaagcgggaatggcatccctagccgttgtgtgtatttggaagaaatggcagtagagctagaagatcaagactggcttgatatgagcaatgttgagcaggtaatattcttacgttcctaatgtgtgcccttagcaaaaattagctatgcggctgaattctgctcactgttctccaacttaygcttgtgtccatatgtccatccctctctctttttttttttttttttttaccagtagaaggccaagtaacctggatgtgcatctctaacattgtggtgttcctcttttggaatcttttcatctaccatggccacatgcccaaatctacccatcctctaagaaccagttaaaatgccttcttaattacaaagccttggccaggcacattgactcacgcctgtaatcccagcactttgggaggctgaggcaggtggatcacgaggtcaggagatcaagaccatctggctaacatggtgaaacg

SEQ ID NO: 87075 - DNA, 601 bp, Human
tctaacattgtggtgttcctcttttggaatcttttcatctaccatggccacatgcccaaatctacccatcctctaagaaccagttaaaatgccttcttaattacaaagccttggccaggcacattgactcacgcctgtaatcccagcactttgggaggctgaggcaggtggatcacgaggtcaggagatcaagaccatctggctaacatggtgaaacgccgtctctactaaaaatacaaaaaattagctgggcatggtggtgggcgcctgtagtcccaactacttgggaggctgaggcagsagaatggtttaaacccaggaggcggaggttgcaatgagccgagatcataccactgcactccagcctggacaacagagcaagactccgtctcaaaaaaaaaaaagaaaaaattacaaagccttgccaaataaaagttgttactccctcctctgggtacctagaataatcagcctctgaatctcttgtgggaattgtcactttctgtctcatgttgcggctttcttatgtacctgtcttatctcccctattagacttaagttcttaagggcaaggcccatcgctttttcttctttatatcct

SEQ ID NO: 87076 - DNA, 601 bp, Human
caaagccttggccaggcacattgactcacgcctgtaatcccagcactttgggaggctgaggcaggtggatcacgaggtcaggagatcaagaccatctggctaacatggtgaaacgccgtctctactaaaaatacaaaaaattagctgggcatggtggtgggcgcctgtagtcccaactacttgggaggctgaggcaggagaatggtttaaacccaggaggcggaggttgcaatgagccgagatcataccactgcactccagcctggacaacagagcaagactccgtctcaaaaaaaaaaaagaaaaaattacaaagccttgccaaataaaagttgttactccctcctctgggtacctagaataatcagcctctgaatctcttgtgggaattgtcactttctgtctcatgttgcggctttcttatgtacctgtcttatctcccctattagacttaagttcttaagggcaaggcccatcgctttttcttctttatatcctttctatcttagtctgttttgtgttgctataaaagaatacctgtgactaggcacagtggctcacatctgtaatcccagcactttgggaggccaagttgggagga

SEQ ID NO: 87077 - DNA, 601 bp, Human
gtcctagctactcaggaggctgaggtgggaggattgcttgagcctgggaggcagaggctgcagtgagccatagtcacacgactgcactccagcctgggcgacagagcaagaaagacccatctaaaaaaaaaaaaaagaacacccaagcagtaatttataaagaaaagtttatttagctcacagttctgcaggctgagaagattcagggtatgtccttggcctctggtgagggcttttgtgctgcctcacaatgtggtggaggaagtcaccaaaggacacataccatgaggacgcatgcaargaggagaaaacctgagaggtgtcctggcttaataagaacccgctctggagggaatttgtccattcctatgagaattaatccagtcttgtgagagcaagaactcattcagcaccttgagaaaagcaccaagcaattcaggagggatccgcctccatacccagacacctcccactagccccacctccaacagtgccacatggagatcaaatttcaacatgaattttgttggagacaaacatataaaccacagcactttaaaaatcaaaacagtgcgttgtaccttgcaggtgcctgagtaac

SEQ ID NO: 87078 - DNA, 601 bp, Human
cacctccaacagtgccacatggagatcaaatttcaacatgaattttgttggagacaaacatataaaccacagcactttaaaaatcaaaacagtgcgttgtaccttgcaggtgcctgagtaacattaaaagaataaaagtttggtaggaaagacagttgacagcttgcagtttaacttcacatttggagtatctttatataagtctgaatgagatcagcaatcacacagaatagtagatttcacatctaagtttaatcactgatctcagcaccattcaacaaatagtcttttaatgcctacyctatgctggggctatactagacacttgaggcttgatttaggataactttatatatgccataattttctaaaattttctaaagtaaaaatatacagggccctttttttctccttcactctacattcaaatctgtgattcttgctaataacctgtgtcagaattaccttttacatcttaatgttctcagattaattttgcaatagtttagtatttttgtttggttttctttataggccctcttcgctcgcttattacttcaagatccaggcaaccacttaattaacatgacttcttctacaa

SEQ ID NO: 87079 - DNA, 601 bp, Human
ctcagattaattttgcaatagtttagtatttttgtttggttttctttataggccctcttcgctcgcttattacttcaagatccaggcaaccacttaattaacatgacttcttctacaacgctaaatctctctgctgatcgagatgcaggagagaggcacattttttgttacctttactcctgcttccagagagccaaggaagaggtaaaggaataatccccattgaatactgtattgtcctcttgggtatgacttcagcatgtgggccagagttggatcagtctttatttcaatttatatrtgtcatagtatgtctagaagtgaatatcagggacactaaagcttttatatcaatttatatatgtcatagtatgtttagaacactggatatcagatgcactaaagctttagtctcctttccgtatcttggggtccacccttctccccagttaaccaatgcctcctattctctctaaaacctctttagaaatcacatccttaaaaaaatctcatgaggctgggcacagtggctcactcctgtaatcccagcactttgggaggccgatgcaggcggatcacatgaggccaggagttcgagacc

SEQ ID NO: 87080 - DNA, 601 bp, Human
ttttgattttcagatttaaaatttcactaattgcattagaaagtctcagagccattatggttctggtataaattaaggaggagggctcacatcttgatctttgaggttgagtaccaatagaataaagctgggcatggtagcacacccctgtagtcccatctactctggaggctgaggcagaaggatcccttgagcccaggagtttgaggctgtagtgtgctataatcacacctgtgaatagccactacactccaggctgagcaaaaaaacaagacccccagctctaaaaaaaaaaaaaaaagaattattgaaagtaaagagctagtgtgtaaaggcatataaaaattcttgtgccctcctttctctctcatttgtcttctgttagattttgaagatgtaactgagtttctggaagaggtcattgaagccttgatattggatgaggaagttagaacatttccagaagtcatgattccagtgtttgatattttattgggccgaataaaagatctagagctctgtcagatccttttgtatgcatatctggatattcttctctatttcactaggcaaaaagatatggcaaaggtaggtctgaaag

SEQ ID NO: 87081 - DNA, 601 bp, Human
ggatttaaaatgtagctggtctgaattgagatgtgctataagtacaagacttagtgttaaaatgtgaaatctgtccatttttatactgattacatactgaaattatcatttttaatgtctcagctaaatgtgatatgacaatcagtaatcaccagacatttgaggaaatcctctaatgtgaaaaacaaataggtgaaaactttgtaaaaactttttaaaaaaactttttaatctcagagggataagagaagatacagcagccacaaaacaagaacaaagaggcaatgaaagagattatttraagaataagaaagagcccttggatattgaaatttttacctcggaaatgttaaatattcagtaaaggagttagaagatataaattcaaggaactcttctatgaacgtagaacagaaggaaaaagatggaaattagaagagaaaggataagaaaacaaaaggatggatctaggaagtctcaaaagcgaaaaatggaggggaggaagttatcaaagataccaaaaaatccccaagactcaaagacagcctctaaattgaaagggcttgccaaggcccctgcacagagaattttttaaaaccca

SEQ ID NO: 87082 - DNA, 601 bp, Human; identical to SEQ ID NO: 36665

SEQ ID NO: 87083 - DNA, 601 bp, Human; identical to SEQ ID NO: 36666

SEQ ID NO: 87084 - DNA, 601 bp, Human; identical to SEQ ID NO: 36667

SEQ ID NO: 87085 - DNA, 601 bp, Human; identical to SEQ ID NO: 36668

SEQ ID NO: 87086 - DNA, 601 bp, Human; identical to SEQ ID NO: 36669

SEQ ID NO: 87087 - DNA, 601 bp, Human; identical to SEQ ID NO: 36670

SEQ ID NO: 87088 - DNA, 601 bp, Human; identical to SEQ ID NO: 36671

SEQ ID NO: 87089 - DNA, 601 bp, Human; identical to SEQ ID NO: 36672

SEQ ID NO: 87090 - DNA, 601 bp, Human
gtgcctcagttttctcacctgtaaaatgggaatagaatccttcctaccatgaattcagtgagttaacgtgcacctggcccggtataatgctgttgctgttttgctttggtgtctgctaccgagtgaagtgctagggttgagtgcgatagaatggcagataaggccccgcccctgcgggcagagcttcccatgtagaggggaggacagggaaagaagctttgcagctatgcagaggtgggcccacgggtgctccttcaccctcggggtgtcctgcgagaggcccttagaggccagatcatgstgtggagtctggttgtgatccacaaggcagcggaagcttctggaaggctttaggcaggagttacaggaaatgcaagctaaagccagatctttcctaggtgaaaggtgtcgagttgttttttttttaaattgaggtgaaacttatataatataaaatattaaagtatagaaggcaggcatttggtacattcacagtgtttacaaccctctcttctatcaagttataagagatttccatcaccccaaaataaaacccatacccattacacggtgacttcccgttccctctccccggatcccc

SEQ ID NO: 87091 - DNA, 601 bp, Human
cgggatttcaccatgttggccaggctggtcttgaactcctgacctcaagtgagctgccggcctcggcctcccaaagtgctgggattacaggtgtgagccatcacgcccggcctatttcagccctttttgtggctgaataatattccattgtgtggagggaccacattatatttgtcagttcatccgctgattggattgatcttggttggttgcatctcccagccggcacgagcaggtctcatgcctcctgcatcctggtggaggtggctggtgggaggatctggcctgagactctcctgcygaggttcaggaacgagccaggtgatggggacaagttggggagtcagtgctggcatctcagaggaggggcctgggccctgagaggagtgctgggagggcagagtgagggccaagttcaggttacagaagccgtgagacagccggacatctgtggtttgtgaggctttggaaacacttaatgcgctctccaaatggggagtctgttggggaggccctggcgggagccggggctacatccaggtcctcggcttggtggccttgttcacttatttgttcaggaagcagcagggtgtgggctctg

SEQ ID NO: 87092 - DNA, 601 bp, Human
cctgcatcctggtggaggtggctggtgggaggatctggcctgagactctcctgccgaggttcaggaacgagccaggtgatggggacaagttggggagtcagtgctggcatctcagaggaggggcctgggccctgagaggagtgctgggagggcagagtgagggccaagttcaggttacagaagccgtgagacagccggacatctgtggtttgtgaggctttggaaacacttaatgcgctctccaaatggggagtctgttggggaggccctggcgggagccggggctacatccaggtcctcrgcttggtggccttgttcacttatttgttcaggaagcagcagggtgtgggctctgtgccaggccgccctggagggctgtcctggggccagtgaggtccaagtgtgatgggcggaggcagctgtggcttgctacgagccggcctcagggacccaccggctggctccggctgctctctgcattctcttcagctctggagagccgtgtgccagccctcagcctcagtttcctcatctgcaaaatcgggacgatggtgtccaccttgcccatgctggtggggtcccaagagctggtgtctggggt

SEQ ID NO: 87093 - DNA, 601 bp, Human
gctctggagagccgtgtgccagccctcagcctcagtttcctcatctgcaaaatcgggacgatggtgtccaccttgcccatgctggtggggtcccaagagctggtgtctggggtgagggagctgggggccaaaagctcctgccctggggcatccagctgtcctttgaagagtaccccgagggtgtgactgagagccagtccccagcacccttgtccagatggggaccaggaggtgggtgaagatatttggggtctgagctctgtgctggttgcccccgagggggcctggagccctgagttasgagcagaacggggtgctggtcctatccgttccctacctgggtagtgggggctgccttcctgggttgggggtggggggagctccctgtgtccctaagccatgcagaggcatgcgcatacgcgctgctcttaggcatgtgggtggcgctctgaggtccctgcccattccccagccccatgtggtggtccctgtgctccaggtccagcctctggtttccagtttgtcctagtttgtcaccttgtagggggcagttgacactttgctggcctgactcgtggtgtgccagagcccgtggctgctg

SEQ ID NO: 87094 - DNA, 601 bp, Human
tgtggtggtccctgtgctccaggtccagcctctggtttccagtttgtcctagtttgtcaccttgtagggggcagttgacactttgctggcctgactcgtggtgtgccagagcccgtggctgctgggcgactgtgcctctttctctcagtggcaagagccttattttctaatagagcctgatgggccagaggttccgccacagggacactgttctctgtctctcgtgcttggggtctcttgctgtggaccccctgggaggttgtcctgggggtgcggggattgtgttttctgggtattttcktatttgctctattggagtgtatttaatttaatatatatattttaaacatcttttagtttgccttaatgtaattttttttgagatttaatttttttttttttgagatggagtcttgctctgtcgcccaggctggagtgcagcggtgtgatctcagctcactgcaagctccacctcccagggtcacgcctttctcctgcctcagcctcctgagtagctggaactacaggcacccgccaccacgcccggctaattttttgcatttttagtagagacggggtttcaccgtgttagccaggatgg

SEQ ID NO: 87095 - DNA, 601 bp, Human
ccatgcccagctaatttttgtatttttagtagagacagggttttgccacgttggccaggctggtctcgaactcctgacctcaagtgatctgcctgcctcggcctcccaaagtgctgggattacaggcgtgagccaccatgcccagcctgcctggctgattttttaaaatttgtcgttgagatgggtgtcttgctttgctgcccaggctggccttgaactcctgggatcaagcgatcctcccacctcagcctcccaaagtgttgggattacaggcatgagccgctgtgcccagcctatttttttattattattatttaattttattttttctcactattgcccagctcctggcctccaactcctgggctcaaaggatcttcctgcctcagcctcctgagtagctgggactgcaggcatgtgccatcacaccctactttgtacttttgcttttctgtctttgctcttgttaaaagccaagtgccatttcatagtacacaggtgcacttgacagcatttacctgattgaggagtttttccagccttcattgctattacaaagcatgcttgctcgtgtgtctctgcatgtgtataagtgttttta

SEQ ID NO: 87096 - DNA, 601 bp, Human
tgctcgtgtgtctctgcatgtgtataagtgtttttataggatacattcctagtcaaagagtgtgtccatttctgtttttaaagatattgaggccgggcacagtggctcatccaggtaatcccagcactttgggaggttgaggcaggaggatcacttgagtccaggagttcgagaccagcctgggcaaaattgggagaccccccatgtctacaaaaaatttaaaaaattagctgagtatgattgcacactcctgtagtctcagctacttgaaaggctgaggtgggaaaatctattgagctcrggaggtcaaggctgcagtaagccatgatcacagcactgcaacagatctagcctgggcaacagagcgagaccctgtctcaaatacatacatacaagcatacatacatacataactcctaaaaggctgtagcagttcatacctgcaagcatctacgagaacacacactttcctatatcctctctgatgctggcaattacaagattttggtttttggtgttttctttggtccagtttggttaaaaattataacaccttttgatttgcacaaccctcatttctggtttattggtatttactttt

SEQ ID NO: 87097 - DNA, 601 bp, Human
ggtttttggtgttttctttggtccagtttggttaaaaattataacaccttttgatttgcacaaccctcatttctggtttattggtatttacttttctgcaaattgcctacacttatccttggcccatttttctgttgtctttttcttttcttttttcttcttcttcttttttttttttttttgagacagagtctcgctgtgtcctccaggctggagtgcagtggcgcgattgccatcttggttcactgcaacctctgcctcccgggttccagctgttctcctggctcagcctcccaagtarctgggactacaggcatgcgccaccacgcctggctaatttttgtatttttggtagagacagggtttcaccatgttggccaggctggtctcgaactcctgacctcaagtgacctacccatctccgcctcccaaagtgctgggattacagacataagccacggtgccagcctgtttatctttttcttatagatttgtgggaggtctttatttggtatggactttaattctttgttctgtttgtttcaggtttcactgctggtctgtagctagtccttcatccttgtttctggtggtacattat

SEQ ID NO: 87098 - DNA, 601 bp, Human
ttggttaaaaattataacaccttttgatttgcacaaccctcatttctggtttattggtatttacttttctgcaaattgcctacacttatccttggcccatttttctgttgtctttttcttttcttttttcttcttcttcttttttttttttttttgagacagagtctcgctgtgtcctccaggctggagtgcagtggcgcgattgccatcttggttcactgcaacctctgcctcccgggttccagctgttctcctggctcagcctcccaagtagctgggactacaggcatgcgccaccacrcctggctaatttttgtatttttggtagagacagggtttcaccatgttggccaggctggtctcgaactcctgacctcaagtgacctacccatctccgcctcccaaagtgctgggattacagacataagccacggtgccagcctgtttatctttttcttatagatttgtgggaggtctttatttggtatggactttaattctttgttctgtttgtttcaggtttcactgctggtctgtagctagtccttcatccttgtttctggtggtacattatcataaagatattaagaagcttcatata

SEQ ID NO: 87099 - DNA, 601 bp, Human
ccatttttctgttgtctttttcttttcttttttcttcttcttcttttttttttttttttgagacagagtctcgctgtgtcctccaggctggagtgcagtggcgcgattgccatcttggttcactgcaacctctgcctcccgggttccagctgttctcctggctcagcctcccaagtagctgggactacaggcatgcgccaccacgcctggctaatttttgtatttttggtagagacagggtttcaccatgttggccaggctggtctcgaactcctgacctcaagtgacctacccatctccrcctcccaaagtgctgggattacagacataagccacggtgccagcctgtttatctttttcttatagatttgtgggaggtctttatttggtatggactttaattctttgttctgtttgtttcaggtttcactgctggtctgtagctagtccttcatccttgtttctggtggtacattatcataaagatattaagaagcttcatataatcataactctactttttccctatggcttttttcctatcccttgttactccatctccagattataaatatatcctccattattttcttccaggact

SEQ ID NO: 87100 - DNA, 601 bp, Human
ttttttttttttttttttgtatatggtatgaggtaggggtctggccagtgaatagggagttgtccaacaccttggtgggatggtccatcctatccattcattgtaaatgctgctcttttatgtgtagtgtccacagacacctgggtcctgattccagacccttcactgtgctccactgcctgtgagtgtctttgtgtaccggaatgctgctgtctccatctctgaagcatcagaacatattttaagatcagttatgtaaattcccacctcattgtccttttcaaaagacgtattggctctkcttgcacgtttatgcttttgtggtgaacttcagagccgtcctatcaggttccaccctttgatctcttgatctggggacggtaaatggtgatatccagcaggtgtcagagggctggattttaaatggcctccgatgagctggcggtctcaggctgtggaagtgaattcatctgctgggtgcagtggagccggccttgacatttgtgggttttgctgacatttgtggaaggctctggaggtgccctttgtgccgacttgcccgagccactcctgctgcccaactcactccggtgtctgctca

SEQ ID NO: 87101 - DNA, 601 bp, Human
gtccttttcaaaagacgtattggctctgcttgcacgtttatgcttttgtggtgaacttcagagccgtcctatcaggttccaccctttgatctcttgatctggggacggtaaatggtgatatccagcaggtgtcagagggctggattttaaatggcctccgatgagctggcggtctcaggctgtggaagtgaattcatctgctgggtgcagtggagccggccttgacatttgtgggttttgctgacatttgtggaaggctctggaggtgccctttgtgccgacttgcccgagccactcctgytgcccaactcactccggtgtctgctcaggaaagaaattctaatgcacactaattttagcattagcccgatggcaaatataattactgagttaattatcactcccctccctagttaatcccagagcaaaatgtgggcacctttcatttcttccttgggatgtacccctgtattagttcagatggggaggcggtacctgcctggcaaagctctcaggaaattgctcaacggggcattaatagctatctgagcgtgtggcctgggctggaacacaccagcctgggtgctgggtgccttccagg

SEQ ID NO: 87102 - DNA, 601 bp, Human
gaataataaatgtttatattaaaaagtcttggtggttttgattgatttatttattttttgagatggagtctcgttctgtctcccaggcttgagtgcagtagcacagtcttggctcactgcaacctctgcctcctgggttcaagcagttctcctgcctcagcttcctgagtagctgggattacaggcacccgccaccacgcctgggtaatttttgtatttttagtggagatggagtttcaccatgttggctgggctggtctcgaacttctgactcaggtgatccacttgcctcagcctcccwgagtgctgggattacaggtgtgagccaccaagcctggcttggtgctttttaaatttattttgagatagagtctgactctgttacccaggctggagtgcagtggtgccatcacagcctactgcagcctctacctcccctgggttcatgtggttctcccgcctcagcctcctgagtagctgggactacaggcacacaccaccaggcccaggtaattttttaaaacactttttttgtagaaatggggtccctccatgttgcccaggttcatttggaactcctgggcttaagtgatcctcttgc

SEQ ID NO: 87103 - DNA, 601 bp, Human
taaaaagtcttggtggttttgattgatttatttattttttgagatggagtctcgttctgtctcccaggcttgagtgcagtagcacagtcttggctcactgcaacctctgcctcctgggttcaagcagttctcctgcctcagcttcctgagtagctgggattacaggcacccgccaccacgcctgggtaatttttgtatttttagtggagatggagtttcaccatgttggctgggctggtctcgaacttctgactcaggtgatccacttgcctcagcctccctgagtgctgggattacaggygtgagccaccaagcctggcttggtgctttttaaatttattttgagatagagtctgactctgttacccaggctggagtgcagtggtgccatcacagcctactgcagcctctacctcccctgggttcatgtggttctcccgcctcagcctcctgagtagctgggactacaggcacacaccaccaggcccaggtaattttttaaaacactttttttgtagaaatggggtccctccatgttgcccaggttcatttggaactcctgggcttaagtgatcctcttgcctcagcttcccaaagtact

SEQ ID NO: 87104 - DNA, 601 bp, Human
tacctcccctgggttcatgtggttctcccgcctcagcctcctgagtagctgggactacaggcacacaccaccaggcccaggtaattttttaaaacactttttttgtagaaatggggtccctccatgttgcccaggttcatttggaactcctgggcttaagtgatcctcttgcctcagcttcccaaagtactgggattataggcgtgagccaccgcgcctggctactttggtacttttgagttaaaactatagagtaggtgactgagtgatatttttaatgcgttctcaagaatttgaacaygaagagagtgtcaccctcccaggttatgcccccgggagttcatgcacttgccacctggtcgctgctcagggggcccagggagtttgctgcagtgccggaggactcctgggtcccggctgtgcctccccgcagccgcctgctcccttgggacactcattcatttgctgtggccactgccacccacagtccttgcctcgtagactccactgcagctctggttacaaagagcgagtggtcagggactcctgacctgccatgcagggccccgtgggcttgtggtggctttggtgccgtccgctg

SEQ ID NO: 87105 - DNA, 601 bp, Human
tcccaaagtactgggattataggcgtgagccaccgcgcctggctactttggtacttttgagttaaaactatagagtaggtgactgagtgatatttttaatgcgttctcaagaatttgaacacgaagagagtgtcaccctcccaggttatgcccccgggagttcatgcacttgccacctggtcgctgctcagggggcccagggagtttgctgcagtgccggaggactcctgggtcccggctgtgcctccccgcagccgcctgctcccttgggacactcattcatttgctgtggccactgccrcccacagtccttgcctcgtagactccactgcagctctggttacaaagagcgagtggtcagggactcctgacctgccatgcagggccccgtgggcttgtggtggctttggtgccgtccgctgcgtctgcctcttagagcatggagttctccttctcaggagggctgagctgctggagctctagtcctgccgcagagcagcccccaagtgcggcgttgcctgtccctgtggagcaggtgactacctggctgcgggcggaacagcaggccatggctctggtagtggtctgtgacagcatatca

SEQ ID NO: 87106 - DNA, 601 bp, Human
aagagagtgtcaccctcccaggttatgcccccgggagttcatgcacttgccacctggtcgctgctcagggggcccagggagtttgctgcagtgccggaggactcctgggtcccggctgtgcctccccgcagccgcctgctcccttgggacactcattcatttgctgtggccactgccacccacagtccttgcctcgtagactccactgcagctctggttacaaagagcgagtggtcagggactcctgacctgccatgcagggccccgtgggcttgtggtggctttggtgccgtccgctgcrtctgcctcttagagcatggagttctccttctcaggagggctgagctgctggagctctagtcctgccgcagagcagcccccaagtgcggcgttgcctgtccctgtggagcaggtgactacctggctgcgggcggaacagcaggccatggctctggtagtggtctgtgacagcatatcaccctgtgggacagatccccgggacctagtggggtgggatagtgagagctgcgtccacaggggaggctcagagacttgtgtgcccagtgtggccctgtgtgctgacccagctgggctctgccct

SEQ ID NO: 87107 - DNA, 601 bp, Human
agagaagcccatgcaggcccccctcacccgttcctgcctgacctgctgttgtgtcctgctcctagctctgcggtctgggacaagcacgttaactgcttcagagctcagtttccccatccgtgatagggaatgatctttatgctcccacaggctcgtcctgaggctgcagagaggcagcgttgaaaagtacctagctcagggcctggctcagtgacggttagctgttagggttaccatcgcatcgcaattgttactccatagtgacgaccccccggggactctggacttgttcagctcagcygagaggctgcttggccgaaaccatctcagctctgcatagtgtggcctggtggcctgtgggttgcgctcatgacaacgtggagcctattcagtcggtaccgagtgtgcgtccttgcctagctggcctcggcatttattttgtagctggagccctggtgggatggggtcaggtgggctctaggagtctgggggacaggtgcaggtaccttcgggtgcgcctcccctgggggcctctgctttgtcagaagtatggcagggggctgagggctgactatctatttgtaggtgtcaccagagcagt

SEQ ID NO: 87108 - DNA, 601 bp, Human
taaacttgattccaaggaaatcaaagctgatcgtcaacactggactttgcaggcagctcccaaacccacatgcatatttacaactaagaaatgccagttcctcaaagaatgttagcctctgagatgcatcaggagaccaggaggcaaggggttaaaggcaaaccgtggcattccccaaatctgtccagttccctggcatggtacagtgtcgcggagcccgaggtggcatcttttgtttggctgctgatggcggccttcgggccttggcatccacgttgctgcaattttccaggaacagtagtcatttgaaagtagagctgccacgttttgctcaataaagggattttgtagagcgatgataaatttggcatgtctttattattattattttttcaacacttaaagaaaataaaagctggtacaaaggtatgtttgtttctgaaatgtgtttccttccccagatgttcttttctgccagttctaaaatgcgttctgagctcggtcctccagtttcctccctgtgaggaagaacaatgagacctttgtaaccacacaggggaaacggccgcttccctctgcagtgggcatgggggaggggctg

SEQ ID NO: 87109 - DNA, 601 bp, Human
tgccaggtgggctctaagagatgtttgatttctttaatccttccagctgccctgtgggctgggggccatccctaccctcattttacagacgaagaaactgaggctgggagaggtcaattaacttgctcaaatttggtataggcaaaactaggaattggcagacggtggttccagtgcctgccttttaattggtacttgaattatacgagtgttttcttccatcaataaaagaaatcggcgaacagcctcccatgggtttcagtaagtgcaagccctccttgtcatcccagacctcagcctrcccatttaatggatgaagacactgaggcctggagggaacagtgacttcggagccactctcctggactctgccactcctctcgcctcccatatgaacctgagtggccacatgaccctgggggagagctactcaactgtcccaaggagagggtgatgactgctggcctcccaccggccatcagcgccccactgactgacacccctgagtcagtctccaccctggaactgtttctctcactatttgccatggccttgggccgcttccgggggcttggcaaggcaggaggcgtggaaccaagat

SEQ ID NO: 87110 - DNA, 601 bp, Human
acagagacctgtgggtcctttacatctgatcatcctgtcatttgtatctgtatctggggtggttagttgcaaacaattccacagtagccaaatcaagaaagtcactggctctcgcaggagcgcgattggtgtggggcgagcctgggggtgtagcccaggcaagcccttcaccctgatgcgcattagccttcttatccaggaaatggggggaggcggtctgggcccagggaggggagcatgccaagctggggatctccaccggtccaggattcagggcgcctctgaccgttctctgcccagygcctcctgttcagttttacttttgtgttttccatttcacttctgcctctaggccagtgtttttcaaaatatgtttcctgagtggaaatgaaaaaatgttctgtgatcaggcgcagttgggaaatcctaggggagagaaagtgaactaggcttcctcaccgcaggacttctcagagcctttaaaatggtaattatgctccaggccttgtgcccctctacctaggcatcctttactggttgggaagagacggcaggttacgggtgagtccgggtaagtggagttgtgcctaagctgataacc

SEQ ID NO: 87111 - DNA, 601 bp, Human
gtagccaaatcaagaaagtcactggctctcgcaggagcgcgattggtgtggggcgagcctgggggtgtagcccaggcaagcccttcaccctgatgcgcattagccttcttatccaggaaatggggggaggcggtctgggcccagggaggggagcatgccaagctggggatctccaccggtccaggattcagggcgcctctgaccgttctctgcccagtgcctcctgttcagttttacttttgtgttttccatttcacttctgcctctaggccagtgtttttcaaaatatgtttcctgagtkgaaatgaaaaaatgttctgtgatcaggcgcagttgggaaatcctaggggagagaaagtgaactaggcttcctcaccgcaggacttctcagagcctttaaaatggtaattatgctccaggccttgtgcccctctacctaggcatcctttactggttgggaagagacggcaggttacgggtgagtccgggtaagtggagttgtgcctaagctgataacctgacgtcaccaacactgttctgtcaccttgctttggtgtggcttcttcacagttgtcacatctgggccgtttggagtgaccta

SEQ ID NO: 87112 - DNA, 601 bp, Human
tagcccaggcaagcccttcaccctgatgcgcattagccttcttatccaggaaatggggggaggcggtctgggcccagggaggggagcatgccaagctggggatctccaccggtccaggattcagggcgcctctgaccgttctctgcccagtgcctcctgttcagttttacttttgtgttttccatttcacttctgcctctaggccagtgtttttcaaaatatgtttcctgagtggaaatgaaaaaatgttctgtgatcaggcgcagttgggaaatcctaggggagagaaagtgaactaggyttcctcaccgcaggacttctcagagcctttaaaatggtaattatgctccaggccttgtgcccctctacctaggcatcctttactggttgggaagagacggcaggttacgggtgagtccgggtaagtggagttgtgcctaagctgataacctgacgtcaccaacactgttctgtcaccttgctttggtgtggcttcttcacagttgtcacatctgggccgtttggagtgacctagcaagtcctttgcttgtctcccaggactttccggagtagccaagcagagccttcggccagttccctt

SEQ ID NO: 87113 - DNA, 601 bp, Human
ttagccttcttatccaggaaatggggggaggcggtctgggcccagggaggggagcatgccaagctggggatctccaccggtccaggattcagggcgcctctgaccgttctctgcccagtgcctcctgttcagttttacttttgtgttttccatttcacttctgcctctaggccagtgtttttcaaaatatgtttcctgagtggaaatgaaaaaatgttctgtgatcaggcgcagttgggaaatcctaggggagagaaagtgaactaggcttcctcaccgcaggacttctcagagcctttawaatggtaattatgctccaggccttgtgcccctctacctaggcatcctttactggttgggaagagacggcaggttacgggtgagtccgggtaagtggagttgtgcctaagctgataacctgacgtcaccaacactgttctgtcaccttgctttggtgtggcttcttcacagttgtcacatctgggccgtttggagtgacctagcaagtcctttgcttgtctcccaggactttccggagtagccaagcagagccttcggccagttcccttgtggggccaggccctgcccgggagcacaggca

SEQ ID NO: 87114 - DNA, 601 bp, Human
gcccccagctctgcggtggagcagcagggacctgcctggcccatctccctgttgagggaagacccggaggcgcctgtcctgttctgtgtgctccgaggtgtctgaaaccagctacctcattttctttttatcttttgcaagtgatttcttatttcctgctccacccccaaacgtgccccctgtatgtttcctgttcgcctgcttccctgacctttgaaatgtggtccctgctcgggaaacttgcctggacctcagtcaattatggttttcctctgggctgtgtgtgtgtgtgtgtgtgtgkgtgtttgagtgtgcaagtgtgtgcattaggattagagagaattcgatggggggccaggggccaacaggaatgggggtggctgagctgagaggccaagggcaggttccaggttgcattgagagccgaagctggtgagtgtgaggcgggcagatgtgaggtgtgtgtggggagtggggtgctgtctgggtgactgggctgggagagggcaggtgggggccaagctggaagaggtggtgttattctgtagcacctgatgtacacagaccttgggggtgcagctccaggctttctctctcccca

SEQ ID NO: 87115 - DNA, 601 bp, Human
agaatcacttgaacctgggaggcggaggttgcagtgagtcgagatcacgccattttactccagcctgggtgacagagtgagactctgtctcaaaaaataaaataaaataaaataaaagtgtgagtatacatacacacgtacagttggttcttgttattcttgaaagttatgctccataaagtcactgggaaccctgaattattgaatactgaaccattgctcctaggggaaacatcgggctaggttcctgtgagcctcaggtcacaacgtttttgccaactgttcgatacctgacctggcttttttttttttttttttaagacagcgtcttgctgtgtcaccccaggctggaatgcagtggtacaatcatgggtcactgcagccttgacctcctgggctcaggccattttcctgcctcagcctctccagtagctgggactataggcatgcaccaccacacctgtctgatttaaaaaaatatacagatgaggtcttgccatgttgcccaggctagtctcaaacttctggcctcaagtgaacctcccaccttggcctcccaaagtgttgggattacaggcatgagccaccgcactcagcccat

SEQ ID NO: 87116 - DNA, 601 bp, Human
tctcagctcatggcaacctctgcctcccggtttcaagctattttcctgcctcagcctcctgagaagctgggattacaggcatgcaccaccacatctggctaatttttgtatttttaatagagacagagtttcaccgtgttggcgagactggtctcgaacccctgacctcaggtgatctgcctgccttggcctcccaaagtgctgagattacagtcgtgagccaccgtgcccggcctgcatttacctgtttttaattgtggtaaaatacatataacacttatcgtcgtaaccatttgtaagygtgaagttcagtggcattaagaacattcatgttgctggtaaccactgccaccatccatctcccaccacaatttaataaatcattgaaaacagactttcttgaccacaaacaatggtgcagcagaagcatcatagatctctgtctgtcctgctggctgagctgtggcatccttccttttttatattgtaaaaactgtaaataaaatgccataaaaacgccagcgttgatctttgtggaacttgcggagctgactgtagaatgtgttgggggtataacaggaccagggcagcccaggtgttt

SEQ ID NO: 87117 - DNA, 601 bp, Human
tgcccagagctgtgttaggtgtcagagaagttgtttgtgaggcattgtgagtagaattaagtaacttgagtgcgtaattgcctctggggatcaggcctgggcatgctcaacattcaccaagtcatgtttgtttttcaatgctccagctcttcctcctccaggaagcctgcccagtctacccacagccaggtctacccacagtcagcccttcctcttcttagaagcctgcccactctaaccgcagccagatcttcctctgtctaggaagcctgcctggttcacccacagccgtgtcttcttyctctaggaagcctgcctggtccacccatagtcaggtctacctcctccaagaagcctgcctgatccacccacagccagatcttcctcctccaagaagcctgcctggtccaccaacagccaggtgtacccatagtcagctcttcctcctctcggaaacctgccaactccacccacagccagatcttccccatctagaaagcctgcctaccccacctacagccaggtcttcttcctccaggaagcctgcctgggccacctgcagtcagcttatccatccccaggctccaggcattacctgtcc

SEQ ID NO: 87118 - DNA, 601 bp, Human
gctattggaatggaagcccagacatctgttatgaattctatatataaatattggatatgcttacatgggttaaaatgagattgttggcacttgggttttcaaactcctgattctgctccgggtaggactgatcacgggtcctgggactcaaggcaggaggggccacgagctggcctttctctgacactgacttgccagaagtgggcgttcctgggagtggcagacatgcacccactagagatagatctgaatcaccccctcacattctcctaatagtgccaagaacccacagcagagtgcrgggtgtactgagtttgtgctgagcaggggtgcctgaatcccggattgaagaaagtgttctacgcccgattaaaccaactgggaatccaggcaaaagaagacgttcccaggggaagccagcctgcccagtgtgcatggtgccttttaaacaaattatctgcattcccattgggatgaagttcacttgacaacattactcattggtttttttgcttttgtttagtttttttttttttttttttttttttgagacagaatctcactctgtcacccaggctggagtataatggtgcaatgtcgg

SEQ ID NO: 87119 - DNA, 601 bp, Human
ggtgaatagactacgtttcatttatccgttcatcggttatggacatttgagctgtttccatgttttggctttgtgaacactgctgttaacatgcgtgtacctgtatgtgtacatacatgagtagaggggttcagttcttttgggtatatatgtaggagtggaattactggtcataggatcattctatgtgtaactttttgaggcactaccaggctgttttccacagcagccagaggtgtctttaaaagcagttgtcaactgggcttggtggctcacacctgtaatcccagcactttgggakgccaaggcgggcggatcacctgaggtcaggagttcgagaccagcctgaccaacatggcaaaaccccgtctctactaaaaatacaaaattagctgggcgtggtggcgtgtgcctgtaatcccagctactcaggagactgaggtgggagaatcgcttgaaactgggaggccgaggttgcagtgagctgagattgcgccatcatactccagcctgggcaactagagtgaaactccgtctcaaaataaaaataaaaataaaaataaaaggaatgatcacttcctgtttcatgaatgaggaaact

SEQ ID NO: 87120 - DNA, 601 bp, Human
ggaggccgaggttgcagtgagctgagattgcgccatcatactccagcctgggcaactagagtgaaactccgtctcaaaataaaaataaaaataaaaataaaaggaatgatcacttcctgtttcatgaatgaggaaactgaggctctgggagatgggaaatcctgcccggaatctcacagctggaggccaggccgggctttgaatccaggcaactgagtctgagtggatggtgtgtgctttgtgttggagctggcccagggctggatgaaggcaacatttaattaatgaaaaccactacccmctcccggctgttacctcttgagcgcttttctatgaagcatcctgtttaagcctcgcactctgtgatgtggaggtgcagtaattatccccatttcacagacaggatgttgaggtcagaggggttgagtgattgtcatgggccaggtctcagccaggcttgctaaccctggagtctgccgtctgctctgaagtggtcactctcagctggagagctgacctggcccttttgcctttgtgatgtacggtcctgaaaaaaatatttgcagaaatagcttcataggaacatatatggaatttggaa

SEQ ID NO: 87121 - DNA, 601 bp, Human
gacaggatgttgaggtcagaggggttgagtgattgtcatgggccaggtctcagccaggcttgctaaccctggagtctgccgtctgctctgaagtggtcactctcagctggagagctgacctggcccttttgcctttgtgatgtacggtcctgaaaaaaatatttgcagaaatagcttcataggaacatatatggaatttggaattaaaaaatatattaaaaactatatatttaccagtattacaatatattacccagagacttgtctccctaatgaggccacctttactttttcaatcttygtctccgctggtgctttctcataactgccattcattctagtagaaatcatggttcacggttatgctgggtgtgtggtttttggtgttgacatgtcgaacgttttgttgttaccgcagtcattttgttactagttaattggtgctacctttccacggagacaatagtctagttacccctgccgctggagattgttctttttttttttttttttttttttttttttttgctattacaaataaggcctcagcaaatattgtgactcagacgttttccttctttctggtgtttcttgggacaga

SEQ ID NO: 87122 - DNA, 601 bp, Human
tgaactgtcctctttgcttttttttttttttttaagctttaaaagaagtttttgtagagatgcggtcttgctgtgttgcccaggctggtcttgaactcctggcctgagatgatcctctctcctcggaaagtgctgggattataggtgtgagctacggagccggcccttcccttctactctgctactctgctgttctctctccctcccgtcgggttctgctcctgccacgttctcccctctccccaccaaaggctgggttttctttgtcagggctcctttcccctttggagaagagggggcygtagggccttggtgcgaggccctccagtgacaggatcccccatcacccagagttccacaggccctggtagggaggagggggagcagaagaggaggtgccatctttgcctgctggggaagggcaggggccacccacacagagctctcccatttgctgtggaccctggggccactgccagttccttccaaaggaaagccagctccccaggtggtgggagagtgatgtggcttcctcttaaacttaggaattgagtgtgtggttgcttctaagtgccttagaagccggagcggctcctggaaa

SEQ ID NO: 87123 - DNA, 601 bp, Human
tcctttcccctttggagaagagggggctgtagggccttggtgcgaggccctccagtgacaggatcccccatcacccagagttccacaggccctggtagggaggagggggagcagaagaggaggtgccatctttgcctgctggggaagggcaggggccacccacacagagctctcccatttgctgtggaccctggggccactgccagttccttccaaaggaaagccagctccccaggtggtgggagagtgatgtggcttcctcttaaacttaggaattgagtgtgtggttgcttctaagtgycttagaagccggagcggctcctggaaagagcctgcctgccacagcgggccttaccctggctgtgcccacagatgtccctggggcctgccgctcctgcccggctctcctggcctcccccggtgtgggttgggaaaagcacagcaaattaaaaaacacctccatctctggcctttgaagaatgcatctgaacagccgagagtgtaaaccgtggtgaaatgtggtctttccagtttggggagaagcagggcagagctggggcttttgtacccagggtttccaagagctcctgcctccctcggc

SEQ ID NO: 87124 - DNA, 601 bp, Human
agacaatctatgtcattgttgtccaaggaagctaatttagagtagaaagttccgtgtccagtcccactctgtgcgtgtgttagcaggggactctcgggccggagctgggtccaccctggtagggggacttcatggggcctgggcgacagcactgtgtatttgtgtgtgtgtgtgtttgtgtgtgtgtgtgtctgaggaggtggaccagtttctcaaaaggcctgtgaccccaagaaccaaggaatttcagcctgggtggatcacaccttcactggtgagtgggacaagctgggggccctcrccacaggagcagccagggcatggggcacagttggcctcattcacaaaatgggagtataagtgatccctgctctggcggccaggacgatgagtgggaacacaccgtgtgggggctgcctggcctgggtgtgccgcgggtgtccttgttggtgatggttccacctgcttgtgccaccagtgccctctgggtctcacacacaactctcttcccagcgaaggcccctcctgccctcaggcctcagtgctgcttccgtctcggaaggccccaggagctcctgcatcctgggcgtgattcctgtgt

SEQ ID NO: 87125 - DNA, 601 bp, Human
cctggtagggggacttcatggggcctgggcgacagcactgtgtatttgtgtgtgtgtgtgtttgtgtgtgtgtgtgtctgaggaggtggaccagtttctcaaaaggcctgtgaccccaagaaccaaggaatttcagcctgggtggatcacaccttcactggtgagtgggacaagctgggggccctcgccacaggagcagccagggcatggggcacagttggcctcattcacaaaatgggagtataagtgatccctgctctggcggccaggacgatgagtgggaacacaccgtgtgggggcygcctggcctgggtgtgccgcgggtgtccttgttggtgatggttccacctgcttgtgccaccagtgccctctgggtctcacacacaactctcttcccagcgaaggcccctcctgccctcaggcctcagtgctgcttccgtctcggaaggccccaggagctcctgcatcctgggcgtgattcctgtgtgcctgcagaccccctcgcggctgccatctcatcctttggtgcacctgttggccagacctcctggtagcgggtgctgcactcccctgaatgtgccggggcctgggggcagggacc

SEQ ID NO: 87126 - DNA, 601 bp, Human
gacgtgagcgaggaggccatcaagcagacctacctgaaccagacgggggccgccgtgcagaacgtggtcatctccggcctggtctctcccgacggcctcgcctgcgactgggtgggcaagaagctgtactggacggactcagagaccaaccgcatcgaggtggccaacctcaatggcacatcccggaaggtgctcttctggcaggaccttgaccagccgagggccatcgccttggaccccgctcacgggtaaaccctgctgcgactccacctgggtccagggggcggggagtgtcaccatytctctctcgaatttgcatgagcccaagttgtttttcagaaaaagggtgtgactctgaaaatgaacccgtgggggggttggctcaggcctgtaaccccagcactcggtgtgactctgaaaatgaacccgtgggggtgttggctcaggcctgtaaccccagcactcggtgtcactcttaaaatgaacccgtgggggggttggctcaggcctgtaaccccagcactcggtgcgactctgaaaatgaactcgtgggggggttggttcaggcctgtaaccccagcactcggtgtcactcttaaaa

SEQ ID NO: 87127 - DNA, 601 bp, Human
gagtccaggaattcaagaccacactgggcaacatggtgagaccccatttctacaaagtatacaaaaatgaatcgggtgtgatggtatgcacctgtaatcccagcttcttgggaggctgaggtaggaggatcatttgagcctgggagatcgaggctgcagtgagctgtgatcccaccactgcactccagcctgggcgacaaagtgaggagatcctgtctcaaaaaaaaaaaagagctcagctttcaagatttgttattgttgaaggaattacttccccttgagattccatagttatgttcctttttttttttttttttttttaattgagatggagtctcccttgttgcccaggctggagtgcagtggcacaatctcggctcactgcaaccttcgcctcccgggttcaagtgattctcctgcctcagcttcccaagtagctgggattacaggcgcccaccaccacgcccagctaatttttgtagttttggtacagatggggtttcaccatggtgtctaggctggtctcgaactcctgacctcaggtgatccacccacctcggcctcccaaagtgctgggattacagacgtgaaccaccgtgcc

SEQ ID NO: 87128 - DNA, 601 bp, Human
cttctttgcgcaatggcacgatctcagctcactgcaacctccacctcccgagttcaagtgattctcctgcctcagcctcctgagtagctgtgattacaggcgtgcactaccacacctggctaggttttgtatttttagtagacacagggtttcgccatgttggccaggctggtctcaaactcctaacctcaagtgatccaccctcctcggcctcccaaagtgttgggattgcaggcgtgagccactgcacccagcctgacctagatcttctaggttagaaagtcccaggagtgggcggccrtgcatccaggcctgccacaggagcccgcctgccctcctccctgaagtcagggctctggaagcccttcccttggccatgccctgtgggacagtgtccaagctctggagtaggactgaagacccctgggctctagtcctggggccaccaacttgctgttgccctttgcagtgacctccccctgactcccatggtgccggctgcaggagccgggcgggaggggctggttgccagatcctgcagatgcccctcctctgggcctgcccagggtagtgggaatgagggtgtggggtgagggtctgt

SEQ ID NO: 87129 - DNA, 601 bp, Human
gggaagggctggagcctttcagagcccaacaggtttgtgtgagagccaggcgtgtgtgtgtctgagcaactgagtgtgggagtgggaggatgtgagcgtgtgtgtgtgtgtgtgcgtgtgcacgcatatgcgtgcatacgtgtgagcctgtgtgtgtccgtgtgtgtgcatgcatgcgtgtgagtggatatttgtgtgtgtatgagtgtgcgcatgtgactgtgtgtgcacgtgtatgtgcccgtgtgagcgagtatgtgcgcgagagtgtctgcatctgaaccagtctgtgtgtaagtayggggtaccagcaggggtgggacacggtggaatttatcgccaaagtattttgagtccctgaggtcaggccagagcagcctcgtgcccccactacctgagaagtgcccccggcctcccaggggtgctgtgctgggcaaccactcatccctggagcccctcgtatgccctcgctgccctccgagtgggctagccacccctgcagctgccggggagccagctgacctccggggcagcctctgttccgcttggtgaactgttgccctctcagccctctccccctgcactgtggctccaggagtcg

SEQ ID NO: 87130 - DNA, 601 bp, Human
gtgtatgagtgtgcgcatgtgactgtgtgtgcacgtgtatgtgcccgtgtgagcgagtatgtgcgcgagagtgtctgcatctgaaccagtctgtgtgtaagtatggggtaccagcaggggtgggacacggtggaatttatcgccaaagtattttgagtccctgaggtcaggccagagcagcctcgtgcccccactacctgagaagtgcccccggcctcccaggggtgctgtgctgggcaaccactcatccctggagcccctcgtatgccctcgctgccctccgagtgggctagccaccccygcagctgccggggagccagctgacctccggggcagcctctgttccgcttggtgaactgttgccctctcagccctctccccctgcactgtggctccaggagtcgcggggttactgaccttctttttggaagggtcggctggtgtagcagtgtctctggctaggagggggcatctgcagtagtcggagaggctgaagatagcagcttgctagaagccctctcccagggccggcctgcggttgctcaccagcggctgccatggccatcgtgtcgccaggacctgcgctcctcctgtcattgcg

SEQ ID NO: 87131 - DNA, 601 bp, Human
acccctgcagctgccggggagccagctgacctccggggcagcctctgttccgcttggtgaactgttgccctctcagccctctccccctgcactgtggctccaggagtcgcggggttactgaccttctttttggaagggtcggctggtgtagcagtgtctctggctaggagggggcatctgcagtagtcggagaggctgaagatagcagcttgctagaagccctctcccagggccggcctgcggttgctcaccagcggctgccatggccatcgtgtcgccaggacctgcgctcctcctgtcmttgcgttccctcccagcgtgggtcgctgcagctccctcacctcccaaccaggcatccactgcatttgtgagcccttgcgcctggtcctgctccccacgcagcgggtatagcccagtctctggccctttcagtgagtgggaggagatggtaaatgaatagtatttgaaagggacgtgtgcgtagggggataaagcagtgcttgggtgctgtggcgaggggcttccgtcggagctcaggtgctgggaaggcctcttggtgacttttgagtcgagactggaagcagatgaggctgagaaccgt

SEQ ID NO: 87132 - DNA, 601 bp, Human
ggtgacttttgagtcgagactggaagcagatgaggctgagaaccgtgtggctgtctgggggcagcgcggtccaggcagagggatcagccagtgcaaaggccctgggctggtttggggcggggcctgtttgaggggctgtagcagaatgtagggaaacagggcccaaggtgtgaggagaggacacatgaggtctcgagcagaggaggtgccagctctgactcgtgctggaaggcatcccctggtggctggagcgagagtgagctgtggggtgggtggcgtgggggcaggagccctctccacrgttattaccgggatcctggcgacagaaagcagcagcggggacacctcacttgtgggggtaaggagtggcgagatttgggatctgttctgaagagaaaagacagctggatttgctggcactctgcatgtaggttcgataaaaagatgagacaaggttggcacggtgccactctgtgcctcagtatccttgtctgtacagaggcgtgaccatgctgcatgtcatgaggaaaacaccaagaacagtttgtgagttcaacaaatgttagctgtcgttataataaaaatgccctttcctcgccac

SEQ ID NO: 87133 - DNA, 601 bp, Human
ggcgagatttgggatctgttctgaagagaaaagacagctggatttgctggcactctgcatgtaggttcgataaaaagatgagacaaggttggcacggtgccactctgtgcctcagtatccttgtctgtacagaggcgtgaccatgctgcatgtcatgaggaaaacaccaagaacagtttgtgagttcaacaaatgttagctgtcgttataataaaaatgccctttcctcgccaccagaagtccagtctccatgcctacgtggttttgtctttttacttctttatggcttttgctatgttgkttgggaagtgctcagtgctaggttgggaggtgatcagtcgggaggtgctaggtgatttgttgggaggtgcatgatgctcagttgggaggtgctaggtgctcggttggaaggtgattggtactttgttaggaggtgcttggcgcttggttgggagttgttggtgtccagttgagaggtgctaggtgcttggttgggaggtatttgattgggaggtgcttggcacttggttgggaggtgctctgcacttggttgggaggtgctcggtgctaggttgggaggtgatcagttgggaggtgctag

SEQ ID NO: 87134 - DNA, 601 bp, Human
ggcacttggttgggaggtacttggtgcctggttgggagtagttggtgtccagttgagaggtgctaggtgcttggttgggaggtatttgattgggaggtgcttggcatttggttgggaggtacttggtgcttggttgggagatgctgggcccttggttgggagtagtctttcccatgctcagatctgagctggctttgcctgcatcatctctgcgagccaactgtccctgtttggctctggcttttcttaactatttgaaatggttcctttacatgcttgcctctgaattctctcccagaasccctccccaggatcacacctgtggctgttcactcccacccctgcccctggggcaaagttgaccttagtgttgattcctgggcctctccccacaccttccctttgctccagtcatttgaatgagagagtgaaaacagtgagatgccggctcccactcatcagatccagtgatgctgatgacgccagccatggtcctaccctgaggtgctgactctgtccctgtaggctccatgtctccggagagggagagggagagggagaggattccagcctgtcacagcgcccgcggcagcaacccctg

SEQ ID NO: 87135 - DNA, 601 bp, Human
gccatgggttttattcttttttttttgagacggagtgttgctgtctcccaggctgagagtgcagtggtgtgatcttggctcactgcaagctccgcctcccgggttcacgccattctcctgcctcagcctcccgagtagctgtgactacaggtgtccgccaccatgcccggctaatttttttttttgtacttttagtagagacggggtttcaccgtgttagccaggatggtctcgatctcctgacctcgtgatccgcccatctcggcctcccaaagcgctggaattacaggcatgagccacygcacccagcctttttttttttttttttaggcagggtctcactctgtcatccaggctggagtgcagtggtacagtcacagctcactgcagcctcgacctcccagggctgaagggatcctcccacgtcagcctcccaagtagctgggactacaagagtgtgccaccatgcccagctaacttttttttaatttttattttttgtagaggtgggattttgccatgttgcccagggtggctcaagtgacccacccacctcagcctcccgaagtactggaattacaggtgcaagccatcgtgcctg

SEQ ID NO: 87136 - DNA, 601 bp, Human
caggcatgagccaccgcacccagcctttttttttttttttttaggcagggtctcactctgtcatccaggctggagtgcagtggtacagtcacagctcactgcagcctcgacctcccagggctgaagggatcctcccacgtcagcctcccaagtagctgggactacaagagtgtgccaccatgcccagctaacttttttttaatttttattttttgtagaggtgggattttgccatgttgcccagggtggctcaagtgacccacccacctcagcctcccgaagtactggaattacaggtgcragccatcgtgcctggccatgttttgttgtttttaaatagacttaattttttcaaacagttgtaggttcacagcaaaattgatgagcagcaggtactgagttcctatacatccctgtcctcacacccacacagccttcccaactgtcagcatcctgtgcagggtggtacatttgttacaactgatgaaagctggctgacgcaccatcacccaaaatccacgtttacacgagggttcgcccttgatttgtacattcttggtttagacagatgagtaaggacatgcacccaccattccatgtc

SEQ ID NO: 87137 - DNA, 601 bp, Human
agttcctatacatccctgtcctcacacccacacagccttcccaactgtcagcatcctgtgcagggtggtacatttgttacaactgatgaaagctggctgacgcaccatcacccaaaatccacgtttacacgagggttcgcccttgatttgtacattcttggtttagacagatgagtaaggacatgcacccaccattccatgtcatacaggatagttccactgccctgattttctgtgctccactcattcatccctctcctctccaactcctggcaaccactgatgctttactgtctctgtrtatttgctttttccagagtgtttagaactggactcatacagattggctctttcacctactaacatgcatttaagtttcctccatgtcttttcatggcttgatagatcatttcttttcttttcttttttttttttttgagatggagtctcgctctgtcgcccaggatggagtgcaatggtgcgatttctgctcactgcaacctccccctcccgggttcaaatgattctcctgcctcagcctcctaagtagctgggactacaggtgctcactaccacgcctggctaatgttttgtattttta

SEQ ID NO: 87138 - DNA, 601 bp, Human
agtttttttttttttaactttgtttttttgagacagagtctcactctttcacccaggctggagtgcaatgtcataatctcagctcactgcagcccccacctcccaggctcaagcgatcctcccgcctcagcctcccgagtagctgggactacaggagtgcgccaccacacctggctaatttttgtatttttggtagagacggggtctcacatgttgctcaggctggtctcaaactcctaagctcaagggatccttcccctcggctcccagagtgctgggattacaggcgtgagccaccgcrcccggcccatgcaccaaatgaggttttgtcaccagatgagcaacaaaagctttccatcttcagagcgttttggattttggaattgttggggagggcttatggcccggcagggttgtgaacagtaaccctgtcacacgcaccacccccaccctggccctatcccagctcaggcatcctgagggcaacagccggaagctgtctcagttattggtgcattccccagtctcaccagggggccttccacatggtcagtgctcaataaaatgggccgagaatgagtaggaagggttttcccctcgt

SEQ ID NO: 87139 - DNA, 601 bp, Human
cgctcctagctgtatactcttaagaatcgaaaacaggtcttcacacaaaatgtgaatggacagtaatgtccgtagcagcactgtgcacaacagccgagggtggaaatgacacaaaggtcccccagtgggtgaatggatgcacagattgggttctgtctgcacactggaatatggttcacccctaaaacgggatgaagcactgacatgctacagcctggatgaacctcgaaaacatggtgccaagtcaaagaagacagacatcagaggctgtatattgtgattccgtttatatgagatgttkagaatgtgtgtagttaagtccatcaaaagtgtttgccggggctgggggcggggactggggagtgactgctgccgggtgtggggtttgcctgtggggcaatggaagtgctttggaactagacagaagtggaggctgcaccgccttgcgaatgcactaggtaacactattcactttaaagtggtaaatttaggctgggtgcagtggcttatgcctgtaatcccagcactttgagaggccaaggcgggtggatcgcctgagctcagggcttcaagaccagccttgggcaacatggcgaaaccc

SEQ ID NO: 87140 - DNA, 601 bp, Human
acaaaatgtgaatggacagtaatgtccgtagcagcactgtgcacaacagccgagggtggaaatgacacaaaggtcccccagtgggtgaatggatgcacagattgggttctgtctgcacactggaatatggttcacccctaaaacgggatgaagcactgacatgctacagcctggatgaacctcgaaaacatggtgccaagtcaaagaagacagacatcagaggctgtatattgtgattccgtttatatgagatgttgagaatgtgtgtagttaagtccatcaaaagtgtttgccggggctrggggcggggactggggagtgactgctgccgggtgtggggtttgcctgtggggcaatggaagtgctttggaactagacagaagtggaggctgcaccgccttgcgaatgcactaggtaacactattcactttaaagtggtaaatttaggctgggtgcagtggcttatgcctgtaatcccagcactttgagaggccaaggcgggtggatcgcctgagctcagggcttcaagaccagccttgggcaacatggcgaaaccctgtctctaccaaaaagataccccccaaaaattagctgggtgtgg

SEQ ID NO: 87141 - DNA, 601 bp, Human
aagtccatcaaaagtgtttgccggggctgggggcggggactggggagtgactgctgccgggtgtggggtttgcctgtggggcaatggaagtgctttggaactagacagaagtggaggctgcaccgccttgcgaatgcactaggtaacactattcactttaaagtggtaaatttaggctgggtgcagtggcttatgcctgtaatcccagcactttgagaggccaaggcgggtggatcgcctgagctcagggcttcaagaccagccttgggcaacatggcgaaaccctgtctctaccaaaaarataccccccaaaaattagctgggtgtggtggtgcacgcctgtggtcccagctactctggaggcggaggtgggagaatcgcttgaacctgggaggcagaggttgcagtgagctgagatcacaccactgcactccaacctgggtgacagagtgagaccccatctccaaaaaaaaaaaaaaaagtaaacgtatgtcctgtgaattttacttcaataattttcttaaaaaacagcatcaacaaaaatgaacagaagaggtggtggatctgcagagcccacagctcccatcttccctgtgccact

SEQ ID NO: 87142 - DNA, 601 bp, Human
catttatcgagttccgttcaattgctgttggtcatagaagggcttgggagagtgacaagcttggccatcccagcaagagggacagtgttcctatggaagctgctgggtccacacatagcacaaagacaagacaagccttttgcccaggagcccattgtctctggggttcccgtcactaccacacaggcaggtcctgaccccggccattggagcgtggggggcagcctttgcagaggggtgtcctttgggggctccgaggagctggggagggtgttctagtcataggagcttggtgggaggragcagatggggaggatgtcactccatgggcaggtcacatctgggtgtgagggtggccaggaaggtcacggctggttttggggaaattgcaggccgtctggccaggctgagggccccatgtggacggggccagcgatgaggcaggtggaatggtgcccgcggggaggtccctgatgccacttgaggccgatgtttgggcagagggacacactggaggctgtcacgggggacgaggcaggatgtgactcattcagaaacaagtgacggtcctcttctggaaccttctctcactctgtcctgg

SEQ ID NO: 87143 - DNA, 601 bp, Human
atggggaggatgtcactccatgggcaggtcacatctgggtgtgagggtggccaggaaggtcacggctggttttggggaaattgcaggccgtctggccaggctgagggccccatgtggacggggccagcgatgaggcaggtggaatggtgcccgcggggaggtccctgatgccacttgaggccgatgtttgggcagagggacacactggaggctgtcacgggggacgaggcaggatgtgactcattcagaaacaagtgacggtcctcttctggaaccttctctcactctgtcctggttttcycagtccacactcgctgtgaggaggacaatggcggctgctcccacctgtgcctgctgtccccaagcgagcctttctacacatgcgcctgccccacgggtgtgcagctgcaggacaacggcaggacgtgtaaggcaggtgaggcggtgggacgggacggggcgggcgggcggggcggggcctggcgggaatgggttgcggccgccgggggtgccccagaaggaacctcggcaaacccgttcgaaatgatccacttggcgggtgtggtgattcaagtctgtggtcccagctactcgggaagct

SEQ ID NO: 87144 - DNA, 601 bp, Human
tggtgccgagagctcgctgaggtctatggaggaagggcgcagatgggatctgggcctggcgtcctggccggcccccaaggccttctccacagagtttccatgtataccggggtggccttgcggaggggcgcagccatgcgtcaggctggagccagctgcagaggccacagacagggtgtcatgagcagtacaagtaaccgctgctgtccattgaacacctactgtgtgcctgggttcagaaaggcaccctgtgctggcttttaaagaattaggccgcctgcctaaaggggggagtgtggcyttctttttcatttaagtcaccaactgttttatacatccacgcccctaaattcttcagttttaggcaaagatgagagggctgcccaggcgtcatttgctcaacaaaaccacacttcacttgtgaggctgtgttccctcaccagggtccccagcaagggggtgtgagtgtttagtaccacagggagggctggcgcggtggctcacgcctgtaatcccagcactttaggaactcctcacctgaggtcaggagttcgagaccagcctggccaacatggtgaaatcccatccccactgcctgcct

SEQ ID NO: 87145 - DNA, 601 bp, Human
gcttgctggaaggtcccaggcaccgtgcaggtgacagtggccggcctcaggttccagcagagccagcatcgggcccagccacttcccttgtgctttgtgaccctatggtcacttggcacaggatcccgggtcaaatgctgcggttgcggcatttgccccaccacttacccctgggggcagcggagaaacttaatcaattgctaaacaacaaaaataatctggccgcctgccagctgggaagccactgtggccaggctgtttatggccttgggatctgcgcagtggacagtggcctgcaccrtgaccccgttcatcctgcgtgccccaggcccaggaggtggctcaagccctctgcctcctgtaagggcacctgagaaggaggccctggagctgggagcagagctgggggtgggcgtccgggcagcagaggccgattctcagctttccctggatctcagctttccccggatctcagctttctgctacccgtgtgaaaagaagccaggagaacacagctatcctgggttggtgccggctgtggtgggaggcctgcggtgggagcctccgggggccactggacctttcctgggtggcctgtggc

SEQ ID NO: 87146 - DNA, 601 bp, Human
gtggcctgtggcctgggagctgcacttggttcggtgcagggaggttgtgacatccactctgtctgcagggatggccggggccctgcggctgggtgatgaggtgggatggaggtgtccggggctgccctgcctccttttgccaaaataacaaaaattatcttgtttgttgtgaaaaaacctgttttcccacattggggcatggagggtattaactgtgatgaccttctgagttcctgcacactggtgacccattggcagggtctcctcctggctctggcaggggtggctcaggccgctgggygacggtgtgctggccagatagttcctggggctgcaggtggcttctttcgccccatccctcccatcccctttcattcttcctgtcaacacatctcagaccctggacaccgaatgagccgtcggtacccacaccccagggcaattcagtggaggggtaggtggctcgttcccccacgttgccccaggaagaggaccctgtccccggcatcctgacccacctcccttagagaccgagagcctctaaggataaacccattcacccgtgtttcagaggcttttttttcctcttataaaataacat

SEQ ID NO: 87147 - DNA, 601 bp, Human
tggcctgtggcctgggagctgcacttggttcggtgcagggaggttgtgacatccactctgtctgcagggatggccggggccctgcggctgggtgatgaggtgggatggaggtgtccggggctgccctgcctccttttgccaaaataacaaaaattatcttgtttgttgtgaaaaaacctgttttcccacattggggcatggagggtattaactgtgatgaccttctgagttcctgcacactggtgacccattggcagggtctcctcctggctctggcaggggtggctcaggccgctgggtracggtgtgctggccagatagttcctggggctgcaggtggcttctttcgccccatccctcccatcccctttcattcttcctgtcaacacatctcagaccctggacaccgaatgagccgtcggtacccacaccccagggcaattcagtggaggggtaggtggctcgttcccccacgttgccccaggaagaggaccctgtccccggcatcctgacccacctcccttagagaccgagagcctctaaggataaacccattcacccgtgtttcagaggcttttttttcctcttataaaataacatt

SEQ ID NO: 87148 - DNA, 601 bp, Human
aaagattagccaggcgtggtggtgggtgcctctaatcccagctactccggaggctgaggcaggagaatcgcttgaacccaggagacagaggttgcagtgagccaggatcacgccactgcactccagcctggcaacagagcgagactctgtctcaaaaaaaaaaataaaaataaaataaataaatacataaattgacttttaggagattggttcaaacaatgtgtgtaatgttgtgtctgagtgtttttcatttatcgttcatgcaaattccgacatcattcactcttctccagagtgtgcygttttcctgcctgtgtcatcacccgtcaccttgaatgccctcgtttaggtaaaataagtacattttattcaaaaatatttgaggacatttgggttgtctccaggttcttggtcttgagttttgctgttcttgtggagccatggtggtgtctggttgcaggaacctccatgcgttccagctgctgcttctgcctgtgttcttagagaggaaatgctggggtccgcggttcccgggctgctgaccaggaagcctgcggtgctttacggcccttccagaagcgggagatgcccccacttaagt

SEQ ID NO: 87149 - DNA, 601 bp, Human
ctccccaccttccctccttcccctattgtaactttctttctgatattataaaagtcactcatggctgggcgtggtggctcacgcctgtaatcccagcacgttgggaggcagaggcaggcagatcacctgaggtcaggagttccagaccagcctggccaacatggtgaaaccccgtctctactaaaaacacaaaaagttagccaggcgtggtggcgggcacctgtaatcccagctactcaggaggctgaggcaggagaatggcgtgaacctgggaggcagaggttacagtgagtcgagatcrcgccactgcactccagcctgggcaataagagtgaagcttcgtctcaaaaacaaagtcacacacgcttcttgtacgagggtcatttggccgaggggccagatggctcaccatctagttgggacaggccatgagctcggaatgctttttacatatttacatggttgagaagaaaatcaggagaataatgttttgggacatgggaaaatgacatggaatttgcattttagtgtccataaatgaagttttgtttgctcccagctgtgttgactgaggcaggctggcttcctacagctgcggcag

SEQ ID NO: 87150 - DNA, 601 bp, Human
aaaatatttgctctctggcccttcccagagtgcttgccgacctctgtccgacagctagaaggaaggataggacccgtccgacgataaccactgttgacatttgagcgcgtttccttcccggcttttgtgtgagagtggcagtctgtttgcttttgtggtcgggatctgctgcacgcacggcgggctgtttgcatgaggcttcctggaggatagggctgggctcggagctgcacgcagtggggcgtgtcctgcatgcagtggggcctcagaagagagctgtggtgggcggggcagtgccaaygctggtgggtgccaggcctccacgctcagatcagccccggcgacaggtttgggccaccctctctctggcctctgtgcagtggcccaggccgtctgctctgcctggcacacttgcctctgtccttccactgaagcgctcctcttaccctctgctcccggctgggtacgttgaattgtgtccctcaaggagatatgctaaaggtctaaccccaggaacctgtgtatgtgatctaatttggaaacagggtcttggctgatgtaatcaagcgaggatgaggtcaccctagagtagggggcctat

SEQ ID NO: 87151 - DNA, 601 bp, Human
actgttagtttccaaacattttacttccttggtgtttaaataaattcctaccaagactctgtagctggtcccagggaaggagttggcctctcttctttatagcccggcacagtcagtcccctgcacctgcccctcccaaccccaggcctgcttccccgtggccatggctgctgcccggacctctctacacacagaacctcctggaggccagctgtgggcaccagccttggcagggctgtggcggagcccaggctgctggtactctctctgcagctgctccctgctggcctggctggacagmgtccccaccaccactggggtcacctctgtgctggtcacagctcactcagaccttcaggcaaatgggttggatcctgcctctctcccaggtgtctcagtctctgcaaaactcaaaaacctcagaggccttgcagcctgaggggtgtcagagacacctccttcgaatcagtaaacacctacagattcaccccagcagtgaaaggactgcttcgccacagaggtttgatttactcctaagtaattggaagggatgccgagaataggttcctcatggtgggactagaggccctctgctgaccta

SEQ ID NO: 87152 - DNA, 601 bp, Human
ccaatacacaccaaatcagatgcccctgaccagatctaaatttggctctcagagatttccattgtagctgggcacttggggaaccttctaagtgctgcctctgcctctccccagcctgcctgcctcagtttccccagccctgggcccgtgtcgctgttgccatcacgtgggcgccctctagtggaggaatcagattatgcactccggggcttggagcaggagtcaggaggggctcctgtctttccttgaaacgttggatgccgggatcctggaacagtctctgcattcctcctggcgagarccagagcctgggcacaggggaccatctgttgtttgaaggctgcagcctggcagggcactcaggagatctggcagttggctgcagggccaggtctaggggccagggcatcagggaggctctgggctggttcagccccgggcccctttgcagattgtgacctgggcccctgtgcaggggcatggccacaggatgctgggaggggtctctgaccctgaccttcttggctctgtgcatccttgagaccagaaaggtctggaacaaatgagtagacgatgccctaacctggggagggagccacat

SEQ ID NO: 87153 - DNA, 601 bp, Human
tctgagttactgggggtcatcactgtgttctgatggcccagctgtgtggaggccgcggtgcagccccatccaaggagccagggccctgggtctagccgtgaccagaatgcatgccccggaggtgtttctcatctcgcacctgtgttgcctggtgtgtcaagtggtcgtgaaactctgtgttagctcttggtgttcctgaaagtgcccccgggtctcaggcctcagaaccagggtttcccttcatctcggtggcctgggagcatctgggcagttgagcaaagagggcgattcacttgaaggrtgtgtctggccctgcctaggagccccccggcacggtgctggggcctgaagctgccctcgggtggtggagaggagggagcgatgaagtggcgtcgagctgggcaggaagggtgagcccctgcaaggtgggcatgctggggacgctgagcagcatggccagcagctgggtctgcagcctggtacccggcgggacttgtggttggggctggtttgtggccaggagaggggctggcaggagacaagggggactgtgaggcagctcccacccagcagctgaagcccaatggcctggctgtgtggc

SEQ ID NO: 87154 - DNA, 601 bp, Human
ccgcggtgcagccccatccaaggagccagggccctgggtctagccgtgaccagaatgcatgccccggaggtgtttctcatctcgcacctgtgttgcctggtgtgtcaagtggtcgtgaaactctgtgttagctcttggtgttcctgaaagtgcccccgggtctcaggcctcagaaccagggtttcccttcatctcggtggcctgggagcatctgggcagttgagcaaagagggcgattcacttgaaggatgtgtctggccctgcctaggagccccccggcacggtgctggggcctgaagcygccctcgggtggtggagaggagggagcgatgaagtggcgtcgagctgggcaggaagggtgagcccctgcaaggtgggcatgctggggacgctgagcagcatggccagcagctgggtctgcagcctggtacccggcgggacttgtggttggggctggtttgtggccaggagaggggctggcaggagacaagggggactgtgaggcagctcccacccagcagctgaagcccaatggcctggctgtgtggctctcagctgcgtgcataacctctcagtgcttcagttctctcatttgtaaaat

SEQ ID NO: 87155 - DNA, 601 bp, Human
gacaccagcatctactgacaccaacatttacaaacaccgacattgaccgacaccgacatttaccgacactgacatttaccaacactgtttaccaacactgacatctactgacactggcatctaccaacactgacatttaccgacactgacatttaccaacactatttaccaacactgacatctactgacattggcatctaccaacaccaacatttaccgacaccaacatttaccaacactgaaatttaccgacaccgacatttaccgacaccgtttaccaacaccgacgtttaccgacacygacatttaccgacactgatatttaccaacactgacatctactgacgctggcatctactgacaccgatgccagcatctaccaacaccgacatttaccaacactgacatttaccaacactgacatttaccgacattgacatttactgacactgacatctactgacactggcatctactgacactgacgtttaccgacactagcatctactgacactgacatttaccaacaccagcatctaccaacaccgacatttaccaacactgacatttactgacactgatatctactgacactggcatc

SEQ ID NO: 87156 - DNA, 601 bp, Human
caggtggatgcccagacccgccctgccatccacctgcacgtccagagctgacttagcctcgagattgctgctggcacctcctgccccgggacacctcggatgtgcccgtggagatgctggctctgtgttttctgctggagtttggtgcgtcttttcctcctgcaagtggccaccgctcttgggtatgtcctcaggcttctgcgagtcatggctgcttctcaggtccttgcccagcgccaggagcaaaccctcctggcactttgttcaggggtggatgcgccagtgttcctgctgtggaccsccatctcacatgagggtcttgggcctgcaggctcgttcaggaaacacccgctgagtacgcagtgtgtgccagctgtgtcccaggcaatggcggggacagtggctgctgctggggttgtggtggcttctggggactctggggacagctgaggtgcaaggagccacggctccttgaggatgcagttggactccaggtggaagggatggttgggggaggtataaatggggtcagggaggagacacatttggaacaatgggaacatttttaagatgctatgtcgggaggcaacaaggtggccaa

SEQ ID NO: 87157 - DNA, 601 bp, Human
tcgagattgctgctggcacctcctgccccgggacacctcggatgtgcccgtggagatgctggctctgtgttttctgctggagtttggtgcgtcttttcctcctgcaagtggccaccgctcttgggtatgtcctcaggcttctgcgagtcatggctgcttctcaggtccttgcccagcgccaggagcaaaccctcctggcactttgttcaggggtggatgcgccagtgttcctgctgtggacccccatctcacatgagggtcttgggcctgcaggctcgttcaggaaacacccgctgagtaygcagtgtgtgccagctgtgtcccaggcaatggcggggacagtggctgctgctggggttgtggtggcttctggggactctggggacagctgaggtgcaaggagccacggctccttgaggatgcagttggactccaggtggaagggatggttgggggaggtataaatggggtcagggaggagacacatttggaacaatgggaacatttttaagatgctatgtcgggaggcaacaaggtggccaacccaggtgctgaggagcccacaccagccctggacgtgttttgccgctcacctttgctg

SEQ ID NO: 87158 - DNA, 601 bp, Human
ccaaaaaacatgtattggaacacagccatgcctgttcagtcacgtgctctccatgctgctttctgctccagagacccttatggcctgaaagctgaaaatattttctatcctttacaaaaaagtttgctgacctctgtcctggaaaattcatctcccaagttctcttccggcactggcgttcctgggtgtcctaaatttggcccctgttatttctgaactctgttttggctctgttccctcccaggagccaggacaggcacgttctctgcatcttgtcccctgacgcccagaggcttggctyggctcaggcattcttggaaatatctggctccaggaaaggcagaggcctcctgagtcggcccagagggaacctgccccaggtctgggggaggcctgacccagcagagtggcttttgccgatgggttgggccggtcaagatgtgctgaaagttgtcctcagaaggccactttgggattccttcctccagtattagagcaactgagagctgctcattgcaagcctgatgttttcccagttggccgggtccaccgggtgccctgggattctgggatctgggtggaaagtagggggcttggggga

SEQ ID NO: 87159 - DNA, 601 bp, Human
atcttgtcccctgacgcccagaggcttggctcggctcaggcattcttggaaatatctggctccaggaaaggcagaggcctcctgagtcggcccagagggaacctgccccaggtctgggggaggcctgacccagcagagtggcttttgccgatgggttgggccggtcaagatgtgctgaaagttgtcctcagaaggccactttgggattccttcctccagtattagagcaactgagagctgctcattgcaagcctgatgttttcccagttggccgggtccaccgggtgccctgggattctgsgatctgggtggaaagtagggggcttgggggagtgtcctgggttctggaatccaggtggcaagtggtgaggttcagggagtggcttctgagccaccataggggtctctgtgggaggctctgcccatccaggagattccgcaggccctgccggcccagagccagcgtcttgcgcttgccgaggctacagccagccccagccgggtggaacagcccgtcgcctcctctcactttgttttggggccacctgggagtgtggagcaagggtagagagggaggaagtggctgccggccgctgcccag

SEQ ID NO: 87160 - DNA, 601 bp, Human
ccctgcagttgctcataactgccccaggtccttatatttgctccaggtcctgccccaggtcctgcagttgctctgtgtggtgggtgtgatctggagccctccgcccattgctgcacctggggcaggcattgctaattgatcccaggactccttcctgcggagcacgccctggttctccaggcagccgctgcctgtcagcctgcagtggttcgggagaggacacctgcttgcctggtctgttccaaatcttgcttctcatcccagcacaggtagggggtgctatgggaaagggatcctcagytggccctgtcactgctctatcagctggggacgtggcatcctagtgaaaacatcatggccgggcgcggtggctcacgcctggaatcccagcactttgggaggctgaggagggtggatcacttgaggtcagaagttcgagaccagcctggtcaacatggtgaaacccatctctactaaaaatacaaaaattcgccaggtgtggtggcgggtacctgtaatccgagctactcgggaggctgaggcaggagaatcgcttgaacctgggaggtggagcttgcagtgagccgagatcttgccactg

SEQ ID NO: 87161 - DNA, 601 bp, Human
gtgaaacccatctctactaaaaatacaaaaattcgccaggtgtggtggcgggtacctgtaatccgagctactcgggaggctgaggcaggagaatcgcttgaacctgggaggtggagcttgcagtgagccgagatcttgccactgcactccagcctgggcaacagagtgagacgctgtctcaaaatctcaaacaaacaaacaaacaaaaaacaaacaaacaaagcgtcatttatccagcacccctggggaaccatgctacctggtgttttatggtacctggcaaggtgcaggtgaagttgckgctcttgggcattgaacccgtcttgtttggggcagctcaggccccaggcagggtccgggttggctctcgttggtgtggccctggcccatccagacctatatttctgccgtcctgcaggtgatcaatgttgatgggacgaagaggcggaccctcctggaggacaagctcccgcacattttcgggttcacgctgctgggggacttcatctactggactgactggcagcgccgcagcatcgagcgggtgcacaaggtcaaggccagccgggacgtcatcattgaccagctgcccgacctgatg

SEQ ID NO: 87162 - DNA, 601 bp, Human
cgtagtggtgcatagctgtagtcccagccaccaaggaggctgagttgggaggattgcttgagccccaggaggttgatgctgcagtgacctgagattactccactgtactccaacctgagcgacagagcaagacttgtctggggaaaaaaaaaaaaatatatatatatatatatatatatatatatacatatatacatacacgcacacacacataatataaaaatatatatttataaatatataatatataatataaaaatatatatttataaataaaatttataaattatatttataagtraatatataatatataatataaaaatatatattatataatatataataaaatatataatataaaaatatatatttataaataatatataatacatacttataagtatatatttaaaatatatgtaatgtatattttttaatgtatgatatataatatacatttataaatacacatttatattattttatataaaatatatataaaatctccaagttgctttttccaaaaaggtgtcttgctgcatttcaaacattcatttaaaaacttgaatgctggtgatctggtccagaatgtgttcag

SEQ ID NO: 87163 - DNA, 601 bp, Human
ttctggatctgctaaaagaagagggaaggaggggctgctgggggaggagcccagagccgagtttacatccggatcccgcaaggcctcccctgccctgaggtcttgttttgtgatgtgcttgtgtccatcctggtttctgccgtgtccccaacatccggccaagcttaggtggatgttccagcacacactcaccctgtctgtgcacctgtttttgtgtccgtaagtgggtatttactcgccttacgagtgagccactgtgggaattcagggaggtggcgcagtgaccacccctggagggatrtgtgtgtggcaggggtcgagggtctcgcccttccctgcttcctgcgcgtggctttctccaggacggggagggctgagctgaagaggtggggacagttgcgtccccccgccacccactgtcctgcggtgagagcagactcactgagcctgcccttctcccttgtgccttccagctacatctactggaccgagtggggcggcaagccgaggatcgtgcgggccttcatggacgggaccaactgcatgacgctggtggacaaggtgggccgggccaacgacctcaccattgactacgctgacc

SEQ ID NO: 87164 - DNA, 601 bp, Human
gactcactgagcctgcccttctcccttgtgccttccagctacatctactggaccgagtggggcggcaagccgaggatcgtgcgggccttcatggacgggaccaactgcatgacgctggtggacaaggtgggccgggccaacgacctcaccattgactacgctgaccagcgcctctactggaccgacctggacaccaacatgatcgagtcgtccaacatgctgggtgagggccgggctggggccttctggtcatggagggcggggcagccgggcgttggccacctcccagcctcgccgcacrtaccctgtggcctgcaagttccccaacctggcaggagctgtggccacacccacgactgcccagcagcctcaccctctgctgtgggagttgtccccgtccacccctgggtgcctttgctgcagttatgtcgggagaggctctggtgacagctgtttcctgtgcacctgctgggcactaggtcccagctaatccctgtgccaggactctaatttcaccctaacacacatggtggttttcattgctggggaagctgaggcctgagcacatgacttgccttaggtcacatagctggtgagttca

SEQ ID NO: 87165 - DNA, 601 bp, Human
cgagaccagcctggccaacatggtgaaaccccgtctctactgaatatacaaaaatcagctgggtgtggtggcgggtgcctgtaatcccagctactcaggaggctgaggcaggagaattgcttgaacccaggaggcagaggttgcggtgagccgagatcacaccattgcactccagcctgggcaacaagagcaaaactccatctcaaaaaataaaaaatagaaaaacaagtgctgtagcggaagtgagcactttgcggagtcaggcttgtgtggcctgttccacaaatgatgtgctcacggyggcctcaggcccacctggagtctgcagcatggggcacaacaggttcattagtgtagaattccaggacaggcctggctcctaagcagccttcttttacaaaaactgcagagcccgcctgtatcctagcactttgggaggccgaagtgggtggatcacgaggtcaggagttcaagaccagcctggccaacatggtgaaaccccatctctactaaatatacgaaaattagctgggtgtggtggcacgcgcctgtagtcccagctactcgggaggctgaggcagaattgcttgaacctgggagg

SEQ ID NO: 87166 - DNA, 601 bp, Human
ttgcttgaacccaggaggcagaggttgcggtgagccgagatcacaccattgcactccagcctgggcaacaagagcaaaactccatctcaaaaaataaaaaatagaaaaacaagtgctgtagcggaagtgagcactttgcggagtcaggcttgtgtggcctgttccacaaatgatgtgctcacggtggcctcaggcccacctggagtctgcagcatggggcacaacaggttcattagtgtagaattccaggacaggcctggctcctaagcagccttcttttacaaaaactgcagagcccgcytgtatcctagcactttgggaggccgaagtgggtggatcacgaggtcaggagttcaagaccagcctggccaacatggtgaaaccccatctctactaaatatacgaaaattagctgggtgtggtggcacgcgcctgtagtcccagctactcgggaggctgaggcagaattgcttgaacctgggaggtggaggttgcagggatctgagaccatgtcattgcactccagcctgggcaacagagcgagacgccatctcaaaaaaaaaaaacctacagagccacacggcctctttctccaccgagt

SEQ ID NO: 87167 - DNA, 601 bp, Human
cagggccgtgtcgcccacctcactggcatccatgcagtggaggaagtcagcctggaggagttctgtacgtgggggctggcagtggggtgggcagggtggcctctaaacccgacccctggaggaggctggaggccagtgcaagatcctgtgtggcctcagccaggcggtggtctctgccagatgccaactgttgcccgctggggttcagcgacatgtccgaatgtcccgaggcctctgaggttgttttcttttgccgcagaacaaatcaccacgaacagcgttttaagacaacaccaactctttttttttttttttttttgagtcaggatcttgctctgttgcccaggctggggtgccctggtgcaaacacagttcactgcagcctcgacctctgggcttaattaagtgaacaccttgcctcagcctcccaggtagctgggactacaggtgggcaccaccacacctggctaatttttttttgtagagacggggtttccccatgttgcccaggctggtctgcaactcctgggcacaagctatctgcctgctgtggcctcccaaagtgctaggattataggtgtgagccactggcctgacaaca

SEQ ID NO: 87168 - DNA, 601 bp, Human
gctccagcctgggcgatagagcaagactctgtctcaaaaaaaaaagccaggcatggtggtgcatgcctgtagtcccagctactcaagaggctgaggcaggagggttgttcgacccacggagatcaaggctacagtgagccatgatcgcaccactgccctccagcctgggtgacagagtgtgaccctgtctcaaagtaagtaaataggaggagagacaagtgggcagttcagactgatggtatgggcacagtagagactggtgcagacaggctggcctgtgatgtcaagcaacttctgtaaytgtttccggcatccatttgtgtgtcaatttccgtgtcagtaggaagactctgtaggctgccaagaggaataagtgggaggatcctcccagagaggccgggcctgcaggagggccagttctcatgagttctcatttggcccctaccctccaggctgtggttctgaggtgggagacagagcctgacctctgtttgtcttgttttgtctttgcagcagcccacccatgtgcccgtgacaatggtggctgctcccacatctgtattgccaagggtgatgggacaccacggtgctcatgcccagt

SEQ ID NO: 87169 - DNA, 601 bp, Human
cagtgagccatgatcgcaccactgccctccagcctgggtgacagagtgtgaccctgtctcaaagtaagtaaataggaggagagacaagtgggcagttcagactgatggtatgggcacagtagagactggtgcagacaggctggcctgtgatgtcaagcaacttctgtaattgtttccggcatccatttgtgtgtcaatttccgtgtcagtaggaagactctgtaggctgccaagaggaataagtgggaggatcctcccagagaggccgggcctgcaggagggccagttctcatgagttctyatttggcccctaccctccaggctgtggttctgaggtgggagacagagcctgacctctgtttgtcttgttttgtctttgcagcagcccacccatgtgcccgtgacaatggtggctgctcccacatctgtattgccaagggtgatgggacaccacggtgctcatgcccagtccacctcgtgctcctgcagaacctgctgacctgtggaggtaggtgtgacctaggtgctcctttggggtgatggacaggtacctgattctctgcctgctaggctgctgcctggcatccttttaaaatcacag

SEQ ID NO: 87170 - DNA, 601 bp, Human
agcacttacctggcaggctgtcatgggcatcaagtaacagggcactccacctggaccctgacacgtgatgcacaggaatgccagctgctatgccatgggtgtggcagtagtaataaagtgaccatctgtatcctcaccacagtgaagcctgtccagggctttctctcctatgcccccatgcctccaggtggccttggatcctgttggttctgtgctctgctcagcgacctttctcccgtgggagttcctgggggttcagcttcatcctacagacagcagcacacactggctgtgcaccctttttttttttttttttttttttttgagatggagtctcgcttttttcgcgcaggctgaagtgcagtggtgtgatcttggctcactgcaacctctacctcctgggttcaagtgattttcctgcctcaccctcccaagtagctgggattacaggctcccaccaccacgcccggctaatttttgtattttcagtagagatggtgtttcaccatgttggccaggatggtcttgaactcctgacctcaggtgatccgcccacctcagcctcccaaagtgcagggattacaggcgtgagccaccacac

SEQ ID NO: 87171 - DNA, 601 bp, Human
ggctgtcatgggcatcaagtaacagggcactccacctggaccctgacacgtgatgcacaggaatgccagctgctatgccatgggtgtggcagtagtaataaagtgaccatctgtatcctcaccacagtgaagcctgtccagggctttctctcctatgcccccatgcctccaggtggccttggatcctgttggttctgtgctctgctcagcgacctttctcccgtgggagttcctgggggttcagcttcatcctacagacagcagcacacactggctgtgcacccttttttttttttttttyttttttttgagatggagtctcgcttttttcgcgcaggctgaagtgcagtggtgtgatcttggctcactgcaacctctacctcctgggttcaagtgattttcctgcctcaccctcccaagtagctgggattacaggctcccaccaccacgcccggctaatttttgtattttcagtagagatggtgtttcaccatgttggccaggatggtcttgaactcctgacctcaggtgatccgcccacctcagcctcccaaagtgcagggattacaggcgtgagccaccacacccggagtgccggttg

SEQ ID NO: 87172 - DNA, 601 bp, Human
tttttttttttttttttgagatggagtctcgcttttttcgcgcaggctgaagtgcagtggtgtgatcttggctcactgcaacctctacctcctgggttcaagtgattttcctgcctcaccctcccaagtagctgggattacaggctcccaccaccacgcccggctaatttttgtattttcagtagagatggtgtttcaccatgttggccaggatggtcttgaactcctgacctcaggtgatccgcccacctcagcctcccaaagtgcagggattacaggcgtgagccaccacacccggagygccggttgtttttagcagtttgtcttgttcctggagagactggctcctgcccaggagctcggggagtagggccgcggggtgctgcctcacacctcgagtttggccgtaagcagaggggacattttgtgactgtccccctcctgagcttcccagcagcttttctccaagttacagcccaaaagctcaggtggatttgcaacccaacggtgtctgtgcacctcccactgatgcccgaactgccctggccaagaaacggggccgtcagaacgctgcactaactgcagccttgggcctccatgc

SEQ ID NO: 87173 - DNA, 601 bp, Human
ggccaggatggtcttgaactcctgacctcaggtgatccgcccacctcagcctcccaaagtgcagggattacaggcgtgagccaccacacccggagtgccggttgtttttagcagtttgtcttgttcctggagagactggctcctgcccaggagctcggggagtagggccgcggggtgctgcctcacacctcgagtttggccgtaagcagaggggacattttgtgactgtccccctcctgagcttcccagcagcttttctccaagttacagcccaaaagctcaggtggatttgcaacccaasggtgtctgtgcacctcccactgatgcccgaactgccctggccaagaaacggggccgtcagaacgctgcactaactgcagccttgggcctccatgccagaggccatgcccttccatccaccaccccctggcctgggccctggccctcctggctcgggaactccaggccccttcctcacggctcgagagacgtgtatttaccgcacaggtgcttgtcattctcttgtggcctcttctccagggagatcacagaaggacagggcctcactgaggtctcggacatggaccctttgatagtggca

SEQ ID NO: 87174 - DNA, 601 bp, Human
tcctgcccaggagctcggggagtagggccgcggggtgctgcctcacacctcgagtttggccgtaagcagaggggacattttgtgactgtccccctcctgagcttcccagcagcttttctccaagttacagcccaaaagctcaggtggatttgcaacccaacggtgtctgtgcacctcccactgatgcccgaactgccctggccaagaaacggggccgtcagaacgctgcactaactgcagccttgggcctccatgccagaggccatgcccttccatccaccaccccctggcctgggccctggccctcctggctcgggaactccaggccccttcctcacggctcgagagacgtgtatttaccgcacaggtgcttgtcattctcttgtggcctcttctccagggagatcacagaaggacagggcctcactgaggtctcggacatggaccctttgatagtggcaggagccaggctgggcaagaggcggccacagtcacctcagcagtgccatcaccaccgccattcagcccttccctgagccgggcgcgcccctggctctggccccagtgtcccagttacagctcacaggagcttgtggtgccc

SEQ ID NO: 87175 - DNA, 601 bp, Human
ccagttacagctcacaggagcttgtggtgcccagcggctgcttctgattgagagtcgaggtcggaggctttgggaggctgagaggctgctcggtttcacaactgctgagggagacttgggctccatctcaggtctgccccatgtcgccctcaacctccagccaccggtcctccgtgtcccccatggccaggcacggcttgcagacatctgtcgttggctcctctcagccgtcgtgggctgaccctggcacgtcctcctgtggctgagcccagtggggacagctgcttccttttattaccckagaactctcgtctttgatcaggccccctcccctatgccacacagtccctgtcactcgggtgagcccagtagtcatggggaaggcctgcgggttccaaacatccaaaggcttgcgtgcagcatgacagcttgaaaccgatgttttttaccttgatcagatttcagcttggcgggggctttgctcagctttcagtgaggcctgggccgatttcccagcatcccctcctgaggccagcctctgtttcctgtgattttctgcacaaagtgggagggaggagtcctaggaaatggggggccacct

SEQ ID NO: 87176 - DNA, 601 bp, Human
gagggcgcagtgggcactcaggcgtggctgagcagatgtgtgttgccgggaggaggaaggactgctccagtcagggctgaatttcccacccggagcatttctgctgtatttggtgtagcgcctgctgcttaaagctctgattcccagttggcaccctttcccttctgcattgaaaaacatacggatgcatgtcttcttgcagtgaatgtgtattctcccagcctctcttctgggttggggctggaggtggagcggcacacaggagccgcagcgatggaggatgtgcgggtgcagcaccccrtacagcagggatgccaaacccgcgctgagtccctctcaacttctgctttgaagcccagtcacgccattgcctgggttttgctgggcggggctgcgtgtgatgttctcctctgtccctcccccagagccgcccacctgctccccggaccagtttgcatgtgccacaggggagatcgactgtatccccggggcctggcgctgtgacggctttcccgagtgcgatgaccagagcgacgaggagggctgccccgtgtgctccgccgcccagttcccctgcgcgcggggtcagtgtgtggacctg

SEQ ID NO: 87177 - DNA, 601 bp, Human
ggctgagcagatgtgtgttgccgggaggaggaaggactgctccagtcagggctgaatttcccacccggagcatttctgctgtatttggtgtagcgcctgctgcttaaagctctgattcccagttggcaccctttcccttctgcattgaaaaacatacggatgcatgtcttcttgcagtgaatgtgtattctcccagcctctcttctgggttggggctggaggtggagcggcacacaggagccgcagcgatggaggatgtgcgggtgcagcaccccgtacagcagggatgccaaacccgcgmtgagtccctctcaacttctgctttgaagcccagtcacgccattgcctgggttttgctgggcggggctgcgtgtgatgttctcctctgtccctcccccagagccgcccacctgctccccggaccagtttgcatgtgccacaggggagatcgactgtatccccggggcctggcgctgtgacggctttcccgagtgcgatgaccagagcgacgaggagggctgccccgtgtgctccgccgcccagttcccctgcgcgcggggtcagtgtgtggacctgcgcctgcgctgcgacggcgaggcag

SEQ ID NO: 87178 - DNA, 601 bp, Human
tgctccagtcagggctgaatttcccacccggagcatttctgctgtatttggtgtagcgcctgctgcttaaagctctgattcccagttggcaccctttcccttctgcattgaaaaacatacggatgcatgtcttcttgcagtgaatgtgtattctcccagcctctcttctgggttggggctggaggtggagcggcacacaggagccgcagcgatggaggatgtgcgggtgcagcaccccgtacagcagggatgccaaacccgcgctgagtccctctcaacttctgctttgaagcccagtcaygccattgcctgggttttgctgggcggggctgcgtgtgatgttctcctctgtccctcccccagagccgcccacctgctccccggaccagtttgcatgtgccacaggggagatcgactgtatccccggggcctggcgctgtgacggctttcccgagtgcgatgaccagagcgacgaggagggctgccccgtgtgctccgccgcccagttcccctgcgcgcggggtcagtgtgtggacctgcgcctgcgctgcgacggcgaggcagactgtcaggaccgctcagacgaggcggactgtgacgg

SEQ ID NO: 87179 - DNA, 601 bp, Human
agacctacggccttcaaagccccagacctcacgtctggcccttgacagacagagcttccccagccctgctgcgcatcctggcccagcatgtgctgtgtgtgtgatttcagcttgcaggagccgtggttaggaattgtccctgtgttggtccattttgcattgctatgaaggagcacctgaggccgggtagattatgaaggaaagaggtctgtctggctcatggttctgtaggcagcaccagtatggcacccgcatctgctcagcttctagtgaggtctcaggaagctttgactcatggtgraagtcgaagcgggagcaggtgcatcacatggtgagagagggagcaacggagagagagagagagcgcctctccctcttgccctcaccttgagaggagatgccaggctcctttaagtaaccagctcccatgtgaactcacagtgagagcccatttgctactgcggagagggcaccaggcatctgctcccatgacccaaacactgcccaccaggccctacctccaaccttggggtcatattttattctgttctatgctatgctatgctatgccatgccatgccatgccatgctattcctattc

SEQ ID NO: 87180 - DNA, 601 bp, Human
atctggaggaggcaggagagtagtctgggcagctttggggagtggagcagggatgtgctaccccaggccctcttgcacatgtggcagacattgctaatcgatcacagcattcagcctttcccactgagcctgtgcttggcatcagaatccttcaacacagaggcctgcatggctgtagcaacccaccctttggcactgtaggtgtggagaaagctccttggacttgaccttcatattctagtaggacatgtgctgtgttgtccacaaatcctcatgtaccctagaaatgaatgtgggggcrgctgggctctctccagagctgaaggaatcactctgtaccatacagcagctttgtcttgagtgcagctgggatttgtggctgagcagttacaattcctacgtggcccaggcaccaggaacgcaggctgtgtttgtagatggctgggcagccgcaccgcagagctgcaccatgctggtttgtatcacatgggtgaccatggtatgtctaagaaggtggagtccctgtgaggtctgcaggtgcccccacagctccaggccaccttgaggattgcctctgcctgcccagccctgagttccctct

SEQ ID NO: 87181 - DNA, 601 bp, Human
caaaagatacagaagagtctgcagtccaaagagactccgcccccatgacgccaagcaggcatccctgggaggcatggcctcctgcagtgtgtttcttctatgtccccccaggggtcatctgtacatatgcaagcatacaagagcgtggactttgttttccaagccagaagataattgtagatttatgtgcagttgtgagaaagagcacagacccatttatcctctgcctggtttcccccagtgctgcctgccatcttgcatgacttccattcctatcataagcaagacactgataacgatyctttcaccttattcagattgacataagtgttttttgtttgttcttgagacaaacttcctctgtcacccagtgggagtgcagtggcacaatcacagctcactgcagcctcaaactcctgggctcaagcgattctcctgcctcagtcccctcaagtagctcagatggcaggtgtgcaccatcatgccaggctaatttttaaattttttgtggaggtgaggcctcactaaatttcctgggctagtcttgaactcctgagctaaagtgatcctcctgcctcagcctcccaaagtggtaggatta

SEQ ID NO: 87182 - DNA, 601 bp, Human
cgagactctgtctcaaaaaaaaaaaaaaaaaagaaaagaaaagaaattatcaatctcctcttttatggcatatatatatatatatatatatatatatatatatatattttttttttggttatgttcagaaaggccttccctgctctgatcataaaaaacaacttattttcacactctctctcttttttttttgagacagagttttgctcctgttgcccaggctggagtgcagtggcgcaatctcagctcactgtaacctccgcctcccgggttggagtgattctcctgccttaccttcccragtagctgggattataggcatgcaccaccatgcctggctaattttgtacttttagtagagacgggggtttctccatgttggtcaggctggtctcgaactcgcgacctcaggtgatccacccacctcggcctcccaaagtgctgggattacagacgtgagccaccatgcccagcccacactctctttcttaacgtcctcctcctttcgttttacgttcacatctttaattcttctgggatgtaattagatttgatgagcaaggtgggcatccagcttgtttcttggctgatggcttatggg

SEQ ID NO: 87183 - DNA, 601 bp, Human; identical to SEQ ID NO: 18055

SEQ ID NO: 87184 - DNA, 601 bp, Human; identical to SEQ ID NO: 18056

SEQ ID NO: 87185 - DNA, 601 bp, Human; identical to SEQ ID NO: 18057

SEQ ID NO: 87186 - DNA, 601 bp, Human; identical to SEQ ID NO: 18058

SEQ ID NO: 87187 - DNA, 601 bp, Human
taactaaacttggaaagagggtagggattgagattatatgtgatcacacaaatatctgtgtatgtgtatctctatacatcatttgtaaatatgtaaatataatgcatttcttattagaaattatagcttgaattccatagtgaaattcatccttccctatggacatggaggcaagtgccctataaaattaacaaacttttgttccaagaacatttatttctgagggtgcagagtatcaatttcaaggttgagtttctttaaaaatcaggagctaatttttaatgaattaacattcaaaggrtctatatgacctaatccactacctgacaattgctggtatgagggaaatgtggccccaagaccactgagttcagagatgagtctgaaaacaattttaacatgaaaatttatgaaagatatgtacacacactacatacctctcaacagcctaagaagaatcttgtgctggcagagagcagaaacaaagactgaaattaacactgaagatatcagctgacttcatcttatgggttaacctattctattttgtaattctgtgaaaatctcatgattatttttaattttcgaaaacatttttcta

SEQ ID NO: 87188 - DNA, 601 bp, Human
ctctgttctttttaccccttcctccttccctttcctgccttgccatctcagatcctattctcataggcactgggcagatgtgagagtgaggactggacctggcactccagacgggagatgattgattgaccagtgagatgtgagaagaaaggaggaaaattaggaggccaccacgcctaacttcagggctgcctgtggcactgacttccccgggtcctgctcaggaaagtagggtaatgactagtgccattcacaagctgtttagctgacattctgagaagttattcagcaaatttagaasagaaagagaatgatataatgaaccaaaaaacaacagttctcaccttatttatgatttttctatttctgaatgagtactcaaatttcactgagtacttgagtttaatttgattatttcaccctatcaagaaatcactttattcttagaattttcctgttagttgaaaatagaattgtattataaattacataggacttttatactatatatagtttacgacgtatatttatatgtaagctatacataactaaacttggaaagagggtagggattgagattatatgtgatcacacaaatatc

SEQ ID NO: 87189 - DNA, 601 bp, Human
gacagttcatacactggtgcataaaattctgggctgaggatatgagggcacctaaggcaaatgtgaagtaatgggatttctgatgaatgtgagaaagaggctaagtaggagctcgcttagctttgaattctctgttctttttaccccttcctccttccctttcctgccttgccatctcagatcctattctcataggcactgggcagatgtgagagtgaggactggacctggcactccagacgggagatgattgattgaccagtgagatgtgagaagaaaggaggaaaattaggaggccacyacgcctaacttcagggctgcctgtggcactgacttccccgggtcctgctcaggaaagtagggtaatgactagtgccattcacaagctgtttagctgacattctgagaagttattcagcaaatttagaagagaaagagaatgatataatgaaccaaaaaacaacagttctcaccttatttatgatttttctatttctgaatgagtactcaaatttcactgagtacttgagtttaatttgattatttcaccctatcaagaaatcactttattcttagaattttcctgttagttgaaaataga

SEQ ID NO: 87190 - DNA, 601 bp, Human
tgaatggaggtaggagagaggaaaggagtcagttgaaggggtgtaagctgaaggcaaggacaacctgggagtaaggggtagaaattcatgtgtgcttcacactttggcaaaactaaaaagggaatattttacaagtttcgaaaaaagtttttccttatagttaatattttgtaagtgagctaaatggattttctcatttcactactacatttcatatttgttcttataatccagtttaattattcctaaacccttttaatcctgaagctggttctcctgggatggaagagcctttctcttktttctttcctttagacgtgatgtgaaataacacaaatccttctctggtatctgtggtgctgaccatgcatctttgggtgcagaaagcactggattcttactccccaacttgcagagggaattctagactgctgcacctccatatcctcagcaactggcatgatgatgagcagggagttagtagaactaatacactaatatgtaaatgaatgaatgaatgtttcctgagtgtggctttaagtttctcagaagaagacagttcatacactggtgcataaaattctgggctgaggatatgagg

SEQ ID NO: 87191 - DNA, 601 bp, Human
ttttaatagagaaagggtttcgccatgttgcccagcctggtctcaaactcctgggctcaagaaatcctcctgtcttggcctcctgacgttctgggattacagccataagccaacacagccacccaccctttccttttttactctcactcagccttattctccattcctccacccttcagcttcttatatctttcttctttccttttgttttgcttttgccctagagccatcagtgttctgtatgagtgcttcagacacaaaagtttctgaaacatttgttgtttttggttaaaaaaaaaaagttggggataggaacagggatgatattctgggataaaggctctctactctcggaattaagacatttttgaaattgaaatacatcacacagaatggaatagttgctattgttgagtgtagaagtacatattctcaacaatggaagaacacagacacaaaatgctatcatttatgaagtatttactacatgttagaaattttagaaaaaaaataactaacatttgttgagtatttgttcatcaccatgtggggcactctatactcaaaagaatctgaaacgaggtcaaatagttcctatgat

SEQ ID NO: 87192 - DNA, 601 bp, Human
tagatccttgaggaatcacaaggattccacaatggttgaactaatttacactcccaccaacagtgtaaaagcattcctatttctccacatcctctccagcatctgttgtttcctaactttttaatgatcaccattctaactggcatgagatggtatctcattttggttttgatttgcatttctctaattaccagtgatgatgagctttttttcataagtttgttggttgcataaatgcctttttttgagaaatgtctgttcatgtcgtttgcccactttttgatgggattgttttttttttcttgtaaatttgtttaagttctttgtagattctggatattagccctttgtcaggtggagagattggaaaaattttctctcattctgtaggttgcctgttcactctaatgctagtttcttttgctgtgcagaagctctttagtttaattagatcccatttgtcaattattgctatattttatggctcagtttgactgtctgtggttcttaaaaacttttagtcctgattgcacacctctggctcagacttttgaatctggttttcaaggtatatctatgactggatgttctcgttgaagtt

SEQ ID NO: 87193 - DNA, 601 bp, Human
ttctggttctagatccttgaggaatcacaaggattccacaatggttgaactaatttacactcccaccaacagtgtaaaagcattcctatttctccacatcctctccagcatctgttgtttcctaactttttaatgatcaccattctaactggcatgagatggtatctcattttggttttgatttgcatttctctaattaccagtgatgatgagctttttttcataagtttgttggttgcataaatgcctttttttgagaaatgtctgttcatgtcgtttgcccactttttgatgggattgwtttttttttcttgtaaatttgtttaagttctttgtagattctggatattagccctttgtcaggtggagagattggaaaaattttctctcattctgtaggttgcctgttcactctaatgctagtttcttttgctgtgcagaagctctttagtttaattagatcccatttgtcaattattgctatattttatggctcagtttgactgtctgtggttcttaaaaacttttagtcctgattgcacacctctggctcagacttttgaatctggttttcaaggtatatctatgactggatgttctc

SEQ ID NO: 87194 - DNA, 601 bp, Human
tcccctagtcccccgaccccccaacaggccctgtgtgtgatgttcccctctctttatccatgtgttctcattgttcaactcccacttataagtgagaacatgcagtgttcggttttctgtttctgtgttagtttgctgagaatgatggtttccagcttcagccacgtccctgcatgtcccatggctgcatagtattccatggtgtatatgtgccacattttctttatccagtctatcattgatgggcatttgggttggttccaagtttttgctattgtgaacagtgctgcaataaacatamatgtgcatgtgtctttttagcagaatgatttataatcctttggggatatacccagtaatgggatggctgggtcaaatggtatttctggttctagatccttgaggaatcacaaggattccacaatggttgaactaatttacactcccaccaacagtgtaaaagcattcctatttctccacatcctctccagcatctgttgtttcctaactttttaatgatcaccattctaactggcatgagatggtatctcattttggttttgatttgcatttctctaattaccagtgatgatgagctttt

SEQ ID NO: 87195 - DNA, 601 bp, Human
acactcccagcggcccgggcagtgagggacttagcacccaggccagcagctgcggagggcgaaccgggtcccctagcagtgctggcccaccgaggctgccctcagtttctcgccaggctttagctgcctccctgcggggcagggctcgggacctgcagccaaccatgcctgagtctctcccactccccccactcccccagtcccccgtcaccccctccgcaccgcccgccccctgtcacctcctgcccctccccctccgccatgggctcctgcacggcctgagcctccccaacaagcactkccccctgctccacagtgcccggtcccatggatggcccaagggctgaggagtgccagcgcatggcgcgggactggcgggcagctccacctgcggctccggtgcgagatccactgggtgaggccagctgggctcctgaggttagtggggacttggagaacctttgtgtctagctaagggattgtgagtgcaccaatcagcactctgtgtctagctcaaggtttgtgaacacaccaatcagcaccctgtgtctagctcagggtttgtaaatacacccattgacactctgtatctaggcaatag

SEQ ID NO: 87196 - DNA, 601 bp, Human
cacactcccagcggcccgggcagtgagggacttagcacccaggccagcagctgcggagggcgaaccgggtcccctagcagtgctggcccaccgaggctgccctcagtttctcgccaggctttagctgcctccctgcggggcagggctcgggacctgcagccaaccatgcctgagtctctcccactccccccactcccccagtcccccgtcaccccctccgcaccgcccgccccctgtcacctcctgcccctccccctccgccatgggctcctgcacggcctgagcctccccaacaagcacytccccctgctccacagtgcccggtcccatggatggcccaagggctgaggagtgccagcgcatggcgcgggactggcgggcagctccacctgcggctccggtgcgagatccactgggtgaggccagctgggctcctgaggttagtggggacttggagaacctttgtgtctagctaagggattgtgagtgcaccaatcagcactctgtgtctagctcaaggtttgtgaacacaccaatcagcaccctgtgtctagctcagggtttgtaaatacacccattgacactctgtatctaggcaata

SEQ ID NO: 87197 - DNA, 601 bp, Human
acccgggctgcaccccacgcttgccggccagctagagttctgggtgggcgtgggcttggtgggccccacactcccagcggcccgggcagtgagggacttagcacccaggccagcagctgcggagggcgaaccgggtcccctagcagtgctggcccaccgaggctgccctcagtttctcgccaggctttagctgcctccctgcggggcagggctcgggacctgcagccaaccatgcctgagtctctcccactccccccactcccccagtcccccgtcaccccctccgcaccgcccgcccccygtcacctcctgcccctccccctccgccatgggctcctgcacggcctgagcctccccaacaagcacttccccctgctccacagtgcccggtcccatggatggcccaagggctgaggagtgccagcgcatggcgcgggactggcgggcagctccacctgcggctccggtgcgagatccactgggtgaggccagctgggctcctgaggttagtggggacttggagaacctttgtgtctagctaagggattgtgagtgcaccaatcagcactctgtgtctagctcaaggtttgtgaacacacca

SEQ ID NO: 87198 - DNA, 601 bp, Human
agggagaggcagggaggggaacccgggctgcaccccacgcttgccggccagctagagttctgggtgggcgtgggcttggtgggccccacactcccagcggcccgggcagtgagggacttagcacccaggccagcagctgcggagggcgaaccgggtcccctagcagtgctggcccaccgaggctgccctcagtttctcgccaggctttagctgcctccctgcggggcagggctcgggacctgcagccaaccatgcctgagtctctcccactccccccactcccccagtcccccgtcacccsctccgcaccgcccgccccctgtcacctcctgcccctccccctccgccatgggctcctgcacggcctgagcctccccaacaagcacttccccctgctccacagtgcccggtcccatggatggcccaagggctgaggagtgccagcgcatggcgcgggactggcgggcagctccacctgcggctccggtgcgagatccactgggtgaggccagctgggctcctgaggttagtggggacttggagaacctttgtgtctagctaagggattgtgagtgcaccaatcagcactctgtgtctagct

SEQ ID NO: 87199 - DNA, 601 bp, Human
catcaagtcctcttattgatcttagcaggaaaacagtgttgagaggtgacagcatgctggcagccctctcagccctcactcgctctgggtgcctcctcggcctcggcacccattctggccgcacttcaggagcccttcagcccgccgctgcaccgtaggagcctttctctgggctggccgaggctggagccggctcccttggcttgcggggaggtgtggagggagaggcagggaggggaacccgggctgcaccccacgcttgccggccagctagagttctgggtgggcgtgggcttggtgrgccccacactcccagcggcccgggcagtgagggacttagcacccaggccagcagctgcggagggcgaaccgggtcccctagcagtgctggcccaccgaggctgccctcagtttctcgccaggctttagctgcctccctgcggggcagggctcgggacctgcagccaaccatgcctgagtctctcccactccccccactcccccagtcccccgtcaccccctccgcaccgcccgccccctgtcacctcctgcccctccccctccgccatgggctcctgcacggcctgagcctccccaacaa

SEQ ID NO: 87200 - DNA, 601 bp, Human
gtgttataatttataagttcttgtacataccaagtactctacatgtatagtcctgttaaatcctcacagcagccatctgaggtaaatacttttgtggacaccattttacagattaggaaatgaaaattagcaaggtgagctaacttgcctaatacatagaaaagctggggtttaaattcagctgcatctggttttagatactttgccactatactataattaaagtataagtgtacacataataaaacaacaacatacaacaaacacaaaaataggcaagaaccaagcaacacacaaaggkgtagaataattacacctcaaaacctaggttaagagaaagtgaggcaatttgagctttttcaaagcaaataggttgctagctattataaaactacttactgctactattattactgcctacttgaagaatgtctcagctctaacagcaattttccatggttttctctatgaacaatactgaataacatgagttattcaaaggatttgccgggcttttaaaaatagcccatttgtgtgttattttattgttatgttatattattttaattagggttcatttatttttctggataactaaggc

SEQ ID NO: 87201 - DNA, 601 bp, Human
gagaagagattccacataactgagtgttgaccatggcttccaaggaatgtaaatggcctcctttaatgtttgtccccctgttcaatgaccttgctcattgccttcaaatgcactcttctttaagtatattccctttcccagacctggaaaagtggacaaaaggcaaggggactgattctaccccagactagacttaagtaagattatggaaaaagcactggggtcattattttctagtgtttggaatgtgtgtatgtgtgtgtctgtgtgtaaatcagtataaaatatatctccacagcaycaaatacactaaatgttctagtcacccagaaaatattccattaataattattggatcaacaaatgaattttcatgtccccttccaaataatgttttaatattaaatgtaattacttgatgattttggaagattagctttgacatctataatttttaaattctaatggttgaacagaagtaaacatgaattctgaaagcatatctctcctctgtatatgttaacacttacttgattagctcttaatttttgccagtgcccttaacttcgttttggcccatctttagtatagttactcatac

SEQ ID NO: 87202 - DNA, 601 bp, Human
tctattacatgttgtaaatttcatatgtagactcttttgccttcatttaaatatttataaaaatttggtccttggagccccttggagtgtgcttatataaaaaacagattcctagtacttatctcaaacttactgaatccaaatctctggggggtggggtcctggtagttttagtttttacccagtctccttgatgattcttctgcaaaggttcagaatctcaatttaatgatttcactgaatctattttgctcaatgcactcctgtgcctataggaatcattccttgactacaaactcayggtaggtgggtgaggctggcctgcagagcaatccatatgtcatggagaagagattccacataactgagtgttgaccatggcttccaaggaatgtaaatggcctcctttaatgtttgtccccctgttcaatgaccttgctcattgccttcaaatgcactcttctttaagtatattccctttcccagacctggaaaagtggacaaaaggcaaggggactgattctaccccagactagacttaagtaagattatggaaaaagcactggggtcattattttctagtgtttggaatgtgtgtatg

SEQ ID NO: 87203 - DNA, 601 bp, Human
tccagtaaagaccacagatgatgatctggttggactacagacaccggctggtgtggggcagtctaccctgccagctcttcttgctcctctctcattactttctagccactaacaagccagtctttcttttcctcaaatactctttctgtagggtgtctacagccttttctagtctctctcctttaatgctcaatccaaaagctatatacttcctctgagaagccctttctgaccccctggtttagatcaggtttccttttatacatttccgtagagcatgttccttgcttttacaacactyctcttggtttgtaatcgtgtgtatatttgagtgattatttgattactgttttcccacctccctctgtataatcaaaacagttaccataaggccaggaatcatgtcttgtttttctcatagcacatcccaagtgtctagcacatacaggcatctaataaatagttgttgaacaaatgaatgcatgaaatgaaggctggctggatggctggatggctggttgggtggctggctggatgagatgtgtgccttttctgaattccctgtgtggtttttggtaagtagatctctggtgcctaggct

SEQ ID NO: 87204 - DNA, 601 bp, Human
caagaaagaaaacaaaatgtaaatgatctctcttaacatgaaatacattcctaacaaaagaaacctctctatttcacagacctactttgtttttcctctctgtccagtacatattgctttgtgatatgtaaaatagtaagttggtggtagaggaagaaggtagaatgctttgttctacttcacacaaagatgccacatttgcaaacagcagccctattttagccgattcagggtgcttaggaacacaattttgttttctctgggttacaaaggggataaactagtttgaagtgtatatttmttttgcagtaataaacataaattacatttaagttgtgtttggttcaacttaaaactcactttgtattaattttattttctaaagagaaaaaattaaaatattccattttgttcagtgacacttaagatactcaactaaaatgtcatagactatttagttgatctcactatttatttgattagatttgctttataacatcctattttgaaaagctgtatgaaaataccgatttcatgacccttaaagggttcattgtcagattgagatttgtctgttttccagattatccagattaataat

SEQ ID NO: 87205 - DNA, 601 bp, Human
aaccaactcacattaacatcaattatgaattttaaagtctgaatcaaataaaaaataaagcctattattttcttagttgtttcattaaccccaaataaataattatgtatattgacagaaagtcgaataaatctctgaatattaatagctagccagatctaatctttatttagagtccttaaataagagcttggaccaaatttcatgttgtctgaagctagtctgggaaacttgtgaaaaccatatttttcctgagctttctggcacaacgcattctggctgagtataaggataaagtttytgactgctatatttaaagaagtctatccatgagcttgagattttgcggaattctcagatgggtttcaatttatcaaaactcttcccgtttttaaccactaaaatagtcatgaatgtatttttttttctttcaggcagggaaatttaacaaaggccaaaatcaaatggctcctcttttatttacatgattaaacacttcaaaaatttaaacacttactaatttactcccaacaggcgaccagcataaatactgaattggacgaggaagctcatttcctcttacaaattctctagaaggaaa

SEQ ID NO: 87206 - DNA, 601 bp, Human
taagatagccaaaacagaaagaactataattgtactagagagtgacataaacattgaaagttacatttccctcctaagagttaaaaaaaaccaaaaacacagttagtttagatagatagatagatagatagatagatagatagatagataaatagatagagactagaagtctctttaaagtccaattaagtcctgaattctacatgacctagaatgagaacaaaatcaacagagtatcagaaagtaaaaatatgttcccataagataacatagtcagttgtttagttttgaaaaaaaaaawtttctaaagaaaaagtaaacatgagaaaatgtactaatgcggcacctgaggaccatatacttttttggattataaatcattactaccacttcatagtgatgttattgagaatcaattctaccagttttctgataacaagaatttgttcttttaaaatacgtatgccctattcgtaacctagagacaattttcagcaatgctacccttcatggaaataagatactactcatctaaatcttactaaatatatgaaattattttaaattaaaagcctaaagcattagcagtagaaaaggaata

SEQ ID NO: 87207 - DNA, 601 bp, Human
tttttttttctgaattacatacttatctttattatcttgttacctcagagtgtaatttacatttattgtatataataaataaagtaactattccctagttaatgaataaaactgcagtatctttaattaacggcagagtataaattaaacagcatgtaagccaaaatcaactggatccagaaaagtgtacaatgaagagtttttaatatttgaagattatcactttacagtttatcttcttcccagccaatttgagtttaaatttttatataatttatcatcttagaatcgatttctgacwtttttttgtccttggatcatgggctaatgtgttaaaccaggtcctaagagtttcctttttcattgcataatgcgtccaaatcttagagaagtagcctttcctcttcaaatactaattgaattgaattatgtgtttgtggtaagtggcagcatctaccaaccttcacttattctcttgtattaatttttattcttcatatacgatataaaatacaattgctatttacctcaagcgttattttacattaaaaatcctcataaattattgaataaacctatcctaaacttccaaatataaatg

SEQ ID NO: 87208 - DNA, 601 bp, Human
aaaaaaaaaaaaggtctaaagctttgcaggcaattcattcattcattcagctcaatttgatgggaatgcaagtttagtgcaatacagattttttaaattattaagatactgaagatgcttataaatatgagctttcaaaagatgcattctaaagtgtttcagtgttttgaacactgcagcattgtcaaaataaatgtttatagatgctcaagataatgtctttgaaagggttgttggtatcattgttgatataaaagtacattattcatataactgtatagtaaatctagttatagtatcrtcttggagaacatgactaaataatattttcaagcattctttcttcccttcgttctttactagaaatatttgtaatgggagtgaattggtagattttttttcctcaaaatttcaaataccgatctaagaattacctttctgaaaggtgagattcagattgattaagaatacataaaatttagagaatacttttctttcactgaatactactactctttttttcctgtgatatttaggacagtaggaaaagtgagttcaaataggagggtttttttttttttctgaattacatacttatctt

SEQ ID NO: 87209 - DNA, 601 bp, Human
caaagccatttaaaatattttacctggaaggtgacattatttaccgccatgtaatatcttgccatagctgttaaatgacctaaagcggatgccctaaactgagtgcacattcggtcaaaagcacaagctttcaagcatcaagaagaaaattcatttttttttgaaccaagggattttgccagccgcctaaagacggtgtagtgtgttgcttaaattattttaaaataattgatgtgactttgcagtctaagcatgatgccttcagtgcttgttctccaaatttaaggaatgaagcactagkttcctttgattaactcttcacttttctgtcctctacagagcaaaacaaaacaaacatgttttaaaagcaattttgttattttttctgattaataccaaaaaagaagttaggttattaatcctaacttaaaggactggatgtgtcagtgctggaggaaaaaagtggtaagtaaagttcgcaggaaacctattttctagttctgtgcctgcaactaacagatcatttacttttagcaagtcatttaatctcccttttctaattcataggtgatttctgagagtctttttccattttaaatat

SEQ ID NO: 87210 - DNA, 601 bp, Human
aaattgaggatatcacactggataccacacacagggcatgtcaatttagccagatgcaaaagaagtcataagagaacatgcttttacttaagtatccaggttctgattccaacctgtcttaaaatagccatgaagtgggaaattcagtttcatgacatggttttcactctgctgtatgttcatctgagtatcagaaactgtcattatttttcccccacgaatgtgaaaagtttgggataaccgaagtttggttgaattcttaggacaattaggcagtccagttctcactatgtcccaggtrtcatgaaaatcttattagcaccaagtagaagaaaaaagcaatggaatacaactcgtttttagcacgaaatttatttcctaaactaacacctttctatgcatctttataactttgcatgactcccatcatcccttttccttgccctccccacatcatctaaaactatctgtgaataaaggactcaggatctttccccaacagcccccggccacttccttgttatgtggaagcttccctgattgtctccctctctaacccttgcagccaggtccagtttgtctcttttctctctctttttcc

SEQ ID NO: 87211 - DNA, 601 bp, Human
tggagaattagagattcccgagtcagttttccaaatctccataatgactacttagaccccaatatatttcattgatctatattggcctcttaacctaacctgttttattgtttgccacatgctcaagatatagataaaaggttgcacataaaataaaattatatgggtagaaattattcattaaatgtacgtatgtcctaaacaaccaggaaatgttttgtagattttattacttatggtttgttatatttgatgcattacttacgatgttttccaaatttagaaaggacaaaggttcatyttctatccccattgaaactacagtttgaggaatgattgacctccgacgtgggcatctcgggtttccaagccgttgttcattcccctggatgtgagagtttgatatttctctgggcaaagggggccaaaagtccagcaaccattttatcagagaacatttctttttctgcgattgctcaggtcttgcgaagcctagctgacgggttgcctctgcacgcagtcttagtgctgtggaatgtggtggttaagagcatgggacttagaggcaacagcacttgcttcagtcctggctgatgcttag

SEQ ID NO: 87212 - DNA, 601 bp, Human
ctgctacttcactgactaattcaggcctttgatatctgtccctggtattactactctcctagccccttggcccatcctctccccaaatctcagattatcctccactttgcagccaagattatctttctaagacaccaataccttgccctattgacttcaagagcactttaaaaattgatgtccatagaaaacattgtcaatatgtgttctgggatggtggaggaataaggaattgtggaatcaaatactttttggtaatactgtgttaaacaaaacttgacaggttttttttttttttttktgctagtctttctagagcctatatacactattacatagaatttgtgatttgccaaattattagactataggacattttcctgaaaaatctcctggtactagtgggacacatttgaggggagacattgatttataggattaaagtcagtttaaacaacatcatagatgcttgctgtggccaagcattgtgctaaacaaacacaattctagctttgggctcagaaacaaagctaaaatgagacacagtccattcctttgatgaacttacattcttatgagagaaactaacagacagacaaga

SEQ ID NO: 87213 - DNA, 601 bp, Human
tcagtacattttttaaaaacaaatgttgaaaagatgggggtctccttttcggggttcttgttcaacttaagcaattgagggagcatttgtgagaggaaaaggtagctaccaagaatgctgccccgcccccaactttggctttcactttattttcttttctggttcaatttctcattcctcaagcaacctggattttacatttagctaattcattcattcactcagtaagaagctgagcatctgtgataagccaggtgtatgccaggggatgagaatacataggtgaaaagttctctaaccmcaaatggagccatatgatttcagggagccttggaggtttgtgatgacattctgcaactgcttcttactgaacaaacagaatcttctagctgtttaaggatgctcaggttttgcagggactctaagcatataattgcacttattcacataggatttcagaactactggatgtttgaactagaagatcatttaatcttgtgaactcctttattttacatgactcaactgggaacacgagaggtgatctggtttgcctcgggtccttcagtagttaaagaaagatccaagattcatttgctaa

SEQ ID NO: 87214 - DNA, 601 bp, Human
gtggtcacgatgtaataatatatatttactaagttgaatttactttggggatcacaataaaaaaggtcagaaaaagctcacctccctctttgtatatttttaaaaatttgatatataatagttgtgtatctttttgggggtacagtgatattttgatagctgaatacaatgtgtaatgatcaaatcaagataactgaaatacccatcacctcaaacaaatttccttttatgttgggaaaattataattattctcttccagctattttgaattatacaatcaattatcattgaccataattyccctactgtactttcaaatactagaacttatttttttctgtcttttgtaccccttaaccaacttcttcttataccccctcccccatttctttcccagtcagtacattttttaaaaacaaatgttgaaaagatgggggtctccttttcggggttcttgttcaacttaagcaattgagggagcatttgtgagaggaaaaggtagctaccaagaatgctgccccgcccccaactttggctttcactttattttcttttctggttcaatttctcattcctcaagcaacctggattttacattta

SEQ ID NO: 87215 - DNA, 601 bp, Human
aaggctaaggatataataaattagacaagctcctgctctcatggaggaatccaacctatacaaacaagaaaatgagttaacatccaagttgtaagcacgctaaggaatataaacaggatgaactgacaaaggatgactgttgcgggtggagagctactttacattagggtggactgggaaggcctctctgaaaaggtaacaatgacatgagacctgaaaaaaggcaagggaaggagccagtcaaaaaaaggtctgaagggggttccaggcaagggatctggcaaatgcaaaggtcttgccrtaggaacaagcggttggaatgacagctgatggagactaaacccaagtctccagcctctggctcccatgttttctccacttggaaatatttctgtctcaatgtccctagtcattatatacttcttatgtaccatttgattttttaaaaataaaatggtatgactcagaacctaggctttggaggcagatatctacaggttcaaatctctactctgccactgacttaccagctgtatggcctgggacaagttactcaacctgacggtttctcattttaaaaaatgacttaacagctatttca

SEQ ID NO: 87216 - DNA, 601 bp, Human
actccagccacaggccattccagttccttttggggttttcaaacatgccaaacttgctcccatctccagttctctgcacttgacttccccatgcctgcaacagcctggaaggcccatggttgctttccctcattatacaaatatgagcttaaatatcatctcagaaacctgttcatcctaccaaaaacgtaccacctccaataaatctccagcatatcactccatttcctctatagcatttggtataatctgcagttgtcttatttatttgtatatactacctaatgcgctcactagaatrtaaactctgggaagatattgcttcagatgctccactgctaccctgttagtccacatatttccaccaccctataaaagggcaagaacagattgctcaataatttggctgctagaatgttttcaatgctggaccagcccttcatttaagataatcaggactgagcagaattttcctggtaagccctggggcttatgaaatcaacatactctaatataggtgctccatatataaatattgaacaaataaatgagctaggatccaagtggctttgcgacaagcttggacaaaaagagagataac

SEQ ID NO: 87217 - DNA, 601 bp, Human
tgcctccccacccacccccctagtgtggagtttccctttgtaagagctggcacctagccagggcctcagaacttcaaggagtaagtctataaactgtctgtgtctagtacatggtagacatctagctcaggacagtttaagttaataaatgaaaagcggtccaccataagccagctaacagttggttctgactccgtatcacacagcctggcatctgtgctcatctttagcaggccagaagttacctgtctttgctgctcacctcctgcattcttgccccttaagtgccaattatgcgatrttaacaatcctgtgcacaggtatgcacctccatgttcacccattccagcagtggctgcctgccaactttctgagctgggaggtcacccacctagattttgtggagccggtccagggccttctaacccccaggataccccaaggaatgtcctaatctggtgacagaagcagttcagggctctctagtggtttctatggagattatctgggcctccacttattttcttcttgtactactgcaattatggaactgagaataattctgaactcttgttcgcctagctttgcaccaacaccaaca

SEQ ID NO: 87218 - DNA, 601 bp, Human
atcatgcaagttttaaggtcaaagaggagacttcctctgctttgtcttgggcctccgagaggatgtattttcaatgaatgttcaattataataaaggttattattattattttttgaaatggagtctcactctgtcacccaaggcagagtgcagtggcgtgatctcagctcactgcaacctccacctcccaggttcaagcgattctcttgcctcagtctcctaagtagctgggattacaagcacacgccaatatgcccagctaatttttttgtatttttagtagagatggggtttcgtcaygttggccaggatggtctcgaactcctgacctcgtgatctgtccacctcggctgcccaaagtgctgggattacaggcgtgagccaccaagcccggcctataaaggtgactttttaatgattaacaagctaaacatatttttttggaaaagagcaaacttgcaacagagtacttcacaagacaaagaggtgcttatctggagggcctccctctgagcaagatagaggaggcaggagacatccaaggcggcccactatcttcatgccaatacccgtcaggccaatacccaacatgatgagatg

SEQ ID NO: 87219 - DNA, 601 bp, Human
ggtctgcttgcagaacaaaggctccttctgtgacatcaagcagcaggtttaagagctccctggcttctggctttggccctctttcaaaaccacaagtacatccaagggcagccaagacaacaacaaagccaagagatacagtcaccaaaagagaagaccaactcccccttccaggcctgccttctgcctggctctcagcaggcaaggctccattctccccaaagtaggtgtccaaagcactgaatacaagcagggtactgacccctgtgcaagaagatagctcagaggatgcccacagctkgtgccaacattcttcggaggctatggaacacactgtctggggaaggccctataatactttctaggttctaatcctagctcagttatccattaaggtatgatcttaggtgcctcaacatccctgaacccatttcctcaactctaaatgatgacactgatgatggtgataacaatgttcataatgaaatctgctatgtctctcacacagggttacaatgttcaaacaaggtagtttatgaacatatcctttaagctatctgaaaactataaaatgtaggagataacaattaataatattagg

SEQ ID NO: 87220 - DNA, 601 bp, Human
agaaacctgggtctgcttgcagaacaaaggctccttctgtgacatcaagcagcaggtttaagagctccctggcttctggctttggccctctttcaaaaccacaagtacatccaagggcagccaagacaacaacaaagccaagagatacagtcaccaaaagagaagaccaactcccccttccaggcctgccttctgcctggctctcagcaggcaaggctccattctccccaaagtaggtgtccaaagcactgaatacaagcagggtactgacccctgtgcaagaagatagctcagaggatgsccacagctggtgccaacattcttcggaggctatggaacacactgtctggggaaggccctataatactttctaggttctaatcctagctcagttatccattaaggtatgatcttaggtgcctcaacatccctgaacccatttcctcaactctaaatgatgacactgatgatggtgataacaatgttcataatgaaatctgctatgtctctcacacagggttacaatgttcaaacaaggtagtttatgaacatatcctttaagctatctgaaaactataaaatgtaggagataacaattaat

SEQ ID NO: 87221 - DNA, 601 bp, Human
cacctccacttagacatgcatgcatctcaaacttagcaaaccccaaacagaagtcctgattctcagcaatctaccataacccccttccctaagaaaatgcaatcaaccaaacaaataaagccttggtcctctcccaagcttccctatctcagcaaatgccctatcccatatacccagctgcctgagccatgcttgactatacctctcccccaccccaccatatccaaacctcagcagatatggcagactgtacctgcaaactatatctcgaatccacagacttctctcctctaccaccacsctagtgcagaaccccacctgctccctgtacttttacaaccacctcctgccttccctcctcatcctcttctccatcaatcctcctccacagggagacaaagcaatcttctaaaaactgatcgtgccattcccttgcttaaaatcctttaaaggtagatttccttttgccctacagagaaaatctgaagtccttacccaaatctagaccagtgctagccaataaaaacacaacgtgagccacatgggtaattttaaattttctgatagtcaatttaaaaaatagctgaagttaattttaatc

SEQ ID NO: 87222 - DNA, 601 bp, Human
agcaggttcagactggagtcagtctttcattcacatccttaaacagaagagctatctggatggccacatacctcttcctcctttggaactggggtcacagcattgtttttaattgtcctgaactgtgtttctctttttaaacttgaggccatgggattgtgtttatcatgtacctcgaccttgggaatcctttttcttacagtctagggtagactatagacaagaacacatttccctccctggctgtcagagattctaaggcctgattacttctaaaatgcctggttctttcatttcaacwgcgagttcctacttttctttttactttgagacggagttttgctcttgttgccccaggctggagtgcaatggcaggatctcggctcactgcaacctctgcctcctgggttcaggcgattctcctgcctcagcctctcaaatagctggacttacagacatgcaccaccacgcccagctaattttgtatttttagtagagacaaggtttctccatgttggtcaggcttgtctcgaactcctgacctcaggtgatccgcccacctcggcctcccaaagtgctgggattacaggcgtgagccacc

SEQ ID NO: 87223 - DNA, 601 bp, Human
aggtatgatttgggcagccatgtgtgaccaactccgatggtcagaatattaactttagttaatgctcctgaaaatcacgggagcttctttaacagccatagcatgctgctgactcattctgaggctgcagttctccagatcttgaaatatttttcgtgtgtggctgtttagccaaaccccatactttcatttgtaatgaatggttttggactctggtgctagtctttctttctccctctcaagttgtattcaactaggtttggtttgctgtttcaaaataccaagatctcttttttttaawaaaaaaatctcatttctgttgctctgacctattaacaattcccctagatttgtcattcatgtatgtgatctgtatgccaatattattgtctagaagatttttttaactgatgaaaacaggggacacagcctccagcgtgcttcctgtattatcatctagcctgaattttcctcaccccacggatagcaccagtgactgatttgcatgcatgccttctcaacattcttctaagcttccaaccaagtaaccccaggaactaaagttaatctggtatgactggcttttagcaaagccctgata

SEQ ID NO: 87224 - DNA, 601 bp, Human
caggtatgatttgggcagccatgtgtgaccaactccgatggtcagaatattaactttagttaatgctcctgaaaatcacgggagcttctttaacagccatagcatgctgctgactcattctgaggctgcagttctccagatcttgaaatatttttcgtgtgtggctgtttagccaaaccccatactttcatttgtaatgaatggttttggactctggtgctagtctttctttctccctctcaagttgtattcaactaggtttggtttgctgtttcaaaataccaagatctcttttttttawaaaaaaaatctcatttctgttgctctgacctattaacaattcccctagatttgtcattcatgtatgtgatctgtatgccaatattattgtctagaagatttttttaactgatgaaaacaggggacacagcctccagcgtgcttcctgtattatcatctagcctgaattttcctcaccccacggatagcaccagtgactgatttgcatgcatgccttctcaacattcttctaagcttccaaccaagtaaccccaggaactaaagttaatctggtatgactggcttttagcaaagccctgat

SEQ ID NO: 87225 - DNA, 601 bp, Human
ccaggtatgatttgggcagccatgtgtgaccaactccgatggtcagaatattaactttagttaatgctcctgaaaatcacgggagcttctttaacagccatagcatgctgctgactcattctgaggctgcagttctccagatcttgaaatatttttcgtgtgtggctgtttagccaaaccccatactttcatttgtaatgaatggttttggactctggtgctagtctttctttctccctctcaagttgtattcaactaggtttggtttgctgtttcaaaataccaagatctcttttttttwaaaaaaaaatctcatttctgttgctctgacctattaacaattcccctagatttgtcattcatgtatgtgatctgtatgccaatattattgtctagaagatttttttaactgatgaaaacaggggacacagcctccagcgtgcttcctgtattatcatctagcctgaattttcctcaccccacggatagcaccagtgactgatttgcatgcatgccttctcaacattcttctaagcttccaaccaagtaaccccaggaactaaagttaatctggtatgactggcttttagcaaagccctga

SEQ ID NO: 87226 - DNA, 601 bp, Human
caggagaggtctaaacagaagctcactgctctgcagtcaggggcagattcaccttccatttctgatgtctagagttaaaaacaattcaccaggtatgatttgggcagccatgtgtgaccaactccgatggtcagaatattaactttagttaatgctcctgaaaatcacgggagcttctttaacagccatagcatgctgctgactcattctgaggctgcagttctccagatcttgaaatatttttcgtgtgtggctgtttagccaaaccccatactttcatttgtaatgaatggttttggaytctggtgctagtctttctttctccctctcaagttgtattcaactaggtttggtttgctgtttcaaaataccaagatctcttttttttaaaaaaaaaatctcatttctgttgctctgacctattaacaattcccctagatttgtcattcatgtatgtgatctgtatgccaatattattgtctagaagatttttttaactgatgaaaacaggggacacagcctccagcgtgcttcctgtattatcatctagcctgaattttcctcaccccacggatagcaccagtgactgatttgcatgcat

SEQ ID NO: 87227 - DNA, 601 bp, Human
gtgtgtgtgtgttttctctaatacgcggaagacctagaccttcctcccactacactctatgagttcactaagggaataaaacattggaaggagagagggaacaagagagaaatgttgttcttggattgacaggccccctcattaaggagataatttagccacaggccagcgaccgaactgtgatggcctcagacagaactccctcagcaacagaacagcactgctgccagagcagcgcctggctccccagccccaatgagaccagatgttttcaaagtgatactgtgagaggctggctgaacttgttgaaaatgaatctctctgaacatgtttaaaataccagggagaaacttaatcagggagataaccaagagaacagacagagtttaccatagggccatttctatctgtttaccaggaaaaagagaaaacaaacaggcttaaaatgggacacgcctggtgagtgcagaaatgacatttttggaaaaatatcagctagtgtgtgcttagattagcaggttatttactgatgttgggaatcatattaaggtcccaataaagagttactttcttactgcaggcaggggaatattgtgcatat

SEQ ID NO: 87228 - DNA, 601 bp, Human
atattttttagatgacaatcacggttctaaggtcttgcccaactcaccagcctaatctcctcaccttgctccttacactccagcaaatttaactacttggaattacctgtatcaataggcctggggtccccatcctcttctcattcatccctggcttctctgaccacacgttcccacccccacccacacacacaactcatacaatcagtgacatctcctcagtgctcctttcctatgaattataaaactttgtgatgacaaacaattacaattcgatataccatgtgtattcccgtctatstcccttactggactatgagctcactaagaacagggaccacactgtattcacctttgtacctcccgtgcagttgctccatgtatgttggtttgaataaatgaacgtgtgtgtgtgtgtgtgtgtgtgtgtgtgttttctctaatacgcggaagacctagaccttcctcccactacactctatgagttcactaagggaataaaacattggaaggagagagggaacaagagagaaatgttgttcttggattgacaggccccctcattaaggagataatttagccacaggccagcgaccgaact

SEQ ID NO: 87229 - DNA, 601 bp, Human
ataggaatttgaattcccaaccaacataaagacttgacccgtggttatggattcttaggagaaaaattattgccattattttttcccatcagcatttgtgtagagacaataggtttcttttttggttccctgaaacagaaaatcaaaataatcctataaacatttaaaaaaacctgaagaagtagttcaatatcttcccacaaagaaaatatcaggcctatatagttttactatatagcaaattcttccaaactttggaattatttattacttgaaaattatatgaactcttccagagacraaaaagagggcattataactttgataccaaaaacagacaaagtcagtaaaagaaaagcataggctaatatcacatgagtaggtatgaacaaatcctaaaaaagtattgacaaaccaaatccaagaatgtataaaatatatatcataatcaaataaagtttattccaggcatatacagtttaacatgagaaaacctgttaatacaatttaccacattcacagattaaaagagaaaaataattttgaacattgaattgatgaaaaaagcattaaaagaatcctttaagtctgatgtatggcc

SEQ ID NO: 87230 - DNA, 601 bp, Human
tctttggtggtctagttttattgcaatgtgtctaggtgaagatttaccatttctcattattatttaaaatttgaccattgctttttcctttctctcaattttctccttctagagctctggttaaatgtacttggggcttttccttctccttcagtgtctctttcatactttccattgccttttctctctgtgctatgttctgtgtgattactttctgtctttaattcataagtattttctccagtcatatctaatttattatttaacctagccattgggttttatatttttattgattatwgttttttatttctagaaattatagtaggttctttttatattttcctgtttattctgagaccacttatgattttatctttttaaaaaaaaatgtaccatacatcgttattttatagcctgtatctgatattccaatatctgaagtctttttttttttttttgagactatctcacttgtcacccaggctaaagtacagtgcacagtcatagctcactgcagtctcgacctcctgggcttaaacgatcttcctgctgcagcctcctgaatagctaggactacaggcatgtaccaccacaccca

SEQ ID NO: 87231 - DNA, 601 bp, Human
accattcaggtctctgttcacacaccacctcctccgagagaccttccttacctagcctatttagatttgccccaccactcccctctatctgctaatctggctttatttttttccatcatacctgatattatagtaaatgtctgtttgctcagggtctatctttcccctggaatacaaccctccaagggtgaggctttgtccagtttactcaccttggtaccctcagtgctttgcacatggcagttgcccagtgagcatttgctggattcttgagtaagagaacaataaacctaagcgcagygttcggggcagcagcaggaacagtaaggggctgggagctgaggctggagaggaggcagggccaggtcacaaggggcttggatgccacacaaacatgcttagactttatcatgatagcaatgggatttattgaaggatcttaagctggaaaataaccagagatttgtgtttttgaaaagtccccctgcagcagcatggaaatcagattagctggagggcaagatagactcagaaagcccaaagaagaggatgttggcatcatctggatgagagatgatgatgagacttgaactagagtgtg

SEQ ID NO: 87232 - DNA, 601 bp, Human
ctgcttcagtgccttggtactgactactcttttgcccagaatattcatccccagatactcaggggcttgctccctcccaccattcaggtctctgttcacacaccacctcctccgagagaccttccttacctagcctatttagatttgccccaccactcccctctatctgctaatctggctttatttttttccatcatacctgatattatagtaaatgtctgtttgctcagggtctatctttcccctggaatacaaccctccaagggtgaggctttgtccagtttactcaccttggtacccycagtgctttgcacatggcagttgcccagtgagcatttgctggattcttgagtaagagaacaataaacctaagcgcagtgttcggggcagcagcaggaacagtaaggggctgggagctgaggctggagaggaggcagggccaggtcacaaggggcttggatgccacacaaacatgcttagactttatcatgatagcaatgggatttattgaaggatcttaagctggaaaataaccagagatttgtgtttttgaaaagtccccctgcagcagcatggaaatcagattagctggagggcaaga

SEQ ID NO: 87233 - DNA, 601 bp, Human
tactgactttttcttcctgttgctcagacatgccaagcctgcctctgcttcagtgccttggtactgactactcttttgcccagaatattcatccccagatactcaggggcttgctccctcccaccattcaggtctctgttcacacaccacctcctccgagagaccttccttacctagcctatttagatttgccccaccactcccctctatctgctaatctggctttatttttttccatcatacctgatattatagtaaatgtctgtttgctcagggtctatctttcccctggaatacaacyctccaagggtgaggctttgtccagtttactcaccttggtaccctcagtgctttgcacatggcagttgcccagtgagcatttgctggattcttgagtaagagaacaataaacctaagcgcagtgttcggggcagcagcaggaacagtaaggggctgggagctgaggctggagaggaggcagggccaggtcacaaggggcttggatgccacacaaacatgcttagactttatcatgatagcaatgggatttattgaaggatcttaagctggaaaataaccagagatttgtgtttttgaaaag

SEQ ID NO: 87234 - DNA, 601 bp, Human
tgtaagtgtttgttattttgaattaagaggtcctactcttcagcaaaatttcactagtacagaccttcttttccaagtagttgaaatacagatagggaaggaaggttacttgtcagtcttaagttatagaatgttttaaatgaatgactgtttacttctttaattattgaataaattaatggctaagagtattgccaaacaaatgtttttagatataacaaaatggaattgtttgcaatactatcaatatttcatgcaatggaggaatgtgaaaagctagcgccaactactgcagactgartaggataaaggctccctttaagctccacgcacactagcaatctgtagaggtggcacacctcctgtgtgcacttggcatggtgtctgtattccagttcactgtattgtatatttttttatatatgctctttccctctacagggtgagctttccaacagtcgtaacatgtctactttacgcccagtcatctcccatagttcttgtattcagcccacaaacatcatcaagcatctataatatgccatgcactaggctagacaatggaaacacaggaaccaaacacaaagcccctgactccaga

SEQ ID NO: 87235 - DNA, 601 bp, Human
tgaaaggaggtaggagccatttgtcagagcacatctggaatattcacttataccctaaaagtaaataaaacaggaataaatagaacactggctccccaggacaggtccagaaaaccagcaaccaggtagagagagaaggtactgaagccacataacatgggaagaaccaaaaggaagaggaacatttagcttgggtgagagtgggcttggggagaaggtagacacaggctgcttgtcagtaacagcttaggacttctgtatggaagaaggagcaaatattccgtttaggcacagccagagrgacctacggggaggaagattttcacctcacttaaggaagtactttccaaaaactacaccatctgaaaatgggatgaactgccttccaagatgggtgtgaaggtccatggtcatctggcagatgggaagctggatggtcctctgtccagactgttggaaaaagctagcatgtgagagcagagactgtatctatcttaggaaacaagaaaacatttattgagcatttactttgtgctagtgatttacataaattagaagatttaatttttataatcctgtgaagaaaggggtactatcctca

SEQ ID NO: 87236 - DNA, 601 bp, Human
tatctctacatgaggaaagtaacatgggtcaatcaaacacgacatagcattggatgaatgactcaaattagggaaaattttattaaagccatccaaagccattcccttgaaatgtctgcaataaaagcagggcttatgaggtgagggttgtagttctgctttagtgagaggcataatgggatggaggagagaggtgctatgtgtagaggtaaatggtttgatcttggtaaatggtaaaagtaccaaaagctactcttggtaaatggaaattacacattaaaaatgaaaagggatggtcttyaacgaggtttgactgaaatagagacccaaaaggagactcgttaaaaattaaggtcttaaatgaatgacattaggataattaagaaaaagaaagaataaaatagagaatttttcgttaactggctaaagaggtttgaggtttgtcttcccagcttctctcctaaaatctctaacattaactatcatcagtcagtgcttgcttatatttcctcctacttgtgattaaaccttcctaattcataacagtactccagtgtcctgacagcaaaactgaggaccagctatttggaaaccccaagtt

SEQ ID NO: 87237 - DNA, 601 bp, Human
aaatttacaaatcagctcctcagttacactagtggctagcagctagcatgacccaattatagaatatttccaacactgcaaaaagttctacgggacagtgatattctagagaaaacacttcttctaaatagaaggacactctgcttccaaagagaccctcactttgctgctcttggttatgacttagtaactaaagtaccaaaggagatttgaagcgctctcacgtataaggtagccccaaacaatggcatctgagaccagctgtacgataaagttcctatgtattgttttcttgaaataygtttttttttttcgagtcttgctcttgtcgcccaggctagagtgcaatggtgtgatcttggctcactgcaacctctgcctcccgggttcaagcgattctcctgacttagcctcctgagtagctgggatcgcaggcatgcaccaccacacctggctaatttttgtatttttagtagagatggggatttcaccatgttggccaggctggtcttgaactcctgacctcaactgatccgcccacctcggcctcccaaagtgctgggattacagatgtgagccaccgcgcctgggtccatctttt

SEQ ID NO: 87238 - DNA, 601 bp, Human
ttcttcctgctccgaagaaatacattatttagaagggttgaatacttagaagcattgaccgccagtccggctggaaagtaactaagtacctaatattactacttggccccagattagccctgaacaagagggtggctgttggaatggaaaagatgactcataaaatctcagggagccttcggtcctccactgaaggtaaatatgggtccacaattcctcatctacattccaaaatccaaaaaactctgaacactaacattaaaaaaaccttacttggcagcaaactcatttggtggcaaamtgtgacctgaactacacaaaatcatttgtcatctatttatccctcttagtgtgaatattcttacttgtcactgtgaaaataatgagtgtgattatggagtgctgaccccaaacctctctgggagtattactatacgtaccatattacctttctggaaaacaaacaaacaaactctgaattttaaaacacacctggctctaaggccagataagggtacctgtaataggatgacgtgagacccctacaaaatttaccaaaggcctaagggagtcaaatttcctccctgttgttttggagagt

SEQ ID NO: 87239 - DNA, 601 bp, Human
aaaagaatatccacctccattccaacaaacctcactacgaccgccccaagtggccaagtggttctactggagcttcctcctcttccgtccatcctctggtcttttaaagagggaggaaatggcagaactctggggaaaggcatgggtacacacaaaagcgacatgcctacatactctgaaactaggatgctgctgcctttgggatagcgaaggtggaatgagactcctgattctaaactctaactcttgctacgatttctcccaaaaaataagtatgttgtcataaatccaagaaaccaartgtgagaatcagacttctttcttctgtaggaggtgacagaatacagtttcaaaaataaaagaaaataaagcaaacagcaacactggaaaatgcggaggcagagggaagaagtgaaaagcatcttttcttcctgctccgaagaaatacattatttagaagggttgaatacttagaagcattgaccgccagtccggctggaaagtaactaagtacctaatattactacttggccccagattagccctgaacaagagggtggctgttggaatggaaaagatgactcataaaatctcagggagc

SEQ ID NO: 87240 - DNA, 601 bp, Human
gtgtggtagccctgcaggtttaggattatacattttctcccatgaaaacacagctcagttgtcattcaggtataagagatgggaaaaaagaatatccacctccattccaacaaacctcactacgaccgccccaagtggccaagtggttctactggagcttcctcctcttccgtccatcctctggtcttttaaagagggaggaaatggcagaactctggggaaaggcatgggtacacacaaaagcgacatgcctacatactctgaaactaggatgctgctgcctttgggatagcgaaggtgraatgagactcctgattctaaactctaactcttgctacgatttctcccaaaaaataagtatgttgtcataaatccaagaaaccaaatgtgagaatcagacttctttcttctgtaggaggtgacagaatacagtttcaaaaataaaagaaaataaagcaaacagcaacactggaaaatgcggaggcagagggaagaagtgaaaagcatcttttcttcctgctccgaagaaatacattatttagaagggttgaatacttagaagcattgaccgccagtccggctggaaagtaactaagtacct

SEQ ID NO: 87241 - DNA, 601 bp, Human
caatgcacaacctgcacaaaacatgtgatgcatccgggagggacacagatacatatttataaagctctggccagattctggtgtggtagccctgcaggtttaggattatacattttctcccatgaaaacacagctcagttgtcattcaggtataagagatgggaaaaaagaatatccacctccattccaacaaacctcactacgaccgccccaagtggccaagtggttctactggagcttcctcctcttccgtccatcctctggtcttttaaagagggaggaaatggcagaactctggggraaggcatgggtacacacaaaagcgacatgcctacatactctgaaactaggatgctgctgcctttgggatagcgaaggtggaatgagactcctgattctaaactctaactcttgctacgatttctcccaaaaaataagtatgttgtcataaatccaagaaaccaaatgtgagaatcagacttctttcttctgtaggaggtgacagaatacagtttcaaaaataaaagaaaataaagcaaacagcaacactggaaaatgcggaggcagagggaagaagtgaaaagcatcttttcttcctgct

SEQ ID NO: 87242 - DNA, 601 bp, Human
gaacccacagagagcaggtggcaaatccagggtcacattgctaattagaacaaaagtgtgggctggggcgcggtggctcacgcctgtaatcccagcactttgggaggccgaggtgagtggatcacaaggtcaggagatcgagaccatcctggctaatacggtgaaaccccatctctactaaaaatacaaaaaattagccagctgtggtggcagacgcctgtagttccagctactcgggaggctgaggcaggataatcgcttgaacctgagaggcggaggttgcagtgagccaagattgcgycactgtactccagcctgggcaacagagcaagactctgtctcaaaacaaaaagaaccagagtgtggacccagctccctccctggggtggggggtctcaggggatgtgaatctctgttggacagctatctgggaaggggaacacatggagctgttatcatttattaacattttagcactactattttatcaaattttctaagcaactacttgatagtgatctaagaaactggacacagtgtaattgtgttttaacgaagtaaaaatctgggcaagtgcaatggggcagtgagtaggttgagc

SEQ ID NO: 87243 - DNA, 601 bp, Human
ctaaaaggaatataggtataaaggggaaggagaaaatgtaaaatttttttttttttgagacgagtcttgctctgttgcccaggctggagtgcaatggcccaatctcggctcactgcaacctccgccccccaggttcaagcgattctcctgctccagcctcctgaggtgcctgccaccatgcccagctaatttttgtatttttagtagagtcggggcttcaccatgttggtcaggctggtctcgaactcctgacctcaggcgatccacccacctcgggctcccaaagtgctgggattacagrcatgagccatcgcacccagaggagataatatacatttatatttagtgctggttgtgggggcaacttctgaagcttaaagatgcagttccaggggaaaataaaaggaagagagtgataaagagtggaagtgagcctaggcttcataggttgaaagggggttacagaagtgaaccataatggatcacagagcaatgcaggagtgctggggtaacttccactcttctgggaacatggtggtggcagttatgatccatcatgaccttggtcttcatatccaagatacaacatgaaatggtatcc

SEQ ID NO: 87244 - DNA, 601 bp, Human
tgcctataatcccagcactttgggaggtcgaggtgggtggatcatttgaggtcaggagtgcgagaccaggctggccaacgtggcaaaaccccacctctactaaaaatacaaaaaaaattagctgggcatggtggcccaggcctataatcccagctacttgggaagctgagggaggagaattgcttgaaccgaggaagtggaggttgcaatgagccaagatcatgccactgcactccagccagggcaacacagtgagactctgtctcaaaacaacaacaacaacaacaacaaaaaaaaaaaacggagtttccctgcacaagctctcttctcttgtctgctgccatgtgagatgtgcctttcaccttccaccatgattgtgaggcctccccagccatatggaactgtaagttcaataaacctttttcttttgtaaattgcccagtctcgggtatgtctttatcagcagcacgaaaacagactaacacaatgtgtgtttctgcgtatatcaacagtccactcctaggctggaagcagtggctcacacatgtaatcccagcactttgggaggccaaggcaggaggaaggccagagttcgagacca

SEQ ID NO: 87245 - DNA, 601 bp, Human
agtggctcatgcctataatcccagcactttgggaggtcgaggtgggtggatcatttgaggtcaggagtgcgagaccaggctggccaacgtggcaaaaccccacctctactaaaaatacaaaaaaaattagctgggcatggtggcccaggcctataatcccagctacttgggaagctgagggaggagaattgcttgaaccgaggaagtggaggttgcaatgagccaagatcatgccactgcactccagccagggcaacacagtgagactctgtctcaaaacaacaacaacaacaacaacaamaaaaaaaaacggagtttccctgcacaagctctcttctcttgtctgctgccatgtgagatgtgcctttcaccttccaccatgattgtgaggcctccccagccatatggaactgtaagttcaataaacctttttcttttgtaaattgcccagtctcgggtatgtctttatcagcagcacgaaaacagactaacacaatgtgtgtttctgcgtatatcaacagtccactcctaggctggaagcagtggctcacacatgtaatcccagcactttgggaggccaaggcaggaggaaggccagagt

SEQ ID NO: 87246 - DNA, 601 bp, Human
tatcgcccagtctggagtgcagtggcgcaatctttgctcactgcaacctccacctctcaggttcaagcaattctcctgcctccgcctcccgagtagctgggattacaggcgcatgccaccatgcccgggtaatttttgtatttttttagttagtagtcaggggcttcaccatgttggccaagctggtctcgaactcctgaccttgtgatccgcctgcctcggcctcccaaagggcgtgagccaccacacccagcctagcttgctttttaaggtcaggcttattgggtataatttgcattcrgcaaaagtcacccttttcagtacaattccatgagcactgacagccaaccccagttgggtaactaccactacaatcacgatatttctatttctatcatccctggaagctccttggtgtacttcatctcttctccaacctcttttcaaccatttatttgttttctgtcactataagttttgccttttccagaatatcatacaaatgtaattttagagtacgtagcctttgagactgtctactttcactcaacgtaatgtattcaagattcacccatgatatggtttggctgtgtccccaccc

SEQ ID NO: 87247 - DNA, 601 bp, Human
tggcacaatgctaggtactggtgtggtcccaggaactgcccctagcttctctccctcacctgcaccatttacatcctgttagaatctctcagcttccctaataactgggtcttaattctatctctaaaagcccttcaccatgtggcctaactttccattcccactgcgactatctcaggttaggctcctggtaacactttcttcccacctggtctgacctgactgaacaattacaaacacatggtatatactaaaaaatatctgttgaatgagccactgcagtcaaaaatcttcaagctcrgcactttttccatctcatcaagggtctggcctccctggtgtggcccatctcaaaatggaaaatttctcctactgaggtggcagcacttaaggactgaaatacaaggctttaacttgcctttttttgtctgttttgatacactctggctctatcgcccagtctggagtgcagtggcgcaatctttgctcactgcaacctccacctctcaggttcaagcaattctcctgcctccgcctcccgagtagctgggattacaggcgcatgccaccatgcccgggtaatttttgtatttttttagtt

SEQ ID NO: 87248 - DNA, 601 bp, Human
cagtgtgtgtacattttaaaataactgaagagtacaattggattgtttgtaactcaaaggataaatggtgatggatgccccatttaccctgatgtgattattacacattgtatgcctgtatcaaaatatctcatatacacctactctgtactcacaaaaattaaaaattaaaataaacgcccttgtgcatctggtgtgggtgctcactcactaaacaaaagaagggtctttgtcctcaggactcacatgctagtgagaagtcttatttttaaaagtaaacaaataaggccgggtgtggtgrctcaaacctgtaatctcagcactttgggaggccaaggcaggcgaatcacttgagctcacaagtttgagaccagcctggccaacatgatggtgaaaccaggtctctaaaaaaaaaaaaaaatacaaaaatcagccaggtgtgatggtgcatgcctgtagacccagctactcatgaggctgaagtgggaggatggcttgagcctgggaggcagaaattacagtgagctgagattgcgccactgcactccagcctgggtgacaaagccagaccttgtttcaaaaaaaataaaataaataaaat

SEQ ID NO: 87249 - DNA, 601 bp, Human
aaatttttagaacaacctcattcccccttccctaaatttaagtgcccagtgtgtgtacattttaaaataactgaagagtacaattggattgtttgtaactcaaaggataaatggtgatggatgccccatttaccctgatgtgattattacacattgtatgcctgtatcaaaatatctcatatacacctactctgtactcacaaaaattaaaaattaaaataaacgcccttgtgcatctggtgtgggtgctcactcactaaacaaaagaagggtctttgtcctcaggactcacatgctagtragaagtcttatttttaaaagtaaacaaataaggccgggtgtggtggctcaaacctgtaatctcagcactttgggaggccaaggcaggcgaatcacttgagctcacaagtttgagaccagcctggccaacatgatggtgaaaccaggtctctaaaaaaaaaaaaaaatacaaaaatcagccaggtgtgatggtgcatgcctgtagacccagctactcatgaggctgaagtgggaggatggcttgagcctgggaggcagaaattacagtgagctgagattgcgccactgcactccagcctgg

SEQ ID NO: 87250 - DNA, 601 bp, Human
tgtagccaaatgctgaactgttgtgacactgatgagcactagagggcagagcttaacagcaaatgattctaaagctagcaatccaggcctctcgttttggtgttgaagttactgactccctatagttaacaagatctcccaaagagtagataggtctaagtcatagaagttgccagaactacacttttaaaaacagtgtatatctctgcccaaatatgtgagtatttaaggtgacaacagcaaccccacagtttttatcctgtaccaggtgggcaagagaaggtagactgaggttaggtgygggaacctctttgctgttttgcaataaaaacaccgaaggatttctggaaaaattttagagacatcagcattacctgctttgcaaaatataaaatttttagaacaacctcattcccccttccctaaatttaagtgcccagtgtgtgtacattttaaaataactgaagagtacaattggattgtttgtaactcaaaggataaatggtgatggatgccccatttaccctgatgtgattattacacattgtatgcctgtatcaaaatatctcatatacacctactctgtactcacaaaaattaa

SEQ ID NO: 87251 - DNA, 601 bp, Human
ttctcccaaggctcctcccactgttctctcctgctccagtcagcctgggcacacgctgtctcccaggcatggagtcttctgccttacccaataccagcatccttcctgccaagccgagatgttttttcagataccaaatcacaattcaaatacaagttgttcccaggaaacttcttggttaccggaggtaacactttgggccaaatgcaaacctcctatctcaaaatctacatacagtatcatagcattttagagctcttcattcaagaacattgacaattaattctaataataaaattcmttgacaatttaaatctgcattttcatgtattgtaaacacagctcttctttctgaagttgaatacaagtcctgacatgctattacatttaatattaaaagctcttagaatatttagaaaccgaattgtagccaaatgctgaactgttgtgacactgatgagcactagagggcagagcttaacagcaaatgattctaaagctagcaatccaggcctctcgttttggtgttgaagttactgactccctatagttaacaagatctcccaaagagtagataggtctaagtcatagaagttgccag

SEQ ID NO: 87252 - DNA, 601 bp, Human
tcttggtgaggcccttccctggtcaccctatctaaaatttaatgtccccttactccaactttcatagctgctttccctgatgcatcttttctgctaagcactcatcgtcagctaacaggattgacttgactgtctttcttattgtctttccagtcctccacccccagagtaaaagctccacaggggcagggatattgttttgttcactgctgtatcctcagcccctggaacagtgaccagcacagggaagagactcaacaaatacttactaaatgactatgtactaaccacaaaattgttyctaacagaacattagcaaaacccaaatgtcagtaggcaactagttaactataactgtatttcatacaatggaatactgggtacccattcgaaagaaggagggaggcccatacgtttaatatggaatgatgtccaatgaaaaaagcaagttgcaaagttatatgtagttagacagtttggcaataaataaaattcctcccaaactcatttcttaacgtgatcttcttctcggaatctcttttcccattcaagcaacatggagcacctactgcttctcccaaggctcctcccactgttctct

SEQ ID NO: 87253 - DNA, 601 bp, Human
ctggtgtaggggtgagttctgctcccacacccagcacctcccagccaggggaaagcacaaacaaactgcattctcagccctgcttatgtggcatcagcaccatcctcagctcctggaggatgtttccaaaaggcttttctgctatgtggaaggccacaggacccaatttagaggtactggctgagacatccccttattgaggccaggtgagcttttcccggtacagtcacctgcgagggcaaccctcatgacttctttccaggtcaaaggacaggacgtttacatcatctccaaatcacaytcaaatcttcccaaatgtgctccttagacagtccttaggtggacatggcctggaagtttgggagcccctgctctcagtctgtgtgggcccgtaggggtttccttctccccttaagaagccctagctccaaccctgtcctccagggttcagctactgaagcactcattaaaatgactggtgcccttgtctgttggcctcatgacccatgtcttattgtcatcattggaatgcctgaacatgataggggcccactgaacatttggagatagctcagggattctcaacctggggtccacaaac

SEQ ID NO: 87254 - DNA, 601 bp, Human
cacagccaggccctcactgcataaagaagctgatggaagagaatgtggtcaaagtgctgagagaggcagatgcaagagactaaggtcctaaaaatgttttccttcccagaagtagtcatcaacccaggccactccacccctgcccttcccagaggtaagtttcctagctcacaccatcaatttgggtttacaggctcaccttatcagtgtaagattaaaacttgagatggagatgtaacatactgtgtctggctctgttggagattatgtgtataaaatgtgatctctgtatctgagaaaygctacaaggagccaacatgaactgatgttacatgaaaacatgcatattatacacccattaataatagggttgtacactcatgtgtcagcaatgaatggaaattaatggtgttttgcagtctattccagggacttccatggaaataattgagttgccttgagttttcaaggataacaatacacgaatttgcctctaggaagagggagagggattcatgttgttggaatgtactgtgccactggtgtaggggtgagttctgctcccacacccagcacctcccagccaggggaaagcacaaac

SEQ ID NO: 87255 - DNA, 601 bp, Human
gtcacagaagtgagtacggactgataaagcaccctggctggccaccttgcacacacccgggttgtagcagggatgtggctggtaagaggaggggatagatagccttgaggcaagtagtattgcagtttcttatggccgctggagcagctttaaccagcacgggaaccccttcactcagtgggtggatggaccttgtttgcatgtaatacttaggacagaaaattggaagagctacaagtttgactctcaacaacccctcctcaccacagacttcagagatgccttgaagaagcctgcagcmgtcacagatatcgtttcacctcactcaccccatgtgaaaggtccccagaagccacattggttttgtttttgtttttgtttttgttttgagatggagtctcactctgtcgcccaggctggagggcagtggcgcaatctcagctcactgcaacctccgcctcccgggttcaagtgattctcctgcctcagcctcccgagtagctgggactacaggcacccgccaccatgcctggctaatttttgtatttttagtagagatgggctaatttttgtatttttagtagagacacagtttcatcat

SEQ ID NO: 87256 - DNA, 601 bp, Human
acacaagctcaattttctgtttttagcgttcaggcaaaaagaaagaaaagaaaaagaaagaatacatacaggacataatcccaagctctcaaatggcagactcactatctgatgatcttggccttctctgagattctatgaaagtcatgggccctccttctagagcaaaagacacatacttgcaatgctttacaattagaacttgtccaatccgctttactatgttgttccgttttgctctgttttaggcatttaccagcctgaagccgtgggttttttttttttttgtttttttttttttaatctgagacggaatctcgctctgtcgccaggctggagtgcagtggcgcgatcttggctcactgcaacctctgcctcccaggttcgagcaattctcctgcctcagcctcccgagtagctgggactacaggcacatgccaccacgccaatttttttttttttttttttgtattttagtagacacttggtttcaccatgttggccaggatgggctcgatctcctgacctcgtgatccgcccacctcggcctcccaaagtgctgggattacaggcgtgagccactgtgcccagccaaagccat

SEQ ID NO: 87257 - DNA, 601 bp, Human
tatattacacaagctcaattttctgtttttagcgttcaggcaaaaagaaagaaaagaaaaagaaagaatacatacaggacataatcccaagctctcaaatggcagactcactatctgatgatcttggccttctctgagattctatgaaagtcatgggccctccttctagagcaaaagacacatacttgcaatgctttacaattagaacttgtccaatccgctttactatgttgttccgttttgctctgttttaggcatttaccagcctgaagccgtgggttttttttttttttgttttttkttttttaatctgagacggaatctcgctctgtcgccaggctggagtgcagtggcgcgatcttggctcactgcaacctctgcctcccaggttcgagcaattctcctgcctcagcctcccgagtagctgggactacaggcacatgccaccacgccaatttttttttttttttttttgtattttagtagacacttggtttcaccatgttggccaggatgggctcgatctcctgacctcgtgatccgcccacctcggcctcccaaagtgctgggattacaggcgtgagccactgtgcccagccaa

SEQ ID NO: 87258 - DNA, 601 bp, Human
cttatattacacaagctcaattttctgtttttagcgttcaggcaaaaagaaagaaaagaaaaagaaagaatacatacaggacataatcccaagctctcaaatggcagactcactatctgatgatcttggccttctctgagattctatgaaagtcatgggccctccttctagagcaaaagacacatacttgcaatgctttacaattagaacttgtccaatccgctttactatgttgttccgttttgctctgttttaggcatttaccagcctgaagccgtgggttttttttttttttgttttkttttttttaatctgagacggaatctcgctctgtcgccaggctggagtgcagtggcgcgatcttggctcactgcaacctctgcctcccaggttcgagcaattctcctgcctcagcctcccgagtagctgggactacaggcacatgccaccacgccaatttttttttttttttttttgtattttagtagacacttggtttcaccatgttggccaggatgggctcgatctcctgacctcgtgatccgcccacctcggcctcccaaagtgctgggattacaggcgtgagccactgtgcccagcc

SEQ ID NO: 87259 - DNA, 601 bp, Human
ctggcttgttcctgcccaaagggacatcggtcaggggtgaacaccagtaatcgtgatcagaacagctcaaaacatcttgtggcaactactaagaccctttatcctactccctctcccctaaagatcaatgctttctggctttttgcttcccctaaacccaggtgatctggctcttgctgaacaaagacagctttaatgagccagggcatgaggctgatgcaaccagctccatctttcctggtgccctgggaagtaggcaatgattagcctggaccttgccccactcagcaccagcctggcrtcacggtgaggacagcctctgcagactcggctctgtggagagcagtgtggcaggtgcctgggaagccctaggcagataaaggggcaagttgatccgcagccttgcttctcaagacttccccagcacccaccctatctctgcctgattctgaacaaataagccagcagctcacacaccttcccacaaagagccagagggcctgagggaggagagctgggaaaccagggaggacaggaggaaaggactttgtgcaaaaggtcagctcctcttccagccaggctcagtagctacagaagctgc

SEQ ID NO: 87260 - DNA, 601 bp, Human
aatgccagtttttccttgggcagccctaatactaacctgccctatttagtaaccatggaaacaggagctgcctgccagccatattcagcagacacatgcttcctgttggcagcagcccctcagctgagaagggccaagagagtgagtgcagagtccttttcccaaagcaccacggtccctgctagaagatcaggctcccagtgaggtaggccctctctccaacagggcatggagggagatggcaggagaaagatatgcctgctaggtacctgcttttcactgtttcagcacatctggaacrtaatactgcccatagccccaaaccctccccaaagcagcccagaatcagggcatcaagccttacactgaggcactcttgggctttgtcaagcggccccatggacagtgactctgcccatggctagaggacagtgactcaccccaggcttcaaggcctggcttgttcctgcccaaagggacatcggtcaggggtgaacaccagtaatcgtgatcagaacagctcaaaacatcttgtggcaactactaagaccctttatcctactccctctcccctaaagatcaatgctttctggctttttgc

SEQ ID NO: 87261 - DNA, 601 bp, Human
ggccccagcagttctgtgagcatgactcatcaatcaggccattagccaccacagaatgggccattttcacctggtattctccttggagagcaaataacaattccttcaagctaaaaacctccccaagaggctagacaggcaccatcccaggcctgagaaaagggaggggggcagtgactgaaatcctgcacagaaattcgtgagattagtcagccaagagactccgaagcccagacacccttcccccagaaatcgtgaatgaaatgcattcctgaaagtaatatgcaaataactcagacaygtaaatcacatagaattacgaataaagtgctccacagccagggtaaaaacaaaaccaaagacacttaggtcactgtggtatcacagctcttgttacctgaggttttctctgtttattctaagaatatctccaaaatacccaaagaatttgttccaccgggattaaataatgactaatcttattaggtaactgtttcctaagcatcttttatttttatttcacaccaaaaataatttctgaagcagcactcaaaggttttaatcaattttctcctgaaacggtcaaggagagagactaaaa

SEQ ID NO: 87262 - DNA, 601 bp, Human
agagaacctagaaggaagcaccaaggtggcagaactcagaagggttttctgagctggaagagcccttgaagactgtctggtcagtgggtccccactgtcctcgaaggtccagtaccgcacctgtgaggaagcgttttctggcttgccctcatttccgttagatggagttcaaagggtaagtccgtgtgagcagccaggcccaggccccagcagttctgtgagcatgactcatcaatcaggccattagccaccacagaatgggccattttcacctggtattctccttggagagcaaataacrattccttcaagctaaaaacctccccaagaggctagacaggcaccatcccaggcctgagaaaagggaggggggcagtgactgaaatcctgcacagaaattcgtgagattagtcagccaagagactccgaagcccagacacccttcccccagaaatcgtgaatgaaatgcattcctgaaagtaatatgcaaataactcagacatgtaaatcacatagaattacgaataaagtgctccacagccagggtaaaaacaaaaccaaagacacttaggtcactgtggtatcacagctcttgttacct

SEQ ID NO: 87263 - DNA, 601 bp, Human
gaagaaacaagatctattcagtccagaaaggaacaataccagatgaggcatgagggaggtatgagaaatatccaacgggattagcgtcaaatcctcgggagaccttggcctttggactaggtcaagtctgcccacaaaaataggaaattgctctgggcccagtgagcaggtatggagagccacagtctcacacccacgcaagggcaagggcccggcctcatcaacgtgtcaacatggggatggagctgctaagtgaggcgctattgccacagcaagtgtgggcgatgacttcctttctgcyttcctccctcactcattctcctctctgactctggaggtctggtctgcagtcttgacggctcccaggccacagaaagtccaccagagaacctagaaggaagcaccaaggtggcagaactcagaagggttttctgagctggaagagcccttgaagactgtctggtcagtgggtccccactgtcctcgaaggtccagtaccgcacctgtgaggaagcgttttctggcttgccctcatttccgttagatggagttcaaagggtaagtccgtgtgagcagccaggcccaggccccagcagttctg

SEQ ID NO: 87264 - DNA, 601 bp, Human
ttcacacaggcagaaacttgtaatgaggaagaaacaagatctattcagtccagaaaggaacaataccagatgaggcatgagggaggtatgagaaatatccaacgggattagcgtcaaatcctcgggagaccttggcctttggactaggtcaagtctgcccacaaaaataggaaattgctctgggcccagtgagcaggtatggagagccacagtctcacacccacgcaagggcaagggcccggcctcatcaacgtgtcaacatggggatggagctgctaagtgaggcgctattgccacagcragtgtgggcgatgacttcctttctgccttcctccctcactcattctcctctctgactctggaggtctggtctgcagtcttgacggctcccaggccacagaaagtccaccagagaacctagaaggaagcaccaaggtggcagaactcagaagggttttctgagctggaagagcccttgaagactgtctggtcagtgggtccccactgtcctcgaaggtccagtaccgcacctgtgaggaagcgttttctggcttgccctcatttccgttagatggagttcaaagggtaagtccgtgtgagc

SEQ ID NO: 87265 - DNA, 601 bp, Human
gagtcggctccttctcccaggctagtctgggacttttcccctctgctgaagccaatacgatccactcgctcaattctcgcaggctggtgtccagcctgccatgcacacagtgccagaaattctcatgtgaccagacttgctttctgatgaaattctaacccctcttagaagaggccttgggctttagctgtcccctcaatttagagaccaggcagaaatcattagcagcccctctcccccgacccagaatttccttctggggctgaactgtaccatgcgacctgctcctagtggttctgtytgcttgtcactccagcacccagaggtttaaggaagcagggtaagttgtacattcacaccaccttgttatgaacagaggctcctttgaggaaaggaggtggcctaaaagtgactttccctaggagaaatactagatgtactaagtaacccaggcaggatccctgtcctcactctcccaagcccacctccagagctgtttatttttaattaagatgctcctggcagccagtttgcagctgataacgttggcacagccatcactactggcaaagcaatattgccttttggtgtttaattagca

SEQ ID NO: 87266 - DNA, 601 bp, Human
ttagagtgaaacccactgccaatccccgaagtgcaccataccctttgggacctcctagtctatcttggaagctttaaaatactgttaatggcatgacttcatctgccccacacttgaacgatccatatttaggccagaaaccacatggatctcgcatcacttcactgggctccaggacagaaaggggctcaagtcaggaagggaatgcttctaaccaatgattaattactcatcctctgtcaaatttcttgacaaagggacaaaaatgaacactcctaccagggagcaaaatcaatggaarctcacccttttcccactctgtatatttttaaacaaaaaggttttctcccactaacaggtagttttcctgatttttttaaaagcgtattgagaagaaagaagcagaacatcataaccctgctgcagccttttcaaaggtaatgaatgagccagtcccacaggagagggagctctgcttcagggtgggaaggattccttgagagctttcagagtccaatttcccaggaataaacgaggtccgcagtcaggctggggccgacaggctttttccaaggcagacaaaccccaagatccacgaaag

SEQ ID NO: 87267 - DNA, 601 bp, Human
tgttaatgttatgatctggaatatctccattacaagtttctttccactgggcttaaataaaacactttcgtcttttttcccccagaaaaaagatccagtagtcttttatgtaacggctgtctactgtgaaccccttcgggatattaaagtcatgaccctcaacatggctggaacatcttgtatttggccccaactctatgagggccagcacatccctgatccttctctccattttcggcctcccatttaattcctttccaaggtctttatacacaagtccgtatgaggcctctaaatacawcctaaattctgtaagaccgctgcaaataagatcttactctctaaaaacacctgtataatcattctcctatgtaaggagggaccctctatatttttagttttgttcccatacagcaaacactattaataccatcgtactttctccagagatgatatggattagaccaaatggaaagttaccatggctaccgcagtgttatttttggtatgagaaattcatgccaagagaagcagtatacatggtcaagaattggagctttatttcctctttgctatcaggcaatcaatcccaatttaattt

SEQ ID NO: 87268 - DNA, 601 bp, Human
tgggaggccgaggtgggcagatcacctgaggtcatgagttcaagatcagcacggccaacatggtgaaaccctgtctctactaaaaataccaaaaattagccaggtgtggtggtgggtgcctgtaatcccagctactcaggaggctgagacaggagaaggcggaggttgtagtgagccgagatcacgccattgcactccagcctgggcaactacgtctcaaaaaaaaaaaagaaagagcactaggcttcagcccagaaaatctgctttctattcctagttccccacgaaatgattctgggcrggctgtttctctgagccttggtgtgtcctctgcggaaagggtaaattattgccctgctcacctcacagagcttattttcagactccagtgagacaaagttgttgaagtcttcatagcatagagagcttgttttgagactccaatgagacaagatgtgaaagaactcatacatttgaaagtcttttgcaaatgtaatgaagtgatattatgacctaataatatccttgtggtaagtctttgaaggcaggaaccatgcctcaaatctcatttattgccccacacctcccacaaatccctccc

SEQ ID NO: 87269 - DNA, 601 bp, Human
aggttcctctgacacaggcacccctgaccttcctcaggcgcaaacattgacaaagtgacaagtttcagctcctttgtcccctgtccacaaaaatacctaaataaataagttactaacagtcagagacacaaggggccagaagaggtaggggtttgtttccagtgccagccccagaaatgtgacccattgtgctttttaccaagttcctcctctagctcaccagggacctgggggcgggcctgccagcggccactccctgtgctccccttccaggctgatgcctccctgcctgcccacaccrgggtactccacgtctctacactttgtgcgtgctcctctctccacgaagaaggccaattctcctccttctctggataacttcgactaattcaccagactcagcaaaggctctgcctccctgcaggaggccatccctgatcctcgccactcctgccccatctatgccaggcatgtgcctccagggagccacagcaccctctaaagagagcaacaccaaatcagtgataaccgatcgtttccttcaaccagagttaaatgtctgcagaatgcccaccaggcatggtattacagcagagatccc

SEQ ID NO: 87270 - DNA, 601 bp, Human
ttgggagtgtcaggctccaacacccggaatgctatcagggttctcaaacaaaagcctcctttcttcagttttggaacagtttattagcttgagggagaagtccacaacagtccaggcctcttatcaaattgtatcaaacaactccacaggttgggattttctagaaatcctatccagaaattttgattacaaataaaattataagtctgactggagttctggatcttcgatgttaacattggtctaatttctttttcatttttttttttgagacagggtcttgctctgtctcccaggctgsagtgcagtggcgcattcatagctcaagtgatcctcccgcctcagcctcccaggtagccaggactacaggtctgcaccaccacacccggccattggtctaatttctaagcaaggccagtgtcttccaatgagctcagggtgggaaaccccacgggggttgggctgtgaactgtaccaggtggcccaagctgggggtccaaaaagacagatccacatctcaaatccactgaactctgggaatccctgtgatgacctgagacctgcatcatcactgcccccaataatgttgtaaacatgtaaa

SEQ ID NO: 87271 - DNA, 601 bp, Human
acatatacacagaatcaacgagcttctaatatttagttttcattcatgccagggttcgggcctggtccctgggggcgcagaccccagtcctgccctgttcctccagaatcctgagctttaagcaccatttcctgttgccccagggagctgacccatggcccctgacatatactgaacttgcagacacactgggatttggctctgaatttgctaggaggcccagatcatgagagggctgtggatgcaaacaggaagcgtccctgtgggcccccagaaataactgtcagaggcatgactggcrggggagatgggcaagggtcctgccattatgaagtgggttccaagagtcagcagagttgaggcattaaagttttcaggacattatttggggctgttggctgccaaggcctgaggaaatattggttatgcttccaagggctcacagtgacctccagataaagcccaaagcctccttcataagtcaagtaatgcctttttccacctggccacaagctaacttgctaacatgttctgacgcagggtccaattgcaggaaccttccatggctccctgaacaaaacatccctcatgtcctgcctcc

SEQ ID NO: 87272 - DNA, 601 bp, Human
gggttggaccgtgaggataaaacttaaggacagggataggaagagtatttgggacatttgagctaagggacatttccttttgtcttttgaagccaaaaagagctggccttggctggaaggttctggctaggaggagagggctaaagcatgcgaaggcacaacaatggtatgttatgtattttatatacatccagcaaccccgccactccccaggaaagccacatcttcaccccaagcatgcgttctgaccccaccttcctgaccgtggccagctggcccaggaagggtgcctgtaccaagytggtccaatcagagttcttcctgggatttttctagatggaactgagcgaagaagatactctatcccacttcagtgaaaacatcatgaggcttgaagcatggaagttgcctcacccccgtgtttcctgccaggtggaacaaagtgctgagagaatcaaaccagcaagcaaagagaagaggagcaagagatggaaagtgacctctagcatgcacatccctaagccccagctgattatatcagccggcaaactcctcttgtgacctaggctagtatgagtggaatccctgtcacttgtgacca

SEQ ID NO: 87273 - DNA, 601 bp, Human
ttgccagcatctggctgccagtgggggatggatgcactggtccctgccctcaaggaaggcacagtctccttggaagatgacacacaaagaacagtttaacacattccaagctctagaaacatactgcttgtcctgccatctgctccctgtccctcccagcttggcagccggggcaagttaccccacctctttgtcctttggttttccctgtggaaaaatgagaaaagtcactgtggccaggagtgtcctggaaacagcttcatggagatgggaggaggacagatgtctggagaatcagggytggaccgtgaggataaaacttaaggacagggataggaagagtatttgggacatttgagctaagggacatttccttttgtcttttgaagccaaaaagagctggccttggctggaaggttctggctaggaggagagggctaaagcatgcgaaggcacaacaatggtatgttatgtattttatatacatccagcaaccccgccactccccaggaaagccacatcttcaccccaagcatgcgttctgaccccaccttcctgaccgtggccagctggcccaggaagggtgcctgtaccaagttgg

SEQ ID NO: 87274 - DNA, 601 bp, Human
aagcagttaaggaaagcagcctggagcctgccaagtgcctggaggctgcctgccacaagtttcttcaatcctcactcactgcccgcctggcccagcacctctgctcggttacacggaggggactggtcctagcttgctgggactggctccaagaaatcataaatatcactctgaatctggaaagcacatctctgcagccccacgtggccccagcaagtccagtcttgacaggctggaatagccagggcccaggagatgattggaaaacacattctggaggcacagagccaggtctgcagaygtgctgggaacctcgattaatgcagaaacccacatttcagcagctctccaaggaagaaaagccattctggcatgggaggaatggagctaggggtctcctgcgtgagcatcagagcctgcatttcaaatcaggcacaacaatggaccctggaggcacaggagattcgagttctgaagacgggacggggaggggtgcacttgggcgatctgtcagaaacccccagaggaggctggggacactcattcgcatgtaggagacagcagaatttgaaaaaggtggcatctgcattataattaataa

SEQ ID NO: 87275 - DNA, 601 bp, Human
ttgttgaaaatttatttgcttatatccaagaagctatttccacagttatctttgcattttccttcctccctgatgtcctaacactcagccacctctccctctccccggctcctttctcagccctgctcataacagcaagggttattattctttttagcactttatatgcatcaatcttttattccaggttttgagataatgcttttaaactggttacaaaaaatataaaatcagctatcttgttacttctgtcctaattcctaagagaagaacaggaaaatcctaaattattgctctttcyccctgtagactccagagagtgaatcctacagggtactataggaggtagggtattacaggaaagtacctagagagagagaaatgaagatattaagattgacgctctcaaataatttgggatgaaagaccagacttcaaaaactatgcctttaagctcttgcatattttatgaaaagtttgaaggttacacaactgcctagacttgtattttaaaagggaaggagggaaagagagagggaggaaaatgagaggaaaggagggagagagggagacccagagtgaacaagcaattgcaaaaggt

SEQ ID NO: 87276 - DNA, 601 bp, Human
cccatattgtgacctgacccccattgagtcaccctgacaggcagtctgcaggcttagcctaaatcccttgtgctgcaccctgggcccacttcttggtctgacctctgaaaatgtggagatctgaaaatatacagcaggtcttgcacagttctttgttgaaaatttatttgcttatatccaagaagctatttccacagttatctttgcattttccttcctccctgatgtcctaacactcagccacctctccctctccccggctcctttctcagccctgctcataacagcaagggttattattctttttagcactttatatgcatcaatcttttattccaggttttgagataatgcttttaaactggttacaaaaaatataaaatcagctatcttgttacttctgtcctaattcctaagagaagaacaggaaaatcctaaattattgctctttccccctgtagactccagagagtgaatcctacagggtactataggaggtagggtattacaggaaagtacctagagagagagaaatgaagatattaagattgacgctctcaaataatttgggatgaaagaccagacttcaaaaactatgcct

SEQ ID NO: 87277 - DNA, 601 bp, Human
ggaaacctgcccagttcccagcaagaccaggcatgctgaccaggaaccgcttgctgaaagtcccatgaacagaaaaaggctgtgtccctgtggttctcccaagtttcccagcttgtccttcaaacccccatgggagccacaaaattattacttatcacactactttttaaaaatgtttatttattttattttttttgagacagggtctcactgtgctagagcacagtggtgcaatctcagctcactgtagccttggcctcctgggctcaagcaacctcctgggctcaagcgatcctcccayctcagcctccctggtagctaggactacaacaggcacgtgccaccatgcctggctaatttttgtaattttttttttagagatagggttttgccatgttgcccaggctggtctcaaactcctgggctcaagcgatccacccaccttggcctctcaaagtgctgggattacaggcgtgagccaccatgcccggcctattacactactttgcacgtcagcaaagaaatagctccaaatccttttccaccaaacaacaacaacaacaacaacaacaacaaagccctggaattttagggctagatt

SEQ ID NO: 87278 - DNA, 601 bp, Human
aagtagtaaacgaatgtaatgaccatgataaggagacggacggtggtgatagtatcggttttataattctgacaatttttctggaacattccaacatttgatcaacagtatacttctgttaggtcaaaatagtaggctaccatggttactttaaaattgcatctttgccttaaaaatgttttcacatagaaatgccacttcttagaattgagcctgtgaaaataattgtaggtatgaacacagcaatcttaaaggatattggtcagagtattagaaacaccctatgtgtccagtaaattgyagtgcatgcataccgtggacagacatacaatgtaggctggtgcagaagaatattctacagtgggtgaaaattcccaggacatagtaagtgagtagaatgggctaccaaaaaagtatatgtagtacaatctcatacttgatttcaaaaagcccgggaggatgtatgtacacaaaagtattcatcgtggttatccccaggagaattatgaggagaattatggataagagtttaatttccttctttttgctatctatgttttctacaatcaattttaaacttaaaaaaacaaagtcagaataa

SEQ ID NO: 87279 - DNA, 601 bp, Human
agatttaaggggctaaaatgttagcaataactcgttattacggttatggttatagtgttcagttatccagtttggaacgatttatcactgaaaattaatactcatgcaagtagtaaacgaatgtaatgaccatgataaggagacggacggtggtgatagtatcggttttataattctgacaatttttctggaacattccaacatttgatcaacagtatacttctgttaggtcaaaatagtaggctaccatggttactttaaaattgcatctttgccttaaaaatgttttcacatagaaatkccacttcttagaattgagcctgtgaaaataattgtaggtatgaacacagcaatcttaaaggatattggtcagagtattagaaacaccctatgtgtccagtaaattgtagtgcatgcataccgtggacagacatacaatgtaggctggtgcagaagaatattctacagtgggtgaaaattcccaggacatagtaagtgagtagaatgggctaccaaaaaagtatatgtagtacaatctcatacttgatttcaaaaagcccgggaggatgtatgtacacaaaagtattcatcgtggttatcc

SEQ ID NO: 87280 - DNA, 601 bp, Human
aggcctggccagtggggaggaggagtccacatgcaggactggggtatagattctggacacaccaattactggctagaaggcctagaacaaagtcaggctggggtccctcatcttacagttactatcagggttatgtatttgtatacataacatatgtaagcactggaacacagtggatgctcaaaaatagttaacaagcatgatgctgctgcttacagcaactggagaatttataatgtggtgcagcctggctgttcctgtagcctgaccacctgggtttgcatcctggctcagctgtatsactctggacaaattacataatctccttgtggctcacttatatcatctgaaaaacacaaatgataatattacctatagaatggctacaaagatttaaggggctaaaatgttagcaataactcgttattacggttatggttatagtgttcagttatccagtttggaacgatttatcactgaaaattaatactcatgcaagtagtaaacgaatgtaatgaccatgataaggagacggacggtggtgatagtatcggttttataattctgacaatttttctggaacattccaacatttgatcaa

SEQ ID NO: 87281 - DNA, 601 bp, Human
aggggccctctcctaagatgcccctctccaggcctggccagtggggaggaggagtccacatgcaggactggggtatagattctggacacaccaattactggctagaaggcctagaacaaagtcaggctggggtccctcatcttacagttactatcagggttatgtatttgtatacataacatatgtaagcactggaacacagtggatgctcaaaaatagttaacaagcatgatgctgctgcttacagcaactggagaatttataatgtggtgcagcctggctgttcctgtagcctgaccamctgggtttgcatcctggctcagctgtatcactctggacaaattacataatctccttgtggctcacttatatcatctgaaaaacacaaatgataatattacctatagaatggctacaaagatttaaggggctaaaatgttagcaataactcgttattacggttatggttatagtgttcagttatccagtttggaacgatttatcactgaaaattaatactcatgcaagtagtaaacgaatgtaatgaccatgataaggagacggacggtggtgatagtatcggttttataattctgacaat

SEQ ID NO: 87282 - DNA, 601 bp, Human
atgctgagtctgtacagctcccttaaagccctgcacctggcattaaggcccccatgatctggctggggctatctccctaagcccactgctacgggtcccttgcacagaccctttgttccagccctaccagcacattcacttcaagctcttcataccattttctgtccccacacttatgcccatgctatgcctcccacctggaacacccccagccctttgcagcatctatccaaatttcccccagccatcagaccagcctaagtctacccccttcacaaggtatccccatcagcaccccccraaattcttcctcagctcctgtaccattcattgctgacactgctcagctgggagctaatcgttcactgcctcgtgacagctattctgcgaacagtcggcattcctattaacatcttttatttctttgttccatgatgaattcttcacctgcctaactaaccttgggcaccccggcgcccctcatagtcctgcagaggaggccctgacctacctgaggaggtttcccctgggcaaattctgctctcgggcctggacgccacccatggtgaggctcagcctcttggccacatccggccttccc

SEQ ID NO: 87283 - DNA, 601 bp, Human
ccctaatttaagttttcagctctaactcccctcctggaccccaaaactgctgctggactgtggcactcaacaagcccatagtcttccagctcagatgaaaaagtgtgttttatcctccaaagtcccctccctcctggtcactcctgtggtctccaatgtgccctcctctgactctaccacgtgaagaagagtcctgggaggccaggctcctacatctcttgactctccctccactccactcctgcagccggggccctccatgactcactaactgggtttcctgttcctgtctctctcctcrcccccggtacatcactgtccatttctattcttaggacaccgtgttcgctatgctgagtctgtacagctcccttaaagccctgcacctggcattaaggcccccatgatctggctggggctatctccctaagcccactgctacgggtcccttgcacagaccctttgttccagccctaccagcacattcacttcaagctcttcataccattttctgtccccacacttatgcccatgctatgcctcccacctggaacacccccagccctttgcagcatctatccaaatttcccccagccatcag

SEQ ID NO: 87284 - DNA, 601 bp, Human
ctacccttcccaggctctgctaaccatccttctactctctgtgtccaagaattcagttgttttgactttttgatcccacaaataagtgagaacatttgtctttctgtgtctggcttatttcacttaacataatgatctccaattccatccacgtggttgcaaataacaggatctcattgtttttatggctgaatagtactccactgtgtatatacacatttcccttatctattcagctgttgatggacacttaggctgcttccaaatcttagctattgtaaacagtgctgcaacaaacatwggtgcaggtatctctttgatatactgatttccactcttctgggtatatacccagcagtgggattgctggatcatatagtagctcaatttttagttttctgaggaacctcgaaactgttctccatagtggttgtactaatttacattcccctcaacagtgtaggagggttcccttttccccacaatcctcaccagcatttgttattacctgtcttttggatataggcctttttaactggggtaaggtgatatccattatagttttgatttgcatttctctgatgaccaatcatgttgaaca

SEQ ID NO: 87285 - DNA, 601 bp, Human
acagtccaattacactctttattttaaaatatataattgttttgactacagtcaccctattgtgttatcaaataagtcttattcattctttctaaattttttgtacccattaaccatccccacctccctcccatcccctactccccacccactactacccttcccaggctctgctaaccatccttctactctctgtgtccaagaattcagttgttttgactttttgatcccacaaataagtgagaacatttgtctttctgtgtctggcttatttcacttaacataatgatctccaattccmtccacgtggttgcaaataacaggatctcattgtttttatggctgaatagtactccactgtgtatatacacatttcccttatctattcagctgttgatggacacttaggctgcttccaaatcttagctattgtaaacagtgctgcaacaaacattggtgcaggtatctctttgatatactgatttccactcttctgggtatatacccagcagtgggattgctggatcatatagtagctcaatttttagttttctgaggaacctcgaaactgttctccatagtggttgtactaatttacatt

SEQ ID NO: 87286 - DNA, 601 bp, Human
taacactgtaaggcatctcaagtccaatcctattactatgaaaaggaggatttctaaatatcaggtcttgcctccctccttgcaattgccctgagtttttttgtttgttttgagacaggctctcgctctgttgcccaggctggagtgaagtggcatggtcatggctcactgcagcttcaacctcccaggctcaagcaatcctcccacctcagcctctcgagtagctgggaccacaggcacacaccaccatgcccagctaatttttatatttaaaaaattttgtgcatacatagtaggtgtrtatatttatggggtacatgagatgttttgatacaggcatgcaatgtgaaataagtgtatcatggagaatggggtatccatgccctctagcatttatcctttgagttacaaacagtccaattacactctttattttaaaatatataattgttttgactacagtcaccctattgtgttatcaaataagtcttattcattctttctaaattttttgtacccattaaccatccccacctccctcccatcccctactccccacccactactacccttcccaggctctgctaaccatccttctact

SEQ ID NO: 87287 - DNA, 601 bp, Human
gaaaaggtaccccttctaacactgtaaggcatctcaagtccaatcctattactatgaaaaggaggatttctaaatatcaggtcttgcctccctccttgcaattgccctgagtttttttgtttgttttgagacaggctctcgctctgttgcccaggctggagtgaagtggcatggtcatggctcactgcagcttcaacctcccaggctcaagcaatcctcccacctcagcctctcgagtagctgggaccacaggcacacaccaccatgcccagctaatttttatatttaaaaaattttgtgsatacatagtaggtgtatatatttatggggtacatgagatgttttgatacaggcatgcaatgtgaaataagtgtatcatggagaatggggtatccatgccctctagcatttatcctttgagttacaaacagtccaattacactctttattttaaaatatataattgttttgactacagtcaccctattgtgttatcaaataagtcttattcattctttctaaattttttgtacccattaaccatccccacctccctcccatcccctactccccacccactactacccttcccaggctctgc

SEQ ID NO: 87288 - DNA, 601 bp, Human
gatcattcagggccaactaggaggccttccctgcagcagtggttctgttatcctgccgaatacactcccactctgtgcatgacattaattccctgcttcgaccattcagcagcctatccttcccaaaggaaacagaagaaaaggtaccccttctaacactgtaaggcatctcaagtccaatcctattactatgaaaaggaggatttctaaatatcaggtcttgcctccctccttgcaattgccctgagtttttttgtttgttttgagacaggctctcgctctgttgcccaggctggagtgmagtggcatggtcatggctcactgcagcttcaacctcccaggctcaagcaatcctcccacctcagcctctcgagtagctgggaccacaggcacacaccaccatgcccagctaatttttatatttaaaaaattttgtgcatacatagtaggtgtatatatttatggggtacatgagatgttttgatacaggcatgcaatgtgaaataagtgtatcatggagaatggggtatccatgccctctagcatttatcctttgagttacaaacagtccaattacactctttattttaaaatatataat

SEQ ID NO: 87289 - DNA, 601 bp, Human
tgtggaatgcaacctgcctgtgagcacacaccttcgcccagggcaggccaccagccagccaactagcaggcccgacgtcagggcaggtggcacctggccagagctgcataagggagccactgaaggacactggggcagggcagcaggccatgagccatcttttcccctcctcccacttaaacatttctgggcgtgctgcgtgtacaaagtggtgacaagttctaggaggatctgcattccaaagggcaaacagaaaagtggctctattaggcctgacttgttgacttaagagacttagtcyttttttcatttcttatcttaaaaagtttttaaaccaggatcattcagggccaactaggaggccttccctgcagcagtggttctgttatcctgccgaatacactcccactctgtgcatgacattaattccctgcttcgaccattcagcagcctatccttcccaaaggaaacagaagaaaaggtaccccttctaacactgtaaggcatctcaagtccaatcctattactatgaaaaggaggatttctaaatatcaggtcttgcctccctccttgcaattgccctgagtttttttgtttgttt

SEQ ID NO: 87290 - DNA, 601 bp, Human
cagggtgtggaatgcaacctgcctgtgagcacacaccttcgcccagggcaggccaccagccagccaactagcaggcccgacgtcagggcaggtggcacctggccagagctgcataagggagccactgaaggacactggggcagggcagcaggccatgagccatcttttcccctcctcccacttaaacatttctgggcgtgctgcgtgtacaaagtggtgacaagttctaggaggatctgcattccaaagggcaaacagaaaagtggctctattaggcctgacttgttgacttaagagactcagtctttttttcatttcttatcttaaaaagtttttaaaccaggatcattcagggccaactaggaggccttccctgcagcagtggttctgttatcctgccgaatacactcccactctgtgcatgacattaattccctgcttcgaccattcagcagcctatccttcccaaaggaaacagaagaaaaggtaccccttctaacactgtaaggcatctcaagtccaatcctattactatgaaaaggaggatttctaaatatcaggtcttgcctccctccttgcaattgccctgagtttttttgtt

SEQ ID NO: 87291 - DNA, 601 bp, Human
ggactccaggggccagaacggcagggtgtggaatgcaacctgcctgtgagcacacaccttcgcccagggcaggccaccagccagccaactagcaggcccgacgtcagggcaggtggcacctggccagagctgcataagggagccactgaaggacactggggcagggcagcaggccatgagccatcttttcccctcctcccacttaaacatttctgggcgtgctgcgtgtacaaagtggtgacaagttctaggaggatctgcattccaaagggcaaacagaaaagtggctctattaggcctracttgttgacttaagagacttagtctttttttcatttcttatcttaaaaagtttttaaaccaggatcattcagggccaactaggaggccttccctgcagcagtggttctgttatcctgccgaatacactcccactctgtgcatgacattaattccctgcttcgaccattcagcagcctatccttcccaaaggaaacagaagaaaaggtaccccttctaacactgtaaggcatctcaagtccaatcctattactatgaaaaggaggatttctaaatatcaggtcttgcctccctccttgca

SEQ ID NO: 87292 - DNA, 601 bp, Human
aagacaagaccgagggcaaattacaaaaggaaatatctcccgagaagtgatatttaagcagtgaccactgcggctggactccaggggccagaacggcagggtgtggaatgcaacctgcctgtgagcacacaccttcgcccagggcaggccaccagccagccaactagcaggcccgacgtcagggcaggtggcacctggccagagctgcataagggagccactgaaggacactggggcagggcagcaggccatgagccatcttttcccctcctcccacttaaacatttctgggcgtgctgcstgtacaaagtggtgacaagttctaggaggatctgcattccaaagggcaaacagaaaagtggctctattaggcctgacttgttgacttaagagacttagtctttttttcatttcttatcttaaaaagtttttaaaccaggatcattcagggccaactaggaggccttccctgcagcagtggttctgttatcctgccgaatacactcccactctgtgcatgacattaattccctgcttcgaccattcagcagcctatccttcccaaaggaaacagaagaaaaggtaccccttctaacactgt

SEQ ID NO: 87293 - DNA, 601 bp, Human
cccccaaactccaaggaacagagaaattccagcaacctttcgaagataagacaagaccgagggcaaattacaaaaggaaatatctcccgagaagtgatatttaagcagtgaccactgcggctggactccaggggccagaacggcagggtgtggaatgcaacctgcctgtgagcacacaccttcgcccagggcaggccaccagccagccaactagcaggcccgacgtcagggcaggtggcacctggccagagctgcataagggagccactgaaggacactggggcagggcagcaggccatgrgccatcttttcccctcctcccacttaaacatttctgggcgtgctgcgtgtacaaagtggtgacaagttctaggaggatctgcattccaaagggcaaacagaaaagtggctctattaggcctgacttgttgacttaagagacttagtctttttttcatttcttatcttaaaaagtttttaaaccaggatcattcagggccaactaggaggccttccctgcagcagtggttctgttatcctgccgaatacactcccactctgtgcatgacattaattccctgcttcgaccattcagcagcct

SEQ ID NO: 87294 - DNA, 601 bp, Human
aagcaccagaatctccctagctagagacagaggcactgcaccagccaagttgttatgaactttaattggccttcccataagcataaaacattgttatgttacagaaatcacgaagttctttcctacctttacaagcaccaaagaaaaaacaaatcaaaaaacccccaaactccaaggaacagagaaattccagcaacctttcgaagataagacaagaccgagggcaaattacaaaaggaaatatctcccgagaagtgatatttaagcagtgaccactgcggctggactccaggggccagaacggcagggtgtggaatgcaacctgcctgtgagcacacaccttcgcccagggcaggccaccagccagccaactagcaggcccgacgtcagggcaggtggcacctggccagagctgcataagggagccactgaaggacactggggcagggcagcaggccatgagccatcttttcccctcctcccacttaaacatttctgggcgtgctgcgtgtacaaagtggtgacaagttctaggaggatctgcattccaaagggcaaacagaaaagtggctctattaggcctgacttgttgacttaagag

SEQ ID NO: 87295 - DNA, 601 bp, Human
gaaaatctgatgaactggaatgtgtacttttaacagagcctaaaattacttacaggcccagagggaatggcttgcctaactaacatgcattttccacatgctccatagtgttgcagttaggaaggaagctgtggggaaacttccattttggtgcaaatctcagcatcccccaaataacctgcaggactgcctggggaggctgccatccccaacctcctggctgctctggggggacccccacacagcctcctcctgctgagctgggaaaaggcaccggcacggtcaccaagcagcagttggraggcacactgtgtaaccacacaaggaaaaggtggaaggtaactttcaacacactcgctgttattccttctgtccctttccaattcagactgggaatttctccagcaccaagcaccagaatctccctagctagagacagaggcactgcaccagccaagttgttatgaactttaattggccttcccataagcataaaacattgttatgttacagaaatcacgaagttctttcctacctttacaagcaccaaagaaaaaacaaatcaaaaaacccccaaactccaaggaacagagaaattcca

SEQ ID NO: 87296 - DNA, 601 bp, Human
agacagggaagggaaaagagacactggggtaacctacatggaggtagtttacgcaggggcattaggaaaatccctttgtggtcccagggaaagtcagttatgaaaataatgaaaacaaccccctgtcttactaatgtaactgcttagtaggtctccccataccccataccttatcactcttccagccttggaagcagaatggagaggaaggggagttggcctggacagctgttctgccaaaagccccaggatccacccgcccacccgggaaaagggagtaggctcatttgtcatgaagacyaccagtttttaaatgggcttgaatcagaaaacctgggttcaaatgctgggtgattctggacaagttacttaacctatctgtgcctcagtttcctcagctgtgaaatggcaataatcatgcctaccctgaaggcttgctacgaggcctaaaagctggcatacggtgtctagctcagtgcttcgccgccggatataattctgcaaacccattcccctccaggctgcaggcctgaggccttgtgtcgttttcgaatgagacaactagatggggcagggtaacagcctgaaggaaaccagggta

SEQ ID NO: 87297 - DNA, 601 bp, Human
atggtgatctccaggaaactggatttgtgtggttttatcttttaatctgtattttagaattttttttttttttttgagacagagttgtgctcttgttgtccacgctggagtgtgatggtgcaatctcagctcaccacaacctccgcctcccaggttcaagcaattctcctgcctcagcttccagagtagctgggattacaggcgtgtaccatcaagcccagctaattttgtatttttagtagagacggggtttctccatgcctcaggctggtcttgaactcctgacctcaggtgatccacygcctaggcctccccaagtgctgggattacaggcttgagccaacatgctccgccattttagaatttttctaaattgaggaaggattattttaaaaatcaaggtagctttaaagatgtttatactaaagatcattttagtaataaaataaatatgtaatgcataagtataatgtaataaaaataaccaaggtctgctactccagaaactacattttcatctacaatctactctcctgtagctttggctttaccaattctgatggagctgaggcaagggggtagtttataaataagcaccagg

SEQ ID NO: 87298 - DNA, 601 bp, Human
aggcttttcttaaaatctttgtcccagacagctctcaacccatctcaattctagtatgtaatctcagtttattagaatcaggtattagttattacaatgtcatggagaagtgttacaactgagccagtgtgtctctaaaatggggccaataggccaggcaaggtggcttatgcctctaatcccagtgctttgggaggccaaggtggggggactgcttgaggacaggagtttgagaccagctgagcaacatagcgagaccccatctttacaaaaaaattaaaaattagccaggcatggtggygtgtgcctgcagtcctagcttcttgggacactaagacaggaggatcacttgagtacaggagtttgaggttgcagtcagctatgatcatgtcactgtacttaagccggggtgagagcaagacactgtctctaaaaacaaaagaaaaattaaacggcggctaatgacacctcacagcacaatgatgtactaagagtggaactaacagatgcaacaacaagtctagccacctgaacacacggcaggcatgggacggttcctctccttgatctggtacacttgtcctcaaccttaattacccca

SEQ ID NO: 87299 - DNA, 601 bp, Human
tgggagatgctgacactgctctgcagatctacagatttgttaagtgtttctgcccagccagagaacagtttagttctctgagcttttgtctgacaccggccggatcctgctgcgacgttttgctgccaacagcaaggctgcatgtgttcggagctgaccgatcccctgcagtggaagagcagaatctcatccaagagcctctccgctgtgggctttgccattcatgttctcacttaacagccacagctggctgctattacccttaattacgcttctcctgggctcagtaaatgctctataygtctggaaactattaaaaatgtgtacagtgattggaaacctgagctctcaaacactcttctttctcctgagaggcttttcttaaaatctttgtcccagacagctctcaacccatctcaattctagtatgtaatctcagtttattagaatcaggtattagttattacaatgtcatggagaagtgttacaactgagccagtgtgtctctaaaatggggccaataggccaggcaaggtggcttatgcctctaatcccagtgctttgggaggccaaggtggggggactgcttgaggacaggagt

SEQ ID NO: 87300 - DNA, 601 bp, Human
tgcaaaatgttaacattgacagaacattttagatgttgcttttaactataaactcacttcccatgctgcattcaattgattctttattcagtgttttctctccctgtgttttaatggccctctagtgttgtataaatggttaactgaatggttatatccattcactcaaccaatatttgcctgaaacctcctggatacaccgactatgggaaaaacaactcaggctggcaaatctgcagcaaaagctcctgtggttggcaagaggaggcactcagatgtcacatgaaggacacttccagarcagtatgcctggaatgggtgaggtggtaaattaaaaataaagggtggttttgtatttgattctcaaatgcaagaaggtgatatcatgtgacacatcaggacctctataaccttggcctttatttaataaacacattgtaattaataaaactactccccaggctctaaaaagaagatcccacaggtcacaagaaacaagctaaggagcaagaccccagccaagaggcagtcaggagaaaagacaaatgaagtggaaagtcagaaaacagccaagagagaagccccaaacctgtcaccctca

SEQ ID NO: 87301 - DNA, 601 bp, Human
actgagccccctggatttggggatggaagggacagaaaaatgtgaggacatgcttgatccaagacaataacatggccatcagaacaaaggcaggaaagaggaggtaagaatggtgttctccagccccactccagaggccaggaaatgaatggggaggaggataaagattgaatagttgatgggctggaatgtgcctgtaaggccagaccctaataaaatcgaaatctcattttccccaacaaacctcccttttctcatcctaaactacatgggtcaacctcagagacccaaaacaggaagsagggtgatcttttctccgcatgacaacaggatcaatatgaatggggtcagtctgcggcagaaagcatagactgtgaccccctttccttcccactgtaaatcaggacccaggagttaactgctttagaccagaattgcctcagtttcttccaggctgtggtacaagtgctggaggcgaagccccagtttatagctgtagttactaaaatacagcatgcatttgaactccagggccactctgtcctgaacgttcggagcttacgatgttactccacgctgtgctctctccgtgcccaggtgt

SEQ ID NO: 87302 - DNA, 601 bp, Human
cctccactgagccccctggatttggggatggaagggacagaaaaatgtgaggacatgcttgatccaagacaataacatggccatcagaacaaaggcaggaaagaggaggtaagaatggtgttctccagccccactccagaggccaggaaatgaatggggaggaggataaagattgaatagttgatgggctggaatgtgcctgtaaggccagaccctaataaaatcgaaatctcattttccccaacaaacctcccttttctcatcctaaactacatgggtcaacctcagagacccaaaacasgaagcagggtgatcttttctccgcatgacaacaggatcaatatgaatggggtcagtctgcggcagaaagcatagactgtgaccccctttccttcccactgtaaatcaggacccaggagttaactgctttagaccagaattgcctcagtttcttccaggctgtggtacaagtgctggaggcgaagccccagtttatagctgtagttactaaaatacagcatgcatttgaactccagggccactctgtcctgaacgttcggagcttacgatgttactccacgctgtgctctctccgtgccca

SEQ ID NO: 87303 - DNA, 601 bp, Human
gtaaattctattcctgccatgatctgacttgcgggacatgtgattgtggctgtttttcagtggcaatgatggaatttcagtgagtacctggcaggatttcagagctaacctgtggctatgaaacagccaagccgagtgaccagcggttttggtgttactagaaagttttgctggctggactgtaaactcatactcaagtcctccaagcatccagggcttgggagaacagaagtgggagtgctgatcctcagcaataaagatggcagcctgactttcctctatgaggcctgcttgacttcakatacagatattcaggtttgacactcatcctaaaaaatccctggcacagcagataaattcaaatgcccagtttcagaaacggtaattagggagttctatggcagatggaccaggaatccgaactttttaataggacagtctgttttaggtgacctgagataaactattctaaggattctgatagaagctctgcaaatgtctcatttcccagtgattatcctagactgcccacacctggtgacccagatggaggcagtctccttcttatacaacacactttagccagatgtctcatcctaat

SEQ ID NO: 87304 - DNA, 601 bp, Human
ctcagcaccagcagacgtgctgtgaagaaaaggctgtggccgccttcctcctgctgcccaccatgctgcccttccttctgtagacccctgctccctacacccactccctgaggcattgcctttctgaaagaagcctctgggtctgggctaggcccatctcctggacatattctcttgatactagaagctgagaagagaaggtggcagatgtggctatagtgtaagggctgggttggatggtgacacgcaaagtaatgtgaccctccttttgggctttctctgggtatgccacttcctcctrggccactgtatgctctggaggactgtgtcctgtcactgctgatgtgctccagaagggaaaggctgacactgttagaaggcagggagccgcctacaaagcatggtaatgtggttggggacaagtccctaactgctgagtttgatgtcatggatggcaaccatgtgatcccacaaaacatctcctttaccagtctcaggggaagctctgggctggaaggctttacccacagcctggcctgttggctctgctgtcaaaattctaggcagttttaggtgacaggaaataaacataatgcacatt

SEQ ID NO: 87305 - DNA, 601 bp, Human
gtcaggagttcaagaccagtctggccagtatggtgaaaccctgtctctactcaaatacaaaaattagccaggcgtggtggcgtgtgcctgtaatcccagctactcgggaggttgaggcgggagaattgcttgaacctgggaggcggaggttgcaatgagccaagatcatgccactgcactccagcctggttgacagagtgagaccctgtctcaaaaaaaaaaaaataaataaaataaaattacccttttgcttaaattttggaacaggtgatagatacacatggtaaaaatgtcaaagtgkctgaaagcagggtagaaagaaaaaataatcccccatccgccccatctgcattgctgttagcgcatcccagagatggcaactctcttcaactgcttgtgcgtgtgtgtttcacatacagcctggcctgctggccagtccactgtcaaaattcaaggcagtattggatgagaggaaataaacatgatgcaaagtaaaacacctgaatgaaaaattacactcttgttataatagaaatcagcattatcatgaaaatacggcagaactgatgttgcttattttaaatactgatcctagaaaatt

SEQ ID NO: 87306 - DNA, 601 bp, Human
ggagtttgctgaagggcttcagctgtttctcatagagaatggcagtttgggtgtactggtgccgcagagcagtccacgtcttttctaaccttgtgatctggaagaaaggtggtgttttggaaaaggttctttttaaaattaccttttagtggctgggcgtggtagctcacgcctgtaatgccagcactttgggaggctgaggcgggtggatcacttgaggtcaggagttcaagaccagtctggccagtatggtgaaaccctgtctctactcaaatacaaaaattagccaggcgtggtggcrtgtgcctgtaatcccagctactcgggaggttgaggcgggagaattgcttgaacctgggaggcggaggttgcaatgagccaagatcatgccactgcactccagcctggttgacagagtgagaccctgtctcaaaaaaaaaaaaataaataaaataaaattacccttttgcttaaattttggaacaggtgatagatacacatggtaaaaatgtcaaagtgtctgaaagcagggtagaaagaaaaaataatcccccatccgccccatctgcattgctgttagcgcatcccagagatggcaact

SEQ ID NO: 87307 - DNA, 601 bp, Human
gggttgtgccatctgagtggaattcccagccctgcttgctggtaactgcttttgtcctttaacaatcaatgcagtgttttctgggaagctgtcaccaggtgcttcctctttcctaacatctctgaccaaatcagtcccttcccctaagtgctcccacagtatacactgcatttatcgtacctgcttaaattcctcaggacatccagttagcacggtgccgcgcgcatgccacatgtgtgataaatgccggccgtgctgactgaggaggctgctttctgtcaccatagcacttgtaagaaaratccgtttacgcaacactgccccacactttccaggatgtgtctgatgctaagagcaggggagctcacttcccagtgtgactgggaaggaacaggaatgcagataaatgaggtctggataaaactccacctcctcatcttggcacatcaccttttctaatctcacctattagaggtactattaataagtggtaggcaagttggccaattcttgttctgttgcccagcgcccaggctggagtgcagtggtgcgatctcggctcactgcaacctccgcctcccgggttcaagtgattctcctg

SEQ ID NO: 87308 - DNA, 601 bp, Human
aatgtccccaaagaaaaatataggatctgttctatataagggagagcagagccccaccctgcagaacctaagcaccttcagagaagaaataacaggtaaactcattaaaaaacaatagagtgaaattggtttgtacaaaccactgtgggaagtagtgctgtgggaaggagggttcattgtacctaggagttcgttacttgtttttaccaactttactgatgtatagtttacatgtcatatgattcacctgtttttggctgtggagtttgatttatgatggtaagtttttacataaaccatyaccaccagtcttagaacacttccatcaccttagtacctctttgcagtcaattcctgttcctactgcagacctcagtcaaccactgatctgctttctgttgctactgttttgccttttctagaaatatgggataaatggaatcatccactatgaactttttaatgtgtgacttctttcacttagcatgatgtttttgagattattccatatgttgcatgctaatcattcttactgatcaatattcagttttatggacatgccattgtttttgtttatccattcaccaattgatgacatttg

SEQ ID NO: 87309 - DNA, 601 bp, Human
cagaactttaaaaaatgtccccaaagaaaaatataggatctgttctatataagggagagcagagccccaccctgcagaacctaagcaccttcagagaagaaataacaggtaaactcattaaaaaacaatagagtgaaattggtttgtacaaaccactgtgggaagtagtgctgtgggaaggagggttcattgtacctaggagttcgttacttgtttttaccaactttactgatgtatagtttacatgtcatatgattcacctgtttttggctgtggagtttgatttatgatggtaagtttktacataaaccattaccaccagtcttagaacacttccatcaccttagtacctctttgcagtcaattcctgttcctactgcagacctcagtcaaccactgatctgctttctgttgctactgttttgccttttctagaaatatgggataaatggaatcatccactatgaactttttaatgtgtgacttctttcacttagcatgatgtttttgagattattccatatgttgcatgctaatcattcttactgatcaatattcagttttatggacatgccattgtttttgtttatccattcaccaa

SEQ ID NO: 87310 - DNA, 601 bp, Human
taacctcctaactggtcttattggcttcagagaaaccgttctgcacctcccagcctcatggtcacctttttataaacacagatcagaccctttgctcagaagagaagagaaaaatactccaaaaccctcagcaaggtattcaaagccctccttgatttgtccccaaatttctctctcaaagacatatatcctgtgtgtatgtgcagttccctagacatgccaagcacctttcttgctctggaggaaacagcccttgcttgggtagacagatctctgcccagggataagcagtgactggacrtcagcccctcagccacactggacagagaagaagggcagtaaggagacaggaaggaggataatgatgcacccttgggtgcaggagacagcggctggacatgcacctctgggctgccttcctcccacactcccccagcccctgccccagagactcacatgtaagccttgtagttggatccaattttctggatgcggatgtcgtacttggagtcgatgaaggcctcggtggtggcgtaggttttggccatggcgaccacgctggtgatgtcctggaagtcaagctggttttccactttgatct

SEQ ID NO: 87311 - DNA, 601 bp, Human
acactgcatgccttcttataaagttttctgcttttctctaatcaataaaatgcgatcaaagttggactaatcagtattttttccacggaatcacaatcttgagttaagccttgaaaatgactagggcagattcatttaccagtagggatgccatgaaaattgtttattattatttctggctgcccaccttcctggggctactctgtatctgaatgtttctgaaattgataattgagttgggagatatttttgtttgcttttttaaagtttctgataacccatggttttctagtaaattccmtttaaaaacccattaagttaatgagatgtggtttctgttgcttgcaggcagagaaatctggtgtaacctcctaactggtcttattggcttcagagaaaccgttctgcacctcccagcctcatggtcacctttttataaacacagatcagaccctttgctcagaagagaagagaaaaatactccaaaaccctcagcaaggtattcaaagccctccttgatttgtccccaaatttctctctcaaagacatatatcctgtgtgtatgtgcagttccctagacatgccaagcacctttcttgct

SEQ ID NO: 87312 - DNA, 601 bp, Human
ccagagtgaaagatagagagggcttggagcaaagacctctcccaagaacgagacagtctgcctattccagaagtccccattcatccttataaccacagccccatgtaatccgtgctttgttgaaccacctctagggtgaaggcgggctgcttttctctgcctggcattctttccttttcctctagattcagcacctctatttccactgggcaatggctctgcccacactgcatgccttcttataaagttttctgcttttctctaatcaataaaatgcgatcaaagttggactaatcagtaytttttccacggaatcacaatcttgagttaagccttgaaaatgactagggcagattcatttaccagtagggatgccatgaaaattgtttattattatttctggctgcccaccttcctggggctactctgtatctgaatgtttctgaaattgataattgagttgggagatatttttgtttgcttttttaaagtttctgataacccatggttttctagtaaattccctttaaaaacccattaagttaatgagatgtggtttctgttgcttgcaggcagagaaatctggtgtaacctcctaact

SEQ ID NO: 87313 - DNA, 601 bp, Human
cacagaagcctgcggatggagggactttccagctgtccagggctaacccttgcagtcctcagatatggagccctgcacacagtcagtgccccataaatgcttggcaaccaggcaacgattggccctctggggtctcatcatttcaagtggaactaacaataacattccagagtgaaagatagagagggcttggagcaaagacctctcccaagaacgagacagtctgcctattccagaagtccccattcatccttataaccacagccccatgtaatccgtgctttgttgaaccacctctagsgtgaaggcgggctgcttttctctgcctggcattctttccttttcctctagattcagcacctctatttccactgggcaatggctctgcccacactgcatgccttcttataaagttttctgcttttctctaatcaataaaatgcgatcaaagttggactaatcagtattttttccacggaatcacaatcttgagttaagccttgaaaatgactagggcagattcatttaccagtagggatgccatgaaaattgtttattattatttctggctgcccaccttcctggggctactctgtatctg

SEQ ID NO: 87314 - DNA, 601 bp, Human
tccataaatgggcgtgcatggctgtgatcaacagaactgtatttagagacaggtggcagctggattcggcctgtggttgtggtttgccaaccctagcttaaagcacaagctacccacacagaagcctgcggatggagggactttccagctgtccagggctaacccttgcagtcctcagatatggagccctgcacacagtcagtgccccataaatgcttggcaaccaggcaacgattggccctctggggtctcatcatttcaagtggaactaacaataacattccagagtgaaagatagagrgggcttggagcaaagacctctcccaagaacgagacagtctgcctattccagaagtccccattcatccttataaccacagccccatgtaatccgtgctttgttgaaccacctctagggtgaaggcgggctgcttttctctgcctggcattctttccttttcctctagattcagcacctctatttccactgggcaatggctctgcccacactgcatgccttcttataaagttttctgcttttctctaatcaataaaatgcgatcaaagttggactaatcagtattttttccacggaatcaca

SEQ ID NO: 87315 - DNA, 601 bp, Human
tggaatagggcagttactcctcaagaatgagctccatccctttcctgggaacacttccttctagggcaactgcctgcacctcctccagtttcacaagcaatgacagggctcagtagttgcaacagagacgatatagcccgtcaagcctaaaattaccacctggccctctacagaaaaagtttgctgacccttggtctaggcaatccaggtagtgctaaagcaaccacaggcaatccataaatgggcgtgcatggctgtgatcaacagaactgtatttagagacaggtggcagctggattcrgcctgtggttgtggtttgccaaccctagcttaaagcacaagctacccacacagaagcctgcggatggagggactttccagctgtccagggctaacccttgcagtcctcagatatggagccctgcacacagtcagtgccccataaatgcttggcaaccaggcaacgattggccctctggggtctcatcatttcaagtggaactaacaataacattccagagtgaaagatagagagggcttggagcaaagacctctcccaagaacgagacagtctgcctattccagaagtccccattcatcc

SEQ ID NO: 87316 - DNA, 601 bp, Human
tgtatacacgggtaaggatacacacatgtacttccttactgtgtctgctaggacttagaaagaatgacagcccagtagcgacaagcacaaaggcccgagtgcagggcaaggagtgggccagagagggggttgaatggccggggaaattctacactgaagtctgacatgaaccccctcctttggagatgggccagcccaaggtccaggaaactcggtaagtaatgacaaagtggagctgtcaggccagggaggctcagcagaaaaatgctgcaatgaggtaatcctcaagaaaaaaaaaaaactgggacaaggtgtcgtcaatgtcaagtggaagctcaaacaatgaagagaggagggaaatgatatcatggctgaaggcaggggcctcaggaacgcactggaatgggccataactcagagggggcagggaggaggtgattttatcaccccgaggccatctgagagcagtggcaggtctggcttgcctcacaggaggaagaggttgattagtggaatagggcagttactcctcaagaatgagctccatccctttcctgggaacacttccttctagggcaactgcctgcacctcctccagttt

SEQ ID NO: 87317 - DNA, 601 bp, Human
tgagactgggcacatacactgagatggaaccaaaaaagtggaatagatggtggatgggggagctggatttttctctgttggagtgggaagttatagattagcaatcaggaaaggctaaaatgaacgaagtggtaccagatgaaagtcagggacatccataggactctgtttagcttcatagggatgtggatgggaacatatagaaaaaattatggatatatgtgtatacacgggtaaggatacacacatgtacttccttactgtgtctgctaggacttagaaagaatgacagcccagtagygacaagcacaaaggcccgagtgcagggcaaggagtgggccagagagggggttgaatggccggggaaattctacactgaagtctgacatgaaccccctcctttggagatgggccagcccaaggtccaggaaactcggtaagtaatgacaaagtggagctgtcaggccagggaggctcagcagaaaaatgctgcaatgaggtaatcctcaagaaaaaaaaaaaactgggacaaggtgtcgtcaatgtcaagtggaagctcaaacaatgaagagaggagggaaatgatatcatggctgaaggc

SEQ ID NO: 87318 - DNA, 601 bp, Human
acaggtgaaccattctgagactgggcacatacactgagatggaaccaaaaaagtggaatagatggtggatgggggagctggatttttctctgttggagtgggaagttatagattagcaatcaggaaaggctaaaatgaacgaagtggtaccagatgaaagtcagggacatccataggactctgtttagcttcatagggatgtggatgggaacatatagaaaaaattatggatatatgtgtatacacgggtaaggatacacacatgtacttccttactgtgtctgctaggacttagaaagartgacagcccagtagcgacaagcacaaaggcccgagtgcagggcaaggagtgggccagagagggggttgaatggccggggaaattctacactgaagtctgacatgaaccccctcctttggagatgggccagcccaaggtccaggaaactcggtaagtaatgacaaagtggagctgtcaggccagggaggctcagcagaaaaatgctgcaatgaggtaatcctcaagaaaaaaaaaaaactgggacaaggtgtcgtcaatgtcaagtggaagctcaaacaatgaagagaggagggaaatgat

SEQ ID NO: 87319 - DNA, 601 bp, Human
gtgagaggaattgacacaaaaatgtatcattgtaagagaaaattgaagtaaaaatgctgagaatagatgaccaccaggagccataaggcactgcaccgtagttggcaaggttgtttcccatggagctacaggtgaaccattctgagactgggcacatacactgagatggaaccaaaaaagtggaatagatggtggatgggggagctggatttttctctgttggagtgggaagttatagattagcaatcaggaaaggctaaaatgaacgaagtggtaccagatgaaagtcagggacatccayaggactctgtttagcttcatagggatgtggatgggaacatatagaaaaaattatggatatatgtgtatacacgggtaaggatacacacatgtacttccttactgtgtctgctaggacttagaaagaatgacagcccagtagcgacaagcacaaaggcccgagtgcagggcaaggagtgggccagagagggggttgaatggccggggaaattctacactgaagtctgacatgaaccccctcctttggagatgggccagcccaaggtccaggaaactcggtaagtaatgacaaagtggagct

SEQ ID NO: 87320 - DNA, 601 bp, Human
aagactgaacgagtttaagcatagtggtggaggtaaagctatttgtcttacggtcaagggaagctatgtcattgagatcaaagggtgaactggtgagaggaattgacacaaaaatgtatcattgtaagagaaaattgaagtaaaaatgctgagaatagatgaccaccaggagccataaggcactgcaccgtagttggcaaggttgtttcccatggagctacaggtgaaccattctgagactgggcacatacactgagatggaaccaaaaaagtggaatagatggtggatgggggagctggrtttttctctgttggagtgggaagttatagattagcaatcaggaaaggctaaaatgaacgaagtggtaccagatgaaagtcagggacatccataggactctgtttagcttcatagggatgtggatgggaacatatagaaaaaattatggatatatgtgtatacacgggtaaggatacacacatgtacttccttactgtgtctgctaggacttagaaagaatgacagcccagtagcgacaagcacaaaggcccgagtgcagggcaaggagtgggccagagagggggttgaatggccggggaa

SEQ ID NO: 87321 - DNA, 601 bp, Human
tacatcatctgatgaaatcccccaaactttggcctgtttttgaggagaatgagggcagtgtgtatagcccctggtgattctggaatcttttgagggccccaaaatgttagaaaagtgatccttagagagaagtgactacttttctctggtgaagattaggaaggccttctggtctctgactgtcttgccatccttctctgtttccttgccttttctgctccagtaacaaccgacctcccttccggtgctccactgcccatggctctttcccaatgtcatggcctctgcaggtcttcttccstttactccgtacagtctttgtctccatctttgcctccctaagtcctgctcatcctcaggtttcatctgacatacgacttcctgacagcccacctttacacagcaaaaatagactgcccggtactacgccctacactaatgctcagtaatgctcatctcccttctgatgactgcattagtgtcctctcttctctgatggaggagaatcctgacggtaggggacatgtttaacttcatcccctgtatacccagtatccagtgggatccggcaggtagtaggtgcccagtaggcacctactgg

SEQ ID NO: 87322 - DNA, 601 bp, Human
cttcatgctgtttgccttttttatttgttggatcctaggtattgttttctaagtcatctttgaaattgaaagattaaattaaaaaatgcctacatcatctgatgaaatcccccaaactttggcctgtttttgaggagaatgagggcagtgtgtatagcccctggtgattctggaatcttttgagggccccaaaatgttagaaaagtgatccttagagagaagtgactacttttctctggtgaagattaggaaggccttctggtctctgactgtcttgccatccttctctgtttccttgccytttctgctccagtaacaaccgacctcccttccggtgctccactgcccatggctctttcccaatgtcatggcctctgcaggtcttcttccctttactccgtacagtctttgtctccatctttgcctccctaagtcctgctcatcctcaggtttcatctgacatacgacttcctgacagcccacctttacacagcaaaaatagactgcccggtactacgccctacactaatgctcagtaatgctcatctcccttctgatgactgcattagtgtcctctcttctctgatggaggagaatcctg

SEQ ID NO: 87323 - DNA, 601 bp, Human
gctcctactatggccagtgcctctccctacacctcctttgtctcttacctctctgtcatggccacctgctccagcatggcagagcctgtgttggccttccagttcccagagatggaggttctcctgtaccagaacaaacaacacattgagggaattagggaccctcgtcactgatctgctttccttctttgctttggctgttaggaggctctgattcaaataactggctcacgtaatggcatgtattcttacgtacacaccttgtcttcaactatattttcctatgtttatttcccttcakgctgtttgccttttttatttgttggatcctaggtattgttttctaagtcatctttgaaattgaaagattaaattaaaaaatgcctacatcatctgatgaaatcccccaaactttggcctgtttttgaggagaatgagggcagtgtgtatagcccctggtgattctggaatcttttgagggccccaaaatgttagaaaagtgatccttagagagaagtgactacttttctctggtgaagattaggaaggccttctggtctctgactgtcttgccatccttctctgtttccttgccttttct

SEQ ID NO: 87324 - DNA, 601 bp, Human
agttcttagagggaaggattggattttttcatcctttagcgctcagcacaacatggcctgcagtaggtactcaataggtgtttactgaacagagctttttgagttcacagcccatgctctgtccattgctattgtgtggctgctagcagaggtcacagggcatgcaggcaagaaggtatgtatgtggcaggccctgagaccagctgacttggcccttcgacccttcccccccttttttttttaaacagagttttgctctttttgcccaggctggagttcaatggcacgatctcagctcacygcaacctccgcctcctgggttcaagtgattctcctgcctcagcctcccgagtagctgggattacaggcacccaccaccatgcttggctaattttgtatctgtagtagagatggggtttcaccatgttggccaggctggtcttgaactcctggcctcaggtgatctgcccgcctcggcctcccaaaatgctgggattacaggtgtgagccaccgcacccggccggcacttccttaagtggggctggcacacagtgtctaaagggagaaagaccgaaaaacccttcagccagagagcatccc

SEQ ID NO: 87325 - DNA, 601 bp, Human
gacctaagccaggccaaccagtacatatggctcagttctaggctttggttgaaatgactgggaaacagaagttttccttcttttgaacctgacactgtgaggatgaaagcctggagccactgtgtgccaccatgaaatgaaagagcctgcctggatgaagccaacacacaaagaagctgaacttgggtgggcagaggaggagccttaaggccttacctgacactgtatatctggagtcgtcagtgacatgagccagtaaatccccctttctgcgcaaaccaatttggtttgtgtggtagcycttgcaaccgatacagagttcttagagggaaggattggattttttcatcctttagcgctcagcacaacatggcctgcagtaggtactcaataggtgtttactgaacagagctttttgagttcacagcccatgctctgtccattgctattgtgtggctgctagcagaggtcacagggcatgcaggcaagaaggtatgtatgtggcaggccctgagaccagctgacttggcccttcgacccttcccccccttttttttttaaacagagttttgctctttttgcccaggctggagttcaatgg

SEQ ID NO: 87326 - DNA, 601 bp, Human
caggaggcactggggaaggctgggctcacattccggaagggccatagagaagatggccacgactgtcccgtgaacacctgttgggggaaggaggtgactgcctcagccacatgattcagtcgtgccaggtcatgagcgcagcctccaagagactcattagcacaggtgggttcccaggttgaaggtggcagctgccccctggggttgatgggaaggacaggtgttcctccctgccaggggctggttctggattaggtgcagccctctctcattcagtcctcacacctgcactctgacttgrgtattactgctttcgttttgcagttgaagaagctcagaaagcatgagcatgcctaaggtcacactcagtctttgttgctgtaggggatgctcccactccagtctccaggggtgcagacctgacataggcctccaatcacagcgttgcagtgtcttgggccatagtgattggttcagggatggtcatgtgacctaagccaggccaaccagtacatatggctcagttctaggctttggttgaaatgactgggaaacagaagttttccttcttttgaacctgacactgtgaggatgaaagcct

SEQ ID NO: 87327 - DNA, 601 bp, Human
aaaaacaggcagggagggacagtgactcacacatccagacggcgatggagagagacagagaagcagcaagagagacagaaagacggagagagagttggagtccaacacgcagagacagagaggcagggagagaggcagggacacacatgacagtgagagagagacccagagaaagaacacgagagagccaggaaggaggggagagaggcagggagagaaggaaccagagttgggagaggtctcccccgaccccaggacttgctggctctgcagtaatggggagcttgccctgtccccatcyggagtcatcctggacacccagccacccctgtgtcccttttcccttgggaaagctgctccaagggctccagaagtccctccaggctgcccttccagtcccagccctggccggacaagaggctgtggaggacaaagggtgcatttttcccagggcccggggcgggtgggctggggagactggcaggctgcttctgcctcgcccagggagcctggccctctagacccactgcttttgttccctttccagccacttgatgtctgcaaggccagtttgctttgctggggacagatctcagcactg

SEQ ID NO: 87328 - DNA, 601 bp, Human
gccaaacatttccgagcagctgtccacccacagcctgtacctgcagggacagatggacagacagtgaagtggcctgggaaagtggggaagcgggtagagggagagaagtggattcacatggaaaaacaggcagggagggacagtgactcacacatccagacggcgatggagagagacagagaagcagcaagagagacagaaagacggagagagagttggagtccaacacgcagagacagagaggcagggagagaggcagggacacacatgacagtgagagagagacccagagaaagaacasgagagagccaggaaggaggggagagaggcagggagagaaggaaccagagttgggagaggtctcccccgaccccaggacttgctggctctgcagtaatggggagcttgccctgtccccatccggagtcatcctggacacccagccacccctgtgtcccttttcccttgggaaagctgctccaagggctccagaagtccctccaggctgcccttccagtcccagccctggccggacaagaggctgtggaggacaaagggtgcatttttcccagggcccggggcgggtgggctggggagactg

SEQ ID NO: 87329 - DNA, 601 bp, Human
gggctggacgcggcactggagctgtgagtgtggagatgggaagttatggcggactctgaggccagaggggccttttcaggggaaagcagtggagagccatgggacatggagtgggggggcagggaagaagagttggggaggggacgggagggctgtgggaccgtgagagacactgggaagacatggaggagaggtgggggttagtgggatacggggaaacagagagaggaagcggcggggatgggaggactataggattgggagaggcatgggctgctggagggtcttgagagagattccrggacccacagcccctctgtgagccctctgttaccattctgtttccctacatctttccctctattcatgcccctgtaccattccatcccccttccaaatcctcaatgctctgccactgtttctcaccctctcccctgccagcctgcacaccccatgtctattatgtccacggctgtatccccagagccacacccatgcttagcccatgggagccccctaaggccatgtttgttgaatgaacaaatgatggactgtctgcatggtgaccaaggaaggtgcccatttcacatgcttggacact

SEQ ID NO: 87330 - DNA, 601 bp, Human
gggttttgccagggccccggaaaacaggcctttcctcttccctctttcccctggcgacagaatgagaccccgtctcaaaaaaaaaaaaaaaaaaaaaaaaaaaaaagaatgtgagtactgcttctagcagggtcctgagctctgcgcaggtcgtacctgggactgaggcctcctggatcccagcgccccagacagggacagtctctcagtcaccactggctgagctctgactgtggagtctgccgcgaaggtacacaggcttgctgcaccctgcctgtcctctctccccctgcccctgccmaccccattttattctggtctctgtttcctacattccctgcagtggaaaacagccaccgcaaggaacctgaggttcattttggaatccccacggtagagacagccaaaggaagtggccaccctcgtctccccagggaaacatttttccagtgagcaatgtcattccccggacaaggtcagagaggacaagttcaagggtcttttcccctgagtatttcactgtgagcctcttcacaaaacatttcacacacattttcagttctcaccacagagatggctgaagaaaccagtgttttgggat

SEQ ID NO: 87331 - DNA, 601 bp, Human
caaggttaggaatgggccctgtgtcctgctaagcaggtgtgccctccacagacacctgtttagtggaggaataagacgcccttgtgataagcccggctcataaggataaggatactaagaagcgccgtattttatggggcatttcctacgtgctacgctctattctaagcattgggtgtggaggatctctcataaacctcagaatagctctttgaggcagtactattatcctcattgtaatcaagaggaagcagagggtcaaagaagtggcaaggtcaaggacacagcactggcaacccayggtcctcccactgcatcaggctaattcccaccaagcactggaacagcacaccagggtaggaactgagaagagggaacctgggttccaggcttggcttctgctgtgtatttgctctgtgatcttgggcaagtttcttttcctctacgggcctatttttttttttttttttctcaacagtgaactgagggatctgggcagctgctaagacccttccagctgggacttgtagggatctgtgagtttaagcacccactttgattaggaaactgaaaagctagcttaagaatgtgaatactggct

SEQ ID NO: 87332 - DNA, 601 bp, Human
cttgtctcccctgttcccacgctctggacatattaggttttctctctcctccaggttcttatgtaatccctctacccactccttacctggccaactcctttcatccaacagggaacagctaactaggtcttcctccaggaagccctctctgatagtgcaagctctgacgagccacctgacaactgtatcctgccgttctcacctggtttcacacgggacagcttatccacggcactgtcaccccttgcttactatgtctccaccaccagactgggagcccccaaggttaggaatgggcccygtgtcctgctaagcaggtgtgccctccacagacacctgtttagtggaggaataagacgcccttgtgataagcccggctcataaggataaggatactaagaagcgccgtattttatggggcatttcctacgtgctacgctctattctaagcattgggtgtggaggatctctcataaacctcagaatagctctttgaggcagtactattatcctcattgtaatcaagaggaagcagagggtcaaagaagtggcaaggtcaaggacacagcactggcaacccacggtcctcccactgcatcag

SEQ ID NO: 87333 - DNA, 601 bp, Human
gtctgtcctcttccacatgctctccaatcagcggcattgagctgtccattacctgtggggaggaagggagagctgagggacccccatgccaggagagatggcggttgggcatcacatcccagaagtgggggctcagggctcaggacagaagtgaccaccagatggcgatgtcctccatgcaaatcacctccagctgggactggccggcagcgacatcagttcccttcggttcagtctaaaccactccctggaggtagttcaattcggcccacgtttgctggatgacagcaatgcgacaagkgccagggagcctctgccgaccttttctgtgcttttctttggggagccgctctccgccccctcctttctcaccctggccccctcccagggtcggggctggccacctctcctttggccccaggtcaaggctgctttccacaaagcagaaacagtaaaggtgggggcttgatcatgacaaaaatatgacgcgggctggagttgacccagggttcagaggaaagagggaagaggaaaggcctgttttccgaggccctggcaaaacacaggcgggagggaaaagcattccacagggagctgggct

SEQ ID NO: 87334 - DNA, 601 bp, Human
gaggggggagggcgctgtgcctcctggcatcgggagctggctcattttggagacaacaaggtcggccatcagctgtctgtcctcttccacatgctctccaatcagcggcattgagctgtccattacctgtggggaggaagggagagctgagggacccccatgccaggagagatggcggttgggcatcacatcccagaagtgggggctcagggctcaggacagaagtgaccaccagatggcgatgtcctccatgcaaatcacctccagctgggactggccggcagcgacatcagttcccttyggttcagtctaaaccactccctggaggtagttcaattcggcccacgtttgctggatgacagcaatgcgacaagggccagggagcctctgccgaccttttctgtgcttttctttggggagccgctctccgccccctcctttctcaccctggccccctcccagggtcggggctggccacctctcctttggccccaggtcaaggctgctttccacaaagcagaaacagtaaaggtgggggcttgatcatgacaaaaatatgacgcgggctggagttgacccagggttcagaggaaagagggaa

SEQ ID NO: 87335 - DNA, 601 bp, Human
aggttggggaaaatgggagacacaatagcgtccattgactggttccctgggagcacacagagggcttgtgtgtccatatgctctcgcacacgcacgcacacacatcctgctcaggcccagcaccgagggcacagaagggacagcagtcgatcatctctgcccacagtgcccaaaggccatttgagacaagattgttctccccaggatggtgaagaagggaaggggcctctgaaagcctcctcaattcacttactggggcaggctgtgaaagctctccccaatgtctggccttcgtccacasccccattccttctccccaaggtggtttcttcctgggggtatcccctttggatccaggggctccccatttccagacagcctggcatttctcatggctataaagtctcctttgatcgtgagggtcttacccaaggtctgaggggggagggcgctgtgcctcctggcatcgggagctggctcattttggagacaacaaggtcggccatcagctgtctgtcctcttccacatgctctccaatcagcggcattgagctgtccattacctgtggggaggaagggagagctgagggacccccatgcc

SEQ ID NO: 87336 - DNA, 601 bp, Human
tctctaataagtggtggaatgtagtaatgctggaatatatttgaggaggaatttcaatggccaaggttttatagatgatcttccctttttctatctttcttactctagctggtcgactcacaaatctatcatcaggcaccactcattgaaatgaataaacacttcctaggtttgaaaggtctgaaaggccagacttgtaaatctaccattttctgcctccttgggcaaagcctcaacttttacctcgcagtagaaaggctcacgcctgtaatcccagcactttgggaggctgaggtgggcrgatcacctgaggtcaggaatttgagaccagcctggccaacatggtgaaaccccatctctactaatactacaaaaattagctgggcgtggcggtgtgcacctgtaatcccagctactcaggaggctgaggcaggagaatcacttgaacctgggaggtggaggatgcagtgagccgagatcgcaccactgcactccagcctggcgacagagcaagactctgtctcaaaagaaaaaaaaaaaaaaggaaataatgacattttcactgcaggacggctgggaaaataaaagtgagaaaataggt

SEQ ID NO: 87337 - DNA, 601 bp, Human
actgggaaggccacaacatgatagtaatgccttctttctgatatatatatataatttatttattttattttgtttttttgagatggaatctccctctatcgcccagggtggagtgcagtggcgcaatctcggctcactgcaacctccgcctcctgggttcaagcgattctcctgcctcagcctcccgagtagctgggattacaggtgcacaccaccaccacatctggctagtttttttgtatttttagtactgatggggtttcaccatattggctaggctggtctcgaactcctgacctcrtgatccgcccgcctcggcctcccaaagtgctgggattacaggcctgagctaccgcgcccggcctctgataggtttttaagaagatccttaaaagattgcagcgagactgcctgctttggtttcttggtgcacaggtgctctgaagctccatgctggtgccagagcgagtgtgcccaggaggttttgattgcaagagaggatacggggcggatttctctcaagactgcatgcaagaatatcagagcagctgatattctttgagaaagttagttagccattgccctgattgcttttcatctt

SEQ ID NO: 87338 - DNA, 601 bp, Human
tggaaatcctagggcccttaagaatgatgctaaatctactctgcctgtgctgtgtaaatggaaaaacaaagcctggataacagcatagtatttccaatatggttcattgaatattttaagcctactgttgagacctagtgttcagaaaaaagattcttttcaaaatattactgctcattgacaatgcatctatccacacaatagttctgatggagatgtacaagataattttgttttcatgccttttaatacatatcacgtcttttagttcatggatcaaggagtaatttaaaatctgagstcatattattttaaaaatacattttggccaggtgcagtggctcatgcctgtaatcccagcactttgggaggccgaggcgggtggctcacaaggtaaggagttcaagaccagcctggacaacatggtgaaactccatctctactaaaaatacaaaaattagctgggcatggtggcgcgtgcctgtaatcccagctacttgagaggctgaggcaggagaactgcttgaaccaggacccgcgaggtggagcttgcggtcagccgagattgcaccactgaactccagcttgggctatagagcga

SEQ ID NO: 87339 - DNA, 601 bp, Human
agccggtgacttagagttgaagccagtgctcattaaccattctggaaatcctagggcccttaagaatgatgctaaatctactctgcctgtgctgtgtaaatggaaaaacaaagcctggataacagcatagtatttccaatatggttcattgaatattttaagcctactgttgagacctagtgttcagaaaaaagattcttttcaaaatattactgctcattgacaatgcatctatccacacaatagttctgatggagatgtacaagataattttgttttcatgccttttaatacatatcaygtcttttagttcatggatcaaggagtaatttaaaatctgaggtcatattattttaaaaatacattttggccaggtgcagtggctcatgcctgtaatcccagcactttgggaggccgaggcgggtggctcacaaggtaaggagttcaagaccagcctggacaacatggtgaaactccatctctactaaaaatacaaaaattagctgggcatggtggcgcgtgcctgtaatcccagctacttgagaggctgaggcaggagaactgcttgaaccaggacccgcgaggtggagcttgcggtcag

SEQ ID NO: 87340 - DNA, 601 bp, Human
aggtgcaagcataaagaacatagcaattgcccctctctgtcactatggaagtgaggagtagggctggaggcaaacgcaggagcccctaggagcccttgctctgatcaaggaagccgctgttagtaacgccagggacagttgctgtatagaaacacaggcccattgtttctagagcttctgtgctatcaagagatgctggaaatctagatgtttaagcaacacctcttgatttttttttttttttttttttgagacggagtcttgcactattatccgggctagagtgcagtggcgcgatctyggctcactgcaacctcctctgtctcctgggttaagagattctcctgcctcagcctctcaaatagctgggattacaggcgtccgccaccacgcccagctaattttttgtatttttagtagagacagggtttccccatattggccaggctggtctcgaactcctgaccttgtgattcgcccacctcagcctcccaaagtgctgggattacaggtgtgagtcaccgcgcccagctcacctcctgatttttaaatgttggttacttttgggttttctaaacccaccgcagttcaaataaaacat

SEQ ID NO: 87341 - DNA, 601 bp, Human
ggggtttcactgtgttagccaggatggtctcgatctcctgaccttgtgatccgcccccctccacctcccaaagtgttgggattacaggcatgagccatcgcatccagcccaggatttattattaaacatgaaaagcagtgagcagaatggtgttgatagtgaatactcctgtgtgtgtgagaaaatgagggcgaggatctgaacaattttattatttatttatgcaaatatttttatttgcataaggaagcactgaaaggacacataggaactaacaaaagtcatttctggggatgggggyagcaaagcgttggatgagaatggggcgggaacgaggcttttcaacatacatctttgattgattgattgattgattgattgattgatttattgagatggagtctcactttgttgcccaggctggagtgcaatggcgccatctcagctcactgcaacctcagcctctcaggttcaagcgattctcctgcctcagcctcctgagtagctgggactacaggcgtgcaccagcacgcccagctaatttttgtatttttagtagagatggggtttcaccatgttggccaggctggtctcaaacccc

SEQ ID NO: 87342 - DNA, 601 bp, Human
ccagcagctgggactacaggcgcacgctgccgcgcctggctaattttttgtatttttaggagagatggggtttcactgtgttagccaggatggtctcgatctcctgaccttgtgatccgcccccctccacctcccaaagtgttgggattacaggcatgagccatcgcatccagcccaggatttattattaaacatgaaaagcagtgagcagaatggtgttgatagtgaatactcctgtgtgtgtgagaaaatgagggcgaggatctgaacaattttattatttatttatgcaaatatttttatttgcataaggaagcactgaaaggacacataggaactaacaaaagtcatttctggggatgggggcagcaaagcgttggatgagaatggggcgggaacgaggcttttcaacatacatctttgattgattgattgattgattgattgattgatttattgagatggagtctcactttgttgcccaggctggagtgcaatggcgccatctcagctcactgcaacctcagcctctcaggttcaagcgattctcctgcctcagcctcctgagtagctgggactacaggcgtgcaccagcacgccc

SEQ ID NO: 87343 - DNA, 601 bp, Human; identical to SEQ ID NO: 20376

SEQ ID NO: 87344 - DNA, 601 bp, Human; identical to SEQ ID NO: 20377

SEQ ID NO: 87345 - DNA, 601 bp, Human; identical to SEQ ID NO: 20378

SEQ ID NO: 87346 - DNA, 601 bp, Human; identical to SEQ ID NO: 20379

SEQ ID NO: 87347 - DNA, 601 bp, Human; identical to SEQ ID NO: 20380

SEQ ID NO: 87348 - DNA, 601 bp, Human; identical to SEQ ID NO: 20381

SEQ ID NO: 87349 - DNA, 601 bp, Human; identical to SEQ ID NO: 20382

SEQ ID NO: 87350 - DNA, 601 bp, Human; identical to SEQ ID NO: 20383

SEQ ID NO: 87351 - DNA, 601 bp, Human; identical to SEQ ID NO: 20384

SEQ ID NO: 87352 - DNA, 601 bp, Human; identical to SEQ ID NO: 20385

SEQ ID NO: 87353 - DNA, 601 bp, Human; identical to SEQ ID NO: 78039

SEQ ID NO: 87354 - DNA, 601 bp, Human; identical to SEQ ID NO: 78038

SEQ ID NO: 87355 - DNA, 601 bp, Human; identical to SEQ ID NO: 78037

SEQ ID NO: 87356 - DNA, 601 bp, Human; identical to SEQ ID NO: 78036

SEQ ID NO: 87357 - DNA, 601 bp, Human; identical to SEQ ID NO: 78035

SEQ ID NO: 87358 - DNA, 601 bp, Human; identical to SEQ ID NO: 78034

SEQ ID NO: 87359 - DNA, 601 bp, Human; identical to SEQ ID NO: 78033

SEQ ID NO: 87360 - DNA, 601 bp, Human; identical to SEQ ID NO: 78032

SEQ ID NO: 87361 - DNA, 601 bp, Human; identical to SEQ ID NO: 78031

SEQ ID NO: 87362 - DNA, 601 bp, Human; identical to SEQ ID NO: 78030

SEQ ID NO: 87363 - DNA, 601 bp, Human; identical to SEQ ID NO: 78029

SEQ ID NO: 87364 - DNA, 601 bp, Human; identical to SEQ ID NO: 78028

SEQ ID NO: 87365 - DNA, 601 bp, Human; identical to SEQ ID NO: 78027

SEQ ID NO: 87366 - DNA, 601 bp, Human; identical to SEQ ID NO: 78026

SEQ ID NO: 87367 - DNA, 601 bp, Human; identical to SEQ ID NO: 78025

SEQ ID NO: 87368 - DNA, 601 bp, Human; identical to SEQ ID NO: 78024

SEQ ID NO: 87369 - DNA, 601 bp, Human; identical to SEQ ID NO: 78023

SEQ ID NO: 87370 - DNA, 601 bp, Human; identical to SEQ ID NO: 78022

SEQ ID NO: 87371 - DNA, 601 bp, Human; identical to SEQ ID NO: 78021

SEQ ID NO: 87372 - DNA, 601 bp, Human; identical to SEQ ID NO: 78020

SEQ ID NO: 87373 - DNA, 601 bp, Human; identical to SEQ ID NO: 78019

SEQ ID NO: 87374 - DNA, 601 bp, Human; identical to SEQ ID NO: 78018

SEQ ID NO: 87375 - DNA, 601 bp, Human; identical to SEQ ID NO: 78017

SEQ ID NO: 87376 - DNA, 601 bp, Human; identical to SEQ ID NO: 78016

SEQ ID NO: 87377 - DNA, 601 bp, Human; identical to SEQ ID NO: 78015

SEQ ID NO: 87378 - DNA, 601 bp, Human; identical to SEQ ID NO: 78014

SEQ ID NO: 87379 - DNA, 601 bp, Human; identical to SEQ ID NO: 78013

SEQ ID NO: 87380 - DNA, 601 bp, Human; identical to SEQ ID NO: 78012

SEQ ID NO: 87381 - DNA, 601 bp, Human; identical to SEQ ID NO: 78011

SEQ ID NO: 87382 - DNA, 601 bp, Human; identical to SEQ ID NO: 78010

SEQ ID NO: 87383 - DNA, 601 bp, Human; identical to SEQ ID NO: 78009

SEQ ID NO: 87384 - DNA, 601 bp, Human; identical to SEQ ID NO: 78008

SEQ ID NO: 87385 - DNA, 601 bp, Human; identical to SEQ ID NO: 78007

SEQ ID NO: 87386 - DNA, 601 bp, Human; identical to SEQ ID NO: 78006

SEQ ID NO: 87387 - DNA, 601 bp, Human; identical to SEQ ID NO: 78005

SEQ ID NO: 87388 - DNA, 601 bp, Human; identical to SEQ ID NO: 78004

SEQ ID NO: 87389 - DNA, 601 bp, Human; identical to SEQ ID NO: 78003

SEQ ID NO: 87390 - DNA, 601 bp, Human; identical to SEQ ID NO: 78002

SEQ ID NO: 87391 - DNA, 601 bp, Human; identical to SEQ ID NO: 78001

SEQ ID NO: 87392 - DNA, 601 bp, Human; identical to SEQ ID NO: 78000

SEQ ID NO: 87393 - DNA, 601 bp, Human; identical to SEQ ID NO: 77999

SEQ ID NO: 87394 - DNA, 601 bp, Human; identical to SEQ ID NO: 77998

SEQ ID NO: 87395 - DNA, 601 bp, Human
cattgcatttagtagcagtaccatatatatatatgcagtgtggacatatgagtgttgaaaggaaagctaattaagtcactaataccagtttttaagttttttttttccttaaatcacctcaggagaaagttaggatcattgaaaggagaatcctaccttactatttatatgagaatcttgctcttgaacactgcatacatgctttcttttccaggtttttccacatttaatagtaggtcctcttctaacattatgtcttattggctccagtttcacctgaaaggaggcatgagttcttcaraccaacccacctcatcacaccccatcaatgcatagccacataaagcgtgggaattcagtgacttttttgccatctgagttctagcttcttcctgtgtataaagtatttattaggactatggttttggtttcagtattttgaagatgataatcctatatataaattatgcaaagaagattctcccttttgaaaataatggaactccaggaaagccaaatatgttcaacataattatgagaaagaagtgtgccactgtcagattggcatttatggaaaaattgttacgattcgtttttccag

SEQ ID NO: 87396 - DNA, 601 bp, Human
gtttatcagatacagggagaatcttagaaactctcttttgtttgcttaaaggcacagctataaatatatttcagcgtgactgagtgtgtcaagtttgagattctgatttgttgtatcagaatgttagagctgggagggaagcactggcaatcaggtttctctacttcctgattttattgaagagtgagctgaggcccagaaatatcaggtgatctgcccaaagtcacacagctcattaatgacaaaactacaactgaagccctggtcttctaaaccccagccaagagctctaacatttttwattctaattttttttttttttttgagatggaggtcttgctatgctgccaagtctggcctcgaactcctgggctcaagtgatcctcctgtctcagtctcctgagcagctgggattacaggcgtgagccaccacattcagctaacattctttttttctttttctttttctttttttttttttttttttgagacagagtaaagctctgtcacccaggctggagtacagtggcatgatcttggctcactgcaacctctgccctgtgggttcaagtgattctcccgcctcagcctcccaagtagc

SEQ ID NO: 87397 - DNA, 601 bp, Human
gatacagggagaatcttagaaactctcttttgtttgcttaaaggcacagctataaatatatttcagcgtgactgagtgtgtcaagtttgagattctgatttgttgtatcagaatgttagagctgggagggaagcactggcaatcaggtttctctacttcctgattttattgaagagtgagctgaggcccagaaatatcaggtgatctgcccaaagtcacacagctcattaatgacaaaactacaactgaagccctggtcttctaaaccccagccaagagctctaacatttttaattctaattttttttttttttttgagatggaggtcttgctatgctgccaagtctggcctcgaactcctgggctcaagtgatcctcctgtctcagtctcctgagcagctgggattacaggcgtgagccaccacattcagctaacattctttttttctttttctttttctttttttttttttttttttgagacagagtaaagctctgtcacccaggctggagtacagtggcatgatcttggctcactgcaacctctgccctgtgggttcaagtgattctcccgcctcagcctcccaagtagctgggatta

SEQ ID NO: 87398 - DNA, 601 bp, Human
tgattttattgaagagtgagctgaggcccagaaatatcaggtgatctgcccaaagtcacacagctcattaatgacaaaactacaactgaagccctggtcttctaaaccccagccaagagctctaacatttttaattctaattttttttttttttttgagatggaggtcttgctatgctgccaagtctggcctcgaactcctgggctcaagtgatcctcctgtctcagtctcctgagcagctgggattacaggcgtgagccaccacattcagctaacattctttttttctttttctttttctttttttttttttttttttgagacagagtaaagctctgtcacccaggctggagtacagtggcatgatcttggctcactgcaacctctgccctgtgggttcaagtgattctcccgcctcagcctcccaagtagctgggattacaggcacgcaccaccacagccggctaatttttgtatttttagtagagatggggtttcaccatgttggccaggctggtctcgaactcctggcctcaagtgatccgcccacctctgcctctgccttccaaagtgctaggattacaggcatgagtcaccacgt

SEQ ID NO: 87399 - DNA, 601 bp, Human
agagaatagtttgtcaggtacttttcctcttaaaacctaacatctgaggaacgtggattttaattattgatgatgtgtgtggagtttcagtgtcacgcattttcttctgagttacagaatcctctgggggatatttcacaatacctttgtgtgtagttgctatgaaggaattaacctgtaaacctctgggatgattgaattgtgggtcaactaaaatgcaatctagctaagacttctgcctacgatctcgcctgtgtgtttctttttgttggtttttagatacagtgctttctattccatrtggctatttagtaagcagtctctttttgatagcttgtacctctgtgattcaatttctgttgtcttttttttctttaattgaatgatatagtaaatatgaacttgtgccatcattagaataatgtgcatatattcacatagaaggtggggcttatgaaccttgtattaaggatttagtgagaggaaataaggactttgccctctcagacctggcacagcagctgcagcagtttcatcataaggtctgtggtctgcacgcacaaaacagcgtgggctcaagtaaaatgcctctggacaggtg

SEQ ID NO: 87400 - DNA, 601 bp, Human
gaggatcatcatgaacaaaggttgggaactgcccagagaatagctgttttcctggaaccatatagagtggagttcaagcttctgaacagagctggttcatcaggagtgtttgagtatgacaatagcaatattggagaaggccttcctcttctggttattcttagattcctagcacatgagtgctggaaggggcgtgtctaacccagtttccacgttattgagaggaacatgagtccctctaaggcttaaccttgacttggtcaaggttagaatgttggatgttttctctcccatgcaatayggtgttcatagtattgtgtttgtttgcacccactggcaaacttataaagaccaccaaggtctttataaggagtctttctctgagaagtcattatacaaaaaagaaacacgtttatagcagcacgattcgcaattgcaaaaatatagaaccagtccaaatgcccatcaatcaatgagtggataaagaaaatgtggtgtatacacacacacacacacacacacacacagacacacacacacacacaccatggaatgctactaagccataaaaaggaatgaagtaatggcatttgcagcaacc

SEQ ID NO: 87401 - DNA, 601 bp, Human
ccagtccctctgggtagatgatgacaaagcagtggccagtgattgcagtagtccatttgtatcctcatgacaagatgccctgtttcttttcttttttttttttttcttttgagatggagtctcgctctgttgcccaggctggagttcaatggcgcaatctctgctcactgcaagctccaccccctgggttcatgccattctcctgcctcagcctcccaagtagctgggactacaggcgcccgccaccacgcccagctaattttttttgtatttttagtagagacggggtttcaccatgttrgccaggatggtcttgatctcctgacctcgtgatccacctgcctcggcctcccaaagtgctgggattacaggcttgagccatcgtgcccggcctcgccctgtttcaattttgaactatatcttagaagtctccttaagcatgtgatatgcagctttggtggcaaggcagcatcctgaacataagcagactttcacctccaagttcctattggagaaatactttccacctccttgagcctggccatgcatggatgcatgtgtgtggtcttctctgaacctgtactccctgtctcagtgctat

SEQ ID NO: 87402 - DNA, 601 bp, Human
aattctctattcactgttcatgttcttcactgatggggattaatggtaaaggattttatagataaaaattagcaaggacctgtcctcaaaataaaattttgtttaaaaatatttatttcaggcatcttactccgtgaagggagaagcaaagattccatcagggccatgttgcctgtccctgtgtagccctaggttgtagtaacatttaataccatctagtgatatatgtgggtgtgagagtggttcattccaaaggaaccatcttcccaactggcactgggcagtcagtctctgttgtcarcctcatagaagtggtgcttgactttgccattttctatcctgcagaccatacaggaggctgatgcctcagccgccactgattcttcaggttgatgggcaagccataatgaggcccatcctgattatgggccaggcttctgctgctgtcacctggcactctattctaacaccctgagtctaccttctagtacttctcataaacactagggtttcttttggtctagtgccatagtcctcaactccagatacatgattaaatcacctgggaagccatttgcaaaaacctttgccagcatcccac

SEQ ID NO: 87403 - DNA, 601 bp, Human
tttgcaaaaacctttgccagcatcccaccactagctggttgaagtagactcctcagtggtggtgaggccctggcatcttattttctaaaaagctctccagaggattcaatcttgtagccagtattgagaaccttttgtttagcacaatgagtagcaaggggagaattaacttcaaaagcagagaaaagaaaaaattctaaaaaaccatccattcaaacaagaagggaagtgatgtggtgttgagacctgactgattccaactaactgtttaaagtctttagcggcaaggatgtaacctccktggacctttgtctccaattgtaacaaaatagaattggactaaatcaccaaagtttctcccggcccaaatactatgactggagaggggtgggagaggtgatatttttatgttctaattctcaatttgcttgtggggcagaagtatcccatagctgagtataatgtcataaaataggatatgtgtataaacaatggaatagttagttctggcctcttctggaggtggcttcacaccacactaccattttcttctcctaacacaagttcactggcaggtgagcattttgggaagtagagaagt

SEQ ID NO: 87404 - DNA, 601 bp, Human
gtttatggccaaatagtattccattgtgtatagacacattgtgtccagtgtgtatggacacttaggttggctattgtcaatagtgctgcaatatacatgggggcgtggctatctcctcaacatattgatttcattttctttgggtatataccccgcagtaggattgctggatcatatggtagttctacttttaattttttgaggaacctctactctgttatccatagtggttgtactaatttacattccaatcagcagtgtataagagttctcccttttccacatcctcatcagcatttatttttttttttgtctagagacaggggaggagggagaagcagaggttggccaatgggtacaaagtcacagctagataggaggaattatctggtgttttattgcatagtagggtaactatagttaatgtattacatatttagcaatagctagaagagaggatttagaatgttcccaccacaaagaaatattttaggtaatggatatgctaactactctgatttgatcattacacagagtatgcatgtatcaaaacatcatactgtaccccataaatatgtacaattattatatgttagttaaa

SEQ ID NO: 87405 - DNA, 601 bp, Human
aagtgaaagttggttttgcctcactcctatggtaaaacagggatcagtttttgaccaaaacatcagtcatcctgtccacccaagtggtttgtcttttatgagcctcctgtgtaagggcagagaaagttatagaaagatgggtattaatcaattcaaagaaaataagtagaaagctcatgcctgaggtttggcagctcaccatcacaggcctttcagaaatggacaggcccctccagtaggtcattcagcaggtcaggctttctctggattgaggctgaggggaacaattttttaaattccrgagcttaaaaaccccctggtgaattttctgagcttttccatctcagaaaatggggcattgcctccctggcctacatttatacagagactttcagaagaggctatgttagggtagaatttggtaagaattggagtcagtttgggctgtggtggactgcaatcacatccctccttgtcttccatagatcaaggacaccttcctgaggacttacacggacgctatgcagacttacaatggcaatgatgagaggagccgggcagtggaccatgtgcagcgcagcgtaagttccagaggagatga

SEQ ID NO: 87406 - DNA, 601 bp, Human
cttcaattttattagatttgttaaataattaatgacccccataaatatcttggggaaaaaaaccgacagcactggcgctcctacaacctataaattgggattgtgctgtcttatgcaagtacttcggggcgctccaccctgtgtgggaggcgagtggtggatctagggagtgaagaaaagtagttaggaggctttggtccagggaacaaacacgccgaggaggaggtaggggactttggccctgccggcaacagccgtgcccgcctagctgcgcttcctacccccaccagtgcgggcgtgrtgcaagtctgatccctccaaaaaattaaacccgaaggtgaaaggggtgtaagcacacacatgcacactatgttcatgattgatagacgggggaggtggaagggaaagaagatggcaagccacttgtgaaaattagagatcatgatgtatccttttctcccctgctgaagtcaggtgatgggatcaactcagtgacccttgttttacttcttgttgctgtgtatgtgagtttgcattataaaagcactatgttggcttatagcaaaaagaagaggaaagaaattgagcaattaagttggaa

SEQ ID NO: 87407 - DNA, 601 bp, Human
agatttcaaacagcagagtctgggaggctgtactgtgtgtgtaaaagaatcctaaaggatgacgtagtcaatattaacatacttgaaaggtaaagagaagatgttcaatgatcgtagttaatataactgagtgcatactatgtgccaagaattgggcgatgtggtttgcattcatttgagatatatatatatatatgtatttaaaaacttgtgagttaggtattttcatcctcattttacagatgaggaaactaagcagttaagtaacactgaagctctaatagatggtaagtggcagagstggtatttaaactcccaaacctgaattttaaacttatcagttttatcattaagttttaaaatgattaatacaaagtgggatttgttagatgctaagcctctccgtggccccctcccatttttctttaaataaaattgaggaagttctgaaaggctggggaggtctagaaaacacagaactgctgcaatacatggagggaaagaccttatatttatttagacttaggggtctgactaaagactgcgggatgagtgaggccagtctttgaaaagtggagccattacacccattcattctctg

SEQ ID NO: 87408 - DNA, 601 bp, Human
aggggtctgactaaagactgcgggatgagtgaggccagtctttgaaaagtggagccattacacccattcattctctgtgcccataggtccagtgctaaactgaaaccaaatcagcttcccctgcgtaggagacacaggaggcatattagatattctttcttatcctctgagaatggccagctaggaagagagcaagcagatacaactcttccataaatggagggaatggagccatgaacagaagaaaagggaatgttgctgagcatctactatgtgcctattccagaatcttcattatatycttgaaacaattgctgagatagatatgagaatccatctcacatatgaagtatgtgtctgtcagcaatggttggaaatttaatcccaactccacacataatctgttctttctacaaagtaatgcatcacctgtgtgatgaattcagcaagcatcaaatgagtatgttcttcatgccgggcgctgtgcaggtgctgaattaaacacaaagactctgcttgctttaaagcaaaaagtttgaagaaggaagccaaccgctagaaaaatacattaccaaataaaaagtagtaagtgacccaaaag

SEQ ID NO: 87409 - DNA, 601 bp, Human
acctacttactttaaagcctcagctttctaagactcaaaaaggaaatcagcttcaaaggaatttaacattagcatgccatgaaacaattaccaggggtggttcgtatgtattgtttaattaaacttctttgaaaaggtctgggggctcgtggtggttctgagtataatttttattatttccatgttactatcctgtctctcaagttgaaacagacaagcaattgttgaaacagtgctggtctggaaaaaatcctgtatcaacacaagaaattccaggaagaaaagaccctgatgttaactrctattagctccagggccctggagaattctgagttgttgacaaacctgtaaggttgagacagcggataacctgctgaaagcagagatgagataaatgtggctgatttgttgataagtatcttgcaagagtctttaaccctttgtcttctttccaatgccttagtatagctgggtggttttcattgtaaatcactcagtgacttttggtgttatttttaactgtgctgaacattttaaagttggctgtaactctttgggaaggggccttcagaggtgtatagcagcattgtgaagtaagtct

SEQ ID NO: 87410 - DNA, 601 bp, Human
ctcctaatgcaattatatttacaacctctttggaaatccaccacaaaacttgaggcacactattatcttaggtgatttccttggtgaagctgcttttcaatatctgtgatcaaagtgaattctgggctgggcgcagtgactcatgcctgtagtctcaccattttaggaggccgagacgggtggattacctgaggtcaggagtttgagatcagcctggccaacatggtgaaaccctgtgtctactaaaaataaaaaacaaattagccaggtgtggtggtgcatacctgtaatcccagctacyagggagcctgaggcaggagaattgcttgaacctgggagtcagaggtttcagtgagccaagatcatgccactgcctccagcctgggcgatggagtgagactccatctcaaaaaaaaaaaaaaaagtgaattctggagagagaattgaaaattggctcagggtagcaaaagaaaggtagttactaggcgctactgttaaaaaaaagttagacattgttcaaattctgcataaattcttcctttgacaaaaaggaatcccaggaatgaagcaattctggggagcaaggtgactaatcgttcag

SEQ ID NO: 87411 - DNA, 601 bp, Human
aaaagactgttgttatctgtatgccctgtgctaagagttccacagtcatgggaacagagggtagcttttgtattaaatattctaggtatttgtagttcacatttcctcaaagttttagatagcaactttacagttttttctcatttattaaaataagcctatacatagttacattattttatcttcacattttaacattgattttaccctacaattgaattcctagtctgatcaatacaaattattaaaagttttgattttttttctctgagagaacaagcatattattggcaaactatgrtagtaatgaaatataataaatatgatgctaaaacctctggagtttataaatcagatgattaatatggcctataagatgatttatttccatctcagatgacattcaacaagtttaaattatacaattctgagacaaatgttggacttcaggtatcttgtgcatgtctacaaatatatgaagataaataccctacttctcctgaggaagtaaattagcagtaaaaggcagcaatgcaagtgggaatagacaataaattaggagaaaactttatttttctattagagtgagccacctggctcc

SEQ ID NO: 87412 - DNA, 601 bp, Human
tttccagaatttgtggatgaaaaccttcattagaagcttaatggattattttttctgaatctctcagtaagctatttatggggtgggtgtgggtgagcatcaagcttattggatcttgattactctttttcattgaagaatgaaaacaaatgggaacttttcttgacagataatatgaatttataggccaccaaaatattacagataaatacacaagccatacagataaaagaatgatagtaaacatatattattcaaatatagaaacaaccttgccaaaatgaacaaagtcagcttttctttttttttttttttttttttttgagatggagtctcgctctatgcccaggctggagtgcggtggcacaatctcggctcactgcaacctccgtctcctcgggttcaagcgattctcctgcctcagcctctcaagtaagtgggattacaggtgtgtgccaccacacccggctaatttttgtatttttagtagagatggagtttcaccatgttagccaggatggtctcgatctcctgaccgatccacccgcctcggcctcccaaagtgctgggattacaggcatgagccactgcacctggccca

SEQ ID NO: 87413 - DNA, 601 bp, Human
ggcacaatctcggctcactgcaacctccgtctcctcgggttcaagcgattctcctgcctcagcctctcaagtaagtgggattacaggtgtgtgccaccacacccggctaatttttgtatttttagtagagatggagtttcaccatgttagccaggatggtctcgatctcctgaccgatccacccgcctcggcctcccaaagtgctgggattacaggcatgagccactgcacctggcccaaagtctgcttttctaataaaagtctgcctacattctggggaagcaactttccttcctctccrtatacccagaatgacagagaacagtcgaaactatttgagcaccttccatctaccccaagacaaaagcatgtatgtgactatcatactcacattttagttccattctggtgagccacagaatacatacctgcctgaatgattaagcgcaaactgaatttgtgtaactaggatatttctaatgtacaggtaatctgactaatcaacaattaacttgtcaagtactgatacaagactgtgctagaagtggtagtgtaagatacagttctttctgtcaaaatctctttggaagagaaaataacc

SEQ ID NO: 87414 - DNA, 601 bp, Human
tacaagactgtgctagaagtggtagtgtaagatacagttctttctgtcaaaatctctttggaagagaaaataacctctttgttttaacgtggccccactccaatccattctccacacagctgctagagtgaactttctaaaatctcattgcatcatttcccagtttaaattccttcagtttcttactgttatctgcaagagtaaaattattgaacacagcattccaagttcttcgtgatctaatgcctgcaacttctcaaacttcatccctggggccactacccttgctccccaccaaacmcacacaggcagtttatcttgcttggtatttctacccctccttgtctccctcccttccttctcttgcccagttaacttagttcagttgtgtcccttataggcagcctccttcacccctctcctctgatcttgaatgcaagttaaagaatttgataattgtgagtcacagatatttccacagggaagaaacatgaaaagtgcaggagttttgtgaaaatacatttgacagatttggtggatttaaagtaggaacagacctagcatggtggctctttcctgtaatcccagcactttgagaggc

SEQ ID NO: 87415 - DNA, 601 bp, Human
ttgtattttttttgtacagatggggttttgcctttttgcccaggctggtctcaaattcctggactcaagtgatctgcccaccttgacctcccaaagtgctgggattacaggcatgagccaccgtgcctggctgagaaatgaacagatttagatacttccaggatatttctatttaatacttcaccaggatgctaaattaccagtttataataacaaattctacaattacatattctaatacctcaaacaaaatatgacatgaacacctgtgatataaaagggccatttaatggctcacgcstaaagcgctggcactttgggagcccgaggcgggtagaactcttgaggccaggagtttgaggccagcctggccaacatggcaaaaccccatctctactaaaaatacaaaaattagtcagcatggtggcacacacctgtagtccagctactcggaaggctgaggcacaagaatcgcttgatcctgagaggaagaggtttcagtgagccaagatcgcaccgctgcacttcagcctgggcgacagagcaagactccatctcaataaaaaaagtgggagggggacatttaaaatgtgtttttgtc

SEQ ID NO: 87416 - DNA, 601 bp, Human
ttttaagaactcatagccagtactttctagcatatacctgatacaccaagttgtttctcatggttgattatgtgagctaactggtcacaaaatatagcactgtacaactattggttaaattttcaatagtataaaactttattagactttcatctgctttgaaacaatttttcaccatagtgttccctttttttttttcctttttgagacagagtcttgctttctgtcacccagcctggagtgcagtggcccaacctcagctaactgcaacttctgtctccagggctcaagcaatccaccyacctcagcttcccaagtagctgggactacaggcccatgccaccatgcccagctaatttttaaatttttaaaattttgtagagacgagatctcactatattgcccaggctggtctcaaactcttggactcgagtgatccacccacctcagcctccccaagtgctaggattgctagtgtgagccaccctgcccagccaactatagttttctaaaccaacaaattctacttattttccagcctaagcaaatgcttacttgggctgttgtgatttccatcaatatctggttgttcttcttggaa

SEQ ID NO: 87417 - DNA, 601 bp, Human
tttgagacagagtcttgctttctgtcacccagcctggagtgcagtggcccaacctcagctaactgcaacttctgtctccagggctcaagcaatccacccacctcagcttcccaagtagctgggactacaggcccatgccaccatgcccagctaatttttaaatttttaaaattttgtagagacgagatctcactatattgcccaggctggtctcaaactcttggactcgagtgatccacccacctcagcctccccaagtgctaggattgctagtgtgagccaccctgcccagccaactatwgttttctaaaccaacaaattctacttattttccagcctaagcaaatgcttacttgggctgttgtgatttccatcaatatctggttgttcttcttggaaagtaagaatagaagataaaatatagttttaaaaaatatgtaagtccaaggaaatgaatcgtatgttttatgccaacacagacagacaaaaaacaaaaaaaattccttcaccaactcaggagtgcggacatacgtatggtctttgatgagtctcagtatattttatgctttcttttaagctcctactattgctagtaaatgac

SEQ ID NO: 87418 - DNA, 601 bp, Human
ttaggaaacatcgaaagcacattatgcactgtgcaggtgaaatgaatggctggaaaacacagtaatatcatcgtgctcctcagtggcgggtcaatcagaagtcaccagaaaaagtccaattcaagaccagtggtaaacttagcagaaaaaaaaaaaaaactgctctacaacacagtgtaaaccatgcacactagtttatccctgttattagaatagactaattcatgaaaaaatgtgaaaatcaaatttttatgactcaaattctatttagaaaccttatctcatttttgcatattgcttrtgtagaggagaaaagttttcttttcttacccgtcaccaggtttatgcctgagacccctataacaaaagacagattaaaaagagaaaagcataacaaatttgtttaatataagttttatgtggcatgggagtcttcagaaatgaagacccaaagaaacagggaagactgtatatttattttttttcttgagatggagtctcactctgttgcccaggctggagtgcaatggcgtgatcttgactcactgcaacttctgcctcctgggttcaagtaattctcctgcctcagcttcccaagtac

SEQ ID NO: 87419 - DNA, 601 bp, Human
cagaaaaaaaaaaaaaactgctctacaacacagtgtaaaccatgcacactagtttatccctgttattagaatagactaattcatgaaaaaatgtgaaaatcaaatttttatgactcaaattctatttagaaaccttatctcatttttgcatattgcttgtgtagaggagaaaagttttcttttcttacccgtcaccaggtttatgcctgagacccctataacaaaagacagattaaaaagagaaaagcataacaaatttgtttaatataagttttatgtggcatgggagtcttcagaaatraagacccaaagaaacagggaagactgtatatttattttttttcttgagatggagtctcactctgttgcccaggctggagtgcaatggcgtgatcttgactcactgcaacttctgcctcctgggttcaagtaattctcctgcctcagcttcccaagtacttgggattacaggtgcctgccaccacgcccggctaatttttgtcattttagtagagacgggatttcaccatgctggccaggctggtcttgaactgctgacctcaggcgatctgcccacttggacctcccaaagtgctaggat

SEQ ID NO: 87420 - DNA, 601 bp, Human
aaagaaacagggaagactgtatatttattttttttcttgagatggagtctcactctgttgcccaggctggagtgcaatggcgtgatcttgactcactgcaacttctgcctcctgggttcaagtaattctcctgcctcagcttcccaagtacttgggattacaggtgcctgccaccacgcccggctaatttttgtcattttagtagagacgggatttcaccatgctggccaggctggtcttgaactgctgacctcaggcgatctgcccacttggacctcccaaagtgctaggattacaggcrtaagccaccttgcctggcagaagactgtatttttatagacagtcatgcagaagtctgatgagacaaaggtgggcctgatctaatggtaataaactgagggaatttagcaaggcttctttgttcaaattcttccctttatgacattcctttcctccaggtatagggaggatccttctggaatgagtctttgacctaattcaaaggaaggtcagcttgattttatatggtctgcttcaagggagaaggggtgagaggaaggcgtaaggatacacttcctgcgcctgctgcttcctcaaatgc

SEQ ID NO: 87421 - DNA, 601 bp, Human
gtgagccgagatcgtgccattgcactccagcctgggcaacaagagcgaaactccgtctgaaaaaataataataacaataataatatgagttgctttcaacttacttataataataaatgtcagcgtccttaaggatccaactgttaatgtgtccttgatttctctcttaaattggctgtcgggtcatggaaaagattgctttcaagtaagggaggctgaggcagaaggatcacttgagctcagaggttggagttcagcctgggcaacatagcgagactccatctctaataaaatttatagaaaaaaattttttttctttatttaaggtccaagttccagccgttctttgccatagagattaaaaattaagtggctgcctgaccttttgccagcccttgtggagaaatcaagcccctggaaacaggagatgcctggtttatctcaactgctcttgtctctagggtgacagttacaagcctgccactgcctcctcacaagactccttgaggcctgaaaattgtttatcaggcagattgtttggctataggaaataaggacacgtgtacaaacataatttaggatggatttagactttttagct

SEQ ID NO: 87422 - DNA, 601 bp, Human
gagatcgtgccattgcactccagcctgggcaacaagagcgaaactccgtctgaaaaaataataataacaataataatatgagttgctttcaacttacttataataataaatgtcagcgtccttaaggatccaactgttaatgtgtccttgatttctctcttaaattggctgtcgggtcatggaaaagattgctttcaagtaagggaggctgaggcagaaggatcacttgagctcagaggttggagttcagcctgggcaacatagcgagactccatctctaataaaatttatagaaaaaaawtttttttctttatttaaggtccaagttccagccgttctttgccatagagattaaaaattaagtggctgcctgaccttttgccagcccttgtggagaaatcaagcccctggaaacaggagatgcctggtttatctcaactgctcttgtctctagggtgacagttacaagcctgccactgcctcctcacaagactccttgaggcctgaaaattgtttatcaggcagattgtttggctataggaaataaggacacgtgtacaaacataatttaggatggatttagactttttagctctctggc

SEQ ID NO: 87423 - DNA, 601 bp, Human
acatatgcagctctacttttgtctgactacttataattctggatttagctcagataccacctattttctgaccacttccttcccagtctagcttaggtgccccagatagcagccttgtgtgagtgtctctatcagaaaaatatattgtggctattcatttgcttatctgttctccctctggactttgagatttttgtgaatgctcaatcatctttatattctcagcaccctaaaatggaagtaggcctatagtaggcactgtataaatatatgatgaggccagcacagtggctcacatctrtaatcctagcactttgggaggcccaggctggaggatcgcttgagcccaggagtttgagaccagcttgggcaaaatagggagaccccgagaccccacttctattaaagataaacaacttagcctggcgtgatagtgcccacctgtggtcccagctactccggaggctgaagtgggaggattgcttgagccagggaggttgaggctacagtgagctgtgattgtgccactgtaccccagcctgggcaacagaatgagatcttctttcaaaaaataagtatatggtgaaagagtgaaggaatt

SEQ ID NO: 87424 - DNA, 601 bp, Human
gcctggatggtatggtaggtgtatgtttgactttttaagaaactgctaaaccattttacaaagtagctgtgccatttcacattcccactcacaatttatgagagttccagttcctcctcatcttaacatttgatatagtgagccttaatgttagcctgtaagtttgtacaggtgttttactgtggttttaatttgcatttccccaatgacaaaggggttgaactttttttttttttttttttttttttttttgagaaaggatctgcctctgttgcccaggctggagtgcagtggcacaatyttggctcattgcaacctccacctctcgggctcaagtgatcttcccacctcagcctcccaagtagctgggcctaccggtgcactaccacaccttgctaatttttgtattttttgtagagatggggtttcaccatgttgcccaagctggtctccaactcccaagttcaaaggagccagctaccttggcctcccaaagtgatgggattacaggcatgagccaccacacccagccagaacatctctttatgtgtttatttgccacttacatatcttctttagtgaaatgtgtattcaattcttt

SEQ ID NO: 87425 - DNA, 601 bp, Human
attgagggccaggtatagtggctcatacctgtaatcccagaactttgggaggccaaggcaggcagatgacctgaggtcaagagttcaagaccagcctggccaccatggtgaaaccccatctgtgctaaaaatacaagaattaactggcatggtggcatgcacctgtagtcccagctactcagaaggcagaagcaggaggatagcttgaacccagggggcagaggttgcagtgagccaagatcatgccagtgtacttcagcctgggcaacagagagagactctgtcacacacacacacacamaaaaaaaagttactgagaaaaatattttttaaaatgataaaataaacgcttttatagaatttatcatcatcttgcatgcataaactatgcccattataaatcatctgccatttttagtttaagtttaaagtggaatgagaacttaatggaactaattcatctgagttcaaatcctagtctcttacattaattctatccatcactaattacagagctctcttaagcttttcacctttatctagtctttccaaagcatcaaattaattttcagagaaataagtactctttctatacttatat

SEQ ID NO: 87426 - DNA, 601 bp, Human
gatagcttgaacccagggggcagaggttgcagtgagccaagatcatgccagtgtacttcagcctgggcaacagagagagactctgtcacacacacacacacaaaaaaaaaagttactgagaaaaatattttttaaaatgataaaataaacgcttttatagaatttatcatcatcttgcatgcataaactatgcccattataaatcatctgccatttttagtttaagtttaaagtggaatgagaacttaatggaactaattcatctgagttcaaatcctagtctcttacattaattctatcyatcactaattacagagctctcttaagcttttcacctttatctagtctttccaaagcatcaaattaattttcagagaaataagtactctttctatacttatatttcatccatttatagaataggtaagtaaattacataattataacaaatacaattgacataaataccctgggaagcaaacctaaattactgttggtaaacatgtaactcaactggtagaaatagaagtgcaaaggctcaaatagagtaacctaccagctttgatagtactctgagaatcaaggaggtttcacagaggga

SEQ ID NO: 87427 - DNA, 601 bp, Human
aaaacaaaaaaggaaatgcacccataatctcaccattatcattttggttttgttctctaatttttaatgcatatacttacatatcttcaatcaaattgcatatgtagctttctttgtccccacaaaaaaaaatttttatttcgatttttaaatcgaaataaatacaggctcattatttgaaaacatagaaaatggcagatcctatttatgattcatacatttaccacttctcccaaattccctaatctcatttcctttttgcctgtgtttatgagtagaaattcatagatattttcttccytttttttttttttttttttttgagatggagtctctctgtcgcccaggctggagtgcagaggcttgatctcggctcactgcaacctctgcctcccgggttcaagcaattcttctgcctcagcctccccagtagctgggattacaggcttgcgccaccacacccagctaattttttgtatttttagtagagacggggtttcactatgttggccaggctggtctcgaactcctgacctcaagtgatctgacctgcctcggccttccaaagtgctgggattacaggcgtgagccatcatgcccg

SEQ ID NO: 87428 - DNA, 601 bp, Human
gccttccaaagtgctgggattacaggcgtgagccatcatgcccggccttattccattttttaaatgacatatgaatttttataacattaatattttataaatttcagttaacattgttaaaggtgatggtagttgctaccttgtgttgagtaactactgtgtgcctgacatgtaactgctcatcttacacagtaattcccatttgactaatgagggaactgtatggctaataaagtgtcagctctgcctctcccgtggatacctcaacatgtgggtatgtgacaaccatcaaccagtcttmccccattgctggatgttaatggtttcttattttctgctattacaaaagatgtagtcactatttttgcatgttagtctgtgtcttcatttcacattgtttcccaataaaagttactagaagtgaatattttaaaagttttgacacatattgccacttgccttcctgaaagattatgccagtttacagggagtgattaattctaatgggagggaaagcagagaaaggagtgacatttcatagaggaggtgacatttgagctggatcccacaggatgagtagggctttgccagaagagaggca

SEQ ID NO: 87429 - DNA, 601 bp, Human
aaggaatattttttaaataacacatttaaaagtgtaaaattattttatctgcttaaagtgcttgcataagttttataagtcttttaaaatactccatgcaattggttataagaatttagggttagtggccgggcgcagtggctcacgcctgtaatcccagcactttgggaggccgaggcgggtggatcacaaggtcaggagatcgagaccatcccagctaacatggtgaaaccccatctctactaaaaatacaaaaaattagctgggcgtggtggcgggcgcctgtagtcccagctacccrggaggctgaggcgggagaatggtgtgaacctgggaggcggagcttgcagtgagccgacatcccgccactgcattccagcctgggtgacagagccagactgcatctcaaacaaaaaagaatttagggttagtttgcattactactgaggctgacatggtaaatgcatttttatttctgttaatgaaagtgatactattcattttatatggactataaagttttgtcttaggaaaaaacttacgtaattttggattatttaataaaaaaaactctccttactgcctagattcccaattcttt

SEQ ID NO: 87430 - DNA, 601 bp, Human
ctgggcgtggtggcgggcgcctgtagtcccagctacccaggaggctgaggcgggagaatggtgtgaacctgggaggcggagcttgcagtgagccgacatcccgccactgcattccagcctgggtgacagagccagactgcatctcaaacaaaaaagaatttagggttagtttgcattactactgaggctgacatggtaaatgcatttttatttctgttaatgaaagtgatactattcattttatatggactataaagttttgtcttaggaaaaaacttacgtaattttggattatttaatwaaaaaaactctccttactgcctagattcccaattcttttcatttttattatgctccaagcttttatcacttaactttgtttaactagtacctatgcaccctttatcacttaatcttccccttcaattatttcataggtttcagtcttaacttcccaaatgtactataagttccttgatgacagatactgccttatagccggggtatattctacaagagcctcagttgtgctacacatagttgttgatgaagaaaggttatagtcagcatcagtaaacttcatctgtttgtattacattga

SEQ ID NO: 87431 - DNA, 601 bp, Human
aataccagcactttgggaggctgaggcagaaggatcagttgaggtcaggagttcgagaccagcctaggcaacatagcaagaccctgtctccacaaaaaaatgaaaaaattagctggacatggtggtgtgcacatgtagtcccacctactcaggaggctgggacagagaatctcttgagcacaggaggttgaggttccagtgagccatgattgcaccactgcactctagcctgagtgacagagcaagaccctgtctcaaaaaatataaaacaagaatatccgtaagaaatgtttagtggagmaggggacacagataagcaagtgaactagaagacagctacaatgaaatgtgttagagcagcagttctcaaagctggccacaggtccagcaccacctggaagttgttagaattctcaggtcccaccccagaccttctgaatcagaaacactcaaggttgggcccagcaatctagttttaacaagcctctaggtgattctgacagtcactgaagtttgcgaactaggatgtcaaaggtgcaagtgaagtgctgcgggaatgcagaacaaaggaccattcatggcatctggtgagatcagaagg

SEQ ID NO: 87432 - DNA, 601 bp, Human
gcactttgatccatcgctcacctgcttaaacatatttcacgtcttaaagtttctctccagctcccattgccttaccacataaaacagagttcttagtatggcagatgtattaggactctttccattgaaaatggtgggaaccgaacttaaactcactgaaacaagtcggaattcattggcccatgtggctgagatattgcaggtcacttgaggaagtgaaggaagtataccaggaaccatgaccgtattccctttttgggacagaattcagcattcctaggactcactctttttctgtttstatgtcatctctgcttgctcttcttttttcatagtgggctcatttcctgcaaatgcaaagaagccttctctactgagcagataacttaatcgtaggcagcccttgcttagccacaaaaaaaaaaaaaaaaaagtgcacatctttcttaaaatgattgtgccaatcacagggaaagttttttcctggccttgattcagaaaggggcacatcatttgagcaactgttggcctggattgtccaagcctggatcagatacctccttttatagcaaggacagcaaaatctgttaccataagaaaa

SEQ ID NO: 87433 - DNA, 601 bp, Human
atgtcatctctgcttgctcttcttttttcatagtgggctcatttcctgcaaatgcaaagaagccttctctactgagcagataacttaatcgtaggcagcccttgcttagccacaaaaaaaaaaaaaaaaaagtgcacatctttcttaaaatgattgtgccaatcacagggaaagttttttcctggccttgattcagaaaggggcacatcatttgagcaactgttggcctggattgtccaagcctggatcagatacctccttttatagcaaggacagcaaaatctgttaccataagaaaagrggtggaagaacttagtgggtgaaccaaacaaaaatggaagacatcttggtccatcacagcatacacagcctttttcagtctatccacaaccttcattaccaccttttttcccacagatatacttcacacccaccaaagtgcttgcttttccttagatgtcatagtactttcatatcaatactttatttaattttatttgcctggtaaacattttctattatctgcctgttgaatacttaatctcctaacgatttaaaaccaaagataaagttcataatgttcataaatgttctatgaaac

SEQ ID NO: 87434 - DNA, 601 bp, Human
aaatgattgtgccaatcacagggaaagttttttcctggccttgattcagaaaggggcacatcatttgagcaactgttggcctggattgtccaagcctggatcagatacctccttttatagcaaggacagcaaaatctgttaccataagaaaaggggtggaagaacttagtgggtgaaccaaacaaaaatggaagacatcttggtccatcacagcatacacagcctttttcagtctatccacaaccttcattaccaccttttttcccacagatatacttcacacccaccaaagtgcttgctyttccttagatgtcatagtactttcatatcaatactttatttaattttatttgcctggtaaacattttctattatctgcctgttgaatacttaatctcctaacgatttaaaaccaaagataaagttcataatgttcataaatgttctatgaaacattttccagcttccccagcaaaagctagtgcttgttcctgagggttcaaacgggagttcatagccaagtcaccactgttactgattttgtcacattgctgttatatgatagttgtttacatacctttgctactattaatagattttg

SEQ ID NO: 87435 - DNA, 601 bp, Human
cctttgctactattaatagattttgccataaaagctaagcctatgcatttaaaaaacatttttaatgcctgacacttagcaaagttttcagcatatagtaagtaagcaaggtatttgaataaaatgaataaatgaatgagtgaacaaatgaaaattgatggtgaaattggtgaataatcaagtctgataagagtatggagtttgtgatagaaagtaatcaaacagaaattggaaacataggctaaagccagatagtggcgatcttgaggatcacattaaggagttaattttttttttttttaattttcgattcaggaagtacatgtacaggtttgtcacacaggtacattgcgtgatgccgaggtttggccttctaatgtgccgatcactcaaatagtgaacttagtacccaatagatggattttcaaccctttttcctgctctgtccctccctgcttttgaaatccccagtgtttattgttcccatctttgtgtctatttgtacccagtgtttagctcccatttttaagtgagaacatgtgatatttggttttctgttgctgcattaatttgcttagaataatggcctccagctgcatcc

SEQ ID NO: 87436 - DNA, 601 bp, Human
tagttacaaatctcttcctgtagtctccccttatgattgatgagtagaagctatacattggttggttgtagcaatgccctggttggcacacatttttcagaacatatagtagctgaatacactccagtcagaatagcactgttttaaacagtgtttgcaaaacagtccagaccactcatttgaatttcaccttccaaaagcagaatatagccaaaatctgggaagtgagtgccataatgtatatgcttactaaactgtccattccgatttcatctgtatatctaatttataacaataatarctaacatttattgttgttatgttctagaaactgctctaaatgctttatgaggcttttctcagtttactctcagtagcactccctacaagataggttttcctcattttatagatgaggaaacagcctcagagaggttgagtgattttcctaaagtcatatggctagtagtagacagagttgaaactcaaatgccggaagcttgtcttcaaattcgaaggtcttagtcagtatgctagatacattagtatttgtcacatgtccacagattgtgattttgtggataaagcccctgcccttcat

SEQ ID NO: 87437 - DNA, 601 bp, Human
ccacaggcatcagtgctgtctttaggtccctttggaattacatacttttcacaattgaagtcactcacttaaaggtgatgcaaattttgcaatagggataaccatgtgcccacgtaagtttccaattttttcttaagtaatactacactagcttaatgagtgggaaaatccaagataggagaggaaaataaattgtacactccagtgtgttggagccagcaagtgagagtgattcttggcatttcagcataattccatgttcagtgacatcatgttggtagcttgaaactagccatgatgrgagtattttactaagaaactggcaaacaagccaggcatggtggtgtgtgccagtagtctcaacaacttgggaggctgaggcaggaggattgcttgagcccagaggtccagcctgggctacatggacccatctctaaaaacaaagaaagaaagaaattggtaaactctgtaagtcagacatctccccctcccccagccccagaaagctggttgttaaacatttatcagcacgctgctagcattgaatttccattagttgactactttaacatcacaatctagataactaaggtacaggcat

SEQ ID NO: 87438 - DNA, 601 bp, Human
aatatgtattgcagttatcagattgctcttccaaatattttaaattccaaaatatttatataataggcttagaattttaaattacccaaaagtaggccgggcacggtggctcatgcctgtaatcccagcactttgggaggccaaggcaggcggatcacaaagtcaggagttcaagagcagcctgcccaacatggtgaaacctcatctctactaaaaatacaaaaaattagctgggtgtagtggcgggcacctgtaatcccggctactcgggaggctgaggtaggagaatcgcttgaacccrggaggcagagcttgcagtgagccgaagtcgcgccactgcactccagtccgggcaacagagcaagactctacttcaaaaaaaaagaaaaaaaaaaagaaatggctgtcttctttgattccataccctcctagacacacacacacacacacacacacacacacacacacacacgcctattgtgagtcccttttttttttttaatttagtgtgaatttatactgtggctcatagtatcagttcctagggcattggtgtgacctgactattaactctgttttctacatcactgattggaaaacc

SEQ ID NO: 87439 - DNA, 601 bp, Human
ctggtctgcctttattctccctcttatccaaccctattgttattccttgagtacttgttgaaggcctgctctatccaaaccactatttaaatttctgagatttcaaaagggaatgggacctatttttgccctggaggaactctgggtttcgtggaggaaactggcacctgaagagatcatgacaatgcatttggtaagagatttaagagagggatgaaagttgcttcactaactttgccttgggagttgggaattttttctggagaaagtcaaacttaaagagctgttaaaggatgagtargtgtttaaatgtccctctcagtctttagttcatcattctatcattaggtcatcaccaacgttcttaaatactgtagtcatattaaaaatgtgaattcataaagccctaaaaagtcactttcctgagttactatagtttcttgaccgtccacttacgagacaggcttataaaattgccaccttaagataaaggtgcagtctgctttgtgaaggcctccccagaatttgtcattacacattttaaaacatattcttttttctcaatgcattttatgcctgtgtatgctggttaaagaagaaa

SEQ ID NO: 87440 - DNA, 601 bp, Human
cctggaggaactctgggtttcgtggaggaaactggcacctgaagagatcatgacaatgcatttggtaagagatttaagagagggatgaaagttgcttcactaactttgccttgggagttgggaattttttctggagaaagtcaaacttaaagagctgttaaaggatgagtaggtgtttaaatgtccctctcagtctttagttcatcattctatcattaggtcatcaccaacgttcttaaatactgtagtcatattaaaaatgtgaattcataaagccctaaaaagtcactttcctgagttrctatagtttcttgaccgtccacttacgagacaggcttataaaattgccaccttaagataaaggtgcagtctgctttgtgaaggcctccccagaatttgtcattacacattttaaaacatattcttttttctcaatgcattttatgcctgtgtatgctggttaaagaagaaaagcaatttgtaatgcatttctcctacaaatggcataaacttcactttttcccacctgtcatcgtatagtaaatgtgttttgaatgtataatatccttttatatattaaattttattacttaaaattatt

SEQ ID NO: 87441 - DNA, 601 bp, Human
cagcctcagttatttggctaattatttaaactctttatgtttcatgtgtaaacataagcaatatgaagttaataaataatggaattggcaatatttctaatgttatactatcataaccagtcataaccatattttctgttggttactttagatatacaaacaagtacatggtttaattaattaaattactttgtaaattttttttttttctttttttgagacagactctcattctgtcaccaggctggagtgcagtggcacaatcttggctcactgcaacctccgcttcccaggttcaagyaattctcctgcctcagcctcctgagtagctgggactacaggtgcgcaccaccacgcccagctaattttttgtatttttagtagagacggggtttcaccatgttggccaggatagtctcaatcttctgatctcgtgatctgcctgccttggcctcccaaggtgctgggattacaggagccaccccgcctggccagctttttctttaagtaaatttaaaaggtggaagtggtatttaaatgggtaaataagatcctgatttttaaaaatgattgttttatgaactaagcttcagggttttag

SEQ ID NO: 87442 - DNA, 601 bp, Human
gactctttattcttatcaatcagtgcataaatattgactgcctgaaaatacatgaataggaacaatacagaggaataaaaatcaggaaaggaaacaaaagattaatttttactcattatatcaagtggactctttttgctgggctttcttaatcggttagcttatgagttgagtcttgggcagaaaaaagaattcacaagaatgtctttctcagatacttttaataccatcttcatgtttaaagaaaaatatctgtgtatagctcaaattggtgttttatgaactgtattttgtgacacarggtcttattccaaaaaatttaagactatcatcataatcaaaatgactgctaaaattttttttattcattattataaaaagtgagtgggctgatacatcaggataaagcaactgatgattttgtcactattgtgtggttaaaatctgtgcctatcttggaggtatggattgagcatcatattattctactctaggtcttaaacatctttcttattcctggtctgacattccaaacatctcctttacatgtcaagaatgcttattcaagttgcaatagctcttaggtatatttttaaaatta

SEQ ID NO: 87443 - DNA, 601 bp, Human
gagttaaacaaaagcccaagcctaaatctcaaataacaagaggaagaaggatgcttccatgtcagccgatgtctcatcaagtacctacttagtcttggaatagactctaactttgcctaccaagtgtttatctgactggtaccacttagagtcttaccatataatttacattacacagtattaggaagtctatacttgttggtgatgcgtgcataattttttaaaaccattgaggtgatcactatctcagagtgctgattagaacttcaagactggtcccaggccaggtacagtggtttaygcctgtaatcccagcactttgggaggctgaggcaggcggatcacctgaggtcaggagttcgagagtagcctggccaacatggtgaaaccctgtctctactaaaaatacaaaaattagctgggcgcagtggcacacacttgtgatcccagctactcaggaggctgaggaaggagaacccgttgaacttgggcagcggaggttgcagtgagccaagatttcgccactgcactccagcctgggcaacacagtgagactccatctcaaaaaaaataaaataaaataaaagactggtcccacagc

SEQ ID NO: 87444 - DNA, 601 bp, Human
cccatttaaaaaacaaaattttggctggtcacggtggctcacgtctgtaatcccagcactttgcagaaggattgctagaaaccaggagtttgaaaccagcctgggcaatgccatgagaccctgtctctacaaaaaataaatccactgagcatggtgacatgcgcctgtagtcccagctactcaggaggctgaggtgggaagatcccttgagccgaggaggttaaggctgcagtgagctgtgattgtgccaccacactccagcctgggcaacagagtgagactctatctcaaaaaaaaaaaataagaaaaaataaataaaaaataaagaaatttctgggccaggcacaggggcttacacctgtaatcccagcactttgggggccaggctggaggatcacatgaggcgaagagttcaagaccagcctgggcaacatagactctgtctgtacaaaaaataaattagctgggctcggcagtgcatgcctatagtcgcacctactcagatggctgagataggtgcactgcttgagcctggaaggttgaggctgcagtgaggtatgatcatgccactgcactacagcctggacgatagagtgagact

SEQ ID NO: 87445 - DNA, 601 bp, Human
tatatcctaccttatgtggaagagcctgtaacaatcctgttagagcagttaattctgattttaaatgagaatcacaggtcagaatttcccagaatgaaattctagggtaccctaatttcaggaattttgtgaaaattacagatcatgctatttataagttgcctaccataatgtctagtgcaaacactaaattgcagctgtttttttccatttgtcactgtccattctttggtttaccatatgaatctaagatttactcacactgtcattaatctcaaccattaacataccattctttctyttaattctatcaaggtccagggtgttgtgttttcttttctctttttcattgtgacactcaggaatgtgtgagataagaggtcctagagggagtgaaaagtcacagatttgctttctgataaaacacctgaatccccctaaatatgtgaagctccgtgaccatttcagagacacacagaggtccagattctatttcttcccccattacaagtcacattgctagagagattcttcccgatatcaagcactggccacaagtcaaactggcgtcttcccatttgggaccagtggaggtgaagaa

SEQ ID NO: 87446 - DNA, 601 bp, Human
gtatgctcattctcttttaattttcgataaggtaattgtttcagtatatttcacttacagttttgagatatttttctattgagccaccattgggtaatgtatgggaaaccaatcaataaatagttcttatgattcaagagatacgttgtaaaaaagatcaattctgcctaaaggtagccatgttaattttctgattcccacaagcttaagtactagctgttaaaaaaaaatattttaagatggatgtatcattttctatagttattggttattttcggaatggtgcaataacaaattactktctgtctaatgacttctattcatggatgcagtggtataaaataatctacccttatcattcatatttctgtgtagttgagtaaggtgggaactatttttgatatgcaggagcaaatactaaagcaatggggttccatgcactttctgtcagcaaaagtatcaactgccagaaacccctgataagtcccatttcaagcaagtagagtctggataataccaaacagcaagacaacagttagtacttgtgaactggcagtactgccaacttgacttaccattctaacccgaaataaacaccccg

SEQ ID NO: 87447 - DNA, 601 bp, Human
tagtaaagacaattctcagaaattacagagggcttcggtctcagcttatgcaaagtcaagtcaggctgcttgactgacaagtcaagtcagtactctttcagttacagatctcagaatcctgcctcaagctggtttaagcaaaaaagaggaaatttttggcttatggcactgaaaactccagggtgggccttctttctgtcgtgactggacttaggtgcaccagtgattacagttgactttcttcatctccgggcttggttttcctctgctgggtttgttctcaaaggctctctccataggrtaacaaagacagccatgaattatttcaggctcacgttttatcagcccaatgtgtcccccacaagaaacaaactaccattttcccaatagtgttgttaagaagttggagaatatgtctcacgggctggcttgggcctcttgcccatttctgaaccaatacctgtgtctatgaggctatgatgttctaattggccaagtctggatcatatgcccagatgtgcacttccagggcatgggtttgattggatgagggccactgccacttgtaccacatgggctgaaatggtaaaggagtgctccc

SEQ ID NO: 87448 - DNA, 601 bp, Human
agctcattgtctgtctagtctccaattatctctgtagagaaaagtactattgtaagtagcaaaaaatatttatgttttacttgagaaaccatatttattctttaatatgtgtgtttacacagaagcttgttctctgaataaaattgtgaaatgctaaaaccaatatttctcttaccttagcattgtggttaagaatgcaaccaaactttcatctgtttggctttctgcaaaatgtacattgagaaagaaactgggaactaccagggagcccttaatgacacagggacactaatgaatcacrttattccccattttcctatgctaggtttcccaaaaccatttctcttactttgctaaactatagaagccctctttttaattcccagctaacataaaagaaaattaaatgggggaggggttgtgtgtgcgtgtgtgtgtgtgtgtaagcttgctgtggtctgagtctagttcaatataagctaaccctttaagcttggattttagcctcttccattccaagagcctcccacagaatccagaccaggggtgctttcatttttctgaggatacagggatatttatgccacttaatctctcaata

SEQ ID NO: 87449 - DNA, 601 bp, Human
ttagcctcttccattccaagagcctcccacagaatccagaccaggggtgctttcatttttctgaggatacagggatatttatgccacttaatctctcaatattagtgtattacctagttcctacattcatttgctgaacaaacattcttttgagcatattacataacagacactagcagttatggtgtaggttacacagcagtaaataagacaaatccctgtgttgggtaatagtcttactgggatgaaaaacagaaatttaaagtactaggaaaaatttaaggtaccaggtccataaagrgcccaagtcatacctaaggggcctaataggccatccctaaagggaagcttacactaaactgatactgattcatacccaaggttgttagaattggacttgattggagatttataagagaaaatcattagcagcatgggacaaatatgaagcccctttattttattttattttattttattttattttattgtattgtattgtattgtattgtattgtatttattttgaggcggaatctcactctgttgcccaggctggaatccagtggcacaatcttggctcactgcaacttctgcctccc

SEQ ID NO: 87450 - DNA, 601 bp, Human
aggggtgctttcatttttctgaggatacagggatatttatgccacttaatctctcaatattagtgtattacctagttcctacattcatttgctgaacaaacattcttttgagcatattacataacagacactagcagttatggtgtaggttacacagcagtaaataagacaaatccctgtgttgggtaatagtcttactgggatgaaaaacagaaatttaaagtactaggaaaaatttaaggtaccaggtccataaagggcccaagtcatacctaaggggcctaataggccatccctaaakggaagcttacactaaactgatactgattcatacccaaggttgttagaattggacttgattggagatttataagagaaaatcattagcagcatgggacaaatatgaagcccctttattttattttattttattttattttattttattgtattgtattgtattgtattgtattgtatttattttgaggcggaatctcactctgttgcccaggctggaatccagtggcacaatcttggctcactgcaacttctgcctcccgggttcaagcaattctcctgcctcagcctcccaagtagctgg

SEQ ID NO: 87451 - DNA, 601 bp, Human
gttacacagcagtaaataagacaaatccctgtgttgggtaatagtcttactgggatgaaaaacagaaatttaaagtactaggaaaaatttaaggtaccaggtccataaagggcccaagtcatacctaaggggcctaataggccatccctaaagggaagcttacactaaactgatactgattcatacccaaggttgttagaattggacttgattggagatttataagagaaaatcattagcagcatgggacaaatatgaagcccctttattttattttattttattttattttattttattgtattgtattgtattgtattgtattgtatttattttgaggcggaatctcactctgttgcccaggctggaatccagtggcacaatcttggctcactgcaacttctgcctcccgggttcaagcaattctcctgcctcagcctcccaagtagctgggattacaggtgcccgccaccacgcccagctaatttttgtatttttagtagagatgaggtttcaccatgttggccaggctggtctcaaactcctcacctcaggtgatccaccagcctcagcctcccagagtgctgggattataggtgtg

SEQ ID NO: 87452 - DNA, 601 bp, Human
tacacagcagtaaataagacaaatccctgtgttgggtaatagtcttactgggatgaaaaacagaaatttaaagtactaggaaaaatttaaggtaccaggtccataaagggcccaagtcatacctaaggggcctaataggccatccctaaagggaagcttacactaaactgatactgattcatacccaaggttgttagaattggacttgattggagatttataagagaaaatcattagcagcatgggacaaatatgaagcccctttattttattttattttattttattttattttattgtattgtattgtattgtattgtattgtatttattttgaggcggaatctcactctgttgcccaggctggaatccagtggcacaatcttggctcactgcaacttctgcctcccgggttcaagcaattctcctgcctcagcctcccaagtagctgggattacaggtgcccgccaccacgcccagctaatttttgtatttttagtagagatgaggtttcaccatgttggccaggctggtctcaaactcctcacctcaggtgatccaccagcctcagcctcccagagtgctgggattataggtgtgag

SEQ ID NO: 87453 - DNA, 601 bp, Human
agtaaataagacaaatccctgtgttgggtaatagtcttactgggatgaaaaacagaaatttaaagtactaggaaaaatttaaggtaccaggtccataaagggcccaagtcatacctaaggggcctaataggccatccctaaagggaagcttacactaaactgatactgattcatacccaaggttgttagaattggacttgattggagatttataagagaaaatcattagcagcatgggacaaatatgaagcccctttattttattttattttattttattttattttattgtattgtattgtattgtattgtattgtatttattttgaggcggaatctcactctgttgcccaggctggaatccagtggcacaatcttggctcactgcaacttctgcctcccgggttcaagcaattctcctgcctcagcctcccaagtagctgggattacaggtgcccgccaccacgcccagctaatttttgtatttttagtagagatgaggtttcaccatgttggccaggctggtctcaaactcctcacctcaggtgatccaccagcctcagcctcccagagtgctgggattataggtgtgagccaccgca

SEQ ID NO: 87454 - DNA, 601 bp, Human
taaataagacaaatccctgtgttgggtaatagtcttactgggatgaaaaacagaaatttaaagtactaggaaaaatttaaggtaccaggtccataaagggcccaagtcatacctaaggggcctaataggccatccctaaagggaagcttacactaaactgatactgattcatacccaaggttgttagaattggacttgattggagatttataagagaaaatcattagcagcatgggacaaatatgaagcccctttattttattttattttattttattttattttattgtattgtattgtattgtattgtattgtatttattttgaggcggaatctcactctgttgcccaggctggaatccagtggcacaatcttggctcactgcaacttctgcctcccgggttcaagcaattctcctgcctcagcctcccaagtagctgggattacaggtgcccgccaccacgcccagctaatttttgtatttttagtagagatgaggtttcaccatgttggccaggctggtctcaaactcctcacctcaggtgatccaccagcctcagcctcccagagtgctgggattataggtgtgagccaccgcact

SEQ ID NO: 87455 - DNA, 601 bp, Human
ttaaagtactaggaaaaatttaaggtaccaggtccataaagggcccaagtcatacctaaggggcctaataggccatccctaaagggaagcttacactaaactgatactgattcatacccaaggttgttagaattggacttgattggagatttataagagaaaatcattagcagcatgggacaaatatgaagcccctttattttattttattttattttattttattttattgtattgtattgtattgtattgtattgtatttattttgaggcggaatctcactctgttgcccaggctggartccagtggcacaatcttggctcactgcaacttctgcctcccgggttcaagcaattctcctgcctcagcctcccaagtagctgggattacaggtgcccgccaccacgcccagctaatttttgtatttttagtagagatgaggtttcaccatgttggccaggctggtctcaaactcctcacctcaggtgatccaccagcctcagcctcccagagtgctgggattataggtgtgagccaccgcactcagcctccctttattcttttaagttacgggatgctttttaaaattttgacatatgtg

SEQ ID NO: 87456 - DNA, 601 bp, Human
ttgtattgtattgtattgtatttattttgaggcggaatctcactctgttgcccaggctggaatccagtggcacaatcttggctcactgcaacttctgcctcccgggttcaagcaattctcctgcctcagcctcccaagtagctgggattacaggtgcccgccaccacgcccagctaatttttgtatttttagtagagatgaggtttcaccatgttggccaggctggtctcaaactcctcacctcaggtgatccaccagcctcagcctcccagagtgctgggattataggtgtgagccaccrcactcagcctccctttattcttttaagttacgggatgctttttaaaattttgacatatgtgtttttttaataatacttttcctacttttgtatgcttagatgctgtgataaagatctctggctttataatttcaaacaaggaatcattgaataggaaaacatgaaaattaggtcatacacatagtaccagaaaatatcaagtccattggccatgtgatcgtaactgagatagcactgagcaattaatgaccgtgtaccttacgtggcaaagaacccaagctgaaataaataggttcctaa

SEQ ID NO: 87457 - DNA, 601 bp, Human
tgaaataaagtttcgggtttttttgggttttttttgtttttgagacagagtctcattctgttgcccaggctggagtgcagtggcacagtctcggctcactgcaacctctgtctcctgggttcaaataattctcgtgcctcagcctcttgagtagttgggattacaggcatgtgccaccactcccaactaatttctgtatttatagtagagacgggtttcaccatgtcagccaggctggtctcgaactcctgacttcaagtgatctgcccacttcagtctcccaaagtgctggggacaggcrtgagccactgcacccagcctgaaataaacagttttaaaagccctttatttaatatcgatcggaaaaaaatgaaacatattccctcagcggcccccaacctttttggcaccagggactggtttcatggaagacagttttttcacagactaggctggggagagatagtttcaggatgaaactgttccatcttagatcaattagattcttataaggagcacacagcctagatccctcatgtgcggttcacaatagggtttgcgccctcatgagaatctaatgtcactgcggatctgacaggaa

SEQ ID NO: 87458 - DNA, 601 bp, Human
tgataaatcttcagggaaacttgatagcatattatttgtacaattcaggtcagtaaacatttgtataggacctatcatgtggaaggtaccatacaaggcactgaggtggagaaaagatggataagatatgttctttcaagaggctaatgaatggtctagtaggagagataggcagtttaggagagttgtaaaatagagaattagggagtagtggtaaggaaggaaatgaaagaaaatgtcaggctacagaggactgtatgagccatactaagatgtttgaacatcattcggaaggcgatgragagtcatgaaagggtttaaatctgaggtgtggaacataatcagattaaattttacaagggtgattctggtgtaaggctttgaaacccccactggtgtttaagagacaacaagtttactagcaacattgagttccttgtagagattggaggccataatttgcagattggttcttctgcaaatgcattgttcgccctagcaatatttggtagacaagtataaaatcagaaaagaaaaaagttaaatgaaccgtatattgcagttttgatgggtgagagaaaaataaaccagactgacaaga

SEQ ID NO: 87459 - DNA, 601 bp, Human
atccatatgagagttcacaagaggtccttatggcttagtccatttgtttggttgtttgggggttttgttttgcttagttttttgctttggttttgtttacatttttgttttatgtttgtttgtttggtcactattgggctaatactgaccattatttagatttataaccttcaatcttgtgatgaattggttttgaaaactgcaggctacaattttttatttctctagtaagctcctggaagtcaagatattttatattttcaaaaataaaattctctccttcagactgactgtgcccacratagtttacagctacaaccaggaataacaaatgcaaggactgcgatcaagttaacatggatttgactgaatatacatccaaacttataagtgggttacagaaagtcaattggcaagtcatttgtatggaaatagtgatgagttttcccatttaaaagttaataatggccaggcacggtggctcacgcctgtaatcccaacactttgggaggccgaggcaggtggatcacttgaggtcaggagttcaagaccagcctggctaacatggtgaaaccccgtctctactaaaaatacaaaaaat

SEQ ID NO: 87460 - DNA, 601 bp, Human
gccaagacctgcatgcatgactcaactgtgtttggttgcttactctctttgctgtgtggtgtaaagatattgttgaaaatgacaaaatggcctgcagatacccctcagggtaactgataaaaagaggaagcatttatgtttacctctagcacagaaagccaagctgttggagaaactggacaggagtatatgaaacatccatatatgacctgaagaaacagaaggatacaccgctgaagttctgtgctgaaactgattcacagaagttagtgaagattagaaaactgcataaagccaaacrtgaagattttgatcatgtattgaaagtgcggatctgtccacgtcacagtgaacacatggcacatagtggtatgctgaccatgaaacaaaggtcaatgatgaactgaaaattaaaaggaactgtgaataatcaatagtctggttgcagaaatttaagaaaagacacagcattacatttttaaagatttgtgatgataaagcatctgctgatcacaaagcagtgaagaaattcattgagtttgccagagtcatggctaatgaaaatctgaagccaaaacaagtctataatgctgatgaaaca

SEQ ID NO: 87461 - DNA, 601 bp, Human
tgcagatacccctcagggtaactgataaaaagaggaagcatttatgtttacctctagcacagaaagccaagctgttggagaaactggacaggagtatatgaaacatccatatatgacctgaagaaacagaaggatacaccgctgaagttctgtgctgaaactgattcacagaagttagtgaagattagaaaactgcataaagccaaacatgaagattttgatcatgtattgaaagtgcggatctgtccacgtcacagtgaacacatggcacatagtggtatgctgaccatgaaacaaaggycaatgatgaactgaaaattaaaaggaactgtgaataatcaatagtctggttgcagaaatttaagaaaagacacagcattacatttttaaagatttgtgatgataaagcatctgctgatcacaaagcagtgaagaaattcattgagtttgccagagtcatggctaatgaaaatctgaagccaaaacaagtctataatgctgatgaaacatcactgttttggcatcattgcctcagaaagacactgactacagctgatgagacagcacctactagaattaaggctgccaagaacagaatatg

SEQ ID NO: 87462 - DNA, 601 bp, Human
tccccacagatctttgcaacttgtggatcaggagatcccctcatgagcccacgctaccagggccttgggtccaataaacagagctgtgcggagtctcagcacaggtacacacagagacaagagttttacatactccggccccggaatttccagcaaggtgacagatccctttgtacattcccctaggaagggggctgaatccagggagccaagcagcattgttctgcaggccccacttccacagcacctcacaagttaagtcccactgtcttggaattccagccagccaatggcaacacartgagtctgcctgaaacaggatggagttccctgtgggaggggtggctaccatttctgtggtttggtcaactgcacattccagcctgccagctccagagagtctgggtggtccagatgaggaagggatacccccaacacagcacagctgctgtgccagattgtgcccaaactgctttaaagtgggaccctgatccattcctcctcactgggcagggcctccctgtggggggccttcaatcactccagctgggcttatatggacagagagctctgatctctccctgggatgcagctcccagaa

SEQ ID NO: 87463 - DNA, 601 bp, Human
ctcacaagttaagtcccactgtcttggaattccagccagccaatggcaacacaatgagtctgcctgaaacaggatggagttccctgtgggaggggtggctaccatttctgtggtttggtcaactgcacattccagcctgccagctccagagagtctgggtggtccagatgaggaagggatacccccaacacagcacagctgctgtgccagattgtgcccaaactgctttaaagtgggaccctgatccattcctcctcactgggcagggcctccctgtggggggccttcaatcactccagcygggcttatatggacagagagctctgatctctccctgggatgcagctcccagaaggaggggaggctgccatctctgtggttcagtcaactgagctgttccagcttgcctactctagagagtctgggcagtccagatgaggaagggtcctccccaacagagcacacctgctctacagccagactgcttctttaagcgggtccctaattctgttcctcctgactgggtgagacctttcaataagggtctccagaaacctctgaaacgagcatttgggccagcagcaggtcagtacccaccctg

SEQ ID NO: 87464 - DNA, 601 bp, Human
tgtggtttggtcaactgcacattccagcctgccagctccagagagtctgggtggtccagatgaggaagggatacccccaacacagcacagctgctgtgccagattgtgcccaaactgctttaaagtgggaccctgatccattcctcctcactgggcagggcctccctgtggggggccttcaatcactccagctgggcttatatggacagagagctctgatctctccctgggatgcagctcccagaaggaggggaggctgccatctctgtggttcagtcaactgagctgttccagcttgccyactctagagagtctgggcagtccagatgaggaagggtcctccccaacagagcacacctgctctacagccagactgcttctttaagcgggtccctaattctgttcctcctgactgggtgagacctttcaataagggtctccagaaacctctgaaacgagcatttgggccagcagcaggtcagtacccaccctgggatggagtgtccagaggaaggagcaggctgccatctttgctgcttcacagccttcactgttgatacctccaagtacaggaaaagcagaggcaactaaggtctggagc

SEQ ID NO: 87465 - DNA, 601 bp, Human
aagatcaaaaaaagacaaagaagggcattatataatggtaaagggttcaattcaacaagaagagttaactcagctctggatcaagcggacctgatagatatctacagaactctccaccaaaaaacaacagaatattcattcttcttctcaccctacagcacttactcaaaacttgttcacataatcagaagtaaaacactccttagcaaatgcaaaagaaccgaaatcataagaaaccatctctcagacaacggtgcaaccaaattagaactcaagattaagaaattcactcaaaaccacmcaagtacatagaaattgaacagcctgctcctgaattacttgtggataaataacgaaattaaggcagaagtcaagaagttgtatgaaattaatgagaacaaagagacagtgtaccagaatctctgggacacagctaaagcagtgttaagagggaaatttgtagcactaaatgcccagatcaataagctagaaagatctcaaggtatcaacctaacatcacaactaaaagaactagaaaaccagaccaaacaaaccccaaggcaagaaatagccaagatcagagtggaactgaaggagatac

SEQ ID NO: 87466 - DNA, 601 bp, Human
taaatccaacattgcattgcatttgtttgtttgtttgtttgtttgtttagacactgtcactctgtcacccaggctgagcgcagtggcatgatcttggctctctgcaacctctgtctcccaggttcaagcgattctcctgccccagcctcttgagtagctgggactacaggcacgtgccaccacgcctggctaatatttttgtattttttagtaaagacagggtttcaccatgttggccaggctggtcttgaactcctggcctcaggtgatcagccagctttggcctcccaaagtgctgggrttacaggtgtgagccaccacacccggccccaagattgcatttaaaagtactgaataaacaggtttttatctagtaattgacttgaaaacttaataagagtttaaagaaaatacctttagactagttccatcacagttctaatttttaaaacatcttcggctgggcatggtggttcacgcctgtaatcccaacactttaggaggctgaggcaggtggatcacctgagtcaggagttcgagaccagcctggccaacatggtgaaacaccatctctactaaaattccaaaaaattagctgggc

SEQ ID NO: 87467 - DNA, 601 bp, Human
aaagaaaatacctttagactagttccatcacagttctaatttttaaaacatcttcggctgggcatggtggttcacgcctgtaatcccaacactttaggaggctgaggcaggtggatcacctgagtcaggagttcgagaccagcctggccaacatggtgaaacaccatctctactaaaattccaaaaaattagctgggcgtggtggcacacacctgtaatcccagctagtctggaggctgaggcaggagaatcacttgaacctgggaggtggaggttgtggtgagctgagatcacaccactkcactccagcctgaatgacagagagagactttgtctcaaaataaataaataagataaaaataaaacatcttcatcaacctctggtaatctacagaaaacttaatgttatcgtgaaatcaaatacaatagcacttataggatatgtctcacaaaacagatgccgacatcagtggctcagacagttgtccagaaggaaagtggcctgcagcacacccgaaagatgctgcatgttggtgacccaagtgtgaaaaagacagccatctcgctgctgaggaatctgtcccggaatctttctctgcag

SEQ ID NO: 87468 - DNA, 601 bp, Human
tcttcggctgggcatggtggttcacgcctgtaatcccaacactttaggaggctgaggcaggtggatcacctgagtcaggagttcgagaccagcctggccaacatggtgaaacaccatctctactaaaattccaaaaaattagctgggcgtggtggcacacacctgtaatcccagctagtctggaggctgaggcaggagaatcacttgaacctgggaggtggaggttgtggtgagctgagatcacaccactgcactccagcctgaatgacagagagagactttgtctcaaaataaataaatragataaaaataaaacatcttcatcaacctctggtaatctacagaaaacttaatgttatcgtgaaatcaaatacaatagcacttataggatatgtctcacaaaacagatgccgacatcagtggctcagacagttgtccagaaggaaagtggcctgcagcacacccgaaagatgctgcatgttggtgacccaagtgtgaaaaagacagccatctcgctgctgaggaatctgtcccggaatctttctctgcagaatgaaattggtgagtcggtataagtatctatgtgtaatatgtacatgct

SEQ ID NO: 87469 - DNA, 601 bp, Human; identical to SEQ ID NO: 30713

SEQ ID NO: 87470 - DNA, 601 bp, Human; identical to SEQ ID NO: 30714

SEQ ID NO: 87471 - DNA, 601 bp, Human; identical to SEQ ID NO: 30715

SEQ ID NO: 87472 - DNA, 601 bp, Human; identical to SEQ ID NO: 30716

SEQ ID NO: 87473 - DNA, 601 bp, Human; identical to SEQ ID NO: 30717

SEQ ID NO: 87474 - DNA, 601 bp, Human; identical to SEQ ID NO: 30718

SEQ ID NO: 87475 - DNA, 601 bp, Human; identical to SEQ ID NO: 30719

SEQ ID NO: 87476 - DNA, 601 bp, Human; identical to SEQ ID NO: 30720

SEQ ID NO: 87477 - DNA, 601 bp, Human; identical to SEQ ID NO: 30721

SEQ ID NO: 87478 - DNA, 601 bp, Human; identical to SEQ ID NO: 30722

SEQ ID NO: 87479 - DNA, 601 bp, Human; identical to SEQ ID NO: 30723

SEQ ID NO: 87480 - DNA, 601 bp, Human; identical to SEQ ID NO: 30724

SEQ ID NO: 87481 - DNA, 601 bp, Human; identical to SEQ ID NO: 30725

SEQ ID NO: 87482 - DNA, 601 bp, Human; identical to SEQ ID NO: 30726

SEQ ID NO: 87483 - DNA, 601 bp, Human; identical to SEQ ID NO: 30727

SEQ ID NO: 87484 - DNA, 601 bp, Human; identical to SEQ ID NO: 30728

SEQ ID NO: 87485 - DNA, 601 bp, Human; identical to SEQ ID NO: 30729

SEQ ID NO: 87486 - DNA, 601 bp, Human
ctacttctagttcagacctcttcccgttaggatatatgggctcagatgcctagatttgttgtttttgtatgaggctcttttcttttctttttgttctttgatttttacttacctttcccttcttttgttcatgtgaatgtcgtatgaatgcaaccttctgctctcctttgctccctatatctttctctttcacgaaaggggatgatcacttgtccaaaaggcagaatgaatagtgtggaacttcctttctatccatggaagtgaaaattatgcaattttccctgagagaaattcagcaagkcttcccatctgagcctctaccactattcttgaagctgtaagaattctggaatattatgcccattcaaaggtgagtcctgattctgattagattttaaacacacacacacacacacacacacacacacacacacacacacacacactttttaagcctaccaaagcaggatagagacccagaagacaccgacctattacgtcacctcagatgtttcacagccatcaggagtaactctttgtagtcagctcagtttcagatcaacttttttttttttctttctttcttttttagacagagtct

SEQ ID NO: 87487 - DNA, 601 bp, Human
tacttacctttcccttcttttgttcatgtgaatgtcgtatgaatgcaaccttctgctctcctttgctccctatatctttctctttcacgaaaggggatgatcacttgtccaaaaggcagaatgaatagtgtggaacttcctttctatccatggaagtgaaaattatgcaattttccctgagagaaattcagcaaggcttcccatctgagcctctaccactattcttgaagctgtaagaattctggaatattatgcccattcaaaggtgagtcctgattctgattagattttaaacacacacacacacacacacacacacacacacacacacacacacacactttttaagcctaccaaagcaggatagagacccagaagacaccgacctattacgtcacctcagatgtttcacagccatcaggagtaactctttgtagtcagctcagtttcagatcaacttttttttttttctttctttcttttttagacagagtcttgctctatcgcccaggctggctggagtgcaatggcgcgatctcggctcactgcaacctccgcctcctgggttcaagcgattctcctgcctcagcctcctgagtaa

SEQ ID NO: 87488 - DNA, 601 bp, Human
cttacctttcccttcttttgttcatgtgaatgtcgtatgaatgcaaccttctgctctcctttgctccctatatctttctctttcacgaaaggggatgatcacttgtccaaaaggcagaatgaatagtgtggaacttcctttctatccatggaagtgaaaattatgcaattttccctgagagaaattcagcaaggcttcccatctgagcctctaccactattcttgaagctgtaagaattctggaatattatgcccattcaaaggtgagtcctgattctgattagattttaaacacacacacacacacacacacacacacacacacacacacacacacactttttaagcctaccaaagcaggatagagacccagaagacaccgacctattacgtcacctcagatgtttcacagccatcaggagtaactctttgtagtcagctcagtttcagatcaacttttttttttttctttctttcttttttagacagagtcttgctctatcgcccaggctggctggagtgcaatggcgcgatctcggctcactgcaacctccgcctcctgggttcaagcgattctcctgcctcagcctcctgagtaact

SEQ ID NO: 87489 - DNA, 601 bp, Human
tgattagattttaaacacacacacacacacacacacacacacacacacacacacacacacactttttaagcctaccaaagcaggatagagacccagaagacaccgacctattacgtcacctcagatgtttcacagccatcaggagtaactctttgtagtcagctcagtttcagatcaacttttttttttttctttctttcttttttagacagagtcttgctctatcgcccaggctggctggagtgcaatggcgcgatctcggctcactgcaacctccgcctcctgggttcaagcgattctsctgcctcagcctcctgagtaactgggattacaggcatgcaccactaggcctggctaatttttgtatttttagtagagacagggtttcaccacgttggccaggctggtctcaaactcctgacctcaggtgatctgcctgccttggcctcccaaagtgctgggattacaggcatgagctgctgcacctggcctcggatcaacttgagggccttattttccagtgcagggaagatggtagaaatatgttttggggaagcattttattaccagtggcattaggtggcagatgtaatagagcaga

SEQ ID NO: 87490 - DNA, 601 bp, Human
ttttaccgtaattcaggtgtgatgtggtggtaactttgactagggcatagaagttgggcaggagaggtaagtttggggcatgtttgggagtgatcgtctataggatctcaagtgtgatttccttcagagaaatgctgagctaaatgggcaggaatctgggatactcagagggaaatgaaaataggtgccctagggggttgcccagataagcagctggcgttccaagaccaaagagtatctgtttctcacccctctcccatttagtttctaaccttgagctttgggccagtgcacagaggayggtggcttcctgcctttggcttcccagctgagagctgttggaacgccccaaaataagccctgcagaacgtgcagcttcctttgctctccctgggtatttttgtaaaacattctttcccaccaagaatgaggaacgttcagagtgatgctgactttatgggctgtatttaacatgttgttttttcatggtgttgtctgttcatgcagagatttctgtctcctgtaaactccctggtaaggaatcttcaatctccatgtgagatgggtctggaaggctcagtgggagcccagaagagctggg

SEQ ID NO: 87491 - DNA, 601 bp, Human
ggattactgggtcatttaaaagatgaaaacaatttggcacaaaaagatgtaatgacttgcctggggaatacagctcaattttcaacagagaaagaaaaaattgttgacaaatccagatttagatcactttaccaggaagatggggcagtttttatactaccctttcaacatggtggcttttaggggcggggtgggggggatttattctaaacatgttagcctgcgtgtaggaatcacacgtcctcatatttaatctcacaacttgattgttctcacaagaacctagctgtatacatattaycgtttccattttacaaatgaagaaactgcacccttgataaaaggaagtaagttgctcaaaattccatagttaataagtgtagaatccaagggtcaagcacagttccttttattctttgactctatcctgttccccatgctgtgtttaccaattgagggtacctgtgctctagccggggcccggaatttaatatttaatgagtcacggaggctcttaagatgatggtcaggctctatgaaataggtgtagattttcttacctctgaagtcatagccagggaacaatgtctttctgtatatt

SEQ ID NO: 87492 - DNA, 601 bp, Human
ccttttcaggtttgtttcccacataccagtagatgtctgcttagtgccagggttctgagctttttatttcacttaagaatataatagcaaggtagaattcaggaaagatttacttgctgttaatgtgaacttttaaaaaaatagtttgaaatgtaggctttgtttttatcccaaagctccatgaaatatgaaaatagcaggagttttaaaggtatatttccacctctagaggaagaactgtccatattatagttgtaattataaattaataaagcctgtgtcatgaaacttgattttgaaygcctgtgttcaaatcctggctttaccacttactagcctagagatattggatgagtgtctaacttctccgttcctcagtttcttcagtgttcaattgggaaatttttcttatggttgatggaaagtttaaataaggtcttggatatgaaactgggattttattagtgtgtgtgtttcaaaatgtggatttggaggccatttaaaaatagcatttccaaaaagtttgcttttaaagcaaagtacttagatatataaatttttatgaattttttttcaaatgataaaataaatgagtttacag

SEQ ID NO: 87493 - DNA, 601 bp, Human
aactgtactcattcatcagcctttacttattttcttctcttttggagagatacttgccattgcccataatgtttgaggtcaggagtatatttgaagagggctttatattttcttaaaaaaaatacaggtggaaaatcaagtttatcagctatttcataccatcttcttctgccatttatgggcaacatgtggaagaggtggcagggagctgggagtttggaataatgtgtctcatcttgaatttgtcgctgaccagggaaaatactcaaggccaactccatcattcccttttgggaattcrgtgcttcagctgtaaagagtgagggcactactaggtgattcctaagatttaaaattctgcatgttttgtggtgtcaaaaccatcaatttctggtgagctgcgtgatcctgcagctgtttctctgatacttttcaatctttagatttaatctattcaacaatgtataattttttaaagggaagcttttatagatacttctgaactataaccgggtgggggggataaatggatgttaaaaaatagaaaacaaccaattaaatagtatatagcatgtaattctccttggaaacttaccacgaa

SEQ ID NO: 87494 - DNA, 601 bp, Human
aagtcctggtttggctctaggtgtgactcatgtgaccaagcacaagtccctctgcccagtgtgttttgttgtcctttgtcaaagcaagcagtcacttgatccagtggatcaagtggctcctgaagaggtcacctccttacccaggccaccgggttctcttgtcagttggaaaagttgaggtgggtcatttaaaaaatccctcccaactttgaacttggaattgttttgtacacaaaacaattgtatgattggctaggtaatgtttacagtgacaacaatgaaatgggcatggtagtttctygtatgtggatttctcctgcatacatgaaagacaagttttataacagcccttgccttgggatacttgtctgttggcatacatactgtgtaatcattagcaaaacaataatagttgctaatgaaataaaacctgtaataagggctgtattaggctattctagcattgccataaagaaatagctgaggctcggtaatctataagaaagaaggtgtaattgggtcatggttctgcagtctgtataagcatggcactggcatctgcttggcttctgggaagacctcagggagcttttactcatgg

SEQ ID NO: 87495 - DNA, 601 bp, Human
ggctcctgaagaggtcacctccttacccaggccaccgggttctcttgtcagttggaaaagttgaggtgggtcatttaaaaaatccctcccaactttgaacttggaattgttttgtacacaaaacaattgtatgattggctaggtaatgtttacagtgacaacaatgaaatgggcatggtagtttctcgtatgtggatttctcctgcatacatgaaagacaagttttataacagcccttgccttgggatacttgtctgttggcatacatactgtgtaatcattagcaaaacaataatagttkctaatgaaataaaacctgtaataagggctgtattaggctattctagcattgccataaagaaatagctgaggctcggtaatctataagaaagaaggtgtaattgggtcatggttctgcagtctgtataagcatggcactggcatctgcttggcttctgggaagacctcagggagcttttactcatggctgaaggcaaaggaggagcaggtgtctcagatggcaaaagcaggagcaagagagggagtaggcagaggagttgccacacacttttaaatgaccagatatcatgagaacacactc

SEQ ID NO: 87496 - DNA, 601 bp, Human
cccttgtgcaaagtgctgcttcttttgtgatctcatttcattttatgtatttatttttttgagatggagtcttgctctgttgcccattctggggtgcagtggtgccatcttggctcactgcaacctccacctcccaggttcaagcgattctcctgcctcagcctcccgagcagctgggactacaggcacataccaccatgcctggctaatttttgtattttcagtagagatggggtttcaccatgatggccaggctggtcttgaactcctgacctcaggtaatccacccgcctcagcctcscaaattgctgggattataggtgtgagccactgcgcccagcctcattttatttctataacaaccctttggggcagagcaggctaaatttgcttaggcaaagggtgtgagcctttgttttaaagggcctgccagagctccaccaggatgtgaggtgcaaatcctgttatgtgctcagaaaggagaattgtgaccaggtaaggtaaactttcccttgtgttttggtgtacctctgtacttaatgggtagagtagaacattatgttctaaaaaatcggggtggtaaaaagaatcaacagtgtgg

SEQ ID NO: 87497 - DNA, 601 bp, Human
ttcttaatcagtgtatcttaaaagtacaactgactgtgtgcctattgatctatattacataaaaggctggaaaccactggtttgatgcttaaaccttagtgtctgttaaaatttcaaacatgatctggaatatattccccctagcatacgtttaagtatcaaatgaaaaatctttgtcacctcctctatgtcttgagttttttcagtgtttataattaaactgtgataagtatgaagctttgcacttggacttaaaaaaatcaagtgtgtaatgatagaaagggagagatttccttaacargagcagactggaagagacttttatttatttattttatttttattttttatttatttattattatttatactttaagttttagggtacctgtgcacaatgtgcaggttagttacatatgtatacatgtgccatgctggtgtgctgcacccactaactcgtcatctagcattaggtatatctcctaatgctatccctcccccctccccccaccccacaacagtccccaaagtgtgatgttccccttcctgtgtccatgtgttctcattgttcagttcccacctatgagcagactggaagagt

SEQ ID NO: 87498 - DNA, 601 bp, Human
tgttaggagagggagagaggactggaagctccgtgggcaaccacaggccttctgcagacctctttagcccccctgtcagagaccctctagagagccgggctttagttcctgcctcaccttctgaaaaggcatcagccagctgcactgtctacacgaggatgctgagaggaccaggaatgatggccaaccaagaagtgttacgggaatgagaccatggattctgctgcaagattctgggacacacgtgctcatggccatcaagaacatagaacctgggcaggacagggacagcattgcttgktcatgtgtgtgtctccagagtctgctggggtctctggcatgggataggtgctgcatgaattttcatggatagaataaatctgaaggaagtgagggtccctttcccaaagggtgttctatcgggcattggctgactctctgttagggagtataggaattgtagcacagatgaagccagactacgtgatttaatgagaatgaaacaaatgactggacaagctgggcatcgtggctcacatctgtaatccctgtgctttgggaggccatggcaggaagatcgattgaggccaggattttgaga

SEQ ID NO: 87499 - DNA, 601 bp, Human
ggctgtctataattcctcagtcaggtgctttctgggcatgtgtgagcatttgctcagctagcttttattgcttgtatgttatttgcttcaaaaattacaagaggatttgtcgggtctgagcagtgacctatccagtcccctgaaactctatggttcttcgtgtaacccagggatgtcttgtaggaggtatgtttgctgtccacgaaagtaaaaagtagtgatatctctttctctcttttgcttccttcctcctaattccacattctcctatttcttggcttctggcacagtggagatacckctactctacattaggcatggccttaggggatccgaattctcaggtcttcctcaatgagttgctgtgtggtagacagcatctgaagtttgaatgggtagagagacctttgtagattgtggccaaatatttacacctggttcatagagtatgtgtttgctgccctgatctcagtgttggtctgggtgttagtgaacctcatgatctttaggaaactatgtgaattaggcttagtccctgaccctgagaagcttatagttagggaaaaagacaaacatataaaggagaaatacacattagaaa

SEQ ID NO: 87500 - DNA, 601 bp, Human
tacaagaggatttgtcgggtctgagcagtgacctatccagtcccctgaaactctatggttcttcgtgtaacccagggatgtcttgtaggaggtatgtttgctgtccacgaaagtaaaaagtagtgatatctctttctctcttttgcttccttcctcctaattccacattctcctatttcttggcttctggcacagtggagatacctctactctacattaggcatggccttaggggatccgaattctcaggtcttcctcaatgagttgctgtgtggtagacagcatctgaagtttgaatggrtagagagacctttgtagattgtggccaaatatttacacctggttcatagagtatgtgtttgctgccctgatctcagtgttggtctgggtgttagtgaacctcatgatctttaggaaactatgtgaattaggcttagtccctgaccctgagaagcttatagttagggaaaaagacaaacatataaaggagaaatacacattagaaacatattcttttttttttttgagatggagtctcattccgttgccaggccagagtgcggtggtgcgatcttggctcactgcaacctccgcctccagg

SEQ ID NO: 87501 - DNA, 601 bp, Human
aaacatataaaggagaaatacacattagaaacatattcttttttttttttgagatggagtctcattccgttgccaggccagagtgcggtggtgcgatcttggctcactgcaacctccgcctccaggattcaagagattctcttgcctcagctgcccgagtagctgggactacaggtgcgtgccgccacgcccagctaatttttgtatttttagtagagacggggtttcaccacattggccagaatggtcttgatctcctgacctcatgatccatccaccttggccctccaaagtgctgggtttacaagaaacatattatttatggtacacatttattaatcaccagatatgtttcaggccttacgctgagtgcttgggaaattgagataaattatagtctcagatctcatggggcgtggatgaagagttgggagaaagaaaaaaataggccaggcgtagtggcttatacctgtaatcccagcactttgggaggctgaggcaggcagatcacctgaggtcgggagttcaagaccagactgaccaaaatggagaagcctcatctctactagaaatacaaaattagccgggcatgcctctaatc

SEQ ID NO: 87502 - DNA, 601 bp, Human
gggaggctgaggcaggcagatcacctgaggtcgggagttcaagaccagactgaccaaaatggagaagcctcatctctactagaaatacaaaattagccgggcatgcctctaatcccagctactcgggaggctgaggcaggagaattgcttgaacccaggaggcggaggttgcggtgagccgagatcgcaccattgcactccagcctgggcaacaacagcaaaactctgtctcaaaaaaaaaaaaaaagaaaaaaagcattgattaatattatctcacagtttctgaaatttgggagcagcktggatgggtgccacaagatctctcaccacatcgcagtccaggtgttgctggacctgcagtctcaccggaaggctgaactccggggaagatctacttgctaccaagcacatcgcatgatggttggcaggatttgtttccccacagattattggactgaggacttcagtttcttgccgtgtagggctctctatagggcagctcacatggcagctgccttccctcaaaatgagtgagcaagagagagtccctgagaggcaaatcacagtctttttataagttaatcctggaggtgacacactg

SEQ ID NO: 87503 - DNA, 601 bp, Human
cctcatctctactagaaatacaaaattagccgggcatgcctctaatcccagctactcgggaggctgaggcaggagaattgcttgaacccaggaggcggaggttgcggtgagccgagatcgcaccattgcactccagcctgggcaacaacagcaaaactctgtctcaaaaaaaaaaaaaaagaaaaaaagcattgattaatattatctcacagtttctgaaatttgggagcagcgtggatgggtgccacaagatctctcaccacatcgcagtccaggtgttgctggacctgcagtctcaccrgaaggctgaactccggggaagatctacttgctaccaagcacatcgcatgatggttggcaggatttgtttccccacagattattggactgaggacttcagtttcttgccgtgtagggctctctatagggcagctcacatggcagctgccttccctcaaaatgagtgagcaagagagagtccctgagaggcaaatcacagtctttttataagttaatcctggaggtgacacactgttccctctgcctcattctctttacgagaagcgagtcactaggtccaggccacactgaaggggagggg

SEQ ID NO: 87504 - DNA, 601 bp, Human
gtgttgctggacctgcagtctcaccggaaggctgaactccggggaagatctacttgctaccaagcacatcgcatgatggttggcaggatttgtttccccacagattattggactgaggacttcagtttcttgccgtgtagggctctctatagggcagctcacatggcagctgccttccctcaaaatgagtgagcaagagagagtccctgagaggcaaatcacagtctttttataagttaatcctggaggtgacacactgttccctctgcctcattctctttacgagaagcgagtcactagrtccaggccacactgaaggggaggggtgaatatgagcacaaggttattaataccaggaggtggagttacacggaaccatcttaggggctgcttaccacagattccccaggtttacatggatgtgctaaggtggaagtggacgttgcctgaagcagttgaataaacccagcacacctctgtggatcaattttacttgaagacatttttgggggaaaactccatttaaaactcttaagagaagcactggtacataatagcacaggatgtaaagttggcatggcttttaagaagaaaaacacaa

SEQ ID NO: 87505 - DNA, 601 bp, Human
agaaaaacacaagttttcaattcatgccgtgttcccttacctctgtatttttgccctcctcagcggtagagcttttttggtagaaatgtcgaaaggttcttgcttgagccccttgctgtatgcgtgagacaccgagacttggaaagggcacatactcttccagggccacagagccagcggtagtcaagggaggaaccatctgcagctcctctctgtgccccgccttccaccgctccacacagtctctgctgcataatgagtctgtgcaacttttaggatgttttctcttcttttctcaaactctctcctgtcccagaaacagattaggaaaaataggtcaaaaattggaatcttgagctttgattttgtccctttagttaaatttcaggggtctgcgtctcctggtgggccatgttgtgtcctgaaaagttgcataaatcaatattacacggctcagacagtgtatctctgcagttatgaataacatttgttttaggaacagagagctgatatacaacgttactttgagactgacaagaccagacataaaacctcagccaataccctctgtctggcagggagtttcttttccagagcatcc

SEQ ID NO: 87506 - DNA, 601 bp, Human
ccagaaacagattaggaaaaataggtcaaaaattggaatcttgagctttgattttgtccctttagttaaatttcaggggtctgcgtctcctggtgggccatgttgtgtcctgaaaagttgcataaatcaatattacacggctcagacagtgtatctctgcagttatgaataacatttgttttaggaacagagagctgatatacaacgttactttgagactgacaagaccagacataaaacctcagccaataccctctgtctggcagggagtttcttttccagagcatccttctcttccccygaccaaagcagtccttttcaaaatcaagctccgcagtttattttatagaagatgacaggttcccttagagtccacattcacataactagaaaaattaatggaaattggagccttaaaattatggtcaagcttattagtgactttacagccaaaatgaggaacgcacagctttggtcactgagaatgtggctggccagaacgtgaattctactacctgctccatagtccctttcaactctcagcaattttttttaatactcatcttattcttttttttttgagatggagtctcactgttgc

SEQ ID NO: 87507 - DNA, 601 bp, Human
catccttctcttcccccgaccaaagcagtccttttcaaaatcaagctccgcagtttattttatagaagatgacaggttcccttagagtccacattcacataactagaaaaattaatggaaattggagccttaaaattatggtcaagcttattagtgactttacagccaaaatgaggaacgcacagctttggtcactgagaatgtggctggccagaacgtgaattctactacctgctccatagtccctttcaactctcagcaattttttttaatactcatcttattcttttttttttgagayggagtctcactgttgcccaggatggagtgcaatggtacagctcactgcagcctctgcctccaaggttcaagcgattctcctgccttagcctcccaagtggctgggattacagatgcatgccatcacacccggctatttttttttttttttttttttttgtatttttagtagaggaggtttcaccatgttggttaggctggtcttgaactcttgacctcaagtgatccaccctccttggcctccaaaagtgctgggattacaggtgtgagctgccatgcctggctaactctgcttgttatt

SEQ ID NO: 87508 - DNA, 601 bp, Human
gcatgccatcacacccggctatttttttttttttttttttttttgtatttttagtagaggaggtttcaccatgttggttaggctggtcttgaactcttgacctcaagtgatccaccctccttggcctccaaaagtgctgggattacaggtgtgagctgccatgcctggctaactctgcttgttattaaagtgtttcttaccaattatttcatttttattaaaagtacatagtaggaaatagagttttagttggacaaggacaacatggtaaagaggaatttggagtaggaagactgtcacrttagtcactgaatcctacctagttcacttagttttttttagcctgttttcacttctgcaagccatggagtgaagagtgcctacttcagagtctttggtgctctcaaagcagcgtaatgtctataaagtacctattgagtgtggtacttcttatgtagttggcacacattaaatgttaagtttctgatcaccttaagagtccataactctttgctggagatcacccttagttcttttctttgttaggccattatctcatgtcctgtttacactgtccccttggattggcctagacctgcag

SEQ ID NO: 87509 - DNA, 601 bp, Human
gctattcacagactgtcagagttagggaggagaaatgacttagaggaatggggtaaggggttttgatagttcccggtctgctcctaatagtgagacccgggcagtcagtcatggctcatctttgtggttcagtttttctcagctgaggaatgagtggtttggattttatttcacatggccaaatgatgtgttggtagtggttccttgaggtgctgtgctgagaaggactctgaggctgcatcctgactcagctaatgatcacttaggaatatcgccatgggagtggagagtgaaagcataygagaggtatctgagctgcttttggactaggtgatttaaatgtctctttttgttctaccttctggatgctttgatttactgacttgtgaagtgtcttgcccaagatcacgtagcccattaagttttagaagctgattctctgacacagagatggttaaaagctacacatttgactctcacattcatacacgtaggctggctgtgggagatgaaaagctagaataagaagttctagaagatccatgacttattgaaaacacaagactactcaaactctgtatgtctttgagggtgagtgagg

SEQ ID NO: 87510 - DNA, 601 bp, Human
gcaaataacctgacctgaagcatgctggggacatgccggaaaagtgaagaggacagtgtggctagagtgaagtgtgtaaaagtggtcatgcatgccaaataaaaatagttgcaacaaccagtaagacatacatgagagatattgtgggttcagttgcagaccaccaccgcaataaaacaaatattgcagtgaagcgagtcacacaaaattcttggttcccagtgcatatgaaatttatgtttacactatactgtagtctcttaagtgtgaaatagcattatgtctaaaaatacagtatacmtaccttaattaaaacttttattgctaaaatatgctagcaattatctgaactttcagtgagtcctgcttttgctgatggagggtcttgccatgatgctaatgactactgactgatcagagtggtggttggtgaaagttggggtggctgtggcaatttctgaaagtgagacaacaataaagtttgccacattgattgactctgcagagaaagagtgatatcaagctgtatcacttctctgtagcatgtgataatgcataatatcattttaccttcaagaaaacttctttcaaaattggagtc

SEQ ID NO: 87511 - DNA, 601 bp, Human
gtaacagtgggcttaaaatattctgtaaaccatgctggaaacagagtgctttcatccaggctttgtcattccatttatagagcacaggcagagtagattcagcataattcttaaggaccctaagattttcagaatggtaaatgagcatttgcttcaacttaaagtcaccagccacattagcctctaacaagagagttaccctgtcctttgaagctttgaagccaggtattgatttcttttctctacttctgaaagtcctggatggcatcttctttcaatataagcctgtttcatctacaakgaaaatctgttgtttagtatttaccttcgtcagtgatcttagcttgatcttctggataacttgctgcagcttctccatcagcacttactgcttttccttgcacttttatgttatggagacctagtttttccttaaacctcaggaaccaatctctgctagcttcagatttttcttctgtagtttcctcacttctttttgccttcatagaattgaacagagttagggccttgctctggattaggctttgacttaaagggaattttgtggctggtttgatcttctatccagatcactccaact

SEQ ID NO: 87512 - DNA, 601 bp, Human
tgcacatcttggctgtttggcacaagaggcctagcttttggcctctcttggcttttgacatgccttcctcactaaacttaaccatttctagcttttgattaaagtgagagatgtgctactcttcctttcacttgaacacttcgaaaccattgtagggttattaattggcctaatttcagtattagtgtgggagatgggagggtccaaggagagacgtgggaatggctggtcagtggagcagtcagaacacacctatttattgatcaagtttgccatctcatatggccatgatttgtgataccccaaaataattatgatagtcacatcgaatatcactgatcacagatcaccataatacatataataataatgaaaaagtttgaaacattgtgatagttaccaaaaggtgacacagagccatgaaatgagcacatgctgttggaaaaattgtacctaaagacttgcttgatacacagctgcctccacaaatcttctatttgtaaaaaacacagtatttgccaactacaataaagtgaagtgcaataaaacaagatatgcctttattagttaagtacacattgaagatgctcaggaaaaaata

SEQ ID NO: 87513 - DNA, 601 bp, Human
gtggtgtgcagctttgaacaagtccagttgccgtggggtttccctccatggcagagggctctccactccgtttctctgcccctgcggcaggcacacctgcagggatgcctgggccctgggtgcagatgggcaatcgtaagcctaatcacccattcaggcacacacttacttgttttccacatgcaaatatggcctttttgcggatgaatttaatacagttgttgcttcctcattttatttaaaacaaaacaaatggccaaccatgtcagttgagggtagcaaatagaaacatgagtattayggtctttgctgtttgtgtcgattacacggctgaaaggaatcccaggcaaatcagtcttttctgtgctcaattttatttttactttatatcaccttttcttactatcgctattggttttaacaaaatttttaaagagggctatcacattcctttctcttaatcattttatcaatatttcaggctccttagttctattttgtggtttctacctttgacatttttagtttctgaacttggggcccattgttcaaagaaaggcattatggagtctccaaaagccattggcaggtggtgtctgtg

SEQ ID NO: 87514 - DNA, 601 bp, Human
cctttctcttaatcattttatcaatatttcaggctccttagttctattttgtggtttctacctttgacatttttagtttctgaacttggggcccattgttcaaagaaaggcattatggagtctccaaaagccattggcaggtggtgtctgtgacttccttagcctggaaataaacaaataaacaagcacaaattagaagtctttgccctattactgcactattagtattgattgcgcaacatcatgcaaaaagtcactttaatttatctggcaggtcctatgtaaacaccaatacagtcawgagggcttggatgggtatttgctttcatttctaatgaaatttcaggcctctagggtaggatatcaaaattggtagatcatttgcaatttattttatcccaaacacctcactttacagtcagagaaactgaggcccagagaagtaaaatgagttgctcaaggtctcagagagcaagaaatagagatgggacttgagcacctagatctctggtattgctgtcctgtagttcatggagctggcagatggatacatctgtgacctgggatgatggagagactgctggacccttcagaggatctc

SEQ ID NO: 87515 - DNA, 601 bp, Human
gaatttctgagttggaaggaagtcttatacgtactgaatttgactgctttattttgtagggaaggaaactgatgtgcctagagtagttgagagctttattcaaactcattccactgttattgagtagttaggatattagaccagcaacatatttgggtagaaactttcatataaaaaagcgtaatcataactatccaatcatgtcaactagtaaggctgctcaggtgggataacacatcaaccttctttgggattcttccctcagacatggttttggtgggaggagcatggcaagggaggrgcgagctccaaatgcagggctgctctgtcctcggcgacctgagcagacacacgagcagagatcagagacactcttagtgaatgaacctccctattggctatattaaagtaatgctctgaaaaagttccgtgtggagagcaaggccagttagggaacattttgtggatcttttatatgtccttaactatatgattcttttatttttaaatgaaaaatgttaagatgttacggggtatgtatgcatagtctaaagtgatgattttagaggtagcaagacagtgagaatgtccctacatgtga

SEQ ID NO: 87516 - DNA, 601 bp, Human
atgtatgcatagtctaaagtgatgattttagaggtagcaagacagtgagaatgtccctacatgtgaaatgggcacagttttatcagggaagtgtcaatagagggttaatgttccacgtagtggctgcaagaatgataagtggtcatggggatagcctgacactctaggagcagaaggtggtgggtatggatagaactactgatatagcatgaatccaacctgctgttatctgcgcaggcctctctgcagctgtttgccctgaagtacatgctgtacgtttctccagctgatcctgcatgastgggtataaacgcctgtccgctgtgtgctggacagccccagacaccctcggcagcctgctgtgtttgtgtgagacatgctgtgttagggatttaagcatctccctactcgttcctcatctttttctcttctcttccttctaatctcctttcatctttccctttgggggagaaaaagtcatcagagttgtttgaaggttcatttatgttgatttgtttttattttgaagctaatttgtttcctgcttgtatctgtaactgatgtacttcatgtgagaccgtgttataatatacttgagttc

SEQ ID NO: 87517 - DNA, 601 bp, Human
gttcactctgacactaatctgagttcaggtccacatctttttttttaattaattattttatttttaaaatttttatttttttgagacagagtctcgctctgtcgcgcaggctggagagtagaggcacaatctctgctcaccacaacctccacttcccgggttcaagcgattctcctgcctcagcctcctgagtagcttacaggtgcccgtcaccacgcccggctaatttttgtatttttagtagaggtggggtttcaccgtgttgtgcaggctggtctcgaactcctggccttaagatatytgcctgcctcggcctgccaaagttctgggattatagaagtgagccactgcgcccagcgcacatacaattgtaggaaggctgagaatggcttttaatttgggagcgtttaaaagcaaacatgcttcctcaagacaacagtaacaaaaaattgacatcgttgaggtgggaacttctttaatgctacctgagcctcttgctgaaatggttctatgcagttttgcatagctaggagtggtaagctcattcacagacatggaagaggcagagtgggcttagggagaggcaccagtctagtggtcc

SEQ ID NO: 87518 - DNA, 601 bp, Human
tcaggtccacatctttttttttaattaattattttatttttaaaatttttatttttttgagacagagtctcgctctgtcgcgcaggctggagagtagaggcacaatctctgctcaccacaacctccacttcccgggttcaagcgattctcctgcctcagcctcctgagtagcttacaggtgcccgtcaccacgcccggctaatttttgtatttttagtagaggtggggtttcaccgtgttgtgcaggctggtctcgaactcctggccttaagatatctgcctgcctcggcctgccaaagtkctgggattatagaagtgagccactgcgcccagcgcacatacaattgtaggaaggctgagaatggcttttaatttgggagcgtttaaaagcaaacatgcttcctcaagacaacagtaacaaaaaattgacatcgttgaggtgggaacttctttaatgctacctgagcctcttgctgaaatggttctatgcagttttgcatagctaggagtggtaagctcattcacagacatggaagaggcagagtgggcttagggagaggcaccagtctagtggtccaacttgggttctgggttccagtcc

SEQ ID NO: 87519 - DNA, 601 bp, Human
tctggttcatggtagattttcaatgaatctgagtgaatgaatgatggatgaatgattttgtatctccttactaggcatatgttccttgagggcatggaccgtgtctaatgggtggctacctagtgtctcattcttggtccgttgttagtggtgatttttgtcctcttctttgcactcatcattctaggcttgtattagggtaaattgttagcataattctgccttgtttcccaccctgcccccgccttttttttcttttgaaacagagtcttgctctgtcacccaggctggagtgcagtgrcacaatcttggctcactgcaacctctgcctcccgggttcaagcaattctcctgcctcagcctcccaagtagctgggattacaggcacccgccactacgcctgactaatttttgtatttttcatagagacagggtttcatcatgttggtcatgctggtctcgaacttctgacctcgtgatctgcctgcctcggcctcccaaagtgctgggattacaggcttgtttgcttttaaacagtttgtgggcagggatggtattttcttatgattctattcctcacagatcctggcccagagccatt

SEQ ID NO: 87520 - DNA, 601 bp, Human
gcctcagcctcccaagtagctgggattacaggcacccgccactacgcctgactaatttttgtatttttcatagagacagggtttcatcatgttggtcatgctggtctcgaacttctgacctcgtgatctgcctgcctcggcctcccaaagtgctgggattacaggcttgtttgcttttaaacagtttgtgggcagggatggtattttcttatgattctattcctcacagatcctggcccagagccattagcagagaaaattctcagtagatgtttgctgacctaaacttcattccaccacstttgccttccttttgccttttcacctcctcttagaaggtaccttatatgataatgtcacctatgcaataaagaccacaaagtaaatttaataaaatagaaggcatgcttccctcttttctaaccccacacttttttttttttaagatcaaaataacgttgcatttgtgtgtgccctgcttttatttatttatttcttttgtagacacgaggtctcactatgttgcccaggctctctccaactactgagctcggtgatcctcccacctcggccttccaaagtgctaagattataggtgtga

SEQ ID NO: 87521 - DNA, 601 bp, Human
agaaggcatgcttccctcttttctaaccccacacttttttttttttaagatcaaaataacgttgcatttgtgtgtgccctgcttttatttatttatttcttttgtagacacgaggtctcactatgttgcccaggctctctccaactactgagctcggtgatcctcccacctcggccttccaaagtgctaagattataggtgtgagacaccacacccagcccagccctgctttcacaaaaaacaaaataatgatgaatatattgtactaccctcactgttttcatttgtctgtgaatgcttyttattttatcaggaaaaggaaaaatttctgtttcttgactgtaattgttgaaatgtattttcaaagttttttactttatttttggactgataccataaaatcgtgtgaaatgatgtgaggattttctaatggagaaatgacttagaatatcccttggatgtcctatctgctttttaattgttttatcatcccagacatgtttctctattcctgtctattcttttatctgtaaaatgaggttattgaactagatgctgtctacaactttttttttttctttcattaacattaaatctctgg

SEQ ID NO: 87522 - DNA, 601 bp, Human
gaaaacccatagaatttctgtaattatcagcctcaataactttctaaagcctttaggaagcagataccctgcaatttatctcactaatttgtttgtgattaacactctctgccccttctcatatcccaagctcagtgttttgatatttaattacagggaattctttcctcttcatagatgatatagcaattgtatttcatttctcttatctgaaatctctgctgactttccatgtcttatgaatttaaatagtctaaatagggcatgagatcttaaatattccttccagtttctacatttkctattcagcaacaacattttccctggaaaagggtgaaagcctgtgagtcccccacagggcaggagcactgaatacacccacattttcctaccatctgacatagatgagacacaaagtagggactcagatgattatttaactgaatcaactggattccttaattctcacaatattatccttcctactttgtaaatagggaaatggaggcttagtcacacaaaatatcttgttcgaagttactaatcaattaagtaacttaataatttattgacatctgaggcatttctctctttctacagc

SEQ ID NO: 87523 - DNA, 601 bp, Human
tatcagcctcaataactttctaaagcctttaggaagcagataccctgcaatttatctcactaatttgtttgtgattaacactctctgccccttctcatatcccaagctcagtgttttgatatttaattacagggaattctttcctcttcatagatgatatagcaattgtatttcatttctcttatctgaaatctctgctgactttccatgtcttatgaatttaaatagtctaaatagggcatgagatcttaaatattccttccagtttctacattttctattcagcaacaacattttcccyggaaaagggtgaaagcctgtgagtcccccacagggcaggagcactgaatacacccacattttcctaccatctgacatagatgagacacaaagtagggactcagatgattatttaactgaatcaactggattccttaattctcacaatattatccttcctactttgtaaatagggaaatggaggcttagtcacacaaaatatcttgttcgaagttactaatcaattaagtaacttaataatttattgacatctgaggcatttctctctttctacagcctcagaccagaaatgatgggattt

SEQ ID NO: 87524 - DNA, 601 bp, Human
gcaattgtatttcatttctcttatctgaaatctctgctgactttccatgtcttatgaatttaaatagtctaaatagggcatgagatcttaaatattccttccagtttctacattttctattcagcaacaacattttccctggaaaagggtgaaagcctgtgagtcccccacagggcaggagcactgaatacacccacattttcctaccatctgacatagatgagacacaaagtagggactcagatgattatttaactgaatcaactggattccttaattctcacaatattatccttcctamtttgtaaatagggaaatggaggcttagtcacacaaaatatcttgttcgaagttactaatcaattaagtaacttaataatttattgacatctgaggcatttctctctttctacagcctcagaccagaaatgatgggatttcagccttcttttcttagagattggtgagccaagacctggagagagaactctggttgtcttaagtcacccagatgaactattaatagaaaaagaattctactcagtcagtacttaaaagcttgacatgtttgtgtggagacctgtgtgtgactgagttcaga

SEQ ID NO: 87525 - DNA, 601 bp, Human
gtagggactcagatgattatttaactgaatcaactggattccttaattctcacaatattatccttcctactttgtaaatagggaaatggaggcttagtcacacaaaatatcttgttcgaagttactaatcaattaagtaacttaataatttattgacatctgaggcatttctctctttctacagcctcagaccagaaatgatgggatttcagccttcttttcttagagattggtgagccaagacctggagagagaactctggttgtcttaagtcacccagatgaactattaatagaaaaakaattctactcagtcagtacttaaaagcttgacatgtttgtgtggagacctgtgtgtgactgagttcagatcactctaatttcctgggcctcacttgacccatctgtgaaatggggcaatgagctcttttcggcatgaaggcaaggaactgtccagaagacctctggagaattcttcttaccctgagatcaagggttctgtgagtagtacaactcacacccaaagtcttagttgcagggcactttagtgggaaaaaaaaaaaaacgctgaggctatttttagagccttcatctggttatag

SEQ ID NO: 87526 - DNA, 601 bp, Human
cgaagttactaatcaattaagtaacttaataatttattgacatctgaggcatttctctctttctacagcctcagaccagaaatgatgggatttcagccttcttttcttagagattggtgagccaagacctggagagagaactctggttgtcttaagtcacccagatgaactattaatagaaaaagaattctactcagtcagtacttaaaagcttgacatgtttgtgtggagacctgtgtgtgactgagttcagatcactctaatttcctgggcctcacttgacccatctgtgaaatggggyaatgagctcttttcggcatgaaggcaaggaactgtccagaagacctctggagaattcttcttaccctgagatcaagggttctgtgagtagtacaactcacacccaaagtcttagttgcagggcactttagtgggaaaaaaaaaaaaacgctgaggctatttttagagccttcatctggttatagactagttggtaggagagcaatacctttgaaaagttaagaaatagttttatacactgtgttaaggatgttgtcaaaactaatactcgtgtatgcaaagactttaacatttattaata

SEQ ID NO: 87527 - DNA, 601 bp, Human
gggcctcacttgacccatctgtgaaatggggcaatgagctcttttcggcatgaaggcaaggaactgtccagaagacctctggagaattcttcttaccctgagatcaagggttctgtgagtagtacaactcacacccaaagtcttagttgcagggcactttagtgggaaaaaaaaaaaaacgctgaggctatttttagagccttcatctggttatagactagttggtaggagagcaatacctttgaaaagttaagaaatagttttatacactgtgttaaggatgttgtcaaaactaatactygtgtatgcaaagactttaacatttattaataattttttctatagattggtgaaattggtttgtaatttttgtcatttcacttttgtggaaattgagcaaaggtgagagataaaatgatgtgatcaggctgggtgcgttggctcatgcctgtaatcccagcattttgggaggccaaggtgggcgcctgaggtctggagttcaagaccagcctggtcaacatggtgaaaccctgtttctactaaaaatacaaaaattagctgggcatggtggcacatgcctgtaatcctagctacttgggag

SEQ ID NO: 87528 - DNA, 601 bp, Human
gatcaagggttctgtgagtagtacaactcacacccaaagtcttagttgcagggcactttagtgggaaaaaaaaaaaaacgctgaggctatttttagagccttcatctggttatagactagttggtaggagagcaatacctttgaaaagttaagaaatagttttatacactgtgttaaggatgttgtcaaaactaatactcgtgtatgcaaagactttaacatttattaataattttttctatagattggtgaaattggtttgtaatttttgtcatttcacttttgtggaaattgagcaaargtgagagataaaatgatgtgatcaggctgggtgcgttggctcatgcctgtaatcccagcattttgggaggccaaggtgggcgcctgaggtctggagttcaagaccagcctggtcaacatggtgaaaccctgtttctactaaaaatacaaaaattagctgggcatggtggcacatgcctgtaatcctagctacttgggaggctgaagcaggagaatcgcttgaacttgggaggtggaggttgcagtgagacgagattgcgccattgcactccaggctgggcgacagagtgagactccatct

SEQ ID NO: 87529 - DNA, 601 bp, Human
aacctttatatctttgttttttccctttccaaacttatccaagaaggagacttcaaggcctgattcattaatttttccttctgctgggaactcaggtgtgtggtggaaggcagcacatgtgacctaatctatattttgacaaagaagaaagctccctgccctcccttgcaccagttcgtttggtaatttttaatcccaaaagccactgctaatacgtttttaaaaattgatgctagctattacgttgttagataaagctcatcttccaactctaaacttgctctttctaaaagtgaaatarcactcaggttgcaaacatagtgaactggaatttcagaggcttgaactgacctacaaaacttgtaactgtagctctagttatacatccactgtggtcttggacatgtgaggtgtttgtctaccctcaggagttttagaagaagaaattttatggaattgctttccatattaagaaattaaaatagccaggtgctattttaattttacagattcacaactgtaatcccagcacttgggaggccgagcagggaggatagcttgagtccaggagtttgagtggagtggtcaacacagccgagac

SEQ ID NO: 87530 - DNA, 601 bp, Human
acaaaacttgtaactgtagctctagttatacatccactgtggtcttggacatgtgaggtgtttgtctaccctcaggagttttagaagaagaaattttatggaattgctttccatattaagaaattaaaatagccaggtgctattttaattttacagattcacaactgtaatcccagcacttgggaggccgagcagggaggatagcttgagtccaggagtttgagtggagtggtcaacacagccgagaccccacatctacaaaaaatttaaacattagctggcatggtgactcatgcctatmgtctcagctactcaggaggctgaggtgggaggatcgattgggcctgggacatcaaggctgccgtgagctgagattctgccactgggtgactgggcctgggacgtcaaggctgccgtgagctgagattgtgccactgggcgacagagcaagagtgtctcgaaggaaggaaggaaggaaaggaaggagggagagaaagaaagaaaaaaggaaagaaaatatacaaaaatctttgtgtagctctgaaataaatatatatatatgtatgcagtgtatatattatatgaaataaaattgcttgtg

SEQ ID NO: 87531 - DNA, 601 bp, Human
ttccatattaagaaattaaaatagccaggtgctattttaattttacagattcacaactgtaatcccagcacttgggaggccgagcagggaggatagcttgagtccaggagtttgagtggagtggtcaacacagccgagaccccacatctacaaaaaatttaaacattagctggcatggtgactcatgcctatagtctcagctactcaggaggctgaggtgggaggatcgattgggcctgggacatcaaggctgccgtgagctgagattctgccactgggtgactgggcctgggacgtcaaggctgccgtgagctgagattgtgccactgggcgacagagcaagagtgtctcgaaggaaggaaggaaggaaaggaaggagggagagaaagaaagaaaaaaggaaagaaaatatacaaaaatctttgtgtagctctgaaataaatatatatatatgtatgcagtgtatatattatatgaaataaaattgcttgtgcttaatttattttaaaatcatgtttgaaaatagagctaattctcagttactacattttcccctctcctctttctgatggtttttttcttaactttttattgtaaatga

SEQ ID NO: 87532 - DNA, 601 bp, Human
tgaaaatagagctaattctcagttactacattttcccctctcctctttctgatggtttttttcttaactttttattgtaaatgattttaaacttatttaaaaagttgcaaaataagcatagtccaatatagccatatacttttactcagattcgtctattgttaacattttatcccattggatttatcatcctcccccttcctccctcccttcctctctttctctgtctacacacacacacacacacacacacacacacacacacacacagtctcccccaccccatatatatatatatatwttttttttttccagaagtatttcagagtaggtcacttatatcattgcctctacccctaagtacagtgtgtatttcttaataataaaaaaaataaagatagtctcatcatattcacagtatggtaatcagcttctgtacatttgacactgattcaatacttcagtctactgtctgtacttctcctttgtcaggtggctcagttctgtccttgaagaaaactgctttttcccattcagtgtacagtccagcctaaggtcaggtagtgcatttagttgtcaagtctctttagtctcctttgat

SEQ ID NO: 87533 - DNA, 601 bp, Human
ttctgtccttgaagaaaactgctttttcccattcagtgtacagtccagcctaaggtcaggtagtgcatttagttgtcaagtctctttagtctcctttgatttggaacatttccacagcctttctttatcttttatggcattgacacttttgttctccccctttacaattatagtattcctcattttgtattagtcactggtttcttcatgttttgattcaattatgcattccctgaaggaatattacaaagataatgtgtccctctcagggatcacatctggagtcttatgtgtccatctmtccgtcattggggatgttaattttgagcaactgatcaaggcattgtccagtttctccacagtataggtattctttcctttgcaattattaagctatccatggggagacactttattcttgctccttatcaaaatattaccctacattttttcctaaaccagcatttactatgattggtgcaaaattaggattccatgttactactctcttcacattcatcattcagcatcctgcgttctactgtatgcgggagccccttccttctcctccctccctcccgctctctctctctcttttcct

SEQ ID NO: 87534 - DNA, 601 bp, Human
ccccccctgccctcccccccgccctccccccttccctccccttttctttctctctctttctctctctctgtctttttctttctttctctctctctttctctctctctctttctctctattttcctctttctttctttcttttggttatggtcttcaagatttctgtttcaatctttcataattcattcttgctatataattattttggccctcaaattatcccagatttggtcagtgggagctgcatcaagttggctcctgtgtccttgagacatgtccccatcatctttgttgttagcarttgattaattgctggaataaaaagatgttctagtttggtcttgtatattctctgtcccagccatgaagtcaagcatgtcttcattatgtcctcactctttttatgtggagaaagatgttagagaccaatatctgagtgctaggtgtgctcattgctactctggtgccttaacttatagcctctttcaatgactggagctaggaaattttatatataaaaatatatatgtaaacaaaacctacgtgtatatgtttatctgtaaatatatgggtgcatatacaaatatgtatacacaaatac

SEQ ID NO: 87535 - DNA, 601 bp, Human
actctggtgccttaacttatagcctctttcaatgactggagctaggaaattttatatataaaaatatatatgtaaacaaaacctacgtgtatatgtttatctgtaaatatatgggtgcatatacaaatatgtatacacaaatactactactattaatttgctaataccacttactacacaaaacaaatctgtgaaaaagagttgaggatttgcttatggtgctcctccttcaacttaaccctgcccaagactgagggtatattgtcaaacgctcttcagggattacctggattagttcttacttcatgtgtctttcccctatatcccaatggtcattatgttcatttaaaatacagttgggttcaaatgcttcagtttgctttgagttttagtttccctccttcccatcctagtttgtttaattttattttttgaatatgtaaaacattaacatgcttccagaagccaaaactaaaccaaaagaagtgccagtctctcagatatttgctccaccttgttattccccacacctcttggaggttttcttggttatctctctggtatttctttttaatcctgatatatatatatatatatatat

SEQ ID NO: 87536 - DNA, 601 bp, Human
tatatatatacacacacacacacacatatatcagattatagcgtcagattatctgtgctttccctcctctcagtaaaacctgtaatgccccttcttccccaaacatatatatatatatatatatatatatatatatatatgtttttatatttcctcttctttcttacacaaaagatagcatgttgtatatcttcttttgcactctgatttcgtaaattttttttctttttttttgcactccctctcttcttttcttcttctctccctccctccctttcccccttcttccgtttttttttcytctctctctctcctgctcaaccaatttcctatgcttggacagttggatagttttctgcaatgaataacattatgcatatgtatttccatatcattggatatatttttgggatatattcttagaaatgggtatgctgggttaagagtaaatattttatgaggtactttagttaccaaatttttctctgatggaatgtcccactagcattcccaactacagatgtctgtgaagcttatgaattgttgccaatttgatggatgagaagtggtatctcagtatagttttgatttgcacgtgtcc

SEQ ID NO: 87537 - DNA, 601 bp, Human
atggggttttgccatgttggccaggctggtctcaaactcctaacctcaagtgatctgcccaccttggcctcccaaagtgctgtgattacaggcgtgagccactgtgctcagtcctttttttttttttttttaaattgggtttttggtctttttttctcaattagaaaggtcttcggaaattagatatattggcctttcatctatgaagtatattacacatatctctcccaatttgtttatcttttgactttgattacagtgttttattttcttttcagtcatataaaatttttatacttayagagacaaatttaagaatcatttcttttattgcttctggactttgttcgtagttagagagcatttcttaacacccgtgttatctgcatgttatcttccagtacctgtatagtttcatttttcacatttagatctttaattcatctgcagtttgtgtgtaacataatgaatggatctaattttacttttttccaaatggttatctggtgtctcaacaccatttagtatgaaaatatcttctcatacttcccgtgtgatttgagattggtggttactttttaacctacaccatgactaggtg

SEQ ID NO: 87538 - DNA, 601 bp, Human
tctgtggtggaatggggaggaaactggcttgcattaattgatgtataaggtagcccatgataaactcaatgccacttttatacacatctgggagcaagagcttttggttaattggcttgcctatgtttttgctctgccttggatgctacagaaatggaattgtttgttagagtcgttgcatggtgaaggaaaaatcagagccaaggttttgaaggacctaagggagaacattctgtgttctgcaggcatcttcctccttgggacacaaacagctccctgcctaccacacacagtggatagrattccttcaatgcctctcctcgggtgaaagatgtggcatgtggaactgaacgatcaaaatcactggggcaactgtatgggcgccctcctgcagtgtaacatcctaacaggacttttgacaggaatggatacctaaatatttacactcctggaggcctcgtctgtctcaaccatacttaccagtcaccacagtgtctcctttctctgtgtagtactggataaatacagataaattctacaccctgacttactcctacctcatgcaaggaagttataaaatgtttgagtagcttacttaagt

SEQ ID NO: 87539 - DNA, 601 bp, Human
ccctgtcttatgaaaagaagtgttgataagctcattaattagctttctgctcatagcttttttctgactgctaatgacttcttgaggatgggcaggctttgatgagctgtgtggtcctgggaaagccttggtgtcctcttttacctgcacagtgagggtgacggtcgtgttacctcctgaggccacctttcagctttgccattctgtcatttgacaaagactgaatagagaaaagacaagatttaacgacagttaaagtccaagccagtttgtatttgctgaaagacacaactgagggaarggaactgacatgtagtttaaacagactggttttttgttgacatgggaagtgtgaataatacttcttcctggtttatgagatatgaaattggttgtctaccttatctgtttctcacttttgttctcagttcatagtttggtcatggaatgcaattttgaagacaacttcaagttgtttttttgctcagtaatcatagtagtatttactgttgttcactgggcacccagtctgtgtacacacatcattcctaatcttagaagaaaaacaacgtgcaagacatgtgttttctttcccactttg

SEQ ID NO: 87540 - DNA, 601 bp, Human
ttacttaagttcaattagaaagtggcagagccaggattcaaatgttggtttgcctaactgcaaagcctatatccaccttccacccagtgctgctacagcattaaagcctgtaaattgaattccacacactcctactttcacctgtactattacagtgataagtaaaaccagcgctgagccctactaacaaggtgtccttgatttgtgtgctgatgctcatgacacttctgtgtggcatctgctgacaggcccacggggcccagatgttcccactacaaagagctcatcctggactccccarccagggaaagagacctgaaaaggaactggtttgtgattagggattattgtgatacttgaagtgaatggtcagtcagttcttcccatttatttgagttcttacttcccttccctttgaacatttcagtcaaacttctaacagtgactttcaacactggctgcgcattaaaatcacttggggaggttttgttttgttttgttttgagacagcgtctccctctgtcatccaggctggaatgcagtggcatgattatggttcactgtagctgcaaccttctaggctcaatcaaccctcctactt

SEQ ID NO: 87541 - DNA, 601 bp, Human
agctgcaaccttctaggctcaatcaaccctcctacttcagccttgtgagtagctgggaatacagggacacgccactacgcctggctaattcgtatattttgtagagacagggtttcactatgttgcctaggctggtctcgaactcctgggcacaagtgattctcccaccttggcctcccaaagtgctggaatcatggagctttttgtttgtaagcatgtcagccctcaccttccagagatcttgatttgaatgggctaggttggggttctcgctattagcgcaaaaaaaagtaagtactgmagggattctaagattcgtctagagaagacgatcaccgcattagggggcagaaagtccacttttcattattttgttggtacagtatactttttttctgactctatgaaccctcaatcttatgatgttaccattccattgaagggtgggatttattcactgagaacatttatatttttttgagatgtcttaggctgtggagagggtgttacagggatggacacagatgctgaatttagtggccccagagaagaggaattaaccactttggattggattattgggagcaaccaaaagtcagtg

SEQ ID NO: 87542 - DNA, 601 bp, Human
ttcaattcagcagttgtccaaagctaatctcttgagctattggtagctttggtgaacatttggagaggactactgtgatggcgtaaaatccggtgacctagttacagaatatcccctgcaggctcactggtaaggaaggctcatgtttaaactcagtgaaaggagagcctggcttatttatggtggtggttgtttacatgtctttaaatgaccttcttttttttttaatataaaggcaatatattctcatagaaaattcagaaactgtaaacagggttaaagaagaaaataaaaatcaacwctatcactttcacctatttattattcttattttatttatttatttatttatttttaaggcagagtctctttctgtcacccaggcagtggcacgatctcggctgactgcaacccctgcctcccaggttcaagcgattctcctgccttagcctcccaagtagctaggattacaggcatgcaccaccaccaagtccggctaatttttgtatttttggtagagacagggtttcaccatgttggccagactggtcttgaactcttgacctcaagtgatccgcctgccttggcctcacaaagtgct

SEQ ID NO: 87543 - DNA, 601 bp, Human
tactcaggaggctgtcaggagaatcccttgaacccgggaggcggaggttgcagtgagctgagatagtgtcactgcactccagcctgggccacagagcgagactccatgttaaaaaaagaaatgtttctgagcactaaagacaatttgaacaaggcagaaaagtacaaataggaaaacaataatcttactagattgtttgtttttgagacagcatctccctttgtcatccaggctggaatgcagcagcacgattatggctcactgtagctgcgaacttctgggctcaatcaaccctcccacytcagccttctaagtagctgggactattctgtagtgataatccttgttaaagttttggaaaataccttttttagagtctctctttctctctacacagacacacacacacacatacacacatgcaacttttatgtgaatgacggcatttacaatttacgtaaattactgcaggtgctatcatttatttttttcactcagcaatatgccttgaaaaaattttaagtcaatcaacatacagatatttgtcatcttttaaatagctatagattttctctcagacttaaagtctaatttttaaaga

SEQ ID NO: 87544 - DNA, 601 bp, Human
aacttctgggctcaatcaaccctcccacctcagccttctaagtagctgggactattctgtagtgataatccttgttaaagttttggaaaataccttttttagagtctctctttctctctacacagacacacacacacacatacacacatgcaacttttatgtgaatgacggcatttacaatttacgtaaattactgcaggtgctatcatttatttttttcactcagcaatatgccttgaaaaaattttaagtcaatcaacatacagatatttgtcatcttttaaatagctatagattttckctcagacttaaagtctaatttttaaagaagtgactgttatatttaaatcatatatagcttcatgatgaaaaaaggaaaaacaattcttgggaccggacatggtggctcatgcctgtaattccagcagtttgggagaccaaggtaggagaattgcttgaggtcaaaggtttgagaccagcctgggcaacacagtgagaccctgtctctccaaaaaaaaaaaaatatatattagctagatgtggtggcacatatctgtagtcctacccactcaggaggctgaggaggtgggaggatcgcttg

SEQ ID NO: 87545 - DNA, 601 bp, Human
gctcaatcaaccctcccacctcagccttctaagtagctgggactattctgtagtgataatccttgttaaagttttggaaaataccttttttagagtctctctttctctctacacagacacacacacacacatacacacatgcaacttttatgtgaatgacggcatttacaatttacgtaaattactgcaggtgctatcatttatttttttcactcagcaatatgccttgaaaaaattttaagtcaatcaacatacagatatttgtcatcttttaaatagctatagattttctctcagactyaaagtctaatttttaaagaagtgactgttatatttaaatcatatatagcttcatgatgaaaaaaggaaaaacaattcttgggaccggacatggtggctcatgcctgtaattccagcagtttgggagaccaaggtaggagaattgcttgaggtcaaaggtttgagaccagcctgggcaacacagtgagaccctgtctctccaaaaaaaaaaaaatatatattagctagatgtggtggcacatatctgtagtcctacccactcaggaggctgaggaggtgggaggatcgcttgaacccagga

SEQ ID NO: 87546 - DNA, 601 bp, Human
tcagcaatatgccttgaaaaaattttaagtcaatcaacatacagatatttgtcatcttttaaatagctatagattttctctcagacttaaagtctaatttttaaagaagtgactgttatatttaaatcatatatagcttcatgatgaaaaaaggaaaaacaattcttgggaccggacatggtggctcatgcctgtaattccagcagtttgggagaccaaggtaggagaattgcttgaggtcaaaggtttgagaccagcctgggcaacacagtgagaccctgtctctccaaaaaaaaaaaaatatatattagctagatgtggtggcacatatctgtagtcctacccactcaggaggctgaggaggtgggaggatcgcttgaacccaggagtttaaggctgcagtgagctagaacggtgccattgcacttcagcttgggtcacagagtgcaactctgtctataaaacaaagacaaaagcaccacagttcgttagatataactgaatattatcttcatttcctactgtagtggttcttagaaaggttgtttcttaagttagaaactgttgcctaagtatttaggatgtggcaggcactgtgcta

SEQ ID NO: 87547 - DNA, 601 bp, Human
gtaatcccaccccttacagctaactactgtgacattttatttgtagaagtccattttgctatcagacctcaagttttaaaatcttaactcaccctctgtaacctagttctcagctctattttatgtaacgtttttaaaggattcaagatttaaaataaacttatctcaccccaaatgcacttgtatatttttgacaccccctcatctctctctctctcttgtctctctctcttctctgtctctcactctatctcagttctctttctcctcttctttctctctctcctctctcctctctctstctttctctctctgtctcacacacacacacggggaaaaaaaatcactcgagttaagaatcagtctctcattttacagataggaaaactgaaatctagaacttgtctgaaatcatgttaaaaaaaaaaaagtggtaatctgtgctcgaacccaggtctcctgaattttcgttcagtgctttttccattctacagtgatgcctccttactaggtcatagaaacagtggcagagggagaaaaggaaaaatacgtcagctccaaagagtgcagtttttttttttctgtgtcctttagctgagct

SEQ ID NO: 87548 - DNA, 601 bp, Human
agggtctactgtgtgcaaggtgtattatgtaggaagccttccacagttcccagagctaggtgagctctgtcatgtaggcctgtcttgtacatatcaccttcgacattgctgagcagtttgtgttggacatgtttgatctcctcccctagaatataaacagctggagagtaggatgcttattagtaggtgcttattaagctttctttaaaatgagtaagtgcacatgctaccttttatagatctgttaccttctaatgaaggcaagaacaataggaacaaacattagttttgtgtgtgtgtgtgagagagagagagacagagagggagagagaaagagagagagagattttgaatgggaataattatgaggccacatctgagggcaaataaccacttccaagttgaagaaaggcaaggagaagacaggaatgagaggagagctgtagcagtcaaaggaaacgggatgagaatatgttattctctgaatcataaagcatttgctctgagaaatgtttttccttaagtggtataaaatgtaaaatgaattgggtcttagtttttcttttcctctttaggaggttggagctgatttttaaaatga

SEQ ID NO: 87549 - DNA, 601 bp, Human
ggtataaaatgtaaaatgaattgggtcttagtttttcttttcctctttaggaggttggagctgatttttaaaatgaggtaggggagggaggtggggtttggagaaagaaagtgaaaattgttttctgaaactctgtttgtcaaataactctctggagagaaagttcagagggtgagggcctgccaaagctgaccagcagcacacaggccaaatcgttctttcgtcattgtcctggtcacttccccacccctgttcgccacccccaaacaccttttttcttctctctctctctctctgtgtttgtctctctctctttcttttctttccttttttttctttttataacatatgaatattataagtaagtagctggagaaaataaaaaagcaaaacaaaacacaaagtaagcagatgatttcaacctgcaattatttgtcaggtcataaaaatgatgtgtcttagatttatttacctgatctcctcatctgttttccactggaagccttctgctcgcgtcacccttcttcatttagttccccaaacttccacccactttctgactcaaagcaggagagaagcattgaacaaaaccactggattt

SEQ ID NO: 87550 - DNA, 601 bp, Human
atttctttgtgtttatttatttatttggctgctttggagccatgagtccttttttaaacccgggtttatgtctgttctaaaaaatgaggacagatcgagttattgccatgcgggtggctctccaagcattccagttgcatagctcttccagaaatatttcttgacgcacttatttagcactttctattgccgttactgagcagattacagaatcctcccggccctttcaccaaacccgtctagagctggtatggatctacttgtgcctatctggcagatagaaagatagaggaatgggaargtgaagtccattgttactcatgaaggattttgaccagtaacctcagaagagtcagaagaagagaaaaagcatgtgctctcctctttcctgctttgcttttctgcttccaagtccctcctccaagcaggaagatctttcctgagcagcagcgtacctgggtgtgagaacccagagggagtgtggtggagagacgtgaaggggtcagttcctggaacattctgttccctctagctcccatgatcattgacttcttgcctctcaagtccttctagggatctccaggcttttgagaggctcagc

SEQ ID NO: 87551 - DNA, 601 bp, Human
gcttgagaaagatcctctatagatcaggaagatgtgtccagtaagagatttgacctttgctggtttcttgacatgggctttgatgaaacccttttagcatgctcactttagatgattcttctcaagggggatgtcagccccaggaccccccagacctccatccctaaacccgggcttgcgtgtctggcaacccagggccagcacttcgttcttacactcagctgagtggtagtcctgccaccattgctgtggctctgggactatagcctctgccttaggaacacttatgagaggaatcgawggaattccaactatttttaaggattttttttttttttttttttttgctgagtttgcattgcaaaaggaaggtagagcacgggccatctctccctcctccacttatatttattctgcacctacctgcacgtgacactctgctattcttcagagaaggttctgacctttgtgaccacgctttacattttcacattgcaaggcaatttctaaagagcttttcccagctaagatctcatttgagcctcacaacaactctggggcaaaggagactgtaaaacaaacaaaaacaaaaacaaaaaaa

SEQ ID NO: 87552 - DNA, 601 bp, Human
tttgaataggtttgaacagttggctgtctttgattggctgaaactctgtgaatggtacaagagtaggttgcatcctgtttacacatcctgttaggacggaggaggcagctttaggctaaacgtaatttaacaagattcaatgagattatacctgtacgcccaagttcacagttaggtagagaaggattgtggggatttgaagcttaggcttactgacttacgccattgtgccatatcattcattctcctcgtggcaggaataatgaatgaatattctattaacaggtactacctattaacygcttacatatatttcaaatgttactaggtagatactttttacaggcctatttcatcttctcaacaaccctataaggtagaaattattatgtccagtttgttgatgaatggctagaaatatagagaagataaataacttgctcaaggttatacttcacagaattgatggacctcgaattctaattaagattgctgcctccaggggtctatcagtataggatgtgatctttacccatcctgagtcctaggagatataaaacatgctgttgaaataacaaagctggtttgtgggtgatcatat

SEQ ID NO: 87553 - DNA, 601 bp, Human
aaatatcttttcctgctccgatcattctttccttttaagtattacctggctggtgaatgtttatattgaattctctttgtacaattcctttcaacaatattgcttggaattataaaaacttaataattgttttaaattgaaatgacaattgcaggttatccttgctttcaaaaagattttgtttctgaaatgtagcttgttaaaagtttggaaataaagcatcacatgaagaaataaagttatatcaagaaagatgcctaacacatgttctgattggctagctggttgtgcctttttttttatgtgtgtgtgtgtgtgtgtgtgtgtgtgtgtgtgtcactctgtctcccaggctggagtgcagtggtgcgatctcggctcactgcaacctccgcctcctgggttcaagcgattttcctgcctcaggcttcccagtagctggtactacaggcgcgtgccaccacgccctaatttttgtatttttagtagagacgaggtttcaccatgttggccaggctggtcttgaattcctgacctcaagtgatccacccaccttggcctcccaaagtgctgggattacaggtgggagccactacacctg

SEQ ID NO: 87554 - DNA, 601 bp, Human
tagcttgttaaaagtttggaaataaagcatcacatgaagaaataaagttatatcaagaaagatgcctaacacatgttctgattggctagctggttgtgcctttttttttatgtgtgtgtgtgtgtgtgtgtgtgtgtgtgtgtgtcactctgtctcccaggctggagtgcagtggtgcgatctcggctcactgcaacctccgcctcctgggttcaagcgattttcctgcctcaggcttcccagtagctggtactacaggcgcgtgccaccacgccctaatttttgtatttttagtagagaygaggtttcaccatgttggccaggctggtcttgaattcctgacctcaagtgatccacccaccttggcctcccaaagtgctgggattacaggtgggagccactacacctggccgtgccttgttttttagtatcagttttttcttttcttttcttttcttatcgtttcttttcttttcttttctttagggtatgattctatttatttgaagttccagaaaaagcaaaactaatctgtggtaatagaaaatcagagtatagtggttgttcgcaggaaagaggtggtatgagattgcctgagaat

SEQ ID NO: 87555 - DNA, 601 bp, Human
tttttttatgtgtgtgtgtgtgtgtgtgtgtgtgtgtgtgtgtcactctgtctcccaggctggagtgcagtggtgcgatctcggctcactgcaacctccgcctcctgggttcaagcgattttcctgcctcaggcttcccagtagctggtactacaggcgcgtgccaccacgccctaatttttgtatttttagtagagacgaggtttcaccatgttggccaggctggtcttgaattcctgacctcaagtgatccacccaccttggcctcccaaagtgctgggattacaggtgggagccactrcacctggccgtgccttgttttttagtatcagttttttcttttcttttcttttcttatcgtttcttttcttttcttttctttagggtatgattctatttatttgaagttccagaaaaagcaaaactaatctgtggtaatagaaaatcagagtatagtggttgttcgcaggaaagaggtggtatgagattgcctgagaataggcaaaagagaacttttcagagtgacaaaagtattctgcatctttgataggagcacggattacttagatgctttcctttttctcaactggcctaagtttct

SEQ ID NO: 87556 - DNA, 601 bp, Human
gcttcctcacacctcaagagacggaattagggatgtgagactgaggtgttggtttcccagtcagtaatcggatgagacactttgctgtcacagatgttaagaaggttaacaagaaatagaattgtaaaactctggccctaaggtggactacggtcactttcactttgagataaggcatgattttaaatgctcctattggtctttatgggttctgtagtctattttcaacagactaaaattgtcttgttgcaaaagtttgcaattttctgcttctttgggagagggttcaaaccaaagttgwcctcttccctttctcttctgaaaggatgacgttagtttctcagctgaaataaaggaaggaggaagtttccattgggtcttaggaaaatattccagcattgggctttaatggcagctgatgtcccaaacttgtgcacaatggctccgagaaggccatagtggtttaggaggcacccataatagtcccttttattcatgctgagaatgaagaaccaggggcaacactaaagaaacctgcacttggcttttccttgctgcttgtggtccctttcctggaagctgctataacacagccaccaag

SEQ ID NO: 87557 - DNA, 601 bp, Human
gagataaggcatgattttaaatgctcctattggtctttatgggttctgtagtctattttcaacagactaaaattgtcttgttgcaaaagtttgcaattttctgcttctttgggagagggttcaaaccaaagttgacctcttccctttctcttctgaaaggatgacgttagtttctcagctgaaataaaggaaggaggaagtttccattgggtcttaggaaaatattccagcattgggctttaatggcagctgatgtcccaaacttgtgcacaatggctccgagaaggccatagtggtttargaggcacccataatagtcccttttattcatgctgagaatgaagaaccaggggcaacactaaagaaacctgcacttggcttttccttgctgcttgtggtccctttcctggaagctgctataacacagccaccaagtcctgggaggaagagaaggaggggattaattcttatgatgcagggggatggctccagagagagtggaagcaaagacatctgtgttctgatgacagctgtgccacgagtttgctctgtgacttggtcaagatgctttgcaatttgaggccttcatttctccgtctgg

SEQ ID NO: 87558 - DNA, 601 bp, Human
tgaggatttctactttcttattattcatttgtacgtgtgtactttcacttatttaaggcaatgaagaactaataatacctaatatggtgccaggctttgtagtaggtgctgacctgtagaagtgaaccataaaccctaagccaagggctataaaatactttaaaattcatgtagaatcctctctcaatcttacccccctttcatttttcagtgtgttctctgatacttttgtacttttgccaggtgataagtccaccttgacttggctattttatatcttttttttttttttttttttttttgagacggagtttcactcttgttgcccaggctggagttcaatggcacgatctcggcttactgcaacctccacctcctgggttcaagcgattctcgtgcctcagcctccctagtagctggggttacaggtgcacgccaccacacccagttattttttgtatttttagtagagatggggtttcaccatgttggccagactggtctcaaactcttgacctcaggtgatccacctgcctcggcctcccaaagtgctggattacaagtgtgagccaccatgtctggccgtctattttatatctta

SEQ ID NO: 87559 - DNA, 601 bp, Human
accttgacttggctattttatatcttttttttttttttttttttttttgagacggagtttcactcttgttgcccaggctggagttcaatggcacgatctcggcttactgcaacctccacctcctgggttcaagcgattctcgtgcctcagcctccctagtagctggggttacaggtgcacgccaccacacccagttattttttgtatttttagtagagatggggtttcaccatgttggccagactggtctcaaactcttgacctcaggtgatccacctgcctcggcctcccaaagtgctgsattacaagtgtgagccaccatgtctggccgtctattttatatcttatagtaaaggatggttgcctcaaaggctgtaaacgtcaatgtttagagatatatatgaaattatttgtaacttccttcaatagtaactttcaaatgccacccttacatggctttatgaaaagtaaacccttctcttaaatgtctgcttttttcttagagtaagtttcttgtgttggctttcttttctctcttctctttatcagtgaattcatttattctaaatttttttctgatgtagtttgggacttcctaact

SEQ ID NO: 87560 - DNA, 601 bp, Human
cttggctattttatatcttttttttttttttttttttttttgagacggagtttcactcttgttgcccaggctggagttcaatggcacgatctcggcttactgcaacctccacctcctgggttcaagcgattctcgtgcctcagcctccctagtagctggggttacaggtgcacgccaccacacccagttattttttgtatttttagtagagatggggtttcaccatgttggccagactggtctcaaactcttgacctcaggtgatccacctgcctcggcctcccaaagtgctggattacargtgtgagccaccatgtctggccgtctattttatatcttatagtaaaggatggttgcctcaaaggctgtaaacgtcaatgtttagagatatatatgaaattatttgtaacttccttcaatagtaactttcaaatgccacccttacatggctttatgaaaagtaaacccttctcttaaatgtctgcttttttcttagagtaagtttcttgtgttggctttcttttctctcttctctttatcagtgaattcatttattctaaatttttttctgatgtagtttgggacttcctaacttaacaat

SEQ ID NO: 87561 - DNA, 601 bp, Human
cttcaatagtaactttcaaatgccacccttacatggctttatgaaaagtaaacccttctcttaaatgtctgcttttttcttagagtaagtttcttgtgttggctttcttttctctcttctctttatcagtgaattcatttattctaaatttttttctgatgtagtttgggacttcctaacttaacaatggaaattgaaaattggagaagctcattctgtattctttcctttttattccatttttgatactggattatgtctgtataattgctcaaattgtgagtcatgtaggaacatgctmtgtgtttctgcacatgatatttaaaacctatttatgctttcttaaccacaaaggggaccataaaagtcctgtcaaatagtcccagactgtaaattccttgaggtcaagagctgtgtcaaatttatttttgtacctctttctgctacagctcccagcccctagcccagtgccaggtagctctggcaaatgagagtgggattgaattggatttctcgttctgaccactctcttggtgcctttatcaacttgtccaccccattgggaggaggggcatggacctgtcaagtgtgatgaattggt

SEQ ID NO: 87562 - DNA, 601 bp, Human
gtcccagactgtaaattccttgaggtcaagagctgtgtcaaatttatttttgtacctctttctgctacagctcccagcccctagcccagtgccaggtagctctggcaaatgagagtgggattgaattggatttctcgttctgaccactctcttggtgcctttatcaacttgtccaccccattgggaggaggggcatggacctgtcaagtgtgatgaattggtagatcatggagttttccatcctccactagaactttagctgtgtttagacttcagaatgctgagtaactaataaaaaackattccaaagcactctgcagatagaaagtgcttcatgtgtaataaataataatagcctcttaagattaggcacagccacacaaagaagtgccagtcttgcaggccgcaagaattcctgatagaccttatggttagagtggattggttgagactgacccttgtcactgttttgtaataagcagtttcacctccaagttaccacgtattttccattatgggaaaagggtagtttctgaactatctaggaattaatccttccaattatcgttaggagtctgactgaaggaacaccatgaaaatt

SEQ ID NO: 87563 - DNA, 601 bp, Human
agtgcaatggcaccatctcggctcactgcaacctccacttcccaggttcaagcgattctcctgcctcagcctcctgagtagctgggattacaggcacgtgccaccacacctggctaatttttttgtttttagtagacatggggtttcaccatattgtccaggctgatctcgaactcctgaccccgtgatcctcctgcctcagcctcccaaagtgctgggattacaggcatgaggtaccgcgcccagcctccaggaacttttctaggtgctgctggtcagtgaagaaaacaaagcctgctgwagttaccatttgaaagactgaacagaagtgtgactttaaaaaatgatttggcaaaagtatgctttaaataaataaacacagcaaacaaaaaacacaacagctctttcattctgtcctttcctctattctttctcttgtctcccatttttgtcctgtgtgtaacctgactccacaccttttattctctcactctgcttatcaacacagccatacttgcttctcaggctcttctgtgtctctttgttgtgtctgctgtgcttcatcatgtggcgatgaagtagatgaaggttgttggtggcc

SEQ ID NO: 87564 - DNA, 601 bp, Human
agctagttccttgattgatctccagacatggagtggcaggtaggtgctcttgttgtaagtcacagaacctggaggaaagagtggttcgtggccctggggcctctgggggctgatgcttggatatttgtttagatatttgtttggatatttgtccccgtccaaatctcatgttgaattctaatcctcagtgctggaggtggagtctggtgggaggtgttggggcggatccctcatgacttggtgatgtctttgtgatagtgaattcttgtgaaatcttgtcatttaaaagtgtgtggcaccycccaccctccaactctgtctctctctctctctctctctctctctctctgtctgtcctcctctcctgctgttgccatgtgaagtgcctcctcccttttgtcttctgccacgttgggaagcttcctgagcctccacagaaggagatgctgctatgtttcctctatagcctgtagaactgtgagccaataattcaacaactcaaccacttcttttcttttttttttttttttttttttttttttggagagacaggtcttactctgatgcccaggctggagtatagtggcatgatcttagctga

SEQ ID NO: 87565 - DNA, 601 bp, Human
ggtgctcttgttgtaagtcacagaacctggaggaaagagtggttcgtggccctggggcctctgggggctgatgcttggatatttgtttagatatttgtttggatatttgtccccgtccaaatctcatgttgaattctaatcctcagtgctggaggtggagtctggtgggaggtgttggggcggatccctcatgacttggtgatgtctttgtgatagtgaattcttgtgaaatcttgtcatttaaaagtgtgtggcacctcccaccctccaactctgtctctctctctctctctctctctctctctctgtctgtcctcctctcctgctgttgccatgtgaagtgcctcctcccttttgtcttctgccacgttgggaagcttcctgagcctccacagaaggagatgctgctatgtttcctctatagcctgtagaactgtgagccaataattcaacaactcaaccacttcttttcttttttttttttttttttttttttttttggagagacaggtcttactctgatgcccaggctggagtatagtggcatgatcttagctgactgcaacctctgcttcctgggttcaagtgattctcctgcctc

SEQ ID NO: 87566 - DNA, 601 bp, Human
tggccctggggcctctgggggctgatgcttggatatttgtttagatatttgtttggatatttgtccccgtccaaatctcatgttgaattctaatcctcagtgctggaggtggagtctggtgggaggtgttggggcggatccctcatgacttggtgatgtctttgtgatagtgaattcttgtgaaatcttgtcatttaaaagtgtgtggcacctcccaccctccaactctgtctctctctctctctctctctctctctctctgtctgtcctcctctcctgctgttgccatgtgaagtgcctsctcccttttgtcttctgccacgttgggaagcttcctgagcctccacagaaggagatgctgctatgtttcctctatagcctgtagaactgtgagccaataattcaacaactcaaccacttcttttcttttttttttttttttttttttttttttggagagacaggtcttactctgatgcccaggctggagtatagtggcatgatcttagctgactgcaacctctgcttcctgggttcaagtgattctcctgcctcaggctcctgagtggctggacttataggcacgtaccaccatgctcag

SEQ ID NO: 87567 - DNA, 601 bp, Human
cctctgggggctgatgcttggatatttgtttagatatttgtttggatatttgtccccgtccaaatctcatgttgaattctaatcctcagtgctggaggtggagtctggtgggaggtgttggggcggatccctcatgacttggtgatgtctttgtgatagtgaattcttgtgaaatcttgtcatttaaaagtgtgtggcacctcccaccctccaactctgtctctctctctctctctctctctctctctctgtctgtcctcctctcctgctgttgccatgtgaagtgcctcctcccttttgwcttctgccacgttgggaagcttcctgagcctccacagaaggagatgctgctatgtttcctctatagcctgtagaactgtgagccaataattcaacaactcaaccacttcttttcttttttttttttttttttttttttttttggagagacaggtcttactctgatgcccaggctggagtatagtggcatgatcttagctgactgcaacctctgcttcctgggttcaagtgattctcctgcctcaggctcctgagtggctggacttataggcacgtaccaccatgctcagctaatttttgc

SEQ ID NO: 87568 - DNA, 601 bp, Human
ggacgtggccccaaaagccatagcctggctgccaggtgccccagagtattgtcaactcagaggaacatctctcaggaaatattccttgattctctcttctctattagttttttaaatgcttctatcccagaggaggtgctcagtaaattttagtttctttccttttccggaaagtctcatgactctttatctgagtttgacttaagagaacttacttaataataattaataataaagaataaaacctgctaataataagatttaatagaactttctgtttaattccatggttattataccyatttcttaatctctctaagagacatggactgtgttaaagtgtgtttatgaactggtggtcgagggtgcatttccctcctaagaaaactcattccttgttttgggataaggttcttggagctacatttaacactcagtcctagacttcagtggctcaaatgccgagacatgacctccatattgaccacacggttgatcatgctgaccacagatttctgctaaagcttgaggtgcctgaccatccctggctattgtcattcgccctaaactagctgtttgggaatggggccagtgatgaccc

SEQ ID NO: 87569 - DNA, 601 bp, Human
ctattagttttttaaatgcttctatcccagaggaggtgctcagtaaattttagtttctttccttttccggaaagtctcatgactctttatctgagtttgacttaagagaacttacttaataataattaataataaagaataaaacctgctaataataagatttaatagaactttctgtttaattccatggttattatacctatttcttaatctctctaagagacatggactgtgttaaagtgtgtttatgaactggtggtcgagggtgcatttccctcctaagaaaactcattccttgttwtgggataaggttcttggagctacatttaacactcagtcctagacttcagtggctcaaatgccgagacatgacctccatattgaccacacggttgatcatgctgaccacagatttctgctaaagcttgaggtgcctgaccatccctggctattgtcattcgccctaaactagctgtttgggaatggggccagtgatgaccctttagtagagataaggcagagcttgtggaggaaaaatcatttcttctccattcccatgatttagccctctgacttcatgcatttctttttgccctttttc

SEQ ID NO: 87570 - DNA, 601 bp, Human
gtttatgaactggtggtcgagggtgcatttccctcctaagaaaactcattccttgttttgggataaggttcttggagctacatttaacactcagtcctagacttcagtggctcaaatgccgagacatgacctccatattgaccacacggttgatcatgctgaccacagatttctgctaaagcttgaggtgcctgaccatccctggctattgtcattcgccctaaactagctgtttgggaatggggccagtgatgaccctttagtagagataaggcagagcttgtggaggaaaaatcatttmttctccattcccatgatttagccctctgacttcatgcatttctttttgccctttttcttgtgctggattttaacccccagcctctctttcgatcatgataatttgcatttattacacacgtactatgttccaggcactgggtaaattgctttctattgttcatttcatttaatcctcaaagccagcctatgcagtagatactagtgatccatattggatggatgaggtatggatggattagaaaggtttatgtagcttacccaatgtggcacaacttgtaatggcagggtcagacttaga

SEQ ID NO: 87571 - DNA, 601 bp, Human
ttccctcctaagaaaactcattccttgttttgggataaggttcttggagctacatttaacactcagtcctagacttcagtggctcaaatgccgagacatgacctccatattgaccacacggttgatcatgctgaccacagatttctgctaaagcttgaggtgcctgaccatccctggctattgtcattcgccctaaactagctgtttgggaatggggccagtgatgaccctttagtagagataaggcagagcttgtggaggaaaaatcatttcttctccattcccatgatttagccctctracttcatgcatttctttttgccctttttcttgtgctggattttaacccccagcctctctttcgatcatgataatttgcatttattacacacgtactatgttccaggcactgggtaaattgctttctattgttcatttcatttaatcctcaaagccagcctatgcagtagatactagtgatccatattggatggatgaggtatggatggattagaaaggtttatgtagcttacccaatgtggcacaacttgtaatggcagggtcagacttagaaactaaatctctccaatactagcttttg

SEQ ID NO: 87572 - DNA, 601 bp, Human
ggagctacatttaacactcagtcctagacttcagtggctcaaatgccgagacatgacctccatattgaccacacggttgatcatgctgaccacagatttctgctaaagcttgaggtgcctgaccatccctggctattgtcattcgccctaaactagctgtttgggaatggggccagtgatgaccctttagtagagataaggcagagcttgtggaggaaaaatcatttcttctccattcccatgatttagccctctgacttcatgcatttctttttgccctttttcttgtgctggattttarcccccagcctctctttcgatcatgataatttgcatttattacacacgtactatgttccaggcactgggtaaattgctttctattgttcatttcatttaatcctcaaagccagcctatgcagtagatactagtgatccatattggatggatgaggtatggatggattagaaaggtttatgtagcttacccaatgtggcacaacttgtaatggcagggtcagacttagaaactaaatctctccaatactagcttttgattttatttttaccctactcacccctgatattcgtcccctggcct

SEQ ID NO: 87573 - DNA, 601 bp, Human
tttcatttaatcctcaaagccagcctatgcagtagatactagtgatccatattggatggatgaggtatggatggattagaaaggtttatgtagcttacccaatgtggcacaacttgtaatggcagggtcagacttagaaactaaatctctccaatactagcttttgattttatttttaccctactcacccctgatattcgtcccctggccttttctgcttacctggcttggagcaagtcctcatctgccaaagactatgtaggtggttggaaggagtgctctgtcctcacctcttcctccyatggcacctgcagccagagacctgctgtgtgtgctatatactcttctgacctctctgattctgaatcgactctcaaggctgaattggctgacatgcatcttctagtggattcattgtttttcatggtttacttggtttatgacaagctagggacagcttgacatttgctttcccgtcagtggtctggggacgtgcacagagctgcttgtttcagatctcctctcggtgtttctctacacttagtgaagactatataaccatggctctattataatacaatacgttataataagatctagg

SEQ ID NO: 87574 - DNA, 601 bp, Human
ggattcattgtttttcatggtttacttggtttatgacaagctagggacagcttgacatttgctttcccgtcagtggtctggggacgtgcacagagctgcttgtttcagatctcctctcggtgtttctctacacttagtgaagactatataaccatggctctattataatacaatacgttataataagatctaggggcattctcgagaacttgggagcaatctaagaaaggagagtgaggttggagagaggcgtgtcctttgcatcttctggtagatgatggtggaggctgtgtaataacaygccaaagcctagcccacttgaaagcatcacgctctccagggaactgcctcagcctggggcacttatattatccatgcttagcatttttgtattactttacatttgtgaactgctttcccatgatttattagctgttcttgtttttaatagcccctggaggtacattgatattcaggcttctgagaatgtaaatgcacagggaacgttcatctcatcagatatttttggatctgggttcaggactctgacctcctgggatgaggccatttggggtcactgcctcccatggattagtaggag

SEQ ID NO: 87575 - DNA, 601 bp, Human
agcagtgatgtaattggcagccaatcactgcctttcgttttcagtgacctcctagacatgagtgggattcgaatgggctctggaagagggagtccttttgtgtggatgtctagcatttttgtaacctgaagagggtgatgtaatggcccagatgaaaggagaaagcggagctgcatggctgctttctgcctctgtcagtcatctctatcaagggggtgggtcatctatgaagggtggaatcgacatcattaggaagaaattgatgcctatgacaattgaagaggttgtgagagagcaattygctttccttaaatggttgcaaatttcatggaccacgaatgccgcatctcaggatacagaagagaacttctgatggggaacggctaccagtaattttgaggaaacccagaaatcagcagaaatgccagaaagtgaggagacgaggaaataggtattatcaaaaaagtccagcgcccatcccccaccccgcccccaaacgaaacaggtatccagagtctagaatctgctgatttcattgtgattccagttgtcgacggtcctatgtagacaggtgatttgtgagtctttgaaaggaagtagt

SEQ ID NO: 87576 - DNA, 601 bp, Human
tgcatggctgctttctgcctctgtcagtcatctctatcaagggggtgggtcatctatgaagggtggaatcgacatcattaggaagaaattgatgcctatgacaattgaagaggttgtgagagagcaattcgctttccttaaatggttgcaaatttcatggaccacgaatgccgcatctcaggatacagaagagaacttctgatggggaacggctaccagtaattttgaggaaacccagaaatcagcagaaatgccagaaagtgaggagacgaggaaataggtattatcaaaaaagtccagygcccatcccccaccccgcccccaaacgaaacaggtatccagagtctagaatctgctgatttcattgtgattccagttgtcgacggtcctatgtagacaggtgatttgtgagtctttgaaaggaagtagtgttcaccaagagccagaacagggtcttaaccagttcccgttttgtctgggttaaccaactggtggattaacacgatgacacagacatagtggggagaatgtgggctttggagttggattgtctggatttaaatccagagtccaggtcattgtatacaaatgaccttaggcc

SEQ ID NO: 87577 - DNA, 601 bp, Human
gataacattgtccagcttcaggaggccatggtagcgcaggagggatgcatgtgttgtgtagttccttgtctggaatgcagggtgacaggaggttggcttgtgtacacatgttcatctccttgggctactggagagggagtctttattttggtggggtgctcctaagagcagtgagctcagagcctctgtcttgagacttgctgtgtgttttcttggcctcccaatgctcctggcataagtgacatccctgcttaggaccctacactcatgatttcaggcaacctttctgccttccttttgrcccctgcctctccaccccatgttcatattcttcatcccaggtgcagtgccaccctgctggctacctctgccaggcagcatccttcatgcttagctcaaattccaccttctcagaaacatctgacttcacatttggtgtcagtctctctcctcctccatttcccatcacacagtttgtactttcagagatactttcatacaccaccttgtattcaatgggtggtatctgtttctgagttctgatcagagggcagacatctctgatcctttggaggctagctcagtagctggcatttatagg

SEQ ID NO: 87578 - DNA, 601 bp, Human
cttgagacttgctgtgtgttttcttggcctcccaatgctcctggcataagtgacatccctgcttaggaccctacactcatgatttcaggcaacctttctgccttccttttggcccctgcctctccaccccatgttcatattcttcatcccaggtgcagtgccaccctgctggctacctctgccaggcagcatccttcatgcttagctcaaattccaccttctcagaaacatctgacttcacatttggtgtcagtctctctcctcctccatttcccatcacacagtttgtactttcagagayactttcatacaccaccttgtattcaatgggtggtatctgtttctgagttctgatcagagggcagacatctctgatcctttggaggctagctcagtagctggcatttataggcactctgtaactgttaaattgaattactgaggaggcctgaggggttggaaggtcaaatgcagttaacccagggaactagaagggcccctgggaacttggttttggagcatggcttttatgagcagctatcagcttttccccaggctccttcttaatcctgtctctctagaggcacaaggagaggtggtg

SEQ ID NO: 87579 - DNA, 601 bp, Human
caccttctcagaaacatctgacttcacatttggtgtcagtctctctcctcctccatttcccatcacacagtttgtactttcagagatactttcatacaccaccttgtattcaatgggtggtatctgtttctgagttctgatcagagggcagacatctctgatcctttggaggctagctcagtagctggcatttataggcactctgtaactgttaaattgaattactgaggaggcctgaggggttggaaggtcaaatgcagttaacccagggaactagaagggcccctgggaacttggtttwggagcatggcttttatgagcagctatcagcttttccccaggctccttcttaatcctgtctctctagaggcacaaggagaggtggtgtttgcttaagatgctggtggcattcctagtgaagttaggtcagaatgtgccatctcttctttagctctcaacttcttagagtgtcaaccctcctcatattggaaaagcttagcttttaaaaaggagaaagtggtttacatgatgacctctgaatttttgactttgattattaatcttcttgaagaagactttgcagttgcccctgttacaagga

SEQ ID NO: 87580 - DNA, 601 bp, Human
ttttgactttgattattaatcttcttgaagaagactttgcagttgcccctgttacaaggaaagcagacatgccaagttgctgcatttgtgaaattgaatgaaattctggctgcgttttatggctctgacctttgggaacagtccagggtcagactgctcacatgatgtgcttgataaatccgcctcccaacagcactgttgagatcttaactagaattgctacttgcgaaacacctttttctgacttgcagttcagattctgcatgtactgctgactactgcttctagtggctcattcagrtaagtatgctatatattaggtagaaagaggatgcgtgatactaaggaaagagaaaaagagccagcccaggacacttgggttccagtgctaagtctgcaagagacatgtttgacatggggccttagttttcagatctataaaatggagacactaatcattattaggaagggttgtcaggagttcgagactagcctgaccaacacggtgaaagcccatctctactaaaatacaaaaattagccaggcgtggtggtacatgcctgtaatcccagctactcaggaggctgaggcaggagaatcg

SEQ ID NO: 87581 - DNA, 601 bp, Human
gaccaacacggtgaaagcccatctctactaaaatacaaaaattagccaggcgtggtggtacatgcctgtaatcccagctactcaggaggctgaggcaggagaatcgcttgaacccaggaggtggaggttgcagtgagccgagattgcgccacggcactccagcctgggtgacagagcgagactccatctcaaaaaaaataataaaaataaattaataaaacaaaaagagctcctcctatgaaagctctggaaacatcctccaccaaactggttgcacttctctaggcacaatatggtttayatccttctaaaatcagcatctcggccggacgcagtggctcacgcctgtaatcccagcactttgagaggccaaggtgggcaaatcacctgacctcaggtgatccgcctgcctcggcctcccaaagttgttgagattataggtgtgagccactgtgtctggccaggaggagctcttacagagctggaagtatttactcagagaaagatggagttagaagggaaggttgagaatgagagacaagttagtgtttattcaaggtggaggtgcacaggcctaatgtaggacaacggcaagtgggtt

SEQ ID NO: 87582 - DNA, 601 bp, Human
ctcactgcagtcttgaactcctgggctcaatcctgagtagctgggattacaggtatgtgccatcatgccagctaattagaaaagtttttctttgttgagatggggtctcactatgttgcctaggctggctttgaattcctaagctcaagtggtcagcctgactcgacctcccaaagtgctgggattacaggcatgagccactgtttctggcctcctttttaatattctgccctgtgcaaagcaccagcaccaacagcctccctcccacaacccccaacagctgtgcattaagtatcacttyggtttgaggatttcctagcttgctgtttatcctgggagaatttctgagtttcttggtctttgtttctttacccaaaagttggggatagttcagctttgtctgcattgtggacactacctccagaaagcaatgggaagaccctttgtaagctgtaccgaactctttgtatttttggagcacattttgtcttttttctcccttcttctggtggctgaggtacctctttggtcttgaaaagacccacttatatggaggcggaaatgggcttatagagggaagtgactttccaagggccctgga

SEQ ID NO: 87583 - DNA, 601 bp, Human
tgtccatgcctgggactttcccagaggaagtcatactttctggaaactctctgaggtcttgaaggggtgggagaagtctctgacacaagtgctgctgtggtcatggaggcttccattcctctctccttgtgttgagcagggaattgctccttggatattttaggtttgagtgactcaacatgcttatgacccagaggatgctgtggtgtgtttggcagcatgctggaattagtcagaaggcaaaactgcttgtcctgaccccagaacccacttactctaggtggatgagaaagtcctctcrgatcctctatttcctaattcatggcaacttctggagaacagtattttctctgttactgctttatggggtttagtgtggaaattaaagaagagaacttcttattttttgtaaataataatgcaatattcagatactgttagtttctgaaatttaaaatgggcatctcacttctgtgttccctccccaaataaatgtattgatactaaaaaagaaagccagctaactttatgaggatggctggtaaatgagccattctgtttttgcttgctgtccaaggcctctaatattaagcctggacca

SEQ ID NO: 87584 - DNA, 601 bp, Human
ctctccttgtgttgagcagggaattgctccttggatattttaggtttgagtgactcaacatgcttatgacccagaggatgctgtggtgtgtttggcagcatgctggaattagtcagaaggcaaaactgcttgtcctgaccccagaacccacttactctaggtggatgagaaagtcctctcagatcctctatttcctaattcatggcaacttctggagaacagtattttctctgttactgctttatggggtttagtgtggaaattaaagaagagaacttcttattttttgtaaataataatrcaatattcagatactgttagtttctgaaatttaaaatgggcatctcacttctgtgttccctccccaaataaatgtattgatactaaaaaagaaagccagctaactttatgaggatggctggtaaatgagccattctgtttttgcttgctgtccaaggcctctaatattaagcctggaccatttcaagcatatatggaggatatatatttcaaatatacattaggggtatatatttcaaaatcgaggacacattaatagtaagaggagaccatgtaagacaaagcacaggtttatttttat

SEQ ID NO: 87585 - DNA, 601 bp, Human
tttggcagcatgctggaattagtcagaaggcaaaactgcttgtcctgaccccagaacccacttactctaggtggatgagaaagtcctctcagatcctctatttcctaattcatggcaacttctggagaacagtattttctctgttactgctttatggggtttagtgtggaaattaaagaagagaacttcttattttttgtaaataataatgcaatattcagatactgttagtttctgaaatttaaaatgggcatctcacttctgtgttccctccccaaataaatgtattgatactaaaaargaaagccagctaactttatgaggatggctggtaaatgagccattctgtttttgcttgctgtccaaggcctctaatattaagcctggaccatttcaagcatatatggaggatatatatttcaaatatacattaggggtatatatttcaaaatcgaggacacattaatagtaagaggagaccatgtaagacaaagcacaggtttatttttatttttgtttacctgtttattttttatatttttgagatgggatttctctcttgttgcccaggctggagtgcgatggtgctgtcttggctcac

SEQ ID NO: 87586 - DNA, 601 bp, Human
tttttgtatttttcttagagatggggtttcaccatgttggccagcctggtctcaaactcctgacctcaagtgatccccccacctcggcttcccgaagtgctgggattacaggcgtgagccactgcgcctggccaaagcacaagtttaaaaattacaagtttccaccagcctcatatctcccttggcttataatattcaagtgttcatggatactggggcttgccatcccccgccccgtgtgttaatgcagcccatggaggcttctcatagagacataaacagtgggctccagaaggtctcyatttaagaaactgaggtctggcaaggtcacacatcgaggaaatggcaaaatcaagactaaaagccagctctttggattctcaattccctgctctttctgacacttcactcttccctcctgtcaggtgaagagagaagccagatggtttgacaaatggttctcgttgctgtcaaatctgccttctttctttgctcagacagacagttcttaccttccctttttcgggggactggcggaggtggggtgaggagagaggtaggaaggtggatgaaggaaaaaaagaagcattttattgcttca

SEQ ID NO: 87587 - DNA, 601 bp, Human
aaataacattaaattgatgccttttagtgggttttaggcttcaattatgggtaataattttcaaattgagaataaagttttgagtgaaaatggacaactgaagcttctaagctttgagaggagttattttagcattttagattttcttttctcagtaaattcaaacaaagatcatacaatcattgaatcatagcacgtctaaaatccaaggctctgtgctggccactgtgtgttttacagactagctcagacgtggctatgagccccaagacatgtttaaactattagagaggatactaaygatacattaataatgttcttggttttgacagaatattctagaacaggaactctagtaggatttttgcttatgttacatcattgaaatttaaattcactcaattatttattgactaaatattgagcacttatgtgatgttcactcttgtattttacatacatcatctcatgtaattttttaacaatcatatgaaatatgatctgagataatagtcagtactgttattattgttctcatcattagatgaggaaattgagactaagtaacttgtccaagtcattcagctggtaagtggtagaa

SEQ ID NO: 87588 - DNA, 601 bp, Human
tgagaataaattacaaaatgtatgtgagtgtctgcaaaggtacctagttcatggtgggagttcaccctatcttggaagtgctcataaacatgcagggttttttttttgagacggagtcttaccctatcgcccaggatggagtgcagtggcgcaaccttggcctcccgggttcaagtgattctccttcctcagcctcccgagtagctgggactataggcgcatgccaccatgcccgactaatttattttgtatttttaatagagacgaggtttcaccatgttggccaagctggtctcgatcycctgacttcaagtggtctgactgccttagcctcccaaagtgctgggattacagacgtgagccaccatgcccggttcaacatgcagttttgtgtactgtttagggacagatgccgaagccacattgcttgggtttggatccatcctaccacataatatcatgtgaccttggacaaacaacttcacttctagtgctgtactttcttcatctataaaatgggcttacatcatagggtccttgtgaggattaacaaagttagaatgcgtagagcatgtagaacaatgcttggcacacagcatgc

SEQ ID NO: 87589 - DNA, 601 bp, Human
ctctgtaactatggctcctaacgtggggagcccacaatctagctatatcatgttagcgagagctctttgtatactgaaacaataaacttaccatcttgatgagttttacatgtagaatggcttaggttataaggtactgccacctcattccactgttgagaattgtctaatgcaaagctcactttttaaacatggataattggacagtcatgagtggatcatcgaagggataagcaaaatatatgtcaaactgagaattaatatctatcaaaacacttgctattatttggtagatgggagrttattttatttttaagaagtagattggctgaatggaaaagcaaaatgtggcataaaataaaatgggatattgttcagcagtgaaaggaataaagtactgatatggactacaacatggatgaaccttgaaaacattatggcaaagtgaaagaagccagttacaaggccgggcaccatggctcatgcttgtaatctcagcactttgggagaccgaggtgggtgaatcacttgaggtcaggagttcgagaccagtctggacaacatggtgaaacccccgtctctactaaaaatacaaaaatca

SEQ ID NO: 87590 - DNA, 601 bp, Human
aaactagaaggaacaagctcccgcttaggaggtgccgttcgagtcctggccagtgtctgactgtagctgatgggtttagagaactgtggctggcttctcacaaaggattttttcatttactcttgttttgtgtttgagtatagacagcttttcccatcctccatcagggtcattgtcccaccttctctgactcacttattgtgtcaacagaattaaaagagcagccggtggacgtgtgtagaggctgaaggagagctgtgttgctagctttgtatttgaacggttcgtacacaaacagttytctttgattaagtatccggtgaaaccaattcacatgaactccaattaaactttaatgaacaagtgggtgtattaatatcagctgagtaatgcaggcagcacagattccagtaagtgactcacttctctgagcagctcattccccatgcacggttagagttactagaaagcttccagctatatttgagtggatctggtctgggccttgtaattctaacaatcctcagggctcgctattcatctagtgacaaaaccacagtcatccagacctctgttttcagagcaaagattggggatgaag

SEQ ID NO: 87591 - DNA, 413 bp, Human
atcttattctataggcttcagcctttttatgaagacctagcttctactcttgccccaggccctaagcaggcccagacttttcccatatacacacactctctctctaacttatstgtcttacatcttaataaggcagcagattgtatcagaatcagttaactctttatcaaaaaacccagagcagacagacgggtgaacttgctcatgggctgagctagaagggaggccacttttccttcacacagcctcggactctccctgggcttttttgtgtgtgctgcgtggagactgtgttctaacatttcagtcatatcttccttattttaaaactacagaattgatcttaccaacttactggggagcacgtcgtcagtaaattctaatggaaaaacctgtctgatcaatgggacagg

SEQ ID NO: 87592 - DNA, 601 bp, Human
attttaaaactacagaattgatcttaccaacttactggggagcacgtcgtcagtaaattctaatggaaaaacctgtctgatcaatgggacaggaaagcgtcacagcaataccggtgagtcattccaagaccaggcacatttgagctgtgttgcttcttcgatgctgactataattctccctcagcattacgtcgtcttaagcagcttttgaatcttcgtctctgattccctttctaggtcagactgtgtctttttttaaaattgtgcctggatatccccttaataggttggacaagtcccrttaggataattggctgtatgaatatgcgaaaatagcaacagtgaattttaaagttcttgaatagtctccccgtcccactgtgaggtgaggcatctggggtgggctatctgttttttgattcttggttcttgtttttaaaaaaataggatgttggaccttgggatgagagggaagtaaaacagttttggaacccttttagaaagcaaactaagacaaaactcctttcttgagaaaaatggatggacattgtaaagaagacagtagggcaccaggaagccttgagccaggtctgcctgtgtc

SEQ ID NO: 87593 - DNA, 601 bp, Human
gtgcctagagtagtacctggcatgggataggtgaccagtaaatatttgttgaatgaatgaacttataaatgaatgaatgactcagactccttctctgatctcttctatacttaaagagagtacaaagaactgtgggaggtaaaaggtactttcctggaagagagagtgtggagggtcatggaatcagttggtatttgagctggaccctgaagaataggtaagtatatgtcaccagcggtggtaggagaagcacactgcaggtaggagaaacatgcaaataggataagaagcagggcacttrtggtgaataatgaggagatcagatgttttataacaggagtttcctgacttgcttgatcttcaaaatcacctgttattaaaaataggttcccagtaccctccctggagattctgattttgtaagacagggttggccaatgataatttacaaaataaatatttgaaaaggtgtatggctttggaaagttatactggaaccatttctaatgggaaataaagttctcacttttcttagtaaaaggactagtatcaactagtaattgctggacctataattaccctataccttctgtgccataga

SEQ ID NO: 87594 - DNA, 601 bp, Human
tatccccacctaggtcagtgcctggcacataatagatgctcagtaagtatttacttgaatgaataactggttcttcatcacagggagcttacactctagtgagggagatagataatacattcttagtcctatgagataagctcataactgggatgttcaatatgactttattaacacagggaatacagctgattatctcttagacattgttaggataaattgtttctatacgtattgaatggactgtggggcatttttggtcacctgcactactacactggatccattctgtgctctgggstgtaagtgtgtgtgtgtgtctgtgcgtgtgtgtaatttcgggaacgggtaacacattcgtattacctctgtttggacacgatttttagtgacagagctaggaataacaggtggaaccttctaagttttgttgcttaaatatcaggccccctcagaattcaggactgatggtagaggatttaccagtttacagggaattcagatattctcttctctttctaggaaagccaaattgttggtcattctgcccccaacatttacagaagcagtttctcggttttatttatccaagattcttatg

SEQ ID NO: 87595 - DNA, 601 bp, Human
aggagagtaatttttgcattacctactttgcaggctctggagttagattgagcgcacctgaagctaaggttaaagatgatggctatgggcatgatgacagtaattgttcttctctggttggggactgattgatgatccctgatttctctgtttaaacgttgcccaaaacaaaggttgagaggtccttaggggagaggcgagataagcagaggtaggacttgcctttcttctgtgcttctccagaattagttgtgtcctgtggcatccacagacaaaaattgagcaatctccttcatagttgagttgagattgtataattcgataaaataggtttaaatagccttatgcctgtataatattcatgaaaagtgtcatgagtgaggtggcttgcttgttttgaaaatgggctgattttgacaaaggggaaaaatcgggattcatttactgtaagttgaaagtaagaaacaacaaagttgaatattagaagaacttggctatcgcaaaaaccacatactttcacatcagtaaaacatggagttctgatctgagtgaaatgtgaaacttcttgcagaccacagagagtaaaaaggagtacttttgt

SEQ ID NO: 87596 - DNA, 601 bp, Human
gtcatgatggtgtacacctgtagtcctagctactcaggaggctgaggcaggaacattgcttgagagttcaaggctgcagtgagctatgattgtgctgctatactccagcttggataatggagcgagaccctatctctaaactaaactaaactaaactaaactaaactaaactaaactaaactaaactaaactaaaagtaagataaaataaacttacggagttggaacattgcaggctatctatctggcttccctgccctgaattcatcgttctctttgatgtgctattgtccaacatttctttttttttctgtttttttctgttttctgtcttgctgtcacccaggcttgagtgcagtggcctgatgttggctcactgcaacctccatgtcccgaattcaagcgattctcctgcctcagccttctgagtagctgggattacaggcacccgctgctatgcccggctaatttttgtatttttagtagagacagagtttcaccatattggccaggctggtctcgaactcctgagctcagatgattctcctgcctcgacttcccaaagtgctgggattacaggtgtgagccaccgcaccaggcct

SEQ ID NO: 87597 - DNA, 601 bp, Human
tcagccttctgagtagctgggattacaggcacccgctgctatgcccggctaatttttgtatttttagtagagacagagtttcaccatattggccaggctggtctcgaactcctgagctcagatgattctcctgcctcgacttcccaaagtgctgggattacaggtgtgagccaccgcaccaggcctttccaacatttctttaaagaaactaaaaattaatttgaataagtaacacaaaaatatagtttaaactatagtataaaattcaaaactatgcaatgacaagtacatctttattttrtctctttacttctcccacccagaggaaagtataagttctttatatatccttttagaaataaactgggtataaataagcatgtgtatacacacacacacagaaacacacacacaaacacacacagatatgtatttatattccagtgtatataaatacatttatatacatgccatttatatacacatttgcatttctgttattagcgactctaaacaccatttgaaatgagccgtacccatttgtaattccgttttctgaactgtccttcacttccttttccattggattgctgaatttttg

SEQ ID NO: 87598 - DNA, 601 bp, Human
actggttgttaaaaggttatctagcttttttttttaaagaaactttgaaagtaatcatatattctaaaaaaattttatgtttttctcttttgtcctgtaaatttgctgtaatatatgaataaaattttcaaatatgaaatcttgttagtattcttgctaaaataattatcaacttgttcattgtttctgtattatatatttttagtgttgctagatcctagagatcattaatatattaatgatctgtgcttcaattttcataagtgagattatttgaaaattctgtgtgtgtgtgtgtgttatcgagaccatcctgaccaaaatagtgaaatctcgtctctaatgaaaatacaaaaattagctgggcatggtgtcatgcgcctgtaatcccagctactcgggaggctgaggcaggaggatcgcttgaacccgggaggcagagtttgcagtgagtgagattgcgcccctgactccagcctggcgacagagagagactccatctcaaaataaacaaacaaacaaacaaggaagcctttcttttttctttattttgaaatagtttgataacatttacatgggttatttctttaaaatatggtag

SEQ ID NO: 87599 - DNA, 601 bp, Human
gatcgagaccatcctgaccaaaatagtgaaatctcgtctctaatgaaaatacaaaaattagctgggcatggtgtcatgcgcctgtaatcccagctactcgggaggctgaggcaggaggatcgcttgaacccgggaggcagagtttgcagtgagtgagattgcgcccctgactccagcctggcgacagagagagactccatctcaaaataaacaaacaaacaaacaaggaagcctttcttttttctttattttgaaatagtttgataacatttacatgggttatttctttaaaatatggtaraattcccttgtgaaaataccttcacttattgccttttttggagtgaagaacggagtgaagaaagttatttctttaaaatatggtagaattcccttgtgaaaataccttcacttattgccttttttggagtgaagaatgtgtttgctctttaaaattttttacattttttttctgtagtaattggactaattagcttttatatctattctgtgattacctttgttaaattatagtttttttagggaagtcacctatttcaaattcatttgcatggtgtaaaataatttctcatgattattt

SEQ ID NO: 87600 - DNA, 601 bp, Human
cccctgactccagcctggcgacagagagagactccatctcaaaataaacaaacaaacaaacaaggaagcctttcttttttctttattttgaaatagtttgataacatttacatgggttatttctttaaaatatggtagaattcccttgtgaaaataccttcacttattgccttttttggagtgaagaacggagtgaagaaagttatttctttaaaatatggtagaattcccttgtgaaaataccttcacttattgccttttttggagtgaagaatgtgtttgctctttaaaattttttacattttttttctgtagtaattggactaattagcttttatatctattctgtgattacctttgttaaattatagtttttttagggaagtcacctatttcaaattcatttgcatggtgtaaaataatttctcatgattattttcatttcctctgtatttatggttatatttcacattattatttaaagttttatggatttctgctatgtgtatccatctttctggctaaagcatcagagtttaatttattatttatttaaaaaatagcttttgcatttatgtgttggctctaccactttgtaatt

SEQ ID NO: 87601 - DNA, 601 bp, Human
gtagaattcccttgtgaaaataccttcacttattgccttttttggagtgaagaacggagtgaagaaagttatttctttaaaatatggtagaattcccttgtgaaaataccttcacttattgccttttttggagtgaagaatgtgtttgctctttaaaattttttacattttttttctgtagtaattggactaattagcttttatatctattctgtgattacctttgttaaattatagtttttttagggaagtcacctatttcaaattcatttgcatggtgtaaaataatttctcatgattrttttcatttcctctgtatttatggttatatttcacattattatttaaagttttatggatttctgctatgtgtatccatctttctggctaaagcatcagagtttaatttattatttatttaaaaaatagcttttgcatttatgtgttggctctaccactttgtaattctttattttctctttaaaatcttcaataataccttctactttttctaggtttattttgttgtttttctcattgtttgaacttggctcttaatttccatatttttatttctgcttttttattcatataaataaga

SEQ ID NO: 87602 - DNA, 601 bp, Human
ccgaggcaggcagatcacctgaggtcaggagtttaagaccagcttggccaacatggtgaaacctgatctctactaaaaaaatacaaaaaaaccagccaggcatggtggcaggcacctgtaatcccagctactccggaggctgaggtaggagaatcatttgaactcaggaggcggaggttgcagtgagccaggatcgtgccattgcactccagcctggacgaaaagagtgaaactctgtctcaaaaaaacaaaacaaaacaaaaaaaagattagcccaatctatttctagctacttgggagrttgaggcaggaggatcacttgagcctagaagtttgaggttacagtgtgctatgatcatgctacttcactccagcctgggtgactgaccaagaccctactggaagaaaaaaaaaataagaattgctcaagaaaaaatacagttgagtagaattagaatgctagcagtgttgcaatagcagagatcacatgatgcccatgatgtttgtgaccttggacactttaggctaaattttgcacagaagcccaagtccaggatagaaatgataacgatgaacctgctgtagtgcagggaaagatgca

SEQ ID NO: 87603 - DNA, 601 bp, Human
ggatcacttgagcctagaagtttgaggttacagtgtgctatgatcatgctacttcactccagcctgggtgactgaccaagaccctactggaagaaaaaaaaaataagaattgctcaagaaaaaatacagttgagtagaattagaatgctagcagtgttgcaatagcagagatcacatgatgcccatgatgtttgtgaccttggacactttaggctaaattttgcacagaagcccaagtccaggatagaaatgataacgatgaacctgctgtagtgcagggaaagatgcagagctggggggragcccaaacccctactgatggccactttttcttctgacctcttcctatgtctcatttaaaaaccagtagctttacttcgaaaactcaattttcagatgagaatcaaaacaaaaatgcaaagaaggcaaatgattcataaaagttgctgagtgaattagaactataatgtgggacaaacactccgcctttctgtctctgcagctagtggtatttccaggttcccagggaacctcctgtcccttgctccactgtgcatttttagatggacctgatatttggttacctcccttgacaggccca

SEQ ID NO: 87604 - DNA, 601 bp, Human
ataatcaaattagccaataagtaagaaaatgttttcttaaccacactgtaaattaagaggattcatattgaaatcacttttccattattgctgtcttagcctgctaaagttatatttagtgtagtgcaactaagcagggttgtgagagctgggaaggtagactgttgtattgggcagggtcagggcagataaaggaccaaaataatgcctgaaatgctgtattaacctgctctaccttgaactgctgtcttgaattggggggaaaaaatgaagctctgaggggatggtgcacagggagaaragagagaatctcaggaattgaaagtctcaatggagaagaggtgggagaagaataggaggctagagtgagggcatgtgatcgtggagtaccgatctggagacaagagaagaaagtagaaaaatgccagcactgtctttggaccctgtgtatctggagtgtgggaggacaggcagacacaaatagagaggctctagggaaaacagcattctcatagaagatccttctccacaaaaagccctccaaatgtcctccaggagggtagaagctggttttaaagctcctcagggtcaggaagatcct

SEQ ID NO: 87605 - DNA, 601 bp, Human
aggaagatccttctcttatttttctttgcatcgtgcagtttaatttagcacagtactttgctcacagcacttaaaaaattattctgggccttgctttttaattttaggcccaaatacctgaaaaaatgttcaggaggaattctgataagaaagagctaacttaggcaattccatttctttttttggttcactgtttcctcatctgaaaagtgttgggctccatgacgtggtttctatgacactcagtacctttgttgaagagaaaacatttttctaaaactaggatttccaaaaaaacaacaacaaaaaaaagaaaaacaaaactcatgaatatgtggatatttttgtgatagtgatgaaggtttgggaatggagtagaatgtttcctaaagtccttttcttttagcagaagacttgagtttgtaaactcggctcatataatttcagcttgcctgtctaccttccttccatctacctacctacctacttacataagtacctacttatatatggagaacacggtggaatttaatttttcttattcttttcgactttggttggcttggtgaatcaagtaaactgtgttgaagaaaaactaact

SEQ ID NO: 87606 - DNA, 601 bp, Human
aagatccttctcttatttttctttgcatcgtgcagtttaatttagcacagtactttgctcacagcacttaaaaaattattctgggccttgctttttaattttaggcccaaatacctgaaaaaatgttcaggaggaattctgataagaaagagctaacttaggcaattccatttctttttttggttcactgtttcctcatctgaaaagtgttgggctccatgacgtggtttctatgacactcagtacctttgttgaagagaaaacatttttctaaaactaggatttccaaaaaaacaacaamaaaaaaaagaaaaacaaaactcatgaatatgtggatatttttgtgatagtgatgaaggtttgggaatggagtagaatgtttcctaaagtccttttcttttagcagaagacttgagtttgtaaactcggctcatataatttcagcttgcctgtctaccttccttccatctacctacctacctacttacataagtacctacttatatatggagaacacggtggaatttaatttttcttattcttttcgactttggttggcttggtgaatcaagtaaactgtgttgaagaaaaactaactttt

SEQ ID NO: 87607 - DNA, 601 bp, Human
tacctacttacataagtacctacttatatatggagaacacggtggaatttaatttttcttattcttttcgactttggttggcttggtgaatcaagtaaactgtgttgaagaaaaactaacttttgagggaaaaaattgaaaaaaaattatgattcttttttttttttttttgagacggagtctcgctctgtcgcccaggctggagtgcagtggcgcgatctcggctcactgcaagctccgcctcccgggttcacgccattctcctgcctcagcctcccaagtagctgggactacaggcgcscgccactacgcccggctaattttttgtatttttagtagagacggggtttcaccgttttagccgggatggtctcgatctcctgacctcgtgatccgcccgcctcggcctcccgaagtgctgggattacaggcgtgagccaccgcgcccggccaaaaattatgattctttgaaaaggatttttctcaggttagtttatatagtttcacagatgcttgagataaggattagaaagttcagacactgaatctccacagacccctgtgaatgtgttggctaagcaccttgtcttctcaggaacac

SEQ ID NO: 87608 - DNA, 601 bp, Human
aaactaacttttgagggaaaaaattgaaaaaaaattatgattcttttttttttttttttgagacggagtctcgctctgtcgcccaggctggagtgcagtggcgcgatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccraagtgctgggattacaggcgtgagccaccgcgcccggccaaaaattatgattctttgaaaaggatttttctcaggttagtttatatagtttcacagatgcttgagataaggattagaaagttcagacactgaatctccacagacccctgtgaatgtgttggctaagcaccttgtcttctcaggaacacacactggaacagactttctttcagtaaaacagggccagaatagtctttgaaacatccaacggtggtttgggaagaggattctctatataatgcctgtccaaatacagaataa

SEQ ID NO: 87609 - DNA, 601 bp, Human
ctgatgcatcgtacttactgaatgttttaccttctctgtgctcttctcagaggatgcacagaggattgggaagaggaagtattggtgacttgatctagaaaaaagagattgtttcaagccacaaaaagtttgagggtaaaatctcaagtcctgtgtgtgatgaatcagtagaaaaggtatcccagtggccagtgtgagtaagctgtcatattttcggtagtaatccttggtcctgtttgattttcctcatcctcacatataagatggagccatttctccctctggcgtttgccatcacagygtcctgcagtctcttggtcttgagatagaaggttgagagaaacactttgcagtattgggagaactgggtctgcctgtgggagtacttgtatctcaatcaatattacagaacttggctccttgtttccaacaaatgttttgctctgttctcatcctgggagttgaaggttgaggcgaggtgggagatgtgctgtataatatggcagccactaaccacatgtggctgttgagcacttgaaaggtggctagtgccacatgttgaaaaataatattttggatatatttgtaaaataattttttt

SEQ ID NO: 87610 - DNA, 601 bp, Human
cttgatcctttccaacatttaatctatggaggttgtgaggataacaatgaaaaggcaagtttaagcttggactgtagatacttttcactgggtggttttattttattatgcttcattgtgaaccagagcctctgtgaacatatgacttataggccctcaggcttccactgtgtccctttccctgattcgtccttcttcactgcatgccctggtgttgggtgagggagcaggctttatgtgatgtcattttctcagagccctgagctgggaaattcaagagtctccatgattcctagttagscatggaagagaccctaactggtccctcaggaacatgtttggttggtcagaggtaactcttatagaatctatgatggcttagtcgttcactcttcctagaaaagacctctttaaaaaggccttttggttatatacggcctgagttttaagtaatatttgcaatgttgattctctggtagaagagaatgaaaagttgtgagtgctcttggaagagtgccggacagctgtagtgatgggaaaagtattggccttggagtcagacctgtgtttacttcctggctctgctattttctagttgtat

SEQ ID NO: 87611 - DNA, 601 bp, Human
gtaactcttatagaatctatgatggcttagtcgttcactcttcctagaaaagacctctttaaaaaggccttttggttatatacggcctgagttttaagtaatatttgcaatgttgattctctggtagaagagaatgaaaagttgtgagtgctcttggaagagtgccggacagctgtagtgatgggaaaagtattggccttggagtcagacctgtgtttacttcctggctctgctattttctagttgtatgactctatgcaagtaacttctcatctctgagcattaatttcttcacctgttygacatagacaatgtctgcctcacaaagttgtgatatgttaatgtatgtgggatacctatctcaggacccaatacttagtctttataaaacactaaatgaattggttttctcatgtatgtcttatggttttgctggtgatggaccaataatcatcttccatcttcactttagaggtgggggaaaagggcattagagtgattgtgtggtaaaatccactctaattctagctgtgagaaaaagagcagtgaaaatgtggtaagcaagtgcttctaaaaagcttggactaaaagcgcttgatgg

SEQ ID NO: 87612 - DNA, 601 bp, Human
gctcttggaagagtgccggacagctgtagtgatgggaaaagtattggccttggagtcagacctgtgtttacttcctggctctgctattttctagttgtatgactctatgcaagtaacttctcatctctgagcattaatttcttcacctgttcgacatagacaatgtctgcctcacaaagttgtgatatgttaatgtatgtgggatacctatctcaggacccaatacttagtctttataaaacactaaatgaattggttttctcatgtatgtcttatggttttgctggtgatggaccaatartcatcttccatcttcactttagaggtgggggaaaagggcattagagtgattgtgtggtaaaatccactctaattctagctgtgagaaaaagagcagtgaaaatgtggtaagcaagtgcttctaaaaagcttggactaaaagcgcttgatggatttgtgctggcttcccggtagactcatctctgtactgcccgcacagcacaattaattgttgttactagagaaggaacaaataaagaaaagagagagagcagacataaaaacatcctttcatctttctgaagacagtcccctttgtcag

SEQ ID NO: 87613 - DNA, 601 bp, Human
tgtatgactctatgcaagtaacttctcatctctgagcattaatttcttcacctgttcgacatagacaatgtctgcctcacaaagttgtgatatgttaatgtatgtgggatacctatctcaggacccaatacttagtctttataaaacactaaatgaattggttttctcatgtatgtcttatggttttgctggtgatggaccaataatcatcttccatcttcactttagaggtgggggaaaagggcattagagtgattgtgtggtaaaatccactctaattctagctgtgagaaaaagagcrgtgaaaatgtggtaagcaagtgcttctaaaaagcttggactaaaagcgcttgatggatttgtgctggcttcccggtagactcatctctgtactgcccgcacagcacaattaattgttgttactagagaaggaacaaataaagaaaagagagagagcagacataaaaacatcctttcatctttctgaagacagtcccctttgtcagatcagtggagctgtacctgtgaatcaccttgggaaagcacagtgtgggtaactagaaggaaggtcttgtggctcattttgtacccacttcctggg

SEQ ID NO: 87614 - DNA, 601 bp, Human
acttctcatctctgagcattaatttcttcacctgttcgacatagacaatgtctgcctcacaaagttgtgatatgttaatgtatgtgggatacctatctcaggacccaatacttagtctttataaaacactaaatgaattggttttctcatgtatgtcttatggttttgctggtgatggaccaataatcatcttccatcttcactttagaggtgggggaaaagggcattagagtgattgtgtggtaaaatccactctaattctagctgtgagaaaaagagcagtgaaaatgtggtaagcaaktgcttctaaaaagcttggactaaaagcgcttgatggatttgtgctggcttcccggtagactcatctctgtactgcccgcacagcacaattaattgttgttactagagaaggaacaaataaagaaaagagagagagcagacataaaaacatcctttcatctttctgaagacagtcccctttgtcagatcagtggagctgtacctgtgaatcaccttgggaaagcacagtgtgggtaactagaaggaaggtcttgtggctcattttgtacccacttcctgggctggggaaatatctaaacta

SEQ ID NO: 87615 - DNA, 601 bp, Human
tcttacataggaatagagttattgccagatttggagatagtacatgttgcaatgtggttgacacagaataagctttcaataaatgattggtattgttgttgttgtcgttattatctataactacaataatttccctagccttattttatagggataggttgtggcaacatgaaatgtgacttggaaaactgatttgcactagatagatagaaaccatgtttttctatctatataatgaacaatgtcatttaagaaagcttagaggcaattccaccagcaccatcttcttttttatttccaytcctagattatttgccctcaagtctttggtaatttctttttgccacatctcttgaatgtttcttctttactatattccatctattattaccataagtccaacgttcatcacctcctgctccactgttgttcctgtctcctggctctcctagagccttggttctcaaagtgtcattcacagagcagcagcagcacccgaaatgcgtcatctcaagatctaccaagacctcctgaagcatgaggcatgttcacccccgtgttgtaggacctccatataactcatttaactacttctcctgct

SEQ ID NO: 87616 - DNA, 601 bp, Human
atttgcactagatagatagaaaccatgtttttctatctatataatgaacaatgtcatttaagaaagcttagaggcaattccaccagcaccatcttcttttttatttccactcctagattatttgccctcaagtctttggtaatttctttttgccacatctcttgaatgtttcttctttactatattccatctattattaccataagtccaacgttcatcacctcctgctccactgttgttcctgtctcctggctctcctagagccttggttctcaaagtgtcattcacagagcagcagcakcacccgaaatgcgtcatctcaagatctaccaagacctcctgaagcatgaggcatgttcacccccgtgttgtaggacctccatataactcatttaactacttctcctgctcagagtacatgcttggccagtgcgtgtttgttctgcctccagaatgttttctgactctgattgctatcattacttcttttgaatctacctaaattcaagttaccatccattgccatgactatggcaatagtctctgaaattgtcttctacttttatggtttccccttgtggcctttttccacaccatctgg

SEQ ID NO: 87617 - DNA, 601 bp, Human
ctaatttttgtatttttagtagagatgggttttcaccatgttggccaggctggtctcgaactcctgacctcaggtgatccacccgcctcggcctcccaaagtgctggaattacaggtgtgagccactgcgcctggcctctctgcttttttcataccactcatcactttacacagtaatctgtagacacactgaccttcctttagccctctgtataagccaagctttttcccacttgatctttctctgattctgtgcaaaactggcttggaagtatctttcaaggcttagctcaaatgttawagccttacctagctcttccccattctttagctaaagtagcacacatacccccctccccatcattcttctgtcattatcttgctttatagtctacaaagcatgtatggttctctaaaagagtgattaccatgcttttgttttctttatgtacattgcaaactgttttggtgagaaatattttagtaataataataatggtgaagatttagtgagtgtttgctataggctaggcacactgtatggtaaattaaataatttaatagatcatttatttggattatttcattctatttagctgat

SEQ ID NO: 87618 - DNA, 601 bp, Human
tgaagtaaagagacacaatgaacgtgactttttgcccaaacaaaggaaaaacgaaactcttctctttattcaagaatgtagattaaattcttactttcttatcatcctctgtcctgtcaacatagtgctgagaatgatgttgtgtatcaactcatttgaccacataaagtttaggaattaatgtagtggctgggtcatgattacaacactgatttcattcctggccaaagactgattcttctgctcttgaggtgagaaaagccagtactcctggatactttcgcttctctatttttatctractgaatgagtctgcaactgggatagtttatgagcctctaataatatacggttagactaccattatctctttcgtgaacattgccaaaagtgtttttttggtaagagatatcttagttataataacagtttgtaggatttatggagtgtttactacatgctaggcactgtatatagtaagctccttaatggatccttatattggatctacacagaaatcttatgaggtagttcccattgtattcttattttacgttaaagaaacaggtttggagagatactgtcttttgaagaagcatat

SEQ ID NO: 87619 - DNA, 601 bp, Human
gagatggtgatgacaaatatatatagtttgtatatcttttatctgaaatgcttgggatcaaaagtgtttcagacatcagatttttcctaattttggaatattttcattaaacttactggtttacattcctgatcaaaaaacatgaaacccaaaatgccccagtgagctttcagcgtcctgtctgtccttgaaacttctggattttggagcattttgaatttcagattttgggttagggatacaaaacctgtataattattgaactttttgggaataattccgttttttaaaaaatgttaawccttttgcatattttccctactctccgctcaccactactatctcttctgcttttcaatggtaaccactcatgcctttttaaacaaaacatgtgttgtatttgccaagacacaggggaagcgaagttaaaggtacagttgactgttcattttctgaataagatggaattctagctttgtggggaaggaagaatcagtgagttttcgttgaaggacccatgccattctttacctaaattaaagttgttaaaagtcacaggaaagaaaattgtgcaagcaattatcatcctttatatcactat

SEQ ID NO: 87620 - DNA, 601 bp, Human
ctaatcccatcttatatcacatgcattaaactaggtgtgtgttatagtagttgcatagaacattttgttcatttgctcattcattcattcattgaatgttcttttgagtacatactaaagaccagatgctggatagactttgggttcggattcaagaagctgtgttagacaaagagcctctattcaagatgcatgatcaactaaaagtgataaaacaatatggtaattttagtgatccagatataaaactaggcattatggtagttttaagaaaggctgcttcatcgaacatttttgcatyaagaagcttcttatcggggagacactaaatgttgagtagggcctcagactctactagaaaggtaagacccatattagggcttggttttgtttgattataaagccattttgtgagaatcaacctccaggctccatgtgttatctttggctcctcaccttcacccccaccctcccaccccagttgcatgcatgccatatttttccttcttcttttcaataaggaagcatcagaatcaacagaataacataaagataggtgtggtgacattataggctcacttctggggcgtcattattacat

SEQ ID NO: 87621 - DNA, 601 bp, Human
aagaaaggctgcttcatcgaacatttttgcattaagaagcttcttatcggggagacactaaatgttgagtagggcctcagactctactagaaaggtaagacccatattagggcttggttttgtttgattataaagccattttgtgagaatcaacctccaggctccatgtgttatctttggctcctcaccttcacccccaccctcccaccccagttgcatgcatgccatatttttccttcttcttttcaataaggaagcatcagaatcaacagaataacataaagataggtgtggtgacattataggctcacttctggggcgtcattattacattaatttttctatatttccaagtaagaataacaatgtaagtacataaaaataatctcatgatagtagaacatattgcatagtatttctctattcatcattccctttacttcttgtagaaaagcttagtgcttgtggatttccttaaataagtgtcttaagcactgtatctgatctgatagatattagcacaacaattggcactgagtaattatatttggagaatttggaaggaattttttctctattgcaaagtggtcatgctgtgttg

SEQ ID NO: 87622 - DNA, 601 bp, Human
tgttgagtagggcctcagactctactagaaaggtaagacccatattagggcttggttttgtttgattataaagccattttgtgagaatcaacctccaggctccatgtgttatctttggctcctcaccttcacccccaccctcccaccccagttgcatgcatgccatatttttccttcttcttttcaataaggaagcatcagaatcaacagaataacataaagataggtgtggtgacattataggctcacttctggggcgtcattattacattaatttttctatatttccaagtaagaatarcaatgtaagtacataaaaataatctcatgatagtagaacatattgcatagtatttctctattcatcattccctttacttcttgtagaaaagcttagtgcttgtggatttccttaaataagtgtcttaagcactgtatctgatctgatagatattagcacaacaattggcactgagtaattatatttggagaatttggaaggaattttttctctattgcaaagtggtcatgctgtgttgtctgcttttatttatatcacaagaccagatctgccgttaactagatgtctaggaaagagttc

SEQ ID NO: 87623 - DNA, 601 bp, Human
tgcttctggcttatttcacttaacatgatgtcctccaggcttatccatgttactgtgaatgacaagatttcattcatttttttatggctgaatagtattacattgtaaatatataacacattttctttgcctgtttatctgttgatggatacttagattgattccttatcttggctgttataattagtgctgcaataaacatgggaatgcagatatcttattgaaaatgtttttttttttttcctttggatatatgaccagcagtgggattgctggatcttacgatatttctttctttttytttttttttttttttgagacggagttttgctgtgtcaccaggctggagtgcagtggtgctatctggctcactgcaagctccgcctcctggcctcctgggttcaagcgattctcctgcctcagcctcccgagtagctgggactacagacgcgcgctaccacgcccggctaatttttgtgtttttagtacagacggggtttcatcatattggccaggatggtctccttctcttgacctcgtgatccgcccaccttggcctcccaaagtgctgggattataggcctgagccaccatgcccagc

SEQ ID NO: 87624 - DNA, 601 bp, Human
tcatgtgaagtgtttattatgctgaggtaaggtatgtttcttttatacctgacttgagatattatatcatgaaggaatgttgaactttatgaagtgctttttctgcatctaatgagataatcatggtttttgtactttgttttgttgaggtaatgtatcacgtttattggtttacctgtgttaaactatccttgtatccctcggataaataccacttgatcatagtaaatgctcctttaaatgtattggtggattcagtttgctagtattttgttgaggatttttgcatctatgttcatcrgagatcctggcctataattttctttttacatgtttgtccttgtctggttttggtatgagggtaagaatgcattcatgaaattctttatttttgagatttattcttttttattatgtctatctttgttgaatttcttcttcatattgtgaattattttcttgatttagtaaaattgtctatctgtattttcttgtatctcactgaggttccttaagatcattattttgaattccttttctggcattttattgatttcttttttactggagtctgaaactaaagagctacattcctttggtg

SEQ ID NO: 87625 - DNA, 601 bp, Human
tatctttgttgaatttcttcttcatattgtgaattattttcttgatttagtaaaattgtctatctgtattttcttgtatctcactgaggttccttaagatcattattttgaattccttttctggcattttattgatttcttttttactggagtctgaaactaaagagctacattcctttggtggtgtcatattttattgctttttcatatttcttgtgtcagtgagttgatgtctttgcatccggtggaacaattacctcttctatacaaactttctggagtgattttcataaaaaaagamttccgcttgcaattagggttggtgttacagttgggaggggtgtgatgactttgtttctgaatagatgcagtgatagggtctccatgcagcttctaaagctacgttcaatgtcagcaataactgtgggcacctcagtagcttaagttgtagaaatttgtggcagtggtggtggtggcatagattattaatgtcctcagtgtcaagggcttttgaggtcctcctattcttatttttttcataatggggagatttagccaaggggactgctcttcatgtcagatatcacatgacctacaagca

SEQ ID NO: 87626 - DNA, 601 bp, Human
tctactctttctcctttcacttgctaataaagcagaacttagaactaagtgtgtgttagtgcttcgacaattgaattttctgtgctatacactcggtttccctttcctgaagttgtttagttaccctcttcaaatagcaattgggaggctacgtcatgtagtaggagggtgcttactgattttggtatcaagatacagtgttacatttttatctgctccatgttaaccatgtgatctttgaagtttggtttttgtatttgtaaaatttgggtaataaggtctcattggagttataaagggratggtttgagacataatggtcattgtgatttttcaagctataaaataaagcatgatgttaaaagatgattaatgttttcatttggtggtagatgacaagtttcttgcagggcatctgatcaatcatgctctttttttttttttttttttgaaacttttattttaagttcaggggtatagttgcaggatccatgttcttttcttaacctgttttgagtcctttatgtaaacgggacattttatcaaaacttcctagaagtcttatatttctcaataaatccatccattctattaaaacaaa

SEQ ID NO: 87627 - DNA, 601 bp, Human
gggcacaaagttgaaaatgatgtgtgattcatcagcaggtctttcaactaaagcagtatctgttttgctttttaggggtcaaggaaacttttgattttaaaatcttaaaagtttttgggctgtctcttgttagatgaggtcatgtgagagtgacatagattaatatttcggtgttttaaaactaggaaacataagtcaaagagatattctcttgcctaatgtgcttataatgttatcttttgatcatataaatgtggatttatgggaagaaatgttatcactgctctctataaccatatayatggaataatggagagaaatcttatttaaaaagtttaactaagggcaactttggctatggagtatatatcataatcttcacatacatatgaagaaattgacactcatggagtttaaataacttgcctaaggccattgattaaaggaaatctgactggctcgaaatcctatgtacttttcccatttcctcatttcaatcaaatagctggttttattttattttctctctccaccaagccttgtgaattaagacaatgagttgctgtttgtctttgtctttccctagcctaataacctagga

SEQ ID NO: 87628 - DNA, 601 bp, Human
tctacttctgtaaaatgtggacaataatattcattttatatggtttctgtaaagttaatcatgaggatggtgttagttcctttctcatcctttctgtccctctttgagcttctgtttcctcacctatgaagccagtagaatcatctcttcctgcttcttcatcgggttcctgtggggtgcaatgaatgtgaaaatgttttgtaaaacaagaaaccattatgtagatataagaggttatgactattaatgaataaatatgggtttggtgtctggaagtaatttttacttatttcatttgtaracactagcattgcagttggctgaaccttgtgtcaaccatccattccaggagccagctatctgaggtaagagaggaggcgtgtcttcttgtttatgaaatactaataggcatctgagccagtaatgttgattttagaagaaatacaaagaatagaagaaatacaaagtactttatgaggaaaagaactgaaaaatggccaagacagtgagctgacctctctttttatttttgtttttttgatttatttttttcccttttaattcatagcccttaaggtttaataccaaaaccaaaaatctg

SEQ ID NO: 87629 - DNA, 601 bp, Human
cttgaaactatcaagaggagttttaagcaagccctgaaaggttacaaaaattactctcaagaaagaggaattttctctctttctcttttcgttatattttggaggtggggaatggtagagagggaatgatagaaacctctcaagtaacctttgggaggtggagaagtaaatagtctgggagcatgctgtagaaatttaaaataatcctgtggcaataattggtatcagtggcagtaatgaagaaagaataacagtttcaataaataattagacttgacagtaaatgtgtcaacaggtaccyacttaatgagtgtaatcattgtttttctctgctctcaacgttgatccactgactgcggtgtgttctctgtcccatttccaaaccaaatctatttaaagctgcactccacggaatctgcaacagtataccctgtttactatttagagctgatacctaatgttctttaataggcaagatctgtacttgaacgagaacaggcttctggcctcttgtagacggttgattatccctgttttccacagggtgattcattagcaaggatgaataatacccaattaaatctcatggacttgtctatat

SEQ ID NO: 87630 - DNA, 601 bp, Human
atccactgactgcggtgtgttctctgtcccatttccaaaccaaatctatttaaagctgcactccacggaatctgcaacagtataccctgtttactatttagagctgatacctaatgttctttaataggcaagatctgtacttgaacgagaacaggcttctggcctcttgtagacggttgattatccctgttttccacagggtgattcattagcaaggatgaataatacccaattaaatctcatggacttgtctatattgccagagtgaattgtttattataatttggtggaaacagtcctrgtctgctttaaataaaattaatcagttaccgttttttgaagtggaggtagaggcagtagttataagtgaaattacctctgtaataacctgaatagaatcacattgtttttgggagcaaagcagtatgttgtatgttatgtgcaccagaagccatgagaatccttttctaatcccagctgtaatgtcacctggctgtgtcacctaggcaagtcaccttccctctatgaggtctgtttcatcatctaatgacaaagttggaccagttgatcatggcattacttccggttaaatgttctctta

SEQ ID NO: 87631 - DNA, 601 bp, Human
tgtactgttcaatatacagaaatactatcacccatctgattaataatccttatcacagcccaatgagacaggcacagatgttctgcttttcaagattctatttcctaacttcatcttgacagttgtaagtctcttgcttctcaaagtttggtctgaggaccggaagcatcagcattacatgggagcttgttagaaatgcaaatctcagatcatactctagaacttctgaatgagaatctctactttaacaagagccccaggtagttcatatgctcattagtgtttgagaaacattcacttyggccctcgccctatttcaaggctattgctgtggtgtgctgacaatgcctggcatgctgccagcattcttggggcatgctgtaccatgccttgagatagcggggtccggggggcggggatgctgtgaagtcactccttgggaataatggaagactgggttgaagggatccagcaggctttatctttttaacacccttcatttccttagaagttactattcagaaggggtcaaactgggattggattctaagtctttctgatccaaagtccatgttcttttcattaaaccacgatgtctcag

SEQ ID NO: 87632 - DNA, 601 bp, Human
atgccttgagatagcggggtccggggggcggggatgctgtgaagtcactccttgggaataatggaagactgggttgaagggatccagcaggctttatctttttaacacccttcatttccttagaagttactattcagaaggggtcaaactgggattggattctaagtctttctgatccaaagtccatgttcttttcattaaaccacgatgtctcagtcaagaggaatgctgggttgtgggtgataactgttcattccctgtagtgtgaatatttccacactggctgctttaccctattackcaattcctagaggggaagaatttttttaaaaaaatttaaaaagcctgagttgaaagccaggatcctgcagcttaatcagttatttttgctttttaatgagggtgactattgtgaaataagtaattattaattactcaaaactaatgaaatattttagtttccttgctcaaaaagcatatggatgctaaaagaaagcatatgggtgctttctgggaagcatattggtgaatggacaaattacagtggtgccaatatgcctttgctgtctggctggggccatcaaaacgtgtgctggcatct

SEQ ID NO: 87633 - DNA, 601 bp, Human
tctgagatggatatgagacttataggcttaaagaatttcggaactggaaaggaagttaaaacctatctagtccagctcccccaccccagggaagaaatgacttacttaaatttgcctgcatagttagtggcagttctgcaaatcgtgcccacatctcaccaagcattggagagatggttggcacttgagtctcttcttaggactctacaggctctgtctggagtccttgtttctatgaagaccactaagaataaaggtaatacaggtgctgctgctgctgtattaaacagatggaaagaartagacattcattgtatgtctgttatgtgataggccttgtgacaggtgttttcacatagtttagcttggtcagtcatcaaaagctagaattcccattcctccatgagggagacagattgtttctaaataggacatttagcagaagctctttcctgtaagctctgaaaggcactcggtagtggatagatgcttccctcctagaacacgggtgtagggctctgcagagtagcatgcatggctcttctaagggatatggattgtagagactgtgaaaataagcagaagttgtgatcaaaattgg

SEQ ID NO: 87634 - DNA, 601 bp, Human
aagaatttcggaactggaaaggaagttaaaacctatctagtccagctcccccaccccagggaagaaatgacttacttaaatttgcctgcatagttagtggcagttctgcaaatcgtgcccacatctcaccaagcattggagagatggttggcacttgagtctcttcttaggactctacaggctctgtctggagtccttgtttctatgaagaccactaagaataaaggtaatacaggtgctgctgctgctgtattaaacagatggaaagaagtagacattcattgtatgtctgttatgtgayaggccttgtgacaggtgttttcacatagtttagcttggtcagtcatcaaaagctagaattcccattcctccatgagggagacagattgtttctaaataggacatttagcagaagctctttcctgtaagctctgaaaggcactcggtagtggatagatgcttccctcctagaacacgggtgtagggctctgcagagtagcatgcatggctcttctaagggatatggattgtagagactgtgaaaataagcagaagttgtgatcaaaattggcgttgggggacttgtggtcacccgagtgta

SEQ ID NO: 87635 - DNA, 601 bp, Human
ggcagggaagacaatacacaaatctgttaaatacacaataaaaatagcttatgatctatgggacttggtattaagcaagatgatattaacgaggtttgattgctgttctgaaatgtggcagctgcgcacacgtattggctgctttttctccccacctttggcagcttgtgagcggtgttgccatgacactccttgggctctgtttagatcagctattttctgaaggagtcgctgaccttccccacgatagaagctgttgatgtggtcacgtcagtgcctcttcgggagctgtgtgactggygagccctcagttgccacttggaaacggttggaaactgtagatcaggcacagacattgaatgtttaggagcaagaagggcttgtgaatatcccgtactctcatttgatgtgtgaggacagtgaggcgcattatgcggaggtgacttgctcaaggccacagagtgcatagagagaaggctgggagaggaggtcaggtcttgtttccctgcttgttgatgttccagctgcacggcactgagccctgcctgagtgcgcacttcagtcctgaaagctgcagagggatgggctggtgacactgccg

SEQ ID NO: 87636 - DNA, 601 bp, Human
tcgctgaccttccccacgatagaagctgttgatgtggtcacgtcagtgcctcttcgggagctgtgtgactggcgagccctcagttgccacttggaaacggttggaaactgtagatcaggcacagacattgaatgtttaggagcaagaagggcttgtgaatatcccgtactctcatttgatgtgtgaggacagtgaggcgcattatgcggaggtgacttgctcaaggccacagagtgcatagagagaaggctgggagaggaggtcaggtcttgtttccctgcttgttgatgttccagctgcccggcactgagccctgcctgagtgcgcacttcagtcctgaaagctgcagagggatgggctggtgacactgccgtgcctaggagtgggcagagaaggtgaagacacggagagtaactcagtgcagaggcagcgacgggaaagtgaaggagagtaagaagcccagagtaaatggccaaggtgccactaacatgtccatccacagaaacttttctgggggagaatgtttcttatcagattccgcagatgggttccttgagaagtgagtgcttaaaggggctgggatagataatcataatgccat

SEQ ID NO: 87637 - DNA, 601 bp, Human
gcgagccctcagttgccacttggaaacggttggaaactgtagatcaggcacagacattgaatgtttaggagcaagaagggcttgtgaatatcccgtactctcatttgatgtgtgaggacagtgaggcgcattatgcggaggtgacttgctcaaggccacagagtgcatagagagaaggctgggagaggaggtcaggtcttgtttccctgcttgttgatgttccagctgcacggcactgagccctgcctgagtgcgcacttcagtcctgaaagctgcagagggatgggctggtgacactgcygtgcctaggagtgggcagagaaggtgaagacacggagagtaactcagtgcagaggcagcgacgggaaagtgaaggagagtaagaagcccagagtaaatggccaaggtgccactaacatgtccatccacagaaacttttctgggggagaatgtttcttatcagattccgcagatgggttccttgagaagtgagtgcttaaaggggctgggatagataatcataatgccatgttctcactgctctgaacccttttctgacctcacgtaagacctcacctaaaacttccacaagagccgttca

SEQ ID NO: 87638 - DNA, 601 bp, Human
taagaagcccagagtaaatggccaaggtgccactaacatgtccatccacagaaacttttctgggggagaatgtttcttatcagattccgcagatgggttccttgagaagtgagtgcttaaaggggctgggatagataatcataatgccatgttctcactgctctgaacccttttctgacctcacgtaagacctcacctaaaacttccacaagagccgttcattgtcagtaccatgctttttttggagtactgtataatgtcaagtatttttccaatagtttatatgtgaaatgtggtctcygccacaagattacagggtcctcgggagcagaaattgtgacttaaatgggcctttctcccttccactttttattcttgccctaccttttaatcaggcacctggaagagatctaaacacaggatgagcatccagtaagtttttgttgagttgaacttagttggattcggatgacctctaaaaaatgtttactaattgctggtgaaaattggcaaatgattattttgtggaaaaatgttctcaccgaattagattttgttaagaattcttatgtgtgattatttttcataaacccaatacact

SEQ ID NO: 87639 - DNA, 601 bp, Human
taaatggccaaggtgccactaacatgtccatccacagaaacttttctgggggagaatgtttcttatcagattccgcagatgggttccttgagaagtgagtgcttaaaggggctgggatagataatcataatgccatgttctcactgctctgaacccttttctgacctcacgtaagacctcacctaaaacttccacaagagccgttcattgtcagtaccatgctttttttggagtactgtataatgtcaagtatttttccaatagtttatatgtgaaatgtggtctccgccacaagattacrgggtcctcgggagcagaaattgtgacttaaatgggcctttctcccttccactttttattcttgccctaccttttaatcaggcacctggaagagatctaaacacaggatgagcatccagtaagtttttgttgagttgaacttagttggattcggatgacctctaaaaaatgtttactaattgctggtgaaaattggcaaatgattattttgtggaaaaatgttctcaccgaattagattttgttaagaattcttatgtgtgattatttttcataaacccaatacactgtctattattatcc

SEQ ID NO: 87640 - DNA, 601 bp, Human
ttaaatacaggtttcatgcttcttttttgtacctttccaggcttttaaggaggagaataatttgaataataatggcataatgtccagagggaaagttgaatacgtaagacagagatgcatgtgggcctatttctgtactttgtgtgcgtgtctctgtgtggtggctttatggtttttaaaataaagttttctgtattttcaatgtatataataactttggaatcaccaaagaaaagttgatattgagacttgggtttttagtggggaggaatggatgttttttttcttttacagttttagkcaaagtgaaactttagaaaattatattatttgaagttagatggaaaccaaacactatctttatagtttctttcagaagaaactttgtcttaggaatctgggcactcttgtaaactttctaaatttcttcagccctcattgatacccacactttgcttaattcagttgaatcagtttacagtgaataacgtccctgggaacattaatcaatgaacacacacacgcgcgtgcgcgcacacacacacacagacacacacacacacacacacacagggaggacaaaaaggaaataaaagcatca

SEQ ID NO: 87641 - DNA, 601 bp, Human
ctttgtgtgcgtgtctctgtgtggtggctttatggtttttaaaataaagttttctgtattttcaatgtatataataactttggaatcaccaaagaaaagttgatattgagacttgggtttttagtggggaggaatggatgttttttttcttttacagttttaggcaaagtgaaactttagaaaattatattatttgaagttagatggaaaccaaacactatctttatagtttctttcagaagaaactttgtcttaggaatctgggcactcttgtaaactttctaaatttcttcagccctcrttgatacccacactttgcttaattcagttgaatcagtttacagtgaataacgtccctgggaacattaatcaatgaacacacacacgcgcgtgcgcgcacacacacacacagacacacacacacacacacacacagggaggacaaaaaggaaataaaagcatcactttgtaccttcctcaattcaaacctgtctgctttcttcagaatttcggatgtatgtgtctgtttcttccagtagattgggagcaccctgaagacagaagagacatatgtatatatatatatttttgtttgtttttt

SEQ ID NO: 87642 - DNA, 601 bp, Human
aagttatggtttagtaaacctgagagagtgtgggagaatttgtattgcactcccagatgatcctgaaactgtcattctgtgggcttatgtttattagcacttctttaaagcatagttcaagacctctgttttccaggatatttaactatcttagtccaaagtctttcctttcttccttgcctccttctctctctcctctttgtcttttcttcttctcttcctcccttctttctcccaccctcctctctctttcttctcatgaagtccatatgatatcctgtctgaattacataactttttytttctttttgtggagatggggtctcactatgctgcccaggctggtcttgaattcctaggctcaagcgatcctcccattgaagccttccaaagtgctgggattacagtcatgagccaccacatctggcctgaattagacaacttcttatttatgtggatctcagaagctccatcatccacttcttaagcctggtaaacacttttattagataagagagacagttttgcataaatgaacaaaaatctagatgaaaagttctcgaatcctgaatcacatcttgccataacctcttactagccg

SEQ ID NO: 87643 - DNA, 601 bp, Human
ctaaatgtacttcctttcctcccagagttcactgttcaataggggacacaaacacataaataactagctcttgcaccaagcgaaatgtacagtgcgacaaaggagaggtacagatagtaggctgtgggcccgaaggagggtttccgtgggcgtgagtatgaaggaggggtttcctgaaggagggggtatttgaacaacccttttgaagactaaaaggatgtccgcaaatgaaatttagggtagaaacatgccagaaaaaggcacagtgttttcaatacgctaggcatttcttaaactattyatagctgaggttatgggaaaagagatagtagaaatatgagaatatcttctccaaagattctatgctaatatcctgatccatctgactatgcttatttgactgctttttgtgtttgtcttcttctttactggatatcctttttgccgcttcctttctggaattttctttcctggccattagcctctctctcctacaccgttgcctcactctcactgccatactcctttggacatcctccttctcttgtttcctaatacttttacatccccttccatcctttactccttagcttttgttttt

SEQ ID NO: 87644 - DNA, 601 bp, Human
ttaaccttttctggaaggaaaatgcatgtggatttatcacgaaggtaccatcagcatttcaaatgctaagtcaaggtaaaaacgacactcttgtctgtcacaaaataacagtacaactagatgttcagcctcactgctctcagcaaagagtgagttccaatttgaggaaatcaggtaaattagaaaaggctgcagctggattagtggcttcactctttccctctaaaactgtaggagtttcatatttccatcaaggcagctcaggtccctagagcatgatgtttacccttacattttcctrggtgtatgggctctttacgtctttggtctctttgcaaacgccctccttcgactgagctctagaaagtactctgtcctgggctgagcgcagtggctcaagcctgtaatcccagcactttgggaggccaaggcgggcagatcacgaggtcaggagttcaagaccagcctggccaacatggtgaaaccccgtctctactaaaaatacaaaaattagccaggcatgatggcgggctcctgtaatcccaactactagggaggctgaggcagaagaatcccttgatcctgggaggtagaggttgca

SEQ ID NO: 87645 - DNA, 601 bp, Human
atcctccaacttaatgaaggtaatgacagtatctacctcaaggattactttggggattcagagttattaccaaaaatgtttaaggccctgcccgactcattgtttatgctcagttaatgttagctatctccatgcttttcagtcaatatattgcattgtgtttggaagtcttcatatctagtttcatacctgacacagacttgcttaacttctgccctggaatctttttgctatccctgtcttactgtctttaatagagcctttcttatttgatacttatttatatacttgccttcgttcrttttttagacaaattttattttcatatttgttgaattaaaccagacacagcttctacacttatggggtttcctttctgggagaatggggctggtgacaattaatgcagaaaacttttattggagatagacatgcaaaaacactcagagatagagttgaggaatttgtagtcattagaggagagagatgttagttttggctgggattggagttaaatggagagaaaataaaggaagactttctggaggaggagggttttgatctggaacctgcacgctcattagaatttgaattcgacctg

SEQ ID NO: 87646 - DNA, 601 bp, Human
ctagttgtttagaagtttctgagagggaatgagtgctggaaactctattttgtcatttgccaatgtaaccccacattggaattgtcttcagagataatgaagagccactgctaaaatcacagactcatgagatgtgaaagcggggaatctgtttagctcacatgcgtgtgagaaagctgagaccctgagacaaatattggcctgtgctgcaggctttcagttagacagggacagcatcagttctcattcccttgttagctctatgcctgatgtcttctcactgttttgctgcattataaakaattgattttttttttttttgagacagagtctcgctctgtcgcccaggctggagtgcagtggtgcgatctcgcctcactgcaagctccgcctcctgggttcaagtcattctcctgcctcagcctcccgaataggtgggactacaggcacccgccaccatgcccggctaattttttgtatttttagtagagacggggtttcaccatgttagccaggatggtctcgatctcctgacctcatgatccacccaccttggcctcccaaagtgctgggattacaggcgtgagccactgcacctggc

SEQ ID NO: 87647 - DNA, 601 bp, Human
cttttcgttaagctggaagggtcctcagagatcttgtccaagcccacccttgacagatgaagaaatagagggccagaaggctttagtaatctttccaagtctttttattagttactgacaaaatcagaactaaagtcaaggtctcttacttacctgtcatttacctgttcaatgcctcttttgtttgtacactctgttaaaaagaaagaggttaactgtttcttttggttataactgttatactacaaacacacacacactccacacacacacacacacacacacacacacacacacacasagagagagagagagagagagagagagaacagatgaaagccatgattaggaacattttatgctcaaggtgagaagaccctctataggacctcgaatgtcttcttttctaaagaacttcatctacctcgggtcagtcctttgatactattcactttgaaaactggtttacctgaaaggaagaggtgtgtgtgaaagagagggtcacccgccacattttatctctctgtcttatttcaggcagacagattcactacatcaagatggtgtttacagttatcgccatgagatgaactagctcatc

SEQ ID NO: 87648 - DNA, 601 bp, Human
tttcgttaagctggaagggtcctcagagatcttgtccaagcccacccttgacagatgaagaaatagagggccagaaggctttagtaatctttccaagtctttttattagttactgacaaaatcagaactaaagtcaaggtctcttacttacctgtcatttacctgttcaatgcctcttttgtttgtacactctgttaaaaagaaagaggttaactgtttcttttggttataactgttatactacaaacacacacacactccacacacacacacacacacacacacacacacacacacagasagagagagagagagagagagagagaacagatgaaagccatgattaggaacattttatgctcaaggtgagaagaccctctataggacctcgaatgtcttcttttctaaagaacttcatctacctcgggtcagtcctttgatactattcactttgaaaactggtttacctgaaaggaagaggtgtgtgtgaaagagagggtcacccgccacattttatctctctgtcttatttcaggcagacagattcactacatcaagatggtgtttacagttatcgccatgagatgaactagctcatctc

SEQ ID NO: 87649 - DNA, 601 bp, Human
gcagttctctgcctcagcctcccgagtagctgggattacaggtgcctaccaccacacccagctaatttttgtatttttagtagagacggggttttaccgtcttggtatgactggtcttgaactcctgacctcttgattcacctgcctcggcctcccaaagtgttgggattacaggcgtgagtcaccacacctggccagtcactaattattaatcacagcccacatttaactgagtacagtcattagtttcattctacagctatacagagagctcatgtaaattcctgaaggctgcaccgcstacaagtggtggggctggagttcgcacgttgctcttgtgccctggagtgatggcagcaagatagatgtgggtaactctctagcgatcccaggtgtgttatgttgtcagcatcctcatctaatcaacatgatgattatcattgagccttttaggttttcagttgttgttatcatttaactcctcaattagattccgagcatctcgatggtaggttttctgtactgcaatgtgtattgccagtgttttatgcaagatatgatgcaggctagtgtctcacagtttacgcaatttgttttccgt

SEQ ID NO: 87650 - DNA, 601 bp, Human
gcctcggcctcccaaagtgttgggattacaggcgtgagtcaccacacctggccagtcactaattattaatcacagcccacatttaactgagtacagtcattagtttcattctacagctatacagagagctcatgtaaattcctgaaggctgcaccgcctacaagtggtggggctggagttcgcacgttgctcttgtgccctggagtgatggcagcaagatagatgtgggtaactctctagcgatcccaggtgtgttatgttgtcagcatcctcatctaatcaacatgatgattatcattgrgccttttaggttttcagttgttgttatcatttaactcctcaattagattccgagcatctcgatggtaggttttctgtactgcaatgtgtattgccagtgttttatgcaagatatgatgcaggctagtgtctcacagtttacgcaatttgttttccgtccatcctttcgatcctttgagcctctcaaggaagcctgggttggcatctgcccaactgtgttgggcagaatggtttttttctcgttgcccgacatggggctgggaaagccatttgaggaggtcgctgtggcatgaatctggac

SEQ ID NO: 87651 - DNA, 601 bp, Human
actaattattaatcacagcccacatttaactgagtacagtcattagtttcattctacagctatacagagagctcatgtaaattcctgaaggctgcaccgcctacaagtggtggggctggagttcgcacgttgctcttgtgccctggagtgatggcagcaagatagatgtgggtaactctctagcgatcccaggtgtgttatgttgtcagcatcctcatctaatcaacatgatgattatcattgagccttttaggttttcagttgttgttatcatttaactcctcaattagattccgagcayctcgatggtaggttttctgtactgcaatgtgtattgccagtgttttatgcaagatatgatgcaggctagtgtctcacagtttacgcaatttgttttccgtccatcctttcgatcctttgagcctctcaaggaagcctgggttggcatctgcccaactgtgttgggcagaatggtttttttctcgttgcccgacatggggctgggaaagccatttgaggaggtcgctgtggcatgaatctggacaagtctttctataggggaaacctgtttcaagctgtggctctttcactttctacatgg

SEQ ID NO: 87652 - DNA, 601 bp, Human
ctgcaatgtgtattgccagtgttttatgcaagatatgatgcaggctagtgtctcacagtttacgcaatttgttttccgtccatcctttcgatcctttgagcctctcaaggaagcctgggttggcatctgcccaactgtgttgggcagaatggtttttttctcgttgcccgacatggggctgggaaagccatttgaggaggtcgctgtggcatgaatctggacaagtctttctataggggaaacctgtttcaagctgtggctctttcactttctacatggcatatggaccctgatttttctsacgcctgcgtaactctactggtgtctcttggctgtcgcagctttgttttgctttgccattgttttattttattttttctgaagacttggttttcttgggctctgcttatatacaacacaaaatttgtagaccatttgcttatgggaaagagtcacacccacggaaattgggagaaaattaactcttggagcccaaagaaactgacataaatcttataccacgaacatcttcaatttccgactttgccttccttctctgtatggtgctgtaccaagatctcttattgggaccaggtttcat

SEQ ID NO: 87653 - DNA, 601 bp, Human
aactgtgttgggcagaatggtttttttctcgttgcccgacatggggctgggaaagccatttgaggaggtcgctgtggcatgaatctggacaagtctttctataggggaaacctgtttcaagctgtggctctttcactttctacatggcatatggaccctgatttttctcacgcctgcgtaactctactggtgtctcttggctgtcgcagctttgttttgctttgccattgttttattttattttttctgaagacttggttttcttgggctctgcttatatacaacacaaaatttgtagacyatttgcttatgggaaagagtcacacccacggaaattgggagaaaattaactcttggagcccaaagaaactgacataaatcttataccacgaacatcttcaatttccgactttgccttccttctctgtatggtgctgtaccaagatctcttattgggaccaggtttcatggagggttactggtaactattaacccactcaatgtacttattttaccattaacctatcatgaatagcctgtccaatccccattaaatgacccactatgggggtcattaattcatttatttatatatgaatta

SEQ ID NO: 87654 - DNA, 601 bp, Human
tttagagtttccagtttttctgctctgtttttttcccatctttgtggttttatgtacctttggtctttgatgatggtgacatacaggtgggtttttggtgtggatgtcctgtctgtttgttagttttccttctaacagacaggaccctcagctgcaggtctgttggagtttgctagaggtacactccagtccctgtttgtctaagtatcagcagcggtggctgcagaacagcggatattggtgaaccgcaaatgctgctgcccgatcgttcctctggaagttttgtctcagaggagtaccyggccgtgtgaggtgtccgtctgcccctactggggggtgcctcccagttaggctacttgcgggtcagggacccacttgaggaggcagtctgcccattctcagatctcaagctgcatgctgggagaacctctactctcttcaaagctgtcagagagggacatgtaagtctgcagaggttactgctgtctttttgtttgtctgtgccctgcccccagaggtggagcctacagaggcaggcaggcctccttgagctgtggtgggctccaccgagttcgagcttcctggccgctttgtttaccta

SEQ ID NO: 87655 - DNA, 601 bp, Human
taactgggcaatggcaggcgcccctcccccagcctcactgccgccttgttgtttgatctcggaccgctgtgctagcaatgagtgagactccatgggcttaggaccctccgagccaggtgggggatataatctcctgatgtgccatttttaaagcccattggaaaagctcagtattagggtgggagtgacctgattttccaggtgccgtctgtcatccctttctttgactaggaaagggaattccctgaccccttgcaattcctgggtgaggtgatgcctcaccctgcttcggctcgtgcayggtgcactgcacccactctgctgcacctactctctggcactccccagtgagatgaacccggtacctcagttggaaatgcagaaatcacccatcttctgcgtcgctccctctgggagctgtagactggaggtgttcctattcggccatcttggctcctcctccctatgttccagacatatcattttcattccacatgtatttctttgtttattgagtgccttccatgtgttaattactttattggattcctgggggtgagaaggggaagggtgtgggcagggccactgcttacagctgctc

SEQ ID NO: 87656 - DNA, 601 bp, Human
agttgggagcagatcatggagattatgaatgcttggactttttctgagatgcagatgtttttgagaggggaatgatatgactagagatgtgtatttttctcccccataatgagaaaaattgatgaagctgtaaggtcccccaggttggtagtggagaaccaggtgtgaaatcatgaacaactccctcccaagtacttttccctcatattccactgcctcttactttttatgtttgttagctggagcaagtagaaaaagcacagatgatttgttttctgttataattattttttaaactacwagaggcatggtggaaaattaaactcgatagattatagttataaatgttgttctttgggcacttgccatgaggcagcattttcatggcaaaccctactttgtatatttttgtcatattatgagaaagaggccctcttctgggtcacatgtttgcctctgcaggactctgacctgtcattttagatattgagtctatccttgttttgatttcctttggactcatggccttgagtatgtcccttatgttcatttgacagattcctgccaatcaaatggaagacaaagctatcccgagggtagt

SEQ ID NO: 87657 - DNA, 601 bp, Human
gattaggaaactgaatcatacagtagttaagttgacttgcccaaggtcacagagctagtaggtgacagaacctagattcagaccctggactctaaccccagagcctatgtcttcatccttctgcattttcaaccttcatgcctgctttgcactattctagtttaccttttataggctctggagttgatggagtctcctttaataaatgggtagtggaggcccagagagaagtgaaacatgtctaagatggtcctgtgattaaagacacatagctgttaacgtgtgacacgaatgcaaacaccaaagtcagattatgaggctttaacacataatttctaaatttaatttaaaatgctcctttttgacctttacttctgctattgattttcatcttttctcttttctccttcttaccccttctcttctttcctcttctgctctcctttcttcctgcttttcctttctttcttcagcaaccattactgagcatttaccttattggaattattggattaggtggaattattggtaattgtgtgttttcatgttactaaaatggactgtccagctcttctgtggccaacatctctttactctagaa

SEQ ID NO: 87658 - DNA, 601 bp, Human
ttaaagacacatagctgttaacgtgtgacacgaatgcaaacaccaaagtcagattatgaggctttaacacataatttctaaatttaatttaaaatgctcctttttgacctttacttctgctattgattttcatcttttctcttttctccttcttaccccttctcttctttcctcttctgctctcctttcttcctgcttttcctttctttcttcagcaaccattactgagcatttaccttattggaattattggattaggtggaattattggtaattgtgtgttttcatgttactaaaatgractgtccagctcttctgtggccaacatctctttactctagaaggttctcaaaggagttaccacacatgaaagaaggttggggaaagcaaagtacccgaagccagtgctttacactggtacacaggagtaggtacccactttccgattcgggggactggattgtgtcattcattgaaatatgaaatagtgaaggaagcttcacttttatatcggttgggggtagcgtgagagttgtttgagcttttcacttttgagagcttttcaaatgaatcgccttatagttaaagctggagattagaa

SEQ ID NO: 87659 - DNA, 601 bp, Human
catagctgttaacgtgtgacacgaatgcaaacaccaaagtcagattatgaggctttaacacataatttctaaatttaatttaaaatgctcctttttgacctttacttctgctattgattttcatcttttctcttttctccttcttaccccttctcttctttcctcttctgctctcctttcttcctgcttttcctttctttcttcagcaaccattactgagcatttaccttattggaattattggattaggtggaattattggtaattgtgtgttttcatgttactaaaatggactgtccarctcttctgtggccaacatctctttactctagaaggttctcaaaggagttaccacacatgaaagaaggttggggaaagcaaagtacccgaagccagtgctttacactggtacacaggagtaggtacccactttccgattcgggggactggattgtgtcattcattgaaatatgaaatagtgaaggaagcttcacttttatatcggttgggggtagcgtgagagttgtttgagcttttcacttttgagagcttttcaaatgaatcgccttatagttaaagctggagattagaagaaagatca

SEQ ID NO: 87660 - DNA, 601 bp, Human
gctctcctttcttcctgcttttcctttctttcttcagcaaccattactgagcatttaccttattggaattattggattaggtggaattattggtaattgtgtgttttcatgttactaaaatggactgtccagctcttctgtggccaacatctctttactctagaaggttctcaaaggagttaccacacatgaaagaaggttggggaaagcaaagtacccgaagccagtgctttacactggtacacaggagtaggtacccactttccgattcgggggactggattgtgtcattcattgaaakatgaaatagtgaaggaagcttcacttttatatcggttgggggtagcgtgagagttgtttgagcttttcacttttgagagcttttcaaatgaatcgccttatagttaaagctggagattagaagaaagatcaagactaggaaactctttatttaaatgtcaatatttaattgacaattaactgttgttgatttaaattaaatatatatatatgtatagagtcttgctctattgcccatgttccagactcaagctatcctctcacctcagcctccagagtagctctgactacaggtgtgacc

SEQ ID NO: 87661 - DNA, 601 bp, Human
gcccagatgctcccttttaatctttcctaatgcaggccatagacattggtctcagaattcttgtaagtctacttttgtcactcaattgtgtgaattgtgtgtttgtacaggtctcctgcatttactaaatatagtggaaatcatatttgcctagagatcagtagacctgtgcattgaatctaggctttgttatttgctatttgtgtgattcattgattgattttctttcagcatcaaattctaagttaataaaatgagattaataataatgtctaccctgtctctctcacagaattggtgktcactttttaactgtgaataatggatgtgatggctctttaaaaagagccttttaaaacaaaatgaatacttttttctacatttacatgtgtaattatgatgtttgtttgttttttcccactctctgggttaactctaaactcctttggattttaaacgcctttggacacttttctttttaaccctccttcatacctaagacagtgctatgtatattgacatttaaatgtacagggctaattatggtttcgtttcttcacttttttgttgttgttgttgttccttttgttacacatttatt

SEQ ID NO: 87662 - DNA, 601 bp, Human
tttcaaaagaatttcaaaagcaatgaagaagaccactgttcagaacctcaatttctgaacctctccttacttttccttcttccttttcagccagtccttgctcaactctgaatatattttgacaatgtttcaattataatatatgcagaataatttacttctttcacttaacattatttttaaatgtcaatgttgctacatattccaaattactttggaattcattatatattattattcttttatttccactagatttatacttaagacagaatctcaagagtgggatatttgggtcaartagcatttacattttggctcttgaaataactaccagcatgtcatttccaaagagacgttaatcattgacaccaccagcagcaaatgttctcattcatcagaccacatttgttttacacgttcctctccttagaaagagataagtatggtttcttttctttagttcttgctaataggatacccaacatattcaaaatggtactccattgttttaattctcatcctctctgaccattagaaatattttgctccatgtgtctttgacgaagtttatgtattgttttatgaagtgtaaattctt

SEQ ID NO: 87663 - DNA, 601 bp, Human
cactgttcagaacctcaatttctgaacctctccttacttttccttcttccttttcagccagtccttgctcaactctgaatatattttgacaatgtttcaattataatatatgcagaataatttacttctttcacttaacattatttttaaatgtcaatgttgctacatattccaaattactttggaattcattatatattattattcttttatttccactagatttatacttaagacagaatctcaagagtgggatatttgggtcaagtagcatttacattttggctcttgaaataactamcagcatgtcatttccaaagagacgttaatcattgacaccaccagcagcaaatgttctcattcatcagaccacatttgttttacacgttcctctccttagaaagagataagtatggtttcttttctttagttcttgctaataggatacccaacatattcaaaatggtactccattgttttaattctcatcctctctgaccattagaaatattttgctccatgtgtctttgacgaagtttatgtattgttttatgaagtgtaaattcttgcccttgcccatttgatctattgagtttatgcc

SEQ ID NO: 87664 - DNA, 601 bp, Human
cttttccttcttccttttcagccagtccttgctcaactctgaatatattttgacaatgtttcaattataatatatgcagaataatttacttctttcacttaacattatttttaaatgtcaatgttgctacatattccaaattactttggaattcattatatattattattcttttatttccactagatttatacttaagacagaatctcaagagtgggatatttgggtcaagtagcatttacattttggctcttgaaataactaccagcatgtcatttccaaagagacgttaatcattgayaccaccagcagcaaatgttctcattcatcagaccacatttgttttacacgttcctctccttagaaagagataagtatggtttcttttctttagttcttgctaataggatacccaacatattcaaaatggtactccattgttttaattctcatcctctctgaccattagaaatattttgctccatgtgtctttgacgaagtttatgtattgttttatgaagtgtaaattcttgcccttgcccatttgatctattgagtttatgccttctttctttatttgggatccaaaatatttattaac

SEQ ID NO: 87665 - DNA, 601 bp, Human
gttgctacatattccaaattactttggaattcattatatattattattcttttatttccactagatttatacttaagacagaatctcaagagtgggatatttgggtcaagtagcatttacattttggctcttgaaataactaccagcatgtcatttccaaagagacgttaatcattgacaccaccagcagcaaatgttctcattcatcagaccacatttgttttacacgttcctctccttagaaagagataagtatggtttcttttctttagttcttgctaataggatacccaacatattsaaaatggtactccattgttttaattctcatcctctctgaccattagaaatattttgctccatgtgtctttgacgaagtttatgtattgttttatgaagtgtaaattcttgcccttgcccatttgatctattgagtttatgccttctttctttatttgggatccaaaatatttattaactctctgcctgacctatttgttccaaacattttttccaagtctgtttgcctttttagttatggtattgtatgtttgtgcatgtgtgtgtgtgtgtgtgtgtgtgtgtgtgtgtatagatctac

SEQ ID NO: 87666 - DNA, 601 bp, Human
tatgctatcttaagtctagagagctgggttctagtcccatttctgcttgtgacttagtctgtggccttaggaaaaggcttttcttatcgttgagtctcattttcctgcctttaatgacaaagaaattacaaaccttatatctgtaaggcacttaataatttgtcccctcttcttaaacttgtacaagtgaagttacaacattctatcaagttcagaacatgtagactgtaaaattttacacctacagaacatgtaggtgtaaaatagagtcacccataaatctattacccagatacaggtrcaatctatcatgatcatatttatgtattcctttcaagtctttagctattagcataaattacccatcatgctgtgtatctcttgacatcatacattaagcattttccatatcactgcatattcttgaatgattacaattttaataactttaatatttcattgagtgattgtgccatatcttaattgtttcattatttgaaaattttgcgatgattaacatttatgcataaatgtagcttacttcttcaataatcttatatatgatgtctgagggttgagacacacgggtcagaggttaatt

SEQ ID NO: 87667 - DNA, 601 bp, Human
atcacaggtgatatcgaatctgctttacttggcgttggctacttgtaaagtcaagatctttcatagactcataaaagcttgtgagcagagttgtcatttgtaccatctaattccatcactacatttttcgagaaggacacaagatttcagagataacggaagttacacagtgggctcatggcggagctaagactagaagctgggtctgaattctgaagatcaggcatctttccactaaatactgagatgtgaacaataatggagagccgtatagcccagaggggaaaccacattataccastttagtggatgattaggaaagcagttttgaaattccaggaaggtactgacttttgtataaagagaatgttttaaaaaaaaaaaccttcaaagttataggagagtgttatttaaattgtaacagcttgtttaaatgaagaaaatgttgctaagggacatgaatgctaaacgttagtctgccatcagctacttctgatgtttaagtcaaatagtccctcagttctgtggtgttaatctacgtcccttttctaatatcattcatttattcagtgcacactgaccaagagctaggccttgagtt

SEQ ID NO: 87668 - DNA, 601 bp, Human
atactgagatgtgaacaataatggagagccgtatagcccagaggggaaaccacattataccactttagtggatgattaggaaagcagttttgaaattccaggaaggtactgacttttgtataaagagaatgttttaaaaaaaaaaaccttcaaagttataggagagtgttatttaaattgtaacagcttgtttaaatgaagaaaatgttgctaagggacatgaatgctaaacgttagtctgccatcagctacttctgatgtttaagtcaaatagtccctcagttctgtggtgttaatctaygtcccttttctaatatcattcatttattcagtgcacactgaccaagagctaggccttgagttagttgccaggaagatatagggactaatacaatgtcatttaaagattaatagaaatgctctaagtcaattattctcaacccttgaatcagagtatatacataaagatccccatatgaggttagtgtgcagactgttttgataaacactactctaagtttattgcactggatgttggataatatgatgtaacggttgtttgtttttcagttttggtgatctatataaatctttttagaag

SEQ ID NO: 87669 - DNA, 601 bp, Human
atggtggttgtgtattctcagagcctctctggaaatcttccctttcacttcttgctttcatgatgattatgaacttcaagtgaaacctagctagaatgaggggaagtaagagcagtgtaaatcttggtccagcaacaccagttctcaccactgcttatttttgtgtttacatgggtctctcttagaagccaagagccccaatgatatgtgctagttcatctgttcattaaacttgtgaagtttcatcaaacccatttatcaaaatgaagggctgtaatgaagattttagagaaagaaagcmctctaaaatattagagctgattgggactttacaggtattcattttgcaaatgagtgtcatctcttgttaaaggtcacacttatatagctgagactagaactggggccacagggactctatgtctatactattggatttatcactttccttggatccatcctacatgattcaatttttaatacctggagttttcactcttgttatcttcctattcaaggataaaagctctagcttcttatctttatataaaacctttaaaaggcagaactcatgttatcttttaaaactttcccctaactg

SEQ ID NO: 87670 - DNA, 601 bp, Human
gaacgtgaagagagggaaacgacattgttgatggtgaacacagcatgagcaagggttcagaatcttgaaaacttattataaatcctgggaatggggtcactgggtcactgctgacatgcagaagaatggtaagagaagatactgaggaggacatctgcaaacaaatgattggtcagaagatgggcctctcaggaggagcagctggaggtgcttcttcatggagggcagcatgcgggtaatttatgatgctggggataactgaaatgactgtggagccaatgatttgcatattgatacttayattttatttatactctcccagaaattgcctgtttctttatatctgtgctatatccgaaaagccaagatgatacagtcagtcagtaacttgggattactatgaaaaatgtgaatctttgcttaagaaaatactgcatcctatattaaccaatttttcaaccttttattataaaatgactttagatttatagagaccttccaaggatagtattaagccattttaaaaattataattaacatttatactaccaatgtgcataatgcattaaaagttttaaacctttacttgatcccttttatt

SEQ ID NO: 87671 - DNA, 601 bp, Human
gatgctggggataactgaaatgactgtggagccaatgatttgcatattgatacttacattttatttatactctcccagaaattgcctgtttctttatatctgtgctatatccgaaaagccaagatgatacagtcagtcagtaacttgggattactatgaaaaatgtgaatctttgcttaagaaaatactgcatcctatattaaccaatttttcaaccttttattataaaatgactttagatttatagagaccttccaaggatagtattaagccattttaaaaattataattaacatttatrctaccaatgtgcataatgcattaaaagttttaaacctttacttgatcccttttatttcacacttatattcactttagtcatactgaaagcaaaccagtcacttttatcccaatttagtagaagaccaagcctcaattaaaagcaaaagcaaaaccaaaattggcatttctcagccatgtgagatgggtttggttttggtatttagaaaaaaaaaatcatctgaagttattccaaatgaacagctaaatttaaaaaccacgagtaaaacagacattcattggtagtttttctatattggtt

SEQ ID NO: 87672 - DNA, 601 bp, Human
tgtttccaaaataaactttcagtggttccttaatgcctgaagaataaatttaaactcaactgtggctgctgagctgtctgtgctttggtttcaacccaccttttagttcttttgcttgctactttctgttattcgccctccaagcacactaaacgtaaatgctgtgtacttttctgcctgtataattttgccaacatttttcaggttcaaccctacttagcactcaaacccagtctgtatatcacctcatcaataaaatcttgttaattctgcccccaccaagaagtgagcctatcttttyctgcatctcagcaacacttgttcttaacctcacttaggtaacttagcacttcatttaggcataaccatttaattggtgagataattaatttaatagattattaataaaattcaagctcttttccatcctcctaccataaaatctccttcaagttaggaaccatttcttattcatatctatttcccaagagtggctaggcactaaaataggtaactattggaagggagatattcaagtttgaggcagtgttctcttcctgctcctcctctttctctttctttctttctttctccttttcct

SEQ ID NO: 87673 - DNA, 601 bp, Human
tgagcctatctttttctgcatctcagcaacacttgttcttaacctcacttaggtaacttagcacttcatttaggcataaccatttaattggtgagataattaatttaatagattattaataaaattcaagctcttttccatcctcctaccataaaatctccttcaagttaggaaccatttcttattcatatctatttcccaagagtggctaggcactaaaataggtaactattggaagggagatattcaagtttgaggcagtgttctcttcctgctcctcctctttctctttctttctttctttctccttttcctctccttcctccttttcctcctcctctttctattcatgattcctctgcctcttcatttttctttcttccattttctttcacccttctttccagagaactttatcaggatgcatttagtatggattaaggtgaaatagcaatgaaatgaggagtattgtcttcgttttcatgcttccataaaaacagtgtttctttttcattgcagattccaacaatgtctcacccatcttggctgccacccaaaagcactggtgagcccctcggccatgtgcctgcacggatggaga

SEQ ID NO: 87674 - DNA, 601 bp, Human
gcatctcagcaacacttgttcttaacctcacttaggtaacttagcacttcatttaggcataaccatttaattggtgagataattaatttaatagattattaataaaattcaagctcttttccatcctcctaccataaaatctccttcaagttaggaaccatttcttattcatatctatttcccaagagtggctaggcactaaaataggtaactattggaagggagatattcaagtttgaggcagtgttctcttcctgctcctcctctttctctttctttctttctttctccttttcctctycttcctccttttcctcctcctctttctattcatgattcctctgcctcttcatttttctttcttccattttctttcacccttctttccagagaactttatcaggatgcatttagtatggattaaggtgaaatagcaatgaaatgaggagtattgtcttcgttttcatgcttccataaaaacagtgtttctttttcattgcagattccaacaatgtctcacccatcttggctgccacccaaaagcactggtgagcccctcggccatgtgcctgcacggatggagaccacccattcctttggg

SEQ ID NO: 87675 - DNA, 601 bp, Human
catcctcctaccataaaatctccttcaagttaggaaccatttcttattcatatctatttcccaagagtggctaggcactaaaataggtaactattggaagggagatattcaagtttgaggcagtgttctcttcctgctcctcctctttctctttctttctttctttctccttttcctctccttcctccttttcctcctcctctttctattcatgattcctctgcctcttcatttttctttcttccattttctttcacccttctttccagagaactttatcaggatgcatttagtatggatkaaggtgaaatagcaatgaaatgaggagtattgtcttcgttttcatgcttccataaaaacagtgtttctttttcattgcagattccaacaatgtctcacccatcttggctgccacccaaaagcactggtgagcccctcggccatgtgcctgcacggatggagaccacccattcctttgggaaccccagcatttcagtgtctacacaacagccacccaaaaagtttgccccggtagttgctccaaaacctaagtacaacccatacaaacaacctggaggtgagggtaagtgctgggatttca

SEQ ID NO: 87676 - DNA, 601 bp, Human
ttgctccaaaacctaagtacaacccatacaaacaacctggaggtgagggtaagtgctgggatttcagagttggttacttggagtaggaaaattcagttatataggtgatttgtagtacaaagttgtgtcagaaaaacgtagtttgtgaattcacagcgtgggtgtcataggctactaaaagtaaaggagcccccggaaatagtctagaccaaccccgtcttttaggaaaaagactttttatgggttatatggctatggttacataatgaaatagggttagagctcaaactagaaacctggmctctttagtcacagctcaatgcctttctactgcgttatcttccacctccagctcattctcttgtagggttttagctaccagacagtcatccctccctcttgccgttggacaaatgtccacaaatgctgccaagcagtagtccaatcagaaacttatacaaagtgaacctaataaagtgcatggaattgtttacctcctctggctgtttttcttcccttaggctgctgaaggataagttgtctagagtgttctgtgagatctgcatttgttgaatctcccagacaaatatgagtgaagcct

SEQ ID NO: 87677 - DNA, 601 bp, Human
ggctgtttttcttcccttaggctgctgaaggataagttgtctagagtgttctgtgagatctgcatttgttgaatctcccagacaaatatgagtgaagcctagttccaggggttttaataacaatgcattcagtttacatcaagtagagtttgaaggtctacgtgagctccagctctcatgtgtatgtatacactcacacacgaagcctcagaggcagtataaatggtaccatactctttggttgaaaaggttccatatttttaccagtgaatgttagcagcttattcaaactcaagaaaamataacttaaaataaaaaaaaaaaaaactgaagaatattagacttctaggagctgagagagaagaggcagtgaaaggagatttaactccctttgttttctgtccctgtcccaccattaaaaaaattattaatatcttaccctcttcatgatgtttccagttgcttcttggatgacattaatgtttgttttgtcaatattgcacgcaagtgtttcacactctgtgatatagtccagtcctcctcttttctttcctgtcctctcctgcgcccaggaaacactttactagtctgttagtatttt

SEQ ID NO: 87678 - DNA, 601 bp, Human
cccttaggctgctgaaggataagttgtctagagtgttctgtgagatctgcatttgttgaatctcccagacaaatatgagtgaagcctagttccaggggttttaataacaatgcattcagtttacatcaagtagagtttgaaggtctacgtgagctccagctctcatgtgtatgtatacactcacacacgaagcctcagaggcagtataaatggtaccatactctttggttgaaaaggttccatatttttaccagtgaatgttagcagcttattcaaactcaagaaaaaataacttaaaataaaaaaaaaaaaaactgaagaatattagacttctaggagctgagagagaagaggcagtgaaaggagatttaactccctttgttttctgtccctgtcccaccattaaaaaaattattaatatcttaccctcttcatgatgtttccagttgcttcttggatgacattaatgtttgttttgtcaatattgcacgcaagtgtttcacactctgtgatatagtccagtcctcctcttttctttcctgtcctctcctgcgcccaggaaacactttactagtctgttagtattttgggtctgatgcca

SEQ ID NO: 87679 - DNA, 601 bp, Human
tcaagtagagtttgaaggtctacgtgagctccagctctcatgtgtatgtatacactcacacacgaagcctcagaggcagtataaatggtaccatactctttggttgaaaaggttccatatttttaccagtgaatgttagcagcttattcaaactcaagaaaaaataacttaaaataaaaaaaaaaaaaactgaagaatattagacttctaggagctgagagagaagaggcagtgaaaggagatttaactccctttgttttctgtccctgtcccaccattaaaaaaattattaatatcttaccctcttcatgatgtttccagttgcttcttggatgacattaatgtttgttttgtcaatattgcacgcaagtgtttcacactctgtgatatagtccagtcctcctcttttctttcctgtcctctcctgcgcccaggaaacactttactagtctgttagtattttgggtctgatgccagaagcctagttcagatgtctagcttgtgtaaggtgaacacctaggttgggtggtagagaggatcaggcttcagcatgcatggctaagctgcagctgtggatctttggatatccttttcctcagaa

SEQ ID NO: 87680 - DNA, 601 bp, Human
agtgaatgttagcagcttattcaaactcaagaaaaaataacttaaaataaaaaaaaaaaaaactgaagaatattagacttctaggagctgagagagaagaggcagtgaaaggagatttaactccctttgttttctgtccctgtcccaccattaaaaaaattattaatatcttaccctcttcatgatgtttccagttgcttcttggatgacattaatgtttgttttgtcaatattgcacgcaagtgtttcacactctgtgatatagtccagtcctcctcttttctttcctgtcctctcctgygcccaggaaacactttactagtctgttagtattttgggtctgatgccagaagcctagttcagatgtctagcttgtgtaaggtgaacacctaggttgggtggtagagaggatcaggcttcagcatgcatggctaagctgcagctgtggatctttggatatccttttcctcagaaagtacaagaacgagaccctcagaaagctgctcttgaaaaacaataaatgaagcctttggtgctgtactaatctctgtagcactccatgatgttttattgccttagaaagagactgcatctttgcagt

SEQ ID NO: 87681 - DNA, 601 bp, Human
tgtggatctttggatatccttttcctcagaaagtacaagaacgagaccctcagaaagctgctcttgaaaaacaataaatgaagcctttggtgctgtactaatctctgtagcactccatgatgttttattgccttagaaagagactgcatctttgcagttaatcaagcacttagtggaactggctttctttgactcatccttctttagtgacttcagggcttgggaatgggatctggaagagaatctctcttcatagggacaggaggagccatatgttggcttcctcatttatggttttttktttttttttttttttttttttttttttttttttgagatggagtttcactcttgttgcccaggctggagtgcaatggcattatttcggctcactgcaacctccgcttcccgggttcgagtgattctcagcctcagcctcccgtatagctggattacaggcatgcactaccatgcttgactaattttgtatttttagtagagatggcgtttctccacattggtcaggctggtcttgaactcctgacctcaggtgatctgccagcctcggcttcccaaagggctgggattacaggcgtgagcc

SEQ ID NO: 87682 - DNA, 601 bp, Human
atctttggatatccttttcctcagaaagtacaagaacgagaccctcagaaagctgctcttgaaaaacaataaatgaagcctttggtgctgtactaatctctgtagcactccatgatgttttattgccttagaaagagactgcatctttgcagttaatcaagcacttagtggaactggctttctttgactcatccttctttagtgacttcagggcttgggaatgggatctggaagagaatctctcttcatagggacaggaggagccatatgttggcttcctcatttatggttttttgttttkttttttttttttttttttttttttttttgagatggagtttcactcttgttgcccaggctggagtgcaatggcattatttcggctcactgcaacctccgcttcccgggttcgagtgattctcagcctcagcctcccgtatagctggattacaggcatgcactaccatgcttgactaattttgtatttttagtagagatggcgtttctccacattggtcaggctggtcttgaactcctgacctcaggtgatctgccagcctcggcttcccaaagggctgggattacaggcgtgagccaccgc

SEQ ID NO: 87683 - DNA, 601 bp, Human
tccttttcctcagaaagtacaagaacgagaccctcagaaagctgctcttgaaaaacaataaatgaagcctttggtgctgtactaatctctgtagcactccatgatgttttattgccttagaaagagactgcatctttgcagttaatcaagcacttagtggaactggctttctttgactcatccttctttagtgacttcagggcttgggaatgggatctggaagagaatctctcttcatagggacaggaggagccatatgttggcttcctcatttatggttttttgtttttttttttttttktttttttttttttttttgagatggagtttcactcttgttgcccaggctggagtgcaatggcattatttcggctcactgcaacctccgcttcccgggttcgagtgattctcagcctcagcctcccgtatagctggattacaggcatgcactaccatgcttgactaattttgtatttttagtagagatggcgtttctccacattggtcaggctggtcttgaactcctgacctcaggtgatctgccagcctcggcttcccaaagggctgggattacaggcgtgagccaccgcacctggccctc

SEQ ID NO: 87684 - DNA, 601 bp, Human
ccttttcctcagaaagtacaagaacgagaccctcagaaagctgctcttgaaaaacaataaatgaagcctttggtgctgtactaatctctgtagcactccatgatgttttattgccttagaaagagactgcatctttgcagttaatcaagcacttagtggaactggctttctttgactcatccttctttagtgacttcagggcttgggaatgggatctggaagagaatctctcttcatagggacaggaggagccatatgttggcttcctcatttatggttttttgttttttttttttttttkttttttttttttttttgagatggagtttcactcttgttgcccaggctggagtgcaatggcattatttcggctcactgcaacctccgcttcccgggttcgagtgattctcagcctcagcctcccgtatagctggattacaggcatgcactaccatgcttgactaattttgtatttttagtagagatggcgtttctccacattggtcaggctggtcttgaactcctgacctcaggtgatctgccagcctcggcttcccaaagggctgggattacaggcgtgagccaccgcacctggccctca

SEQ ID NO: 87685 - DNA, 601 bp, Human
tcagaaagtacaagaacgagaccctcagaaagctgctcttgaaaaacaataaatgaagcctttggtgctgtactaatctctgtagcactccatgatgttttattgccttagaaagagactgcatctttgcagttaatcaagcacttagtggaactggctttctttgactcatccttctttagtgacttcagggcttgggaatgggatctggaagagaatctctcttcatagggacaggaggagccatatgttggcttcctcatttatggttttttgttttttttttttttttttttttttkttttttttgagatggagtttcactcttgttgcccaggctggagtgcaatggcattatttcggctcactgcaacctccgcttcccgggttcgagtgattctcagcctcagcctcccgtatagctggattacaggcatgcactaccatgcttgactaattttgtatttttagtagagatggcgtttctccacattggtcaggctggtcttgaactcctgacctcaggtgatctgccagcctcggcttcccaaagggctgggattacaggcgtgagccaccgcacctggccctcatttatgtt

SEQ ID NO: 87686 - DNA, 601 bp, Human
aagtgatttgtttgcgtgccctgcagcacagtccttggtcccctctcaacatgccaccccacacgtttttgttacctgaaaattctatttgtatcactttctccaaaatggctaggtgcagcctaggtcagaattaatcgctccctttcccgagtttccacatcttattctttgacttatccaaatttctaccacttttgttattgctcctgcttacattctgtcccatattgaacatgtagtatatgccaggctctatgctttctctttattattttattgccttcttatgtaaccctamaaaatgtttttttttttttcttataaagaaatggaagcttaaaggaggtgacattctctatgatttgcttggagtatgtttctgaactaaggctgctgtccatatccagcatgcggtactgcctgtccttctattcacagcacatgtggcagcaaaccccatattacagtgatacatccctgcatcccttataagaatatatataagctttgcttcctcattgaagcaacaagacatggtttctcactcgtccttatgttcctcatagctcatattatgctactgtgtttttagtaggaa

SEQ ID NO: 87687 - DNA, 601 bp, Human
ttgtttgcgtgccctgcagcacagtccttggtcccctctcaacatgccaccccacacgtttttgttacctgaaaattctatttgtatcactttctccaaaatggctaggtgcagcctaggtcagaattaatcgctccctttcccgagtttccacatcttattctttgacttatccaaatttctaccacttttgttattgctcctgcttacattctgtcccatattgaacatgtagtatatgccaggctctatgctttctctttattattttattgccttcttatgtaaccctaaaaaatgtttttttttttttcttataaagaaatggaagcttaaaggaggtgacattctctatgatttgcttggagtatgtttctgaactaaggctgctgtccatatccagcatgcggtactgcctgtccttctattcacagcacatgtggcagcaaaccccatattacagtgatacatccctgcatcccttataagaatatatataagctttgcttcctcattgaagcaacaagacatggtttctcactcgtccttatgttcctcatagctcatattatgctactgtgtttttagtaggaatggttgc

SEQ ID NO: 87688 - DNA, 601 bp, Human
ctccaaatcaaaaaataaaaagatacaacaaacaacaaccaccccacccccaaaaataaaacaacaacagcaattaaactcagtcttagactttgatggcagaacagtatagttctttttctgtttttggtaaatagcaaagcaaatgaactttcctactgtactaatataattttttaaagatggtttttgaaattatcttactaatacactctggggattagtgttaggttgcctttaatggcaaaaaccacgattacttttgcaccaacttaataactctctctctctctttctctgcctctctctctctctctctctctctctaatttggctgaatgaaatttgataatactttttatccatcattaaaatagataatcatttggaaagatttgtaaagttcacgtttgtgaagctggagttgtcttgtggcctagaattcactttctttaatttctgaaattctttttaaaaaacatttttatgttagatttttgaaaaaacaaattggcatgacatgccagttctcactctttttctttctccctctctctctctaaatataataacctttaccttttctgagtatacaagagga

SEQ ID NO: 87689 - DNA, 601 bp, Human
agattttgtgccagatactcttctaggggctgaagtaatggcactgagtgaaacagagactagttcctgccctcttgggatgtattttcttgctataataaaaataacattattaataataatagtgataacatttgtgaaataaaatttatttaataaatgcattttataaccttacatataattaccaataactattcaaaattataaaaaatactttaatataggttaagtaactctaatccaaaaatctgaaatcttaaatgtgaaaaaatctgaaactttctgagtgctaacacartgctcaaaggaaatgctcacaggaacattttggatttcagtattgtggattagggttgcttagctggtatgtgtaaatattccaaaaatccaaaaaatctgaaatttgaaacacttcatgtcccagatgttttgtatatgcgatacttagtctgtagtaatgaatatgtgataatataagtataataataatttagcatgttatccataagtactcatgtcattagcttctaacaacagtgatagagatcacaatgcctcaacactatataaactgtaaaattctagaaccagggtgaat

SEQ ID NO: 87690 - DNA, 601 bp, Human
ggttcaaaaacaataattaatgctgatttgtgtggtgagatacatattaatcatctttatttttgaattatacaaatatacaatactattgtccctccgtattttacatctgaagagaatttaattgcttttttgataataaaaataaacagagagccacaaagagatatcaccacacatgtattagaaaagctaaaataaaaatttgtaccagatgctgctaaggatgtggagaaatgatctctcacaatgctggtaggcatgtgcaaaattttgtagccacgatggaaaactctttggyggtattttacaaaagtaaacatgtactaaccatatgactcagcaaatataccctttggcatttaatccagagaatcaaaatgttatgttcacgaaaaaacctgtacatggatgttcatagcaacttttttttttttatcataatgacaaaacactggaaacaacccaaatatcctttgatgggcagatgtttcagtgaagtctggtacagccatacaatggaataataccattcagcagtaaaaaagaatgaagtattgttggtatatgcaataatctggacatgcttaatgaaaaaact

SEQ ID NO: 87691 - DNA, 601 bp, Human
caaagaggacgcagcaagagtctttgtatgggtggaacagatctgtacctcaattggagtgatgattacatgaatctatacatgggataaagttacatagaactgtatgcacacacaaatcaatgcaggttataaaatggtaaaaactgagtaactcctagttaacaataaggtaacaatgtcagtttgctgggttttcgaatgtattacagctttatgagcattaccatttagggaacctgggtaaaatgtacatggaaactctgtactatttttgcaactttctatgagtccatatttaaaaaaaaattaataatagtaaaataaaggaatgcatatagatatcttaatgtattcttctcttactcaaagtgctatcttacatgccatctgaattgcttgcatgatactttgaaagatcactgctatatgtatccctgccaaaatgtatggcttaaacctgtggttttcaaagctggccagtcatcagaaagacttggagaacatttttcaaaagaaaaaaattaaagcaagtcctaggtcccatcacaattttacagaatcaaaatatctggccatggggcccaggaatctgcattaa

SEQ ID NO: 87692 - DNA, 601 bp, Human
aaaataaaggaatgcatatagatatcttaatgtattcttctcttactcaaagtgctatcttacatgccatctgaattgcttgcatgatactttgaaagatcactgctatatgtatccctgccaaaatgtatggcttaaacctgtggttttcaaagctggccagtcatcagaaagacttggagaacatttttcaaaagaaaaaaattaaagcaagtcctaggtcccatcacaattttacagaatcaaaatatctggccatggggcccaggaatctgcattaaaacaaagcaaaataaaaaayaaaacagaacttcccgggaattgtgattgatgctcaaccaacgtttgggaaccactcatttatttcattaacttcagggaccagtgccttaatctcctttgaaccttctccaagtcctgagagtgtactcttcctcccgtagttaatgatggtagcttttgaagtcttgagagtctttatcttgtgaacattgtacagattcagagacctagagcatccttcatgttgctattcttttccctcagtgctttcattatagacaccaatcgtttgcatatgttgtcctgggtcattttattt

SEQ ID NO: 87693 - DNA, 601 bp, Human
gagactgaggcaggcgaatcacttgaacacagaaggtggaggttgctgtaagccactgcattccattccagcctaggcgtcagagtaagactccatctcaaataaatgaataaataaaaataataaataaatatatgaataaatgaaatagagatatttgtatcttaaagagttgttttcaaagttaagtcatgacaaaataatgacaaaatcagtggaagctgcaatcattgttcttgctattattattgaaatgaaaatatgaacattagctctgagggttctatccatagtttttttwaaaaaattctgattataaaattttaattataaaatcccatatagctcatgctgaccatttaaaaaataatcttagttgtatccttgtttctttttgtatttgctaatagagattttagaattggcttggtgtatgtttgtccttgctagaattatgattccttttttgaatttgcattacacctttgttagaagtagaattactttacttgaactttgtcaatgtggcaaaaaatgattcatgtttatattatctctttgaaaagtagtgtttttactattgaactataagtacagttaa

SEQ ID NO: 87694 - DNA, 601 bp, Human
tccttttttgaatttgcattacacctttgttagaagtagaattactttacttgaactttgtcaatgtggcaaaaaatgattcatgtttatattatctctttgaaaagtagtgtttttactattgaactataagtacagttaaaatgtaaatgaacatttcagaaagaaactattgatttttattaattaaagaaattaattttccaaaatgtcagttgctacagagagattttagggattattaactacacaatctcagaaaaattaatttaattagggattttattttgggttccattcrtttttgagattcatattttggattaagccagtctcctgaaattgtatttaaacttagtctgcgtgtatgtcttttttagggaaagcattcacaacaccatcagaccctcgaagagattcttaacttacccattaagaaaagtaacatctctgtctaggggtcaccagtctctcaagccagttatattgttgctgcttgaataaacaaaacaggtttttatttctgctcttaccaacattactaggctgtgtttgtagcaaaaactgagtatgtggtggtggtagtaactacagtagaaag

SEQ ID NO: 87695 - DNA, 601 bp, Human
tggtgaggtggcttgccccagaccatacaggtaaaaagtagtccagagtagattcaggcataacttgtttgaaccaaattgtgttctttagactgcaacatgctttctgttccttagcatgtaactattacccatgtatttttatttatttttcttttacgtgaatttaaaatgtcatatttgttctgcttctattactgcagtcttgaatgatgattcatcagtgcagtggcctattttagtgaaccacaatagcttgggtagaaagaaaaaagatccaacatacacaggaatggaaagsagccatctttttatagctaaaattgcaaacatctggcaattactctattctacctcccttcaaaaaagaagaatcatcccttcaactggagcctgccactgtgtttaatcaaggcagaaagcaagccttaaggagcaataggttttgattcaaggaggccattgcctaacctagttggccaaagtctcttcagaaaataccccatttagtgctccccataagctactgggttatataatgatagtaatggtaatatagcaattaataactgcagaaatccccttttgtttttctgctgtt

SEQ ID NO: 87696 - DNA, 601 bp, Human
aagaaaaagaacaggaactcctaacaacctaaaatgcatgccttgtgcaatatagttatcccatgcagagctacatagtgtaacgatctctggaatctcaaatgaatgtgctcccttttctctgtcttcattcagttggatagttctggtcttcctccctcgtgtgcacatctttgaacttgaactactgtattacagccagtgttctaacctatatgcgtttctctttggtggccctgctaatatagaagaggttacgctaatgttccttaccatatttttctttttggtgtcttctttttgtgtgtgtgtgtgtgtgtgtgtgtgtgtgtgtgtgtgtgtgtttttaattgtactttaacttctaggatacatgtgcagaacgtgcaggtttgttacataggtatacacatgccatggtggtttgctgcacccatcaacccgtcatctacattaggtatttctcctaatgctatccctcccctaggcccccaccccctgacaggacatagtgtgtgatgtacccctccctgtgtccatgtgttctcactgttcagctcccacttatgagtgagaacatgtggtgtttggttttctgttc

SEQ ID NO: 87697 - DNA, 601 bp, Human
gcccagagaggaggaatctatagcggcagtctgtctacagtgcctttgtggcactgtggtgggctttgtcctgttctaacttcctgggggctttgtttacactgtgatgggaaaaccacctactgaagcctcagtaatggtggacgcccctccccccaccaagctggagcatcccaggtcaacttcagactgctgtgctggcagtgagaatctcaagccagtggatcttagcttgctgggctctgtgggggtggggtccactgagttagaacacttggctccctggcttcagtcccctttccaggggagtgaacggttctgtctccctggcattccaggagccactggggtatgaaaaaacaaagtcctgcagctagctcggtgtctgcccaaacggtcacccggttttgtgcttgaaacccagggccctggtggtgtaggcacccaagggaatctcctggtctgtgggttgcaaagaccatgggaaaagggtagtatctgggccagagtgcaccgtttgtcatggcacagtctctcatggcttctcttggctaggagagggaattccctgaccccttgtgcttccagagtgaggtgatgc

SEQ ID NO: 87698 - DNA, 601 bp, Human
cagaaatcacccaccttctgagttgatctctctgggagctgcagactggagctgttcctatttggccatcttcatcctaagtcccatatttttcttttactttgggacttggaatctacaaatgttccggaatacagacagtattgtattgcagtggactttacatgtttatagtggttctctatcctcttaacactggtaataatcacctggggaacttcaaaaaatttccagtcttgggtctcaccctcaagtattgtaatgtaattgctctgggatgggcactatatatatatatatwttttttttttttttaacactatccatttttagaactgctaaggtaggccaatctctcactgatgcttgaattcatataatcactgtcaaggtgtttttcaggcttatattgagtatttctagtgcaggaaactgaaagaacgctttctgtcttaaggaagttctgattttttgagagatcagatttattattatttaaattctgccttcataacatgagattatcttttagtcttataaatttataatttctagccatggagtttagttagtacttaaaattgtaactacctgcccttca

SEQ ID NO: 87699 - DNA, 601 bp, Human
ttaattgccttgggagaaaacaaaagcaaaaatgtaaggcctgggatttctatgcaaaaggccaaaaagggcttttggtgagattttaaaaatagaaaaccaattagaaaataattaggtgtatagtggtaggcccagacttgaatttcagtatgaattttgaaaaagaatatatattttaaggcctacaagggcaaaagtagatgggctttaaagtttgtgtaggtaagattgtctgtgggtgaagatgggtagtgggatggtgagcaggcagagtggggttggggtgtggggtggcacrgccagctttaatggagacaggcgacttcgatggggggtaggacatgaggtgcacagagcaacagttttcagaggtgcagtagggatgatccaggggatcagagaggaaaagagtaaagactctgccaacctttcagcctggagcctagagccacagtgtgagttaaagatgtaaattccttggaattaagaaccataccttatttagccatttatacagctgcttaccatggtaataattagaaattaagatgatgatcttttatgtgagcaactttcctaaataacacttgatgctgct

SEQ ID NO: 87700 - DNA, 601 bp, Human
ataggcaatggagataaatcagttgtggcccaactagactgcctggatataatatccttttggactggatcatgtcgtttcattgcagtcaggatggctaagcatggtgatggatcataactgaccaaacagacaggttggttagaatgtatgaccagtcatagctgtgtaactgaggaactgattatattcctgtgactaatgaaaaagcccaatcttagagtagctgtggtaattataatgagaatactagtaaaacattttaaggtgttgtgttccagacactattccatgcatttcccacacacacacacacacacacacacacacacacacacacacacacagtctcatttaatcctcataatattatgaggtagtgctattattaatatccattttctggatgaggaaactgaggccccaaccagtgaaataacttgctttgagtcccatattaagtagtactacccaggcaacctggccccagagcttacttacacgtgtagtaactacactgttcttcccatttatgaggtgattaaactatggaggcaggcatggcatacctgcagaacaggactagaatctcataggtttt

SEQ ID NO: 87701 - DNA, 601 bp, Human
tcatctatgcccccaccctcactcatacacataaacatggagatggaacttaactgtgcattctcgtggtacttaaatttttgtaccttggattatcaaaatttttgttcatgtcctagcttctctgcaagttctttggttaaaaccagtgtgtgacacatctctggatcagaaatgtcttcctttctacctttcaccttccccaaccttcctggtctcctagcacagtgccagatgaatgacagctgtttagtatgtttggtaaatgctaactgtgtgtgatcttagaaaagttagtgamctttgctgattttcagtgtcctctttcgtaaaaaagagaataataaccatttctacttcctaggttgttgtcaaggttaagtattatatttaaagtttttttttagtagtgactagcacttagtaagcacttactgaatgttatcattaataaatgatcttacaaagcagtagcatttccttctaggatttttttgtagtccttcatgattgatagagaagagacatgcagtctaggatttcacatcagctttttaaatataggaaaccagatgtaaatatgctgcttcggttatttaca

SEQ ID NO: 87702 - DNA, 601 bp, Human
gtggttttgactccagcagcttccaaacgacttttgctgatgtttcctaattagcaatgctgaatctcgtgttgtatcaatcctccccattccttaagatggaaacaagtgttccagttatagctataccatgtgcctgacaggaaagaattgggttgccatcagaaccttaatttatcaatctcagtggcttaaaattttgaatttgcagcttaatattattcattaacaaagtatttttcatcccttagctttcctccagggaacaaaaggaaatggtacacactagctcttctaacargctctcattcaataaaggatggtgtgcccttaattttgttagcatgtgtataaagaatgtacttttagtggacatgcttcactttgcaaatatagtgcataattttcaaatacatctttgactcttcctcaaacctgctcagaagctgtgtttttcctctcttcattaaaatgttccaacctggaaattttctctttacaattcagatatttttcacttcttgggaagggaataactaaataatttcaatactttaaactacaaggatgatgtatttttgttctacacagcattgatatg

SEQ ID NO: 87703 - DNA, 601 bp, Human
agtcactcagactacttcatctccccatgaaaaacaccattatgatgtctaacagcatagattagttttgcttatttttgtatcatatgtaaaaggaaccacacagaatttattaagtatttttaattgtggttttcgttttttgactcaggcttaaatagctctctttttattgtccacagatttttatatatgcctagtcttgcaaagttattgtaggcagcaccttaatgaggttttaagggaattttgctattctaacattggaaaatttaggctgttttcagtttttatctgttawaatctttgggcttgtagctttcctatcccctccacacccatttcttcactcatatttctcacaatatttcaaattgatttccatatgtggaattattagatcaaatggtacaatgaagttttaaagtttgatatttaccaaattttaatccaaaagttaccaaattatacttgcattagtaatatttaatagtgcctattgctttgttttaaaaaatgtgctaattttatgagaatggcttttcttcaattattaatagggcaacactttctttcacgtttgtaaactagttatagattt

SEQ ID NO: 87704 - DNA, 601 bp, Human
aattggaccatcctgatgtggtggccccaaacactgggcttaatcctctggtgtgactgctttcacaggtcttttcaagagcctaagtaccataaaatattctcacaaaagccttcattccaaagaatgtgtgtgtcggctcatgtcaagagcttttagtgtagaacaatgtgtcgaaaaccacaatctaataaacaaacagataatctagttcagttttgtctaagtaatataatgtctttattaaactatttcctgcacctttagctctattcagaaggagaaagttctgcgtgggaatgtgtgtatatttactcttaataggaggccgtgtagctcctgtgactggatgtcttgtttttctcttctgagtagctcttgttttccatggtgggaattttccgtcttggtaatttggtattttacttggttttcattgtgaagtgtggaagtgtgtacaccttagttttagaaatgttgttttatcacctgcatctcagttatcaagggccaagtcagaaagttctcacgtgtttttaagcctttctaccagaccttgaactatccattaagtcaaaggggataggctatttccatgaag

SEQ ID NO: 87705 - DNA, 601 bp, Human
gaagtgtggaagtgtgtacaccttagttttagaaatgttgttttatcacctgcatctcagttatcaagggccaagtcagaaagttctcacgtgtttttaagcctttctaccagaccttgaactatccattaagtcaaaggggataggctatttccatgaagaaggtttagggattcctggcagggcaggaagaaggggcaagatttgcgaggatcagaatcctaggtactctcctttagactgcctggtgactactcatttgtcatatggaaaatcatggctcaatagttcagtagaatawaactttgtggaaatttctgaatattaaaggcttcattttcaacacggcagtgagatgggagagtcagggtcattcattggtattgtccacgttactggttgctttttgtctgatcttgcctggagaattatttttaagtaatgtgcctggaaagtgcctacttacagttaggttaacggccatcttatggcatcaggaggagctttctggctatacctattaaaggaagccttagtctcttattgccattaattgacccttgcattttgagtcatagaatcataaaccatcagtgtcgag

SEQ ID NO: 87706 - DNA, 601 bp, Human
atgctgggtaaactccacctgtttgctaatcataacattcatttttctcaatgtgatggattttgtcaccacctccccccgcccccccgcctttatggcattgctatgtgaatcattgcaaaaactctgcactaacatttttcattctgtttataaggttcaaatagatagaacaattttctctaggctttagctctggtgtgtataattctggtcaggctcctaatctttttgagggatagtttccttatccataaaatggacctaagaaaagcaatcctatggggacaatataaaactwgtttagctgcaatcttaactcagacttgcttcctgaaattcctcaatctaatattaaataggggttttttgtttaaatgtggtagcaagattatagttacaaaaagaatagaacaatgcattaaaaaatagaagtatcttaaataatatgtttaaattttttaaaaatatgctgaaattataaagaaattcttagaaaatcatgaggaactctggaaaataggtaccatgaatacaagaacttttgctcttgtctatacttgtccttgcactgatgttcctactctgagtctagcactat

SEQ ID NO: 87707 - DNA, 601 bp, Human
gtaccatgaatacaagaacttttgctcttgtctatacttgtccttgcactgatgttcctactctgagtctagcactatgtgcagacttcccttcttatggtatgttgtggtgagcagaataatagccctcaaagttgtccacgtcttaatctctggaacatgtgaatatgttagggtacatgccacagggaaattaatgatgcacatggaactaaggttgttaatcagctaacctaagataatgaaattatcctggagtataaggatgggcccaacgctattacaagtgtgatagcaaatkgaagaagaggacagaggaggtctttgaagtgatgtgatgtgagaaaaacttaacgtgtctttgctggctttgaagatggaggaaggggccacaagccaaagaatgaggagtagctttgagaagctggaaaagacaaagaagtggattctctggagagactccagaaaggaatgctgccctgccaacaccttgattttagtgcattgatatgcataactgatttctgatttatagaacagtaagataaatatatttctgttcttctaaaaaaccaagcttgtggtactttgttgtagtaac

SEQ ID NO: 87708 - DNA, 601 bp, Human
ttcctactctgagtctagcactatgtgcagacttcccttcttatggtatgttgtggtgagcagaataatagccctcaaagttgtccacgtcttaatctctggaacatgtgaatatgttagggtacatgccacagggaaattaatgatgcacatggaactaaggttgttaatcagctaacctaagataatgaaattatcctggagtataaggatgggcccaacgctattacaagtgtgatagcaaatggaagaagaggacagaggaggtctttgaagtgatgtgatgtgagaaaaacttaaygtgtctttgctggctttgaagatggaggaaggggccacaagccaaagaatgaggagtagctttgagaagctggaaaagacaaagaagtggattctctggagagactccagaaaggaatgctgccctgccaacaccttgattttagtgcattgatatgcataactgatttctgatttatagaacagtaagataaatatatttctgttcttctaaaaaaccaagcttgtggtactttgttgtagtaacaacagaaaacgaatacacacaatatcatgttaaaatgatctgtttatatgtttt

SEQ ID NO: 87709 - DNA, 601 bp, Human
tgaacttgaaactcagtgaactggaactactgctggaggaataaaagggagcaataaatcctttgcactccagaatgaaagaccttctgaggcagctggccaaatgaagcaggaggagggaacaagttcctcactcagctaaattatgtctttgggctggccgacctggtctgctaaaataacaaggtggctgaacttctgctcagaacacgtcaccaaattttgcaatttgggactgtcttctatcccatgacttcctaatctgaggaagtgaagaaagcagagtgaatgaaacccaagkattgacttttttatggagggcctccttagagacaaaagttgatttttcaagagaaccctttatattgtgaactctgtattctaattcaaaaaccgttaagttcttggatgaagaacatccaatagattttggaggtcttgtaaactttgctattgatctgggacttaacctttgcagatgtgggactgtgtgtttatacatcaaagtgggtaaagaagagcccatccagagctaggcagacggaattgggatatgtttgtttgtctgattgcccggttgtggtggtggcggttgttttga

SEQ ID NO: 87710 - DNA, 601 bp, Human
ggcttcgtggagaagcacactttgttagttctatttgtttgtttttccctggggtctagagtaatgtatgatatatagatggcactcgatgaataaatagttgtaagatgtagatcaacatcattattttggtgaccacacaatttcccactgtatgattgcaatttatttttcaaccagtaccctgttaatgaacattctgagtttttgcattacattgctttgtgatgaagtttccttaacatgctcctctgcatgttaagttacttctttggtaggataatttattaaaagtgatatkgctgaattaaagtttataaatatctttaaggcttttgattcctcttgccaaattttcttgagaaaagtttagtagcagtagcatatgagaatgctggtttccctatactattatcaattctgtgttttatcaatatttttaatcttagtccttccttttaattaatttgttagcaacttgagtattatcaaaattaatagtaatgttttctagttaaatagcagaaaatacaaatggaagaaaaatagaaaggttaatttttctaatgtataaaaggaacctgaagtttaaggatatcta

SEQ ID NO: 87711 - DNA, 601 bp, Human
tttatttttcaaccagtaccctgttaatgaacattctgagtttttgcattacattgctttgtgatgaagtttccttaacatgctcctctgcatgttaagttacttctttggtaggataatttattaaaagtgatattgctgaattaaagtttataaatatctttaaggcttttgattcctcttgccaaattttcttgagaaaagtttagtagcagtagcatatgagaatgctggtttccctatactattatcaattctgtgttttatcaatatttttaatcttagtccttccttttaattmatttgttagcaacttgagtattatcaaaattaatagtaatgttttctagttaaatagcagaaaatacaaatggaagaaaaatagaaaggttaatttttctaatgtataaaaggaacctgaagtttaaggatatctagcatgataactaaaaaattaatgttcctcggtcaaggtcacatatcttatttacagaggaagatgtgtcactgaagggagatatattgtgctattttgatgacaatgaggacagagaacatggaatggccaagccttgccctgataattatccctctcccagag

SEQ ID NO: 87712 - DNA, 601 bp, Human
gcttgacattctgatcctttgctttagagtcaagaagtacaacattccagctggtctgtcctgggagccagatgctcagaggtctgaagcaggaagtttaagaaggagatttcctgggtattgctttctaaaactgagactttaacagtagtagctggatcagtcaaattaataaccccttccttgtcagagagaagggcagagtgggacaggaaaagagcttgaaaaggtttcgtctctaatagaaatagcatgttgagcaagtcagtgcaattgctttcatattgttagttccaaccartgcactgtaaataggttgagaaggccgagaagtgatgcattaaatgggatgtatcctcaatttttctcttggcctttgctgtaatgcatttcctggtggtttttaaaaccttactcagctgaacaattggagatgacacattttcaggtactgaaaatttctgttttgtgcatatgtgttatttaaaaattataaatgggtaaaataatgacaggttaagaatttgtataatggagagtatttcccttctactttcattcctcagttgcaaaatttagcttcatagaggcaacttgctgt

SEQ ID NO: 87713 - DNA, 601 bp, Human
gatagcaatattaccacattatataaaatatatttttttaatctaggttgtggtcaaaaagtttcagacttactgtgttagctgctttgatccacagattgacactgtgaagtagctgtggttttcctcatttcataggtgaggaaaactgggtctgggactatagaattgccttgcctgaaataaagggtagagctggggtttgtgttttaagtttttggacttaaaatttcgtactattttcctttcaaacatatatttttttctgtattagttactatatagttttttgtttttttgktttcttcttgttttgagatggagtcttgctctgtcgcctaggctggagtacagtggctccatctcggctcactgcaacctccgcctcccggttcaagcaattctctgcctcagcatcctgagtagctgggattacaggctcctgctaccacgcctggctaatttttgtaattttagcagagactgggtttcactctgttgcccaggctggtcttgaactcctgacctcctgatccgcttgcctcgacctcccaaagtgctggggttacaggtgtgagccatgcacccagccactagttac

SEQ ID NO: 87714 - DNA, 601 bp, Human
actattttcctttcaaacatatatttttttctgtattagttactatatagttttttgtttttttgttttcttcttgttttgagatggagtcttgctctgtcgcctaggctggagtacagtggctccatctcggctcactgcaacctccgcctcccggttcaagcaattctctgcctcagcatcctgagtagctgggattacaggctcctgctaccacgcctggctaatttttgtaattttagcagagactgggtttcactctgttgcccaggctggtcttgaactcctgacctcctgatcmgcttgcctcgacctcccaaagtgctggggttacaggtgtgagccatgcacccagccactagttactattaatggaaatgaataaccgtctttacttgaaacttatgctttgctaaccatgattaaaaaagtgttcaccttgtgtgtgtgcgtgtgtgtgtaggtattccaatccagtctcttttgacttcataatttagaaagttaacttgtggagtatctacatgcttttatgcttaccttaatagttagattttcctccaacaaccaaaaattctcccctcaacaaagtgggagaagc

SEQ ID NO: 87715 - DNA, 601 bp, Human
gcaattctctgcctcagcatcctgagtagctgggattacaggctcctgctaccacgcctggctaatttttgtaattttagcagagactgggtttcactctgttgcccaggctggtcttgaactcctgacctcctgatccgcttgcctcgacctcccaaagtgctggggttacaggtgtgagccatgcacccagccactagttactattaatggaaatgaataaccgtctttacttgaaacttatgctttgctaaccatgattaaaaaagtgttcaccttgtgtgtgtgcgtgtgtgtgtakgtattccaatccagtctcttttgacttcataatttagaaagttaacttgtggagtatctacatgcttttatgcttaccttaatagttagattttcctccaacaaccaaaaattctcccctcaacaaagtgggagaagcaatagctgccagctagcagaagctagagacatgtcactgccagtgcagcccatgggtctatgtcagcaacacctgagagcatgttggaaatgcagaatctctggctccagtgtggacctgaatcagagtctgcgtttgatctaggttccccgatgattggaa

SEQ ID NO: 87716 - DNA, 601 bp, Human
acagccatgtctttttattgctatgttctctatcttcaaacattgcattcaagtgagtaaggctgacattttaaggctgtagttggttaatgtggatccttttggtcagcaacatttttctagcaaaagcaacatcaaatatccttaggattttctcttctgggtaagttcaagggtgcacatcatacttatcaattatatagaactcttgggttccagcgagtggtaattgcaaagtaactcggggctgggatcagatgtgacattagaagtggttctcagactgtgatcatcggtaacwgccgaaagctgccaccatttaagctgaagaagtgctttatgtcaagaagaaaatctaataaagtgatagaattattgttatagttttaggtgtgactatgttcgcatagatacattgaagaaaaaaatgagtcttctttgtctttcagagaaacattggaaatgtttgtagataaaatggaatgggccgggcgcggtggctcacgcctgtaatcccagcacttcgggaggccgaggcgggcggatcacgaggtcaggagatcgagaccatcccggctaaaacggtgaaaccccgtctcta

SEQ ID NO: 87717 - DNA, 601 bp, Human
aaattagccgggcgtagtggcgggcgcctgtagtcccagctacttgggaggctgaggcaggagaatggcgtgaacccgggaggcagagcttgcagtgagccgagatcgcaccactgcactccagcctgggcgacagagcgagactccgtctcaaaaaaaaaaaaaaaaaaaaaggaatggtgtctggtaattattttcaaaataataagggttggaaactactgagtgagaacatgggtgaaatagggttggttatgatttgataactgttgggtgcatggaagtttattctgttattccrtctaccttttaaaaaatacctaatatcatttgtggaacataaaatatattgaattattgctcattaattttatcatttgttttacagtattattttttcattttaatttttgtagctacaagtaggatatgtatttatggcatacatgagatattttgatataggcatacagtcttttaaacatatacctttgtatatgtttaaaatatcctataataagaagtgtaaaagagaaaaagtcttagggaacaactgcttaaatggtttgttctattatttgcctttctttctcctaaattt

SEQ ID NO: 87718 - DNA, 601 bp, Human
gaggttgaaggagacaaagaaagaaatgattcattcgctcaacaaatattctgtattcctatgtgggcattattcaagcactaggaatgttatagcaaaaaagacagacaccactctgtcctcagggaacgtaaaagttagtgggactagtggaaataaacaagatacgcacattacaaagtacattagagtggataagtggggaaacagggagggggtcaaggcttacctactaggatgggcattatcaatatggccccactgagaaggcgacgcttaaatgaggacttgaagaaggagrggagggaatgagctctagagatttcttggggagtgtattttcatatagtagatattaagaagtagaaaaggcttttgatattatctatcatttgaaatcagtaaattgcagttgtaaccagtaagtaccaattcagtttctggagtctagatcttttaaggctattgaaaaatatgtgtattgcaaatataggccatgaatttcttgcattttattttggtgtatactaataaaatcaactatcagatgccagtgatgaatgagagtcctataaagtttgtatttattttatgtaacaga

SEQ ID NO: 87719 - DNA, 601 bp, Human
gtagcatgatcactggagaaaattctgcgcagtttcctctcggctatggttaaaacctcatgttcccaagtccaaattatagctggtaaatgtgtgtttttatgcagaagactgtttatgtttccagccagattttcaggtcagagccaaaagaacgtctactaagagtgattataagagttgtaagattttgagagcagaaagggaccttagagatcatttagtccaactctggcgccaggcatctagttacagtcctttcaagtatttgctaaattaatttccttttttttttttttttggaaatggggaaactgagacccaagaagggatggatcctctggtttctgacagaggtcttattgaatttgaaaaatcttgactcctggccttgaccttcttcctgctgtcccagatggcccatgaacttggttttgctttagtcctctagcagacttcaaggctctgagattcattgcagagggttacacgtttttatttggaaggagcaggtgatgccggagttttgcttggctgtctgaatttttgatatatgctataagcttttatttcttcaaaaaaggcaaataaatatttagcc

SEQ ID NO: 87720 - DNA, 601 bp, Human
tattgaatttgaaaaatcttgactcctggccttgaccttcttcctgctgtcccagatggcccatgaacttggttttgctttagtcctctagcagacttcaaggctctgagattcattgcagagggttacacgtttttatttggaaggagcaggtgatgccggagttttgcttggctgtctgaatttttgatatatgctataagcttttatttcttcaaaaaaggcaaataaatatttagccttaaggattcttggtttaacagttctcattttcatgtgggaagatgcaacttggaaaacaggggaaggatttggtttgcttttctgtcaggatcaacgtgacctccatgcctgtgatgtttgtagtgacacttcagcaatcactttattaattcatttgttcttcattcattcagtgtaaattgaatgcttcttgtaagtagacatatatgctagtgattatagccttaaaacttggcatcataggtttaatgctctgagtctcagccttgggacggtcagttagttttatttatttatttatttatttatttattttgatacagagtctcactctgtcacccaggctggagtgcagtgg

SEQ ID NO: 87721 - DNA, 601 bp, Human
gaatttgaaaaatcttgactcctggccttgaccttcttcctgctgtcccagatggcccatgaacttggttttgctttagtcctctagcagacttcaaggctctgagattcattgcagagggttacacgtttttatttggaaggagcaggtgatgccggagttttgcttggctgtctgaatttttgatatatgctataagcttttatttcttcaaaaaaggcaaataaatatttagccttaaggattcttggtttaacagttctcattttcatgtgggaagatgcaacttggaaaacaggggaaggatttggtttgcttttctgtcaggatcaacgtgacctccatgcctgtgatgtttgtagtgacacttcagcaatcactttattaattcatttgttcttcattcattcagtgtaaattgaatgcttcttgtaagtagacatatatgctagtgattatagccttaaaacttggcatcataggtttaatgctctgagtctcagccttgggacggtcagttagttttatttatttatttatttatttatttattttgatacagagtctcactctgtcacccaggctggagtgcagtggcggg

SEQ ID NO: 87722 - DNA, 601 bp, Human
tgctttagtcctctagcagacttcaaggctctgagattcattgcagagggttacacgtttttatttggaaggagcaggtgatgccggagttttgcttggctgtctgaatttttgatatatgctataagcttttatttcttcaaaaaaggcaaataaatatttagccttaaggattcttggtttaacagttctcattttcatgtgggaagatgcaacttggaaaacaggggaaggatttggtttgcttttctgtcaggatcaacgtgacctccatgcctgtgatgtttgtagtgacacttcrgcaatcactttattaattcatttgttcttcattcattcagtgtaaattgaatgcttcttgtaagtagacatatatgctagtgattatagccttaaaacttggcatcataggtttaatgctctgagtctcagccttgggacggtcagttagttttatttatttatttatttatttatttattttgatacagagtctcactctgtcacccaggctggagtgcagtggcgggatcttggctcactgcaacctccacctcccaggttcaagcgattctcctgcctcagcctcctgagtagctgg

SEQ ID NO: 87723 - DNA, 601 bp, Human
agcctcctgagtagctgggactacaggcacccaccaccacgcctggctaatttttttgtattttcggtagagatggggtttcactatattggccaggttggtctcaaactcctgaccttgtgatccacccgccttggcctcccaaagtgctgggattacaggcatgatccaccgcgcccggccagttagttttattcttatctgaccccacagttggtaatttcttcctcttttcagccaggccataggcaagtattagtattatataacattgcttaaggtagttacaaagaagtcacgygtctcagaattttggacttgcaagagaattagagttaatacattcaagttcctttctattgtttgaatcttgtaattttttcctacataacaaaatgtttatgggtaattatgataggtgaggcagtgctgcaggataaggagatggatcagtacagtactcagaatcacattcggaagatgcatatacacagtcatttaagtcattttatggtaaattatgctttggtcatcatacattgatcagaagcataatctaagtcctaggttagtggtggagagtgagggaagtaaattaact

SEQ ID NO: 87724 - DNA, 601 bp, Human
tatgatgaatagtggcttataatcttttttctttttttttgagacagagtcttgctctgttgaccagcctctgcctcctgggttcaagcgattctcctgtctcagcccaccgagtagctgggactttataagcacgccccaccaagaccggctaattttttgtatttttagtagagatggggtttcgccacacaggccagtctggtcttgaactcctgacttcgggtgatccgcccacctcggccccacgaagtgctaggattacaggtatgagccaccatgcccggcctcattttcctayttactaattttatgtgtttagtttaacaatgataatttgaaaatcaattcaagttttagcaaaactggcactggaatttttttttttttttttttttgggacagagtctcgctctgttgtccaggctggagtgcagtggtgtgatcttggctcactgcaagctctacctcctgggttcatgccattctcctgccttagcctcccaagtagctgggaccacaggcacccaccaccacacctggctaatttttttagttttttatttttagtagagacgaggtttcaccgtgttagccagga

SEQ ID NO: 87725 - DNA, 601 bp, Human
cactgccaccactaccttgaaataatttgtgacacatttatactctctgcagtgaaagattggttaactgctcgacaaaaaaaagtcttgtggggaattgatggtggttagttctgttgaatgtagggataaccaatgaggttagctttgccttagctcctgagtttctgtatagggagtaatatactatgcttgcatatttcagaacatttcctttgctcaaagttaagtgagactatagttggttctttttgagtcagtgaaagttttatcccaatttgtctctcccatcaagagtctyagtggtttcttcaaaggtgaaatgtacttattgttttttttattttaacttacaaaaaagtagtgggtctttttctacttataagaaagtaatgtcagccgggtgtggtggctcacacctgtaataccagtactttgggaggctgaggcaggtggattacctgaggtcaaggagttcgagaccagcctggccaacatgatgaaaccccattgttactaaaaatacaaaaatttgctctgtgtggtcgtgtgtgcctgtaatcccagctactccagaggctgatgcaggagaattgcttga

SEQ ID NO: 87726 - DNA, 601 bp, Human
aatttaactaatgaaataaaaatgaggatccaagagttgaaggaacttgtttagatctcataattgtcatgaaagcagttacttatttttaaatagacaataacaaaatcatttcggtgactttttacaaatgagagaatgtggatactcttaaatcctcaaaaagcagccattgtcgtcaataatatatgttgatgtttagtaaccatgaacctccgaggtagttttctttgtaattttttagtggaagattagcacatcttccatcctggcctctagcatattttctgacaaacccctygttgattgtatcacataccttttatccatggatttggtacgaaagccctattgggcccacaaatctttcggttcttttgtaatttacataatccaatcaacaggggcacagaaacaccttgttctgaaagaaggagtgaaagggagtagaggatgctgacaccaaaaacctagggcactaactcatattttatctctgaatatagtactttgaaaccctagtgtcttaggaaggttttctgttcatagctgatttcacttgatccattcaaaagtcaagcatttttgtactcttactata

SEQ ID NO: 87727 - DNA, 601 bp, Human
gaggtagttttctttgtaattttttagtggaagattagcacatcttccatcctggcctctagcatattttctgacaaaccccttgttgattgtatcacataccttttatccatggatttggtacgaaagccctattgggcccacaaatctttcggttcttttgtaatttacataatccaatcaacaggggcacagaaacaccttgttctgaaagaaggagtgaaagggagtagaggatgctgacaccaaaaacctagggcactaactcatattttatctctgaatatagtactttgaaacyctagtgtcttaggaaggttttctgttcatagctgatttcacttgatccattcaaaagtcaagcatttttgtactcttactatataacttaaaatatattatagcatggggtgtttataccaatccttgaggggttaagctattattatcattattttatcattaacttctgtgagtttgacttgtacagggcctcctagcctgcaaatttcaaaattgacgtcttttttttttgagacagggtcttcttgctctgttgcccagtctggagtgcagtggcatgatctccactcactgcaga

SEQ ID NO: 87728 - DNA, 601 bp, Human
ttcccagtagtttcattatttgctgtcaccagttctgttgcaggatcctctattgtaatattgtcttcagattttaaaaaatgtatctctacatattggaagaaagcactgtggtggaaaatacaggaaaactgtgtacagacctgttaaatggaaatgttttcataatttttagttagttttatttgtattttactaatgaaatttagtaaagatgtcaatgtcaatctttcttactacggaaataagttaaattttgccaactagtggaaaaaaagtttctgtggcattttttttttttaaggaatacaggattgatacaagaatgagagcattcatattataagaaatataagttttgtggttttttttgaaataaaaatttggtttatgagaggcttaaaaaatgaataaattcccttctttcctgatagtttctgtcgttcccttggggattaaaggagtgtgaatctatcctacagccacttcctctctgaactgtagatgacacatcaggatgtgatttggggtagatcaagcctcagagtcgaatctcagtgtctagccgtagaggtggtatgatagtatgataattccacat

SEQ ID NO: 87729 - DNA, 601 bp, Human
gctaggaaagagtccacccttactcttttgtgtgtggatattaaattttcccagcaccatttgttgaaaagactgtccttcctgtattaaatgatcttggtgcccttgtaggcagtgacttgaacatatatctgagggtttatttctggactgtctcttatgtgttattatgccaatagcacactgttttgcttactttagctttgtattaatttttgaaatcaggaagtgtcggtcctccacctttgttcctttttactcaggattgttctgcctattttaggtcatttcatattccatrtgaattttaggataggtttttctactttttaaaaaatgtcactgggattttgatcgggaccgcattaagtctggatatcatattggttgatattgacatcttagttatattaagtcttgcattctatgaacatgagatgtctaccatttatttatgtcttctttaattcctttctgaaatgtattcaagttttcattgttcaaggcttttaactatttattcacgttaatttctaagtattttgtcttttattttttgatgctattgtatatggaatgatttgcttaatttcctttttga

SEQ ID NO: 87730 - DNA, 601 bp, Human
aatgatcttggtgcccttgtaggcagtgacttgaacatatatctgagggtttatttctggactgtctcttatgtgttattatgccaatagcacactgttttgcttactttagctttgtattaatttttgaaatcaggaagtgtcggtcctccacctttgttcctttttactcaggattgttctgcctattttaggtcatttcatattccatatgaattttaggataggtttttctactttttaaaaaatgtcactgggattttgatcgggaccgcattaagtctggatatcatattggttratattgacatcttagttatattaagtcttgcattctatgaacatgagatgtctaccatttatttatgtcttctttaattcctttctgaaatgtattcaagttttcattgttcaaggcttttaactatttattcacgttaatttctaagtattttgtcttttattttttgatgctattgtatatggaatgatttgcttaatttcctttttgaattgttcattgttgatacaaatgtaagtgatttttgtgtagtaactttatatgctctacttggctaaattcactatttagttctaatag

SEQ ID NO: 87731 - DNA, 601 bp, Human
aggaaaagctttcagtcttttatcattgagtatgattttctctgtgggtttccatctgtggcttttgctatgttgagatagttttcttctattcccagtttgttgaatatttttcttatgaaaggatattgaattttgtcaaatgcttttctgtgtcaattgagaagataactttttttccattctgttaatataatatataaccttgatttgtttgttgagtatccgttcgttacaataataaatttcacttggccatgatatatcaaacttgtaatatgctattaaatttgacttgggrtatttgattgaggattttgcatcaatgtttattagggatattgttctgtacttttcatgtagtatctttgtcggactttgatgtcacagaatgagttaggaagtgtttccttctttttaattttttggaaagatttgaggataattgttgttagttcatgtatcaatgtttggtagaatttactagtgaagccatggttccagattttttcttactcagattttggatactgattcaatcttcttagtattcatagcatattcagattttttatttgtggtttagtcttggtgcattttg

SEQ ID NO: 87732 - DNA, 601 bp, Human
tcacaatctgtagatttaggttgttggtttgacgtctttcttatctttaaatttaatggtgtatagctataaattgcctcgtttgcactgttttcactgtttcccatacgtttggtatgttttctttcatgttcattcatttttaagtatttttctatttcccttgtgatttctcctttgatccattgtttgttaaagagcatattattggctggatgcagtggctcacacctgtaatctcagcactttgggaggccgaggtgggaggatcacgaggacaggagtttaagactagcctggycaacatagtgaaaccccatctctactaaaaattacaaaatattggccgggcgtggtggctcacgcctgtaatcccagcactttgagaggccgaggcgggtggatcacgaggtcaggagatcgagaccatcctggctaacacggtgaaaccctgtctctactaaaattacaaaaaattagccgggcgtggtggcgggcacctgtagtcccagctaatcgggaggctgaggcaggagaatggcctgaaccctggaggcggaggttgcagtgagccgagatcactccagcctgggtgacagag

SEQ ID NO: 87733 - DNA, 601 bp, Human
ctttttttttttttcatgactggcattttgattttctttctcacttttaaaataaaattttgccagatgtaggattcgtggttgataattttttttccttttagcactttgaatatattggccctctgttttctggcatctaaggctgctgctaagaaaaccggataattttattgaggatcccttgtatgtgatgagtcacctctcttgcaactttcaaaattctccggttgtctttgtcttttgacagtttaattagaaggtgcctcactatttgtctgtttgagttcatcttacttgyacttttttgagcttcttggatgtttatactcttggctttgatcaaatttgggggagtttttggtgattatttcttcaagtattgtccctgccttttctctctgtctcatacttctgggaattccatgctgcatactttggtatagttgattgtgtcccacaggtctcttaggctcagttcacctgtcttcaatcttttttctttctgattcttagactaattaatttactttgacctctcttcaagttttctgattctttcttttgctgttaaatctgtctttgagttcctctagtgaat

SEQ ID NO: 87734 - DNA, 601 bp, Human
tcatatcttctgggttacaacctactcattgccttcattctatctttttcacattccaactgcatatctgtaaccacttagtggtttaaaaaatattattttcttcctctggcttttccacattaaatttctcctcttggtttatttttcagagtactctatgacctacctcatcctatgtagcacactgtatctcccactgtgctttttatacagtccttgctcttttgaagctcatatcgtcattgtcagcttcatatgccaagccaatttttcttgtgtctttctcaatacctgatgraccctcatatcctcatttttagaagcctaactctactattttactcatacgtgtctgacaactggatcatcttgatctctctcttctctgcatcctcagtcttttgattgagtcatgtgatgtggtggcatgagcccagggtttagggctaagaaaccctgctctgttgcttatcactgcatttcccatctttacatgcaaaaatgaggatattaataacaatttttagaaggttattttgaggactaattaagataatgtagagtatccaacaactgctggttcagagtaaaggctact

SEQ ID NO: 87735 - DNA, 601 bp, Human
gtcagcttcatatgccaagccaatttttcttgtgtctttctcaatacctgatgaaccctcatatcctcatttttagaagcctaactctactattttactcatacgtgtctgacaactggatcatcttgatctctctcttctctgcatcctcagtcttttgattgagtcatgtgatgtggtggcatgagcccagggtttagggctaagaaaccctgctctgttgcttatcactgcatttcccatctttacatgcaaaaatgaggatattaataacaatttttagaaggttattttgaggacyaattaagataatgtagagtatccaacaactgctggttcagagtaaaggctactatgagtcagttaataaatagatttattaatgctgtttgattttttctgccacttaatatatacccttttgtggggtaatgtaatcattgcatgtacattaatcttgccaccaaactttattttataagccagaatcataaaataacatgggagacttgtagaaattatttaaaatcacaaatcgtagagcaccagatttgacatggtcctaacccctctgccctttcttgtgatgaggaaactggag

SEQ ID NO: 87736 - DNA, 601 bp, Human
atcacccataacctttattttcatttcattttattttttttgagatggagtcttgctctgttgcccaggctggagtgcagtggcgcgatctcggctcactgcaagctccgcctcccgggttcacgccattctcctgcctcagcctcccgagtagctgggactacaggcgcccaccaccacacctggctaattttttgtatttttagtagagacggggtttcactgtgttagtcaggatggtcttgatctcctggcctcgtgatccacctacctcggcctcccaaagtgctgggattacaggcatgagccaccacgcccggcccataacctttattttattgcgagaagatagaatagctacttgattgatatttgtggcttgattgatctattctttcttcgactgtgcaataggaattctctgggaaaggactatgaagtctgtatacttatcacccttttgatgcttttggggttgttgtaagcatgcaaagggttcattgtgcactgcttctgtatactgactcagggtggtggggagaggaaatgggagaggaagttatatacatcttgagcaaatcaagcttttctatttttagtc

SEQ ID NO: 87737 - DNA, 601 bp, Human
ctagtatgtggcaaatggaagaatcctttggaaaaaaatgaggactttgaagcaggtgtgatgtgaatgttactagaggaaatgttgataccaatgagcaaatattgccctttgttaatgaaagggactatacagtctccagacataaacagctctgcctagacaaaattgtagcagtagggtgagaataatgcattgctataattaatgctaatttgtggatattgctgtattgttgtcattgttttttaattgaatatgtattaagctccaacagggtgctatgaataatgccaacttrtagttgatttatgagaacactcagaagactttattaacaccagtaaatggaaactcgcactccttcgaggtggtaaacgtctttgccatttcgacagatgaggagaagtgaagtagattgtgttttctctgttggcactgcgggtgagaacacagaaactgtcgaatgagagaaaagtattttccttgtcccctggaattgggttagaatacattagtaaagaattctttaatgtgttcagagttgtgggattttaattaaattgttccagttattgttagcacttggattagcaactgg

SEQ ID NO: 87738 - DNA, 601 bp, Human
aagtgagtaattcaacttttcatttttttttgtccccttccttccttccttccttccttccttccttccttccttccttccttccttccttccttcctctctctctctcttttctttttttttttttgagtctcactctgtcgcccaggctggagtgcaatggcatgatctcggctcactgcaaactccgcctcctgggttcaagcgattctcctgtttcagcttcccaagtagctgggattacagttgtgtgccaccatgcctggctaattttttttttgttgttttttttttttttttttgcatctttagtagagatggggtttcaccatgttggccaggctggtctcaaacttctgaccttgtgatccgcctgccttggcctcccaaagtgctgggattagaggcgtgagccactgcaccgggcctgtctcatttctttaatacgaggtactaaactgtcactgagtaaatagtagacatttgattattatttgactctgaatattttttgaaaaaaggaacatttcataagaaagcctgaaatgagacatgagcagaattctggggtatagaaatgatttttaagttgagacaagaa

SEQ ID NO: 87739 - DNA, 601 bp, Human
cctagataatctgtagcagtggtttttaaactattaatttcttagaattgcttcaggaaatattactaaaggagatgggggataaagcagctctgtctgtatatgtttcatacaatgggtttccgtgtctgatttcattttaccaggggatctgctgcttaaaaagggggtgccaaatatctattttactgtcaaatagttcatcttattgtgattattcttagagttcctgttttattgatgaatagataatatatgtattgttccttattattatctatgcaaattgacctttattttmattgtaaggggttactttaaaaatatattatttatattatttttattttataaggattggaattcagtagaaatcattcaacgagtaggtaaatattgtgaaaagtgaggggtttttgttgcatatttagttttgctttcttatttgaatagaacagtgaacagtgaggctacttgtgtatacccaagttcagatcactttaaccatgaccctgcccttacttataaaagagttggcttaaactcggagttggcctaactcttacgggtttagtctgatggcttttgaacagcaaagata

SEQ ID NO: 87740 - DNA, 601 bp, Human
aagtgaggggtttttgttgcatatttagttttgctttcttatttgaatagaacagtgaacagtgaggctacttgtgtatacccaagttcagatcactttaaccatgaccctgcccttacttataaaagagttggcttaaactcggagttggcctaactcttacgggtttagtctgatggcttttgaacagcaaagatagtgacaggcaagttgtgaaatgtcattatagatctatgcagtattagaggttaaaaaaatagaaaacgacctggaaggtgcataccctcatttttgtagaggwaaaagttgagttccagaaagtcaaagaaactgcttgataatatcagcgggacttggtcttgtttaggctgcttcagtagggctgattgtgtgaaacagaggccccctggagtagcgctgaatcatggagtttatcttaaggatggatctgaatgagatctgatatcaggaagctcagggtcagggcagatctgtggctgaactcttccatctatttttcttctcattgttttttttccctctctcccttcctcttttcctctcctctccattcctctgcttctctagtgttcgcttgttc

SEQ ID NO: 87741 - DNA, 601 bp, Human
attatagatctatgcagtattagaggttaaaaaaatagaaaacgacctggaaggtgcataccctcatttttgtagaggtaaaagttgagttccagaaagtcaaagaaactgcttgataatatcagcgggacttggtcttgtttaggctgcttcagtagggctgattgtgtgaaacagaggccccctggagtagcgctgaatcatggagtttatcttaaggatggatctgaatgagatctgatatcaggaagctcagggtcagggcagatctgtggctgaactcttccatctatttttcttytcattgttttttttccctctctcccttcctcttttcctctcctctccattcctctgcttctctagtgttcgcttgttcattgttttcctccacccaatgatagacttcctacctcctgttgtatgtttggattgttaataattaaccatgtacatcatctttttggttgatcacagccatagctcatccctgtggcaattttttattttttattttatttttttttttattttttgagtttcactcttgttgcccaggctggagtgcagtggtaagatcttggctcactgcaacctctac

SEQ ID NO: 87742 - DNA, 601 bp, Human
acatggtagctccctgttgccttcattcatgattataagcttcctgacgctctcatcagaaactgactggatattgacaccatgcttcttatatagcctgcatagtcatgagccaatttaacctcttttctttataaattacccagcctcagctattgttctatagtgatgcaaaaatggcctaatgtaacgtttttgtgctttatcatgaaaaactcttgtcttctgttgttaccttatttcttgtttatttaatgctgtgttctcagttgtcaagccagtattgcacttcagattatgraaatgtattcccccttatgaatgctctagtgtttgctcccaagacagcttttgcgacaacttttcccactgcctttaacatgtggagaagatgtccttctcggatattaataagacttgagtttaggcctggttttgcatattagaaaagttgaattgtatttctgttggccattagataagaaggattttagggaaggggactgtttttgtttttaaatttgtgtctcttccacatagttttacaaagagtatcaaataacatagtgaatttgatatctctaggcaaaagtgcaagtga

SEQ ID NO: 87743 - DNA, 601 bp, Human
cagtattgcacttcagattatggaaatgtattcccccttatgaatgctctagtgtttgctcccaagacagcttttgcgacaacttttcccactgcctttaacatgtggagaagatgtccttctcggatattaataagacttgagtttaggcctggttttgcatattagaaaagttgaattgtatttctgttggccattagataagaaggattttagggaaggggactgtttttgtttttaaatttgtgtctcttccacatagttttacaaagagtatcaaataacatagtgaatttgatawctctaggcaaaagtgcaagtgatatttttcagtagaatacatatatataaactcctcaaggttgggtatcatggcttttttacactgcatactacttagcataaactattttctagagcagcatgggagaaaagccatccactcaaatccatcatgagagttaccctatgaacattggtgtcatggaaaattagacaaagaggagtcagttatcaagttagtgggttatttgtaagtcctcctcccctggagaagggtacatttggggagatagataggtaaggtttttggaaagctaaa

SEQ ID NO: 87744 - DNA, 601 bp, Human
ctagtgtttgctcccaagacagcttttgcgacaacttttcccactgcctttaacatgtggagaagatgtccttctcggatattaataagacttgagtttaggcctggttttgcatattagaaaagttgaattgtatttctgttggccattagataagaaggattttagggaaggggactgtttttgtttttaaatttgtgtctcttccacatagttttacaaagagtatcaaataacatagtgaatttgatatctctaggcaaaagtgcaagtgatatttttcagtagaatacatatataaaaactcctcaaggttgggtatcatggcttttttacactgcatactacttagcataaactattttctagagcagcatgggagaaaagccatccactcaaatccatcatgagagttaccctatgaacattggtgtcatggaaaattagacaaagaggagtcagttatcaagttagtgggttatttgtaagtcctcctcccctggagaagggtacatttggggagatagataggtaaggtttttggaaagctaaacacttcaactgaatgactgggaaagaggatacacatcccaataggaat

SEQ ID NO: 87745 - DNA, 601 bp, Human
tccccctgccccacacacttaaatgttcattgtgttagaaatccacttagaaaagtcattctcaaagtgagaacacctcactttgagaatgactcagaccagcaccatcactggggatgttgagaacatccccataccagcgccatcactagcacctacgaacttggtagaaatgtaagttcttgggcctcacccaagatgtacagataagaaactgtggcaggtacagcctggtaatctaaggtttaataagtcctcctggtggttctgtataggctaatgtttgaaaaacactgatctrggattgtgttctttatggttaattcctggcacccttacacatgttcagatgcatagaagccccatctactgaagcctctcagtaacttagttttacttttgatcaaagtactttataaagtcacatactcaattgcctgactattaacagaagcatttattttgagactattgtcaaagtaacaattaaatagctagcatttattgaatgcttattatgtgaatattacttgacatgcataaacctatttaatttttacaactgcatgagggacccgagagctcaggtgaattgttgaag

SEQ ID NO: 87746 - DNA, 601 bp, Human
ggcttggtgcctgtatgagtctgttttcacactactaataaagacatccccgaatctgggaagaaaaagaggtttaattggacttatagttccacatggctggggaggcctcagaatcatggtaggaggtgaagggcacttcttacatggcggtggtaagagaaaatgagggtgatgcaaagcagaaacccctgataaaaccatcagatctcgtgaaactttttcactaccatgagaacagtatggaggaaactgcccccaagattcaaattatctcccccttgttccttcccataacacrgggagttatgggagtacaatttaagatgagatttggatagggacacagagcaaaactgtatcagtgacctccccatggtactggtcatacagagtgaattctctgttagttcataggacagctgattgtttaaaagagtatagcacctctcctcgctctctcttccgctctctctcaccatatgacatgctgcctcccattaccttcctccatgagtaaacgctttctgaggccctcaccagaagcagatggcagctccatgcttcctgtacagcctgcggaaccatgagccaaataaac

SEQ ID NO: 87747 - DNA, 601 bp, Human
tccccatggtactggtcatacagagtgaattctctgttagttcataggacagctgattgtttaaaagagtatagcacctctcctcgctctctcttccgctctctctcaccatatgacatgctgcctcccattaccttcctccatgagtaaacgctttctgaggccctcaccagaagcagatggcagctccatgcttcctgtacagcctgcggaaccatgagccaaataaacctcttctctttataaattacccagcttcaagttttgcattatagcaatgcaaaacagactaacaaacatagtgtgttttgttacttaaaaagcacacactttcaaaattcctttagttatcaccattttcccccactgatattagaaagaagagagtaataaacattactgaccataatagaaaaaaaatacagtgaaattcctgttgtattattaaatttaaatgaaactaccattgaaaagaaaagttgtatgtaaacacaatgtaatttttgtattattagcctcttaggttttactaaattaagacagttttatattcctaagttatcagggaaagcttttctaattaatcacaaaaggaagctca

SEQ ID NO: 87748 - DNA, 601 bp, Human
agagtgaattctctgttagttcataggacagctgattgtttaaaagagtatagcacctctcctcgctctctcttccgctctctctcaccatatgacatgctgcctcccattaccttcctccatgagtaaacgctttctgaggccctcaccagaagcagatggcagctccatgcttcctgtacagcctgcggaaccatgagccaaataaacctcttctctttataaattacccagcttcaagttttgcattatagcaatgcaaaacagactaacaaacatagtgtgttttgttacttaaaaagcacacactttcaaaattcctttagttatcaccattttcccccactgatattagaaagaagagagtaataaacattactgaccataatagaaaaaaaatacagtgaaattcctgttgtattattaaatttaaatgaaactaccattgaaaagaaaagttgtatgtaaacacaatgtaatttttgtattattagcctcttaggttttactaaattaagacagttttatattcctaagttatcagggaaagcttttctaattaatcacaaaaggaagctcaagcttgggtagggtctgggaa

SEQ ID NO: 87749 - DNA, 601 bp, Human
agagagtaataaacattactgaccataatagaaaaaaaatacagtgaaattcctgttgtattattaaatttaaatgaaactaccattgaaaagaaaagttgtatgtaaacacaatgtaatttttgtattattagcctcttaggttttactaaattaagacagttttatattcctaagttatcagggaaagcttttctaattaatcacaaaaggaagctcaagcttgggtagggtctgggaacctctttgttttccatatgggatcagtggtaagacattccttgagctctgtgaagcacarttgaaaaaaataggattatgtggttactttctcaggtctgtaattgagcagtcacattcaaattccggctttttgaactcacaatctataatgtgtcagtatggttgtctacctcagagattctgaaggttgttgaagattagttcatggtcatgtatgttttgagtatgacgctgggcattggatctaattctagtatataaacatccaagggtggagactgtttcttaattaaatagaccattccccttggccttttgtttcctttaatatcctggataagattttcctatgtaacag

SEQ ID NO: 87750 - DNA, 601 bp, Human
ccattgaaaagaaaagttgtatgtaaacacaatgtaatttttgtattattagcctcttaggttttactaaattaagacagttttatattcctaagttatcagggaaagcttttctaattaatcacaaaaggaagctcaagcttgggtagggtctgggaacctctttgttttccatatgggatcagtggtaagacattccttgagctctgtgaagcacaattgaaaaaaataggattatgtggttactttctcaggtctgtaattgagcagtcacattcaaattccggctttttgaactcamaatctataatgtgtcagtatggttgtctacctcagagattctgaaggttgttgaagattagttcatggtcatgtatgttttgagtatgacgctgggcattggatctaattctagtatataaacatccaagggtggagactgtttcttaattaaatagaccattccccttggccttttgtttcctttaatatcctggataagattttcctatgtaacagtttttacttgatgattaagtttctgatttttttttcatagcacaggacttttcagttagtcctgctcccctaccttgaaacc

SEQ ID NO: 87751 - DNA, 601 bp, Human
tttgtttcctttaatatcctggataagattttcctatgtaacagtttttacttgatgattaagtttctgatttttttttcatagcacaggacttttcagttagtcctgctcccctaccttgaaaccgaaatgaatactgaacaaataaatcgttaacgtattaggcaagatatgtttattttcatcccgtttcacaatcattaaggccatagttagttcaggcaaagatcatctatggacactaaaaccactgggtgggtgaaaggtttttgactagtagaatactcacagtgccccaaartatcacctcacagattatttttaatttaaaaatcatgcagtcatgcttaaaatggtgaaatctggtacacactaccttaatcgagtcatcaaactcagcatcaccaagcatgggccaaactgacccttgagcttcctgatgggatgcagcagaagggatgtggcctcacgcatgtgatattcctgcctgacttatttaatctgaatccagtcatcaagaaaaaccagattggttggactttttataagacacctgaccagaattattttaaaagttggctttataaaaatcaaaaatcag

SEQ ID NO: 87752 - DNA, 601 bp, Human
aaatgaatactgaacaaataaatcgttaacgtattaggcaagatatgtttattttcatcccgtttcacaatcattaaggccatagttagttcaggcaaagatcatctatggacactaaaaccactgggtgggtgaaaggtttttgactagtagaatactcacagtgccccaaaatatcacctcacagattatttttaatttaaaaatcatgcagtcatgcttaaaatggtgaaatctggtacacactaccttaatcgagtcatcaaactcagcatcaccaagcatgggccaaactgacccwtgagcttcctgatgggatgcagcagaagggatgtggcctcacgcatgtgatattcctgcctgacttatttaatctgaatccagtcatcaagaaaaaccagattggttggactttttataagacacctgaccagaattattttaaaagttggctttataaaaatcaaaaatcagctaggagcctgttctaaattaaaagagaataaaaagacatatcattttatgatgtgatccttggatttggggtgaaaattaacagtagataaaagaacactactggcaccactagtgaaatgtgagt

SEQ ID NO: 87753 - DNA, 601 bp, Human
ccttaatcgagtcatcaaactcagcatcaccaagcatgggccaaactgacccttgagcttcctgatgggatgcagcagaagggatgtggcctcacgcatgtgatattcctgcctgacttatttaatctgaatccagtcatcaagaaaaaccagattggttggactttttataagacacctgaccagaattattttaaaagttggctttataaaaatcaaaaatcagctaggagcctgttctaaattaaaagagaataaaaagacatatcattttatgatgtgatccttggatttggggtgraaattaacagtagataaaagaacactactggcaccactagtgaaatgtgagtatgggtgatattagataatactgtttctatgttaaatttctccagtgtgagaatggttttgaaaaaattagaaattcttaggagatgcaaactgaggtgcatatgggggatgtcggggggtggttttgcaacatcttacagatggttcaattgcaacagcaaatctaatttatgtagacagaaagctagtgtgatgaaatggtggccactgatgaatctgggtgaaggatgggtgagtggagtttatt

SEQ ID NO: 87754 - DNA, 601 bp, Human
gggatgcagcagaagggatgtggcctcacgcatgtgatattcctgcctgacttatttaatctgaatccagtcatcaagaaaaaccagattggttggactttttataagacacctgaccagaattattttaaaagttggctttataaaaatcaaaaatcagctaggagcctgttctaaattaaaagagaataaaaagacatatcattttatgatgtgatccttggatttggggtgaaaattaacagtagataaaagaacactactggcaccactagtgaaatgtgagtatgggtgatattarataatactgtttctatgttaaatttctccagtgtgagaatggttttgaaaaaattagaaattcttaggagatgcaaactgaggtgcatatgggggatgtcggggggtggttttgcaacatcttacagatggttcaattgcaacagcaaatctaatttatgtagacagaaagctagtgtgatgaaatggtggccactgatgaatctgggtgaaggatgggtgagtggagtttattttaatagttgttcaacttctctgtgaatttaaattttttggatataaagaatgaaaaagtaaataa

SEQ ID NO: 87755 - DNA, 601 bp, Human
acaaatgaatgctctttcataaccaattgctggtactcctcgtctatcacctgtagttagtgggttagtgatagttggcctgaaatatgacccattcaaaatcagactcttgataatggcctaagttcatttcattcacacgctgtacattttggttctgggctatttattggactgtctttatgtacttacagtgggggagtcatcatcctataattctgctggcagcacttattatgatttgtcaagtcataataagtcccaactgtggtttggtgagctttttatcacatatgtattyagataatgcataaaaataaatataaaaataacatgttcgaatggtttattcataggatttttgtggtccttggtaaagggacgctgtcagtagacacctttggtgccccacctcgcatcttcccctcccaccttcgtgtaccagcagctgctacagcgatcagctctgcacaggtgtgacctggtagcacttggcttcaactgcaacacctttcactcactttctgtgccgggccttctctgcaaccatttaacttctgagacttgtgagacttattcacaaccaggagaacagtatagg

SEQ ID NO: 87756 - DNA, 601 bp, Human
ttcagataatgcataaaaataaatataaaaataacatgttcgaatggtttattcataggatttttgtggtccttggtaaagggacgctgtcagtagacacctttggtgccccacctcgcatcttcccctcccaccttcgtgtaccagcagctgctacagcgatcagctctgcacaggtgtgacctggtagcacttggcttcaactgcaacacctttcactcactttctgtgccgggccttctctgcaaccatttaacttctgagacttgtgagacttattcacaaccaggagaacagtatrggggaaaatgcccccgtgattcaattatctcccacacggtcctgcccacaacacatggggattatgagaactacaattcaagatgaaatttgggtggagactcagccaaaccatatctccttccttctctgcttaactccttctagtccctcagtactgtttctcagaattgattcccaaaataaatggccaacatgcgagcttttctcacaggcattgtttttcttggcagaacacagactaagacgatgtaatctttgaaatctctctagtgatggttaaagagtgtggggattgtta

SEQ ID NO: 87757 - DNA, 601 bp, Human
taacatgttcgaatggtttattcataggatttttgtggtccttggtaaagggacgctgtcagtagacacctttggtgccccacctcgcatcttcccctcccaccttcgtgtaccagcagctgctacagcgatcagctctgcacaggtgtgacctggtagcacttggcttcaactgcaacacctttcactcactttctgtgccgggccttctctgcaaccatttaacttctgagacttgtgagacttattcacaaccaggagaacagtataggggaaaatgcccccgtgattcaattatctyccacacggtcctgcccacaacacatggggattatgagaactacaattcaagatgaaatttgggtggagactcagccaaaccatatctccttccttctctgcttaactccttctagtccctcagtactgtttctcagaattgattcccaaaataaatggccaacatgcgagcttttctcacaggcattgtttttcttggcagaacacagactaagacgatgtaatctttgaaatctctctagtgatggttaaagagtgtggggattgttataattacattaactactttataaaagtttgt

SEQ ID NO: 87758 - DNA, 601 bp, Human
taggatttttgtggtccttggtaaagggacgctgtcagtagacacctttggtgccccacctcgcatcttcccctcccaccttcgtgtaccagcagctgctacagcgatcagctctgcacaggtgtgacctggtagcacttggcttcaactgcaacacctttcactcactttctgtgccgggccttctctgcaaccatttaacttctgagacttgtgagacttattcacaaccaggagaacagtataggggaaaatgcccccgtgattcaattatctcccacacggtcctgcccacaacacwtggggattatgagaactacaattcaagatgaaatttgggtggagactcagccaaaccatatctccttccttctctgcttaactccttctagtccctcagtactgtttctcagaattgattcccaaaataaatggccaacatgcgagcttttctcacaggcattgtttttcttggcagaacacagactaagacgatgtaatctttgaaatctctctagtgatggttaaagagtgtggggattgttataattacattaactactttataaaagtttgtggtggtaactagaaaaagcattag

SEQ ID NO: 87759 - DNA, 601 bp, Human
aagaagaagaataattaacaatagctatattattcatattaatttatagttactggttgctataattaatgctatttaggaaaatcatcataattatagcactttacaacttacagagtattttcccatccattttcttatctaaatcttataacatcaccctggcttagatagaacatgtgatattctcttcattttatagatgagaaaactatggcccagggaaagatttaagcagacaacactctaccacccttgccaatatattggactatctaagagtatgtggaaatacacttascaaatttatgtctactataatattttatatctgcgcacaagaggatcaactttactcagtttttagttgcattccaaaacaataatgtcctgtctttccttgtaccaggacccccattacccagaatgttcacatgaattttaaatgttaaatggaatttttcttaataataccacagtgtttcatagttattactgccctttgatataaacatgaaatctcctctgatagagggattagcaccttgaaaacatctgtttccagtatacagacctgctggccttaaacagtttaatcaga

SEQ ID NO: 87760 - DNA, 601 bp, Human
agtttaatcagactggaaattcagactcagaaaagtctaaatttcaaccaacctgtcatgtcactctttttctatttttggctatgacaagagagttgaagaaaatctatcaatttcacaaggctagccttcaaatctgggccgtccagcttgatgatacacacatagttaccagtgtgagcgtgtgtgtgcacacacagatggacactgaacctctttggttccgtttttatatcaaattctagagtatccactgcttattgttgtacttctaactgtgtttacccaaaagatagtgctrtgagaaaggttactgcctgtgtcacagtctgtcattattcactgatttatttattcaaaaatacttactgaacacttatttgggctaggtcttgaaagagagtccaaggaaacaggaacaaaacagacaaagcttctcatgaagcttatatgttctaggggagagactgaaaataaacagaaaaatacacatggtggcagatattatttaaaaatggatttaaaagggtaggggaataacatgacgtgatgtagaggggtcataataatacatccagaaggagaaaatcataaggtggct

SEQ ID NO: 87761 - DNA, 601 bp, Human
tttgttaacatgtctgtgttgcttccaacaggggaatcccggaggcaagacacttgaggagaggcgctccagcctggacgctgagattgactccttgaccagcatcttggctgaccttgagtgcagctccccctataagcctcggcctccacaggttagtgcagcccacaatcatctccacacagccattcccagatattctactcttatcagaaagaacatgctgcacctgagagcttatttccccttccttccttccttccgtccgtccttccttccttccttccttccttccttccttcctctctctctcttctttctttctcttttttttttttttttgatggagtcttgctctgttgcccaggccggagtgcaatggcacaatcttgtctcactgcaacctccgcctcccgggttcaagcaattctcctgcatcagcctcctgagtagctgggattacaggcgcctgccaccacacctggctaatttttgtatttttagtagagaccgggtttcaccatgttggtcaggctggtctcgaactcctgacctcatgatctgcctgcctcagcctcccaaagtgctgggattacaggcc

SEQ ID NO: 87762 - DNA, 601 bp, Human
tgttaacatgtctgtgttgcttccaacaggggaatcccggaggcaagacacttgaggagaggcgctccagcctggacgctgagattgactccttgaccagcatcttggctgaccttgagtgcagctccccctataagcctcggcctccacaggttagtgcagcccacaatcatctccacacagccattcccagatattctactcttatcagaaagaacatgctgcacctgagagcttatttccccttccttccttccttccgtccgtccttccttccttccttccttccttccttccttcctctctctctcttctttctttctcttttttttttttttttgatggagtcttgctctgttgcccaggccggagtgcaatggcacaatcttgtctcactgcaacctccgcctcccgggttcaagcaattctcctgcatcagcctcctgagtagctgggattacaggcgcctgccaccacacctggctaatttttgtatttttagtagagaccgggtttcaccatgttggtcaggctggtctcgaactcctgacctcatgatctgcctgcctcagcctcccaaagtgctgggattacaggcctg

SEQ ID NO: 87763 - DNA, 601 bp, Human
tctgtgttgcttccaacaggggaatcccggaggcaagacacttgaggagaggcgctccagcctggacgctgagattgactccttgaccagcatcttggctgaccttgagtgcagctccccctataagcctcggcctccacaggttagtgcagcccacaatcatctccacacagccattcccagatattctactcttatcagaaagaacatgctgcacctgagagcttatttccccttccttccttccttccgtccgtccttccttccttccttccttccttccttccttcctctctctctcttctttctttctcttttttttttttttttgatggagtcttgctctgttgcccaggccggagtgcaatggcacaatcttgtctcactgcaacctccgcctcccgggttcaagcaattctcctgcatcagcctcctgagtagctgggattacaggcgcctgccaccacacctggctaatttttgtatttttagtagagaccgggtttcaccatgttggtcaggctggtctcgaactcctgacctcatgatctgcctgcctcagcctcccaaagtgctgggattacaggcctgagccaccatg

SEQ ID NO: 87764 - DNA, 601 bp, Human
tgtgttgcttccaacaggggaatcccggaggcaagacacttgaggagaggcgctccagcctggacgctgagattgactccttgaccagcatcttggctgaccttgagtgcagctccccctataagcctcggcctccacaggttagtgcagcccacaatcatctccacacagccattcccagatattctactcttatcagaaagaacatgctgcacctgagagcttatttccccttccttccttccttccgtccgtccttccttccttccttccttccttccttccttcctctctctctcttctttctttctcttttttttttttttttgatggagtcttgctctgttgcccaggccggagtgcaatggcacaatcttgtctcactgcaacctccgcctcccgggttcaagcaattctcctgcatcagcctcctgagtagctgggattacaggcgcctgccaccacacctggctaatttttgtatttttagtagagaccgggtttcaccatgttggtcaggctggtctcgaactcctgacctcatgatctgcctgcctcagcctcccaaagtgctgggattacaggcctgagccaccatgcc

SEQ ID NO: 87765 - DNA, 601 bp, Human
cgctccagcctggacgctgagattgactccttgaccagcatcttggctgaccttgagtgcagctccccctataagcctcggcctccacaggttagtgcagcccacaatcatctccacacagccattcccagatattctactcttatcagaaagaacatgctgcacctgagagcttatttccccttccttccttccttccgtccgtccttccttccttccttccttccttccttccttcctctctctctcttctttctttctcttttttttttttttttgatggagtcttgctctgttgccyaggccggagtgcaatggcacaatcttgtctcactgcaacctccgcctcccgggttcaagcaattctcctgcatcagcctcctgagtagctgggattacaggcgcctgccaccacacctggctaatttttgtatttttagtagagaccgggtttcaccatgttggtcaggctggtctcgaactcctgacctcatgatctgcctgcctcagcctcccaaagtgctgggattacaggcctgagccaccatgcccggcccttttattctttcttgatcttcttagagtcaatgatttaagttgc

SEQ ID NO: 87766 - DNA, 601 bp, Human
gtccgtccttccttccttccttccttccttccttccttcctctctctctcttctttctttctcttttttttttttttttgatggagtcttgctctgttgcccaggccggagtgcaatggcacaatcttgtctcactgcaacctccgcctcccgggttcaagcaattctcctgcatcagcctcctgagtagctgggattacaggcgcctgccaccacacctggctaatttttgtatttttagtagagaccgggtttcaccatgttggtcaggctggtctcgaactcctgacctcatgatctrcctgcctcagcctcccaaagtgctgggattacaggcctgagccaccatgcccggcccttttattctttcttgatcttcttagagtcaatgatttaagttgcctttttatttaatatcaacatgtattagtcaactggcagaaatttcttaaattgactctttgagtactttctttaaaaataacacaacatcatacaaaaatgttatataaaaaagtaaatctcttattccattgccttgctcttcttacagctttgtctatatggatattttgttacatgttgttatagttttcacaaa

SEQ ID NO: 87767 - DNA, 601 bp, Human
ctgcattccagaagctgatcttccactgctagtgatcattccctgcctctctaaagtcttgaaagggttgtggcaaatctgtttcagggcttccaattcctcagaagacagccatcagaattgtagttgcaaacgctagagaagcagtattgtcactgtgctgtttgactcttgcgtgacatttgtttgactaagtgagagtgcatagagcctctgagcctcactccagttcttgagtggcagcttctgtatttacagtggttcctttcttaaattaagaaccagtcttgtttctctgctstcagttatttcaatacttaactgctcataaggtggcagcactttcttcttcttcttttttttttcttttatgagatggagtctctctctgttgccaaggctggaatgcagtggcgcaatctcagctcactgaaacctccacctcctgagttcaagcaattctgcctcagcctcccgagtagctgggattccaggtgcctgccaccacgcccagctaatttttgtattttagtagagatggagtttcaccatgttggccaggcttctctggaactcctgacctcaagcgatctgcccgcct

SEQ ID NO: 87768 - DNA, 601 bp, Human
ttcttttatgagatggagtctctctctgttgccaaggctggaatgcagtggcgcaatctcagctcactgaaacctccacctcctgagttcaagcaattctgcctcagcctcccgagtagctgggattccaggtgcctgccaccacgcccagctaatttttgtattttagtagagatggagtttcaccatgttggccaggcttctctggaactcctgacctcaagcgatctgcccgccttggcctcccaaagtactgggattacaggtgtgagccactgtgcgtagctgctgtcttctttaratacattccctgtaccttttcttaacatataatggaattgttagccatgtgggattcatggcaaaatatactaccacttagctcttcctcactgaccctgctcttggctctatccatcctgtgagcagtaaaaatatactttgtccctgtaaatgtgtactgaactcatctgtagaaggcactgtggtcttttgggggaaccgatgaggcaaaaaaagtggatagttgagaggaagagaaataggactccgttgtaatcttctaatagcctgtaatgttatatgtgaggatatggcctat

SEQ ID NO: 87769 - DNA, 601 bp, Human
accacgcccagctaatttttgtattttagtagagatggagtttcaccatgttggccaggcttctctggaactcctgacctcaagcgatctgcccgccttggcctcccaaagtactgggattacaggtgtgagccactgtgcgtagctgctgtcttctttagatacattccctgtaccttttcttaacatataatggaattgttagccatgtgggattcatggcaaaatatactaccacttagctcttcctcactgaccctgctcttggctctatccatcctgtgagcagtaaaaatatacyttgtccctgtaaatgtgtactgaactcatctgtagaaggcactgtggtcttttgggggaaccgatgaggcaaaaaaagtggatagttgagaggaagagaaataggactccgttgtaatcttctaatagcctgtaatgttatatgtgaggatatggcctatactgcaggagcacaaagaagatagtgatatattcttctgaaggtgacacagtctgataattcttatcaaaagacttgcattttcatctggaggggtgagtggaattgtatcgttcgagacagcagcagggagtagcctga

SEQ ID NO: 87770 - DNA, 601 bp, Human
gtactgggattacaggtgtgagccactgtgcgtagctgctgtcttctttagatacattccctgtaccttttcttaacatataatggaattgttagccatgtgggattcatggcaaaatatactaccacttagctcttcctcactgaccctgctcttggctctatccatcctgtgagcagtaaaaatatactttgtccctgtaaatgtgtactgaactcatctgtagaaggcactgtggtcttttgggggaaccgatgaggcaaaaaaagtggatagttgagaggaagagaaataggactcygttgtaatcttctaatagcctgtaatgttatatgtgaggatatggcctatactgcaggagcacaaagaagatagtgatatattcttctgaaggtgacacagtctgataattcttatcaaaagacttgcattttcatctggaggggtgagtggaattgtatcgttcgagacagcagcagggagtagcctgagccacagggctgcaagcaagcaccaaggctgcatttagagatctgtaagcaaccagatggctgcagatgaagcctttgaaggcttgtagtagaatataggtctgggacca

SEQ ID NO: 87771 - DNA, 601 bp, Human
tgagtggaattgtatcgttcgagacagcagcagggagtagcctgagccacagggctgcaagcaagcaccaaggctgcatttagagatctgtaagcaaccagatggctgcagatgaagcctttgaaggcttgtagtagaatataggtctgggaccagcctggccaacatggtgaaaccccatctctactaaaaatacaaaaaatagctgtgcgtggtggcgcccgcctgtaatcccagctattcgggaggctgaggcaggagaatcgtttgaacccgggaggcggaggtttcagtgagccargatcacgccactgcgctccagcctggggacagagggagactccatttcgaaaaaaaaaaaaaaaaaaaaagagagaatataagtctggtagtttcctacagacagcgtgtagacacgtttaaatgccagattatgattttaatctgtcttttgtagataatgggattatttgaaggttctcaatcagggaaatctaaaattcattctgaaaaaggaacataggaaataagaccaactctagaatgatgcaggaaatgagcccaggtcagaaaaatgttctccagcaagccactcttcata

SEQ ID NO: 87772 - DNA, 601 bp, Human
tgacactgcatggatttatgcaattgaactaccttaatatttgaaactaaaatttctaaacattttaaaagtgtttgtcagggagtagttttagaataacagatgagaaaagttcagacatattcctgtagtgaattgcagataaaatgtgagcatagagtatcagagctttagtgggccttccaggtcatttagccaaacttacaggtgtgtgccaccatgcccagctaattttttgtatttttagtagagatggggtttcactatgttggcaaggatggtctcaatctcctgacctcgygactgacccacttcggccttccaaagtgctggggttacaggcatgagccaccgtgccctgcccctccccgccccccagctttttttttaaacggagctttcatttaaatcttttttttcctcccctaaatccttataacctaatagacactgaggagatcatgctttgaggtctattgtttaatacaacctttattcttgaaggctgtgtctatacatgcctctcataaaccattgcattttaataggtttattctgcagctacgttttgtttgaggaatctttctgagcacacaaattc

SEQ ID NO: 87773 - DNA, 601 bp, Human
aggtgtgtgccaccatgcccagctaattttttgtatttttagtagagatggggtttcactatgttggcaaggatggtctcaatctcctgacctcgtgactgacccacttcggccttccaaagtgctggggttacaggcatgagccaccgtgccctgcccctccccgccccccagctttttttttaaacggagctttcatttaaatcttttttttcctcccctaaatccttataacctaatagacactgaggagatcatgctttgaggtctattgtttaatacaacctttattcttgaaggytgtgtctatacatgcctctcataaaccattgcattttaataggtttattctgcagctacgttttgtttgaggaatctttctgagcacacaaattcatcatcactgatatttggacagtactgattgtgaagcactttcacatatattctcacttgagtgagatatagatatctcagttctgagatgtgcgtgatgtgctcctttcagggatgatgaaactaagactcaccaagaagattaatggtttctccttggccatatgtttgagcaccgcgtgagcacaactggactttgaatttt

SEQ ID NO: 87774 - DNA, 601 bp, Human
tgtttaatacaacctttattcttgaaggctgtgtctatacatgcctctcataaaccattgcattttaataggtttattctgcagctacgttttgtttgaggaatctttctgagcacacaaattcatcatcactgatatttggacagtactgattgtgaagcactttcacatatattctcacttgagtgagatatagatatctcagttctgagatgtgcgtgatgtgctcctttcagggatgatgaaactaagactcaccaagaagattaatggtttctccttggccatatgtttgagcacygcgtgagcacaactggactttgaattttggcttgtgcttgattttaagttctaaacaccagattgagggtgtcaggttttgtctttgtttttgtaatgattttaccatcgatgaaagctggcatcagtcatctgagtgacactgtcccttgaatgttgctttcccataaaaagaaaaacattcagaaggtcaaaaaaaattaattgtaatagccattaagtagaataagttcataattatggtaaaatacactttcgatgtgcctgttccattcagaaattaaaggatgatccattctaa

SEQ ID NO: 87775 - DNA, 601 bp, Human
gggatgatgaaactaagactcaccaagaagattaatggtttctccttggccatatgtttgagcaccgcgtgagcacaactggactttgaattttggcttgtgcttgattttaagttctaaacaccagattgagggtgtcaggttttgtctttgtttttgtaatgattttaccatcgatgaaagctggcatcagtcatctgagtgacactgtcccttgaatgttgctttcccataaaaagaaaaacattcagaaggtcaaaaaaaattaattgtaatagccattaagtagaataagttcatrattatggtaaaatacactttcgatgtgcctgttccattcagaaattaaaggatgatccattctaatttttttctattactatgatttaacaaagcaagagttaattgggagatatatctcatccttttgaattatcttccctctggtggaactgaattagatgtgttaatatttattggttaacataattataggctgtgagaacaataatcacacacttaaaatattaaaagtatgtgccaagagaagatgatgtctatagtagacggtgttgtgttataattgaaaggtacttgaaaa

SEQ ID NO: 87776 - DNA, 601 bp, Human
tttggcttgtgcttgattttaagttctaaacaccagattgagggtgtcaggttttgtctttgtttttgtaatgattttaccatcgatgaaagctggcatcagtcatctgagtgacactgtcccttgaatgttgctttcccataaaaagaaaaacattcagaaggtcaaaaaaaattaattgtaatagccattaagtagaataagttcataattatggtaaaatacactttcgatgtgcctgttccattcagaaattaaaggatgatccattctaatttttttctattactatgatttaacraagcaagagttaattgggagatatatctcatccttttgaattatcttccctctggtggaactgaattagatgtgttaatatttattggttaacataattataggctgtgagaacaataatcacacacttaaaatattaaaagtatgtgccaagagaagatgatgtctatagtagacggtgttgtgttataattgaaaggtacttgaaaagtcctagaaatgtagaccgttaatgcccaacattgatgtttctatttttgttcaaagcaaatttcaaaacctatagaatcacctgactact

SEQ ID NO: 87777 - DNA, 601 bp, Human
tcaatgtgctacttaaattgtcacgtaaatcaccacgtgtcaaaattattgggagataaaatacaggaataccaacattgtaccttatacctttcagtgtcagagaggactgcgtagagcaggcagtatttgagctaacttggcttaaagtgttacgggaagggcatgggattcaaggtgcaagaataacaagagtgagaaagtcaaggaacgtggaaagtgaatattatttgaagaataagtttgtctaatggggtatgtaaagtgtaaatgggattactgctgaaaaactcaaacttasttagcagtacctaagtagcccttttgatgcccaagggctttcattgttagaaagagaaatttacagggggatagcaacagtgttactggctgcagtgattttggagtaatgactttagcttacagctactttataaaaaaatcctccatgacgctgcatggatttatgcaattaaattacattagtgtttgaaaccaaaatttctaaacattttaaatgtgtttgtcagggagtagttttagaagaacagatgtgaaaagttcagaggtgatcctggagtgaattgcagacaaaatgtga

SEQ ID NO: 87778 - DNA, 601 bp, Human
aatgtgctacttaaattgtcacgtaaatcaccacgtgtcaaaattattgggagataaaatacaggaataccaacattgtaccttatacctttcagtgtcagagaggactgcgtagagcaggcagtatttgagctaacttggcttaaagtgttacgggaagggcatgggattcaaggtgcaagaataacaagagtgagaaagtcaaggaacgtggaaagtgaatattatttgaagaataagtttgtctaatggggtatgtaaagtgtaaatgggattactgctgaaaaactcaaacttacttagcagtacctaagtagcccttttgatgcccaagggctttcattgttagaaagagaaatttacagggggatagcaacagtgttactggctgcagtgattttggagtaatgactttagcttacagctactttataaaaaaatcctccatgacgctgcatggatttatgcaattaaattacattagtgtttgaaaccaaaatttctaaacattttaaatgtgtttgtcagggagtagttttagaagaacagatgtgaaaagttcagaggtgatcctggagtgaattgcagacaaaatgtgatc

SEQ ID NO: 87779 - DNA, 601 bp, Human
ggaataccaacattgtaccttatacctttcagtgtcagagaggactgcgtagagcaggcagtatttgagctaacttggcttaaagtgttacgggaagggcatgggattcaaggtgcaagaataacaagagtgagaaagtcaaggaacgtggaaagtgaatattatttgaagaataagtttgtctaatggggtatgtaaagtgtaaatgggattactgctgaaaaactcaaacttacttagcagtacctaagtagcccttttgatgcccaagggctttcattgttagaaagagaaatttacrgggggatagcaacagtgttactggctgcagtgattttggagtaatgactttagcttacagctactttataaaaaaatcctccatgacgctgcatggatttatgcaattaaattacattagtgtttgaaaccaaaatttctaaacattttaaatgtgtttgtcagggagtagttttagaagaacagatgtgaaaagttcagaggtgatcctggagtgaattgcagacaaaatgtgatcatagaatatcagagctttagtgggccttccagctcacttagccaaactcttattctacagatg

SEQ ID NO: 87780 - DNA, 601 bp, Human
aggactgcgtagagcaggcagtatttgagctaacttggcttaaagtgttacgggaagggcatgggattcaaggtgcaagaataacaagagtgagaaagtcaaggaacgtggaaagtgaatattatttgaagaataagtttgtctaatggggtatgtaaagtgtaaatgggattactgctgaaaaactcaaacttacttagcagtacctaagtagcccttttgatgcccaagggctttcattgttagaaagagaaatttacagggggatagcaacagtgttactggctgcagtgattttggrgtaatgactttagcttacagctactttataaaaaaatcctccatgacgctgcatggatttatgcaattaaattacattagtgtttgaaaccaaaatttctaaacattttaaatgtgtttgtcagggagtagttttagaagaacagatgtgaaaagttcagaggtgatcctggagtgaattgcagacaaaatgtgatcatagaatatcagagctttagtgggccttccagctcacttagccaaactcttattctacagatggaaagcttttgcccagagagggaaagaacacactcaagga

SEQ ID NO: 87781 - DNA, 601 bp, Human
aaatttacagggggatagcaacagtgttactggctgcagtgattttggagtaatgactttagcttacagctactttataaaaaaatcctccatgacgctgcatggatttatgcaattaaattacattagtgtttgaaaccaaaatttctaaacattttaaatgtgtttgtcagggagtagttttagaagaacagatgtgaaaagttcagaggtgatcctggagtgaattgcagacaaaatgtgatcatagaatatcagagctttagtgggccttccagctcacttagccaaactcttattytacagatggaaagcttttgcccagagagggaaagaacacactcaaggaggctcatttagagacagtttcagtgattctttgtattttccccgaactatgacacaaaggcccagcttgatgataaccacgaccaggggagagtttggtttcctttagtatcacaattggtttattccaaaaagtctttcttttatggcgtcttctttaaaataagtctcaaacacataacaaagaattaggcatatcaaagacgtacttcaatggtaaacagaaaacttatgacgttgtaacatctttaag

SEQ ID NO: 87782 - DNA, 601 bp, Human
agcttttgcccagagagggaaagaacacactcaaggaggctcatttagagacagtttcagtgattctttgtattttccccgaactatgacacaaaggcccagcttgatgataaccacgaccaggggagagtttggtttcctttagtatcacaattggtttattccaaaaagtctttcttttatggcgtcttctttaaaataagtctcaaacacataacaaagaattaggcatatcaaagacgtacttcaatggtaaacagaaaacttatgacgttgtaacatctttaagctagtatatatytaaacccaacccattaggtaggcatgatttgttagtataagtacagcttagcctctagaagctatgcaggggttggaacgaaattctgtctatttcttagaagacaagagatcaatcatgaactaatgacttttgtgttccttcttttatcagagttagggtacagtattcatcttctagtttctagtacagggctgtctttttttccccaagtaagtttggtaggattggagctgatgactgagtgacttggaacacttttcaaataaactgtcttacgttaatatttcatggtagctg

SEQ ID NO: 87783 - DNA, 601 bp, Human
tgctggtagcatcttttgttctaacattattttgttattgaccttggttcctgactcagagctactgaattctgtggaatttcctgagtgatggaaatatctattgttttgatgaggcaactcttggtgggctcctggattttggctggttaccagaatgaccaagcaatgatttgaagcttggaagtttaatcttcacctctcatcctctggggatgagaaaggggctagagattgaatgaataacaaatcatgcctatgttttgaatgttttgaagtctgtataaaaatccctgaagtrcagagaggtttcagattgttaagcacatctttatgccaggagggtggcataccccaactctatggtaacagaagctcctatacccaggacccttttggatctagccctgtgcacttcatcatctgcctgtccatctttatcctttatcgtatcctctataataaactagtaaatgtaagtaagcatttccctgagtttcatgagtaattctagcatattatcaaacttgggaaggggataatggcaaaccccaatttgtagtcaaatcagacagaagtctgggtaactggtgaccacccc

SEQ ID NO: 87784 - DNA, 601 bp, Human
ttgttctaacattattttgttattgaccttggttcctgactcagagctactgaattctgtggaatttcctgagtgatggaaatatctattgttttgatgaggcaactcttggtgggctcctggattttggctggttaccagaatgaccaagcaatgatttgaagcttggaagtttaatcttcacctctcatcctctggggatgagaaaggggctagagattgaatgaataacaaatcatgcctatgttttgaatgttttgaagtctgtataaaaatccctgaagtacagagaggtttcagrttgttaagcacatctttatgccaggagggtggcataccccaactctatggtaacagaagctcctatacccaggacccttttggatctagccctgtgcacttcatcatctgcctgtccatctttatcctttatcgtatcctctataataaactagtaaatgtaagtaagcatttccctgagtttcatgagtaattctagcatattatcaaacttgggaaggggataatggcaaaccccaatttgtagtcaaatcagacagaagtctgggtaactggtgaccacccctactctgccccacca

SEQ ID NO: 87785 - DNA, 601 bp, Human
ggacccttttggatctagccctgtgcacttcatcatctgcctgtccatctttatcctttatcgtatcctctataataaactagtaaatgtaagtaagcatttccctgagtttcatgagtaattctagcatattatcaaacttgggaaggggataatggcaaaccccaatttgtagtcaaatcagacagaagtctgggtaactggtgaccacccctactctgccccaccaccgcagcttgtgattgacatatgaagtggaaacagtcttgtgggacttgaacccttaacctgtgggatctgyaatagtaactccaggtagattgtgtcagaactgaattgagtcataaaacacccatctgataccatagaatcagttgatgtatgaaaaaaaccctcacatttagtgccagaagtaaagtgttctgtccaggcatggtatctcacacctggaatcccagcactttgggaggctgaggcaggttgattgcttgaggtcaggagtttgagaccagcctggtaaacatggcgaaaccccagctctactaaaaacaaacaaacaaacaaacaaacaaaacttagctgggggtggtggcatgcacct

SEQ ID NO: 87786 - DNA, 601 bp, Human
aggagacagaggttgcagtgagccgagattgtgccactgcactccagcctgggcaacagagcaaaactctgtctcaatcaatcaatcaatcaatcaatcaatagaagtgaagtgttctgtgagtagcatagaggaaagaggtgagtttttcttcttcaactaatatgaaaaatttggagatattttgaaaataagaatagggtggggcatagtttgatagcctcgtctccaagtttgccaacgggaagagcattggcttcttgattccctgaggtcccctctctgaaaggagctccatttrtgtgaacctgtccacgttaccagtttgtgcttccttttggttatttcaaaaatgggcagggtaactacactccattcccccttttcaaaagatagaatagtattctcaagctacaagaaataagatgatggctcaaagcaacagctcacacagtcattcccatttcattttgggattgttagcttgtgtctggagtttgttttaaaacttcaggcctttgaaggttgggggctggtcctttctgaatgctgttcatcctataaacgatatatttaattcctcactttaaaaactattcta

SEQ ID NO: 87787 - DNA, 601 bp, Human
cagtgagccgagattgtgccactgcactccagcctgggcaacagagcaaaactctgtctcaatcaatcaatcaatcaatcaatcaatagaagtgaagtgttctgtgagtagcatagaggaaagaggtgagtttttcttcttcaactaatatgaaaaatttggagatattttgaaaataagaatagggtggggcatagtttgatagcctcgtctccaagtttgccaacgggaagagcattggcttcttgattccctgaggtcccctctctgaaaggagctccatttatgtgaacctgtccaygttaccagtttgtgcttccttttggttatttcaaaaatgggcagggtaactacactccattcccccttttcaaaagatagaatagtattctcaagctacaagaaataagatgatggctcaaagcaacagctcacacagtcattcccatttcattttgggattgttagcttgtgtctggagtttgttttaaaacttcaggcctttgaaggttgggggctggtcctttctgaatgctgttcatcctataaacgatatatttaattcctcactttaaaaactattctaacttcttagtctatt

SEQ ID NO: 87788 - DNA, 601 bp, Human
tgttctgtgagtagcatagaggaaagaggtgagtttttcttcttcaactaatatgaaaaatttggagatattttgaaaataagaatagggtggggcatagtttgatagcctcgtctccaagtttgccaacgggaagagcattggcttcttgattccctgaggtcccctctctgaaaggagctccatttatgtgaacctgtccacgttaccagtttgtgcttccttttggttatttcaaaaatgggcagggtaactacactccattcccccttttcaaaagatagaatagtattctcaagcyacaagaaataagatgatggctcaaagcaacagctcacacagtcattcccatttcattttgggattgttagcttgtgtctggagtttgttttaaaacttcaggcctttgaaggttgggggctggtcctttctgaatgctgttcatcctataaacgatatatttaattcctcactttaaaaactattctaacttcttagtctatttggaaactgagtactgaaatgctgtgtggtcatatggacacatcgttagctgcagtcccagcactcccacactgggttcctttcatagagcaataat

SEQ ID NO: 87789 - DNA, 601 bp, Human
ggtggggcatagtttgatagcctcgtctccaagtttgccaacgggaagagcattggcttcttgattccctgaggtcccctctctgaaaggagctccatttatgtgaacctgtccacgttaccagtttgtgcttccttttggttatttcaaaaatgggcagggtaactacactccattcccccttttcaaaagatagaatagtattctcaagctacaagaaataagatgatggctcaaagcaacagctcacacagtcattcccatttcattttgggattgttagcttgtgtctggagtttgktttaaaacttcaggcctttgaaggttgggggctggtcctttctgaatgctgttcatcctataaacgatatatttaattcctcactttaaaaactattctaacttcttagtctatttggaaactgagtactgaaatgctgtgtggtcatatggacacatcgttagctgcagtcccagcactcccacactgggttcctttcatagagcaataatgtatgaggcaacctgagaaattatttcaggtatatgtgtgttgtatttagagctttttataagaattcatgtggtctgagggcttggg

SEQ ID NO: 87790 - DNA, 601 bp, Human
gaatgtatcttagctcctagtggggataggggagggcagctgagcagatagctgctgagtgccatggggtgttcattcagctaaagcatgggagggggttgtcttctgtggttctctagccatggtccttgtggtagcctttaactgtgatttgtttgtttgaccttgatgagtccttggctccgagatgattatgttacattacactgaatcactcaatccaacattggtttgaaaagaaacgaacaaagctgcctgttgagtttctctattttacaacagtatctcagtggaaataatyagtcctatgtctatgcagaagcacacatcacatttgcaaaattaaagagtgttcttgttaggactggtttctctgtttctttcttcctctcccactgtttaaatatctattttggtggtagtgttagtatgaaaccccatagttcctttcttttcttttctgatttaaaaagcaaataaacaagaaaacacaagtctagctatgttttttaactcaagatgactagatataaccacagcaaatatgtaggattgttgtgttttaagagaaaaagccgtgtctcagataatttgtagtcat

SEQ ID NO: 87791 - DNA, 601 bp, Human
tactgttgagataacataagaaagaaatatcaactctttttctatattctccacagaactgaggaaaacagaggactattatgttattatttcctaaataaagaccaatatgataaattccttatattcagtgagaggaaagaagttgcttaccgaatgtactgatatatgcttccttttttcagaaaacaacaacatcaaccaaaacacctgtataattattacatgaattttttttttttttttgatacggagtttcgctcttgttgcccaggctggagtgcaatggcatgatctcatstcaccgcaaccactgcctcccgggttcaagcaattctcccacctcagcctcctgagtaactgggattacagggatgtgccaccacgcctggctaatttttgtgtttttagtagagacaggttttctccatgttggtcagggtggcctcgaactcccgacctcaggtgatctgcccgcctcggcctcccaaagtgctgggattacaggcgtgagccactgcacccggccatattacaagatttttttttttgcgtttactgccaggaagctctgcttcattaaaagaagcctctaagattc

SEQ ID NO: 87792 - DNA, 601 bp, Human
gcccaggctggagtgcaatggcatgatctcatctcaccgcaaccactgcctcccgggttcaagcaattctcccacctcagcctcctgagtaactgggattacagggatgtgccaccacgcctggctaatttttgtgtttttagtagagacaggttttctccatgttggtcagggtggcctcgaactcccgacctcaggtgatctgcccgcctcggcctcccaaagtgctgggattacaggcgtgagccactgcacccggccatattacaagatttttttttttgcgtttactgccaggaarctctgcttcattaaaagaagcctctaagattcacctcttccttcctttaccaatttatttctgatacttcttgacccagtatttcaaatgtgataaatatatgccaattataaagcatttcaaaaccaattaattgtctaaatctaagtcatgctttttaagtggaaataaactttgtgtccatacacatatatttgcctataaacatcttaaaaatatatctaaacttcggacaattttaaaaagagagtattgaattttaaatggattctttgcttatattgatggtaaacagtggat

SEQ ID NO: 87793 - DNA, 601 bp, Human
cctggctaatttttgtgtttttagtagagacaggttttctccatgttggtcagggtggcctcgaactcccgacctcaggtgatctgcccgcctcggcctcccaaagtgctgggattacaggcgtgagccactgcacccggccatattacaagatttttttttttgcgtttactgccaggaagctctgcttcattaaaagaagcctctaagattcacctcttccttcctttaccaatttatttctgatacttcttgacccagtatttcaaatgtgataaatatatgccaattataaagcatktcaaaaccaattaattgtctaaatctaagtcatgctttttaagtggaaataaactttgtgtccatacacatatatttgcctataaacatcttaaaaatatatctaaacttcggacaattttaaaaagagagtattgaattttaaatggattctttgcttatattgatggtaaacagtggatccattaaagtagcatattctgctggtgtaaataaaatataagatttaaagtgggttaaaaagatataatatttacttgttccttttaagaaacaagttgaagaaacaataaagcttgaa

SEQ ID NO: 87794 - DNA, 601 bp, Human
accaatttatttctgatacttcttgacccagtatttcaaatgtgataaatatatgccaattataaagcatttcaaaaccaattaattgtctaaatctaagtcatgctttttaagtggaaataaactttgtgtccatacacatatatttgcctataaacatcttaaaaatatatctaaacttcggacaattttaaaaagagagtattgaattttaaatggattctttgcttatattgatggtaaacagtggatccattaaagtagcatattctgctggtgtaaataaaatataagatttaamgtgggttaaaaagatataatatttacttgttccttttaagaaacaagttgaagaaacaataaagcttgaagcctgtatagtcagatatatgaacccataaagtaaatcatttgtgaagtgtcttgaactctttctaatttcatcttgatgttgtactgcttatatgaaaatgctgaaaaatgttacttcttagatactgctagaggtgctaagcttcttaccattcaggaatcttcttcttggctctctccgtcacccagccaacacagagttatgttttatttcccaaatggccaactt

SEQ ID NO: 87795 - DNA, 601 bp, Human
acgttcaaacagggaaaaaatagttttctcaacaaatgatgctggaaccaccagatatctacaaagagtaaagctggactccctacctcatagtgtaagacacaaatgtaaaggataaaactatacaacttgtagaagaaaatatagaagtgaggttcatgaaattgggttagtcagtggtttcttaaacatgacatcaaagcacaaacaactgaagaaaaaatagatgagttggacttcctcagaattaaccaaatttgtgcttcaaatgacaccatcaagaaagtgaacaaacaatccrtggaatttgcaaatcatgtatctgttaaggggcttatatctggaatatattaagattcttacaactcattaagaaaaagacagcccaattaagtaagaaacaaagtatctgaatagacatttccctaaggatatacaagtggataatatgcctaggaaaagatgctggacatatttattgatcaaggaaatgcaagtcaaaccacaacgagatatcacttcacgctcactaaggtggctataataaaaaaagacaacatgtgttggcaatgtggtagagaaattgaaaacatcatacgtt

SEQ ID NO: 87796 - DNA, 601 bp, Human
caaagcacaaacaactgaagaaaaaatagatgagttggacttcctcagaattaaccaaatttgtgcttcaaatgacaccatcaagaaagtgaacaaacaatccgtggaatttgcaaatcatgtatctgttaaggggcttatatctggaatatattaagattcttacaactcattaagaaaaagacagcccaattaagtaagaaacaaagtatctgaatagacatttccctaaggatatacaagtggataatatgcctaggaaaagatgctggacatatttattgatcaaggaaatgcaagkcaaaccacaacgagatatcacttcacgctcactaaggtggctataataaaaaaagacaacatgtgttggcaatgtggtagagaaattgaaaacatcatacgttgctggtggattgtaaaatggcatagcccttttggaagcaatctgtcaattcttcaaaattggtcatagttaccacatgaccaagcaattatatttctatttatgtatccaagggaattaaaatatatgaccacacaaagacctgtatagagatgttcatagcaacatgattcataacagcctaaaagtgggaacaac

SEQ ID NO: 87797 - DNA, 601 bp, Human
aagtaagaaacaaagtatctgaatagacatttccctaaggatatacaagtggataatatgcctaggaaaagatgctggacatatttattgatcaaggaaatgcaagtcaaaccacaacgagatatcacttcacgctcactaaggtggctataataaaaaaagacaacatgtgttggcaatgtggtagagaaattgaaaacatcatacgttgctggtggattgtaaaatggcatagcccttttggaagcaatctgtcaattcttcaaaattggtcatagttaccacatgaccaagcaattayatttctatttatgtatccaagggaattaaaatatatgaccacacaaagacctgtatagagatgttcatagcaacatgattcataacagcctaaaagtgggaacaacctaaatatctatcagttggtgaatggataaacaaaatgtggtgtatccatacaattgaatattactcagccataaaaaggaacgaagctctgcaacatgctacgatatggatgaacctgggaaacattatgctatacgaaagaaaccagacaaaagcgaccacagtttatgattccatttatatgaatgggcaa

SEQ ID NO: 87798 - DNA, 601 bp, Human
atgatgtcccatccaactctctgaaatagattatctacctcttttcagctgggcatcttacttatgatatctgaggacatctctctgttcttgtgctttgcccagccccctttggtttctaatgcatggagccaaaagctacagctagagccataatggtcttgtcctaccatctgaaagacatgttgattgctagaatgtttctgtggttaacaagataattcctctgataagtgaacaaccttcacttaaatgcaaaaattatgactcatagattattaatttgtcacaatttactaamcctatcattggcctattgatgtaagttattcttgtcacgcttcacctacccagacgctaaagcatgtaaagcaatagttaagtttattgttcatctgattgacctggagggcttgttaaatgccattactgggctctaccttatgttttcaattcagtagggctggagtgaggctcaataatttgtatttcaagtgttgctctggtgtggaccacactttgtgaaccctttaaagcttcttgtcagtcacatgtttgtaagcagcactgtcttcctctgttctcttatttctatagctgc

SEQ ID NO: 87799 - DNA, 601 bp, Human
caataatttgtatttcaagtgttgctctggtgtggaccacactttgtgaaccctttaaagcttcttgtcagtcacatgtttgtaagcagcactgtcttcctctgttctcttatttctatagctgcacacccttaaggcttgccctagtgtcaaaagtggatgctagttttatgtcttttttctagaggaggaaaaaccataacctagagaagtatctttccctgcatacatagtacattgacagaatctggaagatgccctttaaaaaaaaaaaaagtaaagatttgtacctgccattctktctttcagaattgtaaatttatgtttattgatattaaatatgcctgtaatcccagcactttgggaagctgggaagggcggatcacctgaggtcaggagtccaagaccagactggccaacatgttgaaattctctttctaataaaaatacaaaaattagctgtgcatggtggcgggcacctgtaatcccagctacttaggaggctgaggcaggagaattgcttgaactcaggaggtggatgttgcagtgagccgagattgcacccctgcactctagcctaggtgacaagagcgaaactcca

SEQ ID NO: 87800 - DNA, 601 bp, Human
gaatgtcaactgtttgatctctctgaacctcattttctttgtccatgatattaatacctcctctgcttatcatatatgatattgtgagaagtaaatgacacattgtacattaaagtgctttgtgaactataaagcgctatacaaagattattttgcattctcatcccagttgtcacacacaatatcttgttaaacatcatctgttttatgataggcacatccttctctctctcagctagggtaaatattgacttttctaactgttttcaggaaggaaatagtgcactgtgaactacttgcyttgtgcacagaatccttttatttccctcctgtgattattttttcttttctagtctcttgctttttaaagtaaacaattaagaagcttgtcatttagccatttatgcatctaaacacttttgtatatgtgagatgtggtcacaaacataaacatatattatgaatttttctcataacatccttttatgcaagacatcctacacaccacatgtattaagaatgaagtgagttgctgttttgcctgaaatgcattattttttgtttttgtttttgacgtttgacttggaaaagggagttgagt

SEQ ID NO: 87801 - DNA, 601 bp, Human
gatattaatacctcctctgcttatcatatatgatattgtgagaagtaaatgacacattgtacattaaagtgctttgtgaactataaagcgctatacaaagattattttgcattctcatcccagttgtcacacacaatatcttgttaaacatcatctgttttatgataggcacatccttctctctctcagctagggtaaatattgacttttctaactgttttcaggaaggaaatagtgcactgtgaactacttgccttgtgcacagaatccttttatttccctcctgtgattattttttctwttctagtctcttgctttttaaagtaaacaattaagaagcttgtcatttagccatttatgcatctaaacacttttgtatatgtgagatgtggtcacaaacataaacatatattatgaatttttctcataacatccttttatgcaagacatcctacacaccacatgtattaagaatgaagtgagttgctgttttgcctgaaatgcattattttttgtttttgtttttgacgtttgacttggaaaagggagttgagttgagccaagagcaatgggtcctcttcccagttgtgtaaccagcagg

SEQ ID NO: 87802 - DNA, 601 bp, Human
ccttgtgcacagaatccttttatttccctcctgtgattattttttcttttctagtctcttgctttttaaagtaaacaattaagaagcttgtcatttagccatttatgcatctaaacacttttgtatatgtgagatgtggtcacaaacataaacatatattatgaatttttctcataacatccttttatgcaagacatcctacacaccacatgtattaagaatgaagtgagttgctgttttgcctgaaatgcattattttttgtttttgtttttgacgtttgacttggaaaagggagttgarttgagccaagagcaatgggtcctcttcccagttgtgtaaccagcaggttgtgttaggtaagtcagctcctttcttgaagcctcaggtacatttgtacatagatcgaaatctagtcttttctcatgccttccactctcaatgtctgtgttctcagtgttaaaaggaagtttcagaagatgaccttcaccttgatgaagaagtccgaacagagtatccccatttatctatctctattctgctaagatacttttcttttcatgcctcaggtctgactgctctttgcaattcagcctgttgcag

SEQ ID NO: 87803 - DNA, 601 bp, Human
atccttttatttccctcctgtgattattttttcttttctagtctcttgctttttaaagtaaacaattaagaagcttgtcatttagccatttatgcatctaaacacttttgtatatgtgagatgtggtcacaaacataaacatatattatgaatttttctcataacatccttttatgcaagacatcctacacaccacatgtattaagaatgaagtgagttgctgttttgcctgaaatgcattattttttgtttttgtttttgacgtttgacttggaaaagggagttgagttgagccaagagyaatgggtcctcttcccagttgtgtaaccagcaggttgtgttaggtaagtcagctcctttcttgaagcctcaggtacatttgtacatagatcgaaatctagtcttttctcatgccttccactctcaatgtctgtgttctcagtgttaaaaggaagtttcagaagatgaccttcaccttgatgaagaagtccgaacagagtatccccatttatctatctctattctgctaagatacttttcttttcatgcctcaggtctgactgctctttgcaattcagcctgttgcagtgaagctctgaca

SEQ ID NO: 87804 - DNA, 601 bp, Human
atattatgaatttttctcataacatccttttatgcaagacatcctacacaccacatgtattaagaatgaagtgagttgctgttttgcctgaaatgcattattttttgtttttgtttttgacgtttgacttggaaaagggagttgagttgagccaagagcaatgggtcctcttcccagttgtgtaaccagcaggttgtgttaggtaagtcagctcctttcttgaagcctcaggtacatttgtacatagatcgaaatctagtcttttctcatgccttccactctcaatgtctgtgttctcagygttaaaaggaagtttcagaagatgaccttcaccttgatgaagaagtccgaacagagtatccccatttatctatctctattctgctaagatacttttcttttcatgcctcaggtctgactgctctttgcaattcagcctgttgcagtgaagctctgacatgtctttcctttaggatgtgactggtcttcactaggactctcaatttcttagggcttacgtttctgttagtatgatcggaaatagaagaggccatgtcctgcctttaatcccctgggatagagatgttggtggattggggga

SEQ ID NO: 87805 - DNA, 601 bp, Human
tacacaccacatgtattaagaatgaagtgagttgctgttttgcctgaaatgcattattttttgtttttgtttttgacgtttgacttggaaaagggagttgagttgagccaagagcaatgggtcctcttcccagttgtgtaaccagcaggttgtgttaggtaagtcagctcctttcttgaagcctcaggtacatttgtacatagatcgaaatctagtcttttctcatgccttccactctcaatgtctgtgttctcagtgttaaaaggaagtttcagaagatgaccttcaccttgatgaagargtccgaacagagtatccccatttatctatctctattctgctaagatacttttcttttcatgcctcaggtctgactgctctttgcaattcagcctgttgcagtgaagctctgacatgtctttcctttaggatgtgactggtcttcactaggactctcaatttcttagggcttacgtttctgttagtatgatcggaaatagaagaggccatgtcctgcctttaatcccctgggatagagatgttggtggattgggggattgaggggtggagaggcttttatatttttagtgagtctttccct

SEQ ID NO: 87806 - DNA, 601 bp, Human
gaccttcaccttgatgaagaagtccgaacagagtatccccatttatctatctctattctgctaagatacttttcttttcatgcctcaggtctgactgctctttgcaattcagcctgttgcagtgaagctctgacatgtctttcctttaggatgtgactggtcttcactaggactctcaatttcttagggcttacgtttctgttagtatgatcggaaatagaagaggccatgtcctgcctttaatcccctgggatagagatgttggtggattgggggattgaggggtggagaggcttttatwtttttagtgagtctttccctttagtgattttcagagcatctccctattagtgcacagtaagaagtatttgttctttttgccatgcaacaaattgcttaaaaaccaagcagctgaaaacgcgtattttctctttgttcttggtgagacaggaatctgtatatagcttagctggaccaccaacttcttggtctttcacaaggctgcaatcaaggttttgactcagtctgcacttgtatctgaaggttcaacgggagaacgatcagcttccttgcttaggtggtttttaatttttttatatgg

SEQ ID NO: 87807 - DNA, 601 bp, Human
gtgaagctctgacatgtctttcctttaggatgtgactggtcttcactaggactctcaatttcttagggcttacgtttctgttagtatgatcggaaatagaagaggccatgtcctgcctttaatcccctgggatagagatgttggtggattgggggattgaggggtggagaggcttttatatttttagtgagtctttccctttagtgattttcagagcatctccctattagtgcacagtaagaagtatttgttctttttgccatgcaacaaattgcttaaaaaccaagcagctgaaaacgcrtattttctctttgttcttggtgagacaggaatctgtatatagcttagctggaccaccaacttcttggtctttcacaaggctgcaatcaaggttttgactcagtctgcacttgtatctgaaggttcaacgggagaacgatcagcttccttgcttaggtggtttttaatttttttatatggttcgatttcttccaggcagttgcataaagtgctttagtttatatctggttgttggctggagtctatcctcagttatttgtcatgggagcctctccatgtggcatctcactacatcaaagca

SEQ ID NO: 87808 - DNA, 601 bp, Human
agagatgttggtggattgggggattgaggggtggagaggcttttatatttttagtgagtctttccctttagtgattttcagagcatctccctattagtgcacagtaagaagtatttgttctttttgccatgcaacaaattgcttaaaaaccaagcagctgaaaacgcgtattttctctttgttcttggtgagacaggaatctgtatatagcttagctggaccaccaacttcttggtctttcacaaggctgcaatcaaggttttgactcagtctgcacttgtatctgaaggttcaacgggaraacgatcagcttccttgcttaggtggtttttaatttttttatatggttcgatttcttccaggcagttgcataaagtgctttagtttatatctggttgttggctggagtctatcctcagttatttgtcatgggagcctctccatgtggcatctcactacatcaaagcatggaagctgagcaagcaataggtagagtttgattacaagatggaagccataatcatttgaaacctaaatgtggaggggacagcccatcacacttaccatagtctgtttgtttgaagtaagtgactaggattag

SEQ ID NO: 87809 - DNA, 601 bp, Human
tagttctggatcccatacttttcaccactctgccagattatttctatgttgttatctgtttttatgtcttaaataatatttatgccatgctgttactaatcaccatttccatccctgtctctgtatctcagttagagaaagtgggtagataaggactggatatcagactggatagggaggaaacacatgcaggagtatcattacctttgagagaggtgggtctgagcttgtccctaagtgctcctggaccagttctaggagatctcaagaaaagaagcaacgtaacatttcactagttccwtacagagtttatattggccttaatgattttgcctttaatttaataagacatatgggagtctacggaatctagggaaggcagctgagtaagtaacgatatttttaaaaaaattggaaataggggccaatatttgaagactaatgaaattcaggggcatctattctcgttccacaaaagtttagctatctggtattccatctggtgatctattcaatcaattaactcttccatattgggatgtttgtcagagtccagcttacaaattgaggaaatccacagtcacttgtgagctagtttgta

SEQ ID NO: 87810 - DNA, 601 bp, Human
acaacacacatgcacaatataaattcctctacaatccctctatttatcctcagtgcaaaacctcaattaactaatagctcatctgaaaactgtcagggctagaaagtcccataacccctcaggataaaatcacaccaaccgtaagttacttaggctctccaaggtcagcctccttttatctagcttccctctttttataaagctgcgggcctgtctctaacaggatcatgtggtaacattcatgatttgcaagagctttactgctacaaagcacatttgcaatacactgtctctttttttkacttggcatttgcgatttaattgttaacccacctgatatatagtgaaattgtggcccagaaatgtgaaatgactgctcttaatttttacaaaaataaaacaaaataatctaatccttaaagtcgtgtcttcttttgcaaaatcctagtacatttttagtacatcagttgtgttccgtagctggggactctgttcaagtgaaccttaataagaagtgtgatgtataaaatggcagagtttgaggtgttctgactgaaataaggagtctgggctctggagcgtggctgagcatcttcttgct

SEQ ID NO: 87811 - DNA, 601 bp, Human
atataaattcctctacaatccctctatttatcctcagtgcaaaacctcaattaactaatagctcatctgaaaactgtcagggctagaaagtcccataacccctcaggataaaatcacaccaaccgtaagttacttaggctctccaaggtcagcctccttttatctagcttccctctttttataaagctgcgggcctgtctctaacaggatcatgtggtaacattcatgatttgcaagagctttactgctacaaagcacatttgcaatacactgtctcttttttttacttggcatttgcgawttaattgttaacccacctgatatatagtgaaattgtggcccagaaatgtgaaatgactgctcttaatttttacaaaaataaaacaaaataatctaatccttaaagtcgtgtcttcttttgcaaaatcctagtacatttttagtacatcagttgtgttccgtagctggggactctgttcaagtgaaccttaataagaagtgtgatgtataaaatggcagagtttgaggtgttctgactgaaataaggagtctgggctctggagcgtggctgagcatcttcttgctcactccagaaacggcc

SEQ ID NO: 87812 - DNA, 601 bp, Human
ttatctagcttccctctttttataaagctgcgggcctgtctctaacaggatcatgtggtaacattcatgatttgcaagagctttactgctacaaagcacatttgcaatacactgtctcttttttttacttggcatttgcgatttaattgttaacccacctgatatatagtgaaattgtggcccagaaatgtgaaatgactgctcttaatttttacaaaaataaaacaaaataatctaatccttaaagtcgtgtcttcttttgcaaaatcctagtacatttttagtacatcagttgtgttcygtagctggggactctgttcaagtgaaccttaataagaagtgtgatgtataaaatggcagagtttgaggtgttctgactgaaataaggagtctgggctctggagcgtggctgagcatcttcttgctcactccagaaacggccctgaggcttcttcatgtctagtgttgtgaaaaccactcaactgcagtgtgcttattacctatgtctaaccttggagcactcagaaaagacctaatgcttattttactgtctgaagtgggaagacagccattgttaacgtgggatctcccctagcattct

SEQ ID NO: 87813 - DNA, 601 bp, Human
aaaaaatacaaactcagtttacctgagactgagtagcacagaggtctccactaccactcatttccctcttcacatggcaatggaacttttcattaaaaataaattgtatttactcatgtatattcttatgctaaactgataccctttttcacaatggataaaacaacaataaatgtttgcagcctcgcacatcaattctcgaaccctgttctgcaatttctggcaataaaaggccttgcttagtgtgcattaaaatcttggttctaaagtcagtgtctactttcatagaaagtatagtttstgacctctgttactatattttcaccagcaatttgcacacttgtcatgaggctttctctttgtatgggtcttagataatgcagtatcttgacatggtacttctatggtaagacaaagaggatgctgtttttgtattaatgcgaccaaaatatttcaaagccaatcttacagaatccccctattggacatcccccataaattttttaatggaacaaaacccctctgtgagaaataacaatttgtatacgatttcaaaggcataattcaaactatagctgaataagaaaaataatacaggatc

SEQ ID NO: 87814 - DNA, 601 bp, Human
acttgtcatgaggctttctctttgtatgggtcttagataatgcagtatcttgacatggtacttctatggtaagacaaagaggatgctgtttttgtattaatgcgaccaaaatatttcaaagccaatcttacagaatccccctattggacatcccccataaattttttaatggaacaaaacccctctgtgagaaataacaatttgtatacgatttcaaaggcataattcaaactatagctgaataagaaaaataatacaggatctaacaaggcaacacttaatgaaaaatcaagggccaggygcagtggctcgtgcctgtaatcccagcactttgggaggccgaggcgggtggatcacaaggtcaggagatcgagaccatcctggctaacatggtgaaaccccgtctctactaaaaatacaaaaatttagttgggtgtggtggcatgtacctgtagtcacagctgctggggaggctgaggcaggagaatcgcttgaacctgagaggcggaggttgcggtgagccgagatcacgccactgcactccagcctgggtgacagagcaagactccatctcaaaaaaaaaaaaaaaaaaaaaaatcga

SEQ ID NO: 87815 - DNA, 601 bp, Human
caggtgcagtggctcgtgcctgtaatcccagcactttgggaggccgaggcgggtggatcacaaggtcaggagatcgagaccatcctggctaacatggtgaaaccccgtctctactaaaaatacaaaaatttagttgggtgtggtggcatgtacctgtagtcacagctgctggggaggctgaggcaggagaatcgcttgaacctgagaggcggaggttgcggtgagccgagatcacgccactgcactccagcctgggtgacagagcaagactccatctcaaaaaaaaaaaaaaaaaaaaaaatcgaacaagtctttggatattaaccatagtgatcatgccctaagtatgtatttactttaggtaaatcttagtaaagcaggaattagctggttagctgcacttactggctttaggttgctggttagttaactggaaaggctgttagtttagaggtgatacgacacatagattatggtttaaaaaggttgcagcccttatttctagaatgtattcaatggtatctgtgctgcctaacccatagggttatgttttaaacgatatgatataaatgtgttatactacattttgaaacgttagttg

SEQ ID NO: 87816 - DNA, 601 bp, Human
gatcacaaggtcaggagatcgagaccatcctggctaacatggtgaaaccccgtctctactaaaaatacaaaaatttagttgggtgtggtggcatgtacctgtagtcacagctgctggggaggctgaggcaggagaatcgcttgaacctgagaggcggaggttgcggtgagccgagatcacgccactgcactccagcctgggtgacagagcaagactccatctcaaaaaaaaaaaaaaaaaaaaaaatcgaacaagtctttggatattaaccatagtgatcatgccctaagtatgtatttaytttaggtaaatcttagtaaagcaggaattagctggttagctgcacttactggctttaggttgctggttagttaactggaaaggctgttagtttagaggtgatacgacacatagattatggtttaaaaaggttgcagcccttatttctagaatgtattcaatggtatctgtgctgcctaacccatagggttatgttttaaacgatatgatataaatgtgttatactacattttgaaacgttagttggtgtcactatatcttttggcaaagagtctccttatgaacttcagggagcttgttt

SEQ ID NO: 87817 - DNA, 601 bp, Human
tcacagctgctggggaggctgaggcaggagaatcgcttgaacctgagaggcggaggttgcggtgagccgagatcacgccactgcactccagcctgggtgacagagcaagactccatctcaaaaaaaaaaaaaaaaaaaaaaatcgaacaagtctttggatattaaccatagtgatcatgccctaagtatgtatttactttaggtaaatcttagtaaagcaggaattagctggttagctgcacttactggctttaggttgctggttagttaactggaaaggctgttagtttagaggtgataygacacatagattatggtttaaaaaggttgcagcccttatttctagaatgtattcaatggtatctgtgctgcctaacccatagggttatgttttaaacgatatgatataaatgtgttatactacattttgaaacgttagttggtgtcactatatcttttggcaaagagtctccttatgaacttcagggagcttgtttctacagaaggagtttggttcataagatgttttccataagaattatataaatttttatataaaaaagtagtgcccaaactattaactcatggagagagatcaaat

SEQ ID NO: 87818 - DNA, 601 bp, Human
ggagaatcgcttgaacctgagaggcggaggttgcggtgagccgagatcacgccactgcactccagcctgggtgacagagcaagactccatctcaaaaaaaaaaaaaaaaaaaaaaatcgaacaagtctttggatattaaccatagtgatcatgccctaagtatgtatttactttaggtaaatcttagtaaagcaggaattagctggttagctgcacttactggctttaggttgctggttagttaactggaaaggctgttagtttagaggtgatacgacacatagattatggtttaaaaagkttgcagcccttatttctagaatgtattcaatggtatctgtgctgcctaacccatagggttatgttttaaacgatatgatataaatgtgttatactacattttgaaacgttagttggtgtcactatatcttttggcaaagagtctccttatgaacttcagggagcttgtttctacagaaggagtttggttcataagatgttttccataagaattatataaatttttatataaaaaagtagtgcccaaactattaactcatggagagagatcaaattctggtctttttaaaattaagctcta

SEQ ID NO: 87819 - DNA, 601 bp, Human
gccgagatcacgccactgcactccagcctgggtgacagagcaagactccatctcaaaaaaaaaaaaaaaaaaaaaaatcgaacaagtctttggatattaaccatagtgatcatgccctaagtatgtatttactttaggtaaatcttagtaaagcaggaattagctggttagctgcacttactggctttaggttgctggttagttaactggaaaggctgttagtttagaggtgatacgacacatagattatggtttaaaaaggttgcagcccttatttctagaatgtattcaatggtatctstgctgcctaacccatagggttatgttttaaacgatatgatataaatgtgttatactacattttgaaacgttagttggtgtcactatatcttttggcaaagagtctccttatgaacttcagggagcttgtttctacagaaggagtttggttcataagatgttttccataagaattatataaatttttatataaaaaagtagtgcccaaactattaactcatggagagagatcaaattctggtctttttaaaattaagctctattagtccattttcacaccgctgataaggacataccagag

SEQ ID NO: 87820 - DNA, 601 bp, Human
cagagcaagactccatctcaaaaaaaaaaaaaaaaaaaaaaatcgaacaagtctttggatattaaccatagtgatcatgccctaagtatgtatttactttaggtaaatcttagtaaagcaggaattagctggttagctgcacttactggctttaggttgctggttagttaactggaaaggctgttagtttagaggtgatacgacacatagattatggtttaaaaaggttgcagcccttatttctagaatgtattcaatggtatctgtgctgcctaacccatagggttatgttttaaacgakatgatataaatgtgttatactacattttgaaacgttagttggtgtcactatatcttttggcaaagagtctccttatgaacttcagggagcttgtttctacagaaggagtttggttcataagatgttttccataagaattatataaatttttatataaaaaagtagtgcccaaactattaactcatggagagagatcaaattctggtctttttaaaattaagctctattagtccattttcacaccgctgataaggacataccagagactgggaagaaaaggatattttattggacttacag

SEQ ID NO: 87821 - DNA, 601 bp, Human
aattatggggtaaaagtcaagatgagatttgggtggggacagagccaagccatatcacaagcttagtgagaaacctaattgcttatatactatctattattttcaaattcattttaatattttggattcttatccaactaagagatatagggaacaaatgctgtaataatcacccatctgtaaaatatggaccttctcatagggaacttacgttttagtagggaaaatataacatatacactaatagagattacagagtaggaggtcctttacagagtaaaaggagaatggagatgtacartttggtgtgtactgtgggttgaggaagattgtgtgttgcggaagatggtgacagctactgacgagtcactttctgccatagagatcaattttccattggtcaattgtggacattcactaatgtaggttggagtgatgcttcaggagcagacatggcataaactatttcaggaaaccataaacagcttagctttatcttcagagtagggtatgaaaagggagagaccaatggtaaaaatccaaattagaatgatgtgatgccatcttggaggcccttgtaagtcaagcaaaggagtttgtg

SEQ ID NO: 87822 - DNA, 601 bp, Human
ggggacagagccaagccatatcacaagcttagtgagaaacctaattgcttatatactatctattattttcaaattcattttaatattttggattcttatccaactaagagatatagggaacaaatgctgtaataatcacccatctgtaaaatatggaccttctcatagggaacttacgttttagtagggaaaatataacatatacactaatagagattacagagtaggaggtcctttacagagtaaaaggagaatggagatgtacagtttggtgtgtactgtgggttgaggaagattgtgkgttgcggaagatggtgacagctactgacgagtcactttctgccatagagatcaattttccattggtcaattgtggacattcactaatgtaggttggagtgatgcttcaggagcagacatggcataaactatttcaggaaaccataaacagcttagctttatcttcagagtagggtatgaaaagggagagaccaatggtaaaaatccaaattagaatgatgtgatgccatcttggaggcccttgtaagtcaagcaaaggagtttgtgcaaaaagtttgaacattaacaacaacaaacaaac

SEQ ID NO: 87823 - DNA, 601 bp, Human
aaaatatggaccttctcatagggaacttacgttttagtagggaaaatataacatatacactaatagagattacagagtaggaggtcctttacagagtaaaaggagaatggagatgtacagtttggtgtgtactgtgggttgaggaagattgtgtgttgcggaagatggtgacagctactgacgagtcactttctgccatagagatcaattttccattggtcaattgtggacattcactaatgtaggttggagtgatgcttcaggagcagacatggcataaactatttcaggaaaccataarcagcttagctttatcttcagagtagggtatgaaaagggagagaccaatggtaaaaatccaaattagaatgatgtgatgccatcttggaggcccttgtaagtcaagcaaaggagtttgtgcaaaaagtttgaacattaacaacaacaaacaaacaaacaaacagaaaacagaaaaaaatattgcattgtatctgtgggaccttcccatccttaggttttaattttcccctctgtcaaatgagagattttacttgataatctccaaaattgtgaccagctctaatgttttacaattcccaga

SEQ ID NO: 87824 - DNA, 601 bp, Human
tcacatagtagaactgaagtgatttctacagtagctctatagctagcaacccagcattggataaactcaaggaatgaaaaatctagtgtgtgctggggttgggagggtagtcatatattactgatttaactgtcatctggaaaactttatgggaactaagtagaggatgccataaggaccattaactgctcctaagatatgatgagcaaagactggagaataggagtgggcctagtctacagattagttttctattattgctgtaacaagataccacgaaattggtgtcttaaaacatcamaaatttcttatcttacagtgctgtaggtcagaattctagtccaggactcactgggttaagatgaaggtgtcagcagagcttcgttcctttctggaggctctagtcatagtcattacctttcccagcttctagaggctgcccatatttcttggctctcggactctgtctttctagtgacattgcatttctctgaccactctttcatagtcatgtctctctgaccacagctgggaaagattctttgcttttaagaactcatgtgattagatgaggctcacctggataattcaggctaatctc

SEQ ID NO: 87825 - DNA, 601 bp, Human
attaactgctcctaagatatgatgagcaaagactggagaataggagtgggcctagtctacagattagttttctattattgctgtaacaagataccacgaaattggtgtcttaaaacatcacaaatttcttatcttacagtgctgtaggtcagaattctagtccaggactcactgggttaagatgaaggtgtcagcagagcttcgttcctttctggaggctctagtcatagtcattacctttcccagcttctagaggctgcccatatttcttggctctcggactctgtctttctagtgacaytgcatttctctgaccactctttcatagtcatgtctctctgaccacagctgggaaagattctttgcttttaagaactcatgtgattagatgaggctcacctggataattcaggctaatctccctgtctcaaaatctttaaccttaatcacatctgcaaagtctttgtaatcaacatgttcacaagttcgaggaattagagtgtgtacattcttggcggggtggggagggctgttcttatgcttatcacagtctgtttttaggaaagtagataagttcacaacgttaatgcatggaggctga

SEQ ID NO: 87826 - DNA, 601 bp, Human
tgcatttctctgaccactctttcatagtcatgtctctctgaccacagctgggaaagattctttgcttttaagaactcatgtgattagatgaggctcacctggataattcaggctaatctccctgtctcaaaatctttaaccttaatcacatctgcaaagtctttgtaatcaacatgttcacaagttcgaggaattagagtgtgtacattcttggcggggtggggagggctgttcttatgcttatcacagtctgtttttaggaaagtagataagttcacaacgttaatgcatggaggctgasattgtgagaagaaatgaagcagccagtcataaagtgtgtttcgtgctaatgtaaagagttctgaagttattctgatggccatagagagctattcaattctacctagtagaggaatatttaatctataatgatgtcaaacaattgaagtgggtagcttgtggtacccaaccatccttcgcattttaaacatgggaaaatgaagactattttttgactcagtatacttgggacacatattagtgccatgtacctatcattattttcccatatcatgtgtttttctaccctttcctcctactt

SEQ ID NO: 87827 - DNA, 601 bp, Human
attctgatggccatagagagctattcaattctacctagtagaggaatatttaatctataatgatgtcaaacaattgaagtgggtagcttgtggtacccaaccatccttcgcattttaaacatgggaaaatgaagactattttttgactcagtatacttgggacacatattagtgccatgtacctatcattattttcccatatcatgtgtttttctaccctttcctcctacttgtttttcctctagcctgtgagaatgccattcatgatttataatgttctgggtaaaaagttcaggtagayctacattaagcaaaggtaactcagatttggaagactgaagcttggtagcagggagggggttacttaggacagagagatgccttggaatggccgcacattgagctcgtgcatgttggagctggcattacccatgtgaggaggtggatgacctgtctatatattcaacactagcttttctttgagatccccacaaaacagatctaggaaatctaatgaaagaattatccctgctacaccgtgtttttaacataggaacggacagttaacttgtgtgtttgttcaagaatgattcataatgca

SEQ ID NO: 87828 - DNA, 601 bp, Human
agatgaactggtgaatagaagaagcctagtaaattggaagattctcttgatgaaacagagaaattgagatttattattcagtcacttccaattacactgttgtgttgcagaggaaagcagctaaacaggatgttggctggtaacaccagcaaagtggaatcaacctcaaaggagatggtgtcagagtggtgttcaatgcctgagcttctaccgagtgagtcacttgtgtgaaaatgtcttgacacagatagaattgaggtgcccacactatatctgatcacagaaatgttaatgcagaatwgcaaactggctttcatcttcatgggattgcaggctgggggataaaagggggtgcatttttaaaggtcatctctattgcttatgagaaaacaatgtatcacatcccatgcatctgtgagactgtatatcaagaatcagaaataaatacatttgaaggaaaactgcaagttgtttctcacgtgtgaatttgatgcttttttttttaaaaaagaaagattttctggaagaatttagcctcctgaaaacttgtttcttctgtgttgtagttgataatatctaccacccactgtggtgcatggag

SEQ ID NO: 87829 - DNA, 601 bp, Human
acaggatgttggctggtaacaccagcaaagtggaatcaacctcaaaggagatggtgtcagagtggtgttcaatgcctgagcttctaccgagtgagtcacttgtgtgaaaatgtcttgacacagatagaattgaggtgcccacactatatctgatcacagaaatgttaatgcagaatagcaaactggctttcatcttcatgggattgcaggctgggggataaaagggggtgcatttttaaaggtcatctctattgcttatgagaaaacaatgtatcacatcccatgcatctgtgagactgtrtatcaagaatcagaaataaatacatttgaaggaaaactgcaagttgtttctcacgtgtgaatttgatgcttttttttttaaaaaagaaagattttctggaagaatttagcctcctgaaaacttgtttcttctgtgttgtagttgataatatctaccacccactgtggtgcatggagaggaaaaaccttctatcccctactttatgtgttattgatgtgacataatttttcagaatagccacacaatttcaaatgtgacttcttttctaacttgcaaatagagctgacaacagcaagatat

SEQ ID NO: 87830 - DNA, 601 bp, Human
atggtgtcagagtggtgttcaatgcctgagcttctaccgagtgagtcacttgtgtgaaaatgtcttgacacagatagaattgaggtgcccacactatatctgatcacagaaatgttaatgcagaatagcaaactggctttcatcttcatgggattgcaggctgggggataaaagggggtgcatttttaaaggtcatctctattgcttatgagaaaacaatgtatcacatcccatgcatctgtgagactgtatatcaagaatcagaaataaatacatttgaaggaaaactgcaagttgtttytcacgtgtgaatttgatgcttttttttttaaaaaagaaagattttctggaagaatttagcctcctgaaaacttgtttcttctgtgttgtagttgataatatctaccacccactgtggtgcatggagaggaaaaaccttctatcccctactttatgtgttattgatgtgacataatttttcagaatagccacacaatttcaaatgtgacttcttttctaacttgcaaatagagctgacaacagcaagatatgtcctgtaaacaaaccccaaaagaatatttttgaacaagttgtagttcaa

SEQ ID NO: 87831 - DNA, 601 bp, Human
gcttctaccgagtgagtcacttgtgtgaaaatgtcttgacacagatagaattgaggtgcccacactatatctgatcacagaaatgttaatgcagaatagcaaactggctttcatcttcatgggattgcaggctgggggataaaagggggtgcatttttaaaggtcatctctattgcttatgagaaaacaatgtatcacatcccatgcatctgtgagactgtatatcaagaatcagaaataaatacatttgaaggaaaactgcaagttgtttctcacgtgtgaatttgatgctttttttttwaaaaaagaaagattttctggaagaatttagcctcctgaaaacttgtttcttctgtgttgtagttgataatatctaccacccactgtggtgcatggagaggaaaaaccttctatcccctactttatgtgttattgatgtgacataatttttcagaatagccacacaatttcaaatgtgacttcttttctaacttgcaaatagagctgacaacagcaagatatgtcctgtaaacaaaccccaaaagaatatttttgaacaagttgtagttcaatttataccagattatggaacactagagat

SEQ ID NO: 87832 - DNA, 601 bp, Human
cttctaccgagtgagtcacttgtgtgaaaatgtcttgacacagatagaattgaggtgcccacactatatctgatcacagaaatgttaatgcagaatagcaaactggctttcatcttcatgggattgcaggctgggggataaaagggggtgcatttttaaaggtcatctctattgcttatgagaaaacaatgtatcacatcccatgcatctgtgagactgtatatcaagaatcagaaataaatacatttgaaggaaaactgcaagttgtttctcacgtgtgaatttgatgcttttttttttwaaaaagaaagattttctggaagaatttagcctcctgaaaacttgtttcttctgtgttgtagttgataatatctaccacccactgtggtgcatggagaggaaaaaccttctatcccctactttatgtgttattgatgtgacataatttttcagaatagccacacaatttcaaatgtgacttcttttctaacttgcaaatagagctgacaacagcaagatatgtcctgtaaacaaaccccaaaagaatatttttgaacaagttgtagttcaatttataccagattatggaacactagagatt

SEQ ID NO: 87833 - DNA, 601 bp, Human
cagatatacatttagagctttgagcctggatcatatcacctaaggtaatggaggaagccatgaatattttgatgtcatggagaaaatagaggaactattaaagaatgcttgggacaagaaacactgaggtgggaggaaatgcaaaggacagtggtgtccagaaatgaagtgaaaaatgtgcttcaagagtgagtgtgtgatcaaggtatccacaccattggatcaaatgccatgaggattaaaagttggaccaatggatctagatcttagttgaggattgccttgataagaacagttatcrttactcttctgagctatttgctcacacttgccttactttttgtcaaagtcgaggcccctctaaataatggttaaatacaagggctctggagttgccctgtctgaggtcaaatcctagtttcatatttactagttgtttgagcttggaaagtttaattaacccttctgtgtgcttcagttttttttgtttgtttgttttacttttgaaaggaaagaaatgatatgttttgtctcataggtttattgggaagattgcaaaaattaaacatataccatagtgtctgtcatatagtaaattacc

SEQ ID NO: 87834 - DNA, 601 bp, Human
tgtgcttcaagagtgagtgtgtgatcaaggtatccacaccattggatcaaatgccatgaggattaaaagttggaccaatggatctagatcttagttgaggattgccttgataagaacagttatcgttactcttctgagctatttgctcacacttgccttactttttgtcaaagtcgaggcccctctaaataatggttaaatacaagggctctggagttgccctgtctgaggtcaaatcctagtttcatatttactagttgtttgagcttggaaagtttaattaacccttctgtgtgcttcwgttttttttgtttgtttgttttacttttgaaaggaaagaaatgatatgttttgtctcataggtttattgggaagattgcaaaaattaaacatataccatagtgtctgtcatatagtaaattaccaataattgttagctctagtgattaagaataaaatgatcactaacatctataaaattacacctgacttatatttccttcttaccctgaaaatcatacaaactctttctagagttgtgcttgagtcggttgcactattttctgcctttttgtttttttggtttgattttttttcagtt

SEQ ID NO: 87835 - DNA, 601 bp, Human
agaataaaatgatcactaacatctataaaattacacctgacttatatttccttcttaccctgaaaatcatacaaactctttctagagttgtgcttgagtcggttgcactattttctgcctttttgtttttttggtttgattttttttcagtttttttaatcattacatgaattaacctcattatgatctaattacttccacatagttctccagattgtgaatgctctgcgaaaccatagcttgttcatatcttagaaccttatgcaagggttggcacttttggcacttcaggcttgaaatycaggtttctgaatgccctggtgattgattgacatttcaccttcaaggtcattccaatacttaatgtagaagtgatagggtaaactcttaattactggaattacctataaataaataaatgacttaaatttcctaaaataatagttaatgtcttgttaatctgagttccttttctctgtaaattatttcacaggcatgaccctctgtaattttctcaccttttaaagtgatcctgaggtatatcatgcaggatagttgacctttgggattggtgttcttgccctacggtagatagctttgt

SEQ ID NO: 87836 - DNA, 601 bp, Human
gaataaaatgatcactaacatctataaaattacacctgacttatatttccttcttaccctgaaaatcatacaaactctttctagagttgtgcttgagtcggttgcactattttctgcctttttgtttttttggtttgattttttttcagtttttttaatcattacatgaattaacctcattatgatctaattacttccacatagttctccagattgtgaatgctctgcgaaaccatagcttgttcatatcttagaaccttatgcaagggttggcacttttggcacttcaggcttgaaatcmaggtttctgaatgccctggtgattgattgacatttcaccttcaaggtcattccaatacttaatgtagaagtgatagggtaaactcttaattactggaattacctataaataaataaatgacttaaatttcctaaaataatagttaatgtcttgttaatctgagttccttttctctgtaaattatttcacaggcatgaccctctgtaattttctcaccttttaaagtgatcctgaggtatatcatgcaggatagttgacctttgggattggtgttcttgccctacggtagatagctttgtg

SEQ ID NO: 87837 - DNA, 601 bp, Human
aataaaatgatcactaacatctataaaattacacctgacttatatttccttcttaccctgaaaatcatacaaactctttctagagttgtgcttgagtcggttgcactattttctgcctttttgtttttttggtttgattttttttcagtttttttaatcattacatgaattaacctcattatgatctaattacttccacatagttctccagattgtgaatgctctgcgaaaccatagcttgttcatatcttagaaccttatgcaagggttggcacttttggcacttcaggcttgaaatccaggtttctgaatgccctggtgattgattgacatttcaccttcaaggtcattccaatacttaatgtagaagtgatagggtaaactcttaattactggaattacctataaataaataaatgacttaaatttcctaaaataatagttaatgtcttgttaatctgagttccttttctctgtaaattatttcacaggcatgaccctctgtaattttctcaccttttaaagtgatcctgaggtatatcatgcaggatagttgacctttgggattggtgttcttgccctacggtagatagctttgtga

SEQ ID NO: 87838 - DNA, 601 bp, Human
tgatctagaacctctacaaaggctgtccttccttcttgataataagtcagtgcatttacctaatatctgggagtttacaaagtatcttcatttattcattagtattgaagtctcagtagtaactcctgaagatggggattcttacccacattttagagatgaggaaacaggatgggagatgaaaggatgttctcaggagtcccacagtaggtgttagttacatagcttggatttcaagcagcatccttctcccaatcccaggtcctggcctgaatgtaaatgtgatttccaatccaagttygaatgtctgtgcactcattagtccctagacaaatctggtttttcttgcatgagaatgaaattgaactttcaaacattttcttaagcctgtaggatctacattctcttcattttctaatatacttgtaactttaaattccttattaagcccgaaggatatttcacttcattgtagaaatttaccattgccattggcttctgcaaaacttggcagtgaactttttttaaaaaacgtggccattgagagtggtccccttgatacttgagtgtgtattgtcccaaacattgcctcaataggtag

SEQ ID NO: 87839 - DNA, 601 bp, Human
acgtggccattgagagtggtccccttgatacttgagtgtgtattgtcccaaacattgcctcaataggtagttactgtagaagaaaatgccgtagttttaatggcagccttgaattttctcctctctcctttaatggaaatccattctatacttattaatccactgagcttgtcagtacacatccctgtcatttctcaaaaatgtaaggaaacagcatgtatagaacaagcactggactaaaagtcggaggagcagattttagaccttccttttctaccaattatttggaatgtggcaaatygctttacttctgtgaacatctagttcatgttttataaagcattgaagtagatcatttctaaggttcttttccaccctatttggtaaattgtctagcatgttctacttcccacttgattaaattactctgcttcattttttttaattttgcaaggaaatactcattacatataaggataggagacttcacttatttccacagatatttattgagcactgactatgtgaaacataattaaagtgtaatgggcatttggaggagggagacattccagaagaggaaactgttatgagtaaagat

SEQ ID NO: 87840 - DNA, 601 bp, Human
attaagtagatctgaacatttgagaaggagttccataaaaaagacaatgaaaatcaagtgtaccagcatctttgattcatacaaggatcattttcagtttaacagtttatctccgttgttggttgtgacttcctgcaggacgtgacttttgatatattcattcttgaacttccaccaagcacagtttcaccatagttgatgctcagtaatagatccttatttgttggactgaattgctgcctactgaagtcaatcctagaaaggagagaagatagcttttttacatagaataactaggagrggttttcttcttttgaatgagctaccaataacaaaataaaactgcaatgaaagaattgacagcctggatctgtaatctgcctgacctgataattgtaaaaactgattactgtgtcagcctgccagatggatcttctccttgaaatgtaacgtgcggcacttctgaatgtgattcaagtgcaagcttccttttctctccccttcatgtttgttagtttgggaaagaagcagttttatttgaactgaacccactcattttaagtgtgtttaatgacagcagtatgtgacagataaaataaaa

SEQ ID NO: 87841 - DNA, 601 bp, Human
aaatcaagtgtaccagcatctttgattcatacaaggatcattttcagtttaacagtttatctccgttgttggttgtgacttcctgcaggacgtgacttttgatatattcattcttgaacttccaccaagcacagtttcaccatagttgatgctcagtaatagatccttatttgttggactgaattgctgcctactgaagtcaatcctagaaaggagagaagatagcttttttacatagaataactaggaggggttttcttcttttgaatgagctaccaataacaaaataaaactgcaatgraagaattgacagcctggatctgtaatctgcctgacctgataattgtaaaaactgattactgtgtcagcctgccagatggatcttctccttgaaatgtaacgtgcggcacttctgaatgtgattcaagtgcaagcttccttttctctccccttcatgtttgttagtttgggaaagaagcagttttatttgaactgaacccactcattttaagtgtgtttaatgacagcagtatgtgacagataaaataaaatcctacggcctcgtttgatgtttagtttcagaccttagtgaaaggaaata

SEQ ID NO: 87842 - DNA, 601 bp, Human
attcattcttgaacttccaccaagcacagtttcaccatagttgatgctcagtaatagatccttatttgttggactgaattgctgcctactgaagtcaatcctagaaaggagagaagatagcttttttacatagaataactaggaggggttttcttcttttgaatgagctaccaataacaaaataaaactgcaatgaaagaattgacagcctggatctgtaatctgcctgacctgataattgtaaaaactgattactgtgtcagcctgccagatggatcttctccttgaaatgtaacgtgcrgcacttctgaatgtgattcaagtgcaagcttccttttctctccccttcatgtttgttagtttgggaaagaagcagttttatttgaactgaacccactcattttaagtgtgtttaatgacagcagtatgtgacagataaaataaaatcctacggcctcgtttgatgtttagtttcagaccttagtgaaaggaaataggataaaacaatgttgttcaaagggagaagttgaaaacaaatgatttgttattacacacttagccatatctctccagggaaatttgggaagtcaaataatataaa

SEQ ID NO: 87843 - DNA, 601 bp, Human
ccaataacaaaataaaactgcaatgaaagaattgacagcctggatctgtaatctgcctgacctgataattgtaaaaactgattactgtgtcagcctgccagatggatcttctccttgaaatgtaacgtgcggcacttctgaatgtgattcaagtgcaagcttccttttctctccccttcatgtttgttagtttgggaaagaagcagttttatttgaactgaacccactcattttaagtgtgtttaatgacagcagtatgtgacagataaaataaaatcctacggcctcgtttgatgtttartttcagaccttagtgaaaggaaataggataaaacaatgttgttcaaagggagaagttgaaaacaaatgatttgttattacacacttagccatatctctccagggaaatttgggaagtcaaataatataaacggtaataatagtagtacttgagatttgtggagtgcctagcagtttgtcgagtggctttatgttcattatcacatcaagtctaggaggttgcctggccagaaatcatcatcccactattacacacacggttgagtgagttacgctaaatactacttctaaaatggtagaa

SEQ ID NO: 87844 - DNA, 601 bp, Human
aattctctgtgctggctcaccaaccaaacatgtgtgcagtacattggaccacgttgtggaaccagcctgttccttaactttactgaagcatatatatgctggcaatatacaaataaattatcacaacggatttcagcagtgagaagtatatgaagttgaacataacagccctccctcagtacccattcattttctcccctgccaaccccaactctttttccaaagagtaatcaccattgtctttttgttgtgcatctttccaagcatgtatctatacatttatgtatacatttacatatatgtgtgtgtgtgtgtgtgtgtgtgtgtttgtgtgtgtgtggtatattatctattttttttcagttcttttcctctggatcttttcatgtcagtaaaaaggatttgccatactatttttaattctgtatagtgctccatagtgtaagggttcatcactgagtctcttttatagtggagagcttcagcttttctttattacaaacaatgttaagatgagcttccttgcatatgtatctttgtgtacatgtgaatccagaattggaattgcttgttttttttttgtttttttttttgttttttt

SEQ ID NO: 87845 - DNA, 601 bp, Human
attctctgtgctggctcaccaaccaaacatgtgtgcagtacattggaccacgttgtggaaccagcctgttccttaactttactgaagcatatatatgctggcaatatacaaataaattatcacaacggatttcagcagtgagaagtatatgaagttgaacataacagccctccctcagtacccattcattttctcccctgccaaccccaactctttttccaaagagtaatcaccattgtctttttgttgtgcatctttccaagcatgtatctatacatttatgtatacatttacatatatrtgtgtgtgtgtgtgtgtgtgtgtgtttgtgtgtgtgtggtatattatctattttttttcagttcttttcctctggatcttttcatgtcagtaaaaaggatttgccatactatttttaattctgtatagtgctccatagtgtaagggttcatcactgagtctcttttatagtggagagcttcagcttttctttattacaaacaatgttaagatgagcttccttgcatatgtatctttgtgtacatgtgaatccagaattggaattgcttgttttttttttgtttttttttttgtttttttg

SEQ ID NO: 87846 - DNA, 601 bp, Human
aacatgtgtgcagtacattggaccacgttgtggaaccagcctgttccttaactttactgaagcatatatatgctggcaatatacaaataaattatcacaacggatttcagcagtgagaagtatatgaagttgaacataacagccctccctcagtacccattcattttctcccctgccaaccccaactctttttccaaagagtaatcaccattgtctttttgttgtgcatctttccaagcatgtatctatacatttatgtatacatttacatatatgtgtgtgtgtgtgtgtgtgtgtgtggttgtgtgtgtgtggtatattatctattttttttcagttcttttcctctggatcttttcatgtcagtaaaaaggatttgccatactatttttaattctgtatagtgctccatagtgtaagggttcatcactgagtctcttttatagtggagagcttcagcttttctttattacaaacaatgttaagatgagcttccttgcatatgtatctttgtgtacatgtgaatccagaattggaattgcttgttttttttttgtttttttttttgtttttttgagattatcaaaattcagtgtgggcc

SEQ ID NO: 87847 - DNA, 601 bp, Human
tacatatatgtgtgtgtgtgtgtgtgtgtgtgtgtttgtgtgtgtgtggtatattatctattttttttcagttcttttcctctggatcttttcatgtcagtaaaaaggatttgccatactatttttaattctgtatagtgctccatagtgtaagggttcatcactgagtctcttttatagtggagagcttcagcttttctttattacaaacaatgttaagatgagcttccttgcatatgtatctttgtgtacatgtgaatccagaattggaattgcttgttttttttttgtttttttttttgtttttttgagattatcaaaattcagtgtgggccatcatcgcaaatgttagaatcctcatcttagctcatgttatcgacctgggtttccacttagttgcttggggatgtgttgttcagaccaagccagacacttctctaaacagacacttgtggccaagagagtaaatgttggggaagttattttccatggcactgtggtttgaatacaggcactcaccatggaagaagagtagggtattcttgtaacagtcttgtttacttaaaacagccacgactcttcgctgagatagaataaggta

SEQ ID NO: 87848 - DNA, 601 bp, Human
tctttgatgaggaaaaatttgaaaattatacagttgtgtttcttttcaatcttcccttgcacgattacaagacgatggaaaagtgcttacactttgattgctgttcctaataaccatgttagaatttcacaggtgatctggaatatcatatcttgactttcatatgtgggagcaagagtcagcaaacaacctttctgtgcttagagatgattttatacataaaataatattgttttgaaaatgaacattgatgggaactgtgtcatattttctgtatcatatttcatgttagctttattarttagctctcattacctcaccaaataactcagatttaaaaatatgtatcttaactgtgatcagcctaaggactctattcgatgatcaagtcatagtcaaatcacagtctcatctcttaatgtgttcctttgatcctcctcccaactctccctccaacattcataccaaatccttggatgtttctgcttagttcaaaaagccatgttctctcactatgtaaattataccaagaataccactaatcatatacgagaagctaacaatctatgcttgagttgtgtgttttttaatatcatgcttt

SEQ ID NO: 87849 - DNA, 601 bp, Human
aaaagccatgttctctcactatgtaaattataccaagaataccactaatcatatacgagaagctaacaatctatgcttgagttgtgtgttttttaatatcatgctttgggatatgatgccaaattggatctccaatttgcctttaattagtcagcaacacttatttaatgcccactaagctcagagcaaggcttggagggtggagaaggggagtaaggagatcgaaaaacaaatacactatcatttccagaatagttacagtatctttatgcatacagaaaacagataaatgaaaggattwagaaaacttaaaagcaaaatccaaatgagtgcaaattggtctgatacaaactgagctatataaatgcaaagaggatgcaaattataaaaacttgaagagtttaaaattgctatctttctacttttattttcataatactttgccatgagaattcttagatctcaggacaccatacccttcagtgaggaaagtttactggttcaattgtatgatttagagaaacaaacctaattcttagcattttatgggcttctgagagatgacgctgtaaaactttttgagtctctgttaaacttttct

SEQ ID NO: 87850 - DNA, 601 bp, Human
atgtgccagagacttcctatgtgctagggttatggagattgacaatagttatacaaaactgagcctgtcacaaaatgtgtatcgacagacagtcttccatttggtgctatagaccagtactcagggtcagcagagggtactctggaagcatattcagggacaaagcaaacctagtcttggaagatctgaggaagtttcctatgatcatgtctgtctcctgccataacaccctgaatgcatccgatctgaactaaactgaggtctgacaaacttgtaggagtttgcgaggtgagtggcttgrggaaagtagagaggaagaagtttttctggaagagaaaagaaaatatgctgtggctctgaggtgaatcacatataatgcacaatagcttagtattgtgataacatttgggactgtgtgggcagacagtggctgcagggcctgaagggtggagagggggaacttacgcttcagtaggggtgtatatgtcttattatgaggtcacaatgaagattgaggtcagctagaggatgtgacattcgagttgggtcacaaaggatgtacaggagtttttcaaggctgaccacagtctaggcagaagaa

SEQ ID NO: 87851 - DNA, 601 bp, Human
agaggaaattgtggcccagaaggttgtatgtaactcatcgaggcactaagtggcagaggtcatgtttcagcctcggccatctggctccaaagcctaaatgtatgaattggccactaaaggcacaactgaaaatactaacagtccctgtgttagtgaagagggatatttggcaaaaagtttttattttgcttttttacaattcagtgatttgtaatttatttacagagtcatgcaatcattacctcaatttaattttagaacatttaaaaagtccatgctcatttgcttcccattctcactytaaccctagataacctcaaatctactttagtggtagtcagtttgtatgaatggcaacttcagtttaatggcttttttttttttttgagtagtcacaatctgatagccttaatcactaattcaggagaataacattgtttgaccatatcatttctaacttctgcatgcaattagtgtactctattcataatttgatgcagagaagggtaaaagtgacaggccttgtggcagtcattggtcaaaggcatatgagtaagactgcctgagaccctaccctggagttctgtcttgcaggtaaggc

SEQ ID NO: 87852 - DNA, 601 bp, Human
gaggaaattgtggcccagaaggttgtatgtaactcatcgaggcactaagtggcagaggtcatgtttcagcctcggccatctggctccaaagcctaaatgtatgaattggccactaaaggcacaactgaaaatactaacagtccctgtgttagtgaagagggatatttggcaaaaagtttttattttgcttttttacaattcagtgatttgtaatttatttacagagtcatgcaatcattacctcaatttaattttagaacatttaaaaagtccatgctcatttgcttcccattctcactcyaaccctagataacctcaaatctactttagtggtagtcagtttgtatgaatggcaacttcagtttaatggcttttttttttttttgagtagtcacaatctgatagccttaatcactaattcaggagaataacattgtttgaccatatcatttctaacttctgcatgcaattagtgtactctattcataatttgatgcagagaagggtaaaagtgacaggccttgtggcagtcattggtcaaaggcatatgagtaagactgcctgagaccctaccctggagttctgtcttgcaggtaaggca

SEQ ID NO: 87853 - DNA, 601 bp, Human
aaaggacaattggtctcaggcagagagtaccagataggacacgctacacaaaggactgtaatgtctcaattagtgtacctattgggtagcacatatatctgaaatggcttaaaataaaaattgcaaatgcaccagatttaatcaatcttagtatttccttctcttatgctctcagtccttagttaaaaataaaatttgcctgcctcattctcctgtgtgctagctagtaggattaactggagttctcaacaggaaagcaatagatctagtagacgacattgtatggtgggtgaaagcccgstagagataattatacagtcactcccactatattacccttcaaagaaactgagcctaatattctcctcctaagcaatttaaccaacttctaaaaaaaagtataagatattatttagagaatgaaatagctactgtatataatcaggaggaagaattatagcaaattatactcatttgataagtgtataaagagctacgctcaaagctttgtattgtacctcccaagtaattgttcagttgtgctaactgtccttaaaaaaggagaagagataaagaactgctaaagaaaaaaaaatcaatc

SEQ ID NO: 87854 - DNA, 601 bp, Human
ctcaggcagagagtaccagataggacacgctacacaaaggactgtaatgtctcaattagtgtacctattgggtagcacatatatctgaaatggcttaaaataaaaattgcaaatgcaccagatttaatcaatcttagtatttccttctcttatgctctcagtccttagttaaaaataaaatttgcctgcctcattctcctgtgtgctagctagtaggattaactggagttctcaacaggaaagcaatagatctagtagacgacattgtatggtgggtgaaagcccgctagagataattatwcagtcactcccactatattacccttcaaagaaactgagcctaatattctcctcctaagcaatttaaccaacttctaaaaaaaagtataagatattatttagagaatgaaatagctactgtatataatcaggaggaagaattatagcaaattatactcatttgataagtgtataaagagctacgctcaaagctttgtattgtacctcccaagtaattgttcagttgtgctaactgtccttaaaaaaggagaagagataaagaactgctaaagaaaaaaaaatcaatcattatacttgttca

SEQ ID NO: 87855 - DNA, 601 bp, Human
taagatctaccacatgtatgtcctagtaggtatagatagatgttatatatctgtgttcactgcacttacatcccaatattttcagaagataggactgtatgcaaatgtttccaatatctctttctaggatcacaaaaaaaaaagagcccctgaggtctttctacttgtttcaaaaatgagctggtagtaatattagagccaatttccttttggtttgctttaaacaaaataaacagcccattatgtaaactgtataagacttaagtgtttgagcacttcccttagagtttgtaagtcttawgcccccaccatcaaaaagtaaacaaataaataataaaaagccaatctaattgttattatgagaagtcatacagcgtatttgctaagagcagctcctctaaagatgtcagactgccttagatggaacactctgtatcctccgcttgccagctgggtaacattcaacaggaagcttaatctctccatgcctcaattcctgacttcaaaattattgtagtaatacaatgcctacttcatacagttgcggagacatcagttaggcgctgttcctctcacatatgtcatcaattctgagaccgat

SEQ ID NO: 87856 - DNA, 601 bp, Human
aaaaagtaaacaaataaataataaaaagccaatctaattgttattatgagaagtcatacagcgtatttgctaagagcagctcctctaaagatgtcagactgccttagatggaacactctgtatcctccgcttgccagctgggtaacattcaacaggaagcttaatctctccatgcctcaattcctgacttcaaaattattgtagtaatacaatgcctacttcatacagttgcggagacatcagttaggcgctgttcctctcacatatgtcatcaattctgagaccgattcacatgcttaayatttctgactaattactgttacgtggtaatcatgacatagcggccattgtctgtacttgtacatcaaaatctgctgtctatggagattagtgacttggaagaaaatcctggagtcaatagtggaccccttttttattaagactcttgatggcccagaggtcagtataatgaggaaaacatagaacttccatgattttgacttgaaaagtaattcaaagggttgaaatttaaacgtaaagaaatttttggaatgctttcatttgttgcacttatattttgctttttatgtatgtagagggg

SEQ ID NO: 87857 - DNA, 601 bp, Human
tcacatgcttaatatttctgactaattactgttacgtggtaatcatgacatagcggccattgtctgtacttgtacatcaaaatctgctgtctatggagattagtgacttggaagaaaatcctggagtcaatagtggaccccttttttattaagactcttgatggcccagaggtcagtataatgaggaaaacatagaacttccatgattttgacttgaaaagtaattcaaagggttgaaatttaaacgtaaagaaatttttggaatgctttcatttgttgcacttatattttgctttttatrtatgtagaggggtgacatatgataaaaaaactatggataattttaagccatttatttcaacaaacatgtaatatatattctaacgacaaagccctatgttataatttaaatggtagtaatttttgtttccggttttgtaatagctaatggtgtattttataatcagtagcatctttgatttgatggggtagtgtagtaagaactcaataaatgttagactcctcattaggatttgggtagaggttaatgtcggtagatacattattagagttaagggtcctaaggctttttaatgtgagc

SEQ ID NO: 87858 - DNA, 601 bp, Human
atacttaccaaatctcggtactgaaaacaagggtttatttcttacttatgctacttgttcatcataggacagaaggagttctttgcagactaatagttgtcatttccaacacttttgacctccatgccagagtaaaagagctctgagggtctcaaactggcaattccacactttgacctggatgtaatacatgtcacttcttatatagctccttagccaaaactattcacatggccctacctagccatagggttgccacagagcagagagctggaaatatgtggagaacagtgtcaataastttgtaatagtaataatggttgacaatcattgtgtgcttcttagtaccaggcactgttgtaagtgctttagatgggtagagtcctttagtactcatcaagtgggtatgatcatgattcccattgtacagatgacaacccaaggcacaaaagggtagaccaacctgcacagaagagacagagcagggattttgcttgtgtgacattgatgtgtgtctcaaactataatggatttgaatgcattttttaaaatgtaaaaggaagatacaaatatagttgagaatcttctgttctgaaaaata

SEQ ID NO: 87859 - DNA, 601 bp, Human
atacatgtcacttcttatatagctccttagccaaaactattcacatggccctacctagccatagggttgccacagagcagagagctggaaatatgtggagaacagtgtcaataagtttgtaatagtaataatggttgacaatcattgtgtgcttcttagtaccaggcactgttgtaagtgctttagatgggtagagtcctttagtactcatcaagtgggtatgatcatgattcccattgtacagatgacaacccaaggcacaaaagggtagaccaacctgcacagaagagacagagcaggkattttgcttgtgtgacattgatgtgtgtctcaaactataatggatttgaatgcattttttaaaatgtaaaaggaagatacaaatatagttgagaatcttctgttctgaaaaataagagatgaggtttggtgatccccaagcctccctaaaatttcacctggatcagccccaaatgacctacacttacaatgactgctgtgttcttttggcgcctcatcttcagaaaccaggggccctctcctggccactgacttacgtcgtagcttagcagaggggcattgtcccagcgtttcggtagat

SEQ ID NO: 87860 - DNA, 601 bp, Human
ctgtgttcttttggcgcctcatcttcagaaaccaggggccctctcctggccactgacttacgtcgtagcttagcagaggggcattgtcccagcgtttcggtagatacttcctcctttgacttatttaacctttctattttgggagttttctaacgtgtagaagaacagtagagtggccacagtctactccattatcaatgatcaatacacaattaccaatacattctcaatcttgcttaatttcactttgcaagttaatctggctgcttgtcaagctgagctgtgaacacaaactgtgttcttggggttgcggggtatagagctcctaaaacaggaagccagtgaccaggggagggccagagaggacatgtggaggacagaattgaagggcttcaactggaaaagagggcgtctctaatcaatagtttagacaagtttgcaagtggaagataaatgatatgacaatatttaatcattcataggacattcttgtaatgtaagggggaaaaggagaaatatgttgttaatagggagccagaattattacctttctccgtagctccaactgtaatcttgcctgctattgaggtagttaataaac

SEQ ID NO: 87861 - DNA, 601 bp, Human
taatttcactttgcaagttaatctggctgcttgtcaagctgagctgtgaacacaaactgtgttcttggggttgcggggtatagagctcctaaaacaggaagccagtgaccaggggagggccagagaggacatgtggaggacagaattgaagggcttcaactggaaaagagggcgtctctaatcaatagtttagacaagtttgcaagtggaagataaatgatatgacaatatttaatcattcataggacattcttgtaatgtaagggggaaaaggagaaatatgttgttaatagggagccaraattattacctttctccgtagctccaactgtaatcttgcctgctattgaggtagttaataaaccaaagcctgtgagctctgttcaatgggacagcaaccagagaggcttctttccaagccctcccaccaggccaagaagcagctgagctggatagaaagcatgccttcagcaccctgggtttcctcttcagtggcatccagaggaccctgggtcacttcacctctctgtctctttctgaaaaacgtatataataaccgtctgggtgactcacaaatctattatagcatttaattaacaaa

SEQ ID NO: 87862 - DNA, 601 bp, Human
gtaattccatttctcttttgccagcttaatttcctgtgtgtgtgtgtgttgtgggggctaaggggggtgtgtaacatgatggattttacagctgaagcttatactcattcatcttcagatatcttttctaatagaaataaagacaataaaagtgataccctcctcctgaaatttacacattaaagaccccttcaaactgctcactttttttctgtcttttttttcattcagaggcaaaatttccccctttttttcatcactgttacgtttgcggcagatgagtctcttccttgaggggaawcgtggtaaatgggcctgctgtatttacagctatgaaacattccagttggctgtcacaccctaagcaaggaaggtttccccatccttaatttgcggcctgaaaagctgtggctctcctcaattaagactttccaaattgcctctgacatggcagcatattcccaggagtcaggtcctgggaggcagtaataacatgagcactgctgtataacaacgtagttttacaagccattttgtgctcttttcagaagctttcaggatgctttttctctgaagttgcaaattaaaaagaaaacaaaac

SEQ ID NO: 87863 - DNA, 601 bp, Human
cagcgtggttatcttggagcctcatttccccttgggtaaaatggaaggataacattggcaatcatacagacgtgttgtgtagaaaggagtaagaagcattttggaagtggcaaagtggcaataatcccctgtaagacagtagctgtttttaagatcactgagctctcaaacactggctttttctgcctcacactttctagatttgtaagacttaatctgaaaatatctttgctattcattatgtataattgtagggctttggatttaaaaaatcctaattctgttatttccctgacaatarcaaattattctcatctaattttctcttatgtgaaataagacatacaccctagttacttccatgcctaatatgattgacaaatctatatgttatctgaattgtgaatatattttcatacatatagaagtacatgtgtgtatttcttgaaatctaatggtcaatatacactaaccagttatttctgggattttgggaacaggcttctttctatacttctctacttatctttaaattttctctaatgagcctactttgcttttgttttacatacagtaattaatatatttataaatgtatgta

SEQ ID NO: 87864 - DNA, 601 bp, Human
attagccaggcatgatggcatgcacttgttgtgtcagccactgctcattgggggttgggggggttgggggtgggcctgaggtaggaggcttgcttgagcccaggaggtaggaggtcaaggctacagtgagccatgactgtatcactgcactccagcctgagcgacagagcaagaccctgcctctaattaaataagcaaatacacacacacaacacacatatataaaataaaataaaaaccccaatgtgttaagatctcaggtttaaacctcggcttatacaaaccatagtactaccgtgcrataactgaattgacaaggtaccaacacctattttaaccagaaaaataacataattgtgttatattttccatgagagtcatactcttgaaattaagtattttctcaatagaattgtttctcaattaaaaaaaaaaacttactcaaaacatttagtatttaattataattataggcagataaaatttataaaagattatcagtaagatcaagaacctctgcctctttaatcatgtttttctctaccttttgctggtctcttcctgattttgatgacctcattgtctatacgagtattaagac

SEQ ID NO: 87865 - DNA, 601 bp, Human
tactaccgtgcaataactgaattgacaaggtaccaacacctattttaaccagaaaaataacataattgtgttatattttccatgagagtcatactcttgaaattaagtattttctcaatagaattgtttctcaattaaaaaaaaaaacttactcaaaacatttagtatttaattataattataggcagataaaatttataaaagattatcagtaagatcaagaacctctgcctctttaatcatgtttttctctaccttttgctggtctcttcctgattttgatgacctcattgtctatacsagtattaagacatttggggtagctttttatgttgtgtactttctttccttctccttatgagatggctgacaccttctaaaggattcagagagtttccatcttattgaaaggtccttatgaaaattcactggtagtgttctcagcttatactaggaaggcatgtttcttcagaagcagtatttgttgtatttagggtgggaatcattatgtagcaagagtggtctacatattggtcttgcagcaacatcagcaccccttatgaatggtttgtttcccaccaaaagtcaaagattagcctat

SEQ ID NO: 87866 - DNA, 601 bp, Human
aatttataaaagattatcagtaagatcaagaacctctgcctctttaatcatgtttttctctaccttttgctggtctcttcctgattttgatgacctcattgtctatacgagtattaagacatttggggtagctttttatgttgtgtactttctttccttctccttatgagatggctgacaccttctaaaggattcagagagtttccatcttattgaaaggtccttatgaaaattcactggtagtgttctcagcttatactaggaaggcatgtttcttcagaagcagtatttgttgtatttmgggtgggaatcattatgtagcaagagtggtctacatattggtcttgcagcaacatcagcaccccttatgaatggtttgtttcccaccaaaagtcaaagattagcctatatgatggatgatggctacagaaaatagtgccagaaaaacagaatcagtagaagatatatattaagacattaattgggaaggagtagcttgcatgattttgtgggctggctaggcaatctaacatctacagattaggcaattaggaagggcaggctgtaactccgtggcatgagatgaagctactcgccacaa

SEQ ID NO: 87867 - DNA, 601 bp, Human
tgacaccttctaaaggattcagagagtttccatcttattgaaaggtccttatgaaaattcactggtagtgttctcagcttatactaggaaggcatgtttcttcagaagcagtatttgttgtatttagggtgggaatcattatgtagcaagagtggtctacatattggtcttgcagcaacatcagcaccccttatgaatggtttgtttcccaccaaaagtcaaagattagcctatatgatggatgatggctacagaaaatagtgccagaaaaacagaatcagtagaagatatatattaagasattaattgggaaggagtagcttgcatgattttgtgggctggctaggcaatctaacatctacagattaggcaattaggaagggcaggctgtaactccgtggcatgagatgaagctactcgccacaatgagaattccttcttctttaaggaatcctcagctctacttccaagacctttcaactgattgaatcaggctcaaccaggttatctagtgtactcttcattacttaaaaatcaactgattagaggctttaatcacatgtacaaaacaccttcccagccacatctagattggagtttg

SEQ ID NO: 87868 - DNA, 601 bp, Human
gggtgggaatcattatgtagcaagagtggtctacatattggtcttgcagcaacatcagcaccccttatgaatggtttgtttcccaccaaaagtcaaagattagcctatatgatggatgatggctacagaaaatagtgccagaaaaacagaatcagtagaagatatatattaagacattaattgggaaggagtagcttgcatgattttgtgggctggctaggcaatctaacatctacagattaggcaattaggaagggcaggctgtaactccgtggcatgagatgaagctactcgccacaaygagaattccttcttctttaaggaatcctcagctctacttccaagacctttcaactgattgaatcaggctcaaccaggttatctagtgtactcttcattacttaaaaatcaactgattagaggctttaatcacatgtacaaaacaccttcccagccacatctagattggagtttgattgaataaatggagactttagcctgaaaaaattaacacacaaatggaccatcacaggagggtagtctttttctacagaatttaaatctgtggtagagaagcaacagatacctcagggcaaaaaaa

SEQ ID NO: 87869 - DNA, 601 bp, Human
ccccttatgaatggtttgtttcccaccaaaagtcaaagattagcctatatgatggatgatggctacagaaaatagtgccagaaaaacagaatcagtagaagatatatattaagacattaattgggaaggagtagcttgcatgattttgtgggctggctaggcaatctaacatctacagattaggcaattaggaagggcaggctgtaactccgtggcatgagatgaagctactcgccacaatgagaattccttcttctttaaggaatcctcagctctacttccaagacctttcaactgattsaatcaggctcaaccaggttatctagtgtactcttcattacttaaaaatcaactgattagaggctttaatcacatgtacaaaacaccttcccagccacatctagattggagtttgattgaataaatggagactttagcctgaaaaaattaacacacaaatggaccatcacaggagggtagtctttttctacagaatttaaatctgtggtagagaagcaacagatacctcagggcaaaaaaagtccaggaagagcataaaggttcaagcagaaccatgagaatgccagcattgtcgttggag

SEQ ID NO: 87870 - DNA, 601 bp, Human
gagaattccttcttctttaaggaatcctcagctctacttccaagacctttcaactgattgaatcaggctcaaccaggttatctagtgtactcttcattacttaaaaatcaactgattagaggctttaatcacatgtacaaaacaccttcccagccacatctagattggagtttgattgaataaatggagactttagcctgaaaaaattaacacacaaatggaccatcacaggagggtagtctttttctacagaatttaaatctgtggtagagaagcaacagatacctcagggcaaaaaaartccaggaagagcataaaggttcaagcagaaccatgagaatgccagcattgtcgttggagatggtgactggaagtgatgataggtctagggaacagtaaatgtggacagactggcattttacctcgggcacacttggacctggataggctccaccagtctgccctggaaacagaaccacagtgggtcagacagtcttttgtattagttttaaatacagagttgattgtctctcttgcattcttaacttgcaatttagtactgtttatattctgcttgaaggttagagacattcgactaaat

SEQ ID NO: 87871 - DNA, 601 bp, Human
ttaatcacatgtacaaaacaccttcccagccacatctagattggagtttgattgaataaatggagactttagcctgaaaaaattaacacacaaatggaccatcacaggagggtagtctttttctacagaatttaaatctgtggtagagaagcaacagatacctcagggcaaaaaaagtccaggaagagcataaaggttcaagcagaaccatgagaatgccagcattgtcgttggagatggtgactggaagtgatgataggtctagggaacagtaaatgtggacagactggcattttacctygggcacacttggacctggataggctccaccagtctgccctggaaacagaaccacagtgggtcagacagtcttttgtattagttttaaatacagagttgattgtctctcttgcattcttaacttgcaatttagtactgtttatattctgcttgaaggttagagacattcgactaaatggtcttttctccacattgctgtcattcattaatgtcctggtcctggactttactcattgaccacaggacaagtggctcaactctctcctgccactacccaggctgttagtcctgttgggaggct

SEQ ID NO: 87872 - DNA, 601 bp, Human
ttcaatactttcaacatcatcttacttcggagccccagatctcttcttttctaccaaccttttttgaaacattaaaactggtgaagatggcctgagttctctctgtgatataaatttatccctccctgaaaaattccattcatgtaacatttttataacactttttaaaacttggatgaaagttttttcatgtagttgaaatgaagcatcactgcctaaagcgtttagaaatttttttactgttggttttaagaaattactctaggatttccactgaggactggcaagtattggtgaagtytgatctctcagagctcatgtttcagatggcaacttaaagggacaaataaataagtcaatcacacggcataatctaactttaatatgattctgcagagaaccagtgactcatttagagaaatcagagtcctcagaaaggtggaaaacatgttagaacttattaagcttgttgcctttagcatgtcaatgccttgtttttataagaagattcaatgggttgttaaaatgcactgtcttaaccctctcccctttgtatttttctactcttaagatgcatcattttatgttgggatctatcagt

SEQ ID NO: 87873 - DNA, 601 bp, Human
ttaaaacttggatgaaagttttttcatgtagttgaaatgaagcatcactgcctaaagcgtttagaaatttttttactgttggttttaagaaattactctaggatttccactgaggactggcaagtattggtgaagtttgatctctcagagctcatgtttcagatggcaacttaaagggacaaataaataagtcaatcacacggcataatctaactttaatatgattctgcagagaaccagtgactcatttagagaaatcagagtcctcagaaaggtggaaaacatgttagaacttattaarcttgttgcctttagcatgtcaatgccttgtttttataagaagattcaatgggttgttaaaatgcactgtcttaaccctctcccctttgtatttttctactcttaagatgcatcattttatgttgggatctatcagtttattttacttgtttttccttcttcctctccttattttgaaggctgacttctgagcttgagccatatccttggcaactgaatgaattcatggggagtatagtagaaaagattttctcacaactctgacagcactgccccctagtaaaaaagggaagagacaaag

SEQ ID NO: 87874 - DNA, 601 bp, Human
gagaaaaaagccctgcagggaacagtacaagcacagtaaattatgaattgctactaaataggcctcattagtccactgtggaccatgtttaattgatattagaaaggagtctggaaaactttggaaagtacatgtaagacaacttgctgttaaactaataaaagtcgttagagtgtctgtttcaaaaattagtaattattaattgtgtgtgagggtcctcaggcagcacccattttactaaaacatgcttagagaaaagatatttctatgagaaatgaaactgcagaatgctgagcagtgyaatatgtgacagttccctgggagtttctcccctcctcgtaggtatttttagcaaaatagtccttaaacattgttttttttttttttttaagttggagtctcgctctgtcgccaggctggagtgcagtggcccgatcttggctcactgcaacctccacctcctgggttccagcaattctcctgcctcagcctcccgagtagctgggactacaggcacgcaccatcaggcccagctaatttttgtattttttagtagagacgggggtttccaccatattggccaggctggtcttgaacacct

SEQ ID NO: 87875 - DNA, 601 bp, Human
gaaactgcagaatgctgagcagtgcaatatgtgacagttccctgggagtttctcccctcctcgtaggtatttttagcaaaatagtccttaaacattgttttttttttttttttaagttggagtctcgctctgtcgccaggctggagtgcagtggcccgatcttggctcactgcaacctccacctcctgggttccagcaattctcctgcctcagcctcccgagtagctgggactacaggcacgcaccatcaggcccagctaatttttgtattttttagtagagacgggggtttccaccataytggccaggctggtcttgaacacctgacctcgtgatcctcccacctctgcctcccaaagtgttgggattacagacgtgagccaccgcgcttgccccttaagtgttgttttaaagaaagttggcgctctactgaagactggagcccaagaagacatttatagggattgtttattttcatgttgttactacactccatggtctgcaaaaccagagtgccagatgttaaattctatcagcataatgcatctttaattaaatattatatacgccatacaattaataatgtggtctgtttccaaaa

SEQ ID NO: 87876 - DNA, 601 bp, Human
acgtgagccaccgcgcttgccccttaagtgttgttttaaagaaagttggcgctctactgaagactggagcccaagaagacatttatagggattgtttattttcatgttgttactacactccatggtctgcaaaaccagagtgccagatgttaaattctatcagcataatgcatctttaattaaatattatatacgccatacaattaataatgtggtctgtttccaaaactttattaagaaattaccataattttgtataataggctaataaaaaggcactgtactttgaaacagcctttcrtaaagtggttatatgatttgtatctgttgaatttggaatttagattaagagattgtgggccagaattatctgatgcaatgtactcaggactttaaataagttgcgaatcttgtagggtctactattatttggcttcctttaaaataaaataggtttcttatttgtcgatgagctcactctttaagaggtttagggaataacttacctactcgctttgtgtcccccaaccctactttgtaaaaacctcaaacaatacaaaacatgataattccaaatatacagtacattgggctatgatat

SEQ ID NO: 87877 - DNA, 601 bp, Human
ctggataattagataaataagatatttataagcgtatggtttatgcacatagacatgaagctctcaatgcctgcatgattttcctgtcatgctcatgtgggttaaagcccaatagatgtattttgaaaactcgaatgccagtatgtctttaaaaagattatatcctgaaataaagttttaacatcctgtatcctatgataaaagttattttgcatttttttctttaccactgaaaacttgcgaggctcaaagtagtttaatttttatatattgaagctactcatttgccatattttaaaarcaaatcataaaacatggtaattggtaatttcacaaattttatcagggaatattttattattacatttttaaaataaaacctgtagatttatttaaaaagcatattttgaactaaagacctgaaatgtgtagcttgtgtagctccatttgaaaagatgaaggttttgctattgtttgcaacagttttgcctgatttttgttttccccttttgctctgtttttgtagttcagtttgttgcagcattgttgtcatgtctaatttttgtttacgttgcactgcacagcactctttcgtatactt

SEQ ID NO: 87878 - DNA, 601 bp, Human
aatgttaaatgaaaaataagatacaaagccacacataaagagggttcacatttaagcaccatcacctatacaaaacacacacgcacacagtcacacacacacacatacacacagtcacacacacacttacacacagatacaagtatacatagaaatacaaaccatgaaaataaagttaccaaaacagttgttatcactaaagttttgaatgagtgttttttatttctttattaaccttgttattacttctcatattttctacaatgagtatcactgtttttagttttgtttttgttttttraatggagtctcactctttctcccaggctggagtgcagtggggctatcttagctcactgcaacctccacctctcgggttcaagcaattctgcctcagcctcctgagtagctgggatgacaggtgcccaccaccacgcctggctaatttttatatttttagtagagacagggtttcactatgttggccaggctgatcttgaactcctaaccaggtgatctgcctgccttggcctcccaaagcgctggtattacaggtgtcagccactgtacccggcgtatcattgttttaatgaatacactg

SEQ ID NO: 87879 - DNA, 601 bp, Human
gttaaatgaaaaataagatacaaagccacacataaagagggttcacatttaagcaccatcacctatacaaaacacacacgcacacagtcacacacacacacatacacacagtcacacacacacttacacacagatacaagtatacatagaaatacaaaccatgaaaataaagttaccaaaacagttgttatcactaaagttttgaatgagtgttttttatttctttattaaccttgttattacttctcatattttctacaatgagtatcactgtttttagttttgtttttgttttttaaayggagtctcactctttctcccaggctggagtgcagtggggctatcttagctcactgcaacctccacctctcgggttcaagcaattctgcctcagcctcctgagtagctgggatgacaggtgcccaccaccacgcctggctaatttttatatttttagtagagacagggtttcactatgttggccaggctgatcttgaactcctaaccaggtgatctgcctgccttggcctcccaaagcgctggtattacaggtgtcagccactgtacccggcgtatcattgttttaatgaatacactgtct

SEQ ID NO: 87880 - DNA, 601 bp, Human
aaaataagatacaaagccacacataaagagggttcacatttaagcaccatcacctatacaaaacacacacgcacacagtcacacacacacacatacacacagtcacacacacacttacacacagatacaagtatacatagaaatacaaaccatgaaaataaagttaccaaaacagttgttatcactaaagttttgaatgagtgttttttatttctttattaaccttgttattacttctcatattttctacaatgagtatcactgtttttagttttgtttttgttttttaaatggagtctcrctctttctcccaggctggagtgcagtggggctatcttagctcactgcaacctccacctctcgggttcaagcaattctgcctcagcctcctgagtagctgggatgacaggtgcccaccaccacgcctggctaatttttatatttttagtagagacagggtttcactatgttggccaggctgatcttgaactcctaaccaggtgatctgcctgccttggcctcccaaagcgctggtattacaggtgtcagccactgtacccggcgtatcattgttttaatgaatacactgtcttacacgagg

SEQ ID NO: 87881 - DNA, 601 bp, Human
aagatacaaagccacacataaagagggttcacatttaagcaccatcacctatacaaaacacacacgcacacagtcacacacacacacatacacacagtcacacacacacttacacacagatacaagtatacatagaaatacaaaccatgaaaataaagttaccaaaacagttgttatcactaaagttttgaatgagtgttttttatttctttattaaccttgttattacttctcatattttctacaatgagtatcactgtttttagttttgtttttgttttttaaatggagtctcactctktctcccaggctggagtgcagtggggctatcttagctcactgcaacctccacctctcgggttcaagcaattctgcctcagcctcctgagtagctgggatgacaggtgcccaccaccacgcctggctaatttttatatttttagtagagacagggtttcactatgttggccaggctgatcttgaactcctaaccaggtgatctgcctgccttggcctcccaaagcgctggtattacaggtgtcagccactgtacccggcgtatcattgttttaatgaatacactgtcttacacgagggcttg

SEQ ID NO: 87882 - DNA, 601 bp, Human
atacaaagccacacataaagagggttcacatttaagcaccatcacctatacaaaacacacacgcacacagtcacacacacacacatacacacagtcacacacacacttacacacagatacaagtatacatagaaatacaaaccatgaaaataaagttaccaaaacagttgttatcactaaagttttgaatgagtgttttttatttctttattaaccttgttattacttctcatattttctacaatgagtatcactgtttttagttttgtttttgttttttaaatggagtctcactctttckcccaggctggagtgcagtggggctatcttagctcactgcaacctccacctctcgggttcaagcaattctgcctcagcctcctgagtagctgggatgacaggtgcccaccaccacgcctggctaatttttatatttttagtagagacagggtttcactatgttggccaggctgatcttgaactcctaaccaggtgatctgcctgccttggcctcccaaagcgctggtattacaggtgtcagccactgtacccggcgtatcattgttttaatgaatacactgtcttacacgagggcttgcct

SEQ ID NO: 87883 - DNA, 601 bp, Human
tataatctgaccaaagaaatgcatttttcttgggatattaaccttcattcattcatcaaatatttgttaaatgccagcttatgggctatgatatgatgaagcataatgaggaagcagcagggaataaaaaggacagtctctactagtatagaagcagacatatgcacatgtgatatgtacagggagggagaagtaaagagcacccactgtgctggaggattcaggcaaagtttcacggaggaacctgacattcagcttgagatgtaagacattcctaggaatcagctagataattcaaagrcaatggagaagtgcattggtgtaggtatcattgttgagatgtgagagagcttggcacaatagacatgaaagaaggtcaatgtatctcaaagagaggtagaagaggtggatttgcatccatcattcccctaacctgttgaagatttttgagcaggaaagcaatatgattagatttgcatttgcaataaatcactctggctaccaaatgaaggactcattgaaaaacagtcgtggacattgggagaccagtttggatgtttttagagaattcataatgaaaaatggtggaatcttggcatgg

SEQ ID NO: 87884 - DNA, 601 bp, Human
tttcctctatgttacttcttttagaagttttagtttcaggcctttctcatctttaaatcattaacccagttttagttaatgatgtcagataagggtccaatatcattcttttgtatgtgtatttctagtttccctaacatcatctattgaagaaattttctttacctatcatctattctttgccccctcatcaaaaatcaattgactgtatacacgtggatatatttccgggctctctgttctgttctgttggtctgtatatcttgtttttcatgccagtaccatactgttttgattactrtagctttgtaatatattttgaaattaggaattgtaatgcctccggctttgttcttggcttcaagattgataaggctttttgtggtcttttgtggttccatgtgagttttagaattgttttttctatgtatgtaaaacttcattttggtatttagatagggatctcactgcatctatagataactttgggtaggatatacattctaacaatatcaagtctttcaacctatgaacacagatgtttatccgtttgtttgtgtcttgtataatttctttcaccgatgtttaatagttttcagta

SEQ ID NO: 87885 - DNA, 601 bp, Human
agctagtcttcagatgttgttttctcactaagtcactgggcactctggccagcctctcttcagcatttggaacccatccattggtgtaggaaaaagaatcagcccccactgctagaactggatctaaagtgctgggtccagccacatccctaacatttggcctgtcctcaccaactgacacagggagatggaatgaatttttataaaccactcatcagaaaacatggaactttattttacttcttatttgagcaaggtggttattcaagatgatctattagatgattacagattttggatrtcagtagatttcatgttatttttaaaatttttgatatatttgtttttcaacagtttcatgtgttttcacatcatattcggctgtgcattgaaaaaatgaaaatcaaaccatgtacttttcactctgattattaagagtggttagaggttgatatttagccatctgtcctgtctgtgctttgggaaagggggaagaggctgatgaagttatggataaattctgggcgcgttgtgagggcattggctgatgaaagggtgggttccttcacagttggcctttgagcaaaacactactgtattc

SEQ ID NO: 87886 - DNA, 601 bp, Human
tatctatatctatatctatatctatatctatatatatcgctgtgagttgggagccacgttttctccagtatttagataaggtggctcagcttgaaagttccagtgctaggacctggaagctagtcacaactctcaagtctaaagtgaccaggcaactttagcctccaattatcataaaaactcatctccgtcagcctcagctattaaagggacaggtatttgctacataatgtgtagaagtgctggggctgtgcattccagggaagttggagaatcttgtcccaattagtgtagaggttawgttaaattctgaaaccatctactattaaaattttcttggaaaatatttcaggaagatgagaccttggaggtcaactaaccatctttcagtaaatctaaaagtttttcttttccagaattagaacagattgttgcttttcatttggatttcgagtttggggcatattttatgggtcagagaagagtgtagaggtaatgaactgttgtggtcagtgttgaaggactttaagatctgtaatttctgttaagattaaggaaacagagaatgttcatacactaccactttgaacattccagtagt

SEQ ID NO: 87887 - DNA, 601 bp, Human
tctactattaaaattttcttggaaaatatttcaggaagatgagaccttggaggtcaactaaccatctttcagtaaatctaaaagtttttcttttccagaattagaacagattgttgcttttcatttggatttcgagtttggggcatattttatgggtcagagaagagtgtagaggtaatgaactgttgtggtcagtgttgaaggactttaagatctgtaatttctgttaagattaaggaaacagagaatgttcatacactaccactttgaacattccagtagtatgagaatatttaaatttattttatttatttatttatttatttatttatttatttattttttgagagggagtcccattctgtcacccaggctggggtgcaatgacgtgatctcggctcactgcaacctccacctcccgggttcaagtgattctcctgcctcagcctgccaagtagctgggattacaggctcccgccaccacgcctggctaactttttatatttttagtagagacagggtttcaccatgttggccaggctggtctcaaactcctgacctcacgtaatctacccatctcgacctcccaaagtgctgggat

SEQ ID NO: 87888 - DNA, 601 bp, Human
ctactattaaaattttcttggaaaatatttcaggaagatgagaccttggaggtcaactaaccatctttcagtaaatctaaaagtttttcttttccagaattagaacagattgttgcttttcatttggatttcgagtttggggcatattttatgggtcagagaagagtgtagaggtaatgaactgttgtggtcagtgttgaaggactttaagatctgtaatttctgttaagattaaggaaacagagaatgttcatacactaccactttgaacattccagtagtatgagaatatttaaattatttttatttatttatttatttatttatttatttatttattttttgagagggagtcccattctgtcacccaggctggggtgcaatgacgtgatctcggctcactgcaacctccacctcccgggttcaagtgattctcctgcctcagcctgccaagtagctgggattacaggctcccgccaccacgcctggctaactttttatatttttagtagagacagggtttcaccatgttggccaggctggtctcaaactcctgacctcacgtaatctacccatctcgacctcccaaagtgctgggatt

SEQ ID NO: 87889 - DNA, 601 bp, Human
tactattaaaattttcttggaaaatatttcaggaagatgagaccttggaggtcaactaaccatctttcagtaaatctaaaagtttttcttttccagaattagaacagattgttgcttttcatttggatttcgagtttggggcatattttatgggtcagagaagagtgtagaggtaatgaactgttgtggtcagtgttgaaggactttaagatctgtaatttctgttaagattaaggaaacagagaatgttcatacactaccactttgaacattccagtagtatgagaatatttaaattaattttatttatttatttatttatttatttatttatttattttttgagagggagtcccattctgtcacccaggctggggtgcaatgacgtgatctcggctcactgcaacctccacctcccgggttcaagtgattctcctgcctcagcctgccaagtagctgggattacaggctcccgccaccacgcctggctaactttttatatttttagtagagacagggtttcaccatgttggccaggctggtctcaaactcctgacctcacgtaatctacccatctcgacctcccaaagtgctgggatta

SEQ ID NO: 87890 - DNA, 601 bp, Human
actattaaaattttcttggaaaatatttcaggaagatgagaccttggaggtcaactaaccatctttcagtaaatctaaaagtttttcttttccagaattagaacagattgttgcttttcatttggatttcgagtttggggcatattttatgggtcagagaagagtgtagaggtaatgaactgttgtggtcagtgttgaaggactttaagatctgtaatttctgttaagattaaggaaacagagaatgttcatacactaccactttgaacattccagtagtatgagaatatttaaattaatattatttatttatttatttatttatttatttatttattttttgagagggagtcccattctgtcacccaggctggggtgcaatgacgtgatctcggctcactgcaacctccacctcccgggttcaagtgattctcctgcctcagcctgccaagtagctgggattacaggctcccgccaccacgcctggctaactttttatatttttagtagagacagggtttcaccatgttggccaggctggtctcaaactcctgacctcacgtaatctacccatctcgacctcccaaagtgctgggattac

SEQ ID NO: 87891 - DNA, 601 bp, Human
ttatgggtcagagaagagtgtagaggtaatgaactgttgtggtcagtgttgaaggactttaagatctgtaatttctgttaagattaaggaaacagagaatgttcatacactaccactttgaacattccagtagtatgagaatatttaaattaattttatttatttatttatttatttatttatttatttattttttgagagggagtcccattctgtcacccaggctggggtgcaatgacgtgatctcggctcactgcaacctccacctcccgggttcaagtgattctcctgcctcagcctrccaagtagctgggattacaggctcccgccaccacgcctggctaactttttatatttttagtagagacagggtttcaccatgttggccaggctggtctcaaactcctgacctcacgtaatctacccatctcgacctcccaaagtgctgggattacaggtgtgatcccaccatgcccagcctgttttaatttttgaaaagagaaagttatatacattgattgcactctaaagaattgttggcatttggagagagttatccgtatggtaatccctgtgttaattatgtctcaattctaggatc

SEQ ID NO: 87892 - DNA, 601 bp, Human
aatgaactgttgtggtcagtgttgaaggactttaagatctgtaatttctgttaagattaaggaaacagagaatgttcatacactaccactttgaacattccagtagtatgagaatatttaaattaattttatttatttatttatttatttatttatttatttattttttgagagggagtcccattctgtcacccaggctggggtgcaatgacgtgatctcggctcactgcaacctccacctcccgggttcaagtgattctcctgcctcagcctgccaagtagctgggattacaggctcccsccaccacgcctggctaactttttatatttttagtagagacagggtttcaccatgttggccaggctggtctcaaactcctgacctcacgtaatctacccatctcgacctcccaaagtgctgggattacaggtgtgatcccaccatgcccagcctgttttaatttttgaaaagagaaagttatatacattgattgcactctaaagaattgttggcatttggagagagttatccgtatggtaatccctgtgttaattatgtctcaattctaggatcagagaaacaaaatggaagagatgatta

SEQ ID NO: 87893 - DNA, 601 bp, Human
atttatttattttttgagagggagtcccattctgtcacccaggctggggtgcaatgacgtgatctcggctcactgcaacctccacctcccgggttcaagtgattctcctgcctcagcctgccaagtagctgggattacaggctcccgccaccacgcctggctaactttttatatttttagtagagacagggtttcaccatgttggccaggctggtctcaaactcctgacctcacgtaatctacccatctcgacctcccaaagtgctgggattacaggtgtgatcccaccatgcccagcctrttttaatttttgaaaagagaaagttatatacattgattgcactctaaagaattgttggcatttggagagagttatccgtatggtaatccctgtgttaattatgtctcaattctaggatcagagaaacaaaatggaagagatgattagggtgggcagaggaatgaatgcagatagatccctcaagtcagtagctaacactagaatacatgtgaagatgagaatggtagatattgcttgaggccagtgactgtaatattagtaattcctctttgtacagactttttagtttccaaagcactt

SEQ ID NO: 87894 - DNA, 601 bp, Human
tttgtggagctcacaaaatccatgatcattaagcccaagtagaggtctttgtctttctttttctgatgagggttcaaaagcccagtgatgagagccactcacttaacgtcatatgtcaaattcatcggacagccacagctccaagtcaggtcttctaaagattgttcccatgctttgaccgtggcaagtgactgaatgttggcatgctttggatggcaggagctcctcatcagcgccagtgtacatggctccactgtgacccatgttacctgcagagattaaagtgggcttaggcagtcaycatggcctttggataaaatcagcggttggaggggaagcacccattaaatccctgcctggcacccaggcctggtgccttagagctatacttccccatccccatcagtcacataaaatttgtcccgaggttctttctaccttcactaagtacttaatatggagttcagtcatccccatttctcacttgaaccattgaaatggcctcttacttagggtttcctctggcagtcatctctgtacccatacatcctacatgtaataccagattaatctttctatggtaccttatcattaattgcct

SEQ ID NO: 87895 - DNA, 601 bp, Human
catctctgtacccatacatcctacatgtaataccagattaatctttctatggtaccttatcattaattgccttttgcaaaaaccttaataagttcccaaccagttgcagaatacattgaaatcccaaactggatttctagttttatctctccccagtatcctggattccagctgatatgttacatttttagttaattctcacctctatggctttgctcaccaagttccttcttcccagtccttccccaaataaaatctacacatctaaaagtgacccattaagatccagctacagtgttawtttctcccataaggttttctcctcttcctaaaagctagttgtgtgttatttcaccctctcttttagatgttttcactcttttactgtactggagtcatttgtgttcctgtcttctatcaacctatatccaagcatatattagactaagttttaggagaatatcctatgtttctagaaacatatgtatgtagtaactatatgcttagttatttagcagaggtttattgaacattgtgttcactttgaagaattttggtagacactctgtagggccctattagtgtttaagacattgtacag

SEQ ID NO: 87896 - DNA, 601 bp, Human
gccagtttttctagcaccatttattgagtaggaaatcctttccccattgcttgtttttgtcaggtttgtcgaagatcagatggttgtagatgtgtggtgtaatttctgaggtctctgttctgtttcattggtctatatgtctgtttcagtaccagtaccatgttgttttggttactgtagccttgtagtatagtttgaagtcaggtagcatgatgcctccagctttgttctttttgcttgggattgccttgtctgtacaggctctttttcatttctatgggtttttttcatttccgtataygttttagcatcagtttgttgttgtccacaaaataggctgctatgatttggagattaccttgaatctttagatcaatttgaaaagagccgatacgttaacaatactgggtttttcaatccatgaagatggcctatctcttaatttatgtatgtcttctctaatttctctcatctacatatcatagttttgcatatattttggtaaacttgtccttaagcacttcaaatattggatgctattgtaaatggtattttaaaatttgtttataatcatttgttattagcatatagaaatagcaat

SEQ ID NO: 87897 - DNA, 601 bp, Human
tacagtttggtttatttcagaaggttgcttccttaaaacaaaattttgaaaatatgagataataacatttaacttctttttcaatcacttataaaatttacgaaacactctcatataagaaaaactctgtaagttgttcagaggcaacttctttagtatcctaccaatactgaatacctaagggagggtaagaactgacgtcgcctcactgccagcccagtgttctttccactctgtgaaacttgcctccatttgtagctgtctgtgtttgtatatattagctctattttgtgtagagttktccaaacataaaatattcctttggcgcagagtttagagactaaaacttctgagtagtatttccgggacataacatatatttaacattatttgaaacccaagattcagtcaacattgctattaagagttaaggagctgaaactgtgcataccctaagtctgaattcaaggtaagaggtcccttgttattcagtctttataagtgtttggtatatttatgcctcctcaaatatgacaccatctttttttaaattcacatttaaagatgattgtaaaacaagaaggataaggtgtaagtgtgg

SEQ ID NO: 87898 - DNA, 601 bp, Human
acataagtctgaataagtttactatagatgatattagtaggttttaccagaggaaaccatgcttttttattttatttttttctttttctttgagacagagtgtcactcttgtcgcccaggctggagtgcagtggtgcaatctgggctcactgcaacctctgcctcccgggttcaagtgattctcctgcctcagcctcccaagtagctgggattacaggcatctgccaccaggcccagctaatttttgtatttttggtagagacggggttttaccatgttggctaggttggtctcaaactcytgacctcaggtgatccactcaccttggcctcccaaagtgttgggattacaggtgtgagccaccacgcctggacagaaaccatgctttataatcctgctacccaccccatccaaagcacacaaaatattagttaagtaagctactagaagacaactgaggctggtggtctctgcaggggcagaaaaatgggaactggagaggagttcaggaaggcagcccagagaatatgaagcaggacccagcacacaacagcctgtgggccacatgtcacttgccacctgattttgtaaataatgtttg

SEQ ID NO: 87899 - DNA, 601 bp, Human
caggcccagctaatttttgtatttttggtagagacggggttttaccatgttggctaggttggtctcaaactcctgacctcaggtgatccactcaccttggcctcccaaagtgttgggattacaggtgtgagccaccacgcctggacagaaaccatgctttataatcctgctacccaccccatccaaagcacacaaaatattagttaagtaagctactagaagacaactgaggctggtggtctctgcaggggcagaaaaatgggaactggagaggagttcaggaaggcagcccagagaataygaagcaggacccagcacacaacagcctgtgggccacatgtcacttgccacctgattttgtaaataatgtttgcttgaaatacagccatactcgcttcattccatattatcaatggctgctctcacactataacagcagagctgagaagatgcaacagagaccgtatggcctacagatattaaaacattttctgtatatcattttacagaaaaacattgttgactgctggtcaaaaatatgggaagaacgtcatgaaatttagattcttattaaaagttcttgaacatccctgaactattt

SEQ ID NO: 87900 - DNA, 601 bp, Human
ataaatacctagcatatattttcagatgccaaaggacatacaatgatgaacaaaaactcagctcgtcctcaaaatcgatatgtattattggtgatgctggactccacccactcatagatgtttctcattattgtgaaacattactttttggaaaaagagagctgggccaggcacagtggctcacacctgtaatcccagcactttgggagaccgaggcaggcagatcatgaggtcaggagttcgataccagcctgaccaacatggtgaaaccctgtctctactaaaaatacaaaaattagcyaggcgtggtggcgcatgcctgtaattccagctactcaggaggctgaggcaggggaatcgctcgaacctgagaggtggaggctgcagtaagcccagatcacaccactgcactccagcctgggtgacagagagagactccatcttaaaaaaaaaaaaaaagagagagctaacatcttcactttttaaggaaatagacattgcccccatgattagatacgtatggatgactagatcatttaaaacaaaaattacataagggcttaaagagtggctcttaagtgtaaatgctaggaagcaccca

SEQ ID NO: 87901 - DNA, 601 bp, Human
agtcagaaactgagaaagggaaaaaattatttgctgaagactgcatgcctcaagtttatacccattatactacactgcctgcttgcgaaagtatgttttaaaaaattgtcactgctgtgcagcaactcaaattgtcactgctgtgcagcaactcaactttaagtcttaaacctagttatcttttatcttgagcaggacatatatgttaagctgctgaggatgctccttaacatgaggccattgggcgggtgtgtgccagacaatcctcctagttgtttctctaatacagagcttcaggtcrtctcttcctttttcatcttctagcctgccctggccaagtacctatgaatcaaccggcaaggcgaggggtgtatttggtgggctatagagtggaattaagcagaatatcaaaaattttagccaataacattgaacctcaaagaggaaagtactgctgagttctgatagatgcaagacaagctaaagacctccttagctccattgttctgcatcagcacaatatgtcctagtgagaaggaaagacatagcaaaactaaaaatgacctgtttttcaagagcaatgtcttttcacccaaacttg

SEQ ID NO: 87902 - DNA, 601 bp, Human
agttctagtaccagactattaatagggagtcaagtagaaatatccttccttcccctccctccctccttcccttcccttccttccttttccctttcccttcccctttccctttccctttcccttcccttcccttctccttctccttccttccttccttccttccttccttccttccttccttccttccttccttctctctctttctctcttctttggtgtgctgagaataatctgcagacagtgactctacagataagattgcaaatattttcccttccttcattccttccttctttcctcycttccttccttctttccttcttccttttttttcttttttaaccacatgatttctatttcctttagcaagatgttatcatgtgagggaagtcttaggtttctatatccctttattcttagtgttagcatttcttattaaagacagatgtctagttttctattttaagggttatctaatttcagtcataaaaatgtcctataaattaagacataactttgtcaatactcttctagaacataatagctaccccaaaatatttgttcaatgatgggaaattcattgatatttagaccttcagag

SEQ ID NO: 87903 - DNA, 601 bp, Human
tatgaaacctgaagctttgaagcttatcactgtggaaataacttctgtatgcataaaagtattatattatttcggtaggactgctataacaaaatacagtcaggccttcatattcaagtaggctgcattcagaattcaaccaactgccaatggaaagtgtttgtaaaaaataacaagtaacaataaaatattagaaaatactacaaatttcaaaatacaatataacaagtatttacctagcatttacattgtattgggtattttaactaatctagagatgatttaaactatgtaagaggayatgtgtaggttacgtgtatagcatatcatatatataagggatttgagcatccatagagtttggcatctgcatggagtcctagaactgatcccctgcagatatgaagggacaactgtaccacaaactgagtgacataaactacagatttttttttcctcacaattctagaggctagaagtctgagatcaaggtactcacaaggttgctttcctctaagagctttctccttggataaaaatggccaccttctctctgtgtcctcacatggtctttcctctgcttctctgtgtcctagtccct

SEQ ID NO: 87904 - DNA, 601 bp, Human
aacgtaagacctaaatctataaaaatcttagaagaaaacctaggaaattatattctagaaatactattctaggccttggcaaaaatttcatatgaggtctccgaaagcaattgcaacaaaaacaaaaattgacaagtgagacctaattaaagagcttctgcagcacagcaaaacaaactatcaacagagtaaacagacagcctatagaaagagagaaaatatttgcaaactatgcatctgacagaagtctgatattgagaatctatatggaactcaaacaaatcagcaagcaaaaagcatccccatttaaaaatgggcaaaggacatgaacagacatttctaaaagatgtgcaattaaccaacaagcatatgaaaaaatgctcaacatcagtaatcattagacaaatgcaaatcaaaaacacaatgagattccttctgacaccactcagaatggctattattaaaaagtcaaaattaatagatgttggcaaggttgtggtgaaaagggaatgcttgtgcactcctgttgggaatgtaaattagttcagtctcactgtggaaagcagttcagggatttctcaaagaatgtaaactagaacta

SEQ ID NO: 87905 - DNA, 601 bp, Human
catcagtggggacagcttagaaagcttgtcgttgcatctaaataaatactgagagtttggatatgtttctaagttcctttcctttgaactgtggggcataaatctcacgagacagcttgttctcaagaggttaccagtacgtttggttctagtctgtccacaaatattgtgagaacaggcttattcagattattttgacatgctcagacaaggcgttccgaaccatgtgagaaatgaacgtgtgtgtgcaagggaaatacacacaatgctactgagcctctaagaggctccattcctcgtrttttgaggagtggaaattgtctcaaaaaatcagcatctcagctctcattcctaatgtatcagaatctagaagttctggttttggaatctgatatagtgagaaatcagaagatgtcctggggtgtgggagaatgatatgttctttagtcgagtttaaatgagtttattccttaacttagcacttccccagtggcacaataagcactcagtaaatgtttattgaagtgaattccaattcctgatttgaatttagtgttggagaaattccagtcaccgggctgataaaaagtggtgtcagatt

SEQ ID NO: 87906 - DNA, 601 bp, Human
gattactggaaaaaggactatgtggagaagctgcttgcaagtaataaactctttgtgttagagtcacctgttttacccaatgcctagcctagatcgttgaaaaggaaattgaaggatggtattcagattaagaaacagatccctggattatgtttaagaatttctgggaggagccaagatggccgaataggaacagctccggtctacagctcccagcctgagcgacgcagaaggcgggtgatttctgcatttccatctgaggtaccgggttcatctcactaggcagtgccagacagtgggygcaggtcagtgggtgcgcgcaccgtgtgcgagccgaagcagggcgaggcattgcctcactcgggaagcgcaaggggtcagggagttccctttcctaaccaaagaaaggggtgacagacggcacctggaaaatcgggtcactcccacccgaatactgcgcttttccgacgggcttaaaaaacggtgcaccacgagattatatcccgcaccttgctcggagggtcctaccccatggagtctcgctgattcctagcacagcagtctgagatcaaactgcaaggctgcagcaagactgggggag

SEQ ID NO: 87907 - DNA, 601 bp, Human
cccaccatccagctctgacctgggcccaccctgtgcaggactctgctgactttgggatgccagctgtggtcctcacacagggctcactgtatccgggggcctggcttgatccggtaaagagcgtctgctgcggtgcctgatggaaagtgcccgcttaattgggagatagggcttcatgaatggatctttcattagttgaaaaaaaaaaatatttgcctgcaaggactgtaaacagaagacttgattcacttgttccttttctcctgccctctcttgggttttgtttgacttagcgtgtttrtacctcaggacacagctggtactaatgcctttccaaggttaagaaagctttccctgccattccctatggtcccctttgtgtactttcaagagacaataaaggaggtgtggatgtgagacagagagtgcattcacattagtcctggctattatggggacctcagaacaagcatcacctccaccctgtctgcatggatttaagagagagcatctgagcacctgagcttacctcaaacacgttctttgaagaagagtcactgccggtcatttctgtaatgtatcacagctgtcctgacctgat

SEQ ID NO: 87908 - DNA, 601 bp, Human
gcttttgggaatttggggaagatatcataaaacagtagaaacttaaactatgtttgaaagcatgaactcatgatagacgggcaagggtagaaacaatcgttttatttctagaagcttcaactctatcttgaaatagtttgttgtgtatattagtccgttttcacgctgctgataaagacatacctgagactggacaatttacaaaataaagaagtttcaatggacttatggttccacatggctggggaggtctcacagtcatggcagaaggtgaaaagcacatctcacatggcaacagacragagaagagagcttgtgcaggaaaactcccattttcaaaaccatgggatctcacgagacttatttactatcatgagaacagcacgggaaaggcctgcccccatgattcagttacctcccaccaagtccttcccacaacacatgggaattaaagatgagatttggatggggacacagccaaaccttatcagtgtgtttataatggcaccacagtttctaaagtattatccattatctttttggtctttataacagaggttggttgtaatcattatctccattttattagtatttcttaaaa

SEQ ID NO: 87909 - DNA, 601 bp, Human
tctttttatgtctttgtttattaaataagaaattagaatctctgatcagtagattggctaggatctgcttatgagtcttagatgcaaaactgacaaatctttaattggttgtgccatcgtatctgtcctcaggcttgttagctaaagctcagttagtgatttgccaccactgccattgcttggtggtagaatagggtaaaggattatcatgccagcatcccttgtccgctgtgaccttagtcttagtgaacaaattttcttgtgtgctttctaaaatgcccatgacccttatttcatactkaggaaatagaagtcacaaagatttcctgaggacctcatcattatgtggagctaggaaaagtactgtggtttatagctctgtggtttacacaaagggaaatccaattgatttgcacaaatacacaaaacaaaatatatttaagtgccatgaagagaaacgatgttctttaggaattaagaggaggttcagaaggaaaatggtgttgattgaatctggccaactgagcttggacaatcagtgacctcagggaaaggagtgttaggaaagagacattcctgacagaggaaataacataagtag

SEQ ID NO: 87910 - DNA, 601 bp, Human
tataacattgttagagtagatactgtaaactgaaaagtgacacataaaaatacataatggtgcagctcaggtatgtgtcatcttaatattcctattaaccttagaactttgtgactgtgttgggattacttgacatatttgtttatcaatcaacacagtgacagtgacgacgaatgagtaaccagtgttttgtttttgaaacatttgaagaagtgttccatatttctgaagttattagtttagtttagtttagtttagtttagtttagtttagtttagtttagtttagtttagttttaackacagagtcttgctctgttgcccaggctggagtgcaacagcgtgatctcagctcactgcaacctctgcctcccgggttcaagcaattctccctgcctcagcctcccaagtagctgggattacaggcacctgccaccacacccagctaattttttgtatttttagtagagatagagtttcggcatattggccaggctggtctcaaactcctgacctcaggtggtctgcctgccttggcctcctaactgaagttatttttttaaattaaactaatacatgcaactggcttaacaaactaatag

SEQ ID NO: 87911 - DNA, 601 bp, Human
cactgcaacctctgcctcccgggttcaagcaattctccctgcctcagcctcccaagtagctgggattacaggcacctgccaccacacccagctaattttttgtatttttagtagagatagagtttcggcatattggccaggctggtctcaaactcctgacctcaggtggtctgcctgccttggcctcctaactgaagttatttttttaaattaaactaatacatgcaactggcttaacaaactaataggactaatgagtctaaaacaaacgacataccctccgtgcttctcctctctccaytctctcaatcctacttcacgaaagacactcttggctgcttcttcctggcatttgcacagcttcatgtctaaaacagaaatgcatttctatctttggaggcataaatcttagacattatctgtggattaataacacaaaagacacggatatgccatccatataaatgtttgactgtttagagcttcctactctgggaaggattgacccatctccctccaaaattgagaaaagggactttcactggacattatcttcaagtccttgcagtgttccagaaggtgtgacaatctggtcctttgg

SEQ ID NO: 87912 - DNA, 601 bp, Human
gcttatttgccatctgtatatcttgtttggtgaggtgtctgttcaggtcttttgcccatttttaatggttgtttttcttactaagttttgagagttctttggatattttcaataataatagtcctttcttaaacgtgttgtttgcaaatactttctcccactctgtggcttgtcttctcataaacgcttgacaaagatgcatttttgacatgcaccctgcctcatctatagcatgtcttcaaataggcttaagcgactaacttgagggaagctgatttatcttggagaactcctaactcatttttctttcattcatttaataggcagcagacttggggatataaaaggaatattctgatgtttagttagtgcttaattattttgcattcttaagtcaagcttttgactgttattgcagtgcacttgcacaaacatgaacatttcaacatctgctgttagtgtgaccagaaagagagagaagagaaaggaaaagaagggagaaatgttgactcaatcctgtccttatgtgaaacaataaaaatattttaaaactttctctcagttatgcgacatagtgcttttctattttttcctaaactgg

SEQ ID NO: 87913 - DNA, 601 bp, Human
acgggtagagtggctattaaattcggtctgtatatacatgatatatattatgcatattttcagaacatatgctgtgttaccatcttctgacccaaagagaaaagctgcagtaaggattttttcaggactgtaattgggcaaatgaccttgtaacgcagtggtctccgacctttttggcaccaatgaccacttttctggaagacagtttttccacgaacccagggttggtggggtagggatggcttcagtatgaaactcttccacctcagattatcggcattagagtctcataaggggcatrcaaactaggtcccttacatgcgcagttcacaataaggttcgcacccctatgagaatctaatgccaccaccactgatctgacaggaggcggagctccggctgtaatgctggctcgcctgccactcacctgctaggaacaggccaaggaccactatcagtccatagcctggggactggggacacctgttacagaatttatactgttaaatgtcacttgatatgcacactaaacctattacaaaccacatattgtcacttgtcataattggacagagctgcagtgaggttttggttttaagtg

SEQ ID NO: 87914 - DNA, 601 bp, Human
atgtgtttcttactggttcatttcggcatgccgctaaatgtgtaaaacctagaagatatcccatagccttgtttgaataaataaagttacacatggtgtttcaagttcacctatttctttgactaccaaaagacttctggttttaataaaacaactgtgaagttcaagtcctgtgtattctaacactttgatttactcaatggcctgatagaaactgtttttaaaaattatatttacccttagcattttcctgagtattgtctttagctattggtggggaagatggatatatgtgtatgtktgtgtgtgtgtctgtgtgtgtgtgtgtgtgtggagagagagagaagagatacatggacccattgccacaatcttttaattatgtgaaacaaaaaatatttaaataacgttgaggttatccatatcttctgtattatattctgtgttactgatttttttggatcaaatagtgatttttcatgagctaggtataaaaatattaccagggactaaaattaggggaaactgggagtaacttagagtgtagccagttgtttttctactggtgctaccggcattgaaagcaagagagttcctccct

SEQ ID NO: 87915 - DNA, 601 bp, Human
gcatggagccatcatttattcaacagtcactcatcaaatacttgttgaatgcttactcggtgccaatcacttgtccacacactggaagtcaggagtaaatacaatcataaaaattcctgccctctgggtgcttacatttctggttgtgttatgctgcagggagaaagaggagattttcaaaggtaatagtacctaataccatctgaaatcctaaaatttctgccttactgtcttccacctaccatccccattggggaaaccttaccttagaggaggccactatatagtggatatataataktgtttgtattttatatcttttatcactgttttctgcacacagtaaaacagtgataaaagttatcactttcttaagattttgaggttgctgtacattctcatttgtgaacaaaaactttgctctgattacgtaggattcatttaaaatccatggaatcttttgacactgaagttagaagttcattttatcaacaagtgaaatagtctcaggcacaaggtggaaggatgtgagtcctaaaatcttcggtaggagttggctgggcgcaatggctcacgcctgtaatcccagcactttgggagg

SEQ ID NO: 87916 - DNA, 601 bp, Human
ccataggacctagcattgcctctttcaattaataaatgtgtaaggaataaattattttggcatattatcccttgtcttttaaaagtttcacaggagtccctttgcaatcaagttaaaggctataaaaatttaacatctagttgtgttggcagagttgtcagcatttacttcagtttatcaaacttcaatatttatttaaattgaaaccaatcagccatttttttctatgcaaatcacaaatctcatttattaatgccttcccctccccctttcccttactacatcaataggaagattacaycttgacatgataaaaggagacaagctttcgttaatgttaagaatctgctccatggccccctttgcccagaaagtcatgaattctgataatcaaggggcagttgcctatgttatttttttttaagtttctagttaattatttgctcttccttatttgcattttgagatgtaacagtagagcagtttacccattctctcctgaaaactatgagtctgtttcagacaaattactatactaggcacccaccctcagtggaggtgcaggagactctaggcccggaatgggtgaaataccagaagt

SEQ ID NO: 87917 - DNA, 601 bp, Human
cataggcatatattaaccattttaatatgtatcagaaaaggtatgttctttttcctcagaaatgttgaagcctgactttgttatagaaagcacccaggaatcatgtcttcagagttcctaatttttagtgttttcttgtactgccccgactgctgcaatcctctctcttacattggaattctgttttaagttttggtgattggaatcctctttttgatttaagagaaagaatcctaggggtgaaagattactatactggaaatgaaagattactagtctctaaatgagaattggctttggkctgtaatagataaaaagatttttaagggaaaaatattagaaaagtgaaaacgtttttaaaaaaaataggtagcagtcaccaccgtattctggtggaatcgaattcttgaagattagatttgtgtattcatggaataatctagacaaaatcctgccttgcacatagtggggagatacactaaaatactgaaacagctacattgtattcaggtgaagctacatagatgtaaataaagggcagccagcgggtacaagctgtcaattaagtgttttcaatagtctactccgtgtcgccacatct

SEQ ID NO: 87918 - DNA, 601 bp, Human
cattttaatatgtatcagaaaaggtatgttctttttcctcagaaatgttgaagcctgactttgttatagaaagcacccaggaatcatgtcttcagagttcctaatttttagtgttttcttgtactgccccgactgctgcaatcctctctcttacattggaattctgttttaagttttggtgattggaatcctctttttgatttaagagaaagaatcctaggggtgaaagattactatactggaaatgaaagattactagtctctaaatgagaattggctttggtctgtaatagataaaaakatttttaagggaaaaatattagaaaagtgaaaacgtttttaaaaaaaataggtagcagtcaccaccgtattctggtggaatcgaattcttgaagattagatttgtgtattcatggaataatctagacaaaatcctgccttgcacatagtggggagatacactaaaatactgaaacagctacattgtattcaggtgaagctacatagatgtaaataaagggcagccagcgggtacaagctgtcaattaagtgttttcaatagtctactccgtgtcgccacatcttaggtaatttagatagg

SEQ ID NO: 87919 - DNA, 601 bp, Human
agatttgtgtattcatggaataatctagacaaaatcctgccttgcacatagtggggagatacactaaaatactgaaacagctacattgtattcaggtgaagctacatagatgtaaataaagggcagccagcgggtacaagctgtcaattaagtgttttcaatagtctactccgtgtcgccacatcttaggtaatttagataggtagaagacaggtcattagcactgaagttgagaacacatttgaactccagaatgggattaatgcatctccaaaaaacgtgtattttctaaccctgtgcaaaaattatatttgaaaagattaaaacaaacaacagttttcttcgttctttgttatatgtctttgtacttgaaaaaggtaaaattctgcattacgttttaaacaaattgtgccagggtaaagggtaaaatctccatcaacatctaaaggtctttcttgttcagaaaatgaaggcccctctcctgcattaaagaccaatgtggccttatagatccttatacagagggaacaaaatgacattagacagactctaaggtgccctcaattattcccacgtggtggtattcatgcctttgtgtaat

SEQ ID NO: 87920 - DNA, 601 bp, Human
cttctttaaaagctgttattaaatcttcctgtggctgtcctagagatgatataacagaacttctgctgggaaatgggagagggggagggaagcgttccatgagctgctctgtcatttgcatgccagtgaaattaagtttgaatttacattaagaggagttttgaaatttaggatctatcttaccaaatcacaattcagcctaacaaatgttatggaagtacaacaggagcccggactgtccattgtcatctaaatgatggatgtgtttaaggtgtttacatcagtgctgtttctcccaccyaccctaggtctgggtggttgcctgggattgtttactcaaagacagtagcttgacaatttggaaatgacagaggacgctgatacttgaaatcaaactgtagccctggaatagcccaaacatggtcccagggtggtcttgcttctgacttatgtggaaacggccaaatcttcaactacattctgtagcttttctttattcacccagccaactggaagatgagtacctatcttggaaatttcccagaagcagcaattcatactttccttataactcttaacacattgctttatagtttctgtt

SEQ ID NO: 87921 - DNA, 601 bp, Human
taaaatggacatcactggaaagccttcctcatgaagtgattagaacagatgcagataatagcacaggtgtggttgaaaattgtgaacattcatggaaaagttcacttgttttttttttatttgtttttgttttactgtcaagaatataataggagccactcaatttatgactctgtcctttcacttattattaaaattatggtattccttttgccactcctgtggacaacatagccaagcaaatgagcattttagtctttctcgtcgtcctgtcttagtttgccaaaactttgaatactcggtgtgtgtgtgtgtgtgtgtgtgtgtgtgtgtgtgtgcgcgcgcgcgcatgtttagttgctgttgaaaatatttgaccactatgaggaactggtaaatttgcctgtgctcaggaatacattacatggatgctctggttagtcactttgtactttacatctgacttttcctccatcagagacaaaattaataataaacaatttttaagattttggataaaaaccttattaaaatgcatggcatatttttcttttttcttatggggctattctaagcatttgaaaccttttgatgactcagg

SEQ ID NO: 87922 - DNA, 601 bp, Human
attagaacagatgcagataatagcacaggtgtggttgaaaattgtgaacattcatggaaaagttcacttgttttttttttatttgtttttgttttactgtcaagaatataataggagccactcaatttatgactctgtcctttcacttattattaaaattatggtattccttttgccactcctgtggacaacatagccaagcaaatgagcattttagtctttctcgtcgtcctgtcttagtttgccaaaactttgaatactctgtgtgtgtgtgtgtgtgtgtgtgtgtgtgtgtgtgtgygcgcgcgcgcatgtttagttgctgttgaaaatatttgaccactatgaggaactggtaaatttgcctgtgctcaggaatacattacatggatgctctggttagtcactttgtactttacatctgacttttcctccatcagagacaaaattaataataaacaatttttaagattttggataaaaaccttattaaaatgcatggcatatttttcttttttcttatggggctattctaagcatttgaaaccttttgatgactcagggtcatcaccatgaccatctattgttatgctctgctgaa

SEQ ID NO: 87923 - DNA, 601 bp, Human
ctcaaatcagtagcagaaaataacagtgatgcattcagacagcaaaaagagaaaataataattttattaagtttacaggaaaggtctcagctttcttaaaagcctatctttaggaagtaagtaactggagctgcacacccaacagaggaagatgactttacttatcatttacttagaaattatctttgaaaggatcattgtgctgttgttagcaaaaaggagcttctgtaaatgtcacctcaaactttgaaatctgggaaagtctcattatgaaacgcaagttttatctttcatactcagygctggagcactgagtatccttgcattcatgaagactttctggtacagagtaaacggagctgggagcataagtgagaatgcagctccagctgacagacccccagctctatcttcccaggtgcatttcctttttttttttttttttttgtgagacagagtctcgccctgtcaccaggctggagtgcagtggcatgatctctgcttactgcaatcaccgcctcctgggttcaagtgattctcctgcctcagcctctcgagtagctgggactacaggtgcacaccaccatgcccagctactttt

SEQ ID NO: 87924 - DNA, 601 bp, Human
tttatggcctactgtaacaaagccattgtaagtgtacagtgggagggtcaagaaaccttattctatggattcaaacacattatgcatacaatttacacgtaggcacaaaagtatcccttcaaagaccctccaataagctatggtatagttgaggaaacactagacttgaagtcgggaaaccggagtgttgtcattttaatctcaggctatatctttacatgaacaagagaactttgtgttatttttcatattcgaactctttgtgctgaagattctgcagtcaaactgcaagacacatacrcattggctgatcagaaatgacataaccattcttactgcactgagttgatattcagtcaataaacagtctaatctcggttaaatgtttgcatatttttagacttttaaaaatttgaaatcagcctctcaagttccattagacagttttatcacggacacatcaagttccatgtacaacaggctgagaaccattaagctacaaaatttctaaaattttctccaggttctcagttgctaaattctctcttgaacatttttggggataaaaaactggcagagaaaaagaagaaagtacaccttt

SEQ ID NO: 87925 - DNA, 601 bp, Human
tctgagggaccttgagccccatgccaaagagtctgtataccttatctaatttgtttaatggggccactaggcaattacgggtccgggacccgcatggcaagaatgccttccatccacagcagcccttgatgtgaggtcagaaagctaactgctaaacttgcagtcctgagggaacaccctcaaatggataaacccagctaagcaagctggaccatttccttgggaattattcacctctcaatcaaagaaggaaacttcccaaattcaatccatttgccttaacgtggtgtcccattaccaygaatactgagttgtatacattcttccctagctcccttgaacaagcttctctactacttttcttaaaaaaaaaattacccatttatgacttatttattatttatccccttcctataagggaatgtccactctttgagatcctcattcttcctccatcatgatgatgtgatgatgtaatgatgtagtcaaggcgcttccctggcctaatgtgtatgagggcaggctttgaagtttgacagtcttaaagctagagtggtgtcatgcattgctcacctctctaatcccagatttcctcctctgt

SEQ ID NO: 87926 - DNA, 601 bp, Human
ttacgggtccgggacccgcatggcaagaatgccttccatccacagcagcccttgatgtgaggtcagaaagctaactgctaaacttgcagtcctgagggaacaccctcaaatggataaacccagctaagcaagctggaccatttccttgggaattattcacctctcaatcaaagaaggaaacttcccaaattcaatccatttgccttaacgtggtgtcccattaccacgaatactgagttgtatacattcttccctagctcccttgaacaagcttctctactacttttcttaaaaaaaaaawtacccatttatgacttatttattatttatccccttcctataagggaatgtccactctttgagatcctcattcttcctccatcatgatgatgtgatgatgtaatgatgtagtcaaggcgcttccctggcctaatgtgtatgagggcaggctttgaagtttgacagtcttaaagctagagtggtgtcatgcattgctcacctctctaatcccagatttcctcctctgtataatgggataaatacctttcctatgaacattttcagatttttaaatattaataattcatatgaaatactcagc

SEQ ID NO: 87927 - DNA, 601 bp, Human
tgatgcctgtgatctagatggaggcagatttcctctctcccccaccctggtataccatagtctgttctaatgctgggatcaaggatgaaagtgctaatttgggagtgtcccccactttcttactagctgatatggtttggctttgtccctacccaaacctcatcttgaattgtgatccccacatgtcaagggagggaggtgattggatcgtgggggcccttcccccatgctgttctcttcatagtgagggagttcttatgagatctgagatttttaaggcagttttccttgctcttgctcrcttctccctctgctgccaccttgtgaagaaggtgcctgcttccccttctgccatgattttaagtttcctgaggcctcctctgccatgcggaactgtgagtcagttaaacctctttagaaattacccattctcagggaagttttttatagcagtgtgaaaatggagtaattcaatgaccctttcttactgactcattggtctgatttcttgaccaaagctctgaatattcccatgtcatcctgtctaaccagctgtcttatactctttttttttttttttttgagatgaagtctcgctctg

SEQ ID NO: 87928 - DNA, 601 bp, Human
tgccaccttgtgaagaaggtgcctgcttccccttctgccatgattttaagtttcctgaggcctcctctgccatgcggaactgtgagtcagttaaacctctttagaaattacccattctcagggaagttttttatagcagtgtgaaaatggagtaattcaatgaccctttcttactgactcattggtctgatttcttgaccaaagctctgaatattcccatgtcatcctgtctaaccagctgtcttatactctttttttttttttttttgagatgaagtctcgctctgtcgcccaggctggrgtgcagtggcacgatctcggctcactgcaacctccacctcccgggttcatgccattctcctgcctcagcctcccgagtagctgggactacaggcgcccatcaccatgcctggctaatttttttgtatttttagtagagacggggtttcaccacgttatcttattcttaacagtgtctgaggtatttttttgaaacacaattcttaccttaactgccccaggcaccacggcagaagaaccatgaccttgctgagaggcactgcatgccaaatgagacttagtttttccaaagtacttggga

SEQ ID NO: 87929 - DNA, 601 bp, Human
aatttcagtgttaatcctagattacaatcccgcctctattattttaactttgttcacatctgttaactgctctgaaaatcagagctaatactgcctacctcatcagggaaagattaaacgagaaaagaatgagatgtgattgacacagcaggagctctgtgtatgctatttcctcctctatctctgtgcctggtacatggtaaacattcaggacacttctgctgcctgcttggctggagagcctgtctatgcagcctcagtgttgggaggatttgagcctggggtcggcctggcacccagstatggtagttagcaaatctatcctcagctcagtcagtgatcaaatcactggctctaggctgtaaactaacagggccagaattgggttctggactctgaagcccaggcatgcatattgcaaaagtcagaatcgaagtcataggaaaatgatgaaatttcctttctggccagaatgctattatttcaccaagggcaacaaatcttcttggcaggaaaagttgacttgcttgtgctttgtgtaatcaattgtatttgcaagtgatggagtccttctcacagtggcttagaggaggtgttaacc

SEQ ID NO: 87930 - DNA, 601 bp, Human
acatttcattgttttcggagaattttcacagttcattatctcacttcacagttcctaatagtctctctgaggtccatatggtaagaattagtaccctttactatatttgttgaatcacaagtgagcggaggaatgggtatagttgagacccacagaagtgaagtgacttgcccaaatccatatagcttattatgctacctgtttgttagaggtttcctgttgtatcagaaactagtgagataaatattagtaatttttgtcccattgacacatgatggtatatcaggaattctgagctcattttttttttttggctcaataagtgaccttagaaaatccagaatgggatttttaagttgaatatccttctctgacctgtgaaatcactgcatctgtttccctgactttatcacaaggtaacccaagatattgccaatatttacatgtgacaaactctgaaagatgtgcataatgctcccaaaggtcatcatcttcatacctaccttataaagtgcaaatggaattgacctagtctagaataagcaggcgagatgcagagagattatgtgacatagctaggtcatgtgactagtatgcagca

SEQ ID NO: 87931 - DNA, 601 bp, Human
agtgacttgcccaaatccatatagcttattatgctacctgtttgttagaggtttcctgttgtatcagaaactagtgagataaatattagtaatttttgtcccattgacacatgatggtatatcaggaattctgagctcattttttttttttggctcaataagtgaccttagaaaatccagaatgggatttttaagttgaatatccttctctgacctgtgaaatcactgcatctgtttccctgactttatcacaaggtaacccaagatattgccaatatttacatgtgacaaactctgaaaratgtgcataatgctcccaaaggtcatcatcttcatacctaccttataaagtgcaaatggaattgacctagtctagaataagcaggcgagatgcagagagattatgtgacatagctaggtcatgtgactagtatgcagcaggcttggggcataaatcctagtcctctggctcccgagtccagtgttcattacgctatgtgacatgtcagtattgctgtttgctcggggttaggcttttcctttggaggttagagcttgataactctaaatcgataaacttcttagtatgccacagtaatgc

SEQ ID NO: 87932 - DNA, 601 bp, Human
ctacaagttggaatggatacggtgccctaattttcgtgttccctttgagcacaagcaataacacattttaaaggatgataaatagctgtgtaaaatgtagatgggttctataaatacttaccaaaatccctgtagtcagaccctggtagaaggagagaatagtcaaagtgttctctctttccacattcttcttcttcttttaggggtagtttggtagttaagaacacagttgctagacccagacagactcagacttgagtcttgccctacctgtactacctgttagattttagggaactcyttaattttcatgggcctctatttgtagaaggatgctaacaatattatgtgtagtttttagaacattcatctagtataatccctatacattttaagtaggtaattatgggttatctctcatgactgtttttatcttcatctgagaccctttctttcttcctttaagatacttctatccatatttttccctagagagaaacagtattagctactcctgcctgtcagtttaagctactgtgtcatgactattttgcatttctaagtttatccttacctttatcatcaaagtgctgactaatgc

SEQ ID NO: 87933 - DNA, 601 bp, Human
tggatacggtgccctaattttcgtgttccctttgagcacaagcaataacacattttaaaggatgataaatagctgtgtaaaatgtagatgggttctataaatacttaccaaaatccctgtagtcagaccctggtagaaggagagaatagtcaaagtgttctctctttccacattcttcttcttcttttaggggtagtttggtagttaagaacacagttgctagacccagacagactcagacttgagtcttgccctacctgtactacctgttagattttagggaactccttaattttcatgsgcctctatttgtagaaggatgctaacaatattatgtgtagtttttagaacattcatctagtataatccctatacattttaagtaggtaattatgggttatctctcatgactgtttttatcttcatctgagaccctttctttcttcctttaagatacttctatccatatttttccctagagagaaacagtattagctactcctgcctgtcagtttaagctactgtgtcatgactattttgcatttctaagtttatccttacctttatcatcaaagtgctgactaatgcagtatctgccacc

SEQ ID NO: 87934 - DNA, 601 bp, Human
atacttaccaaaatccctgtagtcagaccctggtagaaggagagaatagtcaaagtgttctctctttccacattcttcttcttcttttaggggtagtttggtagttaagaacacagttgctagacccagacagactcagacttgagtcttgccctacctgtactacctgttagattttagggaactccttaattttcatgggcctctatttgtagaaggatgctaacaatattatgtgtagtttttagaacattcatctagtataatccctatacattttaagtaggtaattatgggttayctctcatgactgtttttatcttcatctgagaccctttctttcttcctttaagatacttctatccatatttttccctagagagaaacagtattagctactcctgcctgtcagtttaagctactgtgtcatgactattttgcatttctaagtttatccttacctttatcatcaaagtgctgactaatgcagtatctgccaccttgtgcctgctcagtaaatacaatttgggttaaactttattcatttttagttatgagtgcaatataatgacatagctaaaagttcgaaagtagagaaggg

SEQ ID NO: 87935 - DNA, 601 bp, Human
agctaaaagttcgaaagtagagaagggataacaaataggtactgataatgccactcttgtaatactacatgtagctgactggtgaaggccatggactatagagtcatactggaatccaggcttcagtgccttgagtgctctacttagaaatctgtgctttaatttccttagcactgaatgagggcaataaaagtaaccacctaatcaagatgcagggtggatgaaatacatctgaagcatttggagtaaggcctggcccaaaggttagctgtaataataaaaaggtggatggtgacgatgwacatgatgatggtttgtgtgtccctttattcatattgccattcacaaattacttgagtagtcctacttctcctgtttggtttatttgttgcaagaaacatgtgcattagaagattgaagatgattgcgcccacttgaggaaaccggacccagagaggtgaaatgatttcctaaatagcacccagaaagtttatgatagagaggaacatagaactctagcagccaggctgctctattcttattttctctatacttttcttgttggaaaaggacactgttgactcctagttaccatctaaca

SEQ ID NO: 87936 - DNA, 601 bp, Human
ctgactggtgaaggccatggactatagagtcatactggaatccaggcttcagtgccttgagtgctctacttagaaatctgtgctttaatttccttagcactgaatgagggcaataaaagtaaccacctaatcaagatgcagggtggatgaaatacatctgaagcatttggagtaaggcctggcccaaaggttagctgtaataataaaaaggtggatggtgacgatgtacatgatgatggtttgtgtgtccctttattcatattgccattcacaaattacttgagtagtcctacttctcctrtttggtttatttgttgcaagaaacatgtgcattagaagattgaagatgattgcgcccacttgaggaaaccggacccagagaggtgaaatgatttcctaaatagcacccagaaagtttatgatagagaggaacatagaactctagcagccaggctgctctattcttattttctctatacttttcttgttggaaaaggacactgttgactcctagttaccatctaacattgtggtccaagctacagagacagtagagcacattaagttctttcagtctggcttttatgctggctttgtgtga

SEQ ID NO: 87937 - DNA, 601 bp, Human
tagcttctaatgtgaaagaatatagtattatttacctgtttttccctttgcccacctttaggtacagtactatttattattttattttactattttaagatttaacattaattctctagcttatatctcagattgataagagcagttctacttcttttgatgagtcaagtgaatgaatgaagacattaaaaatgaccatgtcggccgggcatggtggctcatgcctgtaatcccagcactttgggaggcagaggcaggtggatcacctgaggttgggagttggagaccatcctgaccaacrtggagaaaccccatctctactaaaaatacaaaattatccgggcatggtggcacatgcctgtaatcccagctactcaggaggctgaggcaggagaatcacttgaacccgggagtcagaggttgcggtgagccgagatgttgccattgcacactgagcaacaagagtgaaactccatctcaaaaaaaaaaaaataaataaaaactaaaaaacaaccatgtctctcaaagccttgtactcagaccacctgcatcagaattagttgggggtacttgtaatatttttggtttccatctttgtgcg

SEQ ID NO: 87938 - DNA, 601 bp, Human
tgaccatgtcggccgggcatggtggctcatgcctgtaatcccagcactttgggaggcagaggcaggtggatcacctgaggttgggagttggagaccatcctgaccaacatggagaaaccccatctctactaaaaatacaaaattatccgggcatggtggcacatgcctgtaatcccagctactcaggaggctgaggcaggagaatcacttgaacccgggagtcagaggttgcggtgagccgagatgttgccattgcacactgagcaacaagagtgaaactccatctcaaaaaaaaaaaaawaaataaaaactaaaaaacaaccatgtctctcaaagccttgtactcagaccacctgcatcagaattagttgggggtacttgtaatatttttggtttccatctttgtgcgcagagagactatatcattaaaaaatgtttgtccttaagaaaggttcttttgatagttcaagactttgtaatgtatgtgaaattccactacaaataagtggatgggttgttaaatctcactggcaaaaggcagatgagttgagagactgaggcacttttgttgcggttaagcatccctttctggaattgatga

SEQ ID NO: 87939 - DNA, 601 bp, Human
cttgacttttttctcttctttggctataagcttatcttcttaccatgttgagatactttgatttgattttcactggtcaagcaaaaaaacatgttcttgttattttcacttaggcactttgtctgcctccctgctgaggcccaaaaattcagtgtgatcggtgtgtctgtcagaaggtaggattgcttgcctagggtggcattgttattgaacaaaacacatgccctttctttgcatcctaagtgtcttggattgctgagccagaaccgctctgactcaaatgaaaaccaccttgtgttargtgaaagatggggagttaaccatttgtttgctggtttgcatttcccacgaaaaactcaaaaacagaaatttacctcgccatggaaagtgatgtgccaagcgtcatatttgcatattaaaaccgaaaactgatttgcatgttatttcagtgtcttgtgtcacgttcaggcatctgtcaagcccactagacagaaacagcttgtacagtaggaaagtgtttttatgcatatcagactgaaaatctaggtgccttatttttatcagcaacttgtccacactttgggctctccaatctctccta

SEQ ID NO: 87940 - DNA, 601 bp, Human
ttactcataatatcacaatcctgacataagtcttgttaacatttggatatattcacttctagtagctgtttgataatacttacataggctaacatatactggcccttttgcatatatatttttatacatttgtaattatcagatgtactattttcatatcttcttattttttggcactataatggcaagaattatgacaatccaagtatctaaaataacagattaataaaatcttattttgagcagacaggaaattagaaccagtcagggctggagccgtggcaaccgaaactctgtgccrtctttttgatagtgctttattaaaactgtagcttgtaattgaggatagtttttctatgggacaatgcatagaaagctgtgcatggtgataaaacctttttttcccgacattagagcaactagcccattgcattcttccaggcaaccaaatgaagatgaaacgtgtgcctggagtcactgccaggcatgtggggcacagcaaaggccaaaatatggttttagtttgaaaacccaaccttgaataatggttcattctattcatcaaacttttaggtcatgggtcttgcctaggtgaagccat

SEQ ID NO: 87941 - DNA, 601 bp, Human
ggaaaaactgagtgtatgttttagccataacattgtggaaataggttcttttagtttcacacaaatagagatcttctcaccccaccgagaaaactcgctttctcctttacggagggcccgcatggaggtttagagggaaggaaccctgaaatgagaactgtgaataaggttggcaggagatctttgacctagattctcctcgactctgaggatttggcgcttctgctctgcgactcgcttttcttacttcttgcctacccggcaggataacatcagtggttgtaccttgtctgccgaagcytaagggaggctgctctgctctaaatagccaagcatgagctttactttactatttgtcttttggtcctaaaggcgagactgtacaagaattaatagttggagaggcagcaaggcatacgttcaccaaatgtcatgaatttcaagatttgtagctaaaaagtactcagagtaattacatcccttgctaaagcaacaattaatgtgaaattcgggtacactacactgaagtcctttatcagcagatggaaaagtggagagttactggagagatctcattctgcaaacattctgcttccaagaa

SEQ ID NO: 87942 - DNA, 601 bp, Human
agcattcaatttcccatgactttcaacgattaacctttgagcatattgtattgccgtaaggcaggtcagcctggccagcgagtgacttatctccatgtggtagttcagggcccagtctccatccttcctgtgcctcacaaggccacatctaactgcaaggagcatgggaaatgtagtctagcagtgtgcccagcaagaggaggaaatggattttggtgagcagttagcaggctctgccatgcttagtaaacatcagtcctttttaaagcatattagccactaaattgctcagaatgccacratatctggctgcgttttttttttttgaaagtgtcagtggtcttggtgttagaagatgtttgccaatacacttacttcagaagcatgactttcataaaaactcagctcccatttttaaatctcataatgacttcccattacttaaaacaggcttggcattgaccatatcttacttctcttttctcatcctagttctgtttttttcccttttttttttttttttttttttttgagacagagtctcgctctgtcgcccaggctggaatgcaatgatgtgatctgggctcactgcaacctctgc

SEQ ID NO: 87943 - DNA, 601 bp, Human
tttgtatttttagtagaggtgggatttcaccatgttagctaggatggtctcgatttcctgacctcgtgatccgcctccctcagcctcccaaagtgctgggattataggcgtaagccaccacgcccagcctttcctcttaacagttttttagatatacatgttcctcctgaaatgcctttaactttcttccttctttcttttcttcttcttcttcttttttttttttttccggctgttgtacgcaatttattcttcaagatcaaactacaggtcatctttttttggcagccttcttccgtcycagaacactgaattcatacctgtgttttagagcttagactttattgtaattgcctattttcatgtctctttcttcccaaactgtgagttgttagagacaggatctctgaataatttgtctttatacttaaagttcttggcacttggtaatcccgtaggagatttatgttaagacaattttgacggagtcctctaaaatctgtcgctcagtaactcacctgtggatcatataacgttaacttgcctttagtaagagattcgggtatttcagaaacaaacatattagtgattaagattgata

SEQ ID NO: 87944 - DNA, 601 bp, Human
gataaaagaaatctttgcttagataatagactcagactaaaatccaaacagccgcacagtaagagaactagaaagtcttggagacaatgatatcaaaaccccgagaggcattgcagtgaagaagtatgcccaactcagcacaccccagtttcaacgttctgctgtttttaagcagcggtacctctacaaggttgctcacttatcttcttaagtctctattttctcatccagaaataggattacatgtcatacagggctgttgtgtaggcatttgagatttcacatctgtgaaagtaggcaycttgaaaagggtcttgcaaacatgaggaattaatatgctacagtgaatatgttgctgatacaactcacacttctacttctgaagaaacgagaaacaaaaataacacaaactattccctttcagcacctcccaccacaaatattcaatcgtgttttattacccatacaatatgctagaagttgcttattaacaaataagttggacacagttgttcatttttcttaggaggtattgagccctaaacactatcgagagagaggtattagagtaggtctctgattatgacagtaagaatagtac

SEQ ID NO: 87945 - DNA, 601 bp, Human
ggtcatagtcaaatctctgtctctaaccttaatgatactgccgtataatgtattcctttatctctggccaccagtatattagataaactcaccatctcatttcagtcttgctgctctcccattcaccctctacttcagcgggaactttctaaatatgattagaacactcttctaaaaacacttaccgtggtttctaatgcctggatgttcctaattgagaacatgcaaatatattccccgtggtctgtgaacttcttgaaattgtaagtaaattttgtgtacactgcagatacctgtttttttgttgttgttgttgttgttgttttgtcaaaagacagtttaacacattagattttgagacttgtccacgttcttacccaaggcctggagcccctagctcaccgagaagccctaaacatctcagcatggcatggaagcagtaattaactgacccttcctatttttccacctgtccagaccgaaatactgaaccacttgtagtttttcccactcacaccaaactacgtctcaactttgaaactgtgctcctctcagggtccttcacttggcctgggttggaagctccaggatagcgggtcat

SEQ ID NO: 87946 - DNA, 601 bp, Human
tccttaatctaaagtataacaataaagctaaacataaattgatggagattaacaacaatgcatggagaacagtaaaacaaaacatagaaaatccacgaaggtttctagttacatcaaaatacacaaaaagtttattaatgctcttgtcattgccatgtgaggagggtttataatggggtctaaaatacattttttaaaagtgaaaaataaggtctctgtatttaggtcctattaaaaaggaaaagctgacttaccaagtatatatgcttcaaatatcatagcaacaaaatatattgccacaaaaaaaaaactgaacatagatgctaattgcatgaatgaatatatattgaacactctgggaaacagatataaattattacctttcccttcaagaactgtccaagctctactacttagtagcttagaaaacttgaacaagtattattccctctaaaccttcatttttgttttgttttatctgtaatatgggaataataactagcttatactgttgttttaagaaatggatgaaatatttatacaaagcacttagccaagttcttggcatgtagaatatgctcaatacaatactcaaggttct

SEQ ID NO: 87947 - DNA, 601 bp, Human
catgccatgagaactgctctgtggatagtggttaaaaacatgcactccagagccaggatgcacttcttaccagcaagatgaaatcaagaggcaaaggactagtgaaaagaactgtcctttattgttccgtgctttaaacatttctcaagcaccttctctgtgcctgctactgtgctgggtgttcaggacacccaaatgcagaggctctgccctcatggggctcacgggttcctaggaaggacaagagagtcacagatgtcaaggattttagtgcagatattagcactgtgttgggtgtgaytgagctgctatgtgagagtccataagtctgcctgaggatgagcggaaagaatacatagcagtgtgtttgcatcagcagggcctgacccaagagcgataaagtcttctcttcctttctgtcagagttttacctttggcctattctggactgcaaatagcattgccaagcacttcccttaaataacttctcttttttgcaggactatcctctcagccctgccaaaaccccatcacctactctttctttactactttgcctatttaatgctggaatttttatttaaactgtagctgatttact

SEQ ID NO: 87948 - DNA, 601 bp, Human
ttgtccatgttcattataacttgtgactgtcgcattacagtattaggtaaatgccacagatgttgaaccatgataaagcagttggatgagtctatatctctaaagggaagatacagtctctatactgtgggcatttgccatctacttggacttaagttttggctataacagatttccttaccatggacctgtgtctttccattaacactggtgtcattgagagggcctctaaacactaccctgtagaggaaagggaggaaacatagtagaaagttgggggtaggagaaaattcttacccarttcaataaaccagacagtgagtgtttagcccagctcatctacaggaagccttggttcaagtgcttgcattttagagcaaattttttcctagacaactagaaaaatatgttgatactaaaggaggctctcagttctagtgatagatacttaaaaagaacaaggggtggctcatgcctgtaatcccagcactttgggaggctgaggtgggcagatcacgaggtcaagagatcaagaccatcctggccaacatggtgaaaccccatctctactaaaaatacaaaaatcagctgggcatggtgg

SEQ ID NO: 87949 - DNA, 601 bp, Human
ctagacaactagaaaaatatgttgatactaaaggaggctctcagttctagtgatagatacttaaaaagaacaaggggtggctcatgcctgtaatcccagcactttgggaggctgaggtgggcagatcacgaggtcaagagatcaagaccatcctggccaacatggtgaaaccccatctctactaaaaatacaaaaatcagctgggcatggtggcacgcacctgtagtcccagttactcaggaggctgaggcaggagaatcacttgaacccaggaggcggaggttacagtgagccaagatcrtgccactgcactccagcctggtgacagagggagactccgtctcaaaaaaaaaaaaaaaaaaaaaaaaaaaaaaggaacatggggcgatgaagtagctgtaaattattataatttagagtcaattcagagcttataatagaaaatggaaaacttttaaattgagtattaaaatgaataggagagaaaggtattattctcagaaaattgggacatctacagggctagttgccagttttaaagtttgttttttcaaacagttttaggcagctaaaggaaagcaaagttgagtttttctccaga

SEQ ID NO: 87950 - DNA, 601 bp, Human
ttctagtgatagatacttaaaaagaacaaggggtggctcatgcctgtaatcccagcactttgggaggctgaggtgggcagatcacgaggtcaagagatcaagaccatcctggccaacatggtgaaaccccatctctactaaaaatacaaaaatcagctgggcatggtggcacgcacctgtagtcccagttactcaggaggctgaggcaggagaatcacttgaacccaggaggcggaggttacagtgagccaagatcgtgccactgcactccagcctggtgacagagggagactccgtctcaaaaaaaaaaaaaaaaaaaaaaaaaaaaaaggaacatggggcgatgaagtagctgtaaattattataatttagagtcaattcagagcttataatagaaaatggaaaacttttaaattgagtattaaaatgaataggagagaaaggtattattctcagaaaattgggacatctacagggctagttgccagttttaaagtttgttttttcaaacagttttaggcagctaaaggaaagcaaagttgagtttttctccagataaccttgagatatctctttgaaattgtccaagacttttctgtg

SEQ ID NO: 87951 - DNA, 601 bp, Human
aatacaaaagaaccaaagttttcttattcaaaagaaacaaaagagattcccagtatcttttatctcagtgtctttatccaatttacttgtaatatttcctatctgttttcttcactaaatgtaagtctgcgtgagggcaacaatttatgtttagttcagtattgtgttcctatcattcctggaataatgcctggcacatcggagatatttaataggtgttaatgaattaatgaactaataaatgaaaactgtgagcagactttcacacttctgtgacaggacatggtatatagtaaactayagggaggaaatacttcattcatttaagatatatttatttagcaccttataaaatcataaaacgttagagctggagggaatcttaagagactaggaaaacctcttcatttttagagatcatgaaaatgagtgagatttttagggtcccaaatttgttagtgacagagccacagagtataactcagattttctcattcctttttttaattcacttaagggcacaggaaaacatataaactagagtaagacatggctgctacatttattgaacttaaatttaaattgttttaacacctttgga

SEQ ID NO: 87952 - DNA, 601 bp, Human
tgaaagattgtccgtttaaagtaagcctcttcaagactgtgaaccaccacccaagattggtgtttcataccgtcttgatacaaacagcagacatccagtcattcagctgcgttaggatcactatctctttatcagaagaaagaagagaaaagtagaagagagatttctacttcataattgaatgttctttgcttattaactgtggaagcaaacttgaaattctgggagagaaagcactgatggggcacacattgtctgtggtgcaaagaaagtctcagtttggtactggtacctgaacctrcaagtgctaattatgcatcttctggtattaacacacaaacacaattaactgtgaactcagctccttttccctttcaaaccaccatcattcccccaacctgcactttccccaccactttctctaaaacacacagataagcatctccttacagactttgaagtgacattaggattgtcagaaggcataattaattgactgtcagcaaagctattgtttgaacatctctggagttgtacttggtaggcatcttgtttttttgttgttttgttttgtctgagacgtagtcttgctccgtcgccc

SEQ ID NO: 87953 - DNA, 601 bp, Human
caggctgatcttgaactcctaaccttgtgatctgccagccttggcctcccaaagtgttgagattacaggcgtgagccactgcacctggccctgttgtatttttaattgaccgattctttcctctacaaatatttattgagtgcctactactcaccaattattgtagtgtatactatgggagataatggaaatgatataatggccaaggagagaaagcatttgtcaaatcctctagggccaagggctttgatagagaacagatttcacaactggcagtggaaaatgtattcttttccatccmggttcagaggattttgccactgtacttgtgccatataaaatgctgaaatagttcatgagaagaggtacaggcatacatcttcctggtgtgtgaagatgagtggcaatgcactgtctctggttagagttcccaccaaaaattgtaaaatacttaaaaagaaaaagcaaaaaatatccgaggcaattaaaaaaaaaaaaaaaaagggaaatcacagaagcaggtccaagttaatgaccttatcccaattctgttcctaagtctgactctgatgttagtcatgttgtatttaattcttccaga

SEQ ID NO: 87954 - DNA, 601 bp, Human
ctagtccaatcttacatcacaaacatgaaaacagaatgaagagtgacaatcactttctaaagatttttaaaatgtcacttataactatctgcaaaagaacctgcgtcttttgacttataatgttaagtgattttcttgtttattccttaaaactgcctttgtagaatgcactatgttatttgatggttctggagtaatacaaaagaagagagtgattaatttgcctgggatcctacaacaaaccagttgaccaagagataataagcttattatattatgcagatctatacctattcacttsgtttagttaagaaacagctcatcaatatggaatacacattttcatagtagatttgtgggttgcatagcttttttgtgtctgttttcaatttctgttcctttgataactgaacaaataacagagatggtgaaacccagcaagcaaattatcttccagattttatgtgatctcccttctctagtgagttggtatgtctactaatgacacagtagattataaggttatttggtttaagtaaatatttatgcagagcctatgatatgtccatctctgtcttaggtggggtgaattagaattact

SEQ ID NO: 87955 - DNA, 601 bp, Human
tctcccttctctagtgagttggtatgtctactaatgacacagtagattataaggttatttggtttaagtaaatatttatgcagagcctatgatatgtccatctctgtcttaggtggggtgaattagaattactataagtgctttctgaaaaaaaaaaaaatgtaccatgaacaaatttagaggtctctgcccccaagaagtccatagaccattataggttagagaataaaaaatatatgataatcccttttcccatgtgataaatgttataaaggagctctgtacctatgattatgagagrgaatgtttgagagctctaggaaaaacctccctagggagattaagaggtgatatctgatgtcttcatgaaggaataaaatgtttccaagtagagaaagagaagaaagatgttagatacagaagaaacagcatgtacaaaggtatagaggtaggaaaacatggtattctgggaacaggaagatgttacttcctaacagaacttctctgtggctgaagccacattgagttgagggacaagtagtgggacaaggaaggatagagagtctggagttcagtgataaaagatcttgtgtgatagtca

SEQ ID NO: 87956 - DNA, 601 bp, Human
attggtaaggacctacttgattagatatgacccacctgaataacctcacatactcttcctatctcaaaactcttaacttaatcctatctgcaaagtccgttttgtcatatacagtagcatgttcataggtttcaagcatttggacatggtcctctttgggaggcattacgctgcctgtgacagtgctcttctgatacattttcagtgatcttctagacataacaatcctggtcctgggaacatgcatggcggggacctaaataagtctattttttaagaggccctaccctttgcatagatyctaatcttggggtaaaggaaagtttgagatttcactccacctttttttttggtgctggtatttccactgtgggaaagatcattcggatttaacaaccacatgaagctcctggattatctggggcatgtttgctgattcccaaggaagcttgatctttttgatggagcacttgagctggtaagttattagaagctgagctataattttccttggcattggtcatttttgtctaatcttttatttttttttgttttttttgttttgttttgttttgttttgagatggagtctcactgtgtcc

SEQ ID NO: 87957 - DNA, 601 bp, Human
tggcggggacctaaataagtctattttttaagaggccctaccctttgcatagattctaatcttggggtaaaggaaagtttgagatttcactccacctttttttttggtgctggtatttccactgtgggaaagatcattcggatttaacaaccacatgaagctcctggattatctggggcatgtttgctgattcccaaggaagcttgatctttttgatggagcacttgagctggtaagttattagaagctgagctataattttccttggcattggtcatttttgtctaatcttttatttttgtttgttttttttgttttgttttgttttgttttgagatggagtctcactgtgtcccccaggctggagtgcagtggtgcgatctcggctcactgcaacctccgcctcctgggttcaagcaattctcctccctaagccttcagagtagctgggactacaggcgtgcaccaccatgcccgggtaactttttgtattttcagtagagacagggtttcaccatgctggccaggctgatctcgaactcctgaccttgtgatccacccacctcagcctccaaaagtgctaggattacaggcatgagcc

SEQ ID NO: 87958 - DNA, 601 bp, Human
cctaaataagtctattttttaagaggccctaccctttgcatagattctaatcttggggtaaaggaaagtttgagatttcactccacctttttttttggtgctggtatttccactgtgggaaagatcattcggatttaacaaccacatgaagctcctggattatctggggcatgtttgctgattcccaaggaagcttgatctttttgatggagcacttgagctggtaagttattagaagctgagctataattttccttggcattggtcatttttgtctaatcttttatttttttttgttttgtttgttttgttttgttttgttttgagatggagtctcactgtgtcccccaggctggagtgcagtggtgcgatctcggctcactgcaacctccgcctcctgggttcaagcaattctcctccctaagccttcagagtagctgggactacaggcgtgcaccaccatgcccgggtaactttttgtattttcagtagagacagggtttcaccatgctggccaggctgatctcgaactcctgaccttgtgatccacccacctcagcctccaaaagtgctaggattacaggcatgagccaccgcgcct

SEQ ID NO: 87959 - DNA, 601 bp, Human
atgctatcatatgctttctgcattccagacatatattgaaatatcttggttgttatagccatcttctcccacatacatcccctttctctcttcccctctacatttttttctgttacttgttatttttggtactgatgtgcttttatttgagtaggatattggaatgcaattgtcttcttagtccaccatcccctgacctgtcattattgaaaaacaaaattctgtagcaaatgagtccccgaaagtgttttttttcaaatgatgatgatcggtcacgttgtgaatctgtagactcctttgygaaaacaacaataaacacagtattatttatggtggatatgctaggtacatccaaagctcttcatatgtgttgccttgtataatttcctcagcaactctaatttaatagaaactattgtccatgtatagatgaggtagtttatacccagataggttatacaaacctgtaagtaacagagccaaattttaaaggcagacaatgtaactgcagaaaccttgttcctaattgtttaatggaatatggtttagaattctgtgtggagaatcttactctaccctagtggtaaacttaaagctcttt

SEQ ID NO: 87960 - DNA, 601 bp, Human
acatcatttctttccaaaggtagcttaaacacatgtagagccatacagtggtagagttggaaaaaaaatcttaaaatcatttgcgtaattactctctttagcaatgagaatgccaagacatacagaagaggaaagcgacttcgtatgacctatcattagtgtcagaaccaaggctgcattccgttattcacgctccacagtcttagattctttgcagatgctacatggttttcattttcctaaacataaagataaacaaagtaatgtactgttgatctggaaggagcaattatgcataagygaaagtctagtaaacaaaagcttacctctttagaatataagaatatttcaaatatctttgaaatctttattgaaaaaagaaaggcattacataattccttgcctttttaaacagactaaaccgggtgtcattcacaatggcttggcaccacgtttatgaaattatttattgccacgagccctaaggtagtgatgttggcagagtgtgtagaggcacccagggttgtccttacaccaagtaaacacatactgctgtgtttttttatagctcctgtctattttttatccctttttgactcca

SEQ ID NO: 87961 - DNA, 601 bp, Human
ctttgcagatgctacatggttttcattttcctaaacataaagataaacaaagtaatgtactgttgatctggaaggagcaattatgcataagcgaaagtctagtaaacaaaagcttacctctttagaatataagaatatttcaaatatctttgaaatctttattgaaaaaagaaaggcattacataattccttgcctttttaaacagactaaaccgggtgtcattcacaatggcttggcaccacgtttatgaaattatttattgccacgagccctaaggtagtgatgttggcagagtgtgtrgaggcacccagggttgtccttacaccaagtaaacacatactgctgtgtttttttatagctcctgtctattttttatccctttttgactccatagttgatttttgctactttaatgatgctactgtggcagcagccttcttcagttgttttgtttcaacccttgttagcttgaaatcatatagacagtattgggaaacagtgtaacagggtgggaagaacatgaatttgaatttcgttacgtcacttagtgcctcccctccttgggaaaattatttactctttctaagtatcagttgcctc

SEQ ID NO: 87962 - DNA, 601 bp, Human
gaaaggcattacataattccttgcctttttaaacagactaaaccgggtgtcattcacaatggcttggcaccacgtttatgaaattatttattgccacgagccctaaggtagtgatgttggcagagtgtgtagaggcacccagggttgtccttacaccaagtaaacacatactgctgtgtttttttatagctcctgtctattttttatccctttttgactccatagttgatttttgctactttaatgatgctactgtggcagcagccttcttcagttgttttgtttcaacccttgttagctwgaaatcatatagacagtattgggaaacagtgtaacagggtgggaagaacatgaatttgaatttcgttacgtcacttagtgcctcccctccttgggaaaattatttactctttctaagtatcagttgcctcatctatataatggggacgatggcagttattttccatgaagaagaaatgagacaatcctagtaaagcacactgggcctcttcaggaaaagtagtggaataaatgttattctgggattaactttaatgatgtttctgaaactgtttaatatttctgaatgtgggaaccttac

SEQ ID NO: 87963 - DNA, 601 bp, Human
tattataacctttcagacatactcctcgcatttttacatgtttgcttgcttttctgagtgcgtaacaaaactggagaaggtctaatctgattaaataataggtttctacagtgtgtgggctcaagtttctatctccattccaggcataggatgggtctctgtgattctgtaggatgccagccccttcttctttggtttgttgttactatactatgcttatgagaaggaaaactatccgggagatatttaatcgcgtacttggaagaactgggtgaattcaaataatggaaattctaaccatttttttttttttacttctttccctcataagaacatttaatcaaggtttttctttaatgagatctattcgtggtgactctaaaatgtaatttaattcttatcagaattcagttaagctttaccaaagacccttgttcaatattgattcgagttcagcacagtcctcaagccctcagatggatgtatcagaactttaatttcttctgaacttttatatgtccaataagctgcatactagaagtgtaaggaggttgaggaaattgggcaaatgaaataaaacaagttggctttgaagatagtt

SEQ ID NO: 87964 - DNA, 601 bp, Human
ttaaataataggtttctacagtgtgtgggctcaagtttctatctccattccaggcataggatgggtctctgtgattctgtaggatgccagccccttcttctttggtttgttgttactatactatgcttatgagaaggaaaactatccgggagatatttaatcgcgtacttggaagaactgggtgaattcaaataatggaaattctaaccatttttttttttttacttctttccctcataagaacatttaatcaaggtttttctttaatgagatctattcgtggtgactctaaaatgtaatytaattcttatcagaattcagttaagctttaccaaagacccttgttcaatattgattcgagttcagcacagtcctcaagccctcagatggatgtatcagaactttaatttcttctgaacttttatatgtccaataagctgcatactagaagtgtaaggaggttgaggaaattgggcaaatgaaataaaacaagttggctttgaagatagtttgcattaaggagaatcctagaactgtgcgtctctcttggaaccaaaagccttagaacaggaagcatattctgtgtgatccagcaaaattg

SEQ ID NO: 87965 - DNA, 601 bp, Human
cataagaacatttaatcaaggtttttctttaatgagatctattcgtggtgactctaaaatgtaatttaattcttatcagaattcagttaagctttaccaaagacccttgttcaatattgattcgagttcagcacagtcctcaagccctcagatggatgtatcagaactttaatttcttctgaacttttatatgtccaataagctgcatactagaagtgtaaggaggttgaggaaattgggcaaatgaaataaaacaagttggctttgaagatagtttgcattaaggagaatcctagaactrtgcgtctctcttggaaccaaaagccttagaacaggaagcatattctgtgtgatccagcaaaattgcctttggttacactgttgaaaactgatgtctaaaaggtattccatacaaaccagagcaaacctagcccttggccatcagtcagtgtgcctgtcttttttttttttttaattgatggaatgagaatattcaagatagtggcttaattatttttgtataaggaccagcatgtttgatactctgagttcaggaatgagaccagtctaatgtaaattaaatttacttctgcctaaattg

SEQ ID NO: 87966 - DNA, 601 bp, Human
ccatttgccagtcaaaatgtattgtgtgttttgcaatcttttagaattgtaaataacatgcctatagatagttaataaaaattttattttttattttgaattacatccttagcataaattctttgatttatattaccaaatcaaatttaatctggaggacttttgcattaccttgctagatttctttagaaatatttttctaatttacagaaccatcaacaataatgaaactatatgttaaaatgcaaactatcccctatggcagaagtttatttatattttctgaactaatttaataagsacattatgtcttagttattttaagtttgtgtaattattagcaaaatcaatgagatgcttttcttctttggtgatatgtctcttgaaagcctagttttggttattcttatagatttgaatatgtaaacagattaaagtaaagatcactaaaactttgttaggaagtgatataaatagaatgtatttatcctaattctagctctcctggtgtgaccttgggtaaatcatttagcttctgagtatcagtgtcctcatttactaaagggagatattaatttctcccatgtcttcacagataagg

SEQ ID NO: 87967 - DNA, 601 bp, Human
caatgagatgcttttcttctttggtgatatgtctcttgaaagcctagttttggttattcttatagatttgaatatgtaaacagattaaagtaaagatcactaaaactttgttaggaagtgatataaatagaatgtatttatcctaattctagctctcctggtgtgaccttgggtaaatcatttagcttctgagtatcagtgtcctcatttactaaagggagatattaatttctcccatgtcttcacagataaggaataagcagttgtgatattttgtatacatgaaattatttactaatawaagtgcttaatctgattaacagaatttttatcattgctttttttttcccctttagtataatgtgatacactatagaaaccctctaaatctggggcaatttcttggctgtagttgctatggaaatactgaaataaataaatgtcatggaaggaatataaggacacatattaaaagcggaggttcatgctttgcttaagaagatttttatgttggtatgaatatgaagggcagcaacagtgcctcctgcttatgtacccttctgcacataaagagacagccttactcataagtatagtttta

SEQ ID NO: 87968 - DNA, 601 bp, Human
gagaaaaatttgtcaagcactctcttgggaagttaagcatgttacccactgggaatagttatctcttccattcatacagccccttacattttataatgctaccgagcatctgttgttgcatgctgtcatacctagtagagccttgtgaaatagatcatggggagattattagtctcattttacaaatgtggctcggatgttttcaaagtaaatgacaaaacaaagactatgaataacttttataatttacactttattgcttggcccatactaacatccgtgctaacattcagcaactaattttttttttcttttttgagatgtggtcttgctgttgttgcccaggctgaactcaaactcctgggataaaatgatcttcctgcctcagcctcgcaagtagctaggactacaggcttgcaccaccacgtgcaacgtgcaacttaatgttcaactcttttttttttttttttttttttttttggagacagggtctctctctgtcgcccaggctggagtgcagtggtatgatcttggctcactgcaatctccacctcccggattcaagcaattctcctgccttagcctcctgagtagctgggat

SEQ ID NO: 87969 - DNA, 601 bp, Human
atggggagattattagtctcattttacaaatgtggctcggatgttttcaaagtaaatgacaaaacaaagactatgaataacttttataatttacactttattgcttggcccatactaacatccgtgctaacattcagcaactaattttttttttcttttttgagatgtggtcttgctgttgttgcccaggctgaactcaaactcctgggataaaatgatcttcctgcctcagcctcgcaagtagctaggactacaggcttgcaccaccacgtgcaacgtgcaacttaatgttcaactcttytttttttttttttttttttttttggagacagggtctctctctgtcgcccaggctggagtgcagtggtatgatcttggctcactgcaatctccacctcccggattcaagcaattctcctgccttagcctcctgagtagctgggattacaggcgcccaccaccacgcccggctaatttttttattttttcatagagacggggtttaaccatgttggccaggctggtctcaaactcctgacctcaggttatccactgccttggcctcccaaagtgcttggattacaggcatgagccatcacac

SEQ ID NO: 87970 - DNA, 601 bp, Human
agcaatgaagtaataaaactactggtaaaaaaataaaggggcaaagatgtagtagtaaactcagaccaaaataagataatattaattacctactaactacaatattcatagaagaaaagtaccattcagtacaaaggtatcaagcagtctgaagaacattactttttgataaatgtcacagttccccatgaagaatagccctgagctttccttcattaaatatcattatattgaaatgtataatttaaaaatactgaagtaagagataagaagggtgaaaacatattctttataaaacctkaacacattgcttttagtctttgataaatcataaaaaggagttaaataatatgattgataacgttaatttaatccacatacactgatctatgcaaacaaagagtttctatcttctgtctaaatctgcatgggagatttagaaaaacatttatcatatcaaagtctaataggaaattgtagacagttcctactgtggctggcagaattacatgtagccatatagtagaacaagaaatgaataaatacataagcgcactcttgggttaaggaatcttagaaagtagtgatgatgctaacactg

SEQ ID NO: 87971 - DNA, 601 bp, Human
gtattttggggattgaatgtgctttggaaagcctctctcgctttaatagacattcgtattatcaccctttattatacaacaatgttttcagtgggggaatgaatagttactacactctcctttgctagtggtatttatttagccctttcaaccaaatatcccccagccctctgctcatcttagttactgctcaccacatccttgcacgttccaaggcagcccttacttggtaaggaaagagaggcacagacctgtaagtggattgcccagaacaacaaagaggcctagctgaacataaccytttcttcccagttcctgttgcaaaccgtattaactgctgttgtcatagaattagaatgctttttaaagtccagcaggaaccttagaaattcaataatgccattttatagctgagaaagctaaatcccaagaaagctgagtgttttgcctgaggttatacgatttattaacggcagaggtgggactagaaaccatgagtcttcatgaggccttcaaagaactactttctttgggaccgacatgaagggtttaaacatttgtggctacaggtccagagagacatccctagaaaatgctgaga

SEQ ID NO: 87972 - DNA, 601 bp, Human
tctcggctcaccgcaagctccacctgccgggttcacgccattctcctgcctcagcctcccgagtagttgggactacaagcacccgccaccacgcccagctattttttttttttttttttttgtatttttagtagagatgggtttcaccgtgttagccaggatggtcttgatctcctgacctcatgatccgcctgccttggcctcccaaagtgctgggattacaggggtgagccactgcactggccataattcttaatggataaaggaatgataattacccagctgtagcgtggactccatrttagtacggtctcctaaactactcttcattctcaggagaaataaatgtttgtaacctaatattctctattagaagaaaatggacagtggcagagaagagagtgtgtgtccgtgtgatcaggccataaagttaatcttaaaagtaaacctgaaaataaattcaaagattctagatatgagagtcttttacgtagtggggttggtatgaggcagtaaatgattttaaggaaagaatatagaatttaaagtgagacctggttcacactcagccagctgctattctgcattcttccctttactt

SEQ ID NO: 87973 - DNA, 601 bp, Human
tcccatgcaggcaatgactgttacatctttcccttctttgtagtttatttttgcccagatggatctgcattcatttgtactatctattataatattgttagaattcactattatactgtagaattcattaattctattatattgtagaattcactaattctataatattgtacaattcacattatatattataacattgtagaattcaccaataatattgtaaaagtcactaataattcataaaaggaatgaattcatttgtgatcttatcaaaaaaaatttaaaaagaaaaaagaggccrggcacagtagctcacgcctgtaatcccagcacgttgggaggccgaggtgcacagatcacttgaggtcaggagttcgagaccagactggctaacatagtgaaactccatctctactaaaaatacaaaaattagctgaatgtggtggcacaagcctgtaatcccagctactcgggaggctgaggcaggagaatcacttgaacccaggaggcagaggttgcagtgagctgggatttgtgccactgcactccagcctgggcgacagagtgagactccatctcaaaaaaaaaaaaaaagtaaaga

SEQ ID NO: 87974 - DNA, 601 bp, Human
gaggccgggcacagtagctcacgcctgtaatcccagcacgttgggaggccgaggtgcacagatcacttgaggtcaggagttcgagaccagactggctaacatagtgaaactccatctctactaaaaatacaaaaattagctgaatgtggtggcacaagcctgtaatcccagctactcgggaggctgaggcaggagaatcacttgaacccaggaggcagaggttgcagtgagctgggatttgtgccactgcactccagcctgggcgacagagtgagactccatctcaaaaaaaaaaaaaaagtaaagaaagaaagaaaggaagaaagggagaaagaaagaaagaaagaggcacttgaatgaaagtactgtttcttagctcacatggttatagggtgaaatgaggattcggagaggacaggactgaacaaaaatcagtgtgggggctttgagtcgtaaataactgtaccagggcttagccccagttagacacataacaaatctgcaagagagaattttgcctaacttgaatcaccaaaggacaactgtaagtcagcatttcaggctctggaatattacttgcatacccacttggtttgagaac

SEQ ID NO: 87975 - DNA, 601 bp, Human
gaatcacttgaacccaggaggcagaggttgcagtgagctgggatttgtgccactgcactccagcctgggcgacagagtgagactccatctcaaaaaaaaaaaaaaagtaaagaaagaaagaaaggaagaaagggagaaagaaagaaagaaagaggcacttgaatgaaagtactgtttcttagctcacatggttatagggtgaaatgaggattcggagaggacaggactgaacaaaaatcagtgtgggggctttgagtcgtaaataactgtaccagggcttagccccagttagacacataamaaatctgcaagagagaattttgcctaacttgaatcaccaaaggacaactgtaagtcagcatttcaggctctggaatattacttgcatacccacttggtttgagaacttgtggagtctgagagatggcaagtcatgagactaggagctcggttttctcaaaatgtgtcagcggtcacctgctttgtaatcactgtgaactcctcattaaaaagtaaagttctggactcctccccagaatttctgcacaaggagacaggaactttgcatcttttgcaaggctcctgggacagcagggagttg

SEQ ID NO: 87976 - DNA, 601 bp, Human
acaaaaatcagtgtgggggctttgagtcgtaaataactgtaccagggcttagccccagttagacacataacaaatctgcaagagagaattttgcctaacttgaatcaccaaaggacaactgtaagtcagcatttcaggctctggaatattacttgcatacccacttggtttgagaacttgtggagtctgagagatggcaagtcatgagactaggagctcggttttctcaaaatgtgtcagcggtcacctgctttgtaatcactgtgaactcctcattaaaaagtaaagttctggactcctccccagaatttctgcacaaggagacaggaactttgcatcttttgcaaggctcctgggacagcagggagttgggaggtaaatttttatgcacagtcaagtttgaaatccactagtctgtacttccagtcaagctcatgcaaaaattggtcccaaaatatgtttgcattcttatctcccatcagctctcctacacattctttttacaacacttgcccaaggtgaggactcttctcctggacattgatatggaggtttctctgtctattcccatgccattggttgcctaccttctgccttttcc

SEQ ID NO: 87977 - DNA, 601 bp, Human
ctgattgatggattgcagatcagaatatcctatgcttctagttatatagaaactacatgcttagtgttttttttttttttttagacagagtctcactctgttgcccaggctgaagtgtagtggcacaatcttggctcactgcagcctccacctcccagattcaagcgattctcctgcctcagccttctcagtagctgggactgcaggcatgtgccaccacgcccagctaatttttgtatttttagtacagacggggtttcaccatgttggcccggatggtctggatctcctgacctcgtgwtccacctgcttcagcctcccaaggtgctgggattacaggtgtgagccaccacacccggcccatgcttagttatttaacagaggtttattgagcactgtgttggctttaaacaattttgctagacattcagtagggcctgatgagtgtttaagacctcgtacagttcaggtgcattttcctttaaggatacatttaacctgctagatgtcatctcattttgaagacaagagaaaaagagaggaagacttgttttttcagagggttattatacattcctattagatcattaggaaattggca

SEQ ID NO: 87978 - DNA, 601 bp, Human
cttccttgggaaaagtgagtgtttaaacacatgtccattgaatatttttaactgaaaagtgaactatttgccagttttaagagacattgagtgagcaccttctgtgtgcaaaagactgtgctccgtgctatgcggaatacagcgcagtgtgagacttgttcacgctctcgtggagccctgaggtgaatgagaagtatcagacatgtgaacaaatataacacaaggcaaagtaatccaacttatctgtgagagattcgggcagttgtgagagctcagaggaaaggccatgccccatcctacrgtggggagaggaggggactggcatcgagaaagacctcccagaggatgcagcatttgagcaaagccttgaaagtagagtaggaatggataagggggaaagaatgaatgagaacagttccaatatctcaacatttttttatgttgaattccattatagcttctaggatcaaaggaaaagaaatcagcctcttgttcagtaaagatttgttgagcattcattatatgtgcattattctgcagaaaatttggggctgggagaggtaaaaaaataccttcaggataacaggctttttcacaaaag

SEQ ID NO: 87979 - DNA, 601 bp, Human
ttgcaaaagagagaatcatcagtatttgggaaactcactgtttgaatgagatagaaagccaaacagataaatgggaattattttaagtgccataatgggtctatgcactgtctttggagattggatggacagggtagcaaaagattgaggagctaattttgctgctgtttatctaagcatgtcagggtcctgtcttttcacgtagattatgagtgtcttggcatgtcttttgtctctctgcatcccccgaggctccttgcacagtcctcacactccactggcgttctgttaatatttgttkatgatgatactggtgattttttctctctgacatccagaacactggagagattttctgttggcccttgggtataacagatttttatttatacatttgaattagccttttagaaatcattcttaagtaaaatagatatctttttagtgagagagtttctaaatacgaacttattcaaaacagtaatgatattctattttagccagctaatactcaactacgatttgcaatttagagagttgtgcttgtatagattgtccctttctgaagtgagtgaattgtaactttaaataagggctgtta

SEQ ID NO: 87980 - DNA, 601 bp, Human
gagaaatttttttctcatatgaagttatgattaaatttgtgaattgcacaagcttggaattctgctgcaggatgcctacattctgtattgctttattttggtcatatattacaaatggaatatttcccagctcatttatatacagttcctggttgctgaaattttactggcaagctttgtgaactaattttacttctcaaagatactaggaataaagtgaaaatagggtcttttctctcataggtctaaaagatacttctttcctttaaccattacattctggaggtgtaattaatccaaycctgctgtagataggatctcattataaagattctaggtaaacagtctttctagcagaaatgatctttttggttcagtcttgcagcatttcctaaaattgctagtgtacgtagtaaatagggaggtaagtggggaaatttcctaaaaatgccagtgtacagagtgaattgttaggtaaatgagaaaatcaggcttgatttaccaaccaccccatgtgcacatacaaacaaacacacactcacaccaaagccaggaaccctgcaacaaagttctatttaccctgaggagatataaaactttg

SEQ ID NO: 87981 - DNA, 601 bp, Human
ataaaaggaggttaataaaagggaatacttatcatgttgaattaatgggaatattaaatgagtttatgtggtttaattgcctagcacagtatctgcctcctaagatatgtttaataaatgctaactgtgactatagagatttaccctgaagatacctgtcatgtcatgccttctctgtcaaatagatcatgaatgcagttcctagcctctctctcctgttataccctcctagcaatattctgatgcagatgaacccagccacttgtcttttgcttgccagaacagctgaatgttgctgggaaaaaaaaaaacaaaacacagccgggcataatcatatcattataagttgtgaccagccttgacctgcgccttgaccccacccacagcctacattcttacaccctgctctcaactgtttcagacattctctactgtgacttctatctcccttccccactccttccttctcaagggatgccctggcctcattcttcatagtgaaaatgaaagctgccagaagaaactctttcagcttctgctctcaaatctgtgcccatcctttctgtcccttagtgcctatcagattatcagttgccaattg

SEQ ID NO: 87982 - DNA, 601 bp, Human
tgcttgttctcatttataagtgagagctgaatgatgagaacacgtggacacaaataaggaaacaacaagcactgggatctacttgagggtggagggggagaggagggagaggaatgaagatagctgttgggtactgggcttcatacctgagtggtgaaataatctgtacaacaaacccccatgacatgagtttgcctatgtgactaaaccttcacatatacccctgaacctaaaataaaagttttttttaaaaaaagaaaaaaaaatcctgcctccatttttctatcaagtattctgcctrctaccaggcccctatcccttcatagactagctgaggacatcagggacttccatgttgccaaaaccgtgagtctaatcagtgtttacctaacttgatatctcagtaaaggatcattcattcttacaaaactgtccctcccaacttccttggcaccccagcctcccgattttgtttttaatttttcaataggttattgggggcacaggtggtgtttggttacatgagtaagttcttagtggtgatttgtgagattttcgtgcacccatcacccaagcagtatatactgcaccatatttgtaa

SEQ ID NO: 87983 - DNA, 601 bp, Human
tattcatcatatatatatattccatcatatatatatatatatatattccatcatatatatatatacacacacacacacacacacacacacatacccacacatcccagtttctttatccacttgttgattgatgggcatttgggttggttccatgattttgcaattgcgaattgtgctgctataaacatgcttgtgcaagtatctttttcgtatgacttcttttcctctgggtagatacccagtagtgggattgctggattaaatggtggttctacttttagttcattaaggaatctccacmttgtttccataggaccagcctgctgattttctctttacctatgtctcagttacctttgctgttttgtattctccctgactcctaagttgtccagtctctctgggatcattttctttctcaattttctctttagtcaccctcatatcctcccaagcttttagatatcatcagtatgctgacatgtctcaaataggtaccatgatggttttgttactattttttatcttagccattctgataggtgtgtagtaattatctcattatagtttgacttgcttttctcaaagtgctaatgatatt

SEQ ID NO: 87984 - DNA, 601 bp, Human
taatcctgcaactaccatgtgacccagcagttgcactcctgggcatttatcccagggaaatgaagacttgtatatcccagggaaatgaacaaatcaaatatttgttcatagcagctatatttgtaagattcccaacctggaaaaaacccagatgtctttcaacaggtgaatggttaaacggtggcacattcttaccctggaatacgatttagcaataaaaggaaggagttgttgatatatgcaacaccttgggtgaatctcaaaagaattatactgagtgggaagggccaacccccaaagrctgcatactgtatgattctatatataacattcttgaaataacactatataaatggagaacagattagtgtttgtcaggagttagggatgggagacaagaagtcagggattaggaattgggggtttggggtagctgtggttataaaaggacaatagaagggatcattgtggtgatggaactgctctgtatctttgccatggtggcagatacattaatctatacaggcagtgcaattacataaatcaaatacacacacacctgcatgaacttacacatatatacagacaagtggagaaatct

SEQ ID NO: 87985 - DNA, 601 bp, Human
ctgctctgtatctttgccatggtggcagatacattaatctatacaggcagtgcaattacataaatcaaatacacacacacctgcatgaacttacacatatatacagacaagtggagaaatctgaataagattgatagactgtatcaatctcatattctggctgtaatattgtaccatagttttacaaggtattattgctgggggaaactggataaagggtacttagatctctacgttatttctttcaacttcatatgaatctacaattataagaaaatttaaagtttaatttatagaaaasgcaattttagatttgaaataaaattcctacattaactgaaaaattaattaaatataaatttaaaatcaaaattaaaaaccctttgacaactttagatctctctctcttacacacacacgcacacacacacatacatctaagctttattgtctttgctctactaacagttcagctccctgtaattcagtttctatccccacctctccacttacaccacacttctgaacatcaccagtgacctctttgatgtttaatacacttaagactcttcagtccttatcattcttgagctcttgcagc

SEQ ID NO: 87986 - DNA, 601 bp, Human
tgctctgtatctttgccatggtggcagatacattaatctatacaggcagtgcaattacataaatcaaatacacacacacctgcatgaacttacacatatatacagacaagtggagaaatctgaataagattgatagactgtatcaatctcatattctggctgtaatattgtaccatagttttacaaggtattattgctgggggaaactggataaagggtacttagatctctacgttatttctttcaacttcatatgaatctacaattataagaaaatttaaagtttaatttatagaaaagrcaattttagatttgaaataaaattcctacattaactgaaaaattaattaaatataaatttaaaatcaaaattaaaaaccctttgacaactttagatctctctctcttacacacacacgcacacacacacatacatctaagctttattgtctttgctctactaacagttcagctccctgtaattcagtttctatccccacctctccacttacaccacacttctgaacatcaccagtgacctctttgatgtttaatacacttaagactcttcagtccttatcattcttgagctcttgcagca

SEQ ID NO: 87987 - DNA, 601 bp, Human
actccatccctgtagaccttgctgttcctcccagtctgtggccactaacctcagttatttttactgaatgtgttacctcatccatagtgagtcttttgttgttgttgggttttttttttagcaacaatgtattttttaattaaggtatgtacattgttattttagacataatgctattgcacacttaatagactaccatatagtgtaaacataacctttactgcactgggaaaccaaaaaaataagtgtgacacactttattcaatagtcactttattgcaatgttctggaacccttttttttgttgttgttgttgaacggttattataacatgtctgatttagaggaaagtacactgaactgaaaatcaggaaagctgggcccagggggctggccttgagcagctgactaagcctgtacatttaattcaaaaagagctactcaggttattcccttaatcggtcttatactttatgacagtaagcacttacctcgttctgtcacatggtgtggccagattatgcatgtactatgattcaaaacattcacgtaaataaatcttcctaacatacaagaattatgtgtctgtggtgctttccag

SEQ ID NO: 87988 - DNA, 601 bp, Human
actgaaaatcaggaaagctgggcccagggggctggccttgagcagctgactaagcctgtacatttaattcaaaaagagctactcaggttattcccttaatcggtcttatactttatgacagtaagcacttacctcgttctgtcacatggtgtggccagattatgcatgtactatgattcaaaacattcacgtaaataaatcttcctaacatacaagaattatgtgtctgtggtgctttccagcttttgatgtgcttgcaaacccattttctcatttaatcctcacaaagttggaaaccagmtcacttacttattcatgtttacaggaataatcaacattgatgccaataattttgattatatattttaaaaatctcatgaaattggttttaaaagaatcatttattagacaaaaagagtgaacctatcaacaggcaattcacagaagagaaaataaaaataacaaatgaaccaatgaaatgatgttcaaattatttaaagaaatacagtttaaaatattattttttcattctcagaccagccggcatttataagttcaatgcttggtattggcaaaagtatgggaagcatgtactcacatg

SEQ ID NO: 87989 - DNA, 601 bp, Human
ctgaaaatcaggaaagctgggcccagggggctggccttgagcagctgactaagcctgtacatttaattcaaaaagagctactcaggttattcccttaatcggtcttatactttatgacagtaagcacttacctcgttctgtcacatggtgtggccagattatgcatgtactatgattcaaaacattcacgtaaataaatcttcctaacatacaagaattatgtgtctgtggtgctttccagcttttgatgtgcttgcaaacccattttctcatttaatcctcacaaagttggaaaccagcgcacttacttattcatgtttacaggaataatcaacattgatgccaataattttgattatatattttaaaaatctcatgaaattggttttaaaagaatcatttattagacaaaaagagtgaacctatcaacaggcaattcacagaagagaaaataaaaataacaaatgaaccaatgaaatgatgttcaaattatttaaagaaatacagtttaaaatattattttttcattctcagaccagccggcatttataagttcaatgcttggtattggcaaaagtatgggaagcatgtactcacatgg

SEQ ID NO: 87990 - DNA, 601 bp, Human
gctgggcccagggggctggccttgagcagctgactaagcctgtacatttaattcaaaaagagctactcaggttattcccttaatcggtcttatactttatgacagtaagcacttacctcgttctgtcacatggtgtggccagattatgcatgtactatgattcaaaacattcacgtaaataaatcttcctaacatacaagaattatgtgtctgtggtgctttccagcttttgatgtgcttgcaaacccattttctcatttaatcctcacaaagttggaaaccagctcacttacttattcaygtttacaggaataatcaacattgatgccaataattttgattatatattttaaaaatctcatgaaattggttttaaaagaatcatttattagacaaaaagagtgaacctatcaacaggcaattcacagaagagaaaataaaaataacaaatgaaccaatgaaatgatgttcaaattatttaaagaaatacagtttaaaatattattttttcattctcagaccagccggcatttataagttcaatgcttggtattggcaaaagtatgggaagcatgtactcacatgggcttgtgataggagt

SEQ ID NO: 87991 - DNA, 601 bp, Human
ttgagcagctgactaagcctgtacatttaattcaaaaagagctactcaggttattcccttaatcggtcttatactttatgacagtaagcacttacctcgttctgtcacatggtgtggccagattatgcatgtactatgattcaaaacattcacgtaaataaatcttcctaacatacaagaattatgtgtctgtggtgctttccagcttttgatgtgcttgcaaacccattttctcatttaatcctcacaaagttggaaaccagctcacttacttattcatgtttacaggaataatcaacawtgatgccaataattttgattatatattttaaaaatctcatgaaattggttttaaaagaatcatttattagacaaaaagagtgaacctatcaacaggcaattcacagaagagaaaataaaaataacaaatgaaccaatgaaatgatgttcaaattatttaaagaaatacagtttaaaatattattttttcattctcagaccagccggcatttataagttcaatgcttggtattggcaaaagtatgggaagcatgtactcacatgggcttgtgataggagtacaaattaatacaaccttttc

SEQ ID NO: 87992 - DNA, 601 bp, Human
ccaataattttgattatatattttaaaaatctcatgaaattggttttaaaagaatcatttattagacaaaaagagtgaacctatcaacaggcaattcacagaagagaaaataaaaataacaaatgaaccaatgaaatgatgttcaaattatttaaagaaatacagtttaaaatattattttttcattctcagaccagccggcatttataagttcaatgcttggtattggcaaaagtatgggaagcatgtactcacatgggcttgtgataggagtacaaattaatacaaccttttcgaaacraaatttagcactatctttcaaaattttaggtgtgcactatttttgaccctgcaactcgatttcagacagtaggcgtatttgcataaaggcacagtggtattctgtttcagaatacacattgcaacatttttatgatagaataaaaggactagtaaaataaagtacagcaactgcatgcaataataacatggaggctatcagaaaaataagacaaatctatatatgctaattaaagacaccttaaaaactattttaggaaaaaacaaggtacaaaataggacataaaggatctgatttgtg

SEQ ID NO: 87993 - DNA, 601 bp, Human
gaaccaatgaaatgatgttcaaattatttaaagaaatacagtttaaaatattattttttcattctcagaccagccggcatttataagttcaatgcttggtattggcaaaagtatgggaagcatgtactcacatgggcttgtgataggagtacaaattaatacaaccttttcgaaacaaaatttagcactatctttcaaaattttaggtgtgcactatttttgaccctgcaactcgatttcagacagtaggcgtatttgcataaaggcacagtggtattctgtttcagaatacacattgcarcatttttatgatagaataaaaggactagtaaaataaagtacagcaactgcatgcaataataacatggaggctatcagaaaaataagacaaatctatatatgctaattaaagacaccttaaaaactattttaggaaaaaacaaggtacaaaataggacataaaggatctgatttgtgtttgaagaaaaatttcaaacatgagtgtttatatgtgaatgtgtgtgtggtgtgtgcgtgtgtgtgtgtgtacatgcttatacaggcatgtataagcaatctgatacatgcctgtataagtatt

SEQ ID NO: 87994 - DNA, 601 bp, Human
tcaatgcttggtattggcaaaagtatgggaagcatgtactcacatgggcttgtgataggagtacaaattaatacaaccttttcgaaacaaaatttagcactatctttcaaaattttaggtgtgcactatttttgaccctgcaactcgatttcagacagtaggcgtatttgcataaaggcacagtggtattctgtttcagaatacacattgcaacatttttatgatagaataaaaggactagtaaaataaagtacagcaactgcatgcaataataacatggaggctatcagaaaaataagamaaatctatatatgctaattaaagacaccttaaaaactattttaggaaaaaacaaggtacaaaataggacataaaggatctgatttgtgtttgaagaaaaatttcaaacatgagtgtttatatgtgaatgtgtgtgtggtgtgtgcgtgtgtgtgtgtgtacatgcttatacaggcatgtataagcaatctgatacatgcctgtataagtattacccaatcttttagtgattatctctggaaaagagttttacttttcattctctacccttctatgacagttgaatttttgaatttttaaa

SEQ ID NO: 87995 - DNA, 601 bp, Human
aaggtacaaaataggacataaaggatctgatttgtgtttgaagaaaaatttcaaacatgagtgtttatatgtgaatgtgtgtgtggtgtgtgcgtgtgtgtgtgtgtacatgcttatacaggcatgtataagcaatctgatacatgcctgtataagtattacccaatcttttagtgattatctctggaaaagagttttacttttcattctctacccttctatgacagttgaatttttgaatttttaaatgaataaatgtgtgtgtgttgtgtatttttaaagttaacatacagactgagckcagtggctcacgcctgtaatcctagaactttgggaggcgaatcacctgaggtcaggagttcaagactagcctggccaacatggtgaaacccttgtctctactaaaaatacaaaaattagtcgggtgtggtggcgggcacctgtaatcccagctactcgggaggctgaggcaggagagtcgcttgaaccaggaggtggaggttgcagtgagccaagatcatgccactgcactccagcctgggcgacagagtgagactctgtctccaaaaaaaaaaaatgttagcatatagcgtagaattca

SEQ ID NO: 87996 - DNA, 601 bp, Human
aatctgatacatgcctgtataagtattacccaatcttttagtgattatctctggaaaagagttttacttttcattctctacccttctatgacagttgaatttttgaatttttaaatgaataaatgtgtgtgtgttgtgtatttttaaagttaacatacagactgagcgcagtggctcacgcctgtaatcctagaactttgggaggcgaatcacctgaggtcaggagttcaagactagcctggccaacatggtgaaacccttgtctctactaaaaatacaaaaattagtcgggtgtggtggygggcacctgtaatcccagctactcgggaggctgaggcaggagagtcgcttgaaccaggaggtggaggttgcagtgagccaagatcatgccactgcactccagcctgggcgacagagtgagactctgtctccaaaaaaaaaaaatgttagcatatagcgtagaattcagcttttcttattctaggtagcgatggtgcttttcactgctttgcccaacttaattgacccaagtagaaaagtcttcaaaaaaaaaaaaacgctttagaaaaacactttagacactttagatttatgtgacttc

SEQ ID NO: 87997 - DNA, 601 bp, Human
tgtgtgtgttgtgtatttttaaagttaacatacagactgagcgcagtggctcacgcctgtaatcctagaactttgggaggcgaatcacctgaggtcaggagttcaagactagcctggccaacatggtgaaacccttgtctctactaaaaatacaaaaattagtcgggtgtggtggcgggcacctgtaatcccagctactcgggaggctgaggcaggagagtcgcttgaaccaggaggtggaggttgcagtgagccaagatcatgccactgcactccagcctgggcgacagagtgagactcygtctccaaaaaaaaaaaatgttagcatatagcgtagaattcagcttttcttattctaggtagcgatggtgcttttcactgctttgcccaacttaattgacccaagtagaaaagtcttcaaaaaaaaaaaaacgctttagaaaaacactttagacactttagatttatgtgacttcaaaagtcaaaaatggtaataatcctgcttaggcagaagccttgccctcagtcccaaaacatgatggacaagcgggtgacttacctgtggcttttcttgtatcttgcagtctgtcagcaatcatga

SEQ ID NO: 87998 - DNA, 601 bp, Human
ccagcctgggcgacagagtgagactctgtctccaaaaaaaaaaaatgttagcatatagcgtagaattcagcttttcttattctaggtagcgatggtgcttttcactgctttgcccaacttaattgacccaagtagaaaagtcttcaaaaaaaaaaaaacgctttagaaaaacactttagacactttagatttatgtgacttcaaaagtcaaaaatggtaataatcctgcttaggcagaagccttgccctcagtcccaaaacatgatggacaagcgggtgacttacctgtggcttttcttgyatcttgcagtctgtcagcaatcatgaaatgtaggcctcagagtggaagggcccctagagaccatccattgcctctcaggagcatggtcattctgcagatcaaggtcctgctctgggagaaatgggtgcacactcactctgcgttctgtccagcccttctgccacctacatttctatgcttttctcttactgctaaatagcttcctaaaggaaaagtgaatggtctttgtgaattcaaacctcattctgttgcttccctatttaaaactcttcaatgagtccctcttcccaatgctctgtc

SEQ ID NO: 87999 - DNA, 601 bp, Human
acacatagtagatgctctattagtgttggaatggatgagctctagtgagtaagcgcctaagacaacacagaccctaaggtcttctgaacccaaccaagtgccctgtttttgctgctataccaggctgtccttcttcccactgccatcctcctggttctgttctctcagcccaagcaccgtgtgtagcctaatcatgtatatctattctcagagtttgtaggacaggatacgagttaacgacttaacgcccttcaagattttgtgtaacagggaaaggagagaacacctggaatggttcccrcttggagaaacgtttttcatccttcttagtttcagctccaatcagatggattcagcctgtgacagtcaacatttacagcccttgggagcagctccatactcacctcctttgcctgcttaccgcaagctcactgcctcctcctcagattgtgccagacataccaggtttgctgccggtgagaagcaacaatccaaatcctacctttctgttcaggtcccagtaaaatcttcactggcagcattttagaattgccccttccctcttctctcaaagggctgctgttcagctggcaggaccagc

SEQ ID NO: 88000 - DNA, 601 bp, Human
tgctctattagtgttggaatggatgagctctagtgagtaagcgcctaagacaacacagaccctaaggtcttctgaacccaaccaagtgccctgtttttgctgctataccaggctgtccttcttcccactgccatcctcctggttctgttctctcagcccaagcaccgtgtgtagcctaatcatgtatatctattctcagagtttgtaggacaggatacgagttaacgacttaacgcccttcaagattttgtgtaacagggaaaggagagaacacctggaatggttcccgcttggagaaacrtttttcatccttcttagtttcagctccaatcagatggattcagcctgtgacagtcaacatttacagcccttgggagcagctccatactcacctcctttgcctgcttaccgcaagctcactgcctcctcctcagattgtgccagacataccaggtttgctgccggtgagaagcaacaatccaaatcctacctttctgttcaggtcccagtaaaatcttcactggcagcattttagaattgccccttccctcttctctcaaagggctgctgttcagctggcaggaccagcttctctgatgca

SEQ ID NO: 88001 - DNA, 601 bp, Human
ggtgggcaccggtccacatcacaggaagcccagctgtggtggctgtcagtgtcagaggggctggcagacagtagtagaggcccagagaagttactttgtacgtatcagtctagaaggaagagattatgaagattagtcaagcctccctttctcatttatcctttttttttttttttgagatgaagtcttgctttgtctcccagcctggagtgcagtggcacgatctctgttcccgcaacctatgcctcctgagctcaagcgattctcctgcctcagcctcattagtagctgggattataascacccaccaccacgcccagctaatttttgtatttttagcagagatggcgttttgtcatgttggagagactggtcttgaactcctgacctcaggtgatcctcccacctcagcctcccaaactgctgggattacaagcatgagccaccatgcccggccactttctcattatactgatagcaaaattgagacccacatcagcgatctaacctgtcatttcaatgatgtcctgacataagagtaagcggccagcctgccctttaagtaaagcctactcatatgggagtatatgtgctttattaa

SEQ ID NO: 88002 - DNA, 601 bp, Human
gctggcagacagtagtagaggcccagagaagttactttgtacgtatcagtctagaaggaagagattatgaagattagtcaagcctccctttctcatttatcctttttttttttttttgagatgaagtcttgctttgtctcccagcctggagtgcagtggcacgatctctgttcccgcaacctatgcctcctgagctcaagcgattctcctgcctcagcctcattagtagctgggattataagcacccaccaccacgcccagctaatttttgtatttttagcagagatggcgttttgtcatrttggagagactggtcttgaactcctgacctcaggtgatcctcccacctcagcctcccaaactgctgggattacaagcatgagccaccatgcccggccactttctcattatactgatagcaaaattgagacccacatcagcgatctaacctgtcatttcaatgatgtcctgacataagagtaagcggccagcctgccctttaagtaaagcctactcatatgggagtatatgtgctttattaattagcagaagggtatccaggccttcttggaagctgtcttctctctgtatgggtaaatgg

SEQ ID NO: 88003 - DNA, 601 bp, Human
gtcaagcctccctttctcatttatcctttttttttttttttgagatgaagtcttgctttgtctcccagcctggagtgcagtggcacgatctctgttcccgcaacctatgcctcctgagctcaagcgattctcctgcctcagcctcattagtagctgggattataagcacccaccaccacgcccagctaatttttgtatttttagcagagatggcgttttgtcatgttggagagactggtcttgaactcctgacctcaggtgatcctcccacctcagcctcccaaactgctgggattacaarcatgagccaccatgcccggccactttctcattatactgatagcaaaattgagacccacatcagcgatctaacctgtcatttcaatgatgtcctgacataagagtaagcggccagcctgccctttaagtaaagcctactcatatgggagtatatgtgctttattaattagcagaagggtatccaggccttcttggaagctgtcttctctctgtatgggtaaatgggcaacttttctagccttccgtctaattgggtttaatatcagtgaaagaatctttaagaaggtgtgcccttaggtgc

SEQ ID NO: 88004 - DNA, 601 bp, Human
acatggataatttgtattgacagttgatagttacatagaggtatatctcactggttctcaactctagctgcattttagaatcaccaggagaattttctttttcgattctgatgcctaaatctctgccctagaacaataaaatcagaatctctaaaagtgaggcccagacatgggcagttttgttattatttatcattgtttaataataaatattacgtaaaagtcagacttttaatggctcatttgtagggaggagaacttgccatttcccaaagtatcaccagcataaaaggtgaatttktattttgttctctaagtttctggcatattctgaaactgcaatttaagtgactctcctacctctgtcttactcccaatttatatttagctggattcatattagagggcaagaaggggcaaatagaaaaaaagtgatctttatcaaacccatttccttgtgttagaaaaacgatttgttggaaaaagccatcgaggagatttgagattcagcacaaaaaagaattcgatatcacctaatacaagctgagaagggctacctcagggggtccttgtgcacctcactaaggaaggtctttggcag

SEQ ID NO: 88005 - DNA, 601 bp, Human
atcattgtttaataataaatattacgtaaaagtcagacttttaatggctcatttgtagggaggagaacttgccatttcccaaagtatcaccagcataaaaggtgaatttgtattttgttctctaagtttctggcatattctgaaactgcaatttaagtgactctcctacctctgtcttactcccaatttatatttagctggattcatattagagggcaagaaggggcaaatagaaaaaaagtgatctttatcaaacccatttccttgtgttagaaaaacgatttgttggaaaaagccatcraggagatttgagattcagcacaaaaaagaattcgatatcacctaatacaagctgagaagggctacctcagggggtccttgtgcacctcactaaggaaggtctttggcagaggcagagaccatgacaaaggttttttttttctttattggacaagagccagaaaaaaatggccccaagattatgctcagccccgggaacctacagaaaccatggagcagtaggaatgggtagctagccgtgttagaagtaaatttgaggccgggtgcggaggctcatgcctgtaatcccagcactttggga

SEQ ID NO: 88006 - DNA, 601 bp, Human
cgggaacctacagaaaccatggagcagtaggaatgggtagctagccgtgttagaagtaaatttgaggccgggtgcggaggctcatgcctgtaatcccagcactttgggatgccaaggcaggaggatcacgaggtcaggagatcaagaccaacctggccaacacggtgaaaccccgtctctactaaaatacaaaaattagctggacgttgtggtgtgtgcctgtagtcccagctactcaggaggctgaggcaggagaattgcttgaacccgggaggtggaggttgcagtgagctgagatcaygccactgtactgcagcctggcgacagagcaaaactccgtctcaaaaacaaaacaaaaacaaaaacaaaagaagtaaatttgattaatgaaatctacctttatgtttttacccaaagtgttatcaggaaagataacgttaaaaaatacacgtgattttcttaatgtcttagtttgagcaagtaattctaactgctctagcaaacacatttttaaatctcagggatttaacacaatgcaagtttatttttgtctgacaaaaatcccccatgtttagccagtgcattccacgtgggattcaga

SEQ ID NO: 88007 - DNA, 601 bp, Human
aacctggccaacacggtgaaaccccgtctctactaaaatacaaaaattagctggacgttgtggtgtgtgcctgtagtcccagctactcaggaggctgaggcaggagaattgcttgaacccgggaggtggaggttgcagtgagctgagatcatgccactgtactgcagcctggcgacagagcaaaactccgtctcaaaaacaaaacaaaaacaaaaacaaaagaagtaaatttgattaatgaaatctacctttatgtttttacccaaagtgttatcaggaaagataacgttaaaaaatacaygtgattttcttaatgtcttagtttgagcaagtaattctaactgctctagcaaacacatttttaaatctcagggatttaacacaatgcaagtttatttttgtctgacaaaaatcccccatgtttagccagtgcattccacgtgggattcagagactctgtcttattccatccagtggttccaccagtctctaaagcctagaggtcctatgccagattatgtgaattaaaattagaagagagtattaaggatcttctgggacagtggtgggatggttacagtttccagactcataaatgtaa

SEQ ID NO: 88008 - DNA, 601 bp, Human
ccactttatatccttcatacatttgtatgtctgtgttgacattgaatgtttgcatgacatataaaatataagtagtaatgacaaatttaatagtgaatacttacagtagtgcatttcatcctatgaaacgggcaatctggcccattctatataataggggagaaaatagaaacttagatttactaattagttcaagttggcacagatataaggggatctcagacttcaactcaggcagtcaggcagggcctatactcttgatattcctttcttgatactttctcagtatcaaattaccacrtaatagacaatgccactcataaatctagcccactctaggaacataataaggcctgttgagacattcagagatgtctccctgatcttcaaagatgaatttttattcttccctaagctgctgtctcttcagtctcaacatcctaagttcattttatctttcctcacaggtcaggttttcagctctaactgtgttcatcctggtggctctgccctggacatactgcagttcttttatgtacctcttatcgtatggggtacaatggctttcggtactgctcagtgaggggagagaaatagatag

SEQ ID NO: 88009 - DNA, 601 bp, Human
gtctgagggcattctcttgaatgcttagttctgtgttacttaggatccattcatagagcatattatttatattatgtgaggtttaactcttcattataactcatggaatcaatgatagaaatgcaggttatttatactgtcagtcccaagtatgtaatattaaaccaccaaaattcagtttaagaaacttgcaataagctaccacttggctcaaagcaaggaattaggatggtcaggttgaactttctttatatataaagaactgagtctctgaaaaaggaaaaagacttttaaatgacayccagtgaatgtctttttaaaaaataatagctttaatggctgggcacggtggctcacgcctgtaatcccaggacttcgtgaggccgaggtgggtggatcacctgaggtcaggtgttctagaccagcctggccaacatggtgaaaccccgtcactactaaaaatacaaaaattagctgggtgtggtggcaggtgcctgtaatctcatctactcaggggggctgaggcaggagaatcacttgaacccgggaggtggaagttgcagtgagctgagattgcaccaccgcactccagacctgggga

SEQ ID NO: 88010 - DNA, 601 bp, Human
gagggcattctcttgaatgcttagttctgtgttacttaggatccattcatagagcatattatttatattatgtgaggtttaactcttcattataactcatggaatcaatgatagaaatgcaggttatttatactgtcagtcccaagtatgtaatattaaaccaccaaaattcagtttaagaaacttgcaataagctaccacttggctcaaagcaaggaattaggatggtcaggttgaactttctttatatataaagaactgagtctctgaaaaaggaaaaagacttttaaatgacatccartgaatgtctttttaaaaaataatagctttaatggctgggcacggtggctcacgcctgtaatcccaggacttcgtgaggccgaggtgggtggatcacctgaggtcaggtgttctagaccagcctggccaacatggtgaaaccccgtcactactaaaaatacaaaaattagctgggtgtggtggcaggtgcctgtaatctcatctactcaggggggctgaggcaggagaatcacttgaacccgggaggtggaagttgcagtgagctgagattgcaccaccgcactccagacctggggaacaa

SEQ ID NO: 88011 - DNA, 601 bp, Human
ttctttatatataaagaactgagtctctgaaaaaggaaaaagacttttaaatgacatccagtgaatgtctttttaaaaaataatagctttaatggctgggcacggtggctcacgcctgtaatcccaggacttcgtgaggccgaggtgggtggatcacctgaggtcaggtgttctagaccagcctggccaacatggtgaaaccccgtcactactaaaaatacaaaaattagctgggtgtggtggcaggtgcctgtaatctcatctactcaggggggctgaggcaggagaatcacttgaaccygggaggtggaagttgcagtgagctgagattgcaccaccgcactccagacctggggaacaagagcgagactttgtctcaaaagaaaaaaaaaagctttaaaatatatattgcatatggataaatttacatatcataaaagtatacttggctaagttctcaaaagtaaacacacttttataatccccaccctaaaaaagaaggaacattagcagttaattacttcagaagttttcttcatgacaacctggttgtatgcctttcttttttcctaaaagtgatcactatcctgacttataataa

SEQ ID NO: 88012 - DNA, 601 bp, Human
accgcactccagacctggggaacaagagcgagactttgtctcaaaagaaaaaaaaaagctttaaaatatatattgcatatggataaatttacatatcataaaagtatacttggctaagttctcaaaagtaaacacacttttataatccccaccctaaaaaagaaggaacattagcagttaattacttcagaagttttcttcatgacaacctggttgtatgcctttcttttttcctaaaagtgatcactatcctgacttataataatactatatattagattaaaatacttttgttgtataygctttttttttttttttttgagacagggtctcactctattattcaggctagagtgtagtggcacaatctcagctcattccaacctccgcctccagggttcaagcaaatcttgtgcttcaaccacacaagtagctgggattacaggcttgcaccaccacagagagcaatttttaaaattttgactagagatggagttttgccctgttggccaggctggtcttgaactcctggcctcatgtgatccacctgccttggctaggattacaggcattagccactatgctcaacttgttgtatatg

SEQ ID NO: 88013 - DNA, 601 bp, Human
agttctcaaaagtaaacacacttttataatccccaccctaaaaaagaaggaacattagcagttaattacttcagaagttttcttcatgacaacctggttgtatgcctttcttttttcctaaaagtgatcactatcctgacttataataatactatatattagattaaaatacttttgttgtatatgctttttttttttttttttgagacagggtctcactctattattcaggctagagtgtagtggcacaatctcagctcattccaacctccgcctccagggttcaagcaaatcttgtgcytcaaccacacaagtagctgggattacaggcttgcaccaccacagagagcaatttttaaaattttgactagagatggagttttgccctgttggccaggctggtcttgaactcctggcctcatgtgatccacctgccttggctaggattacaggcattagccactatgctcaacttgttgtatatgcttttatgcagttttcttttgttctgttatgttcatgaggttcttctaacattttaaatatggccatagtttatcttcttctagaagctttaataattttaggtgttacttttagg

SEQ ID NO: 88014 - DNA, 601 bp, Human
actcctggcctcatgtgatccacctgccttggctaggattacaggcattagccactatgctcaacttgttgtatatgcttttatgcagttttcttttgttctgttatgttcatgaggttcttctaacattttaaatatggccatagtttatcttcttctagaagctttaataattttaggtgttacttttaggtgttttattgttttgagttaatttttatataaggtgatcaaattttgagtaaaggtatttttccccccatagggatgtccaattgttccagcaccatttgttgtaatytaattaatcttatgcagattgtaaatcagatgcatgttacagaccatataaaccatagatgggtctatttctggattctctattctgttccatcagtctgttaatatatgtctgtccattctccagttcacacactgtgtgggcaattatcattttgcagcaaatctagaaatcaggtagtacggtttgttctgctctttcaaaattgtttggctgttctagttagttcacctttgcatataaattttaaaattcgtttgtcagtttttacaaaaatccttctggggttttgattagaat

SEQ ID NO: 88015 - DNA, 601 bp, Human
gatttaatttgccagtagtttgttgaggatttttgcatttgtgtcatgaggtatactaaactgtggttttcttttttggtaatatatttgactagatttgttatcagtgcagtgctggcctcataaaaggaattgatgagttccttcctctcttatattctggaagaatttgtatggaattggtattattatttaaatgtttggtacagtttgccagtgaagccatctggacctggaattttctttgttagaaggctttaatctacaaattttattcttgttaattgacagtttgcatctgttagaaaattggtccatttaatctcattttaatgtctgtaagtactgtggtattgtttccctctcattcatgatatttataattaatgtcttatttcttttttttcttcttggtaagtctgaatagagtttgttgtgatttttttttcacaaaagaattagcttttggtttcactgagattttctctattggttttctgctctcaattatattgacttctgctctttattattttactacttttgcttggcttgggttaagtttgctcttctctttctatttccctaaagttaaagattc

SEQ ID NO: 88016 - DNA, 601 bp, Human
actgtggttttcttttttggtaatatatttgactagatttgttatcagtgcagtgctggcctcataaaaggaattgatgagttccttcctctcttatattctggaagaatttgtatggaattggtattattatttaaatgtttggtacagtttgccagtgaagccatctggacctggaattttctttgttagaaggctttaatctacaaattttattcttgttaattgacagtttgcatctcttagaaaattggtccatttaatctcattttaatgtctgtaagtactgtggtattgtttccctctcattcatgatatttataattaatgtcttatttcttttttttcttcttggtaagtctgaatagagtttgttgtgatttttttttcacaaaagaattagcttttggtttcactgagattttctctattggttttctgctctcaattatattgacttctgctctttattattttactacttttgcttggcttgggttaagtttgctcttctctttctatttccctaaagttaaagattcagttgttgagttgagatcttttgtttttttctaatatgaacatccaatttcaaagtact

SEQ ID NO: 88017 - DNA, 601 bp, Human
tgtggttttcttttttggtaatatatttgactagatttgttatcagtgcagtgctggcctcataaaaggaattgatgagttccttcctctcttatattctggaagaatttgtatggaattggtattattatttaaatgtttggtacagtttgccagtgaagccatctggacctggaattttctttgttagaaggctttaatctacaaattttattcttgttaattgacagtttgcatctcttagaaaattggtccatttaatctcattttaatgtctgtaagtactgtggtattgtttccttctcattcatgatatttataattaatgtcttatttcttttttttcttcttggtaagtctgaatagagtttgttgtgatttttttttcacaaaagaattagcttttggtttcactgagattttctctattggttttctgctctcaattatattgacttctgctctttattattttactacttttgcttggcttgggttaagtttgctcttctctttctatttccctaaagttaaagattcagttgttgagttgagatcttttgtttttttctaatatgaacatccaatttcaaagtactgc

SEQ ID NO: 88018 - DNA, 601 bp, Human
ttcttggtaagtctgaatagagtttgttgtgatttttttttcacaaaagaattagcttttggtttcactgagattttctctattggttttctgctctcaattatattgacttctgctctttattattttactacttttgcttggcttgggttaagtttgctcttctctttctatttccctaaagttaaagattcagttgttgagttgagatcttttgtttttttctaatatgaacatccaatttcaaagtactgcttaagttgcattctacaaattttgatatattgtgttttcattttcrttcaagatattttctaatgtatctagtaatttttttgacgcatggtttatttagaaatgtgttatttaatttttaaatatttggatattttttctaggcctttctgttattgtcttttagtttatttccttgtgatctgtgaacatgttttgtgtaacttaaattcatctaaatttgttgaggtttgttttatgtgctagaaatatggtatatcttggttaatgctctgcacatttcaaaaatatgtgtattctgctattattaggtgaagtgttctatagttgtcaattaggttaattt

SEQ ID NO: 88019 - DNA, 601 bp, Human
tgttatatcatcttaaccccatattcaattccttccttattacataatatgattctttaactctgaaaatattcttgttctgaattttagataatattaatttaactttcttttattagtttacaaagtatttttccagccttttgtttttagtctatcaatgtctatataattgaagtagcttgcttttagacagatacgtctttcattttatccaatttgaccatctgtattttaatttgtgtgtttacactatttacatttgatgtgattattgatatagttggattgaaattcacartcagcttttgttacttttccatctgctatatttttctcttcctgcctttctttgaattaaatgtttttcacaattccatctcatttacactatttgtttattatttatactcttgattttaatgttagtattaccctttgatttgcaatatacacctttaattaactagagtttaccttcaaatactattatatcactgtctgagtagtttcaggaccttacaattgttactctcaatttacttaccatcttttcgtgttcttgttgtcattcattttacttatatatattctataaata

SEQ ID NO: 88020 - DNA, 601 bp, Human
tacttaccatcttttcgtgttcttgttgtcattcattttacttatatatattctataaatacacagcacattgatactaattttgctttagaatgttatcttttagagcaattaaaaataatgagaaagctaattcatttctgctttttcagcactttatttttttgtataaatccacctttgtgtctgataccgtattccttctgcttgaagagctcccttcaatatttcttcaattctgtcctgaaacagtttttaattctccttcatttgaaaactatttttaccaagtagagaattrgttggcctttttccttttatcacttttaagatgtcacttcattgttttctcacttgcatagtttctgacaagaagtctgctgtcaatgtctttcttgctttcaatgcagtatgaatttttgttttctgactgatctcaaacttttatcctttgtctcttttctaacagcttgaagctatgtttattagggtttttagttttagttttctggttttagttttagtgtttgtatatatcctgtttgtcagtcccttaatttcttggctcttctatcttcagttggttgtttattctttagaa

SEQ ID NO: 88021 - DNA, 601 bp, Human
acttaccatcttttcgtgttcttgttgtcattcattttacttatatatattctataaatacacagcacattgatactaattttgctttagaatgttatcttttagagcaattaaaaataatgagaaagctaattcatttctgctttttcagcactttatttttttgtataaatccacctttgtgtctgataccgtattccttctgcttgaagagctcccttcaatatttcttcaattctgtcctgaaacagtttttaattctccttcatttgaaaactatttttaccaagtagagaattgtttggcctttttccttttatcacttttaagatgtcacttcattgttttctcacttgcatagtttctgacaagaagtctgctgtcaatgtctttcttgctttcaatgcagtatgaatttttgttttctgactgatctcaaacttttatcctttgtctcttttctaacagcttgaagctatgtttattagggtttttagttttagttttctggttttagttttagtgtttgtatatatcctgtttgtcagtcccttaatttcttggctcttctatcttcagttggttgtttattctttagaag

SEQ ID NO: 88022 - DNA, 601 bp, Human
cactagagccttaaacattaatcatagttattttaaattccctatctgatcaatccaacatctgtcttatttctgagtctatttctgtttgttgctttgtctcttgacagtgtgttgttatttttacttcttggtatgccaggtaagtttttgttaaaagccagacatattatataggataataaagataggctaatatatttcacacctgtaaatgaacatgccttttcttttgttaggcctttagtgtggggtgtttgtgtcaatcttgtcagaagttggccttgatttgaattttttkttgttgttgttgctgtgattccccttagtgcaccacagatttcaaatatctctaatgttactttgtctttgtggtgaggagtggttttccaaaaggactttctcagtatttgctccaccctcagatttagatcttctttttgtgcctgtaccacagagacaacttctttttttgtctgtctcccaaattttgcactgttggtgggaatgtaaattagttttgtggttgaacttgattgctgttactttttacttgatgcttttgaggcagagggacattttctgctgttaccttcagttt

SEQ ID NO: 88023 - DNA, 601 bp, Human
agaagttggccttgatttgaattttttgttgttgttgttgctgtgattccccttagtgcaccacagatttcaaatatctctaatgttactttgtctttgtggtgaggagtggttttccaaaaggactttctcagtatttgctccaccctcagatttagatcttctttttgtgcctgtaccacagagacaacttctttttttgtctgtctcccaaattttgcactgttggtgggaatgtaaattagttttgtggttgaacttgattgctgttactttttacttgatgcttttgaggcagagrgacattttctgctgttaccttcagttttagagaggcagtgtggctgtgagtctccgaagcaggctgtttcagtgatcctgcctctccccgggactaaaatcacttcttattcttttcccctacctatgatgagttatcactggtgccctaagagccacaagactcactgttattttcctggggctgaagacctttattccaaagggacaatccgggagaagtatatgggcagggcattaagcctttcccagagctgctgctgttccgctcctgaagcctgcaccacaacagatactttat

SEQ ID NO: 88024 - DNA, 601 bp, Human
cttcttattcttttcccctacctatgatgagttatcactggtgccctaagagccacaagactcactgttattttcctggggctgaagacctttattccaaagggacaatccgggagaagtatatgggcagggcattaagcctttcccagagctgctgctgttccgctcctgaagcctgcaccacaacagatactttatcagtactcttttttgctttttattttattctattttactttaagttccaggatacatgtgcagaacatgcaggtttgttacacaggtatatgtgtgccctggyggtttgctgcacctatcaacccgttgtctagttttaagccccacatacattagctatttgtcctgatggtctccctccctttgcccccatcccccaacaggctcagatgtatgttgtgcttctccctgtgtccatgtgatctcattgttaaaactcccacttataagtgagaacatgcagtgtttggttttctgttcctgtgttagtttgctgaggatgatggcttccagcttcatccatgtcactgcaaaggacatgacctcattcctttttatggctgcatagtattccatggtgtac

SEQ ID NO: 88025 - DNA, 601 bp, Human
ttattctattttactttaagttccaggatacatgtgcagaacatgcaggtttgttacacaggtatatgtgtgccctggcggtttgctgcacctatcaacccgttgtctagttttaagccccacatacattagctatttgtcctgatggtctccctccctttgcccccatcccccaacaggctcagatgtatgttgtgcttctccctgtgtccatgtgatctcattgttaaaactcccacttataagtgagaacatgcagtgtttggttttctgttcctgtgttagtttgctgaggatgatrgcttccagcttcatccatgtcactgcaaaggacatgacctcattcctttttatggctgcatagtattccatggtgtacatgtaccacattttctttatccagtctattattgatggacatttgggttggttccatgtctttgctattgaaaaatagtgctgcagtaaacatacaggtacatgtgtctttatagtagaatgatttatattcctttggatatatatccagtaatgagattattggatcaaatggtatttctggttctagatccttgaggaatcaccacactgtcttccacaa

SEQ ID NO: 88026 - DNA, 601 bp, Human
tcatatcctttgcccactttttgataaagttgtttggttttttcttataaatttgttaagttcctctagattctggatgttagacgtttgtcagatggatagattgcaaaaattttctccctttctgtaggttgcctgttcactctgatgatagtttattttgctgtggagaagctctttagtttaattagatctcatttgtcaatgttagcttttgttgcagttgcttttggcattttcctcatgaaatctttgcccatgcctatgtcctgaatggtattgtgtaagttttcttctaggrcttttatggttttgggttttatatttaagtatttaatccatcttgaattaatttttgtgtaagatgtgaggaaggggtccagtttcagttttctgcatatggctagccagttttcccagcaccatttattaaataaggaaccctttccccattgcttgtttttgtcaggtttgttgaagatcagatggttgtagatgtgtggtgtaaattctgaggtctctgctctgttccattggtctatcagtactcttattctgcctcaggtctttcgtgtgagcatctgctgagatctgaggaaaa

SEQ ID NO: 88027 - DNA, 601 bp, Human
cttttattacaggatattgctataattgttctacgttattattagttattgctattaatcttttttgtgtctaatttataaattatactttatcataagtatgtatgtataggaaaaaacagtatgtataggggttaggttgtatccacagtttcagtatctactggtggtcttggaaggtatcttccacggataaaaggacactacggtagttggttgttctgcagcctcagttctctatggattcaaaaccagttttagatttgcacactgtctggcttgttttaaattattgtatggrtgggagtggtgctcctttcattttctccatcttgtacagaagccataattattttcaattctatataatttttgattgaatgaaaaataccataatttttttgttctattagtagacatttgaattatttatggttaggttcatgacaacaaggaatgcttctatgagcacatgtcttttggtgtacatatataaaatatttctcaagggtatagatgtaggaatggaattcattaattgtaggagaatacatacgacacacacacatgtatgagttatagggtatatatatatgtgcat

SEQ ID NO: 88028 - DNA, 601 bp, Human
cgttcctcctggtctgttcctaggtcaaggttgagtacgtttatagatattctataaatatattttattttcaacattaagtgtagttcatatagttgatgatctaagcaataagaaataaagtaaaatctggataattttggttactctgcttttcctctgtgtgtttcaactacaaaattcctcactacaatgctccccaattccttttattggtgcttgcagtgccagtgggcaaactgaattcttcatgcaaccaaagaattccaaaaacgtatttcttgcagctagcataaatctscagttccacaatggtagcagtggtggattttacccaatgttttaatgatgaatgtaatcagaacataaaaagatctaaatgcatactttgaaggaatttgcaaaaatgactagaagaactgaaaaaagcacaattcagtttgtttctttagcatctgtgtttatctttccccttctcttgtgcatattgaggatgttttaaagattatatttttaaaaccaaataaatagtttccaaaatgttcactgatggggtaaattagcgttctctttgtagatgtaattattaaataaattcaaa

SEQ ID NO: 88029 - DNA, 601 bp, Human
ccaatgttttaatgatgaatgtaatcagaacataaaaagatctaaatgcatactttgaaggaatttgcaaaaatgactagaagaactgaaaaaagcacaattcagtttgtttctttagcatctgtgtttatctttccccttctcttgtgcatattgaggatgttttaaagattatatttttaaaaccaaataaatagtttccaaaatgttcactgatggggtaaattagcgttctctttgtagatgtaattattaaataaattcaaaggactaaccctagaatgacatttttccctcattyctgggtaatttttgagatttcccctcatgcccaggagctaattatactctctcactctccctctctctctctctctctctcgctgcagctttctgtatgtgtgtgtgtgtattatatctaagaaattttactccaaacatctaacattctgggtacgggtttgatttggggaaaaaattacacttttttttttatcctttagcttttctccttaaaaagtatcagtgagggcagggaaagggaaggagaatggacccaaactaataaaaggattgatcagtgattatgaacaaaatatag

SEQ ID NO: 88030 - DNA, 601 bp, Human
actgaaattcagacttttctgctagctcttagaaaacaaaagcaatgtgtgattcatgtgtcacccactgtgggaagttggatgttgcattgcatttgtctctcagtcttaaaagtcaatatggcaaagtcattagcggcagagcccagaagatatccctgcccatgagctgtggagatctggacaagttactttacccaactccaagactcagtgaatgctcttatccgtaaaatggggacaatgataatatgtcttcctccctttgggtatttgatgattaaatgagaaaacacgtcamacagtcaattcagtgcttcgcgcacaataaaagcttaataaatactagttatgattatgtttagccaacatgtgttggcatctgacactaaataaatacttgtccaatggaaatgaccagaatttagtgcccctaacacttcactgtagtatttgccatatggataagcaatctttattatgctatttggatttagttccaaagctaaccccacctccttatattgaagccagctcctaggccacctggataacttttctggcatttcaatgaacacaccaatacaatacaagcataatt

SEQ ID NO: 88031 - DNA, 601 bp, Human
ctagctcttagaaaacaaaagcaatgtgtgattcatgtgtcacccactgtgggaagttggatgttgcattgcatttgtctctcagtcttaaaagtcaatatggcaaagtcattagcggcagagcccagaagatatccctgcccatgagctgtggagatctggacaagttactttacccaactccaagactcagtgaatgctcttatccgtaaaatggggacaatgataatatgtcttcctccctttgggtatttgatgattaaatgagaaaacacgtcacacagtcaattcagtgcttcgygcacaataaaagcttaataaatactagttatgattatgtttagccaacatgtgttggcatctgacactaaataaatacttgtccaatggaaatgaccagaatttagtgcccctaacacttcactgtagtatttgccatatggataagcaatctttattatgctatttggatttagttccaaagctaaccccacctccttatattgaagccagctcctaggccacctggataacttttctggcatttcaatgaacacaccaatacaatacaagcataattagactttctggattttagatc

SEQ ID NO: 88032 - DNA, 601 bp, Human
aggttacatagtgtctgtgacttcagctacacatggataatccacaagactctggacttattttcactgttgtgtaatagggttagttttgtttttagcagattctcccaaggaagtgtggtaatcacatttctcaaaccattacattaactgctgttagcaataaattattgcttatgtgctaaaagtcaaaaaaagcttttcccctttggaacttctttactatactccctgatatgttttgctgtcctagaaactggtgtttgtgtgtgtgtgtttgtgtgtgtatgtgtgtgtgtgygtgttcaattgagtcaagaacagaggagaggagactcaggctgaaaatgtcaagttattttgagtcaaatatttgtacatttactttggaagttatcactaaaaaacaaaaagtgtgtgtctctttgtgtctgtatctgtgtgaatctgtgtgcactcattggtataaaaggaggaatactcttctcaaaagtacacaccaatgttcttgtccaaaagcctactttcatatatgtgaatgtgaattcctacattctgtgtgtttgcttctcctcactatagcccatttctaacatatccc

SEQ ID NO: 88033 - DNA, 601 bp, Human
tttgagtcaaatatttgtacatttactttggaagttatcactaaaaaacaaaaagtgtgtgtctctttgtgtctgtatctgtgtgaatctgtgtgcactcattggtataaaaggaggaatactcttctcaaaagtacacaccaatgttcttgtccaaaagcctactttcatatatgtgaatgtgaattcctacattctgtgtgtttgcttctcctcactatagcccatttctaacatatcccaacttaatttcctaaatctgtcctatctacataccacaaagtgcttaactgagaaattracttctgtgttacagataaatggaagttagattaaaaggataatacattttcatttttagtgttcttaaataatcctttttattgtaaataaatataacgttaactccgataagtccagactacttcactgagttcaccaccgaaatgttttcacaaaatcagcatcgttataccttggcttttataagaagttagtatacgaaacttgtataggaaaatgtctctgtattatctatgaaactgttaataaatatgttttccatcatgtccatgtcatcgtttacatatacgagatgatt

SEQ ID NO: 88034 - DNA, 601 bp, Human
gtttgttgaatggaagaagcaggcacaatcacagctttcccttctggtgatctgctttatgatacaatttccaggaatgcattgtgtctaaaattggggaccatatgtacaggaaattctttcttatgtcagtgtgaaatccctccaaagtaaatccccctttatggttttttattggtgtttattcttttttaatacagaaaactgtaaactttttattagggcaggtttttttgtgcaaaagccttgtcatgggctagatgacatttcttttcctgtagagatacttggacattttacrattcaattacttccttccaaaagccatatttagaattccagccaatctgtgagccagaaaggagtgagccagtataataatcaaggtaatgtggcaagaaggtgtgaaatttcttagcctttctagaagagatgggtgaaaataaatgttttcagggtcagtaaataactttcccctagtagccagacagaaagcatcttactttgctcaagctggacctttgtcatttgaaggatctcctcctaatgccatctaagcttgagaggttcatatggctgcagcatggtttatcttgctgtt

SEQ ID NO: 88035 - DNA, 601 bp, Human
tgagaatcatgctgcttttatggattagcagaaattcatcttacgtgaccaagagcagctgcataatggctagaaaacatttgccctttctgcttatgttttggttatcccaacacattctatgtgcaatgtctgagtttgaaagttctttttaaactataaaatcatttcccaaagttaggactgattatgaatatcatcaatgattgtttttaaatgtcattatggtaaagtcatagaatagtgaccatctgtgctgcctttgtctttgtataggtgcagtagtcccagcctttctttctctctctctctctctctctctctgtgtgtgtgtgtgtgtgtgtgtgtgtgtgtgtgtgtgtaggatcactggagtatggtggtgaagaaagctgtcacagcacagaagttcagaaggaggtactgtgaaggtcccaaagcattgagcttagctagttctgaaagcactaaggttaactagtcaactcgagagttgggtgtatatactgctaaggaagggttcaacccagggggctcttgctctcccaagacaggaaacatgtatctgaagtgtgaatctattgctattatcctcagtttg

SEQ ID NO: 88036 - DNA, 601 bp, Human
agaatcatgctgcttttatggattagcagaaattcatcttacgtgaccaagagcagctgcataatggctagaaaacatttgccctttctgcttatgttttggttatcccaacacattctatgtgcaatgtctgagtttgaaagttctttttaaactataaaatcatttcccaaagttaggactgattatgaatatcatcaatgattgtttttaaatgtcattatggtaaagtcatagaatagtgaccatctgtgctgcctttgtctttgtataggtgcagtagtcccagcctttctttctctctctctctctctctctctctgtgtgtgtgtgtgtgtgtgtgtgtgtgtgtgtgtgtgtaggatcactggagtatggtggtgaagaaagctgtcacagcacagaagttcagaaggaggtactgtgaaggtcccaaagcattgagcttagctagttctgaaagcactaaggttaactagtcaactcgagagttgggtgtatatactgctaaggaagggttcaacccagggggctcttgctctcccaagacaggaaacatgtatctgaagtgtgaatctattgctattatcctcagtttggc

SEQ ID NO: 88037 - DNA, 601 bp, Human
ttagcagaaattcatcttacgtgaccaagagcagctgcataatggctagaaaacatttgccctttctgcttatgttttggttatcccaacacattctatgtgcaatgtctgagtttgaaagttctttttaaactataaaatcatttcccaaagttaggactgattatgaatatcatcaatgattgtttttaaatgtcattatggtaaagtcatagaatagtgaccatctgtgctgcctttgtctttgtataggtgcagtagtcccagcctttctttctctctctctctctctctctctctstgtgtgtgtgtgtgtgtgtgtgtgtgtgtgtgtgtgtaggatcactggagtatggtggtgaagaaagctgtcacagcacagaagttcagaaggaggtactgtgaaggtcccaaagcattgagcttagctagttctgaaagcactaaggttaactagtcaactcgagagttgggtgtatatactgctaaggaagggttcaacccagggggctcttgctctcccaagacaggaaacatgtatctgaagtgtgaatctattgctattatcctcagtttggcaggcgacagggttctgagagtg

SEQ ID NO: 88038 - DNA, 601 bp, Human
agcagaaattcatcttacgtgaccaagagcagctgcataatggctagaaaacatttgccctttctgcttatgttttggttatcccaacacattctatgtgcaatgtctgagtttgaaagttctttttaaactataaaatcatttcccaaagttaggactgattatgaatatcatcaatgattgtttttaaatgtcattatggtaaagtcatagaatagtgaccatctgtgctgcctttgtctttgtataggtgcagtagtcccagcctttctttctctctctctctctctctctctctgtstgtgtgtgtgtgtgtgtgtgtgtgtgtgtgtgtgtaggatcactggagtatggtggtgaagaaagctgtcacagcacagaagttcagaaggaggtactgtgaaggtcccaaagcattgagcttagctagttctgaaagcactaaggttaactagtcaactcgagagttgggtgtatatactgctaaggaagggttcaacccagggggctcttgctctcccaagacaggaaacatgtatctgaagtgtgaatctattgctattatcctcagtttggcaggcgacagggttctgagagtgag

SEQ ID NO: 88039 - DNA, 601 bp, Human
tcctgttatcctcgtgtcgattcttgccccattagctttcagcagtaaatagttgagggtctcatctggaaagttctattattagtaccacatggtcagtacattttaagatagacattttaataggcagaaaactgtatacaaggagagatgtgcaatgcagaataactatcaaatgatatctagatatcttagattgctactctaggccatccatggtcttaccccatgggttcctctaactcccttcatcctcccttaacattagctgtaggttttctcatcactgtctttgctcacsttattttctctgccttgaattccctccctcaagctccccacaccagcaccaccagcatgtaccctgttctttaagactcaactcaaatacctctgcctcaaaaacatattgccctaattgtcctggctgaaagtgacagtcatctctggaccccccccactctcatctctgcacctctctatgtcatccttaatcactttctgacttgtgttcttacatagttgaatatgccttatctctactacttgatattaaacttcataatgataataagatcctatcttatcttctcctgtctct

SEQ ID NO: 88040 - DNA, 601 bp, Human
ccttaatcactttctgacttgtgttcttacatagttgaatatgccttatctctactacttgatattaaacttcataatgataataagatcctatcttatcttctcctgtctcttccctgatcaggcctagggtagttcctcccacactgtactgttaagagaatacataatgaaaaagtaaatgaataaatggcagaaaccttatgtggaatgctggtgcaaacagttcctttgactgggggcttttaaaaagagactgattgtataggagatctgagcaattttcatattaatggaatgrattattagagctggcatgaacatcaaaagaatctagccacaaccacctctcaggtcatcttcattttcaaatggggaatctaagatttagataggaccattccagatcacatagtgagtgattaatagacctaggactcatacctcatctgacatccaacaccacatgttcttttgaaataaggctggaataatagtgagacacacatattagacacatgattgtgagaagacagttttccaccccacagcacatgaccccatacgtttaagtccctgcctatacaaatagtacagacaa

SEQ ID NO: 88041 - DNA, 601 bp, Human
cagaccagcgtggacaacacagtgaagccccatctcattaaaaaaaaaaaaaagatatattaagaaacttttgaaagtataaatcatctaaatcatcatgtataaatgtaagagatatgaaataagctctgtgaaaatataatggctgatggcgtccctgtgtgaaagatagaaatggacattttatgtaatttccatacacaccaaacaaaacaaaagatctttagaatttccaagcatgagtgaggttttacattgattgtaaagaatatagaatgcggaaactcatttttaattattraaacttataggctgaaaaaaagagtaagcactatttaaaaaaaaaaaaaaaaggctcaaccaggcgcggtggctctgtaatcccagccctttgggaggctgaggcgggcagatcacgaggtcaggagatcaagaccatcctggctaacacggtgaaacctcgtctctactaaaaaagtacaaaaaattagccaggtgtggtggcacgtgactgtagtcccagttactcggaggctgaggcaggagaatcgcttgaacctgggaggcagaggttgcagtgagccaagattgcaccactgca

SEQ ID NO: 88042 - DNA, 601 bp, Human
ttacattgattgtaaagaatatagaatgcggaaactcatttttaattattaaaacttataggctgaaaaaaagagtaagcactatttaaaaaaaaaaaaaaaaggctcaaccaggcgcggtggctctgtaatcccagccctttgggaggctgaggcgggcagatcacgaggtcaggagatcaagaccatcctggctaacacggtgaaacctcgtctctactaaaaaagtacaaaaaattagccaggtgtggtggcacgtgactgtagtcccagttactcggaggctgaggcaggagaatcrcttgaacctgggaggcagaggttgcagtgagccaagattgcaccactgcactccagcctgggcaacagagtgaaactccgtctcaaaaaacaaaaaaaaaaatgcttccccacacccacccccaacgaacgaacaaacacacttaggaaatagggaagaaggttatgttttgggacaactttctatacactgagaaaatccaagaggtctccacatctacctataaaattcagtgatgctcagagctgacatgtcaatttttcctattacatagtaagaagctcagcattatgggccgag

SEQ ID NO: 88043 - DNA, 601 bp, Human
aaccctgcaggcctggccacccaggctctttccggtgttccatgtacactgcatagattgagtggacacccaggttaaagagatctctcagtactcttggattttcctttaccttaattttgaaattataatattttagacataacttgtgcaggatcacacagtgagtctataggagaactggatgagaacccaagttttctgactttcaatcagctctctctccctacatgtaccttaacatgtatcataaagatgactgttgccatatgggctaagccctccattttctgagtatgcwttaccacctccttccctcagaacaattaacagaggatctcataaagatgtgctatatatgtgtcccatagattttaatgagacttcagtaggtgggaaggtgtagtatttattctgggatattggaagagcaagttggataggaccttaaattttctacatagatacttgtggaggacaggctctagggtgacttccaatgacccctgcctcctggtgtttacatctctgtgtaatacctctccttgagtgcaggtgaatctgtaacttgcttctaatcaatagaagaaggcaaaggtgt

SEQ ID NO: 88044 - DNA, 601 bp, Human
accctgcaggcctggccacccaggctctttccggtgttccatgtacactgcatagattgagtggacacccaggttaaagagatctctcagtactcttggattttcctttaccttaattttgaaattataatattttagacataacttgtgcaggatcacacagtgagtctataggagaactggatgagaacccaagttttctgactttcaatcagctctctctccctacatgtaccttaacatgtatcataaagatgactgttgccatatgggctaagccctccattttctgagtatgcawtaccacctccttccctcagaacaattaacagaggatctcataaagatgtgctatatatgtgtcccatagattttaatgagacttcagtaggtgggaaggtgtagtatttattctgggatattggaagagcaagttggataggaccttaaattttctacatagatacttgtggaggacaggctctagggtgacttccaatgacccctgcctcctggtgtttacatctctgtgtaatacctctccttgagtgcaggtgaatctgtaacttgcttctaatcaatagaagaaggcaaaggtgtt

SEQ ID NO: 88045 - DNA, 601 bp, Human
tttgtttctttttgggtggttttttttttttttttttttttggtgtgttttgtttgatcttggttttggttttccaatctaggcctgaggtccagtgctaatttgatgctagtgtgaactctctgagcctggttccttgacgttccattgggtgactattgcagtggttcagatgtggtgctaccagccttccccaccaaggaagttgcctgctttctcatctttgatcctcttcaccaactaaccacaacacaccagtgaaaattttaatttctccattcagttcctcagtttccgccascaggtggtgagttcctgcgatacagataacctttttgtcttgttcagtacaacctcagtgcctagcacaaggccttgcagaaagctgacattccttaactctttatttctgaaatgaattaatgttcttaggttccatgtctcgtggaccaaataatgcaatcctagatcttgccatagcatctgggacaccacgtatgatgatttaggtaatcagtgaaaatccatgtcagcagctgccaatttacagatgaattatgtccaatggtttggagatgaatgagttttacagttcatagag

SEQ ID NO: 88046 - DNA, 601 bp, Human
gaagttgcctgctttctcatctttgatcctcttcaccaactaaccacaacacaccagtgaaaattttaatttctccattcagttcctcagtttccgccaccaggtggtgagttcctgcgatacagataacctttttgtcttgttcagtacaacctcagtgcctagcacaaggccttgcagaaagctgacattccttaactctttatttctgaaatgaattaatgttcttaggttccatgtctcgtggaccaaataatgcaatcctagatcttgccatagcatctgggacaccacgtatgakgatttaggtaatcagtgaaaatccatgtcagcagctgccaatttacagatgaattatgtccaatggtttggagatgaatgagttttacagttcatagagcatgacaaaattcatcttagccttccattttatagatgagctaactgatctctgagagaggaacgacctctgaatgtcctgggaagagcttgtggcagaagtaacttctacctagtagtgtattttccttactgcctgttctcatttgataacagacccatatatcaattatttgcatccttcaattaacccacaagaagg

SEQ ID NO: 88047 - DNA, 601 bp, Human
tgcaatcctagatcttgccatagcatctgggacaccacgtatgatgatttaggtaatcagtgaaaatccatgtcagcagctgccaatttacagatgaattatgtccaatggtttggagatgaatgagttttacagttcatagagcatgacaaaattcatcttagccttccattttatagatgagctaactgatctctgagagaggaacgacctctgaatgtcctgggaagagcttgtggcagaagtaacttctacctagtagtgtattttccttactgcctgttctcatttgataacagayccatatatcaattatttgcatccttcaattaacccacaagaaggcaaatttaatccagtgttagataaaataattattcacagggtcataacactattaaagaataagctatggccaggcgcggtggctcactcctgtaatcctagcattttggaggccgaggggggcagatcacttgaggtcaggagttctagactaccctagccaatatggtgaaaactgtctctactaaaaatacaaaaaaaaaaaaaaaatcagctgggcatggtggcagacgcctgtaatcccagctactcagga

SEQ ID NO: 88048 - DNA, 601 bp, Human
gcatggtggcagacgcctgtaatcccagctactcaggagctgtagtcctagcattttgggaggctgaggcgggcggatcacttgactaccctggccaacatggtgaaacctcatcctactaaaaatacaaaaaaaaaaaaaatcagctggtggtggtggcagatgcctgtaatcctagctactcgggaggcggaggcaggagaatcactcgaacccgggaggtggaggttacagtgagccaaaattgcaccattgcactccagcctaggtgacagagtgaggctccatctccaaaaaaaawaaaaagaatacactatgaggcagtgagatatagggcaagactcatgttaggactgccacagagcagtcagtagtggcaacaagaaaggaacgcccctacgatgtgacaagtctctaccttgatatcaatggaattatgaatgggcagagaggctgtgcccattcttacctaacagggaagctgtccataaataaggtagcaattcctgaatcaaggacaagccttctgcccagtctttatatgtaaagaaacagtagtttcatttgaagggaaaccattataattgtctcagatgtgcat

SEQ ID NO: 88049 - DNA, 601 bp, Human
gatgcctgtaatcctagctactcgggaggcggaggcaggagaatcactcgaacccgggaggtggaggttacagtgagccaaaattgcaccattgcactccagcctaggtgacagagtgaggctccatctccaaaaaaaataaaaagaatacactatgaggcagtgagatatagggcaagactcatgttaggactgccacagagcagtcagtagtggcaacaagaaaggaacgcccctacgatgtgacaagtctctaccttgatatcaatggaattatgaatgggcagagaggctgtgcccrttcttacctaacagggaagctgtccataaataaggtagcaattcctgaatcaaggacaagccttctgcccagtctttatatgtaaagaaacagtagtttcatttgaagggaaaccattataattgtctcagatgtgcatcttgttccagggtacttctttgtatttttgatgaggaaccaaaggctttattatagatcttgtgaatacctgtcagccaggatttagaacaaatgcatttgggcaattttgccttttatttcagataaattttatatgttgtttctgtccagaattgtagg

SEQ ID NO: 88050 - DNA, 601 bp, Human
aactgcaggaaatgtttattttacttttctttaaagaagaagacagtaatgaaaaatgtatcgactgccagcccactgtttttatttctctttgtgtgagctatggcttctccacatcttgagccttaaactctttgatgttgtctttttaagcataacataaaagattattccctttagtctgtaggcttggaggtgggcaaacatgacatattcctgggtattcatatttctataacaataattgatgcaggttttggggctgttgtatttgccgtagccttatatgataaacatttgkcattccatgacgtttcagctttgtcaactttccaatcctgtatggagttccctcttattgtttctgtgtgaacaacttgacaagagtggcatccgtggtcagattcttcactctatccctgcaggacttttcattgtgctctgcacacgatggaggctcaatgcatgaatgaatgcatggatgaatttttcagtttgattccgtgagctgcttaattctattagatgcgctccctaggcttttataagacgtttaattggtacatgtttcttatcactttttaatactccataagtgttt

SEQ ID NO: 88051 - DNA, 601 bp, Human
ctggttctagggataaagaagagccagagaagaaatctgggcttcccagcagcaccttgggaggccgaggcaggcagatcacaaggtcaggagttcgagaccagcctggccaatatggtgaaacctgtctctactaaaaatacaaaaattagccaggtgtggtggctggcgcctgtggtcccagctactcgggaggctgaggcaggagaattgcttgaacctgggaggtggaagttgcagtgagctgagattgcgccactggactccatcctgggtgacagaatgagactccatctcaaatataataataataataataataataataataataataataatctgtgcttcctgcttaatttctagttttggtattcctactatcaggcccaacctctgtcctttgtgttcacagctaaatttgatttgcgtttggtcagaggatgggagaacagagaacaatagtcaccctcatcagcaactgagaaattcagtctgttctgccaaccttgcttgtatcttttcatataaatcttgaaattgcctctatttcaagtctgatggtcagtgactaattattaaagccattacttgctttttt

SEQ ID NO: 88052 - DNA, 601 bp, Human
tggttctagggataaagaagagccagagaagaaatctgggcttcccagcagcaccttgggaggccgaggcaggcagatcacaaggtcaggagttcgagaccagcctggccaatatggtgaaacctgtctctactaaaaatacaaaaattagccaggtgtggtggctggcgcctgtggtcccagctactcgggaggctgaggcaggagaattgcttgaacctgggaggtggaagttgcagtgagctgagattgcgccactggactccatcctgggtgacagaatgagactccatctcaaacttaataataataataataataataataataataataataatctgtgcttcctgcttaatttctagttttggtattcctactatcaggcccaacctctgtcctttgtgttcacagctaaatttgatttgcgtttggtcagaggatgggagaacagagaacaatagtcaccctcatcagcaactgagaaattcagtctgttctgccaaccttgcttgtatcttttcatataaatcttgaaattgcctctatttcaagtctgatggtcagtgactaattattaaagccattacttgcttttttt

SEQ ID NO: 88053 - DNA, 601 bp, Human
gttctagggataaagaagagccagagaagaaatctgggcttcccagcagcaccttgggaggccgaggcaggcagatcacaaggtcaggagttcgagaccagcctggccaatatggtgaaacctgtctctactaaaaatacaaaaattagccaggtgtggtggctggcgcctgtggtcccagctactcgggaggctgaggcaggagaattgcttgaacctgggaggtggaagttgcagtgagctgagattgcgccactggactccatcctgggtgacagaatgagactccatctcaaacatmataataataataataataataataataataataataatctgtgcttcctgcttaatttctagttttggtattcctactatcaggcccaacctctgtcctttgtgttcacagctaaatttgatttgcgtttggtcagaggatgggagaacagagaacaatagtcaccctcatcagcaactgagaaattcagtctgttctgccaaccttgcttgtatcttttcatataaatcttgaaattgcctctatttcaagtctgatggtcagtgactaattattaaagccattacttgctttttttaa

SEQ ID NO: 88054 - DNA, 601 bp, Human
gaaacctgtctctactaaaaatacaaaaattagccaggtgtggtggctggcgcctgtggtcccagctactcgggaggctgaggcaggagaattgcttgaacctgggaggtggaagttgcagtgagctgagattgcgccactggactccatcctgggtgacagaatgagactccatctcaaacataataataataataataataataataataataataataatctgtgcttcctgcttaatttctagttttggtattcctactatcaggcccaacctctgtcctttgtgttcacagctaartttgatttgcgtttggtcagaggatgggagaacagagaacaatagtcaccctcatcagcaactgagaaattcagtctgttctgccaaccttgcttgtatcttttcatataaatcttgaaattgcctctatttcaagtctgatggtcagtgactaattattaaagccattacttgctttttttaaagcctgaaccttgctttccagaatcttttccacctttgagattattttaaatatcatcattactttgagaaaagcaaacttaacaaggatgccttaagaaatataaaggtgtcatt

SEQ ID NO: 88055 - DNA, 601 bp, Human
taataataataataataatctgtgcttcctgcttaatttctagttttggtattcctactatcaggcccaacctctgtcctttgtgttcacagctaaatttgatttgcgtttggtcagaggatgggagaacagagaacaatagtcaccctcatcagcaactgagaaattcagtctgttctgccaaccttgcttgtatcttttcatataaatcttgaaattgcctctatttcaagtctgatggtcagtgactaattattaaagccattacttgctttttttaaagcctgaaccttgctttccrgaatcttttccacctttgagattattttaaatatcatcattactttgagaaaagcaaacttaacaaggatgccttaagaaatataaaggtgtcattgcccaggaggcaagaaagggaggcagaatggtaatgaaatgagacagcccttgctttggttttataagatctgggtctgaatcctggcagtgtgttctttctaactttaggtaattcaggagccctagaaacctcatctctctatctagtgtgggaaaacgtgaaacaactttgggccatagattgctctatgcaaactcaaca

SEQ ID NO: 88056 - DNA, 601 bp, Human
tcctatccctagtcttgtttggttgggtagcttccaattaataacagcttcaaattctggctaatatttgtttagcacttcatggcttacaaagtacttcattattttaacattgtagtattggtaataatatcaaactttctgttattacaataaatgttccttttttactttattattccattactttattactgtttttcagatgtactgtgatctacattttacggatgaaaaaaagattctaggaggataagggactttgtcacaaaagttagcttctaaatgatggggggactcrtatgcaccttttgaaactcctaaacccatgttgattccccaaaggctttggtggtcctaaacatttgacataatcagagtctattataaaaaggtatggcttatccagctcctggttcctcactgtctcctctatctcaaaatattctagaaaaaactttactccctgaaaatatacagctttaggataggtgcagctccatttcatactctgattttcattcctcatttgaaaagttgaagcgtaatttcttataagactttagaagttgaagtcaggactggataaagaaaatgtggc

SEQ ID NO: 88057 - DNA, 601 bp, Human
ctgagggaggagaatcccttgaaccagggagtcggaggttgcagtgagccgagatcactccactgcactccagcctggcgacagagtgagactccgtctcaaaaataaaataaaattaaattaaattaaatttaaaaaagagtaagttgctcaactttttaaactttagttttattatccacaaataataaattataaattgctgctttacatatatgatataaaaatgcatcaatccagttaatttggggtaaatggtattattccagtcttacctcctagaatactcagaagacacaayggtgtatcactagaaggagatagttttgttttggtttggtttggtttcttcagtcttctttttcctattccttccttttccaagaaacccacgatttctttctttctttttccagctattgatgaggtcagggagtaatatgttcagatctttgttgtatctttgttccgtttagaaaccagtatctgggaattcaacagagaatttggggtcactggaagctatgttttacctacatacaactacatcttcctcttagacctagagactagatactgaaaatgcaaaaggaagccatat

SEQ ID NO: 88058 - DNA, 601 bp, Human
taagacactaaattctactcctgcctcttctagtctagttggtcacctgccctttctgaatttgtttttttttttttttttgagatggagtcacgctctgtcaccaagctggagtgcagtggcacgatctcggctcactgcaacctctgcctcccaggttcaagcgattctcctgcctcagcttcccaagtagctgggattacaggtgtgcaacaccacgcccagctaatttttgtattttcagtagagatggggtttcaccatcttggccaggatggtctctatctcttgactttgtgawccgcccaccttgggccactgcgcccagccctgaatttgttttcttaactacccatttatttgcttgaaacagatgacttaaaatattccttcctcctctgaagttgttctttaaacttttctatgtaagaaattgattgagctgtattcctaggtattttattctctttgtagcaattgtgaatgagagtttactcatgacttggctctccttttgtctattattgatgtataggaatgcttgtgatttttgcatattgattttgtacgctgagactttgctgaagttacccaccagctt

SEQ ID NO: 88059 - DNA, 601 bp, Human
actattaggaatggacctttgcttctcacagcagtcatttattcctccactttttctactagcgtcatgtgaagtgggaagggtactggcccgagagttaggagactcgagttcaagtggcagctctgcgctggcttggcagtgtaactggccactccatcaccaggacttaatttcttcatcagtaaaatgtttggtttggactgaacagtccctttttcatctctgacatcctacggtcccttaaaaatccctcctctgggctgggcgcggtggctcacgcctgtaatcccagcacttygggaggccgaggcgggcggatcacgaggtcaggagatcgagaccatcccggctaaaacggtgaaaccccgtctctactaaaaatacaaaaaattagccgggcgcagtggggggcgcctgtagtcccagctactcgggaggctgaggcaggagaatggcgtgaacccgggaggcggagcttgcagggagccgagatcgcgccactgcactccagcctgggcgacagagcaagactccgtctcaaaaaaaaaaaatccttcctctgggtacctcatctttttcagttgcccctgcagtccct

SEQ ID NO: 88060 - DNA, 601 bp, Human
ctcacagcagtcatttattcctccactttttctactagcgtcatgtgaagtgggaagggtactggcccgagagttaggagactcgagttcaagtggcagctctgcgctggcttggcagtgtaactggccactccatcaccaggacttaatttcttcatcagtaaaatgtttggtttggactgaacagtccctttttcatctctgacatcctacggtcccttaaaaatccctcctctgggctgggcgcggtggctcacgcctgtaatcccagcacttcgggaggccgaggcgggcggatcamgaggtcaggagatcgagaccatcccggctaaaacggtgaaaccccgtctctactaaaaatacaaaaaattagccgggcgcagtggggggcgcctgtagtcccagctactcgggaggctgaggcaggagaatggcgtgaacccgggaggcggagcttgcagggagccgagatcgcgccactgcactccagcctgggcgacagagcaagactccgtctcaaaaaaaaaaaatccttcctctgggtacctcatctttttcagttgcccctgcagtccctctctttagcatttctgtgaggaag

SEQ ID NO: 88061 - DNA, 601 bp, Human
cttcctctctcacactctacactttgcttttctagaattgaagcctggagaagaaatattgtctaaagagcttgctacaagaaaatttccctaaaaagtattgggtcttaaaatttcatctcattttcaagttcttagaatactgttaatttgcaaagctgattatggatggcatactttattatgctttttaatcatacttcaaaactgcactatggatttgttctttctgtcttcctcccatgcttaatcattatttttggtggcaccttctaaactgttgacttattttctttctttctgatttgtagtagatgttgtataatctaagtttaggcagagatagtgaaagtgctggcctgcctgtatttcagccagtcctgggttaatattattcatgtggcaatgtctgttttactttaggactcaacgtatttaatacttcctctcctcctctttacaatacatagaggaaaggcctttgaaacataatttctctccctatgggaaatgctttctataaatttttcattttcaatacaaactgcttcactttacaaaacagtatctgtccctagcatgaaaaaatactggagggata

SEQ ID NO: 88062 - DNA, 601 bp, Human
ctttcataaatctcctctggtatatatgctgtgtacccttgacaaggagaacactattaatggcgacagtatgcactggaactcagagcactgacgtgggaattgggagctctcaggtctgttgtttctgccagagaatgactctgtgaccttgggacaagtggattcacaaacaagctgaaggagatcatatctgtcctagaccgaaagcttatctgagaaagatgctacatgactacaaagaggttatttagtttcttagttcagataaggaaaacactaataattagtccaaacttcraggctttgtctttgtcttctaagcttgctttcccctgtgatgtccagtctctcctaaaccagataaggattcacactattaatctcgacaaaatcaattctttgcatttgtgcttttattaggtcagtcattagtcaatgaacacttattgcacgcctgctgtttgtgcagacactgtgctagtcaggggatgcaaaagatgagtccgtgctggtcccatttcaaagaactcaaaatatggtggagacaagcacgtatacaaaaccagaacacagtataatgaataccacaggagtatac

SEQ ID NO: 88063 - DNA, 601 bp, Human
atgcactggaactcagagcactgacgtgggaattgggagctctcaggtctgttgtttctgccagagaatgactctgtgaccttgggacaagtggattcacaaacaagctgaaggagatcatatctgtcctagaccgaaagcttatctgagaaagatgctacatgactacaaagaggttatttagtttcttagttcagataaggaaaacactaataattagtccaaacttcgaggctttgtctttgtcttctaagcttgctttcccctgtgatgtccagtctctcctaaaccagataaggaktcacactattaatctcgacaaaatcaattctttgcatttgtgcttttattaggtcagtcattagtcaatgaacacttattgcacgcctgctgtttgtgcagacactgtgctagtcaggggatgcaaaagatgagtccgtgctggtcccatttcaaagaactcaaaatatggtggagacaagcacgtatacaaaaccagaacacagtataatgaataccacaggagtatacccgcaaaagttatatgggtgaagaaagaaggattaattagttctgccagagaaggactaattcagggaag

SEQ ID NO: 88064 - DNA, 601 bp, Human
tgttatgtatgtacccattgtggggtgatacaggcagaataagctctgaatttgagacttgtgaaaaccataagagcctcgagtcttgtcttatgagtctccgggtagagctgaactggctgcagctccaatgagaggcaattgcttgagaactgtttccaccagcatactgcatggaatgggtccctctctgatgcagatcccactgatactgatgtcgcactcttgctgatgcagatcccactgatattcatgtcgcactcttgctgattttgatgggccagtcaatagcagggcagcgtgtcaagatgctggagcaaggaagtcctttgtactatttttctcactgctgtcttttccttatggcatgccattctgtcttagaaaatgtgagacctgaagtagacatttggcatcatctagtccaacctctttgatacacagatgtaaaaactgaggcacagaggaggggaagaactttgctcaaatcaaaaagtgtattaaggatggatgcagtggctcacgcctataatcccagcactttgggaggccgaggcggatggatcacaaggtcaagagatcaagaccatcctggccaaca

SEQ ID NO: 88065 - DNA, 601 bp, Human
gaataagctctgaatttgagacttgtgaaaaccataagagcctcgagtcttgtcttatgagtctccgggtagagctgaactggctgcagctccaatgagaggcaattgcttgagaactgtttccaccagcatactgcatggaatgggtccctctctgatgcagatcccactgatactgatgtcgcactcttgctgatgcagatcccactgatattcatgtcgcactcttgctgattttgatgggccagtcaatagcagggcagcgtgtcaagatgctggagcaaggaagtcctttgtactrtttttctcactgctgtcttttccttatggcatgccattctgtcttagaaaatgtgagacctgaagtagacatttggcatcatctagtccaacctctttgatacacagatgtaaaaactgaggcacagaggaggggaagaactttgctcaaatcaaaaagtgtattaaggatggatgcagtggctcacgcctataatcccagcactttgggaggccgaggcggatggatcacaaggtcaagagatcaagaccatcctggccaacatggtgaaaccccatctctactaaaagtacaaaaatt

SEQ ID NO: 88066 - DNA, 601 bp, Human
gtcttttccttatggcatgccattctgtcttagaaaatgtgagacctgaagtagacatttggcatcatctagtccaacctctttgatacacagatgtaaaaactgaggcacagaggaggggaagaactttgctcaaatcaaaaagtgtattaaggatggatgcagtggctcacgcctataatcccagcactttgggaggccgaggcggatggatcacaaggtcaagagatcaagaccatcctggccaacatggtgaaaccccatctctactaaaagtacaaaaattagccgggcatggtgrtgcacacctgtagtcccagctactcgggaggctgaggcaggagaatcgcttgagcctaggaggcggaggttgcagtgagctgagatctcaccactgcactccagtctgatgacagaacgagactctgtctcaaaaaaaaaaaaaagaaaataggttccgggtgttgcagcaagtaataatgattaaacattgtttaattaaataattaaacaatgcttgcttctctcccactgaaggaggtagaaggcacagcaccgtggtgagcgaggcccagctttctgctgtgttcctctgccatgc

SEQ ID NO: 88067 - DNA, 601 bp, Human
ggaagaactttgctcaaatcaaaaagtgtattaaggatggatgcagtggctcacgcctataatcccagcactttgggaggccgaggcggatggatcacaaggtcaagagatcaagaccatcctggccaacatggtgaaaccccatctctactaaaagtacaaaaattagccgggcatggtggtgcacacctgtagtcccagctactcgggaggctgaggcaggagaatcgcttgagcctaggaggcggaggttgcagtgagctgagatctcaccactgcactccagtctgatgacagaacragactctgtctcaaaaaaaaaaaaaagaaaataggttccgggtgttgcagcaagtaataatgattaaacattgtttaattaaataattaaacaatgcttgcttctctcccactgaaggaggtagaaggcacagcaccgtggtgagcgaggcccagctttctgctgtgttcctctgccatgcctagcatgtgaccactgtggagtgatgccagacggctgtgccattccagtgcactgaggacggagggacccttttcctctgaggacacatcatttcaccttaacccctttggccagaac

SEQ ID NO: 88068 - DNA, 601 bp, Human
accccatctctactaaaagtacaaaaattagccgggcatggtggtgcacacctgtagtcccagctactcgggaggctgaggcaggagaatcgcttgagcctaggaggcggaggttgcagtgagctgagatctcaccactgcactccagtctgatgacagaacgagactctgtctcaaaaaaaaaaaaaagaaaataggttccgggtgttgcagcaagtaataatgattaaacattgtttaattaaataattaaacaatgcttgcttctctcccactgaaggaggtagaaggcacagcaccrtggtgagcgaggcccagctttctgctgtgttcctctgccatgcctagcatgtgaccactgtggagtgatgccagacggctgtgccattccagtgcactgaggacggagggacccttttcctctgaggacacatcatttcaccttaacccctttggccagaacaaagttgcatagctgcaaggacgactgggaaatatatttattctgggcagccatgtacttagctacaatttggaggttctaaagaaagaaaggaagagaatggaaacaattttcaaggcctaccacagcaaattggtg

SEQ ID NO: 88069 - DNA, 601 bp, Human
ccacagcaaattggtgccatttctaggactagtatcctatttcctaactcctagtagaatgttttttctataccacagatttttaattctcataaagatgtgatttttaattaagaagcctataagaacattttgaatatgcacaaattcatcattttatatgtccatacgggatgcagtgattcccctttgcttaagatcaatttttgtttttattaatcccttgatatatagataggagtcaggcagacccaagtttaatttctgtctaccaacttgtgactttgggtccatatgaataaaaaaatctatgctttgattttgttttttcctctctaaaatagtaacaacatgtcatcttggggttgttttaaaaattaaatgggatgatattaatgaaagagcctagcccagtgtttagtattgaataggtagatatctaatggtacagataccagtttccttctttctcctcacttccttaggttccctccaacctgaagacaacgtatgtttctcatagataattacaaggaatttaaatccttgacaaaatgattttctggctatccatagcggacatgtctagatacatactctg

SEQ ID NO: 88070 - DNA, 601 bp, Human
caaggaatttaaatccttgacaaaatgattttctggctatccatagcggacatgtctagatacatactctgttcattttaaaagatgaggaggttctgacacaatcagagaactttttaaaagttatggatgcctgagccccagccccagagataatgattaaacaggcctagaggttgttagtttttgaatgaagtttttagtttttatctgcctgagtgagtctgatgtgctattgtgttttacacagatcaatatgatggtagaatgaaacagagaaaacggggaagctgagaggtcrcttaggcaggtattgtgattatctaagtgagagatgatagaacaatatggcaaaagatggaattaaaatatttagtgggcaaaattaataggacttgatacctgatgagatataggaaaaataaacttaatacatctttcaacactagcaaaactgtagctcttgaaatttatctgacctgaactaattggttcggggtaaaggagaggagaaattgtgatatgtgaaatatattaatatttagaaaattcttccaacattattaatatatagaaaattcttaattatctggaataatga

SEQ ID NO: 88071 - DNA, 601 bp, Human
acatgtctagatacatactctgttcattttaaaagatgaggaggttctgacacaatcagagaactttttaaaagttatggatgcctgagccccagccccagagataatgattaaacaggcctagaggttgttagtttttgaatgaagtttttagtttttatctgcctgagtgagtctgatgtgctattgtgttttacacagatcaatatgatggtagaatgaaacagagaaaacggggaagctgagaggtcacttaggcaggtattgtgattatctaagtgagagatgatagaacaatatrgcaaaagatggaattaaaatatttagtgggcaaaattaataggacttgatacctgatgagatataggaaaaataaacttaatacatctttcaacactagcaaaactgtagctcttgaaatttatctgacctgaactaattggttcggggtaaaggagaggagaaattgtgatatgtgaaatatattaatatttagaaaattcttccaacattattaatatatagaaaattcttaattatctggaataatgagccaaactcaacaagataaaatctaagagggtcaagtcaaatttcattc

SEQ ID NO: 88072 - DNA, 601 bp, Human
caaagaagcttttctatcatccccaggagtacaaagagagcccttccatgaccctagttgtttggctcagaccacttatagcttactgtaatttaggaagtaattgtaattcataaagccaggtagataataaacatcttggcagggttgagtttcaggcagctctgaagggaaccaacatgtgagtggaatggtattgggaacatttctagtctctgcttgcagatcttgattctaatggatgactcaaactggtttaattctgatctgaaatgtgcaggcaggcagtcattactctgtrtacacatagctgaaaacatcatcacttaagcatgggttttagacattctcctggatgagttagttacccatggtagacaaatactgtaagtaaaaagagcattctcctaatttctatgttgtgtgattaacttcagatcatttatattcctggagaaatatgtagcactattttttctttaaaagatatattcttgctgaggtagaataaagaacagaaaagttgtaagaggccttagattttaggttatttaatgtcatttaattttgtattcaaccaatacttactgattgcctgtta

SEQ ID NO: 88073 - DNA, 601 bp, Human
aatatttactgagctccttctctgtgccccaggcattgttctggaaactgagggtgatgctttgaacaagacaaagaaccatgccctattgaagcttttgttcagccctcaaatcactccatttcaagggaccaaaagccctattaacttaattcccttattttatagctgacggaatttaggcccagggaggaaatgctttgtacaaaactcactgctggtggctgacgttggcaagactggaatacagcccttgacttctgctttatttctccttgccactgagccatacagagtctckgtaaccatctatgtcagcaattctagtttagtgctggggttggttagcactgtgacccaaagataagtctttttctctatcaaggcctcatgtctactcttaataaaggtaacaaaattgagggttgttaagatggggcttcacaggcgtgggtaccaggggctttgttggaccttgattacggttaagtcaagaaaatggaccttgccaagtataactgccgcaaactagacagagaactgtatgagacttcttattggctcatagacttctctgtacacactctaaatgcatggtatg

SEQ ID NO: 88074 - DNA, 601 bp, Human
taattcccttattttatagctgacggaatttaggcccagggaggaaatgctttgtacaaaactcactgctggtggctgacgttggcaagactggaatacagcccttgacttctgctttatttctccttgccactgagccatacagagtctctgtaaccatctatgtcagcaattctagtttagtgctggggttggttagcactgtgacccaaagataagtctttttctctatcaaggcctcatgtctactcttaataaaggtaacaaaattgagggttgttaagatggggcttcacaggcktgggtaccaggggctttgttggaccttgattacggttaagtcaagaaaatggaccttgccaagtataactgccgcaaactagacagagaactgtatgagacttcttattggctcatagacttctctgtacacactctaaatgcatggtatgtaactactccatcacttgataggcattccaggtatgtaaactaaataagatacatggcaagaaaaattacctgctgaagacaaaacaacaaaaacaaaataatctgtatttttccaaactcaatattcaatattcaagggagtatgggt

SEQ ID NO: 88075 - DNA, 601 bp, Human
tggcaagaaaaattacctgctgaagacaaaacaacaaaaacaaaataatctgtatttttccaaactcaatattcaatattcaagggagtatgggtacttgtgtatatattttatacttgtctacttctctccagtaataagaatgatagaagttggctcagttgattagtcagaggctgttgaaccaagatgtagggtcgatccttctgtgtaacagtaattctctccagcgaaaagagctttataacaatatctttatatctatttacattcttaaacagtgcttctcccatttcttatmatatttaattctcattgttaagagattgttaaggcagaatacttagtatcccattctatagatgagaaaattgacacccatgtagcttatggaattttgttcaaggtgctgtgaattccagctactctggaaattcactgcctcaatgaaactggtctaaatgttggttaatagcctctatttataggttgctgatagtaggaattatgaaagctggacctaaggcttcctaatgtgaggctttggataggattatctgctctgagctcttagccagaaggcccccatatttatcagtgt

SEQ ID NO: 88076 - DNA, 601 bp, Human
cccaagtagtgtcacatactcagcttaacaatttttcattggctatgtaagtaattatgttaattttatcatattcttattgttaagtgggacagaacaccagggagatgtgttggtattcaaaaagggacctagtgtggggttgggagaagagcactgcatagaaaccatgccatctgcgtcctggactttttcacaaaatagtatatcacattgggcaaatataccacaataggcaaatcagcttcacaaaatgcagtgtcctagtatgtgaggtgagacagttggacaagatgattcrgggaatttttcaagctcaaccaaactatgtatttatgagaggctatgggaaatctgcatgctaaagattattaactgcattctgaataattgcctttatacagaataacggagaaagatatctgagaaacttgttaattggaggacagtgtgaagtagaagaatgagcctttctctttgtactttagaaaacacaggttcaaatcctggctgcatttatagctgtgtgtcatgtaatgcggaaaagaattctaccattctacctcctataccagattgctctggagattagacgggctcc

SEQ ID NO: 88077 - DNA, 601 bp, Human
tgttggtattcaaaaagggacctagtgtggggttgggagaagagcactgcatagaaaccatgccatctgcgtcctggactttttcacaaaatagtatatcacattgggcaaatataccacaataggcaaatcagcttcacaaaatgcagtgtcctagtatgtgaggtgagacagttggacaagatgattcggggaatttttcaagctcaaccaaactatgtatttatgagaggctatgggaaatctgcatgctaaagattattaactgcattctgaataattgcctttatacagaataacrgagaaagatatctgagaaacttgttaattggaggacagtgtgaagtagaagaatgagcctttctctttgtactttagaaaacacaggttcaaatcctggctgcatttatagctgtgtgtcatgtaatgcggaaaagaattctaccattctacctcctataccagattgctctggagattagacgggctcctgtttgtgtacatttagtaaactttaaggattgtaccaaatcaaagtatcagttattatttttggtgtataaaggaatataaattacttttatgaagaattaagaaatgt

SEQ ID NO: 88078 - DNA, 601 bp, Human
taaccctagtgcttaagaataaaaaacagggcgtaatttactttgtgaagaatgtgatttttagctcatggcaaaattgaatagaacggcctaattgctgtgatctttttgttctttctgttggctttttccttatggttttagggcatatttctcaattttaaagccagtttatgtagtccaaatacaaacagaaaattttataagaaaattgtttttctaaattttattttgatagtaacacataggttttgtctgtgctagttaaaacatggatgttcggccgggcgtggtggctcaygcttgtaatcccagcactttgggaggccgaggtgggcggatcacctgagctcacgagttcaagaccagcctggccaacatggtgaaaccctgtctctgctaaaaataaaaaattagctgggtgtggtggtgtgtgtcggtagtcccagctactcaagaggctgaggcaggagaatcgcttgaacctcggaggcagaggttgcagtgagccgagatcgcgccactgcactccagcctaggtgacagagtgagactctgtctttaaaaaaaaaaaaaaaaaaaaaaaaaggatgttcatgtc

SEQ ID NO: 88079 - DNA, 601 bp, Human
gtgatctttttgttctttctgttggctttttccttatggttttagggcatatttctcaattttaaagccagtttatgtagtccaaatacaaacagaaaattttataagaaaattgtttttctaaattttattttgatagtaacacataggttttgtctgtgctagttaaaacatggatgttcggccgggcgtggtggctcatgcttgtaatcccagcactttgggaggccgaggtgggcggatcacctgagctcacgagttcaagaccagcctggccaacatggtgaaaccctgtctctgytaaaaataaaaaattagctgggtgtggtggtgtgtgtcggtagtcccagctactcaagaggctgaggcaggagaatcgcttgaacctcggaggcagaggttgcagtgagccgagatcgcgccactgcactccagcctaggtgacagagtgagactctgtctttaaaaaaaaaaaaaaaaaaaaaaaaaggatgttcatgtctggcaatattgagttccccttcatcagtgctgctcaatacacagatttcgttacaatattcttcctgtgaaatgaatttgtttcagtgcaggcttatct

SEQ ID NO: 88080 - DNA, 601 bp, Human
cctcggaggcagaggttgcagtgagccgagatcgcgccactgcactccagcctaggtgacagagtgagactctgtctttaaaaaaaaaaaaaaaaaaaaaaaaaggatgttcatgtctggcaatattgagttccccttcatcagtgctgctcaatacacagatttcgttacaatattcttcctgtgaaatgaatttgtttcagtgcaggcttatctgcgactcctataagagtattagatattaaagactcttgttatagcacaacattaattccaaagtgggttaaaataagtttttttycaagtgccaaatccaatcccaactagaatagattcttaagagtcatagaccaccaccatactgcctgctctctcaccattcataagtaattactctcttctctgcgttcccatcattcattactcgtgcctcaatgatagcaatttgtcatgccctttgcctcgaatcagttgttaatagttgtgtccacctgtctcactgcattgagaacctttgagggcaaggatggcatctttatcttccatctcttcctctgtacctgccaggctgttgaacactttgttccattctttaggcttt

SEQ ID NO: 88081 - DNA, 601 bp, Human
taggctttctgcaatattagagtaagtgaggaggcagctctgctctttagagaggcatataagaagtttgtttaaagagagtttataagaaaactgaggcaatagatgcaaaaagttatgctccaaaagattaacaaaaaaagttgaaattatttcactgaattttcagttctgtgtttcatagctgtcatcttcaggggtaggggggtgtgtcatgacatcaaaaaagtacagtttagagatttgatgctatctattaaattgtttcaaaacgtttcctatctatcaggaaaactttcayctgtaaaagaggaattttgattctaattgaaaaatcacagtcataggggtgggatgctgttaagcttgagattattattttcagtctgtttcaaaacacacattacatgcagatacaaatatagacttagattaagatatagacaaaggacattagaaagaccaagagaaatgttaataaaaagttcatgtctcacaggaaggcagagctgttggaaggttatctagtatagggtcattagaactaccaaggtaaaatgatatcttcacttgcaaagcaaacccaaaagtactgccatca

SEQ ID NO: 88082 - DNA, 601 bp, Human
aggtagagaataagtttttattccataattaagttaggcaatagcagtattctgagttcagataatggcactggcatttcaagagaaattggctgagtcatagccctgctcctttactgtaccacattaccattctgttgggaacacctacacttgagctgtacttcccaacctttttcacatcccagttcatgtggaaaatgatggcattcattcagcacacggagtaagtggatgagatctctcctgtcctgttcctgaggcaaccgctcaggaactctggacacctctggtccttccraatcctcccaaatatggtgcatccggaacccacttgaaacacactgtgtgttaacctgccagttgagaagttctagactggagaattgttttgcatggttaaatagaaaaaaaaaaaacttattttatataaagtacttacctggactttattaattcattaactaactgatatttgtggagcattaattttatgcaagcatactgttgtagatgcttgggatccaacgacgagttttctcttgtcctataggagtttaggagacaaactgtcttaagatcttaacatgttttctctatt

SEQ ID NO: 88083 - DNA, 601 bp, Human
tagttcacgtttatgttatctatatgcttcatttatattcatatgattcttcagctcttctgcctgtgagttacaagttatttatacaatatccaaagatagaaaaaaatactaccccattgtatctctgacttaaaaacgttgcatttgggggttttctgtacaaagttgatttgtgatttaattgttagtttcactgagtttttttgtttttagtcacaattgtattgccaacatttcagaaaaatttataagctgtgacttttagcaacagaatctgcttttttctgctactcttacrtcctttcattttaaccatactttcattggagtagcctaaaacatttttttatggaaaaaagtcctcaaacagtgcctgttgcaaaatgaataaaatttggattcttcattcagctttggccaaaggccttccacagctcgttaccaattacttactgtgtgtcatgaactttgtagtccctgggcaaggatgcttactattgtggataccgtagatagagtgtacaataggaataggaagtataagaagtataaggacttcctatactttcccacaggtgttgattgcaaggacacttct

SEQ ID NO: 88084 - DNA, 601 bp, Human
cagggtagaaaagaaacaggccctcattcttcaaaccatcatcatctccaaactcttaccctgtgctcttctgctattttaatttcaccacttcaaaatgggaaaaacaaataggttaatagtttccatgcgtttagactgtgaccagaggcatacgaagcaatttcagaacctcaggcaaccacagctttgagggaaggatgatgatggatttaccaattcatcttgggatggattccagagttaagggagtcaggccagcactgtgctgccagagtgggatataaacaatattcattckttcattctttttgtacacattcatctcaggcttatttctatttcagacagtatactgggtgcattataggacagagaaatacattcttaagacatagtctctgcccctaatgaaattaaagtctggtagaggaaatagacataagcacaaataatttaaataaagtgcacactgaaagtattgtaagcaaaccaaataaagtgctcaggaatgggagagaaagaagcaattcattccaagtgggaccattgaggaaggcttcactggggaatggccttctagcctgtaccctgaaaggtc

SEQ ID NO: 88085 - DNA, 601 bp, Human
atttcagacagtatactgggtgcattataggacagagaaatacattcttaagacatagtctctgcccctaatgaaattaaagtctggtagaggaaatagacataagcacaaataatttaaataaagtgcacactgaaagtattgtaagcaaaccaaataaagtgctcaggaatgggagagaaagaagcaattcattccaagtgggaccattgaggaaggcttcactggggaatggccttctagcctgtaccctgaaaggtcaaaatggcaaattgcgatacatctaggcattagccaaggyacagaagtatgggagtttcacataggtttgaacaagagtgagtggtctgagatgttatgagaaccataaaggggggttggataccatgtaaagaataagctctttttacattgtgaagccattaagattttattatccagaaaggtacttgtatttgatcacatctgtgtttggaaagaaaactggaagtcattggagacaggggcaaggggagtattataagaagagagatacaaagaagccaaatcataggtcattgctataggttagacataaggacactagttacctacgtacaga

SEQ ID NO: 88086 - DNA, 601 bp, Human
atcccattcagttctgcatctttctaataagatccacatcccgggtttattcctgattgtaaactcaatgagttaatccagatacctcagttgtaatatagcattttacatgtgaaacgtggttgtttgctaagagcatggaattaaagggcaggatggaaagttaacagccgatctttctgagacctgactcactaactggtgtctcttttaaggggtgctatatatttttaaagcttagaatatttttaaggccagataaatgtgtttcttaattcactttttcaaaccagctcccttstacattcaacatttctgtcaagagtttgcaaactctaaacttggagatggtgtgtaaatcaaagctttaaatgatcagaagcctaattgattatgctgagttctgatttgggttctgcatttagcatgctctgtctcagtcatctgacaggctattctgtaaaaagtaggggtcttagtgatcgcactatggtctaagtggtcacactatgtctttgataatgaatcaagttttagaagtaatagtgaagcattcctcaatcggtgaaccagagtggtatagttcaagggtcaacaaact

SEQ ID NO: 88087 - DNA, 601 bp, Human; identical to SEQ ID NO: 32699

SEQ ID NO: 88088 - DNA, 601 bp, Human; identical to SEQ ID NO: 32700

SEQ ID NO: 88089 - DNA, 601 bp, Human; identical to SEQ ID NO: 32701

SEQ ID NO: 88090 - DNA, 601 bp, Human; identical to SEQ ID NO: 32702

SEQ ID NO: 88091 - DNA, 601 bp, Human; identical to SEQ ID NO: 32703

SEQ ID NO: 88092 - DNA, 601 bp, Human; identical to SEQ ID NO: 32704

SEQ ID NO: 88093 - DNA, 601 bp, Human; identical to SEQ ID NO: 32705

SEQ ID NO: 88094 - DNA, 601 bp, Human; identical to SEQ ID NO: 32706

SEQ ID NO: 88095 - DNA, 601 bp, Human; identical to SEQ ID NO: 32707

SEQ ID NO: 88096 - DNA, 601 bp, Human; identical to SEQ ID NO: 32708

SEQ ID NO: 88097 - DNA, 601 bp, Human
taaattcagtatatactctccccagcttgctttgagggtcccacaaactataacatggcatgcatacacacaaacacagcaaaaaagtaacaggtgtcataagaatggataaagtgctttgtgtgtacttactcctcattttttaaattgattatccctcatctttactgtatctttttcactatagaggcatcctaattgatttttaaattcaagagatttatcgagcaccttctataagccagcggctatacaaagtggacaaagagccctgacatccagcatgacagaagtgctattyggcacttgttcttcaagttgcccacttggatctcttccaagtgcactttccttttttccctgccctataactttttaataataaacttccactcctgctctgaaaaataaaaaagtaaataaaataaaaaatggccaggcacagtggctcatgtctgtaaatcctagcactttgggaggccaaggtgggcagactgcttgagcccaagagttagaaagcagcctgggtaacatagtgagacccgtgccgccccttctcccacccctgctgcctctatttaaaaaatatatatatattatg

SEQ ID NO: 88098 - DNA, 601 bp, Human
gctgggcacggtggcacgcacctgtaatcccagctactcaggaggctgaggcaggagaatcacttgaacccgggaggcggaggttgcagtgagctgagatcacgccactgcactccagcctgggtgacagagcaagactctgtctcaaagaaaaaaaaaaagaagatagttcatttaatacctgcaaaattctctcactcaagtatcacccccagtttaaggatgttttgagattagagaaatagataagctgctaagttctgggttaattaaaaaggaagagcatcatgtctcagaagcyaaattcagtatatactctccccagcttgctttgagggtcccacaaactataacatggcatgcatacacacaaacacagcaaaaaagtaacaggtgtcataagaatggataaagtgctttgtgtgtacttactcctcattttttaaattgattatccctcatctttactgtatctttttcactatagaggcatcctaattgatttttaaattcaagagatttatcgagcaccttctataagccagcggctatacaaagtggacaaagagccctgacatccagcatgacagaagtgctattc

SEQ ID NO: 88099 - DNA, 601 bp, Human
aaggttagaagttctttgctgggcgcggtggctcatgcctataattccagcactttgggaggccgaggtgggcagatcacgaggtcaggagttcaagaccagcatggccaacatggtgaaaccccgtctctactaaaaacacaaaaattagctgggcacggtggcacgcacctgtaatcccagctactcaggaggctgaggcaggagaatcacttgaacccgggaggcggaggttgcagtgagctgagatcacgccactgcactccagcctgggtgacagagcaagactctgtctcaaagaaaaaaaaaaagaagatagttcatttaatacctgcaaaattctctcactcaagtatcacccccagtttaaggatgttttgagattagagaaatagataagctgctaagttctgggttaattaaaaaggaagagcatcatgtctcagaagctaaattcagtatatactctccccagcttgctttgagggtcccacaaactataacatggcatgcatacacacaaacacagcaaaaaagtaacaggtgtcataagaatggataaagtgctttgtgtgtacttactcctcattttttaaattga

SEQ ID NO: 88100 - DNA, 601 bp, Human
ctggattttaaaaggcagaagacttgtaagaacataaacacaccagttatcaatctcccctttccattcgggattcaagaacctacgtgtggccccaaggaatagtctgtagaagtgcatctgccttccaagctgcccacctaacttctagaaataacctacccacaaatgtcattcacccattccctgttcactgactcatgcatgtaacaaaggactactcttcccccagaaactggcacatccaagggatgcagagcatcgtgaaaggacagaaagagagaccctggcctcgaggagmacacctgtcaggttatgaaggttagaagttctttgctgggcgcggtggctcatgcctataattccagcactttgggaggccgaggtgggcagatcacgaggtcaggagttcaagaccagcatggccaacatggtgaaaccccgtctctactaaaaacacaaaaattagctgggcacggtggcacgcacctgtaatcccagctactcaggaggctgaggcaggagaatcacttgaacccgggaggcggaggttgcagtgagctgagatcacgccactgcactccagcctgggtgacagagc

SEQ ID NO: 88101 - DNA, 601 bp, Human
cctactcctcttcatgggtgagggtagagtctgcccctgcccctccccactaggttcagggatactccttagaggggagatgcggtcagaatctgcagaggggaacccaccaaatagaacccccagggtgagccccacatcggcctgtgtatatcccagggtgatcctcttctgcttcaggagcttggcaaattgctcgagttctttctgcagagctttgatgtcctgggactggattttaaaaggcagaagacttgtaagaacataaacacaccagttatcaatctcccctttccattcsggattcaagaacctacgtgtggccccaaggaatagtctgtagaagtgcatctgccttccaagctgcccacctaacttctagaaataacctacccacaaatgtcattcacccattccctgttcactgactcatgcatgtaacaaaggactactcttcccccagaaactggcacatccaagggatgcagagcatcgtgaaaggacagaaagagagaccctggcctcgaggagaacacctgtcaggttatgaaggttagaagttctttgctgggcgcggtggctcatgcctataattccagca

SEQ ID NO: 88102 - DNA, 601 bp, Human
gtagctttattaaagcatgcaaaaaggctacatgtgatgaaggcagttattagccactctcctatctcctagacaacggttgaatcttacctaataatttaggaatatttaaaaaatataatctaccatttaaaacataccatttaacctacaatacctaataacattttttttccttttctagagttggaaccctaaactgacaatgtttacacagggttatgacatctacttggattattaatgtcatttaagcttttcagaattataccttcagatttatgccaaccttacttaaaayttcatttagagctttcctggaattagaaagcaaaaaagctttatttactgtcacatagctactaacctggtttttcttgtgattgtatcattgaagatattccatatctctctttagcataatcctacaaaaaaagttttttgcatcgtgactttttatgtaaacactaagagcacagtaaacacataaatactaataatagaatataaaaatgaatttaactttcaggatcattttattaattcagaaagtcagtagtttcataatgtggaaatctctcattcatttacatatgtactc

SEQ ID NO: 88103 - DNA, 601 bp, Human
acaaaaaattcggagtccttaccgaaagagctttaataatgaaaccaatcctacctttagctctgcttgtatgaactcttgcacgtacccaaacaacttcatcagctttttgtattgtcaagtctctaacccgaaccaaaactcgatctgtaataacagtaaacgatttttatatagtaaaataatttttaaattcagaatttacaaagagatcataattatttttgacagctagcataagtacttggaaccatcctgaataattctcaatctttgacaacactgtcttctctatcatgtkccatgtgcaatttgcctcaagttttgtgaactgtgctttctaaacatatttttaaaatccgtctatttctctaccatcttcactgccgccatactaaaccaagctattgtctcccacctgaactacagcaatagcttcctaactgcaatccctgtgtccccttctaattcagtctcctttgaagtcagacagtttcaaaatgcaaatctgaacacttcaatgacttgtaaggccaaacacagcctatcctgcctaggacatggaacttttgcctgcctgccacagtacctaagtcagcta

SEQ ID NO: 88104 - DNA, 601 bp, Human
ctgaggattggaaaggttatgcaatttgcgtagagtaaacagattgtaagcacaaatccaggattcaaacacacatctgtctcactgaaaaggtcttattcataaccactgggaagtatcactcatgagttttaactgttaagaagaaacagacatggcagtcgtaaaataaagggatgggtgtgaagggaaatattcttggttcaggcttacttgtagcatgcattctatcttttaatttgctaaattactatgtttaggaaaaagtgccccatttggacagaacaaaggctctcagtayaacgggagagagacgagtaaatgaaggattataatacaatgtgactgactattggcagaataaatggcccaacctttcaggaaggcaaatcaacattatttgaaaatttaaaactccaccagtactcttctcaaagtctgtcagtattcatcaggggaggatactgaaagaatagacaaactcttaacaatggtggccctaagagtgaaatgtatgtataaagtgctggaattttaaaaataatgggcatgtattaattctacaataaaaaaattataaaacacaattaagaaatgctct

SEQ ID NO: 88105 - DNA, 601 bp, Human
cagggtaaatttgtgtaatgcttctggagaacaatttggcaataagcattaaaaggcttaaaaacgttatctttgactcaataaatacattttttagaatatatgttaaggaaattgaaacagaactacttgtgactaatgctatggtcctcaagctttctacgttcaaagcactttaaaatacaagaaccttgatggtccacttaaaatgatttttaaaggactcaaacaaacaaacaaaccatcagtactggctccctggtaaatagaactgtccactcagactacttctctatgaagyacttttgagaccaagctcttgtcatgtattaggaaacaaaattgttctttctttggctctggttggtgacacaccttactgcatgattagcttagttccatgttttacaaggcactaccttccacatgctgagagataaacaggagcagtgtgtacatgatcctttttgtgcaaatttaaaaaacaaaaaatatggtcatgtctgtatgtatattttgtctgtctgtaaatgtatttttttttttttttctgcaagaacacacaagaaagaacagtggctattttgcagggaagagactg

SEQ ID NO: 88106 - DNA, 601 bp, Human
agtcatgttggctcacgcctgtaatcccagcactctgggaggccgaggtgggcggatcacttgaggtcaggagttcgagactaggttggccaacgtggtgaaaccccatctctactaaaaatgcaaatattagccgggcgtggtggcaggtgcctgtaataccaactacttgggaggttgaggcaggagaattgcttgaacccagcaggcggaggttgcaatgagctgagatcgtgtcactgcactccagcctgggtaacagagcaagactccacctcaaaaaaaaaaaaaaaaaaaaaargaagtgaagaatgttcactataccctttaaatgtttactgtgcttattagatttaattctaaaaaatttttcttattaaaaaaaggcaacagatgggggaggaagggaatgaagtagtgagaacagtctatgagcatattgttttacaaaaacctatatagtatgtaaaagtgtgccagtacaaaaataaccagatcaatagaacataagaaaaaattgataatagaccgtattagataaaggagatcctaattctaaacagaattcaggacattacgaaatttaaacaaacaccccaac

SEQ ID NO: 88107 - DNA, 601 bp, Human
attaatgacttctttttttttttttgagatggcatctcgctctgttgcccaggctggaatgcaatggcataatctcggctcactgcaacctccaccttctgggttcaagcaattctcctgtctcagcctcctgagtagctgggactacaagtgcctaccaccacacctggctaatttttgtatttgtagtagagacgggggcttcaccatattggtcaggctggtctcgaactcgtgaccccaggtgatccacccgccttggcctcccaaagtgccgggattacaggcgtgagccactgcrcctggccttaatgactattattagtaacaccactaccactgactacttatttgatgattaattatcattcctttttcacagctggatgactatatacaaaaagtatgcagggcgctgggaacacgaacgtaagtatttgttagaaaatcatgatagactcttacatgaggaaaaagtgataaaaccatatgtaacgtgtaatcccaattttgtttgtgtaagaagtatattaagattgatcatatggggaaaaaaaccaccaaaatgtggctaccaatgaatggtgaaattataggaaat

SEQ ID NO: 88108 - DNA, 601 bp, Human
gccttaaccaaaagaagaaagaaaaaggaaagcaaaaatgcaagcagacttacagttactactttcaacatacagtattttgaaatgcaaatcagatagcaatcacaagttaaaaaagacaggttgcaaacaaagtgtcaacacagacataatctattgactttagagtcatatatgattggcaggtttttaaccactaaaaaacactcttaattttcccttttgctttggaggatgatccagtcacaaagtaaaatcctaaaaaacgaagttgtattaatacaggaaacaaattcaaagkagttttaaaatattggaaggacaaaggttattaccacagagaaacttgcagatgaataaaaataacattttcctaggaactactactgaaaccacagccacgttaccccacttagaaaagtatgttactgtgaaatggaaggtaatgtgcacacgacagtgctaggctaagccataatgtagtcagagtgtattagctactctaatagtccagacagaagcagcaccaacctagctgcctcacaaagctgtccagtgataatttcagtgctacacaaagaccctggagaaagaatggaga

SEQ ID NO: 88109 - DNA, 601 bp, Human
aaattgctgggattacaggcatgagccaccatgcccagctgatccaaaataagcgtggtgagaagtatgcactactcaacaaggcacagaccagcagttctaaaactactctataggttctctttagtggaataaaaaatgtcagcaaaccccattaatcacttaaataagttctgtcatgttacttaaagacctacaaataccaaactactgtaaatgcttatgcttatagcccttaactttaaaatagaaataaatttttaaataaaaacaaaattcaaattaataagtaatattaatgtttaatttcactaaaactaaattgctgacatttggtttactctataaagcttgtagccttagagccagttccataattaatttgtttctgtattctgacttcaatactagtaatgggaagaatacctgttcagttacctaaaacattaactttgaggtagagtcaggatatttcagcttcacaattaaccaaaattctgcaaagagtaatctaagaatgacaatttaaataaagtatcagtcaatcattttataaaactgtcttacttatgtgaaagttaatgtggcattgttagttaaa

SEQ ID NO: 88110 - DNA, 601 bp, Human
caagtgaacggcccattttggcctcccaaattgctgggattacaggcatgagccaccatgcccagctgatccaaaataagcgtggtgagaagtatgcactactcaacaaggcacagaccagcagttctaaaactactctataggttctctttagtggaataaaaaatgtcagcaaaccccattaatcacttaaataagttctgtcatgttacttaaagacctacaaataccaaactactgtaaatgcttatgcttatagcccttaactttaaaatagaaataaatttttaaataaaaacamaattcaaattaataagtaatattaatttttaatttcactaaaactaaattgctgacatttggtttactctataaagcttgtagccttagagccagttccataattaatttgtttctgtattctgacttcaatactagtaatgggaagaatacctgttcagttacctaaaacattaactttgaggtagagtcaggatatttcagcttcacaattaaccaaaattctgcaaagagtaatctaagaatgacaatttaaataaagtatcagtcaatcattttataaaactgtcttacttatgtg

SEQ ID NO: 88111 - DNA, 601 bp, Human
aatatagggcttcatggaattaacatataaacaccattgtttctcccactttgttgtgtatgagttcacatgctttaatgtccagtctctttgggcagtaacattcaaaatggaaacgaaacatcttgaaaataaacaaatagtcctaaggcactcctctagctccaagcattttatatataacaactgatctaagacagaattaaaattaaatggagattagaaatggccttttcctcacagacatatttctctccatactattttccaaaccagattctggcagaatagttagctcgtycactaactgagctgctagcttcccaaagagaatgtgttactaactaaatattcttctgaattatctcatgcttcattgatcctcaagtttctaagtaaagatttttgttttatttaagcaacagaactcactagaattggtttagatgttggtgatgtactgtttttaataataacagaagggtggtagaatactaagcaatggaactcagtgctttccaaattttgcctttccaattatacttagaaactaagagataaagaggaatgagatcctgaagaggtcagtgaaacaacgaaa

SEQ ID NO: 88112 - DNA, 601 bp, Human
tcccatacaaaatgtaccagttttacttttgtgtatattcttgtactgacaaagtatatcacaatatagttgatgaaaaggataagatttaattttcatggaaaaattctattcattctgatgaggatttgggtctttagtagttgtggtgcaattagacattccagaaaccagacagtacttactttaaacaagagaacaccagaatccatttcaatgaaaaaggatcaaaatgaggataataggtgaagagtagttaagaaagaaaattgtttatgtcacttggctacactgcctagawatctttatgtctgttaccaactaacttaaaaaaaaaaaatcaacagcatgcatatctcttgtactctcgtaagtctcctgcactggggctatcacctaatacctagctaaaatcttgactactgaagaaactcagaatttattatggcaaaagaagtagttggtgaactaagataaggctcttctgaggcttgaagggatcaagaggctccagtggactgttacaaagttttctaatacttgcaatctagtgtcactgaactgaatctatcttcaatttgactgccacctaccagtaaat

SEQ ID NO: 88113 - DNA, 601 bp, Human
gccaatgttgcatggagcagatgagccatctcagttgggtgcatcacagaattgtaagcaaataaatgtttgttgtttcaagtcactaagtactggggtgatttgttatataacaaaagctaattgattcagtaactaatttataaacctcagtattttacattaattagtaagaacatataaatttgacatgaaaactattagaacccaaatctatttctatatgcgattttatattttgaaaaaacttaccttctgaacatgtaactcaacgtcttgctgtgtacagcttccaattttstgattcacttttctcacaacaccttctacatccacaatgctctctttgttgatgctgtcaagagaaaaaattcccaacttgaatcatctcatcagaggtgtcagaactcctctggtgtttcagcagtaaagctgaatatgttaaactcttttttaatacagtaagccacttgagataaagccagtctatttaacctacttagaataagctattacgtagcataccttgtgagattccttgaagagatgattttttagatgccataatttagttaccacttataaaatactctggacataa

SEQ ID NO: 88114 - DNA, 601 bp, Human
gggcagacggggttcagccaaactgatcacataaatctgtaagtgagagattaccaaaaatagtagaaagcacacaaaatctgcatctttttcttaaaaaacaatctacagttgacttaagcatgaagcaatgtttgcatacatctttaattgaaactacttgctgaaatcaaacaagatgatacaggttttttcaccttgatgatttgtttaaaatggggataataatattttttgcctacctctatggttgttagaacagtcaaataaggtaacatatataaaaattatttgtaaattytaagatgcctaccaatgtaataagtaatgactggggtgtaggcactggcttacggtctagctatgtcaaaaaagctatggttaggggttggtgctgtggctgacacctataatctcagcacttagggaggctgtggtgggttaatcacttgaacccaggagttcgagaccaggctaagcaacatggtgaaaccccgtctctacaaaaaacacaaaaattagccaggcatggtggcacgtgcctaaaatcccagctacttgggtggctgaggcacaaggatcacttgaacctgggaggcag

SEQ ID NO: 88115 - DNA, 601 bp, Human
ttttaaaacaaagaaagtcaatatcctgttaactagtatttaaccgctcctgttgcctgcaattctttttaggggaagggtcagtcagaaaaggaaattgtttcctgtattatcatacttacagtcaggcaaataccatttagctttataagcctgagacaggtatggtatccctgcccctctctaatgcggcataattgcttcacttaataaataaatgaggcataccctaagatcaatgactctgttgtctaatcttgtatcctggttaacagtagctcttccttcctaaaaaaaaaaraaaagaaaagaaaaaaataaattttactaatattttgaagagcacaaaaaatacttttagaagccatgtttacttttaattgagtaggatgtgtgtacgttaatattatgcccgaaaatcagataatggtagaaacacaaagtgcggccagagagaagttagcgttaaaagagagatggaaagaagacaaagaatgaacagatattaatggttctttccctcctccacccctcaaagccttgcctcattattgggatataagaaaaattaaccacccacttcttcattgattcctggatt

SEQ ID NO: 88116 - DNA, 601 bp, Human
ccttattttcaactgacaaggaatgtacaaataccttatatatttaatttatcattactatacttacccttaccttaagatacctaaatgaacaggaaaaaggccttctttatcatttaagttataaaccatactaataatattagtttccttaatgtttaaatctaaaaattgttttgggtcagacaaatattttaatgattccataatatgtaaaaaaaataatacttcctcctcactcattaaacaaatatttattatatgcctcctagtactgggctaggtgttagatgataacggygattacagagggcatgaggtagaagataaactaaacagaaagcagaaaactaatttttctacacttaaaaaaattaattttagaaaagcaaaacgaaaaacccagtccttgaactttagttctaaaaaagcttgacattccttatattaaaatagtacttttaaattctatagcaaacttcccaaaagtatggttattaaaattaaaacactgctattctgtattatgtgaaagatctgaaataaagggaaaaacaatattctgcatttatagaattcctttccctgaggtcctcatagc

SEQ ID NO: 88117 - DNA, 601 bp, Human
tgccaggccaatttctacattcttaaacatactcattagccctgcaatgcagtaaataaaattcgtatttttgaactcttttaaaataccaatgaaacatatcaaatacatcaacaaggaatagttgaattgctggtcttcaaataaaaattttaaatatgatcttctgtcacttattaaaatgctagcttagactattatagcttacctaatacttgaaatatagtcacaaatacagaaagagggaaaaatagagactttcttaatcaacttgactcggttctattttcttttcctattytctctatgttaaacatcatcataaataaacaactttcaatgacctgtaaagggaagagctctttgccagtttagagggtgtaggtgaagtgcacattctacatgattcaattttctgaacatctagaacacatctaatatttctataaatgttaattcatcagatccaaatagatttaaatatccgttcagtctactagtttctaatctttactgagcacttaatgtaaatataaattgatttaagaattaaccatatttgaccaggcttaatttacatgtcgacagattcagttgactg

SEQ ID NO: 88118 - DNA, 601 bp, Human
gtttcaactgccaccagtaggaggagctcaaggactaattttccttttcattatatcattatcttaaaaattttaaaaagatcatactaagtttagcttttatcctctttggagtcttggttttagaaaatgagattggaaagtagctattacataagagggagagaggaacctcattcatcttgaagtctcatgagacagcaggggtacacagggaagaccatttctaaataattttcaaataacttggaggtcatttccaactaatccgacataggtatcacttttagagacacctcasaacaacttcgtaaaaatattaaatactgagttaatcagatcatctgggagaaaggcaggctgtctgaatatttctcaattttctaagaaaaaaatttttttaatgttgtccttcttcggtttttatttattccagaatcataccattctaggaagctcagacccctctgcaattgtttttagtcccaagagacatttcagaattagaaaaagaaatccagcatataaagagtcctaccttttcctttaccaaatgacccaacagcttttcatttggtgtgctgaaaaagaaacgtgaaat

SEQ ID NO: 88119 - DNA, 601 bp, Human
aagggatactcaatctatactttctttatccattcatccactgatggacactaaggtcatttctatatcttggctattgtaaataatgctgcattgaacatcagagtgcacaaatctcttcaacatgctgatttcatttcccttggtatgtaagaccagaaatggaatttctgaatcatatggtaattctctttgtaatgtttagaagaatctccatcctgtttttcataatggctgtaccaattttacattcccatcaactatttacaaacaaggattcccttttctccacatccttacyaacaattatccattacctttttactaacagccagaggtgtgagatggttatctcattgaggttttaatttatatttccctaatgtttagtgatgttgagcattttttcatatacctattggccatttatatgtaggttttacatttaggcctttgatccattttgagttaatttttgtatatgatgttaggtaagggtctaatttcaatcttctgcaaatggacattagttttttctgtaccatctgttgaaaaaactgtctctcgaccaattttaatttgaaaattttgtaagtacatt

SEQ ID NO: 88120 - DNA, 601 bp, Human
ataacaaatgaaaaaaatccaaaatcagacacacttctggtcccaagcattttggataagggatactcaatctatactttctttatccattcatccactgatggacactaaggtcatttctatatcttggctattgtaaataatgctgcattgaacatcagagtgcacaaatctcttcaacatgctgatttcatttcccttggtatgtaagaccagaaatggaatttctgaatcatatggtaattctctttgtaatgtttagaagaatctccatcctgtttttcataatggctgtaccaaytttacattcccatcaactatttacaaacaaggattcccttttctccacatccttaccaacaattatccattacctttttactaacagccagaggtgtgagatggttatctcattgaggttttaatttatatttccctaatgtttagtgatgttgagcattttttcatatacctattggccatttatatgtaggttttacatttaggcctttgatccattttgagttaatttttgtatatgatgttaggtaagggtctaatttcaatcttctgcaaatggacattagttttttctgtacca

SEQ ID NO: 88121 - DNA, 601 bp, Human
tttgtctatgggttcaacttttaaaaggtaccatatatatgtgagatcacacagtatttgtctttctgtgcctgatgtgctaatttgtttagcatgatgtcctctatgttcatctacattgctacaaatgacaggatttccttcttttgtaaggcagagtgttatttcattgtatagataaaataggtttgagtattcctaatatgaaaatccaaaatgctccaaaatctgagactttttgagtgccaacatgatactcaaaaacataaacaaaaaaaccaaaaaatgctcattggagcayttcagatttctagatttggcatgttcaaccagtaagcacaatgcaaatatgataacaaatgaaaaaaatccaaaatcagacacacttctggtcccaagcattttggataagggatactcaatctatactttctttatccattcatccactgatggacactaaggtcatttctatatcttggctattgtaaataatgctgcattgaacatcagagtgcacaaatctcttcaacatgctgatttcatttcccttggtatgtaagaccagaaatggaatttctgaatcatatggtaattctct

SEQ ID NO: 88122 - DNA, 601 bp, Human
gattaaatcaagctaattaacatatctatcatcttgcatacctatattttttgtggaaagaacatttaaaatctactcttttagcaattttcaatgtggaacaatggatctccagaacttaatcatcctaagtcaatctttataccctttgaccatcttctccccattccaacaaccattctactctttgtctatgggttcaacttttaaaaggtaccatatatatgtgagatcacacagtatttgtctttctgtgcctgatgtgctaatttgtttagcatgatgtcctctatgttcatcyacattgctacaaatgacaggatttccttcttttgtaaggcagagtgttatttcattgtatagataaaataggtttgagtattcctaatatgaaaatccaaaatgctccaaaatctgagactttttgagtgccaacatgatactcaaaaacataaacaaaaaaaccaaaaaatgctcattggagcacttcagatttctagatttggcatgttcaaccagtaagcacaatgcaaatatgataacaaatgaaaaaaatccaaaatcagacacacttctggtcccaagcattttggataaggga

SEQ ID NO: 88123 - DNA, 601 bp, Human
cgggaattagtttctgcacgtgctcctgaaacagaatgataggttgtttcacaacttaaatattaaaggtgctgaacatcaaaattgctcaaataaatgaaagctataaatccaaagacttcacttaagccttgaatactttcagaatagcaccatttgtggcaaaaccaatttgtttttattctcatcacacttcgttcctcagcttctgattggtagccaaaaagaagacaatgaagatgtgggaagctagatactgtgcagtttaggtaactgagaatttgttaaatttgagccacarattactgacctggtgtgctaagcttggagacgtcaggcacaacaatcagtgtccctgtaaagtcacacttgtcaccagcttgagctgattccacagcttcagcccttaaaattacttctaaactgcgggggatactccctcgaggaagctcagcttgggtctcttgaatacgaacctgtaatacagacaaacaaccaaccaagaatgagaagcaatacctttcagatgccatataatctaaattaaataccacaaatacggacgtattctaaactatctgacccattagcagacttttca

SEQ ID NO: 88124 - DNA, 601 bp, Human
aagtggaggctacagtgagccatgactttgccattgcactccagcctgggtgacagagagagactgtttcaaaaacaaacaaaaacccccaaaacgactgacccttgggttggttggcgcaacacagcaggcaagaaagaccagcctataagaaaggtccctaacaccaagggcccggagtcctcgaatgccttctgtctcatatccatcaacaccactgacacgggaattagtttctgcacgtgctcctgaaacagaatgataggttgtttcacaacttaaatattaaaggtgctgaacrtcaaaattgctcaaataaatgaaagctataaatccaaagacttcacttaagccttgaatactttcagaatagcaccatttgtggcaaaaccaatttgtttttattctcatcacacttcgttcctcagcttctgattggtagccaaaaagaagacaatgaagatgtgggaagctagatactgtgcagtttaggtaactgagaatttgttaaatttgagccacagattactgacctggtgtgctaagcttggagacgtcaggcacaacaatcagtgtccctgtaaagtcacacttgtcacca

SEQ ID NO: 88125 - DNA, 601 bp, Human
gtggcagctcagggtaggtgtttcttaagctgtcactctactaagactcactgttggcctgcctggccaacagagcaagacctcatctctaaaaaagtttttttaattagctgggtgcagtgattcacacctataatcccagctactcaggaggttgagatggtaggatcacttgagcccagaaagtggaggctacagtgagccatgactttgccattgcactccagcctgggtgacagagagagactgtttcaaaaacaaacaaaaacccccaaaacgactgacccttgggttggttggygcaacacagcaggcaagaaagaccagcctataagaaaggtccctaacaccaagggcccggagtcctcgaatgccttctgtctcatatccatcaacaccactgacacgggaattagtttctgcacgtgctcctgaaacagaatgataggttgtttcacaacttaaatattaaaggtgctgaacatcaaaattgctcaaataaatgaaagctataaatccaaagacttcacttaagccttgaatactttcagaatagcaccatttgtggcaaaaccaatttgtttttattctcatcacactt

SEQ ID NO: 88126 - DNA, 601 bp, Human
ctttcacagtcatttggttcttaatgctctcagctgtctgttcctcatctctgagctctttccccccaaactaatggtagagaacaaaggaagaatcattagtatagaagcagtcaaaagagcataaaggagaagaaacttcattacaaacacaacatagcgtgggaagtcaacctcacaatttattgactgtaaaggtttaaaaaaaaacaactccccaaactagtaagccctcagttaacaaagacacttaagggtatgtcatttgtccagtgagttaaatagaaaaaaagctacctgaatgctcaagagataagcgatagcagaatgttaatcactgacataaagatgcaaataaaataagagaatattatgttcactccctttttccaatactgaactattttccaaactcccatttatgacacagaatcaagttaactgaatgatactgccaggggttcatcattctcagaagtttacttcccagattactaaatctttttatttgtatttcctccagaagaataacagaggaactatgaaactttaaaacaaaaaacagcgtggataatttgtaccactgcacttaaaagcattg

SEQ ID NO: 88127 - DNA, 601 bp, Human
acaagagccaatgtggtgacctacacctgtaatcccagctactggggaggctggaggtagggttgctttagcccaggagggagtgcttcagcctagacaacatagcaaaaccccgtctctctaaaacacatacacacacaccaacaaggccaggagactacaaccacaaaaaggccaggagactagtctagcatatggaaacacacttaagtgcagctctgtcataaggccaggaaataagatgacaaaataacttttccttaaaaaaataaaattgtgataaaaatacataataaaactyatcattttaaccatttttcagtgtataagttcagtggcagtaagtacattatgttgtataactgtcaccactatccctttccagaactttgtcatcatcccaaatagcaactttatccattaaataactcatttctcccattcccccagccactgataacctctatcctaccgtgtctctatgaatttgcacattacaggtacctcgtataagtgaaatcatgtacctgtccttttgtaaatgacctctttcagacccactaaaaactttcacagtctgatttatgtgctttcagaaatc

SEQ ID NO: 88128 - DNA, 601 bp, Human
actgcactccagcctgggcgacagagtgagactctgtctcaaaataaaatagaataaaaaaagataaaaaaaggttgagttcttaccataatcctaattgagtatggaagacaaggatggaagagttcaaagataaagcatcaggcctaaaattttagtcatagccttcaaaacacagcttgcaaccaagagtcaggaaaatgtgaaactgccaaaggtatagacagaacaagtaaccaatcataaacactccattttggtaaataaaaagagaaacaagagccaatgtggtgacctacayctgtaatcccagctactggggaggctggaggtagggttgctttagcccaggagggagtgcttcagcctagacaacatagcaaaaccccgtctctctaaaacacatacacacacaccaacaaggccaggagactacaaccacaaaaaggccaggagactagtctagcatatggaaacacacttaagtgcagctctgtcataaggccaggaaataagatgacaaaataacttttccttaaaaaaataaaattgtgataaaaatacataataaaactcatcattttaaccatttttcagtgta

SEQ ID NO: 88129 - DNA, 601 bp, Human
gagaggttgtgactctctgaaaaaaaaagggaataatacacatgcctgtctgggtgctgctagagtaagacataacacatatacagcactgagaacatggcaggtgctcagaaacttgttgcttttattttgggccctaagtttcttaaaagtttgaaagtaatcaaatatttattatagcttctaaaaacagtcaaaaattgtgttcacactgacaaagttaacataaaatatctcatagcagcattccctttggaaagtacatcctattttatttttattttttttgagacggagtctygctctgttgcccaggatggagtgcagtggcgcaatctcggctcactgcaagctccgcctcctgggttcacgccattctcctgcctcagcctcccaagtagctgggactgtatacaggcgcccgccaccacacctggctaattttttgtatttttagtagagacggggtttcaccgtgttagccaggatggtctccatctcctgacctcatgatccgcccgccttgatttcccaaagtgctgggattacaggcgtgagccatggcacccggccagtacatcctattttaaaaccttacaaa

SEQ ID NO: 88130 - DNA, 601 bp, Human
ctgggttcatgtcattctcctgcttcagcctctcgagtagctgggactacaggcgctcgccaccacacccggctaattttttttgtatttttagtagagatggggtttcactgtgttagccaggacggtctcgatctcctgacctcatgatccacccacctcagcctcccaaagtgctgggattacaggcgtgagccaccgcgcccagctaaaacatcaattttaaaagaagtctttaatagtaataaacagcaacaatcatctatcagaaggtcttgcaattaaaaataaaacaaaacaraactagatatggggcttattccagaaatgcaagattggtttaacatctgaaaatcaatcaatatgctaaattaataaaagaactacatgaccacctaaacagatgtagaaaaagcatttgacaaaatccaacaccttttcattacaaaaaccaaacaaaccaggaatagaggaggttttcctaagtctaataaagggttttttctttaacctgacaaagggcatctatgaaaacccacagataacatcaaacttaaaggtgaaaggctgaatgttttgcccctaagatcaggaataagac

SEQ ID NO: 88131 - DNA, 601 bp, Human
ctgggattacaggtgtgcgccactatgcccggctaatttttgtatttttagtagagatggggtttcaccatgttggccaggctggtctcgaactcctgacctcaggtgatccacctactttggcctcccaaagtgctgggattacaggcgtgagccaccacacctagcctaaaacatcaattttatttattttttaatttaattaatttatttatttagacagagtcttgctctgtcacccaggctggagtgcagtggcttgatcttggctcactccaagctctgcctactgggttcatgycattctcctgcttcagcctctcgagtagctgggactacaggcgctcgccaccacacccggctaattttttttgtatttttagtagagatggggtttcactgtgttagccaggacggtctcgatctcctgacctcatgatccacccacctcagcctcccaaagtgctgggattacaggcgtgagccaccgcgcccagctaaaacatcaattttaaaagaagtctttaatagtaataaacagcaacaatcatctatcagaaggtcttgcaattaaaaataaaacaaaacaaaactagatatg

SEQ ID NO: 88132 - DNA, 601 bp, Human
tcttatagccaaatataaaaggatgttgcgttcaaggatgcttactacaattttgtttgtaatacaaaacactgaaaatgaaccaaatgtcactcaacaggagtctaaagaatcaagctgtggtatacacaattgaatatgggaaattaataaaaaacgaaagttgatctaatatgtgctggtaaaagattgccaaaataaaattatgaagttaaaccagcaggaatgaaattgtcagtattatgcttatgtacaaaatattcctaaaaggggcacaaactcaatagatgccttattttcytcctcctaaaattcctttttatccattagatacctctaagtatctactgttgctgggagttgcagggaaagagttgtcttttcaatttacaattgtgtactgcttaaaagctacttgaatctgtagcttttaaagtttagattctccctagtgttggttatactgtcatacttattttcatttaaatactctgttaatataaataaatatatacatatataatcaatctgttgatctttggttatttttgttataattggagcatgctttatcaaagaaaataaaagctttgttcatgga

SEQ ID NO: 88133 - DNA, 601 bp, Human
acaacatgttcaatctcacccataattaactaaacacaaaccaaaataatgacataccctttttcacataaacaggaactcctatgtgattttggtggtatgatgtgcacaccattgaagacatcaatttgttagaaatttctcttatagccaaatataaaaggatgttgcgttcaaggatgcttactacaattttgtttgtaatacaaaacactgaaaatgaaccaaatgtcactcaacaggagtctaaagaatcaagctgtggtatacacaattgaatatgggaaattaataaaaaacsaaagttgatctaatatgtgctggtaaaagattgccaaaataaaattatgaagttaaaccagcaggaatgaaattgtcagtattatgcttatgtacaaaatattcctaaaaggggcacaaactcaatagatgccttattttcctcctcctaaaattcctttttatccattagatacctctaagtatctactgttgctgggagttgcagggaaagagttgtcttttcaatttacaattgtgtactgcttaaaagctacttgaatctgtagcttttaaagtttagattctccctagtgttggt

SEQ ID NO: 88134 - DNA, 601 bp, Human
ctgaccacaaaagaaagaatcttaacagatttaaatagacatcagccaataaatatataacaacatgttcaatctcacccataattaactaaacacaaaccaaaataatgacataccctttttcacataaacaggaactcctatgtgattttggtggtatgatgtgcacaccattgaagacatcaatttgttagaaatttctcttatagccaaatataaaaggatgttgcgttcaaggatgcttactacaattttgtttgtaatacaaaacactgaaaatgaaccaaatgtcactcaacargagtctaaagaatcaagctgtggtatacacaattgaatatgggaaattaataaaaaacgaaagttgatctaatatgtgctggtaaaagattgccaaaataaaattatgaagttaaaccagcaggaatgaaattgtcagtattatgcttatgtacaaaatattcctaaaaggggcacaaactcaatagatgccttattttcctcctcctaaaattcctttttatccattagatacctctaagtatctactgttgctgggagttgcagggaaagagttgtcttttcaatttacaattgtgta

SEQ ID NO: 88135 - DNA, 601 bp, Human
gccttatctcaaaaacaaaacaacaaaaatagcagaactaacatttatagggccctcagtgtatgagacactgttctcttaggcaggtcttagaagaattaacttatgcaatcctcacaaaaattttattaggtaaatgatattatccccattttatacatgggcaaattgaggcctaggaaggttaagtaatttatccaaggtcacagttaagtagtggagccaggatttgaatagtctagcttcagagactgtgctcttagccactaaattttgaagatattcatcccagaatactggaaaaaaaaaaagaccccaaaatatgcaacttgctctcaaatggttcaggaaaaaagtgtgcagatatatacagacagtaagcaataaagcaaacagggtaaaatgttattatgtgaatcacgtaaagggtatatgggtgttctatgcactattccatttcttgcaacttttctgtaagcttgaaattatttctaattaagaagttgtctgggcggaacacagtggctcatgcctgtaatcctagcactttgagaggccaaggctggtggatagcttgagctcaggagttcaagaccagtcc

SEQ ID NO: 88136 - DNA, 601 bp, Human
aactcaccatgccatacatttccctttttataaattatacctcagtcacactgtaaaaaaaagccaaacccccttttcaaagacgaccttacatcaaacctattaataaaactaggaaaaagcagggctgctttggttgaagcgaagatgggacgcttgaatgccctttcgtactactccccttttacctcgttaatacccactgacctatcctcgtggaatgcagggctcaaagaacaatctaaaaatcaaacattatacaaatgcaacctaaggaggagagttcctttgaggccagggrctacattatcttatctgtattgccagcgcagaggcctactagtacattgtagggtctaagtacatttttcctgaatgaaaggtattaaatggtaacttacgtctttatgcactctataaactatgacgtgatcgtctccgtctaacaactacactcaaatgcttaccaagctctttaaagggaagaattccatggtcgtatgagcattcaacagttacataaaaatgtatttgcagtgaattctagtatgtcccataccaaagattaaaaacatgcaacaaatctgtttatctctgctct

SEQ ID NO: 88137 - DNA, 601 bp, Human
actttgaatagcatggtaaagcagttaagggtaggaagcgtactagtgtccagacgccacactttaccaataactacatgaggattttactccatttctagtctgcaatggccttttgatagtatagatttctaggctcaattaattactgttaaaatataccctaggggtccagctgttttaaacagaaccattgtaagggaatagtaattttgcatttgtaaaaacatttgtatgtgctgcttcatatgttatcaggtcccaaaattattaaaataggcccagaatgttaaaaagaagracctacaaagctttgcctgacaataagcttgtgaagaaatgttcaggctggcaggtatgctgatactccacaaatttactttgctaaagtgagtttatctaacaacttatcctctcttccgacagaacaacacgaagtttggcaatcacaagtggcctatgtgaacagagcttacagaagtgaccgagcatgtaagcagtaccaggtaagcctcaccttcttccacctttctgaggtgaagcacaataaggttagagattcggcagtactcagagaagcccagccttaaggaggctttgg

SEQ ID NO: 88138 - DNA, 601 bp, Human
ggatgctgaccttttcataccataaaccccttgtggaaaattaagaaatacttaaatatattacatcaaatgcttgtaaatacaacttcaaaaaaggaagtaatgcttgaattttaaggttaaacaactctgcaaaatcttctaattaattggaagtctgtttcatacttaatatcattcagcaatttttaattactgaccactgaactttttcatataccaccatttcatagagttaggagaagaatctatgaaaattcatctgaaaaatttttcactctgagctaataaaaaaaaaggkagaacatgccatctggcttaaaatcttgatgacagattttaagcccacgatataattacaggttagtcaaaactgtccacaaatgagaagagctcctagccaagcccatagaaaggaactcaggaaactgtgatttgatcctaagaagtctggcaaggctccacagtataaacactgaagccactaagggggactggacactttttaaaaaattgccctttcaaatctacccctgaagttagattggacactttcaagcactcactctatgtgttaacataccttcataggaagcatcat

SEQ ID NO: 88139 - DNA, 601 bp, Human
taggcctgtctcatactccatgagacatgtgctgcacgcatgggctagctgctactatttcattcctgagtccccatgcttcccaccctgttcttggcagaattctcaccacaggcaactttttccgaagctccttccgtaggatcccgtcattgagcagcacaagcaggttagaggcagagtacactgaggggtagagagtggccttgagaggctggctctgcagcctccatccctctcaccttctccccagagctgcagggatcacctgtcacatgctctgctcagacacccacagacagtggaaaccaaccttcttctccacccacttcctcagcactcccctctccccaacatgatctcacaagggtggctggaccaagaaaggatgggtcaatctcagtgacaagccagttactgccctgctggatggcactggtcatccagctgcccacaactgcccatcgctctctgaactgccacagatacacggtcccacctcctggccctttctctcttggcagcctgttcctgagggtctattccacctccacttttcttttttctgagtcggagtttcactcttgttgcccaggctgga

SEQ ID NO: 88140 - DNA, 601 bp, Human
ccacaggcccaggctgagcactgacggccaaggcgtcaaggatgtctccagcacaggggccttgctcagcacactccccactcaatccccagcccacagtgccagccctatcctgccccgcgctaaggatacagtgcagcagcggccgggcaatgtacaaaaactctgcgatggtctcctgcagccccaggggggtgggggtcgcactcagctcctcgtgatgctgctgctgccgtccctcccgctgctggggagctccccagtgcctggagtgcagggacggcgctagaacacaagggcrgcagatgagcgagccaggcccaggctggggcaggggaaggtggctgctgaccaaagccagtccctcaagcccaggcagacagcacctaggtgcccaggccagccacatcctccacttactgttctggagggttcgcaccacccggtttgaccgcttccccacgtaggactgctcatggttgccagggctgtggtcaccatctagcagggatagacagaaggccatacagtcagagggacatgcttccagcggagcctgcaaagaacgtgtgcagtgaatgctcaggagctaaggggagaa

SEQ ID NO: 88141 - DNA, 601 bp, Human
gcgcccgccctgtcgccatccctgtgggccacctggcaatgccctcagccctgccctcagtgcctctcctgccaaccaatgtttaagttcctgctcaagtggcctgatggcccagagagctctgcgggcgggactgggctggcatctggtgactgccacccggacaacacacagtgcttggtgaaccctggatgaggcgtggggaagggaaggcgccagcagggaccggagcaccagtgcccgcttgccagccctctccctggctcagggtgtcctgggtgcttactcggagaagcggtcrtagaaaggagagcgcagcaggtagtagagcagcaggatggtccggcgccgcagctcccgccgctccctccgggtcaggccctttctgtcactcaggaggctcaggctgggaggcagggaggacatggtcagggccaggggcatgatctaggcccacggaaggggaggagccatgggctgggtgtccagaggggcagcaacaggaggagcaggggccgctgccaccccgcctatgtgaggccaggattatagcagaaagcccagtggagagtgaagccccaggcaggcccaggctcacctg

SEQ ID NO: 88142 - DNA, 601 bp, Human
tagctctaccactggctagctgggtgtctttaagttgcccaacctccttgaacctccaggtcctcctctgagaagtgaggataagccaaactatttggcaggaagaagtggaaatgagctagaggccatgggcgcccgccctgtcgccatccctgtgggccacctggcaatgccctcagccctgccctcagtgcctctcctgccaaccaatgtttaagttcctgctcaagtggcctgatggcccagagagctctgcgggcgggactgggctggcatctggtgactgccacccggacaacayacagtgcttggtgaaccctggatgaggcgtggggaagggaaggcgccagcagggaccggagcaccagtgcccgcttgccagccctctccctggctcagggtgtcctgggtgcttactcggagaagcggtcatagaaaggagagcgcagcaggtagtagagcagcaggatggtccggcgccgcagctcccgccgctccctccgggtcaggccctttctgtcactcaggaggctcaggctgggaggcagggaggacatggtcagggccaggggcatgatctaggcccacggaaggggaggag

SEQ ID NO: 88143 - DNA, 601 bp, Human
atgttagccaggatggtctctacctcccgaccttgtgatccgcccgcctcggcctcccaaagtgttgggattacaggtgtgaggcatcgtgcctggctaaactatgccagttttgtttttttttttctgttttgtttttttgagacagggacttactctgtcacccaggctagagtgggatggagtgatcataactcactgcagcctcagcctcctggcctgatcctcatgcctcagcttcctgagtagctaggacttacaggcgcacaccaccatgtctggctaattattattattattwtttttttttgtagaattgggttgcccaggctggtctcgaactcctggcctcaagccaacctcctgccttggcctcctaaagtgctaggattataggtgtgagccactgctgcccagcctatgccagtttttaagctattagtaggtcctagacaaagggggtcccgggagccttgtctgcctcacagtcccagccactgcacagggtttccccctgtcagactgtggtctaacctcaagcagtcatagtggcaggcctgtggaagaactagtcccaagctgccccctgctcaacccagca

SEQ ID NO: 88144 - DNA, 601 bp, Human
accatgttagccaggatggtctctacctcccgaccttgtgatccgcccgcctcggcctcccaaagtgttgggattacaggtgtgaggcatcgtgcctggctaaactatgccagttttgtttttttttttctgttttgtttttttgagacagggacttactctgtcacccaggctagagtgggatggagtgatcataactcactgcagcctcagcctcctggcctgatcctcatgcctcagcttcctgagtagctaggacttacaggcgcacaccaccatgtctggctaattattattattwttatttttttttgtagaattgggttgcccaggctggtctcgaactcctggcctcaagccaacctcctgccttggcctcctaaagtgctaggattataggtgtgagccactgctgcccagcctatgccagtttttaagctattagtaggtcctagacaaagggggtcccgggagccttgtctgcctcacagtcccagccactgcacagggtttccccctgtcagactgtggtctaacctcaagcagtcatagtggcaggcctgtggaagaactagtcccaagctgccccctgctcaaccca

SEQ ID NO: 88145 - DNA, 601 bp, Human
tcaccatgttagccaggatggtctctacctcccgaccttgtgatccgcccgcctcggcctcccaaagtgttgggattacaggtgtgaggcatcgtgcctggctaaactatgccagttttgtttttttttttctgttttgtttttttgagacagggacttactctgtcacccaggctagagtgggatggagtgatcataactcactgcagcctcagcctcctggcctgatcctcatgcctcagcttcctgagtagctaggacttacaggcgcacaccaccatgtctggctaattattattattattatttttttttgtagaattgggttgcccaggctggtctcgaactcctggcctcaagccaacctcctgccttggcctcctaaagtgctaggattataggtgtgagccactgctgcccagcctatgccagtttttaagctattagtaggtcctagacaaagggggtcccgggagccttgtctgcctcacagtcccagccactgcacagggtttccccctgtcagactgtggtctaacctcaagcagtcatagtggcaggcctgtggaagaactagtcccaagctgccccctgctcaacc

SEQ ID NO: 88146 - DNA, 601 bp, Human
taaaagtaggctctttactgccatgaatcaaaagtatgcttggggtgtttgcttcataataattagtataacatatatttccccttctcttcttccttcattttaattggtagatatttcatatgaaatatatgagaaatagcgccttttctgaaaggtgagaattttttagtcttttgagtgttttactgactaaaggttattaacgctgaagaaagcatgatatgtaaacttacagtttgatgtggacatcatagtcagtaagttattaactgtctccatgagatcatgttgctgcttytgaagaactgaattattcaccgtggcagtcactatttttttttctagttcttcaatgatggaattttgcttggatactaacacctgtagctgatctttctcttcttttattgactgtagttggatgatgtgcttgtcttccatagctagcaccttcttttctaggaaacttgtaaggaaaagaattgttagttagtgaaggctattctaatgaaatattttatatttattgaatttctacttctccaaggtactctgttaagatattgtagtggttataaagtaatatgatgttaccaga

SEQ ID NO: 88147 - DNA, 601 bp, Human
ggatttcaccatgttggccacgctggtctccaactcctgtcctcaagtgatctgcctgcctcagcctcccaaagtgctgcaattagaggcgtgatccaccacacctggcccttccctccaatatataagagacgctgcaaagtgaaacaataataaggaaggcaaaatgtgcttaagaacctggcaagataagggaactagcatctcttaagtgccattgtattatctcatttaatcttaatggccatcccatgggtctgatattatttttcccatgtaaaacctaaataaatgaatatcrgctgtggtttagtaatttgcccagtctcatccttctaattaatgatggaactaactaaaagtaggctctttactgccatgaatcaaaagtatgcttggggtgtttgcttcataataattagtataacatatatttccccttctcttcttccttcattttaattggtagatatttcatatgaaatatatgagaaatagcgccttttctgaaaggtgagaattttttagtcttttgagtgttttactgactaaaggttattaacgctgaagaaagcatgatatgtaaacttacagtttgatg

SEQ ID NO: 88148 - DNA, 601 bp, Human
agaatgtccctaaacactgttatctgtatcatgaccccattgcctgccccttcaggccattatcccactgaggacatagtggggtgcagtgacacatctcagcttaccgcatcctcctcctcccaggtttaagtgattctcctacctcagcctcccaagcagctgggatttcaggtgcccaccaccaagcccagctaatttttgtatttttagtagagacaggatttcaccatgttggccacgctggtctccaactcctgtcctcaagtgatctgcctgcctcagcctcccaaagtgctgsaattagaggcgtgatccaccacacctggcccttccctccaatatataagagacgctgcaaagtgaaacaataataaggaaggcaaaatgtgcttaagaacctggcaagataagggaactagcatctcttaagtgccattgtattatctcatttaatcttaatggccatcccatgggtctgatattatttttcccatgtaaaacctaaataaatgaatatcggctgtggtttagtaatttgcccagtctcatccttctaattaatgatggaactaactaaaagtaggctctttactgccat

SEQ ID NO: 88149 - DNA, 601 bp, Human
atgtatttcttgccgaagataagatagacatttctacatcattcatatgcagcttttgtattttctgcacagcagcggcacttagagcccttggcaagcactctaggcgaggtagctgcccagtaactatggctttgtactgtgtgaggctggggaagatctttggggagagacttctgctctctggttcctcactcactaaagtggcctgcctagagccagggagttagtaaggggagacgaatacctcaccttgatctcttctgtagaattagggaatgttaacgtgtagatgccattygtggtgtgtcctgatttgaatacttcagcacagtctctgaagctgatttgttcttctttagcaacagtggggtccttagctgcttttaaaaaatagtaaggcatttaaacggagttcatgaaaagacaaagacttgttatttcaagagccaatcatttggtgagttttattactttggaattcttaagtaagcaaaaggctgtaccacttttttaacctttctagaaagtttcctttcagcctgttttcttcttaattctcaaaagattaatacttactttttggtcattaattccatgt

SEQ ID NO: 88150 - DNA, 601 bp, Human
tgacaccacttatttttcaagatgagaaaattgaggtttgtgaaagcttattgttccctgctgtgtaaatgagtttcttttactgcaaatgtttaaagggaatataaatcctaatgtttccaaccatgacctgaggctcatataatcccagagtactatatattttcatctttctgcagaatatttcagttattctgggggccatggggtgggacagtgcactggggtgggaagcttgcacttagactgagaaacatagatgaaacaatgtgatggggctgcatggttagcggctgtcccyctgcatcggtgtccatggcatccccatttcacatgcatcctctgtcccccctcttgacactcctgtccccaggccaagaacacgccaacatctggtgacagacaatggcatgcacagaattgtcatgaaaaccagatagcaaaagagattgaaaggcttagcctagagtctgttcgttgccttttcatctgcagcagactgtgttgtttgtgggtttgttcccttccttccctgttgtatggcttctagggcgttagggacattaactaattttcagggttgatttaacacagcattaat

SEQ ID NO: 88151 - DNA, 601 bp, Human
actgccagcacataaatgatttgagccatatgagtattcgctttgattccattagtgatgatgataaggttattagaacattttcttagtacttcatccaggtttttagaaaaaagaacagaggatttgtaaaaactggagtattatggttaattggactataaaacttgcagagaaagatagtgttcaaatagagttatctacccagccagaagatactgagtaaaagtgctgaaattgattatatcaggatcagcaaagcagaagtcctcagatacttcccaagaccttaccactccarttacaacaaacctaagggcagttaatatctttaatctgtccactggtgcacggtgcaggaacctgatatctttctataaagcttgatgtttttcagcaaataatacttgacttgcttcaactctgaggcaatgattaagtgacgggttaaatagcaaaccatagagacaaccgttaggagtcaggtgtcctgtgaaatttagggaaggaaatgaccatacatgcttttgataaatgccatcttgcagtctctctctcgtagaagaaccaaatgaatttttcaaaactaaagctgcagtat

SEQ ID NO: 88152 - DNA, 601 bp, Human
ttaaatcagttcatgaataatactgcctcttatttgcctgcagtcaacaaaatggtcagtgctgctcacttctatcaatatttctttttaaaaatctatttcataaaccagctgaataagctactttggtttgaggattcatgtacatatattgaagttaattctgtatcctaaatggtatgctcttgggttgaaagcattgatgtggctcttggtgagcctatccttgttccaagaatgtttgattcttcagtgtcaaaattactgctatgaagttaccagtacttaaatacatgttctrtcttgttcagagaacaagtttatcttgttatggaagtcagaggcaaaactcttaaatgtctgagagtcactgccagcacataaatgatttgagccatatgagtattcgctttgattccattagtgatgatgataaggttattagaacattttcttagtacttcatccaggtttttagaaaaaagaacagaggatttgtaaaaactggagtattatggttaattggactataaaacttgcagagaaagatagtgttcaaatagagttatctacccagccagaagatactgagtaaaagtgc

SEQ ID NO: 88153 - DNA, 601 bp, Human
actctttttatttctgctcttaaactggctctgtgggtttaaactttgtccagaacacagaattctttcttaagctaagcgcatgcatgctcaatttcaactcagctggagttttattatgaaattaaaaacccctgaaaataagattacataaatagttttaaataataaagattacagtagaacgaaacatgttttccagaaagtaagataaattttctgccacatacaaggtaggaaatattgaagttaaggttcaaaaccaattgtaaatattcttcttgtgttgtgtcccatggtstttttgagaataatggaggcgatttggcagggtaagcttcaacgcacactgttctctgtttacgagttagaatcctaaagaggagagcgaaaagagaaccaagagagtgctattcctgttctttcatttcctacatgaggaaagaggggtgcagaggaagtgcagtggctgcctgatgcctcattgccagtgcaaccagagaactgtccctggaacagcctggtctgcaggggacttctccccagcatggttctggtctctctccaggaaggtcacccagctcgtattgccttccccagt

SEQ ID NO: 88154 - DNA, 601 bp, Human
tgtgaaggggatactctttgatcatagggtttggaggactcctgttacgttctcgtactgtggggctgtttggcttcctttatgtgcaatactaatcagattttttggttcacatctgagcacaagggccttgaggctccagtgtcctggtgcaaggtgtgtgacctgggcttggcttagcaccttggcctcaagggcatgacttcacgcttctctgtacatagctcactgcccacagtttttctctaagcaactctttttatttctgctcttaaactggctctgtgggtttaaactttgkccagaacacagaattctttcttaagctaagcgcatgcatgctcaatttcaactcagctggagttttattatgaaattaaaaacccctgaaaataagattacataaatagttttaaataataaagattacagtagaacgaaacatgttttccagaaagtaagataaattttctgccacatacaaggtaggaaatattgaagttaaggttcaaaaccaattgtaaatattcttcttgtgttgtgtcccatggtgtttttgagaataatggaggcgatttggcagggtaagcttcaacgcaca

SEQ ID NO: 88155 - DNA, 601 bp, Human
ctgtagaaaaccattgacttgtgttcacagccttgaaacctttcactaaatgccagcccctgccacctccacagagagctatgtgaaggggatactctttgatcatagggtttggaggactcctgttacgttctcgtactgtggggctgtttggcttcctttatgtgcaatactaatcagattttttggttcacatctgagcacaagggccttgaggctccagtgtcctggtgcaaggtgtgtgacctgggcttggcttagcaccttggcctcaagggcatgacttcacgcttctctgtayatagctcactgcccacagtttttctctaagcaactctttttatttctgctcttaaactggctctgtgggtttaaactttgtccagaacacagaattctttcttaagctaagcgcatgcatgctcaatttcaactcagctggagttttattatgaaattaaaaacccctgaaaataagattacataaatagttttaaataataaagattacagtagaacgaaacatgttttccagaaagtaagataaattttctgccacatacaaggtaggaaatattgaagttaaggttcaaaaccaatt

SEQ ID NO: 88156 - DNA, 601 bp, Human
catctccatcctgtagaaaaccattgacttgtgttcacagccttgaaacctttcactaaatgccagcccctgccacctccacagagagctatgtgaaggggatactctttgatcatagggtttggaggactcctgttacgttctcgtactgtggggctgtttggcttcctttatgtgcaatactaatcagattttttggttcacatctgagcacaagggccttgaggctccagtgtcctggtgcaaggtgtgtgacctgggcttggcttagcaccttggcctcaagggcatgacttcacgyttctctgtacatagctcactgcccacagtttttctctaagcaactctttttatttctgctcttaaactggctctgtgggtttaaactttgtccagaacacagaattctttcttaagctaagcgcatgcatgctcaatttcaactcagctggagttttattatgaaattaaaaacccctgaaaataagattacataaatagttttaaataataaagattacagtagaacgaaacatgttttccagaaagtaagataaattttctgccacatacaaggtaggaaatattgaagttaaggttc

SEQ ID NO: 88157 - DNA, 601 bp, Human
cataaacagtaatataatataaagtgttgatgagaatatgactcacttgtcatcatctgttccaggctaaggaccccaccctgatggctggcccagagattgctgttttttttgagattcattatgaatggcacattttggcagattggccccgaaccccacatctccatcctgtagaaaaccattgacttgtgttcacagccttgaaacctttcactaaatgccagcccctgccacctccacagagagctatgtgaaggggatactctttgatcatagggtttggaggactcctgttacrttctcgtactgtggggctgtttggcttcctttatgtgcaatactaatcagattttttggttcacatctgagcacaagggccttgaggctccagtgtcctggtgcaaggtgtgtgacctgggcttggcttagcaccttggcctcaagggcatgacttcacgcttctctgtacatagctcactgcccacagtttttctctaagcaactctttttatttctgctcttaaactggctctgtgggtttaaactttgtccagaacacagaattctttcttaagctaagcgcatgcatgctcaattt

SEQ ID NO: 88158 - DNA, 601 bp, Human
ggggttgtctaagaaacagatggtttcaaataaattgaaagtggtggattaaaatgatggtgaaacataaacagtaatataatataaagtgttgatgagaatatgactcacttgtcatcatctgttccaggctaaggaccccaccctgatggctggcccagagattgctgttttttttgagattcattatgaatggcacattttggcagattggccccgaaccccacatctccatcctgtagaaaaccattgacttgtgttcacagccttgaaacctttcactaaatgccagcccctgccacctccacagagagctatgtgaaggggatactctttgatcatagggtttggaggactcctgttacgttctcgtactgtggggctgtttggcttcctttatgtgcaatactaatcagattttttggttcacatctgagcacaagggccttgaggctccagtgtcctggtgcaaggtgtgtgacctgggcttggcttagcaccttggcctcaagggcatgacttcacgcttctctgtacatagctcactgcccacagtttttctctaagcaactctttttatttctgctcttaaactggctct

SEQ ID NO: 88159 - DNA, 601 bp, Human
gggtataagtgacagagcccccccactccccccttacgtagcagaagcaggaggaatgtagaccctgagtgcaggactcagccgagagggttctctgggatataaggcacggagtagaccatcggggttgtctaagaaacagatggtttcaaataaattgaaagtggtggattaaaatgatggtgaaacataaacagtaatataatataaagtgttgatgagaatatgactcacttgtcatcatctgttccaggctaaggaccccaccctgatggctggcccagagattgctgtttttttwgagattcattatgaatggcacattttggcagattggccccgaaccccacatctccatcctgtagaaaaccattgacttgtgttcacagccttgaaacctttcactaaatgccagcccctgccacctccacagagagctatgtgaaggggatactctttgatcatagggtttggaggactcctgttacgttctcgtactgtggggctgtttggcttcctttatgtgcaatactaatcagattttttggttcacatctgagcacaagggccttgaggctccagtgtcctggtgcaaggtgtg

SEQ ID NO: 88160 - DNA, 601 bp, Human
gacaatttagggtccttcccaaaggaaaatggattttaaataggtcagttattagacactaagctgctgctggaagaaaacttgtattaggataatgagaactacttggggagccaccagcagaagccttggcataaacagctcagttcatgggaatgtgaagcaccattaaacagtcggcttaccaaaaaaatgctgagtccacctttaaaaataagctaagtagtggcagccttgtttatttgagagtcttactctgttgcccaggctggagcgcagtggtgtgatcttggctgactgyaccctctgcctcccaggttcaagcgattctcctgcctcagcctcctgagtagctgggattacaggtgtgcaccaccacacctggctaatatttgtatttttagtagatacagagttttgttatgttggccaactggtgtcaaactcctgacctcaggtaatccatctgcctcggcctcccaaagtgctgggattacaggcgtgagccagcacgtctggctgcagcttttgttttggtacagttgaccttatattggccattctttaaaggggagactgaagcaccaattttaaaaaccat

SEQ ID NO: 88161 - DNA, 601 bp, Human
atagcagaaattccttctggtgctgtgacaatttagggtccttcccaaaggaaaatggattttaaataggtcagttattagacactaagctgctgctggaagaaaacttgtattaggataatgagaactacttggggagccaccagcagaagccttggcataaacagctcagttcatgggaatgtgaagcaccattaaacagtcggcttaccaaaaaaatgctgagtccacctttaaaaataagctaagtagtggcagccttgtttatttgagagtcttactctgttgcccaggctggagygcagtggtgtgatcttggctgactgtaccctctgcctcccaggttcaagcgattctcctgcctcagcctcctgagtagctgggattacaggtgtgcaccaccacacctggctaatatttgtatttttagtagatacagagttttgttatgttggccaactggtgtcaaactcctgacctcaggtaatccatctgcctcggcctcccaaagtgctgggattacaggcgtgagccagcacgtctggctgcagcttttgttttggtacagttgaccttatattggccattctttaaaggggag

SEQ ID NO: 88162 - DNA, 601 bp, Human
agtaagcctcattcccttcccagtctttaaggtgtattttaagcacatagcgttgctgattagtcagttgcgaaacaaactcatttcccagccaatattctcctgaagggttaccaaatccctgtaatgcaagttgttaaattcaattatttcatgtaattttttctttgtatatttgaagtggatagtccgtcaacttaacatagaataactatcaaatagcagaaattccttctggtgctgtgacaatttagggtccttcccaaaggaaaatggattttaaataggtcagttattagayactaagctgctgctggaagaaaacttgtattaggataatgagaactacttggggagccaccagcagaagccttggcataaacagctcagttcatgggaatgtgaagcaccattaaacagtcggcttaccaaaaaaatgctgagtccacctttaaaaataagctaagtagtggcagccttgtttatttgagagtcttactctgttgcccaggctggagcgcagtggtgtgatcttggctgactgtaccctctgcctcccaggttcaagcgattctcctgcctcagcctcctgagtagctgg

SEQ ID NO: 88163 - DNA, 601 bp, Human
cacaatcctcccctgggcagcctgctcaaggactttaacattgtgtctcctttcagactgttcaggtcgtggagcggagtgtctgacttgggcattaatgagatgaagatgagactgtaggtcagatgatgactgtttttgtgatgttcgtgttgaccttcatttgctaatttctgacctcaaagtgggtatttcataatgtgtgctccatgatcacgaggcgccagcagtctgtgctctttagactcctttaggctggcgttggtgccagtgggcacacagtctcacgtctttgcccctmccgttgcacacacatttcggagtgcctctatgtgccttgtgtaccagcattactgtgcatgtggcttcaccgtacttatcttgcacactaggttgtcaagtcccattgctgttctctctctctactctcatggcattttagaggcagaaagtaaattcccagtcaaggttgcccatgctattacttatgattattgctaccaaatgggtgaggacaaggtaaacacccagggaatgctgtgaatctgatgtatttcctgtagaggagagcagagttgactaaccatcccacctaactctg

SEQ ID NO: 88164 - DNA, 601 bp, Human
ctgcccaccacaatcctcccctgggcagcctgctcaaggactttaacattgtgtctcctttcagactgttcaggtcgtggagcggagtgtctgacttgggcattaatgagatgaagatgagactgtaggtcagatgatgactgtttttgtgatgttcgtgttgaccttcatttgctaatttctgacctcaaagtgggtatttcataatgtgtgctccatgatcacgaggcgccagcagtctgtgctctttagactcctttaggctggcgttggtgccagtgggcacacagtctcacgtctytgcccctaccgttgcacacacatttcggagtgcctctatgtgccttgtgtaccagcattactgtgcatgtggcttcaccgtacttatcttgcacactaggttgtcaagtcccattgctgttctctctctctactctcatggcattttagaggcagaaagtaaattcccagtcaaggttgcccatgctattacttatgattattgctaccaaatgggtgaggacaaggtaaacacccagggaatgctgtgaatctgatgtatttcctgtagaggagagcagagttgactaaccatcccacc

SEQ ID NO: 88165 - DNA, 601 bp, Human
cgtgctgcccaccacaatcctcccctgggcagcctgctcaaggactttaacattgtgtctcctttcagactgttcaggtcgtggagcggagtgtctgacttgggcattaatgagatgaagatgagactgtaggtcagatgatgactgtttttgtgatgttcgtgttgaccttcatttgctaatttctgacctcaaagtgggtatttcataatgtgtgctccatgatcacgaggcgccagcagtctgtgctctttagactcctttaggctggcgttggtgccagtgggcacacagtctcacktctttgcccctaccgttgcacacacatttcggagtgcctctatgtgccttgtgtaccagcattactgtgcatgtggcttcaccgtacttatcttgcacactaggttgtcaagtcccattgctgttctctctctctactctcatggcattttagaggcagaaagtaaattcccagtcaaggttgcccatgctattacttatgattattgctaccaaatgggtgaggacaaggtaaacacccagggaatgctgtgaatctgatgtatttcctgtagaggagagcagagttgactaaccatcc

SEQ ID NO: 88166 - DNA, 601 bp, Human
atactgggcattgtagagttttcagttggttgttcaggcaacttgacatttagccgcttctccgtgctgcccaccacaatcctcccctgggcagcctgctcaaggactttaacattgtgtctcctttcagactgttcaggtcgtggagcggagtgtctgacttgggcattaatgagatgaagatgagactgtaggtcagatgatgactgtttttgtgatgttcgtgttgaccttcatttgctaatttctgacctcaaagtgggtatttcataatgtgtgctccatgatcacgaggcgccascagtctgtgctctttagactcctttaggctggcgttggtgccagtgggcacacagtctcacgtctttgcccctaccgttgcacacacatttcggagtgcctctatgtgccttgtgtaccagcattactgtgcatgtggcttcaccgtacttatcttgcacactaggttgtcaagtcccattgctgttctctctctctactctcatggcattttagaggcagaaagtaaattcccagtcaaggttgcccatgctattacttatgattattgctaccaaatgggtgaggacaaggtaaacac

SEQ ID NO: 88167 - DNA, 601 bp, Human
atctttccataatgagaatagtgaatatgcttcactgatgtttaaagagtcacatccatgtatatctgtttctcaaacatgcttctgaattttcatccactgtttgtacagcaggacatactgggcattgtagagttttcagttggttgttcaggcaacttgacatttagccgcttctccgtgctgcccaccacaatcctcccctgggcagcctgctcaaggactttaacattgtgtctcctttcagactgttcaggtcgtggagcggagtgtctgacttgggcattaatgagatgaagaygagactgtaggtcagatgatgactgtttttgtgatgttcgtgttgaccttcatttgctaatttctgacctcaaagtgggtatttcataatgtgtgctccatgatcacgaggcgccagcagtctgtgctctttagactcctttaggctggcgttggtgccagtgggcacacagtctcacgtctttgcccctaccgttgcacacacatttcggagtgcctctatgtgccttgtgtaccagcattactgtgcatgtggcttcaccgtacttatcttgcacactaggttgtcaagtcccattgc

SEQ ID NO: 88168 - DNA, 601 bp, Human
ttgcagttatgagaagtttcagtcccttcacagttctcttatcatgctagcatcatgttttattaggataataattttcgatgtaatatctattttatcttgccaagcaaattaagctttaaaccaatgtgtgtgtttttctaaatggcctatccaaaaattgattgcatttctaaaggaaatatctgttaagaaccatctcagtttaaaatatttttataatgtcagcgtacaagggtaatgacccattttgtaaaaatctttttatacaaacagcctaatccttaatttttgtgcttcttttttttttttttttaattcttctgttgtagattcctaactgttgccagttgaaaaaatatttaacttggaggtaaaacactgaccaaccacttgtgtctcaaaattcattgaagttttgatctctttggagtcaagttggaactgctgtgaggcccaaacacctatcttctcattcatctcggttgttgcctctccaggagagcctgatctttccataatgagaatagtgaatatgcttcactgatgtttaaagagtcacatccatgtatatctgtttctcaaacatgcttctgaattt

SEQ ID NO: 88169 - DNA, 601 bp, Human
cccttacatgctgcatacaactggcgtctcaaagcatttgcagttatgagaagtttcagtcccttcacagttctcttatcatgctagcatcatgttttattaggataataattttcgatgtaatatctattttatcttgccaagcaaattaagctttaaaccaatgtgtgtgtttttctaaatggcctatccaaaaattgattgcatttctaaaggaaatatctgttaagaaccatctcagtttaaaatatttttataatgtcagcgtacaagggtaatgacccattttgtaaaaatcttyttatacaaacagcctaatccttaatttttgtgcttcttttttttttttttttaattcttctgttgtagattcctaactgttgccagttgaaaaaatatttaacttggaggtaaaacactgaccaaccacttgtgtctcaaaattcattgaagttttgatctctttggagtcaagttggaactgctgtgaggcccaaacacctatcttctcattcatctcggttgttgcctctccaggagagcctgatctttccataatgagaatagtgaatatgcttcactgatgtttaaagagtcacat

SEQ ID NO: 88170 - DNA, 601 bp, Human
cacttggggaacatttcttctgggaaaaaaaaatcccttacatgctgcatacaactggcgtctcaaagcatttgcagttatgagaagtttcagtcccttcacagttctcttatcatgctagcatcatgttttattaggataataattttcgatgtaatatctattttatcttgccaagcaaattaagctttaaaccaatgtgtgtgtttttctaaatggcctatccaaaaattgattgcatttctaaaggaaatatctgttaagaaccatctcagtttaaaatatttttataatgtcagcrtacaagggtaatgacccattttgtaaaaatctttttatacaaacagcctaatccttaatttttgtgcttcttttttttttttttttaattcttctgttgtagattcctaactgttgccagttgaaaaaatatttaacttggaggtaaaacactgaccaaccacttgtgtctcaaaattcattgaagttttgatctctttggagtcaagttggaactgctgtgaggcccaaacacctatcttctcattcatctcggttgttgcctctccaggagagcctgatctttccataatgagaatag

SEQ ID NO: 88171 - DNA, 601 bp, Human
tctattgatgcatttatgcatttcttataacatgtatattccagttttccaacacttggggaacatttcttctgggaaaaaaaaatcccttacatgctgcatacaactggcgtctcaaagcatttgcagttatgagaagtttcagtcccttcacagttctcttatcatgctagcatcatgttttattaggataataattttcgatgtaatatctattttatcttgccaagcaaattaagctttaaaccaatgtgtgtgtttttctaaatggcctatccaaaaattgattgcatttctaaargaaatatctgttaagaaccatctcagtttaaaatatttttataatgtcagcgtacaagggtaatgacccattttgtaaaaatctttttatacaaacagcctaatccttaatttttgtgcttcttttttttttttttttaattcttctgttgtagattcctaactgttgccagttgaaaaaatatttaacttggaggtaaaacactgaccaaccacttgtgtctcaaaattcattgaagttttgatctctttggagtcaagttggaactgctgtgaggcccaaacacctatcttctcattc

SEQ ID NO: 88172 - DNA, 601 bp, Human
taaatactcatctctgttgggattttgaaacactgtactttctttccattgtcttcccattaatcatagacaggattgagatgaaccacttcccttgcttatcttttaactctctcttgtctcctttgaacatgtttagttctcatggaacttgttaaattatccccagaggcaagaaaaataagggagaatactattttttatgagtctctgttagaaaggttttgtgtaattttaggtccttttgtggcccactggtttaaagtgctttctttaaaatttggttattaagaatggccaygttcttgaagttgctttacattggtatgggttgattttttttttcaatctctgcagctttgccagggatgattttatataacagtggagtaaagaggtaacatcaacattaacaattaaacctcagtgttatataaaactgccagaatgtgtgtgaaaagtgatgaatttttaagatttaatgtacgcatagcttttagttttactagaaagaatgaaattctattgatgcatttatgcatttcttataacatgtatattccagttttccaacacttggggaacatttcttctgggaaaa

SEQ ID NO: 88173 - DNA, 601 bp, Human
tttgttttggcactgaaagtcactgaggttcagagatataaacttgtccgaggtcagactcttaagtcatggaggtaggatttgcaccagatgcagcaaatgcctctgccatgtttcaacactggtgcacacctaaacagagatgtttgtttgttgaagaagttgtgaaaagatgagggtagggccatgtgatgtggagttctgtaagtgttgctcctaagtgacttcagtattaaggcagccctagaaacttcatcctaaggcatgaactggacatgtgagtctcagtattttcccacaygtttcaaaagtgagactggccgtagctcagtctctaaatgcctgctgcaaaatgctaatgtcataaatactcatctctgttgggattttgaaacactgtactttctttccattgtcttcccattaatcatagacaggattgagatgaaccacttcccttgcttatcttttaactctctcttgtctcctttgaacatgtttagttctcatggaacttgttaaattatccccagaggcaagaaaaataagggagaatactattttttatgagtctctgttagaaaggttttgtgtaatttta

SEQ ID NO: 88174 - DNA, 601 bp, Human
atgttcttttagttttacctgctggtcgggccaggccaggtgcttacacctgcatgcacactggatgcttataaccacctgcagtggtggccgccatctttgttttggcactgaaagtcactgaggttcagagatataaacttgtccgaggtcagactcttaagtcatggaggtaggatttgcaccagatgcagcaaatgcctctgccatgtttcaacactggtgcacacctaaacagagatgtttgtttgttgaagaagttgtgaaaagatgagggtagggccatgtgatgtggagttcygtaagtgttgctcctaagtgacttcagtattaaggcagccctagaaacttcatcctaaggcatgaactggacatgtgagtctcagtattttcccacacgtttcaaaagtgagactggccgtagctcagtctctaaatgcctgctgcaaaatgctaatgtcataaatactcatctctgttgggattttgaaacactgtactttctttccattgtcttcccattaatcatagacaggattgagatgaaccacttcccttgcttatcttttaactctctcttgtctcctttgaacatgtttag

SEQ ID NO: 88175 - DNA, 601 bp, Human
ctttgtaaaacctgctaatgtttgcaagctgccacattggaataatataatttctaacagtttgtattggaagaatacaaagaagagagaaaatgttcttttagttttacctgctggtcgggccaggccaggtgcttacacctgcatgcacactggatgcttataaccacctgcagtggtggccgccatctttgttttggcactgaaagtcactgaggttcagagatataaacttgtccgaggtcagactcttaagtcatggaggtaggatttgcaccagatgcagcaaatgcctctgccrtgtttcaacactggtgcacacctaaacagagatgtttgtttgttgaagaagttgtgaaaagatgagggtagggccatgtgatgtggagttctgtaagtgttgctcctaagtgacttcagtattaaggcagccctagaaacttcatcctaaggcatgaactggacatgtgagtctcagtattttcccacacgtttcaaaagtgagactggccgtagctcagtctctaaatgcctgctgcaaaatgctaatgtcataaatactcatctctgttgggattttgaaacactgtactttctttcc

SEQ ID NO: 88176 - DNA, 601 bp, Human
atgttggcacgttgggtcctcacgtcctgatggagaaacaggcacacgaagacccaggcgaggagcctacaaagcaaatcctgcaatggtggcaggagaagtgtacttgaagcaccaagatgatgcccttctttgtaaaacctgctaatgtttgcaagctgccacattggaataatataatttctaacagtttgtattggaagaatacaaagaagagagaaaatgttcttttagttttacctgctggtcgggccaggccaggtgcttacacctgcatgcacactggatgcttataaccacstgcagtggtggccgccatctttgttttggcactgaaagtcactgaggttcagagatataaacttgtccgaggtcagactcttaagtcatggaggtaggatttgcaccagatgcagcaaatgcctctgccatgtttcaacactggtgcacacctaaacagagatgtttgtttgttgaagaagttgtgaaaagatgagggtagggccatgtgatgtggagttctgtaagtgttgctcctaagtgacttcagtattaaggcagccctagaaacttcatcctaaggcatgaactggacatgtga

SEQ ID NO: 88177 - DNA, 601 bp, Human
aattccattctacagaagcgtgttctgtactcgttaatggactaatgcatactctggacaaaatattttgcactggtataaacaggaaccaacttatcatcaaatccttcagcaaagagggatgttttcatgaaaccttcaacacatatcacttgcacaactatcagaagcgactgtagagccctgtaatttattttcctgctgctttcagataaacagaagagaaagaaatgcagcaccaggctcctcctcccaggtctccagtcatcttccatagagacggagtcctgagacaactggrcaacctcaaacattattttccgcagggggccccgggggggatggagaatgcagcagacaaggaatggccactgagtttggggaagaaatctacagaacggtgctgaaaataaatccttgtggctacatttcctcatgtctgtatagtagggtaatgtaattaaacttttagacattgagaaaggaacaaatgtcggagtaagttagacactatttacaatacagacgatccctgacttcccatggggctatgttctgataagcccattttctgttgaaaatgttgtatattgaaaatgca

SEQ ID NO: 88178 - DNA, 601 bp, Human
agtttgcgtgttctattcagaatccttcacatattcaggactttgacagattcataggtcagtgccttctggagcttgtccaactagagaagttgctgtccatgcaaaatggagctgctcattaggctggttcattcatggtccagaccactggctggaatttgacctcttcacaggcaagaccactccactttctctcttgggctgtttttcctctccccagtctcttttccaattacattctcagtccctaaatcttgatttgcgtaagtaaatatattgtttccttggttattaatgmaattctcctactctcctgagaagctcagcacatacgggtggtctaataagcacacccttctcaaggagagagctgggtccagcatgtggggaaatggtagacaggaaacaaagtcctaggtgtctgtggctcctccacctgaccctttccctgctgttcagctttaaaaaggatgattgtgccaggatgaaggaaacaggaagcttttgcaaaatcaataggagggctttgctcattggtgtaataatggtgtaacatagggaggacctgtggtaccaaatagtagtcatattatctcag

SEQ ID NO: 88179 - DNA, 601 bp, Human
ttcatttgattcaggtgaatgcagattggacggaagtttgcgtgttctattcagaatccttcacatattcaggactttgacagattcataggtcagtgccttctggagcttgtccaactagagaagttgctgtccatgcaaaatggagctgctcattaggctggttcattcatggtccagaccactggctggaatttgacctcttcacaggcaagaccactccactttctctcttgggctgtttttcctctccccagtctcttttccaattacattctcagtccctaaatcttgatttgcstaagtaaatatattgtttccttggttattaatgaaattctcctactctcctgagaagctcagcacatacgggtggtctaataagcacacccttctcaaggagagagctgggtccagcatgtggggaaatggtagacaggaaacaaagtcctaggtgtctgtggctcctccacctgaccctttccctgctgttcagctttaaaaaggatgattgtgccaggatgaaggaaacaggaagcttttgcaaaatcaataggagggctttgctcattggtgtaataatggtgtaacatagggagga

SEQ ID NO: 88180 - DNA, 601 bp, Human
tctttatatatgtatatataaaaacatgcatattctttatatatgtatatataaaaacatgcatattctttatatatgtatatataaaaacatacatattctttatatatgtatatataaaaacatacatattctttatatatgtatatataaaaacatacatattctttatatatgtatatataaaaacatatacatattctttatatatgtatatatataaaaacatatatatattctttatatatatatatgttgtgtttatacattggtttgttatttcatccaggttcctacattstttcttggtggtaacagctcagtgacttcatttgattcaggtgaatgcagattggacggaagtttgcgtgttctattcagaatccttcacatattcaggactttgacagattcataggtcagtgccttctggagcttgtccaactagagaagttgctgtccatgcaaaatggagctgctcattaggctggttcattcatggtccagaccactggctggaatttgacctcttcacaggcaagaccactccactttctctcttgggctgtttttcctctccccagtctcttttccaattaca

SEQ ID NO: 88181 - DNA, 601 bp, Human
atatatatattctttatatatgtatatataaaaacatgcatattctttatatatgtatatataaaaacatgcatattctttatatatgtatatataaaaacatacatattctttatatatgtatatataaaaacatacatattctttatatatgtatatataaaaacatacatattctttatatatgtatatataaaaacatatacatattctttatatatgtatatatataaaaacatatatatattctttatatatatatatgttgtgtttatacattggtttgttatttcatccaggwtcctacattgtttcttggtggtaacagctcagtgacttcatttgattcaggtgaatgcagattggacggaagtttgcgtgttctattcagaatccttcacatattcaggactttgacagattcataggtcagtgccttctggagcttgtccaactagagaagttgctgtccatgcaaaatggagctgctcattaggctggttcattcatggtccagaccactggctggaatttgacctcttcacaggcaagaccactccactttctctcttgggctgtttttcctctccccagtctcttt

SEQ ID NO: 88182 - DNA, 601 bp, Human
atagaatgtatattctttatgtatatatggaatatatatattctttatatatttatatgtgaatgtatatattctttatatctatttatatatagaatatatatactttacatatatagaatatatgtattctttattacgtatatatattctatatatattctatatatattctttatatatacgtatatatattctatatatattctttatatatacgtatatatagaatatatatattctttatatatgtatatataaaaacatgcatattctttatatatgtatatataaaaacatrcatattctttatatatgtatatataaaaacatacatattctttatatatgtatatataaaaacatacatattctttatatatgtatatataaaaacatacatattctttatatatgtatatataaaaacatatacatattctttatatatgtatatatataaaaacatatatatattctttatatatatatatgttgtgtttatacattggtttgttatttcatccaggttcctacattgtttcttggtggtaacagctcagtgacttcatttgattcaggtgaatgcagattggacgga

SEQ ID NO: 88183 - DNA, 601 bp, Human
gaaatattctataagcaggggccgggcgcagtggctcacgcctgtaatcccagcactttgggaggccgaggtgggtggatcacgagatcaggagaccgagaccatcctggctaacacggtgaaaccccgtctctactaaaaatacaaaaaattagccgggcgtggtggcggacgcctgtattcccagctactcgggaggctgaggcaggagaatggcgtgaacccgggaggcggagcttgcagtgagccgagatcgcgccactgcactccagcctgggcgacagagtgagactccagctcaaaaaaaaaaaaaaaaaaaagaatgtataaaccttaaattgcatgccgttctgagtaacgggataaaatctcctgatgcccacttcatccctcccagaacatgaataatctcctctatccagtggatccacgctgtctacatccggtctcctgatcacttagtagctgtcttggttattagatcgattgtcacagtatcgcagtgcttatgttcaagtaacgcttatttgacttaataatggccccaaaagtgcaagagtgatgatgctggcaattcagatatgtcaaagagaagctgtaa

SEQ ID NO: 88184 - DNA, 601 bp, Human
ccccttatctgctatttttgctttctgcactttcagatacctgaagtcagctgggccaaaaatattaaatggaaaaatctagaaatattctataagcaggggccgggcgcagtggctcacgcctgtaatcccagcactttgggaggccgaggtgggtggatcacgagatcaggagaccgagaccatcctggctaacacggtgaaaccccgtctctactaaaaatacaaaaaattagccgggcgtggtggcggacgcctgtattcccagctactcgggaggctgaggcaggagaatggcgtsaacccgggaggcggagcttgcagtgagccgagatcgcgccactgcactccagcctgggcgacagagtgagactccagctcaaaaaaaaaaaaaaaaaaaagaatgtataaaccttaaattgcatgccgttctgagtaacgggataaaatctcctgatgcccacttcatccctcccagaacatgaataatctcctctatccagtggatccacgctgtctacatccggtctcctgatcacttagtagctgtcttggttattagatcgattgtcacagtatcgcagtgcttatgttcaagtaa

SEQ ID NO: 88185 - DNA, 601 bp, Human
tgtgagagaaagaaacacagtagtccccccttatctgctatttttgctttctgcactttcagatacctgaagtcagctgggccaaaaatattaaatggaaaaatctagaaatattctataagcaggggccgggcgcagtggctcacgcctgtaatcccagcactttgggaggccgaggtgggtggatcacgagatcaggagaccgagaccatcctggctaacacggtgaaaccccgtctctactaaaaatacaaaaaattagccgggcgtggtggcggacgcctgtattcccagctactcrggaggctgaggcaggagaatggcgtgaacccgggaggcggagcttgcagtgagccgagatcgcgccactgcactccagcctgggcgacagagtgagactccagctcaaaaaaaaaaaaaaaaaaaagaatgtataaaccttaaattgcatgccgttctgagtaacgggataaaatctcctgatgcccacttcatccctcccagaacatgaataatctcctctatccagtggatccacgctgtctacatccggtctcctgatcacttagtagctgtcttggttattagatcgattgtcaca

SEQ ID NO: 88186 - DNA, 601 bp, Human
gcatgctggggtttgtgagagaaagaaacacagtagtccccccttatctgctatttttgctttctgcactttcagatacctgaagtcagctgggccaaaaatattaaatggaaaaatctagaaatattctataagcaggggccgggcgcagtggctcacgcctgtaatcccagcactttgggaggccgaggtgggtggatcacgagatcaggagaccgagaccatcctggctaacacggtgaaaccccgtctctactaaaaatacaaaaaattagccgggcgtggtggcggacgcctgtaktcccagctactcgggaggctgaggcaggagaatggcgtgaacccgggaggcggagcttgcagtgagccgagatcgcgccactgcactccagcctgggcgacagagtgagactccagctcaaaaaaaaaaaaaaaaaaaagaatgtataaaccttaaattgcatgccgttctgagtaacgggataaaatctcctgatgcccacttcatccctcccagaacatgaataatctcctctatccagtggatccacgctgtctacatccggtctcctgatcacttagtagctgtcttggttattag

SEQ ID NO: 88187 - DNA, 601 bp, Human
agctaaagccagggcaggagaggtgtccagcacaggggctgtgggagtgaagccccatctgcaccttaatttctgggcttggccaaaaacaggagcatgctggggtttgtgagagaaagaaacacagtagtccccccttatctgctatttttgctttctgcactttcagatacctgaagtcagctgggccaaaaatattaaatggaaaaatctagaaatattctataagcaggggccgggcgcagtggctcacgcctgtaatcccagcactttgggaggccgaggtgggtggatcacgagrtcaggagaccgagaccatcctggctaacacggtgaaaccccgtctctactaaaaatacaaaaaattagccgggcgtggtggcggacgcctgtattcccagctactcgggaggctgaggcaggagaatggcgtgaacccgggaggcggagcttgcagtgagccgagatcgcgccactgcactccagcctgggcgacagagtgagactccagctcaaaaaaaaaaaaaaaaaaaagaatgtataaaccttaaattgcatgccgttctgagtaacgggataaaatctcctgatgcccacttca

SEQ ID NO: 88188 - DNA, 601 bp, Human
ctcaggctccccttgctctattaaatgattttttcggttgaagtttaaactaaaatattaagtactcagtggagctacataaaaaggaagtctctatgtttcagagacaaaaaggaaatttaaagtgagagtgtgtgctcgctcagctaaagccagggcaggagaggtgtccagcacaggggctgtgggagtgaagccccatctgcaccttaatttctgggcttggccaaaaacaggagcatgctggggtttgtgagagaaagaaacacagtagtccccccttatctgctatttttgcttkctgcactttcagatacctgaagtcagctgggccaaaaatattaaatggaaaaatctagaaatattctataagcaggggccgggcgcagtggctcacgcctgtaatcccagcactttgggaggccgaggtgggtggatcacgagatcaggagaccgagaccatcctggctaacacggtgaaaccccgtctctactaaaaatacaaaaaattagccgggcgtggtggcggacgcctgtattcccagctactcgggaggctgaggcaggagaatggcgtgaacccgggaggcggagcttgcag

SEQ ID NO: 88189 - DNA, 601 bp, Human
gttgaagcctctaatcctgtaagggctgctttggcccaagaggccttagaaacccggtgtaagcctcaatcggtagccggtctggcctctttctcacacttaaccgacacagctcttgctctgatctcatcccaagtcatctcgctggaggacaattaactcggcttcaaaatggccctcagcctggagccaagatttaggagcaagaccgtctagttgggagagaagatgtttttggagagttgaagacttcttgaaaaagttcgaaaagttcttgaaaaagcaaaggatgcttctttcsgtctgggagagggaaaacctctcccagggcaaaaggaactaagaccaggggtgggttaaaaaaaaaaaaaaaaaaacctttcactcttgtagaataagccaggagccggcgtgtggtagacttctgggcctgtttcccgacagctggtttcgtttagatttttgtgtgattaactgacatcttcctgttcctttgccacatgtatctagcaagcctcttttaccttataagggaaatcctttgtagcgtgtggaaggctttgattgcaggaaggggtggaacccaaaatgactcggccgt

SEQ ID NO: 88190 - DNA, 601 bp, Human
taggaggagttaagatctaggcaattaaaaagaatgaaaggcacccattcatgggaaggcctcagtgacgtttcttaagacagtttcatcagtggttttcacaattctctgcatttggtgtttcagaggacactgcaatacgaaacacctgtgggagtgccctctttctgcttctaggaatctgaggctgagaaaccttcctgactctatttgtgtagtttttcggccacgttagcctcattctatttttttttcccccagtatgaactcagggcaggagagggagtggtttcctaataattttttttttttgagacggaatcttgctctgttacccaggctggagtgcagtggcgcgatctcggctcattgcaaccttcacctcccgggttcaagcgattctcctgcctcagcctcccaagtagctgggattacaggcgcctgcccccacacccaactgatttttttgtatttttagtagagatgcggtttcaccatgttggccaggctggtctcgaactcctgacctcatgtgatccacccacctccgcctcccaaagtgttaggattacggatgtgagccaccgcgcccggccttcct

SEQ ID NO: 88191 - DNA, 601 bp, Human
ttgtgttgctggagagaccagcactgacattcatctcaaagcacatggtatgtttgactcctatgttgactcaactacccatcttgtactgggacactcgctttttttttttttttttgagacggagtcttgctctgtcaccaggctggagtgcagtggcacgatctcagctcacggcaacctccgcctcccgggttcaagtgattcttctgcctcagcctcctgagcatgtggaactacaggcacgtgccaccacactcagctaatttttctatttttagtagagacagggtttcaccaygttggccaggatggtctcgatctcttgaccttgtgatacacccacctcagcctcccaaagtgctgggattacaggcatgagccaccacgcttggcgatgctcatcttttgctatggagtggtagatgtttttcccagacattttccgggaagatcatactgaaattttggtatgagtgtaaattccctatggcctggactcctgggtgggctttgacggggaagatcaggttaacagagggcaggacatgggggaggctcccactggtggctggcctgatacttcttaacatggctgcac

SEQ ID NO: 88192 - DNA, 601 bp, Human
cctcctgagcatgtggaactacaggcacgtgccaccacactcagctaatttttctatttttagtagagacagggtttcaccacgttggccaggatggtctcgatctcttgaccttgtgatacacccacctcagcctcccaaagtgctgggattacaggcatgagccaccacgcttggcgatgctcatcttttgctatggagtggtagatgtttttcccagacattttccgggaagatcatactgaaattttggtatgagtgtaaattccctatggcctggactcctgggtgggctttgacrgggaagatcaggttaacagagggcaggacatgggggaggctcccactggtggctggcctgatacttcttaacatggctgcacctccgacctccccaggctgaaggtgatgtggccgccctcaaccgacgcatccagctcgttgaggaggagttggacagggctcaggaacgactggccacggccctgcagaagctggaggaggcagaaaaagctgcagatgagagtgagaggtaaggacgctttgaatctggtggcatccgtgtttgcttttagaaaatggggatcatgctgccgacctc

SEQ ID NO: 88193 - DNA, 601 bp, Human
ggctcatgcctgtaatcccagcactttgggaggccaaggcggacggatcacctgaggttgggagtttgagaccagcctggccaacatggtgaaaccccgtctttcctaaaagtacaaaaaaattagcctgccatggtggcgggcacctgtaatcccagctactcaggaggctgaggcaagagaatctcttgaacccaggaggcagaggctgcagtgagccgagatcgtgccattgcactccagcctgggcaacaagagcaaaactccatctcaaaataaagtgaggggtgtttatccttayggtaaccatgaaaagaaacttccgacagacagaaaggcaaacagaacgggcagatgtgagactgcaagtatgactgtccatggtggtcagtttgcaaagcactgcttctcgtattttctctgaaagccacagtgcctcttagtgttctctagacaccaaatttcaggtaggccggatgcagtgattcctgcctgtgctcccagcactttgggaggcagaggcgggcaaatcgcctgagctcaggagttcaagaccaactggggcaatgtggtgagaccctgtctctacaaaaaatacaaa

SEQ ID NO: 88194 - DNA, 601 bp, Human
ccagcttgaacccaggaggcagagggtgcagtgagccaagatcgcaccactgcactccagcctgggcaacagagtgagactctgtctcaaaaagaaactgaccacgttcctcacccgcccatggtatctgtgctgcaacccagccaccagtagggtgccttctcctcggtagccagatcattctctggcacgccttggcacaggctctctggaagactgagggtagattgtgtaattcacagaagcagcagtctgtgtgtggtggaaaaggagttccttgtgtggcaatggtgtgggcccraccagtgatcatcgcgtctgcccctcattcacaccggagttctcacttgagccagccaccatgcttttgcagtataaacacctcccaaagattcatttctttttttttttttttttttgagacagggtcttactctatcacccaggctggaatgtagtggtgcgatcacagctcactgcagcctcgacctcctgggctcaagcgatcctcccgccacggcctccagagttccagagtaaagctgggactacaggcgcatgccatcatgcccagctaatttttttttgagacagagtctcg

SEQ ID NO: 88195 - DNA, 601 bp, Human
cccagctaatttttttttgagacagagtctcgctctgtcgcccaggctggagtgcactggcgtgatctcagctcactacaagcttcacctcctgggttcacgacattctcctgcctcagcctcccaagtagctgggactacaggcacccgccaccacacccggctaatttttttgtatttttagtagagacagggtttcaccgtgttagccacgatgttctcaagctcctgaccttgtaatccacctgccttggcctcccaaagtgctggcacgcctagctaatttaagatgcatttctgrttgtgctgctgtgaccactaaccagagattagaaaccagctaaggaatcttggagattgcatgtcacccaagctggaaatttcttcccaagtagtggaacagccagggcagagggaacagacgctactgcagactctgcttcagccactgaatcaagggagagagtggcagctccggcagccacggggcagtggaaggacccagtcacgagagttcctggctgtgcctgtggcctgggttagctgctgttcacagtcagaccagcctggctggatgctgacgttgagggctcccatattg

SEQ ID NO: 88196 - DNA, 601 bp, Human
ctgcactccagcctggatgacagagcgagactccatctgaaagaaaagatagatgagaggtgggtggaggggtgtgagtgaacggccgtcctgatgagattgctccttgcagaggaatgaaggtgatagaaaaccgggccatgaaggatgaggagaagatggagattcaggagatgcagctcaaagaggccaagcacattgcggaagaggctgaccgcaaatacgaggaggtgagtggggctggcagatggcgcagcagcaggaagtgggaggaaatgcatctgctgagatagggaggacrccggggccaacgaaaggaagctctcggttaggtcagctgtcctcctgcgtgaacatatgtttgtccagagacaaccacttggctaggaaactatctcccacgatgccagaaagtgctgcggacgcttgtctaacgtaatgggaaaaccgaatgatcagctcacttgtgtcgttagctgggagttttggcacagttgggcaaaaatggaggattgtggtcccaagccatggagtttcagaccatgcaagctcaggccctcctttgcctccctcgatggctcggctcttccctcccgcctct

SEQ ID NO: 88197 - DNA, 601 bp, Human
gcactccagcctggatgacagagcgagactccatctgaaagaaaagatagatgagaggtgggtggaggggtgtgagtgaacggccgtcctgatgagattgctccttgcagaggaatgaaggtgatagaaaaccgggccatgaaggatgaggagaagatggagattcaggagatgcagctcaaagaggccaagcacattgcggaagaggctgaccgcaaatacgaggaggtgagtggggctggcagatggcgcagcagcaggaagtgggaggaaatgcatctgctgagatagggaggacacyggggccaacgaaaggaagctctcggttaggtcagctgtcctcctgcgtgaacatatgtttgtccagagacaaccacttggctaggaaactatctcccacgatgccagaaagtgctgcggacgcttgtctaacgtaatgggaaaaccgaatgatcagctcacttgtgtcgttagctgggagttttggcacagttgggcaaaaatggaggattgtggtcccaagccatggagtttcagaccatgcaagctcaggccctcctttgcctccctcgatggctcggctcttccctcccgcctcttg

SEQ ID NO: 88198 - DNA, 601 bp, Human
agaaagagctggatttctcctgcacactcttgagtcctcttccatggggtctgagcaccatctttgatctccatctcaggaggatagagatagaacatgaggctcttcttagcgagatctgagcatagttgtataaataaatacagagcctgcctctcacctgattcccctggttcctccagaaataccatctcaaaggtatagcaatgatcagaggtggaattgggctttttagtttgaaacagcacccaaagcagttgctacgtggcagctacgtcgggaacaaaggacacacttccayggccgaaccccactgaatttcccagcctcttcctcattcttgctcctgcttttgcagtttcacagacattctttgttctcccatcacctccaccccccacttttttttttttttttttgagacagagcttcgctctgttgcccaggctggaattcagtggcatgatcatagttcattgcagccttgaactcccaggctcaagcgatcctcccacctcagccaccacctgctattcactcaactgggtgtggctttccttttgcttgataaacccctattcagcctttttttttcttttct

SEQ ID NO: 88199 - DNA, 601 bp, Human
gctcttcttagcgagatctgagcatagttgtataaataaatacagagcctgcctctcacctgattcccctggttcctccagaaataccatctcaaaggtatagcaatgatcagaggtggaattgggctttttagtttgaaacagcacccaaagcagttgctacgtggcagctacgtcgggaacaaaggacacacttccatggccgaaccccactgaatttcccagcctcttcctcattcttgctcctgcttttgcagtttcacagacattctttgttctcccatcacctccaccccccacttttttttttttttttttgagacagagcttcgctctgttgcccaggctggaattcagtggcatgatcatagttcattgcagccttgaactcccaggctcaagcgatcctcccacctcagccaccacctgctattcactcaactgggtgtggctttccttttgcttgataaacccctattcagcctttttttttcttttctttttttttgagacagggtctcactctgtcacccaggctggagtgaagtggcgtgatctcagcttactgcagccttcgactcccaagttcaagcaattctcc

SEQ ID NO: 88200 - DNA, 601 bp, Human
tcccaagttcaagcaattctcccacctcagcctcccgattacacgctaatttttataatttttggtagagatgaggtttcaccacattggccaggctggtctcgaactcctgatctcaagtgatctgcccgcctcgccctcccaaagtgctgggattacaggcatgacccactgcacctggcctagagatgagatcttgctctgttgcttaggctggaagtgtagtggcgtgatcatagctcactgcaggccccaaactcctgggcttaaataatcctatcacctcagcttcctgagtagytaggacttgcaggcatgtgccactactccaaaactgtatttttttttttttttttatagagcacagtctatgttgcctaggctggtcttaaactcctggcctcaagtgatcctcccaccttagcctcccaaagtgctgggattacaggcgtgggccaccgtgcctggctaatttttctagtttttggtagagacaaggtttcatcatgttggccaggctggtcttgaactcctggcctcaagtgatcctcccaccttggcctcccaaagtgctgggattactttgggaggccgccgagcc

SEQ ID NO: 88201 - DNA, 601 bp, Human
tgtgtgtgtaattttttttttttttttttttttagtagagatggtgtttcaccatgttgcccaggctgatctcaaactcctggcctcgagtgatccacctgcctctgtctcccatatgtgccagccctggcatatatctgatactaggatgtgtaaggaatgaatccagttggtgtgtgtatgccagacactgccccgggccagggggatagatgtaacaccactaatacctcagctgctttgttttgttttgttttgagatggagccttgctctgtcgcccaggctggagtgcagaggcrcgatctcagctcactgcaacctccacctcctaggctcaagcaattctcctgcctcagcctcctgagtaactgggaatacaggcgcacacaccacgcccagctaatttttgtatttttagtagagacggagtttcaccatgttggccaggctcgtctcaaactcctgacctcaagtgatccacccacctcggcctcccaaagggctgggattacaggtgtgagccactgtgcccagcctggcatctgctcttgaagagctcagagtcgagtctagtggaagggattgacaaagtcacagag

SEQ ID NO: 88202 - DNA, 601 bp, Human
agatggggtcctgccctgttgcccaggctagagtgtagtggtccaatcagagctctctgcagccttgaattccagggttcaagccatcttccctcctcagcgtccccattagctgggactacaggtgctcaccaccatgactggctaatttttaaattctttgtagagacggggtctcactatgtgacccaggttggtctcaaattcctgggctcaagtaattctcccaccatggtcccccaaaacactggaatcacaggtgagagccaccacacccagccctccttttctttctttctgttttttttttgtttttgttgttgttgttgtttgtttttttgagatggagtcttactctgtcacccaggctggagtgcagtggcgtgatctcggctcactgcaacctccacctcccaggttcgagtgagtcttctgcctcatcctccccagtagctgggactacagctgcatgccaccaagcctggctaatttttgtatttttagtagagacggggtttcaccatgttggccaggctggtctcgaactcctgaccttgtgatccaccagcctcaggctcccaaagtgccaggattccaggca

SEQ ID NO: 88203 - DNA, 601 bp, Human
gtttgctcatttctgatagatgccttgcattttttttttacatgccttgcatttttgcagaagctctgtcccagggagctcaaagcttatcatagtatttaaaaaaaaaaacagaaatacagaaagtgtagggactgcaataaagactagtctgcaagtctggggcccacttctcccagaattttttcaagagttccagtgtttaacattcggcctcagaaattccagaatcttggggttcaaatggaatcttccaaactgcccatcccacccagaaaggacacattcttcagaccatatsttccaatgtttttttggggaagtgaggttcccatataagggaaaatgccccattccaaaatacgacctttggacagggtgacgtcattggaaatccgaaataaactgaggggtggggaccagtggggggaagctctgtcacttctggttaccactgttttgaagcttcattgtggctaatccccctgcagaacctcaaaccacttagagatcaactccatagatctttggttttcttcatctgtttcacatggaacacagctttctcctagtctgtgctttgtttgctcacgtgtttttt

SEQ ID NO: 88204 - DNA, 601 bp, Human
tcatttctgatagatgccttgcattttttttttacatgccttgcatttttgcagaagctctgtcccagggagctcaaagcttatcatagtatttaaaaaaaaaaacagaaatacagaaagtgtagggactgcaataaagactagtctgcaagtctggggcccacttctcccagaattttttcaagagttccagtgtttaacattcggcctcagaaattccagaatcttggggttcaaatggaatcttccaaactgcccatcccacccagaaaggacacattcttcagaccatatcttccartgtttttttggggaagtgaggttcccatataagggaaaatgccccattccaaaatacgacctttggacagggtgacgtcattggaaatccgaaataaactgaggggtggggaccagtggggggaagctctgtcacttctggttaccactgttttgaagcttcattgtggctaatccccctgcagaacctcaaaccacttagagatcaactccatagatctttggttttcttcatctgtttcacatggaacacagctttctcctagtctgtgctttgtttgctcacgtgtttttttcttcc

SEQ ID NO: 88205 - DNA, 601 bp, Human
attattcataataatattttatttttaaaaaattttttaataaaataataaataaagagaccaggatttaaaatcctagctctactactttaaccatgccaacgtgaacaagctgcttaggttttctgcaaaataaaggtgatatctctgttatgaggattaaatgagataatggagaaactggctcgtccaacatagtcagcattcagttaacatctattcacccagactggataggcccaggtcactgatctgtctgatagaatcctcccaggtcatagtcacttgactctgtgtgtgtgtgtgtgtgtgtgtgtgtgtgatggagtcccactctgtcacccaggctggagggcagtgacgcaatctcggctcactgcagtgtccgcctcccgggttcaagtgattctcctgcctcagcctcctgtgtagctgggattacaggtgtgcgccaccacacccggctaattttttgtatttttaagtagagatggggtttcgccatgttagccaggctggtctcgagctcttgacctcaagggatccacccaccttggcctcctaaagtgctgggattacaggtgtgagccaccatgcccag

SEQ ID NO: 88206 - DNA, 601 bp, Human
catgtccaacttcctgagtggcttatgatccactaatgttgccaaggcagcgggggactggtttgttggctctgtggcacactgtgcacccccgccacccccgtgtcatccctgacttgtccctgtgcttcttagagcctgggatggctcttgtcataagcggaaccagagcagatggctctcttctgaacagcttgcccttgattccagtagctacagcattagtctgtctttccgaatgaagatttatatttatattatggaacttgctgatgggtttctcaagttttctgcttgttayggcctgtcaacaaggctttcactctgcgttcaggtgtgtgggccttgatcattgataccatggtgtccatgagcctgttgttcacatggtgctgtcaatgagcagagaacagtcacctgcttacctgtctgttcatcttacttcatttatggtgcagttttacgtgtgactgaatatgccttcaccctcctatgatcatgtttaagtttaggttgccatgaggaggcatggcaaatgcttttgaacactttcgtacccctcatcttatgtctctccaggccctagattagtggtcatctt

SEQ ID NO: 88207 - DNA, 601 bp, Human
atggtgctgtcaatgagcagagaacagtcacctgcttacctgtctgttcatcttacttcatttatggtgcagttttacgtgtgactgaatatgccttcaccctcctatgatcatgtttaagtttaggttgccatgaggaggcatggcaaatgcttttgaacactttcgtacccctcatcttatgtctctccaggccctagattagtggtcatctttcagagaatggctagaactcgagtcttctgggatagcctactaacacgctttaccattgaggagtgtcttcaaaactcacatcatytgaattgccatgcgtctctatatgtgaaaagtaattggaaagtgtttcttgtagggggaaatgttttagggttgttgggtatcagtcctagagctgatttatgtatattttcaacttaaaaattattccatagaaatatttgtgttgccgcaggggttgttagctgggaaccccagtgtgttctgctttgcctttcaccctgtcacaggggttttcaccttgacggcacactagattcacccagaagcttttaaaaatggcagcacatggactgcatctcaagaacttctcattttggtt

SEQ ID NO: 88208 - DNA, 601 bp, Human
ggctagaactcgagtcttctgggatagcctactaacacgctttaccattgaggagtgtcttcaaaactcacatcatctgaattgccatgcgtctctatatgtgaaaagtaattggaaagtgtttcttgtagggggaaatgttttagggttgttgggtatcagtcctagagctgatttatgtatattttcaacttaaaaattattccatagaaatatttgtgttgccgcaggggttgttagctgggaaccccagtgtgttctgctttgcctttcaccctgtcacaggggttttcaccttgamggcacactagattcacccagaagcttttaaaaatggcagcacatggactgcatctcaagaacttctcattttggttgacaggggcagggtagagacgtcacaatattttaaaagctccccagccgattctaatatgtgccatgggtgaagctctaatgcattccaaattgttaggaggagtaaacagtttagagaagaggttggtaccagtgtgaagaagcatatagaagcagagcaatgcttccataggattcttgactttgtcaccctgactgccttgacctggtcacggctatgtaa

SEQ ID NO: 88209 - DNA, 601 bp, Human
ttcctttctcatgttttggctttggggctagggtaagtaccggtcaactcctgaagttttttccattcattttatcctcttattttcagattgaagaaatgtatgtgaaagcagtttttattgctttactttcaatgttttagtgcaaataaggtgaacttaaaaaagtgggtgcacaattgttctacaaataagcatttttaataatagtagagtgtgttttcttatttgaaaataagatgtttggcctggtgtggtggctcatgccagtaatcccagcactttgggaggccaagatggrtggatgacctgaggccaggagttcaagaccagcctggccaacatggtgaaacccggtctctactaaaaatacaaaaattagctggccatggtggtacatgcctgtggtcccagctacttgggaggctgaggcaggagaatcgcttgaacatgggaggcggaaattgcagtgagccgagatcatgccactgcactccagcctgggggatagagtgagactccatctcggaaaaaaaaaaaaaaaaaagaagatgttcataataatcccctaaatgatcaaatgtaagcggactcctctgtg

SEQ ID NO: 88210 - DNA, 601 bp, Human
agtattataaggcccctaatccttaggagttattagtaagagctgtctttaaagcactggcagcttttaaggttttttttttcttttgtcctacatagagcaccagaataatttcacatattactatatttttgtgtctgaaatgtcagtagaaccttctgtccaccaaagaggaacatcttgaaggagttgggctgctttatttactctgtggagggatctgttctctctggctttactttgtctaatcactacccctttgctgtcgagccccgatatttaatgagtaaacaaactcatrtaaaaccagtttggccgggctggtgactggttttaagaaagtcagtgatgatttcacggtgtttggggagcggtacccacaaacctttagagccttttacaaagactgaagagttttaagtagagttcaacctgtggacaagctggtatagaactgttgaaacaggtgaaacatgatgcttctgcttcctttcagcatctatattggaaagcgactgagcacaccctctgccagcacctactgagggaaaggaaaagcccctggaaatgcgtgtgacctgtgaagtggtgtattgtcaca

SEQ ID NO: 88211 - DNA, 601 bp, Human
agaatccatcaatactaggagtttagacaaggtctgccttctgcattgctgcattgctgtatttgctgtgcctggtgctagcctgtactgtctgctacattatttaacagagcaagctctatttccagcagctgcctacatgatctcattgtgctgttttgccagttttcctcctctgaccccgcccgggaccatgtgcctgaattgaaatgaattaattaagatgcactggaacaaaagacaacgggatgcggagtataattcttctttgtctgtagcaatttcattacttttttttttwaaaaaaaaggtttttccagatcttctccactgtaaaagctgaaaaattatccgtatcttaacacacacacacacaaaagttcctaagttagaaacaagcatcacatgaaaaggtaccaaacaaagaataaaagcccagtggaaggataatgaaatatttatttaaaacaacaaaatagtattttcatcctgagattctctacccatcacataatattcatattctttgcatccaatagaggttttcttctctgtggtctttagggctaccactttcattgtctattcgctgatgtggtgg

SEQ ID NO: 88212 - DNA, 601 bp, Human
gtctgtctgcagaatccatcaatactaggagtttagacaaggtctgccttctgcattgctgcattgctgtatttgctgtgcctggtgctagcctgtactgtctgctacattatttaacagagcaagctctatttccagcagctgcctacatgatctcattgtgctgttttgccagttttcctcctctgaccccgcccgggaccatgtgcctgaattgaaatgaattaattaagatgcactggaacaaaagacaacgggatgcggagtataattcttctttgtctgtagcaatttcattacttttttttttaaaaaaaaaggtttttccagatcttctccactgtaaaagctgaaaaattatccgtatcttaacacacacacacacaaaagttcctaagttagaaacaagcatcacatgaaaaggtaccaaacaaagaataaaagcccagtggaaggataatgaaatatttatttaaaacaacaaaatagtattttcatcctgagattctctacccatcacataatattcatattctttgcatccaatagaggttttcttctctgtggtctttagggctaccactttcattgtctattcgct

SEQ ID NO: 88213 - DNA, 601 bp, Human
accaacctcctcataatccttctcaagggcagccatgtcctcacgggcctctgaaaactcaccttcctccatcccctccccaacgtaccagtgaacaaaggcacgtttggcatacatcaggtcaaacttgtggtccaggcgagcccaggcctcagcaatggctgtggtgttgctcagcatgcacacagctctctgtaccttggccaggtctccaccaggcaccacagtgggaggctggtagttgatgccaaccttgaagccagtggggcaccaatccacaaactggatggtacgcttggtyttgatggtggcaatggcagcattgacatctttgggaaccacgtcaccacggtacaacaggcagcaagccatgtatttaccatggcgagggtcacatttcaccatctggttggctggctcaaagcaagcattggtgatctctgctacagaaagctgttcatggtaggctttctcagcagagatgacaggggcatatgtggccagagggaagtggatgcggggatagggcaccaggttggtctggaattctgtcaggtcaacattcagggctccatcaaatctcagggaagcagtgatggag

SEQ ID NO: 88214 - DNA, 601 bp, Human
tctgagcgcagtaggagattatcggcggcccagatctgggtcaagatccgatttccgttccctcaaaatcccttactgccaccacctgctcccctgaattcctaacgcagcagggagagacaggtggcctctacagactgttgtgtacgaactgtcgtaatacactggtgtagagcggtacattgacagggagctcttccgcagtcctcttattgctttcatcaaaaaaagaacactcaggttaacaggagacacgccctgtagccctagtcgcgtcgcgacccagagcgcatgcgcaaascgcagtggcggtttcccgcccaggagcggcgggaaggtaacggtcgcgcgtgcgcgcttttgtctccagctgcttcccacccccgcttttcgcgctcaagaggaagtgagggctggaagagtccgcgcgcgcgtccacccaaggcggagtaagggcatgcgctggaaaggactgcggggactcgagggaccgcacccaggacacagttacgcgacaaaagagagctccggatacggcggagggcagcccgagccccccatcccttccagagtccgagaagaaatcctggcgcccctcgac

SEQ ID NO: 88215 - DNA, 601 bp, Human
cagcctggccaacgtggatggagatgcactcacgctgcgggaaggaaaaaagatatcacaatttaaaccaatctattgatgactgtcaagtggaacaaaatactcatgcaatctttatttttttagagataaggtctgtcgcccaggcttgagtgcagtgatgccatctaggctcactgcagcctaggctccagtcatccccccacctcagcctctggagcagctgggaccacaggcacagaccaccaagctggctaattttttcattttttttgtggagatgaggtctggctgtgttacytaggctactcacgtaatctgaaaacgaatttccttttctaaagcgatcttttctaaagatccttttctaagatgtactacttttgagaacagctacactatagtctacgttgcttttaatgaatgttaccttcccatcctaaaccgggaaggcctccttccagaccaagacagctcagtcacagcttcctcctttggaggaccaagacaggaaggtgggcatccatccagcgctcaggccccagaagcccactttagactaggtggtcacatttccgggcagctcctagcacaggaagca

SEQ ID NO: 88216 - DNA, 601 bp, Human
gggctggatgccgtgttccaggcagtagagctcccagcaggcattgccaatctggacaccagcctggccaacgtggatggagatgcactcacgctgcgggaaggaaaaaagatatcacaatttaaaccaatctattgatgactgtcaagtggaacaaaatactcatgcaatctttatttttttagagataaggtctgtcgcccaggcttgagtgcagtgatgccatctaggctcactgcagcctaggctccagtcatccccccacctcagcctctggagcagctgggaccacaggcacagrccaccaagctggctaattttttcattttttttgtggagatgaggtctggctgtgttacctaggctactcacgtaatctgaaaacgaatttccttttctaaagcgatcttttctaaagatccttttctaagatgtactacttttgagaacagctacactatagtctacgttgcttttaatgaatgttaccttcccatcctaaaccgggaaggcctccttccagaccaagacagctcagtcacagcttcctcctttggaggaccaagacaggaaggtgggcatccatccagcgctcaggccc

SEQ ID NO: 88217 - DNA, 601 bp, Human
cccctatgcaagcgttgaggtggtaaactagtctgagaatctagggctcctgcctttctagtctgttgagctcccttttccctagaggtgcctgcacagtaagtgggatccttgacaccagactctctatactccaagtatagatgaatctaaaaaccaaggcacttttagaaaaaaacgcaggaaacaaagcttttgatgttaatgactttactttgagatatgatggaaaaatattacaggtacacatggaaaagacatgatcaccaagtgaaaacaatctaaccagaaagctttaacrtctgtcagttaagctgaagctgaaattctgggagcatgacatgctgcagggccaaaaggaatggataattagtattcctctccttcttcctcaccctctccttcaacagaatccacaccaacctcctcataatccttctcaagggcagccatatcttcacgggcctctgaaaactcgccttcctccatcccctcacccacgtaccagtgaacaaaggcacgcttggcatacatcaggtcaaacttgtggtccaggcgagcccaggcctcagcaatggctgtggtgttgctcagcatgcac

SEQ ID NO: 88218 - DNA, 601 bp, Human
caatggtcatatctttgacagcagcaacatgtatagtaattaacttccatggtacagtcctgtcctctaaggggtataggttagctgaggggactactaagcaaaacattaaaatatatgatgagaaccactacaagttcaaagtgctgtgggaatatgtatttatctgagtggcaatgcagtattgctgtattctgcaccctgctaatttttctccactttaaactgagttcaaattcgatgcctatggaatttgtaagctacaaaaccttactttgggaggctgtgctaccactttatragaactctcattaatgagcctttgctactcaccgaatgttatttgaacaaccccaagtttacctgttttctaattcagtattaagctttttttttttgagatggagtctcgctctgctgcccaggctgcagtgcagtggcgcgatctcggctcactgcaagctccatctcccgggttcatgccattctcctgcctcagcctcccgagcagctgggactacaggcacctaccaccacgcccggctaattttttgtttttttttgtatttttagtagagacagtttcaccgtgttagccagg

SEQ ID NO: 88219 - DNA, 601 bp, Human
aaatacttcgatcatataactctgcagaaagatatatttatggtaataaatactttgatcatatacctctgcagaaagatgtatgtatcatagcctttgattgtcattttattgaaatctattctcttccatatgttctcaacagaacaaataattattcccaattatttccaccttctggattatatatttaaaagtgttacttcacttgaacccaggagttcaaggctccagtgagctatgatcacaacactgtacttcagactgggtgacagagagagacactgtctttaaaaaaaaatactaaataataaataaacaaaaaagtgttacttgctggccgtctgaactcaattcttacccgccctatctatttcagcttatatttaaaaattaaaaactggccaggtgcagtggctcacgcctgtaatcccagcactttgggaggccaagtcaggtggatcacaaggtcaggagattgagaccatcctggctaacacagtgaaaccccgtctctactaaaaaatacaaaaaattagccaggcgtggtggtgggcacctgtagttccagctactcgagaggctgaggcaggagaatggc

SEQ ID NO: 88220 - DNA, 601 bp, Human; identical to SEQ ID NO: 88218

SEQ ID NO: 88221 - DNA, 601 bp, Human; identical to SEQ ID NO: 88219

SEQ ID NO: 88222 - DNA, 601 bp, Human; identical to SEQ ID NO: 17755

SEQ ID NO: 88223 - DNA, 601 bp, Human; identical to SEQ ID NO: 17756

SEQ ID NO: 88224 - DNA, 601 bp, Human; identical to SEQ ID NO: 17757

SEQ ID NO: 88225 - DNA, 601 bp, Human; identical to SEQ ID NO: 17758

SEQ ID NO: 88226 - DNA, 601 bp, Human; identical to SEQ ID NO: 17759

SEQ ID NO: 88227 - DNA, 601 bp, Human; identical to SEQ ID NO: 17760

SEQ ID NO: 88228 - DNA, 601 bp, Human; identical to SEQ ID NO: 17761

SEQ ID NO: 88229 - DNA, 601 bp, Human; identical to SEQ ID NO: 17762

SEQ ID NO: 88230 - DNA, 601 bp, Human; identical to SEQ ID NO: 17763

SEQ ID NO: 88231 - DNA, 601 bp, Human; identical to SEQ ID NO: 17764

SEQ ID NO: 88232 - DNA, 601 bp, Human; identical to SEQ ID NO: 17765

SEQ ID NO: 88233 - DNA, 601 bp, Human; identical to SEQ ID NO: 17766

SEQ ID NO: 88234 - DNA, 601 bp, Human; identical to SEQ ID NO: 17767

SEQ ID NO: 88235 - DNA, 601 bp, Human; identical to SEQ ID NO: 17768

SEQ ID NO: 88236 - DNA, 601 bp, Human; identical to SEQ ID NO: 17769

SEQ ID NO: 88237 - DNA, 601 bp, Human; identical to SEQ ID NO: 17770

SEQ ID NO: 88238 - DNA, 601 bp, Human; identical to SEQ ID NO: 17771

SEQ ID NO: 88239 - DNA, 601 bp, Human; identical to SEQ ID NO: 17772

SEQ ID NO: 88240 - DNA, 601 bp, Human; identical to SEQ ID NO: 17773

SEQ ID NO: 88241 - DNA, 601 bp, Human; identical to SEQ ID NO: 17774

SEQ ID NO: 88242 - DNA, 601 bp, Human; identical to SEQ ID NO: 17775

SEQ ID NO: 88243 - DNA, 601 bp, Human; identical to SEQ ID NO: 17776

SEQ ID NO: 88244 - DNA, 601 bp, Human; identical to SEQ ID NO: 17777

SEQ ID NO: 88245 - DNA, 601 bp, Human; identical to SEQ ID NO: 17778

SEQ ID NO: 88246 - DNA, 601 bp, Human; identical to SEQ ID NO: 17779

SEQ ID NO: 88247 - DNA, 601 bp, Human; identical to SEQ ID NO: 17780

SEQ ID NO: 88248 - DNA, 601 bp, Human
caagcttgttctaggaggatcacctggctgctgggtagagagcggccaggggactagccatcctgctggtaagaaggagggacaggttcagggtgtgaggaagagttagggggcagattagcctgcttggtgagggatacagaatagggagtggggaggcaggagtctaggatgatgctggggctccttggtgggtggggtgtccagtgggagaccagagggcggtgggcagggtgtgaaaatcatgtgggaacctgctgaatttgagactggggatcattggaggacccaattggaggawtcatacagtcagtcggttttgggtctggagctcagaggagaggatagggctggggccaaagaccctgggagtctgagtttggagggatggccactgaagcctcagagaggacatcactgtccagggagactgagcagagggcaggaagatggctggccggtggcctgttcagccaaccatgtttcggtggaggtggggaggtgctgctggagctgcctcatgcccaggaccgccttggcctggctcctgatggaccttggatgtggaggcagagagtgttgacttgcctcacacagtccg

SEQ ID NO: 88249 - DNA, 601 bp, Human
atcacatttcatctgctgatggccacgatggaaccagccccctggtgctgggtgacgcaggtgttttcagttgtttgctgtgatgaggaatgaacatcctgtgtgtaacagttcttctccaaacaatgtgggattgtttcctcgaagcagtttcccaaaagtcgaacaactggatcccagagttcttgcaatgtatcagcatgaagatgtttaaacagatcaaacatgttataaccgcaagtggggttgtccctcggggctcatttctttggttggattcagttttcgttggagatgaccyccgtatggaggtggtcaggaagggaattctgacccaaagaacaaacccagcccaaccccatgttcacccagagccaggtggtgggggtagagcgagggcctgagagggatgctgggtctggctcatccccaccccaccgtttcagccagcaccgtcttcccagaggacctgacatcctagcccagactctggtgtaggtggggacacaggaagttgattggaaaagtggactaacttagagatttccaaggcaaaaatccagagagccctgggacacctgtggttaattcattcagcatt

SEQ ID NO: 88250 - DNA, 601 bp, Human
aagcctctaacccaggtctaagccagaccctgcaggccctgctccagcctgcagttcgagaggagcaggtggaggcagaggctgtcctgtgacagacatctagcaggctcatgctgaggactcagtgtatgcaggatgaactcgccagctctgccctccaggagcaaggggaggaaggggtcttgatcacctgctgggtacagtatagggtcatcaatcagggtgctggatacaggccccatccacctttggagcagccagggggtgggaagtgggtgtttctgagggagggctggccctrtctgctgcacacactactgtacatccaggcagatggtgacatcagccacatgcaagggctgggagggcttcctggaagaatgagcttaactgagcactcttccagcaagcatggtttgagagtctgccacgtgctccctctgagcactgggtttggcactggggagacacagtgcccacgcagactacgcatggagctggaggccttgcctgcaggcacaggaacctgctgctagtggagagccttgagggttccaagtggggcgggagggatgatggcatttctggcagttttgcctga

SEQ ID NO: 88251 - DNA, 601 bp, Human
gccacatgcaagggctgggagggcttcctggaagaatgagcttaactgagcactcttccagcaagcatggtttgagagtctgccacgtgctccctctgagcactgggtttggcactggggagacacagtgcccacgcagactacgcatggagctggaggccttgcctgcaggcacaggaacctgctgctagtggagagccttgagggttccaagtggggcgggagggatgatggcatttctggcagttttgcctgatagtggcaggtggagtgggatggtgcaggcatagggagactgagrcagacaggccagtggggacatctgggagggcagaggcaggagctggactagggcttggcagtgaggaagcggagccatgtgtgaggagacacagatgtgtgcaggggggctgggcaccatggctcacgcctgcaatcccagcactttgagaagccgaggcgagcagatcacctgaggtcaggagttcaagactagcctggccaacatggtgaaaccctgtctctactaaaaatacaaaaattaaccaggtatggtgatgcacacctgcaatcccagctactcaagaggctgaggcaggag

SEQ ID NO: 88252 - DNA, 601 bp, Human
ccataggccctgccttcctgggtcctgaaggctcaagccctggctgcagaaggaggcagcccagatcaaacccagtttggatgcagcctgggcccacagaagcctctctgatgaggtcggggggctgagcctatggcagtgcaaaccgagtgttcattcttagggtgtttgggaagccccccttcatctcccacctggcaccctgactggggaactggccctttaaagccaaccaagggctggcttttggggggaaacatcctagatttctgccatctacttacaagcctgggccagggagggggggccactcagcccccgacaggggcattggaagggcaggtggagccagtggcattgattgcagtaacctgatcccgtgagggaggcggccacagcggcagcagcgcaagggccaggccagccgggaggaaggtgcctgcagctgagggctgcgctgggaagagctggggctgggacccgggtcggcagctgcagcctcctctcctggcctgtctatttttaatgagctccccaggcttctgcagcaggcaggacgcagaaagacaggcccaagcggtggaggccagaggcccccagc

SEQ ID NO: 88253 - DNA, 601 bp, Human
cccaggcttctgcagcaggcaggacgcagaaagacaggcccaagcggtggaggccagaggcccccagccctgccttgagccctggcccccccacccttccgggcatgagagggcagccctggggccccgcagccccccggccgggcagggctctccatgcagctggtgctgaagatggattcgagcccagacaatgacagctggttggaggatcaatgggagcgctggtaggggctaccggggctggcgggggtggagaccgagttggggtgagctccatcgagctcagggtctctgatctgaatgaggcgagtggcagggagtctgggcctcctaggttcccctgggggctaagccaccatctctcctgggtgaccttgaactagtgggtttcccttgctctgtgcctcaatttcttggacttatttgggaaaaggctcatacattctccccaacttcctaaatgttctacccccccaccacccccccagcaagccaggcagagtgcccaggacctagaggtgagcaagagacaggctgccttgcagtggctggcccagccctgcattctgaggtggggactcagggctggcctagggag

SEQ ID NO: 88254 - DNA, 601 bp, Human
ggctggcctagggagaggggggttctagtggagctggttagtattctggtgccctggtgctctgagctgtctcccaaggttgtaacacctctggtcccacctggggcttctcctgaccccatctgtgcagcctcctgttcagggtccttacactggataaggagaagatgttgtggttgaagagatgagaccaccaagtgcacagcatgaggctggagtcctttctggaataggctgaaactacccacactgacaccagattttccttcgcttgttccctgggctcaaggggcatgagtcttcctgagctggggcgtggggcactcctctgaggctgctgccggcgcctcgggtcttgctactgcagggattgcactgggagctcccctactccaggctgctcttctcaagtccacattctccatggtgaactggccttggcacctgccttgaccctgggaggaggctctgaccagttgggccttctaagcactgcctgctggttggcaacagaatgacagcttccagggaggagccagagtgacctggagcctcctcttccactgccaccctaggaggactgccttttggcacaagcccc

SEQ ID NO: 88255 - DNA, 601 bp, Human
ccctatgagtcggccatcggagaggaatatgaggaggccccgcggccccagccccctgcctgcctctccgaggactccacgcctgatgaacccgacgtccatttctccaagaaattcctgaacgtcttcatgagtggccgctcccgctcctccagtgagtcagcaaggggaagcagtggggtgggggggtccctagcgggggcagagccaaaatgcgaagtgttctgggaggcgaccccaggccccatctggttaggactgaggcttctacctgccccgctaaacctggatcagagctgcgaccccccatccagccacaccacctcacctgcaggtgctgagtccttcgggctgttctcctgcatcatcaacggggaggagcaggagcagacccaccgggccatattcaggtgagagccatgggctggctgggcctagccaggcagcagtttgggccacacaccaccctctacttgtcacccctacatggcctcagcctaacccctgccatcagccttcatttatccactcagccctgggaggacagtgtccactctctagggactcagagtatggtgacaaagaggatggctacagtgag

SEQ ID NO: 88256 - DNA, 601 bp, Human
ataagctcatgtttgggctggccaggtggctcacgcctgtaatcccagcactttcggaggccaaggtgggcggattgcctgagctccggagttcaagaccagcctgggcaacatggtgaaaccttgtctctactaaaatacaaaaaaaaattagcagggcatggtggtgtgcacctgtagtcccaactactcgtgaggctgaggcaggggaattgcttgaacccaggaggcggaggttgcagtgagctgagatcgcgccactgtactccagcctgggagacagagagagactctgtctctaaaaaaaaaaaacaatgaataaataagctcatgttcacaaatctggagtcagtctcatctactcacaaaacctgttaccaactcagggagtggcatggccatctcccagtcactgagctcaaatctcagatttagggttgattccttccactccatcccaagacctgctccttcctgtctccaacattctaccttcccagtccagcctctgctgcccacagattggaccacatcaatctcctgtgcaaaaatcctatgatctgtccattcctaggcagatttccaccccaccccatcttca

SEQ ID NO: 88257 - DNA, 601 bp, Human
agggaaaaagaatatacattctttctatgtatatggaaaccatagctccaaagaaagccttcctagcatcaggttgtactcttaaatatcttgcttaatccaaaacatagtttgtcccaggaatattttatttaaatggcatttatagtctaaagcctgtttttaattgagtttggggatgaactttttttctcctccacgaaacacatcttcatgtctttgcttattgtcaacatatcagggcagccttctctggcctcttttatttaaactgcaaccacctcccaccctggaaacatgytctctcttttccctggtttatttttcttcatagtacttacaccaccatctgacctaccacatattttattttcattattgtctgttttcaccacttgaagggatggatgttggtggaggattctgtgcactggtgtatccctagaacaatgtcaaccacatagtaggtatccaataaatatgcctttaaaatgagtttgtgattttatcaaataaatacatgaaaaacattattttaattagacttgctttaagacaaatcacaagactctcccaaaattgctctcctacaaatcacagt

SEQ ID NO: 88258 - DNA, 601 bp, Human
acaggcacacctctttcagaggagacaacctggccagcttctcctccagcgttgatatacacctttgttccctaggctgggtaccagatgagctagcagcttgagtttagaataagcaatatgtatctttacatgctcagttcagcaagatgctatcagtgtgacaagaagatgggaactatacgcctagggaagtgacaggattacaaggactgggacaaatgctcaggcagtgtgtggagaatggcatcctccaccacacctaaactccctccctctccactgtcacacagttcacttyggtagttatttgttggtgaaatgcacacaggatgcatactgtgtcctctggcatccatatagcaatgggctcctccagaacaatccataacatggtggcttcacactgcctgcctgttggcttgttgtcaccaccccagtgctcaagaaaggaatactaaatgccatagcaaattcaaaactctgctgaaccctgacaactaggaaggtttgtattaggattaataaaacaatgatcaaaaatcttgatactagtacaactctgactcatttactgtttgatgccttgaatatttaatag

SEQ ID NO: 88259 - DNA, 601 bp, Human
ggttataccacctgggtttgtgtaagtgcactctataatgtttgcacaaaaacgcgatcacctagtggtgcatttctcagaatgtatctgtgtcattaagtgatgcatgtctgtattaataaaataaagttacttcaacaaggggggaaatggtgaagaaatgtttctgacctacctagccaatagttggctggataactttggaaaggaggcacctattgtgccttttccctttccctgacatccccagacacccagaaacttccctcacaccccaagaaggctttgcaaaggtgttcayggactcaggtgtcctctgagaggctcaaaacaatccccagattacctacatttttaatggggagggagctcaaaagctggtaaaccttcaagatccaaagccaggggatgaggttcatgtgggagagcaggggtcacctactctgctgccaatgccatctctgggccaaggggccaaatgtgaggatgacatgcttgcagctgggggaaacaggttgtccttctgcccatctttgctcctggctgtcctttcaagtctattagaaatacagaggaggcccacgcatactacttttaggat

SEQ ID NO: 88260 - DNA, 601 bp, Human
gaaagaaaaaaacttagtgtgctgtaagacagcacacgaaacatttatagtctactacagtgtgtatagcataatattctcttaaatgtattttctaaaagctcttatattaaaaaacaatgggaacaataatttcccatctcggcatgtctatagaattttgtggtctctaaatgatctgaactaactcggaattttgcatgtttttaacttgttgaatctgttgaatccccatgtacctatcacagtttcaacaattagcattcatggatggccttgtttcatccctattctccttacwcttctagtccccaaatgggattatttgaagcaaataccagacatcacaccattccatacacatatactttagcatgaatagaatatacacagtcatgtaccacataacaatggttcagtcaacgatggaccgcgtatatgacagtggccccataagattagaatggagctttatgggggtaccaccttttatcttttacacactatctgtactgtaccttttctatgtttagatacacaaataacattgtgttacaattgcccatagcgttcagtacaacttcatattgtacaggtttgt

SEQ ID NO: 88261 - DNA, 601 bp, Human
ttcagaccctatggacctaaatttttgtctagacatgcaactagctttttcaccacaaagaaaaaaagaaagaaaaaaacttagtgtgctgtaagacagcacacgaaacatttatagtctactacagtgtgtatagcataatattctcttaaatgtattttctaaaagctcttatattaaaaaacaatgggaacaataatttcccatctcggcatgtctatagaattttgtggtctctaaatgatctgaactaactcggaattttgcatgtttttaacttgttgaatctgttgaatccccrtgtacctatcacagtttcaacaattagcattcatggatggccttgtttcatccctattctccttactcttctagtccccaaatgggattatttgaagcaaataccagacatcacaccattccatacacatatactttagcatgaatagaatatacacagtcatgtaccacataacaatggttcagtcaacgatggaccgcgtatatgacagtggccccataagattagaatggagctttatgggggtaccaccttttatcttttacacactatctgtactgtaccttttctatgtttaga

SEQ ID NO: 88262 - DNA, 601 bp, Human
tccctgcttccctccaccctgcccccatctgctaagcagatgcttggctgctcctgtacactttagtactgataccactttcacagtgagtccttaactttttaactttctaagaaaccaggagtactgaaaccacgggaatttcaaacactgaagttggaagggacttcggctgtcattgactcttactttctcgtttcactactgtacctctagagaccttgtttggatgggaacttggttactccagaccccagagcaaagaaaagtcttctgctcaggaagggggtcctttccaatrgagtgagcagttgtccaagtaagggaataggcactccatgggtgtgagaagttccagccagaaagccctcatatcccatcccacagattagaaaactgaaaagtgacttctccagtgaactagttttagagttggacaatactgggtttaaattccaaacctacttctcattagctctgtggctctgagtgaagtacctgacctctaaaccttagttttctcatctttaaaatggggataagaatacctaacttcagtgatagtttcgaaagtatttactcaaatgaaataatgtttata

SEQ ID NO: 88263 - DNA, 601 bp, Human
tggatctgtgtccccacccaaatctcatgaattgtaatccccattgttggaggtggggcctggtggaaggtgactggatcacggggacagtttctcatgaatagtttagcaccatcctcttggtactatccttgtgatcacgagttctcacaagatctggttaagtgtggagcacctctcccctgcttcctcctgctctggccatgtgatatgtgtgcttccccttcacctgctgctatgactgtaagtttcctgaggcctccccagaaactgagcagatgccagcaccatgcttcctgtacagcctgcagaaccataagtcaattaaacctcttttcttataaattacccagtctcaggtatttctttatagccatgcaagaacagactaatacaacttctaagccagcaggatgtgggcacggtgtcctgtgggctttgtaacagctgggacactacacctagagagagggaccaggccactggagaattctgacttcccaggcctcctcccaaatgaccaaggctcggtttagagaacagggatataaacaatggctgtaaaacagcagctacatccccagcttctacatcccctttc

SEQ ID NO: 88264 - DNA, 601 bp, Human
cgggtgatccagaggtatactgaaatatgaaatcactccattaaggccatcaatgaaaatctgctactataaagtcaataatgaatataaacccagacttgcctgggagtattcagtcctatttttgataatcagaacactcagaagtgacagggtctctacttgcttcatacaccagatgtaccctgcacatactaggtactaagtaaatgtcaggcaatgctctaggctcgggtgttagagtggtaaccagtgatccctgttctcatagagattaaattctagaaagatgttatttttytagagttaaatcccccacacagcaaaaactgtgcttgtcaacctttcttacacagtgccctatacagcacagattctacgggggtgtttttatatgtgcaattgtatcatcttttcttcatgtctggaattttccttatattagaaagcctttccctattgacattacatcattcactcatttccctagcacttgcaaggtttcctttttttctttttaacttttagatcgctgatatatttgtttattctcatgatcagagtgaagtatgggtccactttttgctttcactttttttcc

SEQ ID NO: 88265 - DNA, 601 bp, Human
taatatgattaggcaatcagaaaaccctattttaacacaattccgggtgatccagaggtatactgaaatatgaaatcactccattaaggccatcaatgaaaatctgctactataaagtcaataatgaatataaacccagacttgcctgggagtattcagtcctatttttgataatcagaacactcagaagtgacagggtctctacttgcttcatacaccagatgtaccctgcacatactaggtactaagtaaatgtcaggcaatgctctaggctcgggtgttagagtggtaaccagtgatycctgttctcatagagattaaattctagaaagatgttatttttttagagttaaatcccccacacagcaaaaactgtgcttgtcaacctttcttacacagtgccctatacagcacagattctacgggggtgtttttatatgtgcaattgtatcatcttttcttcatgtctggaattttccttatattagaaagcctttccctattgacattacatcattcactcatttccctagcacttgcaaggtttcctttttttctttttaacttttagatcgctgatatatttgtttattctcatgat

SEQ ID NO: 88266 - DNA, 601 bp, Human
atctcgccactgcactctagcctgggcgacagagcgagactccgtctccaaaaaaaaacaaaaaaaacaaaaaaaaaacaaaaaaaacttgttttcagtgacccatgtaaatcagacatagtagtatctgccacttaagacactgtcaggtaattacctaaataaatgtaaataacattaataataatgttattattattataaaaataaatgtaaataataaaatgttttatctgaacagaattcagataaaaaatgtatacaaagcatagctgtagctttcaaagagaagtagatgagyaggaagtggtagttgaagttgctgtctcttatactttctacccaaatcatactgataatctctgcctatgaaccatggtataccccagatgatgaatagagtaacagcagtaccctacgtgtcctacacaatgtacattcttgagatcttttctgttgctactctcattaaaaacacgcaacagtaagaaaatacagtaaaactgctttaaaacatgagaaaaatactgagcttatctgctgtgtatacacgtggccctgcaacgtttgaagaaacctgagatattagggcaggggaact

SEQ ID NO: 88267 - DNA, 601 bp, Human
ggataaatatgacacaaatgctgcctagtgacaggtcaaagtttggctttcttcgatctttaatgaacatgaaaaaaagtcctaagtataacaactagacacactgaaacaaaatacttgttttcaaaaattagccgggcgcagtggcagacgcctgtagtcccagctactcgggaggctgaggcaggagaacagcatgaacccgggaggcggagcttggagtgagccgagatctcgccactgcactctagcctgggcgacagagcgagactccgtctccaaaaaaaaacaaaaaaaacaraaaaaaaacaaaaaaaacttgttttcagtgacccatgtaaatcagacatagtagtatctgccacttaagacactgtcaggtaattacctaaataaatgtaaataacattaataataatgttattattattataaaaataaatgtaaataataaaatgttttatctgaacagaattcagataaaaaatgtatacaaagcatagctgtagctttcaaagagaagtagatgagtaggaagtggtagttgaagttgctgtctcttatactttctacccaaatcatactgataatctctgcctat

SEQ ID NO: 88268 - DNA, 601 bp, Human
tcgtgagacttactcactaccatgagaacagtattgggggaaccacccccatgattcaattatctccacctggccctgcccttgacacatggggattattacaattcaaggtgagatttgggtggggacacggccaaaccatatggcatggaaaccaacaagtggttatatgcaacacaaaatgtcacctaggatgccatgctctgccctctagggaaaaacaaagggaacgaggcttgtgccagcagtagaagctttgttatttgaggagtacaactaacatgcactgaatgattacagyctacatcaaaaacttctacacaccactgaggcctatgtgaggagagatgggtggaggcagggcttctaggtgatctgtgactggtgcagggcaaagaggaggccagaggcagggaaaacagcaaagcaggtgcttccaggtgatgcaagaggcagcaaagagccactgcaggttctgtcaagagagtggcatcagcaagcagtgtctcggcaggaccagtcagagatgtggggcagaggggcaggaggagagacagagatgggagacaaggccggggacaggaagagaggaaggaatgat

SEQ ID NO: 88269 - DNA, 601 bp, Human
aattcccacttataaaaccatcagatctcgtgagacttactcactaccatgagaacagtattgggggaaccacccccatgattcaattatctccacctggccctgcccttgacacatggggattattacaattcaaggtgagatttgggtggggacacggccaaaccatatggcatggaaaccaacaagtggttatatgcaacacaaaatgtcacctaggatgccatgctctgccctctagggaaaaacaaagggaacgaggcttgtgccagcagtagaagctttgttatttgaggagtamaactaacatgcactgaatgattacagcctacatcaaaaacttctacacaccactgaggcctatgtgaggagagatgggtggaggcagggcttctaggtgatctgtgactggtgcagggcaaagaggaggccagaggcagggaaaacagcaaagcaggtgcttccaggtgatgcaagaggcagcaaagagccactgcaggttctgtcaagagagtggcatcagcaagcagtgtctcggcaggaccagtcagagatgtggggcagaggggcaggaggagagacagagatgggagacaaggcc

SEQ ID NO: 88270 - DNA, 601 bp, Human
catctgaattaacggtaaaatgttcctctgtatagaccgattacagaaggtacaaataaatgtcccttgagttacctctgaatgagctgctggaaaagactgaaggtgcggtcccataacacttgtttgttttttgtgatagggtcatgttcgtaggtgtatttctgttccaattcctccaactttttaagctgctgccgaacttgctgcagactctccgcaactatagtgaacctgggaagacacaagacacagatgtctctatgagaaacagtccagaagcagcctggattaaagggamtcatggtatattagtccattctcatgctgctaataaagacatactcgagactggagaatttataaaggaaagaggtttaattgacacatagttccacatggctgaggaggccccacaatcatggcagaaggcaaatgaggagcaaagtcacatcttacatggtggcaggcaagagagtttgtggagggaaattcccacttataaaaccatcagatctcgtgagacttactcactaccatgagaacagtattgggggaaccacccccatgattcaattatctccacctggccctgcccttg

SEQ ID NO: 88271 - DNA, 601 bp, Human
atataaagaaatacataacaactatataacaaaaggcagagtaggaaaggaacgaagggtgactgtaggccacgaagggagataacatctgtttgggaaatctgggaagattaaatgatgagatacaaggtgaagctttcgggatgatacaattttgaaagcaggtacatgaaaagaaggctctgaggaagaggaagtatcctcaggagagccacagaaaagcaagtatgcggcatggcccctataggaatcagcaagaggtcaagtttgcctagaaaggggcgtgtgtggacgtgaagcrtggagtgttcagctaggtccaggctgcagaaggggggccgtgaatgcccagctgggcattcacttggatcagcaggtgatgaggaaccagaatggaactctgctctgggacagcactggtcacagggaggaaggactgggaaggaggactggtggggaggctggggaagagtccagaaaggaggatttgagagcctgagacatgaggaggggagaggaggaggtgaggcatgttagggtcacggcggagactcagccaaaggggaaggaggagtggaaggttactatagcttccagccta

SEQ ID NO: 88272 - DNA, 601 bp, Human
acagctgctgccctgactctctgcaccacgggtaactgaaggaaaggaatgagataggctgttctgggagagtaaatgtcttccccgactctgccccctggaacgcaatcagcagccgctgccactcagctattgcttccacccaaaatcaagtacatttttatcatgtcaagtttgcattaaaaaaaaaaaaacttgcaatatgaacccttcttttccactcagtgacatttatctatctactaagtgtgtctagagagcctactgttcacaaggcactgcgctaggtcctgctgggggmaaagggtgacaaaggcatgtctctgccttccagaactttatgatattcaagaaatataaagaaatacataacaactatataacaaaaggcagagtaggaaaggaacgaagggtgactgtaggccacgaagggagataacatctgtttgggaaatctgggaagattaaatgatgagatacaaggtgaagctttcgggatgatacaattttgaaagcaggtacatgaaaagaaggctctgaggaagaggaagtatcctcaggagagccacagaaaagcaagtatgcggcatggcccctatag

SEQ ID NO: 88273 - DNA, 601 bp, Human
gcaagactttccaaccccagagtcgccaatcagaagtaatttgaataaataatcaatttgggattcatgctggacatgtcactgtagctgccaccgctgccacggccacccttgctgctacagctgctgccctgactctctgcaccacgggtaactgaaggaaaggaatgagataggctgttctgggagagtaaatgtcttccccgactctgccccctggaacgcaatcagcagccgctgccactcagctattgcttccacccaaaatcaagtacatttttatcatgtcaagtttgcattaaaaaaaaaaaaacttgcaatatgaacccttcttttccactcagtgacatttatctatctactaagtgtgtctagagagcctactgttcacaaggcactgcgctaggtcctgctgggggaaaagggtgacaaaggcatgtctctgccttccagaactttatgatattcaagaaatataaagaaatacataacaactatataacaaaaggcagagtaggaaaggaacgaagggtgactgtaggccacgaagggagataacatctgtttgggaaatctgggaagattaaatgatgagatacaa

SEQ ID NO: 88274 - DNA, 601 bp, Human
agcaaattccttggctgttgtgtagtctactactttctctgtggtcagatcacacttgttccctaccaacaatttgttgacgttttcactgggataatgatctattttctgcagtcactgtttaatattattgaaggactcctgatctgtcacatcatacaccactaggatgccattggctcctctgtaataactggagatgactgttcgaaacctttcctgttctgctgtgttccatatttgaagcttgattgttttcccgtctaactctatagttcttattttgaaatccataccaatkgtgctgatgtagctttctgtatatgttatcatctgcaaacctaagaaggaggcaagactttccaaccccagagtcgccaatcagaagtaatttgaataaataatcaatttgggattcatgctggacatgtcactgtagctgccaccgctgccacggccacccttgctgctacagctgctgccctgactctctgcaccacgggtaactgaaggaaaggaatgagataggctgttctgggagagtaaatgtcttccccgactctgccccctggaacgcaatcagcagccgctgccactcagc

SEQ ID NO: 88275 - DNA, 601 bp, Human
cattctttcttttttttttttttgagacagagtcttgctccgtctcctaggctggagagcaatggcgcaatctcggctcactgcaacctccgccacctgggttcgagcaattctcctgcctcagcctcccaagtagctgggattacaggcgcccgccaccatgcctggctaatttttgtatttttagtagggatggggtttcatcatgttggccaggctgctctcgaactcctgacctcaggtgatccacccacctcggcctcccaaagtgctgggattacaggcatgagccaccgtgccrggccttgttgcattcctagcactagtttccaaaaacagaattccaagggaatcagcaaattccttggctgttgtgtagtctactactttctctgtggtcagatcacacttgttccctaccaacaatttgttgacgttttcactgggataatgatctattttctgcagtcactgtttaatattattgaaggactcctgatctgtcacatcatacaccactaggatgccattggctcctctgtaataactggagatgactgttcgaaacctttcctgttctgctgtgttccatatttgaagc

SEQ ID NO: 88276 - DNA, 601 bp, Human
ctgaattttaacactggacttctcagcaccaccagctgttgctccaggacccattagcttcttaatctcagctgccatcatcatggaacacagttctacattcattgcattctttcttttttttttttttgagacagagtcttgctccgtctcctaggctggagagcaatggcgcaatctcggctcactgcaacctccgccacctgggttcgagcaattctcctgcctcagcctcccaagtagctgggattacaggcgcccgccaccatgcctggctaatttttgtatttttagtagggayggggtttcatcatgttggccaggctgctctcgaactcctgacctcaggtgatccacccacctcggcctcccaaagtgctgggattacaggcatgagccaccgtgccgggccttgttgcattcctagcactagtttccaaaaacagaattccaagggaatcagcaaattccttggctgttgtgtagtctactactttctctgtggtcagatcacacttgttccctaccaacaatttgttgacgttttcactgggataatgatctattttctgcagtcactgtttaatattattgaaggact

SEQ ID NO: 88277 - DNA, 601 bp, Human
tagccaggcgtggctaattagtcccaactactggagggttgaagtgggaagatcacttgagcccaggaggttgaggctgaagtgagccatgatcacaccactgcactccagtctggatgacagagtgaggccctgtctcaaaaatccaaaataaaaaataaaaaccccgtatttaattatgttcatttacatgtcagaattaagaataaaatgtgcactcaaagtacaagtaatgtttttaaattttaaaaaacccaacatacaggacttcttgtttgaacattagccatagggaaccaaktacatttttttaaatattacttccaataagtacgatatttattaaacatatcttcagttgttttgttacatagtatgcaacaaattacaatattctgcagccacaaattatatgcagagtatgaagaagctattaatcagacagtgtaatctttccatttataactctacaaggaagaactagcaaatcagatcttacatataacatctcactaaactttacgcatggaaagtgacagacactgcttgtgctgtttgatataaaatggctgaacttcatcttcagaagactatacctgac

SEQ ID NO: 88278 - DNA, 601 bp, Human
aagggggttagagagtacgatctaaaaaatcatttgaaagattctgacaagttggatgaacaaagtgatattttctaattagtaaagaaatcccaaaacctaatagggacttaacagaaacagaataactgtaatgatctgtgaaactattacattgaaacaaacatacaatgaaggctaggcacagtggcccatgtctgtaatcccagcactttaagaggctgaggtgtgaagattgcttgagcccaggagttcaagaccagctcaggcaacatagtgagaccgtatctttacaaatttgttttttttttttaattagccaggcgtggctaattagtcccaactactggagggttgaagtgggaagatcacttgagcccaggaggttgaggctgaagtgagccatgatcacaccactgcactccagtctggatgacagagtgaggccctgtctcaaaaatccaaaataaaaaataaaaaccccgtatttaattatgttcatttacatgtcagaattaagaataaaatgtgcactcaaagtacaagtaatgtttttaaattttaaaaaacccaacatacaggacttcttgtttgaacatta

SEQ ID NO: 88279 - DNA, 601 bp, Human
agaaaaaagggggttagagagtacgatctaaaaaatcatttgaaagattctgacaagttggatgaacaaagtgatattttctaattagtaaagaaatcccaaaacctaatagggacttaacagaaacagaataactgtaatgatctgtgaaactattacattgaaacaaacatacaatgaaggctaggcacagtggcccatgtctgtaatcccagcactttaagaggctgaggtgtgaagattgcttgagcccaggagttcaagaccagctcaggcaacatagtgagaccgtatctttacaaattttttttttttttttaattagccaggcgtggctaattagtcccaactactggagggttgaagtgggaagatcacttgagcccaggaggttgaggctgaagtgagccatgatcacaccactgcactccagtctggatgacagagtgaggccctgtctcaaaaatccaaaataaaaaataaaaaccccgtatttaattatgttcatttacatgtcagaattaagaataaaatgtgcactcaaagtacaagtaatgtttttaaattttaaaaaacccaacatacaggacttcttgtttga

SEQ ID NO: 88280 - DNA, 601 bp, Human
atattcctggaaacacttctacaattagtatcgaggagaaagactacaaaacaatgtatgtagcctactccgagtttttaaaaaagaaatatgtcatatttgtgtgtgtgtgtgtctctatatgaaatatttgtgtagacatggaatcctaattttttaaaaaggaaacattatgtcatgtttgtgcgtgtgtgtttccgtatgaaatatatatttgtgtagacatggacaaaatcctgggaggacagacactaggccatttactgtggtggtccacagatatttatatcacggactgctytgagaaactgatgaaagctataaatccatccatcagaaaaatgtacatgttataaatccacattcatacagcttctggggttcataaggctcaggttatgagcctatgcccaagaggggtgaggcagccaggaacttttactctctattacacacatttctgcaatttggaattctgttttcctgtgaacacgcattacatttatgattggaaaaaaaccaggagtgtgtacatatatgtatatcagttacatttctactatgaatatattaataaaagactctcagatattctcagtaa

SEQ ID NO: 88281 - DNA, 601 bp, Human
ggccaggccggtctcaaactctggcttcatgtgatctgcctgccttggcctcccaaagtgctgggattacaggtgtgagccactgcacctggcctagccactaagttttgggagtggtttgttaggaagcaaaagctaaccgatataccaaagatgatggcagggaagacaaggcacagaccatgctatgaggaagaatattcttataggagtgggaaaaagcaaaaagccagaggaaaatgatctgaatgatcataaatcatttttgaaacttgccaaaacagtatgtgacacaagctarcaaaaacattaaatatgggaggggtggggggggagccatcttgttccttaatgagagtggccaagttagtgccagtccaggtctagggtctcagggcaaaataggatgaggctgctccacctggacccccaagagagatgcccattcctgggttcccactgcccagaagagacaagagtgaatcccacaggctccacacagtctccccaagatgctgctgacctcgctccagaaaaaaacccccaaatgaccacagaatcatggcagcctggacgttcagcctcgggttggatcaggggc

SEQ ID NO: 88282 - DNA, 601 bp, Human
tttttagacagagtctcactctgtcacccaggctggagtgcagtggcatgatctcagctcactgcaacctctgcctcccaggttcaagcgattctcgtgcctcggcctcccaagtagctgtgattaccggtgcacaccaccacacctggctaattttttgtatttttcatagagacggggtttcgccatgttggccaggccggtctcaaactctggcttcatgtgatctgcctgccttggcctcccaaagtgctgggattacaggtgtgagccactgcacctggcctagccactaagtttygggagtggtttgttaggaagcaaaagctaaccgatataccaaagatgatggcagggaagacaaggcacagaccatgctatgaggaagaatattcttataggagtgggaaaaagcaaaaagccagaggaaaatgatctgaatgatcataaatcatttttgaaacttgccaaaacagtatgtgacacaagctaacaaaaacattaaatatgggaggggtggggggggagccatcttgttccttaatgagagtggccaagttagtgccagtccaggtctagggtctcagggcaaaataggatg

SEQ ID NO: 88283 - DNA, 601 bp, Human
agtcatgtaataaggccttgctagagcacctggctccaaccacactagctcagaccaggacaacctacaactcacagaatatgagaaataatgagtttttgagtttttagccactaagtttttgtttgtttgtttttagacagagtctcactctgtcacccaggctggagtgcagtggcatgatctcagctcactgcaacctctgcctcccaggttcaagcgattctcgtgcctcggcctcccaagtagctgtgattaccggtgcacaccaccacacctggctaattttttgtatttttcrtagagacggggtttcgccatgttggccaggccggtctcaaactctggcttcatgtgatctgcctgccttggcctcccaaagtgctgggattacaggtgtgagccactgcacctggcctagccactaagttttgggagtggtttgttaggaagcaaaagctaaccgatataccaaagatgatggcagggaagacaaggcacagaccatgctatgaggaagaatattcttataggagtgggaaaaagcaaaaagccagaggaaaatgatctgaatgatcataaatcatttttgaaacttgcc

SEQ ID NO: 88284 - DNA, 601 bp, Human
aaatgtttaagctatcgttattgtttattgagcagctacttggtgcaaggccctgcactaagcactggggatccagccaacagcactgcccagtagtcacaaagctcagaggactgccaatgtgaccatttaattctcatttttattctctatgatctttaatgctctcatgaaagtaccaggaaagtcagttatctggggaaagtggcaagtttaagttttaagtctgaggttaaaattttgaaagaccttgcacttctatatccagtgattactttgtcatgttctggccaaataatgwatccgtgagcgtcctagatgtagactagaaatcatgggctcactcacagatctattagttccccttcctttccaatctcaaccagaagttcaatgcttttgtgaatgacaatcaccattagctatggaagggacctattttcccgtttggaaaaaaaaagaatttaaaataaaagggatagtatgataaaagctgacttgtcaaagctaagaagaccgtcagagctggaaccgacagaaaagacacaagggcccgaagcagctgagaggagctgagctgacgcagaagatggtaaactgc

SEQ ID NO: 88285 - DNA, 601 bp, Human
ccgccagactgccattggtggactcctccatgttcatcacttttgtgtgcgtgcccaaaatgttgaacttcctaaatctatacaatataggaaagaaatgctgaaaagtcttccaactattaaataaataaaaatatagcacagtatagcgtaaagtacgtcacgtacccttttactgtatttctctcattcacatctctgcaaaaaaaatatatataatcacatatgcgtatttaaaatttgaaataagctttaacaaaattataagagtataagagcataagagtgtaagtgaatgatraataaaaaataaatctacacctatggatttgcagcctttcattcactccctgcttccatctacccatactaggtctggcaagtatcactgaatgacctttggcaaataaatggtctgggccttacattgttcatttgcacaacatactaacagtgccaacatataggacatcatgaggaataaactagttaattcctcaccagtacaccctcaataaatgtaagcaccagcaccagtacaccctcaataaatgtttaagctatcgttattgtttattgagcagctacttggtgcaaggcc

SEQ ID NO: 88286 - DNA, 601 bp, Human
ttaggactagaaagaatgacagacgtgactttatctttagaatgcagaacatgggacaaattggccctcgttcagggtccatgagcagaagcacgtttcctcagtggcctcatggtgcggacaccagtctggagggatctcttggaatcacaacccgctcctctcctgtgttcaaactttccctgaatgtttccccatgcaccttcgttaactgtttcatgccctgaggctcgggacagcttctccctcccctttccctcagcagagtcctccaggctgggcccagtgactccaggtccamctgccctcaagtggacgtcaatctctgagctgtcaatccctgagctgacgagggagcaggctggggccctgagggcggctctgaataccctcaggcacctgagttgggctaagctttcgagttaggtagagcttcctagctacgaggcttgctggatcacaaagtggtctctagtgaaaaaggatgcctttaacctcctgcaggttctgggcccagggaaagcttcggactcagcacccacagagcctcacagcaactggcagcccccatgttcacagaggaggaaagatggtgcaccca

SEQ ID NO: 88287 - DNA, 601 bp, Human
aaagtgttctcaaccaaaacaactccagatatttcatcctttgtccatagttcatttctgaatgcatcacaaacccaactccttaaggatcacgctgtaggaaggaaactgatgcaaaggcaatgcttttggtaggggatgcaatggccgaaaagccctcttggcacacagcaaggcagtcatcaaagtggcctctcgttccaactctgacagtaactctgtgcacccttagctaaatcctgcaaacttctgtgagtcaatttcttcacccgtaagatgcgaagaatacaaaagcccacarcagctactccactgagttgtccatgagtgtctaatgaatttgtgtgcaaaatcgtttgacaatagtaaagcacaaatgtggtgtttttactgttgtcacagatataccaaatacccagctcctttgctgctcttccctgatgggtctgaactcctctgtgaggtgtccccagccaccaactgacctgtccttgctagacagacctgcctgatttgggcccattcacaacataaagggactctcacctcattcgttctggtgccagcatttttctgttctttcaattgctataaaacaaat

SEQ ID NO: 88288 - DNA, 601 bp, Human
cactaaatcaaaggtgttctgctgggcctcctagagaagcctccctatccagtgcctcttcccactgccttcctctgctgctcagcagagccccctctcccaaggatcctacagaatttttttcaaagttcaacctaggtgcccaagatcacccctagatcttcaatgtaactgatacttgactttacaagtttattttagacattatttatgcatttccctcagctttcctccaaataggacatgggctcagggagtctgatgcaaatcaaaaaccaagtgagagaaacgagaggaagamgcccggggttattagctacacaaattaaagcagcctgggcgagaagaggcggtaagcccattatcggtcttcaaagagaactacaaatgagccattacagctagaaaagatatccttcttaactctcaccaaataaagaaatggaataaggggattttgtacttgtattaaacagcacaagaccaccactgtgacagctgcatatccaagagaagaaggcactgttgaaagtcactgagttaggaagagcctactgctgtttggagtaaatgcagtgctgctctacagaaagcaaatctg

SEQ ID NO: 88289 - DNA, 601 bp, Human
aaacagaaactgattctaaagctttggttggacggatggctcttgtatttgctctcaaggaaaagagccaaacacccaacaaagattgtatgtacacagttgacattttcggataccttaatgccaaattaactgagcaattataatacgtgctgtaagagggcggaatttaaatggtctaaaatatgtatatgttggtttgagtttaatggcagaaaggaatggatggcagattcctgggcaccacgatatgagagtttttagggaaagcggaaacatcacaaagccttaccatctgctstctccctccccagccccccttttccctccctcctctaaagagaggacagtccttttaatgccctcttcatgttacacttccttccaagaccatcagctgactttgccttttgcactaaatcaaaggtgttctgctgggcctcctagagaagcctccctatccagtgcctcttcccactgccttcctctgctgctcagcagagccccctctcccaaggatcctacagaatttttttcaaagttcaacctaggtgcccaagatcacccctagatcttcaatgtaactgatacttgactttac

SEQ ID NO: 88290 - DNA, 601 bp, Human
gggacttcacacacatggaatggtgggactatgtgctcaaactcccactcaccgcctccgttctgggaccgctccacccatgtgaatgtgatggccccttcccgggagctctcactgaaccgcagcaggaaggtccccggctgctggtccttcaacagggcacgctctcgctccttgctgatgaagcccatgatgcacctggatatcgaagagatggacggatgggcttttagttcaatcatgatttccattttcatgctaacttacaaaccaagaaaatggctggaatgtgagaaaaaaracctacggtaaaaaacgtagactattttaaaatctgttcagttgacacttaaggaagcatttcacttatacatgtatatactaaggttttaaaaaaagcgatatgaacatggtgtcagtaggatgctacagatgctcaataacacgtgtgggattaatgagccttttattgttcctttattattttaaaggccataacaatgtctgaatgtatacatcttttttactggagaggaagacctaggcaatatattttcatattttagcccttctgatcaagttaaagcttctgttgaaatat

SEQ ID NO: 88291 - DNA, 601 bp, Human
ggtcctgcatcaactccctggctgatgatgtgtatgaagtcttctcccgaagcctgtctcatctgcacactctactctgggatgaccctaagagaatgtggatgcttactcctgtgggaaatgtgattccttccaagaacgggttgcagattacattgactcacatccttgatctgcagataacaaacctgatgcaaaggaaagaattggcattgtcttttcaaaaccatcatttccacaatatgttccagagagtgaaccacaaccacaaacatttgtggtggtttattaaatcctatcrggggctcatttggggtaagtataagatctgcaatttcatgtcccaaacgcactatctgtatgagctgactggcggcgatgaagagggacttcacacacatggaatggtgggactatgtgctcaaactcccactcaccgcctccgttctgggaccgctccacccatgtgaatgtgatggccccttcccgggagctctcactgaaccgcagcaggaaggtccccggctgctggtccttcaacagggcacgctctcgctccttgctgatgaagcccatgatgcacctggatatcgaagagatg

SEQ ID NO: 88292 - DNA, 601 bp, Human
aaaagagcaatgtcaacatctgagtgatgaaagcactagtgcatacttacacactttatcttttgtctgtaattgaattatcacgttatatttttattttgggtaagtgcatacacttgtaaaatacatttgcaaaagtacagctcatgggaggctcatgtccccagcccagccccttgggaaatgtttcacactccagggatgtgataagcaatagccagactggaatctgtgccgcttctgcctgggtaagcctaggtgtgagcatgtgcggtgcactaccctgagatgacaatgcctygtggcttaccctggacagaaaagcaccagagaaatgtctggggagtccctcatccctaccttgaggtttgaatgcagataaagctgctccacacagtgtttttacatgaaggctacatccattcaccccaagacagtgctgcaggccaaataactgacaatgacatttccaaaattttttctaccttttataaaatgaaacaacaaaatcaaagcaagtggagacagtgtatctcaatcattactttggccttttctagattgaaaagaactactttcccactctgatcaacttttgctc

SEQ ID NO: 88293 - DNA, 601 bp, Human
tacaaacagcttcttcagggtgcatgttttgaatggggcaaagattagctttttgtgggaggctttccaggataccggacaaaagcatgcactagagactcactaggtagattcaaatattctttctaccatttactaactgcttgatcttagtcaagttacataaaaggggctgtgtggggaggaggggctctgttcccacatctgtcaaagtaggaataacaataacacctaactcagaaggtggctgtgaggactgaatgagttactacctgtgaagtacatggtatactgtaggtgyttaatgtcacctattaatggtggtggtgatgatgatgtaatttgctcaggaacaacaaaggaggtataaaaaatccccccattttacagttcctgtgatgtaacatattttctgaatagggctttatatttattccatttttgtgccaggcctatagcagtgttgggagcgaaactctagcaggatccttcttacatgcagaaaaggttcattttacacttgccaataggaatgaaactatttcgctgccacaatagctaactgtttttctaaatggcctatttcgtcaacaacaatcag

SEQ ID NO: 88294 - DNA, 601 bp, Human
gcccctatgtttcagtctagcttatgtttctcttttctttctttctttctttttttttttcaaattggagacggagtcttcctctgttgcccagactggagtgcagtggcaccatcttggctcactgcaacctccaccttccaggttcaagcgatcctcctgcttcagccccgctagtagctgggattacaggcacacaccaccatggctggctaatttttgtatttttagtagagatggggtttcaccgtgttggccaggctggtctcaaactcctgatctcaggtgatccacctgcccyggcctcccaaaatgttgagattacaggcgtgagccaccgcgcccggcctggctgatgtttcaaatgtgtgcttaatagggtggaccgtgggggtaaagagagggagggagggggagatagatagatagaggaagagaggaagcccagattcagatcctgtcactgcgtgaccagggcaagtggcttaacctctctaaatctcaaagtcttcatctatcaaaaggggattaatagtacctagcagataggcttgttaaattagatggcatacgtaaaatgtttagtatagtagacagaaag

SEQ ID NO: 88295 - DNA, 601 bp, Human
tttgcacagctcctgtttatcagcattgtctaatcatattcactggtacccttaaacatcaaactttaaaaatttaaaactatgcttgatatatctccctagtaaatgttacatatttctctgccatattaaaacattgtaatcaatagagtttaacatttcttgttcaacttatgtgtattttaaggatgcattattatactgcactgtaatacagtgatgctgtaagacaagtgctggcacactttccctgaaaggccaaatagtaaatattttcagcttttggggttctctagtcackactacaacttctcagttcagtggtggtagcaaaatagctgcaaacaataggtaaatagatgtggcagtcttccaataaaactttatttacaaaaagaggaggtccctgctgtagtttgcgtagccctacactaaaatatatttattggtaagttctctcatgccttgattggttctgctttaaccagtactcttaagggtgggtttgttcttttgtggatttttgtatcttgtatcagttgactgttcttcatgtctctactttagctatcctccttcactcttaccttctgtatccagt

SEQ ID NO: 88296 - DNA, 601 bp, Human
tttacctcatagggttttaatatgatagaaagtgagagtccttttttagcagtaaagccttaaaagatgtaagtttttatttttaaattcaaccaatgattagccttggggcaaaatcacttggatgataactagaatttgtcaatttgttagacttaacattcattctcatatgctattttactatatggtcagccaccatcaattcaactttctatctaacaggtttattaatctgccagtttgctggtgttgatagacggttgttatcagtcagctcactataaattcaaaatgatamactgattttaaaacaaccctgaattatcatctgaaggatcattattcttaaatgaaggcataaagactagcaaatccttttgtattgtgttattattaggcctcattttttttaatcccacttgaaaagacagtttttcattgtctcataggtttaccatactatactatgtgttttaagagttatgcgaaaaaaaaattaagaaagacttgaccccagccttgaagctttatagtttggggaggttaggtaatatgaaatgttatttaacaaaataagaccatacagttggtttcaatt

SEQ ID NO: 88297 - DNA, 601 bp, Human; identical to SEQ ID NO: 37832

SEQ ID NO: 88298 - DNA, 601 bp, Human; identical to SEQ ID NO: 37833

SEQ ID NO: 88299 - DNA, 601 bp, Human; identical to SEQ ID NO: 37834

SEQ ID NO: 88300 - DNA, 601 bp, Human; identical to SEQ ID NO: 37835

SEQ ID NO: 88301 - DNA, 601 bp, Human
aattttattattctatgtaaatcacttgtttgtgttttgaaatccttctgtgtatgtgcttgtatataaagataaaaataaagcactaagaaaaaagcaaaattgagtacgttagctgtgctttttccaaggtcatttttagtatagtaatattactcaagtgtttaagtatttgaaataatggtattgcttttatattttacagataaaccacataatcctatggtaaatgctggagcaattgttgtgacttcactaataaaggtaaaatgttgatgtttcattttaacctagtaaaactttttttttttaacagctaaggcataaagatgaatctgggattatttatgtagaattatgaaaaattttctcttggtgttaagaaatttgtcttatggtatagtgttaggatctttatttcaaaataaatgatgtagtcatttcaaggcaaaattaaaacagatgactcattgtaaattccaacagtcatttactcttgacttgaagatctggaaaatatttaaagtctgctgaagaaaggcatagaggctttttttttttttttaaagttttgatatttttcctttcgtttccttttggt

SEQ ID NO: 88302 - DNA, 601 bp, Human
taaggtcactttctcctgagtttttgttttgtttttagcatgtgtttcacaagtgctttttttttttttttttttttatgaagttcatacaaatcttggagagcaaagcctgatataaccctatgtaaaattgaatgccccagaatatgtaatatttttcttaggatcttttagggaaaggattaaattcatataaatatctataatgtgatctctgcaaattgtatgatcacataatatttataaattggtattggtttgaaatttaggtaataaaaccatagccaaaaggccttaaaarttgtcaaacccagttctcttactttatataacggaggaaactgagaacctggcaaggttgtaacagcagtagaattggacttgaactaaatctcctgatactcaatgtgctgttcattacaattcactctgccatatttaacgtaggtgtttgccatttctcttgatgacatctttaattttagttagcatagttatattgccccaaatgcagaagtactatttccttaatttgaactggttcaaacgataacaatttattggtttaaaagttgtatctcatttgatagcaagtgttacg

SEQ ID NO: 88303 - DNA, 601 bp, Human
catgaatcaattcataaatatgttgtaaaaactataaaacattgcaatatagttacattaattttttaatagataatgttaaaactcagtgcctctatcaaattttcattcatacagtattcttcaaaggaatgtaaattctgtaacttgacaggcatatttacagaaaaattttataatttactttttttttttgagacgaagtcttgcttgtcgcccaggctggagtgcagttctgcctcccaggttcacgccattctcctgcctcagcctcccgagtagctgggactacaggcgcccrccactgtgcctggctaattttttttttttttttgtatttttagtagagacagggtttcaccatgttagccaggatggtctccatctcctgacctcatgatctgcctccctcagcctcccaaagtgctgggattacagacgtgagccaccgcgcccggcctaaatttgtataattttctggtaccagaatctgattacccttttcaaacaacccatatgggtttgttttttaaaaatcatttggtgagtggattagaaattttgataagtatatttcttccaatttggtttattttaaaaa

SEQ ID NO: 88304 - DNA, 601 bp, Human
aactaaagtgaagattgcaaaaaagcaagtcataccaattttttcgttaaccaatgcatacggaagttgtgtttatactatagtaagtgtgcagtagtattgcatctaaaaaaaaacagtgtgaataccttaattaaaaaatattttataggtaagaaatgctaaggatcatcggagccttcagtgagttctaatctttttgctggtggaaggtcttgtcttgatgttgatgactactgactgataatggtggtggttgctgaagattgcggtggctgtggcaatttcttaaaataagacracaatgaagttgccacatcaattgactcttacttttatgaaagatttctctgtagcatgcaatgctgtttgacagcattttactcagagtagaacttctttaaaaattggagtcagtcctccaaaactctgccactgctttatgaactaagtttatggaatgttctaactcctttgttgtatttcaatgatcttcagagcatctttaccagaagtagttttcatctcaagaaaccactttcttagttcactcatgagaagcaactcctcatccgttgaagttttatcatgagattgcagc

SEQ ID NO: 88305 - DNA, 601 bp, Human
agtcatccatgaggattggaatcaacttcatttgaactcctgttaatattgatatttcgaccacctatgatcatgaaagttcttaatgatatttagaatggtgaatcttttccagaagattttcagtttactttgcccagatccattagacaaatcactattattgcagctattgccttatgaactgtgtttcttaaatagtaagacttgaaagttgaagttactccttgatccatgggctgcagaatggatgttgtgttagcaggcatgaaaacaacattatgctccttgtacgtctctrtcagaactcttgggtgactggtgtgttgttagtgaacagtagtattttgaaagaaatattttttttttttctggctggtcatggtggctcacacctgtaatctcagcactttgggaggttgaggtaagaggattgcttgagcccaggagttcaaaccagtctgctcaatatagtgagactcccatctctattaaaaaacaaaatctttttgagccgtaggtttcaacagtgggcttaaaatattcaataaacaaggttgtaaaccgatgtggtcttatctaggcttgttataagcccagg

SEQ ID NO: 88306 - DNA, 601 bp, Human; identical to SEQ ID NO: 37836

SEQ ID NO: 88307 - DNA, 601 bp, Human; identical to SEQ ID NO: 37837

SEQ ID NO: 88308 - DNA, 601 bp, Human; identical to SEQ ID NO: 37838

SEQ ID NO: 88309 - DNA, 601 bp, Human; identical to SEQ ID NO: 37839

SEQ ID NO: 88310 - DNA, 601 bp, Human; identical to SEQ ID NO: 37840

SEQ ID NO: 88311 - DNA, 601 bp, Human; identical to SEQ ID NO: 37841

SEQ ID NO: 88312 - DNA, 601 bp, Human; identical to SEQ ID NO: 37842

SEQ ID NO: 88313 - DNA, 601 bp, Human
gatccaaattatagtacaaattatagaggctccatgtattgtaggtcaaatatagtactttacatttttatgtttaattaaatctgccattcatattctggagattcctgaatatattgtagaagttttaaaactatttgaaaggggaaatactgttgtttacatgaatttgtattaatctgtgggatttttaaatgaagttcttttagaattagttaataaggagttccagtataatgatatattcaatatatgtaacagtttatgattacttgcttttaaagatttttttaaaaaattyatttgaagtaaagagagaggagacttaaaatacctggtgatcttgatctgacagtgtatatttaataggcatatatttatgtggaaagaactgctgaaatatactgatatgtcagcctatatcctgataatttatatataatgtgtgggttgcatatgtttgtgcatatgtatatacgtttgtgcatacatatatatgatttccttatctatgtaccttaatctacccattcatattctgaaaatgatgagcagttcttttcacattgtgtactatgtataaattattcattgatctatt

SEQ ID NO: 88314 - DNA, 601 bp, Human
tagatctactttagtaatttttgtaagttgtagctaatagagattttttaaatatgccatgtatagaaaacctgttttcataaaaaactttataatggcttcctgatccattaacccttaaccaaaatgaataggatactaattagcacttggattgcattgcttttttggcggaatctgtgggtttttttttttttttttgtaaatttcattcaccagtaaattacagaatacttattattgaaaaccatcatgtattgctttaaaacaaaagttataatcttgccctcaaaaggcaagmgttagaaacaggtgagctggtgccaactgcttctgtcggttaatcttgtaacatttttactatacatttaactctaaatctcatttactaattatggaatttttttaaagaaaaattatataccacatctcaatggcaaagaataattcattgtatttatttttaagccatatttcaatatctgaggatatgatttttctgtacatagtatgattaaaaataatggtattttttcattaggtatttaccttgctgaaacactttcaggccttaaaaccacagataattaaaattatctat

SEQ ID NO: 88315 - DNA, 601 bp, Human
aatgaataggatactaattagcacttggattgcattgcttttttggcggaatctgtgggtttttttttttttttttgtaaatttcattcaccagtaaattacagaatacttattattgaaaaccatcatgtattgctttaaaacaaaagttataatcttgccctcaaaaggcaagcgttagaaacaggtgagctggtgccaactgcttctgtcggttaatcttgtaacatttttactatacatttaactctaaatctcatttactaattatggaatttttttaaagaaaaattatataccrcatctcaatggcaaagaataattcattgtatttatttttaagccatatttcaatatctgaggatatgatttttctgtacatagtatgattaaaaataatggtattttttcattaggtatttaccttgctgaaacactttcaggccttaaaaccacagataattaaaattatctatttggaaggcttagcttttgaaagaaaaaattcttacccaaagtagtttttaaatttctattttcatattatgtttctggtgatttatgtttatataatgaaaatctcctctgcacagcaattata

SEQ ID NO: 88316 - DNA, 601 bp, Human
atatataagtaaaacgattttaaataaatagaagactagtcaagttctaaacaaatggtttcttaagaaaaatttgttttctttgcatgttagctcttggaaaacatgcaaaatatctagctacttcccttgtttattttagacatttggatctgtgagtggcccccaagtttcctaatttgtctgtttatttactctgtctatagtacatgttgtcttcagtatcaatctccatttcatagttctggagttttaatatttatgaaggactgtgtgtattgagttcttgaaatatgttaasttttgaaaggctttgttgacttacaaaatgttaaaacttaaatattgttgctctcaaaatattatagtattggtttcttaattctgaaaatttaaactgcctgagtagctcttctccctacaagtttcagtataaactcattcaatataaagtctgcttgcttttatattatgcattccaaaataaaaatgatgaaatattagtatcagttacacaaatgtaactactcacatttgaaccattttattgtaaaattcaactttcaattatgataatcagtctcttgctgaactttttaga

SEQ ID NO: 88317 - DNA, 601 bp, Human
tccgcccgcctcggtctcccaaaatgctgggattacaggcgtgagccaccacacccggctgaaactttgaagactttaaaaaaggggagagaatgatttggtttttaaatactgctctgcggagaatggattaaagagagagaaagttgaagttttggactcgagatgtgttggtggcttggactagaggtgagagaaataggtaaataagagatgtgtttaagaaataggattggcagcacttggtgatcgtttttggtgggtgaaaaggaatgcgatatcaagctgactaccaggtttwtagtatgagcaacagggccaaagctgctgcattaactaagatggagaacactggaaaagcaaaccttgggagtatgggaagaaattagtttaactttggctattgtgacaatgaaggatctgtttgattgtggatatcaggaggttgattgacagtgctttaaacatatgggggttatttttctaatataacagaaagtctcagggactatcagggaaaccaaccagggctagtgccattagtaaggtaaacttctgttacacaagccttaagtgtgttgatcttagaaatcacgcctat

SEQ ID NO: 88318 - DNA, 601 bp, Human
gtctcccaaaatgctgggattacaggcgtgagccaccacacccggctgaaactttgaagactttaaaaaaggggagagaatgatttggtttttaaatactgctctgcggagaatggattaaagagagagaaagttgaagttttggactcgagatgtgttggtggcttggactagaggtgagagaaataggtaaataagagatgtgtttaagaaataggattggcagcacttggtgatcgtttttggtgggtgaaaaggaatgcgatatcaagctgactaccaggtttatagtatgagcaayagggccaaagctgctgcattaactaagatggagaacactggaaaagcaaaccttgggagtatgggaagaaattagtttaactttggctattgtgacaatgaaggatctgtttgattgtggatatcaggaggttgattgacagtgctttaaacatatgggggttatttttctaatataacagaaagtctcagggactatcagggaaaccaaccagggctagtgccattagtaaggtaaacttctgttacacaagccttaagtgtgttgatcttagaaatcacgcctatcaacttagagttg

SEQ ID NO: 88319 - DNA, 601 bp, Human
ccagcatagtgcaatatcagcagtcaaggaaagagtattttaaggagtttggagcattgaactgtatgaaagcatagataatttagtaagatgagggttttatatttacatgatgtcctttctaaattttttttagatagaacaattgctttattttttagtgtcttaaaatatgcttttctccagcaattttctgtattatatgttggaggagcctgctatgtaatttgaataataaagtggctatgaaagtgctttgaaaagttacagcattagagaaacatactgttattacacctcttctgtgagtatgctccataaagcacacatgttgaacgtttcacaatagaaatgtgaaataaacattgaagaatatagggagttaagtaaggctctggagaccagtgaaaatgagggatttcttttctaacattaaagcaattagtaaagattgtgttagtattgtgggttggaataactatagaaaactcaagtccatgtgcctggcttcgttatagtagcaggatttgaggcatgctaagagaaataggaccttaaactctgaattgaaaccataattcttcctgtatgaatgctaaaa

SEQ ID NO: 88320 - DNA, 601 bp, Human
ggagcctgctatgtaatttgaataataaagtggctatgaaagtgctttgaaaagttacagcattagagaaacatactgttattacacctcttctgtgagtatgctccataaagcacacatgttgaacgtttcacaatagaaatgtgaaataaacattgaagaatatagggagttaagtaaggctctggagaccagtgaaaatgagggatttcttttctaacattaaagcaattagtaaagattgtgttagtattgtgggttggaataactatagaaaactcaagtccatgtgcctggcttygttatagtagcaggatttgaggcatgctaagagaaataggaccttaaactctgaattgaaaccataattcttcctgtatgaatgctaaaaccgtgttgtttcacagcaggaagagaacctcatctattttcagggaccttgtttgtatttatttatttttaatttacacaaaatggtgtctttgtaagaatagtttgattccaatggcctggattttttttttttgtttaatatgtgtatttggtgatgaatgtcttctcttcctgtcttaaattcgcttttaagttctttgacttttgg

SEQ ID NO: 88321 - DNA, 601 bp, Human
catactgttattacacctcttctgtgagtatgctccataaagcacacatgttgaacgtttcacaatagaaatgtgaaataaacattgaagaatatagggagttaagtaaggctctggagaccagtgaaaatgagggatttcttttctaacattaaagcaattagtaaagattgtgttagtattgtgggttggaataactatagaaaactcaagtccatgtgcctggcttcgttatagtagcaggatttgaggcatgctaagagaaataggaccttaaactctgaattgaaaccataattcktcctgtatgaatgctaaaaccgtgttgtttcacagcaggaagagaacctcatctattttcagggaccttgtttgtatttatttatttttaatttacacaaaatggtgtctttgtaagaatagtttgattccaatggcctggattttttttttttgtttaatatgtgtatttggtgatgaatgtcttctcttcctgtcttaaattcgcttttaagttctttgacttttgggttttatgtacttgttttttaaatatagcactttatcattccagaaatgtggaaccttgtcctctatccta

SEQ ID NO: 88322 - DNA, 601 bp, Human
aagtaaggctctggagaccagtgaaaatgagggatttcttttctaacattaaagcaattagtaaagattgtgttagtattgtgggttggaataactatagaaaactcaagtccatgtgcctggcttcgttatagtagcaggatttgaggcatgctaagagaaataggaccttaaactctgaattgaaaccataattcttcctgtatgaatgctaaaaccgtgttgtttcacagcaggaagagaacctcatctattttcagggaccttgtttgtatttatttatttttaatttacacaaaayggtgtctttgtaagaatagtttgattccaatggcctggattttttttttttgtttaatatgtgtatttggtgatgaatgtcttctcttcctgtcttaaattcgcttttaagttctttgacttttgggttttatgtacttgttttttaaatatagcactttatcattccagaaatgtggaaccttgtcctctatcctaacacactaatgtaatattcactaatgttcatgaacttttacaaaaacttgtttgtataatagtgggagaagaccagaaagatagtgaatgagaaactttgata

SEQ ID NO: 88323 - DNA, 601 bp, Human
actccagaggctgaggtgggagaatcacttgaacccgagaggcgaaggttgtatgagccgagatcttgccactgcactccagcctgggtgacagagcgagaccttgtctcaaaaaaaataaaatgcagggttgggggccgatagaggaattaattttgcaatttaatacccaaaattgaatatttgatgccttgagggagaatattcacttagtcaatagatatttaatgagcacctattatgtgtgatagacactgagtttacggtggggaacagaaagacaagtggtctctgcccacayggagcctatatttaatgagagagacaaaaaacaagtatatataaaaatatatatactttatatatagttatatataacaaatatagttaaaaaggatatagttaacaatacaatatatatatatatatgaaggggaaaagcaaggtaagggataaggagtgatgaaaagaggggagtgttttagagtcttgagagaacatttgaatggagacctacccaaagggagggggagagggagcctcctgacagcctggggaaagagcatctctagcagccagttgtaggccttgagtgcctgag

SEQ ID NO: 88324 - DNA, 601 bp, Human
ccttgagggagaatattcacttagtcaatagatatttaatgagcacctattatgtgtgatagacactgagtttacggtggggaacagaaagacaagtggtctctgcccacatggagcctatatttaatgagagagacaaaaaacaagtatatataaaaatatatatactttatatatagttatatataacaaatatagttaaaaaggatatagttaacaatacaatatatatatatatatgaaggggaaaagcaaggtaagggataaggagtgatgaaaagaggggagtgttttagagtcytgagagaacatttgaatggagacctacccaaagggagggggagagggagcctcctgacagcctggggaaagagcatctctagcagccagttgtaggccttgagtgcctgagaccagccagatgttctgaatggagtagagctggaaagggaagagtggtaggaatgatatgtgcagtgtaaccaggaatagagcctttagggtcctgaaagccatggtaaagagtttgattttcctttagatatgatggaaaggcacgggagttccttgatgtttttaaaagatccctatggcagcagag

SEQ ID NO: 88325 - DNA, 601 bp, Human
aaggggaaaagcaaggtaagggataaggagtgatgaaaagaggggagtgttttagagtcttgagagaacatttgaatggagacctacccaaagggagggggagagggagcctcctgacagcctggggaaagagcatctctagcagccagttgtaggccttgagtgcctgagaccagccagatgttctgaatggagtagagctggaaagggaagagtggtaggaatgatatgtgcagtgtaaccaggaatagagcctttagggtcctgaaagccatggtaaagagtttgattttcctttagmtatgatggaaaggcacgggagttccttgatgtttttaaaagatccctatggcagcagaggtgataaggtggtggttcagatgaggcctaaggcaatagtgatagaggtggtgagaagtgataggattccaaacatattttgcaggaaagaggatttattgatgagctagatgtgggctgtgagagaaagaatagaatcaaggactaccccccatggtctgtatggtgaatttgtctgaattagaaaaagctaattctgtctctggccagaagcagaagcacttctcagcaccactgggta

SEQ ID NO: 88326 - DNA, 601 bp, Human
tttaaaaataggatgaaattgtgtctgttttaaggtaaactgagagaaccaatgaaagaggaaaagttaaagatgctagaaacaaaggggatcagtgagggaacaagaacagggcatctagaggataagtgtttgaaggaatagataaaaagtagtctcaaaaatgaggaagctttttactttgagcgatgaaaacagtttttatctttttagcaaagttgtagttaggatcttctgtctgtttttaggggtctccactggtattaaaggcctgaagaaagtatggcgggaaccaacaagcaaaaaaaattgtcaagcagtaatgagagaccaggtggaaatatggagaataatctgtaatagccagtcagtattctgtggtccaagagcaaaaagggaattgagaattcagagttgaccccattaaaaaagaaagacattaaggacacctgaaacagtggtttataacccagaaaagtgcatatcaaagtcacctggagactttaaacaaaattatgggctgagcatgttggctcatgcctgtaatcccaacagtttgggaggccaaggcagaaggattgcttaaggcccggagttcaag

SEQ ID NO: 88327 - DNA, 601 bp, Human; identical to SEQ ID NO: 37843

SEQ ID NO: 88328 - DNA, 601 bp, Human; identical to SEQ ID NO: 37844

SEQ ID NO: 88329 - DNA, 601 bp, Human; identical to SEQ ID NO: 37845

SEQ ID NO: 88330 - DNA, 601 bp, Human; identical to SEQ ID NO: 37846

SEQ ID NO: 88331 - DNA, 601 bp, Human; identical to SEQ ID NO: 37847

SEQ ID NO: 88332 - DNA, 601 bp, Human; identical to SEQ ID NO: 37848

SEQ ID NO: 88333 - DNA, 601 bp, Human
gctggacttttccttctgatgatttttaaaaatgaattatggtagtctatttcttgagtcaattttggtaagttacatttttctaagaatatccatttcatctgagttttcaaacttagtggcgtaaagttatttatagttttttaagacctaatattgacctaatattgattgtacacttatctctccttagctcctgaccaaccttgccaaaggtttgccaattttattcttttttagagatctgcaaactagggtctgtgtgcccagtctcactcacctcctgtttttataaataaayttttattggcacacagctgggcctatttatttatgtactgtttgtggctgattttgagctacaatggtgagttaagtagttgtgacacaggctgtttggcccgtaaagcctaaaatatttactctctggccttttacagaaaaagcttgccaacctctgatctttttgaagaagccactctgggcttagttgctattcttgcttgtgctgtacacgtgtatatatttgtctcctctcttagttattttattgttcttatctaacttaatttgggtgcttagttcattaatttttagtcat

SEQ ID NO: 88334 - DNA, 601 bp, Human
tccttccttcctttcttcctctctttctttcttctttccttttttttttttttttttttttttttttgtagggacagggtttccacgttgcccaggctggtctcaaactcctgggctcaagcgatctatctgcttcagcctccccaagtgttgggattacagacgtgagccaccacacctggtctattccttattatatctttatatcatccttttattttcagcctttctgaatccatgttttatatatatcttttataaatactgatcagttggattttaaagaacccagtcagacatkctttgttttttaactggaatatttggtccatgtacatttattatatgactaatattttggatttttttccattattttatttgtatctcccctctagccctgatatactttctgtacagatttatcatctgggattagcttccttctatcgaaagctcttttaggattttcttaatgaaggcctactggtggcaaactctgtccttccctacctactggaaaatatctttattttgccctcatttttaattactatttatttggggtattaaattctataatgttagtggttttccctta

SEQ ID NO: 88335 - DNA, 601 bp, Human
gatctatctgcttcagcctccccaagtgttgggattacagacgtgagccaccacacctggtctattccttattatatctttatatcatccttttattttcagcctttctgaatccatgttttatatatatcttttataaatactgatcagttggattttaaagaacccagtcagacatgctttgttttttaactggaatatttggtccatgtacatttattatatgactaatattttggatttttttccattattttatttgtatctcccctctagccctgatatactttctgtacagatytatcatctgggattagcttccttctatcgaaagctcttttaggattttcttaatgaaggcctactggtggcaaactctgtccttccctacctactggaaaatatctttattttgccctcatttttaattactatttatttggggtattaaattctataatgttagtggttttcccttagtaattaaagatacctttgtgtaaattagcggggcgtggtggcgggcacctgtagtcctagctactcgggaggctgaggcaggagaatggcgtgaacctgggaggcggagcttgcagtgagc

SEQ ID NO: 88336 - DNA, 601 bp, Human
atttattatatgactaatattttggatttttttccattattttatttgtatctcccctctagccctgatatactttctgtacagatttatcatctgggattagcttccttctatcgaaagctcttttaggattttcttaatgaaggcctactggtggcaaactctgtccttccctacctactggaaaatatctttattttgccctcatttttaattactatttatttggggtattaaattctataatgttagtggttttcccttagtaattaaagatacctttgtgtaaattagcggggcrtggtggcgggcacctgtagtcctagctactcgggaggctgaggcaggagaatggcgtgaacctgggaggcggagcttgcagtgagccaagatcatgccactgcactccagcctgggcgacagagcaagactccatctcaaaaaaaaaaaaaaagttagtggttattctgctatttattgtgtacttttaaaatcttgtttctgtccaattctcctctcctgattctcaagtttcgtggttatttttactgtactgctttttagtcgtattttcaaatccctttgtttcttcaaatgaagt

SEQ ID NO: 88337 - DNA, 601 bp, Human
aagatgagatgcctgggtagggagaaagggtgactacagtagtcccctcttatctgtgagggacacattccaagacccccagttggatgcctgaaactgcaaatggtaccaaaccttatatatactgttcgtccctatacatgcatacctatgataaagtttaacttataaattaggcacagcaagagattaacaacaataactattaataataataaagtaggacaattagaacaatatgccagcattactgctcttgcactttggggccattgttgagtcaaataagggtaactggaayatgagcactgagatatcagaagagtccatctgttgactgagatggccaccaagtgactgacagccaggagtatagacagtgtagatacactggacaaagggatgattcatcacttggatgagacagagtgagatggcacacagtttaaaacttatgaattgtttatttgtataatttttcatttaatatttttgggtcccagttgaccacaggtaactgaaacctcagacagcaaaactgtgggtaagggggtactgccgtacctgatttcttatgaaaagaaaacaagaattaacacta

SEQ ID NO: 88338 - DNA, 601 bp, Human
aataactattaataataataaagtaggacaattagaacaatatgccagcattactgctcttgcactttggggccattgttgagtcaaataagggtaactggaatatgagcactgagatatcagaagagtccatctgttgactgagatggccaccaagtgactgacagccaggagtatagacagtgtagatacactggacaaagggatgattcatcacttggatgagacagagtgagatggcacacagtttaaaacttatgaattgtttatttgtataatttttcatttaatatttttgggycccagttgaccacaggtaactgaaacctcagacagcaaaactgtgggtaagggggtactgccgtacctgatttcttatgaaaagaaaacaagaattaacactaaccacaaccttatgccaggtgtgtctcctcatctacatcttgttagagccttttgggatagtgatattatcccattttgcctctcagaataccaagtaccaagcctctcaaaagttttgcatgtccagagtcacagctggtaaatgatgaagcaggactctcctcaggtctgtctgccatcacgtcccattttcttt

SEQ ID NO: 88339 - DNA, 601 bp, Human
gccctagtatatgataactctgttttttactaagtgatttgataaatgtttaaaatcatatggtcttgattcctttttaagaattttcatgtcagttcataaaaaatctgtcagaccatctacattcatttttggttagagaaatggtgtcagcaaatcctgtattctaatattttgggtttttttataagcgagttgcagaatattttttactttttattttccttgtcgtctataaactctcctatctaaccaaaaaaaggatataaataaataaaatcaagatgactattatgattartttgggctctgtgagatggcagatgagttggttttcttctgaaattcggcattaggaataattaggaataaataccattctgatttttatgaataatgattccattatataatggtgtaacattcttatattttaagtgaaaccttttgcattttgatgaaattaaaatgttcttaattttgaaactctgttttggatatccagctcactgttaatgaagcggctgctcaactctgtgtgaaggataatgccctgctgacaagaagagatgagctttttgccttggctcgacagatttct

SEQ ID NO: 88340 - DNA, 601 bp, Human
taaaatgttcttaattttgaaactctgttttggatatccagctcactgttaatgaagcggctgctcaactctgtgtgaaggataatgccctgctgacaagaagagatgagctttttgccttggctcgacagatttctcgagaagtcacctataaatatacttacagaaccaccaagtaagtatttaactaatcgtcattatttttgcattgcttgagagaagtagagttcgaaacatcatctattgatagaatataagcatttctgaaaaagtggaagtatgattattgttctatgaaacyaaacaatgcagtgattttgaaaacattgccaaggtgatttttgttgtttaattctcactgttctcttttgaaaggcatcattctctagttactatagcattgttctggtagtggttttaaacattcttctctcatacacacactttggttttgagtgtgacgaggggatttagtcagacagcatttatagacgtatttgtacacccgctaactacgtgaacttgttgaactctgaggaaatagaatggtcctttttgcaaggtgtttgaatctgatgagattagctgaatatgtaaaacg

SEQ ID NO: 88341 - DNA, 601 bp, Human
acttttacataatttagaagccaccttggactcctaaggtgccctcattatttttttacggctgcatggtattgaattgtgtggatgtgctgtgattcatttagcccctattgatggctactggggttgtgtctagtcttttattgtaaaaccacaataaataacatcatacataatatgttttgttgattctgagatgtactttttcacattttaacaaatcttttatattgaagtataacttgtagttgatggcttgtcatagtttaattaatttcatagtggtacatgaaataattaygtgtcttaccattgatggagcatcattttatatatatatatgtaggtaccactgggataggttttcccagcagagaaattgctgggtcagggtaaatacatctgtagtttctgtagatagacaaaatgcattttaatctcatgtagccataaacatacatcttaagtggtcattttagtcattttatcctaaattattcctactgaaccataaagggatatcctccttgatttttttttcattatgtgatgatcattaaatatttattaagtgctaggctgggcacagtggctcacgcct

SEQ ID NO: 88342 - DNA, 601 bp, Human
tggaggtatggtcatatgttacattttcttatgctgataatgtttgcttttgttttaagatcaagcaaaatcttaactagttcagacaaaaaagatggtcccataaactagtgaaaaatggctttcaataaatcttttaaaaatatagaattttgttaccttgaaatacaatatttacagtaatttgaattagcagaccaaggaaaatttttttaaacttttttttcatgtagagatgtggtctcgctatgttgcccaggctggtcttgcactcaaactcctgggctcaagtgatcctccytccttggcctcccaaaattctgggattacaggtgtgaaccaccatgcctagtcccaggaaattcttaaaagaaaactgtggtgactagtccagtcaatttatcaaaggttgatttgcaatcggtgtttcttacagatttaaaacttcacgggttaaaccattcctttcatagttgtatttacatcattagtcatcaaatacagaggagctaacttttcgtttctttatattaactatctaagggaaatgataatttagtagctataaattacagagactttactgtaactaaagcctctt

SEQ ID NO: 88343 - DNA, 601 bp, Human
caaaatcttaactagttcagacaaaaaagatggtcccataaactagtgaaaaatggctttcaataaatcttttaaaaatatagaattttgttaccttgaaatacaatatttacagtaatttgaattagcagaccaaggaaaatttttttaaacttttttttcatgtagagatgtggtctcgctatgttgcccaggctggtcttgcactcaaactcctgggctcaagtgatcctccctccttggcctcccaaaattctgggattacaggtgtgaaccaccatgcctagtcccaggaaattcytaaaagaaaactgtggtgactagtccagtcaatttatcaaaggttgatttgcaatcggtgtttcttacagatttaaaacttcacgggttaaaccattcctttcatagttgtatttacatcattagtcatcaaatacagaggagctaacttttcgtttctttatattaactatctaagggaaatgataatttagtagctataaattacagagactttactgtaactaaagcctcttttagagtgtcacggttgaggctgctcttttgattttagatttgcaagtggtaaggtgggagttaa

SEQ ID NO: 88344 - DNA, 601 bp, Human
tttcaataaatcttttaaaaatatagaattttgttaccttgaaatacaatatttacagtaatttgaattagcagaccaaggaaaatttttttaaacttttttttcatgtagagatgtggtctcgctatgttgcccaggctggtcttgcactcaaactcctgggctcaagtgatcctccctccttggcctcccaaaattctgggattacaggtgtgaaccaccatgcctagtcccaggaaattcttaaaagaaaactgtggtgactagtccagtcaatttatcaaaggttgatttgcaatcrgtgtttcttacagatttaaaacttcacgggttaaaccattcctttcatagttgtatttacatcattagtcatcaaatacagaggagctaacttttcgtttctttatattaactatctaagggaaatgataatttagtagctataaattacagagactttactgtaactaaagcctcttttagagtgtcacggttgaggctgctcttttgattttagatttgcaagtggtaaggtgggagttaagaaaaacatacttaggactctccgaactatagaatggtttcagaactattgtttctt

SEQ ID NO: 88345 - DNA, 601 bp, Human
gtccagtcaatttatcaaaggttgatttgcaatcggtgtttcttacagatttaaaacttcacgggttaaaccattcctttcatagttgtatttacatcattagtcatcaaatacagaggagctaacttttcgtttctttatattaactatctaagggaaatgataatttagtagctataaattacagagactttactgtaactaaagcctcttttagagtgtcacggttgaggctgctcttttgattttagatttgcaagtggtaaggtgggagttaagaaaaacatacttaggactctcmgaactatagaatggtttcagaactattgtttcttacaaatactttttaaaaagtctagtttgcagcagagtggaaatctggtcaggtggctccttcctttctttttgttttaggcaggggatggaggtcagtgttctcttagccatcctattatttaatttcaagttaaagcaaataatctatgcttgaccaccctaaatttctgtcatcagttatatctacagagtatctatatggcagtaatcctttattcatatcaaagccagagttatcttataaaaacataaatccctttcttgc

SEQ ID NO: 88346 - DNA, 601 bp, Human
caaagccagagttatcttataaaaacataaatccctttcttgcttaactcctttcagtggctttctactgtacctggaataaaatctaaactttttttttaaaggatctaagaccccacatgatctgactgcagcttgcatctcctaccttgtctgctgccacactctccattcttactgtgttccagccgcactgactgactttctgttcctgaacatgccaaactcatttatgcctcaacactcactgttttccccctacctagacttctgtttctttagatggcttcaagtcacagcygagtttcccctgacttccctgcctccctttctaaaggggcaccctctccccaaaatcacactcaggcttattctcctggtttgttttcatagcattcgccagtatttgaaactgttagttacttgttttaaatttattatcagtctgccccattagatgagaataggtctcttatctgtgaatctgctgctgtatacttagagtttgtaacagccttgcacctaataggcacttaataaaatctatagaatgaaataatgaatggctgcagataagcatctttgacttataaacacttta

SEQ ID NO: 88347 - DNA, 601 bp, Human
aacatagaaactgctaagaaggcatgtgccattggaggattgagaggaaagaaagcacagaaactacccaggggccaaaaaattagttgctaggctagaaatatgtctctatctatttctcaccattggccctaagtgtgatcatgattcaggctgctcacatttaagccacacttgtctagctttagaggtcactaaatattgaaatttgtgatcatgaatctcatggactgtttgagctgcagttgtttcttgatgagttttattggtaagtctttctgaccctctcagaggccttgtwtttcattacagtgctttcagtttcttattagaagcacaaagtgttgggctgtaacattagatatgacctttctgttcctttaaatatactccactagagatacttgagttatagttctatacggttagtttattggtttactggaggtcacaaagccacttgaacagctctggattcaaaattaagataatcagtgttacttttccctgtgaataactcttctaacccttcctaaataagacaagcgacaatcggccccaggcttctttaaatgcttttatagacactagacttttgatt

SEQ ID NO: 88348 - DNA, 601 bp, Human
agaacaataagtttgtctagggaatgtgattgacacaaaggacctcataaataaaactagaaagaatttagaattcttttaacatactttttctcttatttcatttgagtctttctcttgtgattctcagcttgttattttctatttaaagaaagtaatatacaagactgagcatggtggcttatgactgtaatcccagcactttgtgaggctgaggcagatggattgcttgagtccaggagtttgagaccagcctgggcaacatggcaaaaccccatccttacaaaaattagccaggcatgatggcatgtgcctgtagtcccagctaatcaggaggctgaggtgggagaatcactgccccactgcactccagcccgggcaacagagcacaaccttgtctcaaacaaaggaaaaaaagtttttaagtaacgtacaaataaacttaagcttagcccattttatagtgtaacagatttctaattacaaggcccaaactaatgagacaagtttttctcttttttcaaatctttaagtgttctaaaatcctttataacaataagcatatgtgccacattgctggctttttccatcttaaaaacat

SEQ ID NO: 88349 - DNA, 601 bp, Human
acagtgtatgaatcagctgggtggatgcgacatttttgttgaatgtataaacacatgtttctagatttccagtgttcttttcactgagatagttccccacgaatgtgcttaatattctctggttgattttagtattaaatgttgagttcttccttctctaagatgtctgtactttgtaattgtccataaaatttctcttttttccccagtatgatgctttactctgattaaatctggtggctttttggatgaacttaacagatatcagtaacaaacatttatcaagtaattcctatgggcmaggcactgtgttaagtatttttcatgaattttctgcttccttaaaatgattctgcaagttaagtactattgttatccccattttatagatgagaaaatagacacagagagatgaaataatctacccagtatcacagcaaataagtagtagagttgggttttgaactctgcaagtcatatagttaaagcccgtccagcttatgaaaaacagagctataatttctgtttatagaaatgcctgtgtttttgtgagtttcataaaggtagtaactctgaatttatggactgagcataggctttg

SEQ ID NO: 88350 - DNA, 601 bp, Human
gctttactctgattaaatctggtggctttttggatgaacttaacagatatcagtaacaaacatttatcaagtaattcctatgggccaggcactgtgttaagtatttttcatgaattttctgcttccttaaaatgattctgcaagttaagtactattgttatccccattttatagatgagaaaatagacacagagagatgaaataatctacccagtatcacagcaaataagtagtagagttgggttttgaactctgcaagtcatatagttaaagcccgtccagcttatgaaaaacagagctrtaatttctgtttatagaaatgcctgtgtttttgtgagtttcataaaggtagtaactctgaatttatggactgagcataggctttgaagctagcgttgtagctgtaaaaaaaaggaaacccagtcttgtctgtgatgaagattaaatgaaataatgaacataaaatatagaacatagggactggtatattgtagacccctggaaaatgataaccgcttatattgaagttgttctaactcttctactagcttacctcactgaacttgagaacttaagcagttccagtggggtgggggtttgc

SEQ ID NO: 88351 - DNA, 601 bp, Human
gcataaattaagaaaacaagaattcttagtgctgacaaggaaattgtcatgtattgcttgtggtatgataaactagtaaaggccctctataggtttagcgaaagtacataaggcacaaaaatatcatctctgcagtaattctgcttctgggaatcttttgtagtagataatctaagctatcgaaaatgctatctccatgaaaatatttttgcagtgtttttcataaaaccaaaaattaggaaaagaataaaaaatgtccaatgcgaggatagtggctaatcaaaccccccactaggttaartgttttttatgtgttttgtttttgtttttgtttttttgagacagaatctcactttatcaccctttgtcacccaggctggagtgcagtggtgcagtctcggctcactgcaacctccgcctcctgggttcaagcgattctcatgcttcagcctcccaagtagctgcccagcctccctagtagctgtgatttctggcgtgtgctaccactcccagctaattttttttttttttttttttttttttttagtagagatggggctttaccatattggacaggctggtctcgaactcctgacctcag

SEQ ID NO: 88352 - DNA, 601 bp, Human
aatgctatctccatgaaaatatttttgcagtgtttttcataaaaccaaaaattaggaaaagaataaaaaatgtccaatgcgaggatagtggctaatcaaaccccccactaggttaaatgttttttatgtgttttgtttttgtttttgtttttttgagacagaatctcactttatcaccctttgtcacccaggctggagtgcagtggtgcagtctcggctcactgcaacctccgcctcctgggttcaagcgattctcatgcttcagcctcccaagtagctgcccagcctccctagtagctgkgatttctggcgtgtgctaccactcccagctaattttttttttttttttttttttttttttagtagagatggggctttaccatattggacaggctggtctcgaactcctgacctcaggtgatctgcccaccttggcctcccaaagtgctgggattacaggcgtgagccactgcacccagcctaggtgaaatgttatataaccgttattatcaatgatcataaagccttctttccagtgtaaaacaataggaatgatgacatttttcatcttatttatgtttctactgaggttacagctgta

SEQ ID NO: 88353 - DNA, 601 bp, Human
cctgggttcaagcgattctcatgcttcagcctcccaagtagctgcccagcctccctagtagctgtgatttctggcgtgtgctaccactcccagctaattttttttttttttttttttttttttttagtagagatggggctttaccatattggacaggctggtctcgaactcctgacctcaggtgatctgcccaccttggcctcccaaagtgctgggattacaggcgtgagccactgcacccagcctaggtgaaatgttatataaccgttattatcaatgatcataaagccttctttccagygtaaaacaataggaatgatgacatttttcatcttatttatgtttctactgaggttacagctgtagaaaataatgtatgtttcataaaaggctgaaatgaaatattttataaccattaaaatcttaatcatgattattcaggtagtgagattaagagtttgctttattttcaagtttttgataatattttattatttacaaactctaaatataaaggacttcttatttgacccacaggatgggtttccagatttccaggattctgtgcaaacactcttccagcaggctagagctaagagtg

SEQ ID NO: 88354 - DNA, 601 bp, Human
tgttcaggcaaaatttatttttaagaaaaaccatggtatgtttttaatattatgcatatttcttttttcttttcattaggagaaagacctttgaatctccgaatgcctaatttacagaacagacaaccccatcattttgtggtggatggggagctgagcagactttaccccagtgaggcaaagtcccactcatcaggtgagaacgtgctatatgatgagagggtaacacttgaataaaagcatctttaaattctgttctatttcctcccccatcaaaaaaaaaaaaaaaaaaaaaaaagtyattactgacagtgttcctacaggttgagtatccctaactggaaaattcgaaatgcttcaggatccaaaatgttttgagtgtcagaatgacactcaaaggaaacccgcattagaacatttcagatttgggatgctgaacctttggtgtaatgcaaatagtccaaaatctgaaaaagctcaaaatccatagcacttcctggtcccaggcattttggataagggatgctcaattgtcagtttttctccccttggaagtggtagattgccataacactggctgctctcactagtctttttgcaa

SEQ ID NO: 88355 - DNA, 601 bp, Human
ttctgttctatttcctcccccatcaaaaaaaaaaaaaaaaaaaaaaaagttattactgacagtgttcctacaggttgagtatccctaactggaaaattcgaaatgcttcaggatccaaaatgttttgagtgtcagaatgacactcaaaggaaacccgcattagaacatttcagatttgggatgctgaacctttggtgtaatgcaaatagtccaaaatctgaaaaagctcaaaatccatagcacttcctggtcccaggcattttggataagggatgctcaattgtcagtttttctccccttrgaagtggtagattgccataacactggctgctctcactagtctttttgcaaacttcatattccgaacaatgacagggaaaactcatgaaagttgagattactttgattagccattatatgaatggtgatgtttatatgaaagtttaataataaatagctggtttgagttgtgttactaccttttttggcaataacataatatgaaattgatggactacatgtttgctttgacagtgagaaaaccttgtgtatcaaaatctagacttttcatgcagatgtattttggaggtgatactcatat

SEQ ID NO: 88356 - DNA, 601 bp, Human
ctcctctagctcccgcctccccgccaggcgagcaggagaggtaggcctgagcctctcctctccccaccccgcatcccgggctcccagaccctgcagccccgtgggcccgctcccgtccggggctgccagctctgcccgagcctcaccagtgcccgattcgggctcagcggcccatccggccggtttcgcttcccggtacgctgcagggtcagggtcgcggcccggaacgtggggattggtccgggcttgagctcctcggccttccacgccgcctcctcccacagctgccacctccgtacgsccccctcggccaacggagcccgaacctcggccaggcccgggcggaagtgacgtcacgatagacccgcccacccggggccgggccgtgggagccccgccccctggcgcgggtggtgagatggctggggccgagtcccaggggcgccggggccatgggccaagctcaggggagcagagcctgaggccgagaggggtcccctgggcacgaagaaggggagctcattagtaacctcgatttgggttctgtggactggaagaggctcccataaggcaggggaggagaaggagaagaggaatccat

SEQ ID NO: 88357 - DNA, 601 bp, Human
gctcactctcatccaggttgatatagtcctgccgctcctcctggtcccccgtgcgatggtttcgggagcgctggaggatgtgagccctgtcccggatgtgatgcccaatggacatctgctccagtccactgtctgaatcccgaacagtcctccgtgtctcccggatctgggatgaggcagaacgtggcacactcagccgccccttccaaagccctgcctataccatctcaggataaacacaccacacacaacccaatccggaaaaaagcagccagggtttctggcggtgccgctcaatccyaccttctctgggacaggagggctccccaactcaccccgcctggtgccgagcgcatctctgatgtctcttggtagaccttgggggcaccatcacccgtattggagtaggagatgacagtggaagatgagaaggtctggcaattgcctccagctgtcatgtgttcctgaggacagggtaggtaggggagggctgaatggggaggcatcacccctggtgaagggatttcacccttcagctgcctgttctagcctgtatctttctcacaaaatgcaagaactgaaaaaacatcaggcctcatca

SEQ ID NO: 88358 - DNA, 601 bp, Human
agacccccagggagaggtgggggccggcttgcctgttaatttaatattaaattggggatgggaatcgagaggaaaaagttattcaggggatgatttctcagcctctcagcctgtacctggagggggaaagagagaggagcacaagtcaaaaggaagaaaaaacttacgttaagagccaggagttggggtttaatcccctatgtcagtgagaacattgttctctttccatgtcaacttgtactaccaaaggcagctcctgcgggagcctgaactgagcctgccttgcagccgaggaccgtcmgcaggtgcaccccaccctccttactcctgatacttacaagagaggctgagggcccggggccctcaccagtcatagcggcgggactgtcgggaaggggagtcctcaggtccctggatggccaggcggggaggcccctccgcccttcgtcccccagcccctgaggactcaagccgccgaaactccaggggacgctgctgccggaatcgggaggtctcccgccgccactcgtcatcaaacgctgcggcctcacctggaaaggacagagcggacatgaggcctgtgtgcggcctggctcctgga

SEQ ID NO: 88359 - DNA, 601 bp, Human; identical to SEQ ID NO: 23961

SEQ ID NO: 88360 - DNA, 601 bp, Human; identical to SEQ ID NO: 24672

SEQ ID NO: 88361 - DNA, 601 bp, Human; identical to SEQ ID NO: 24673

SEQ ID NO: 88362 - DNA, 601 bp, Human; identical to SEQ ID NO: 24674

SEQ ID NO: 88363 - DNA, 601 bp, Human; identical to SEQ ID NO: 24675

SEQ ID NO: 88364 - DNA, 601 bp, Human; identical to SEQ ID NO: 24676

SEQ ID NO: 88365 - DNA, 601 bp, Human
ggcccccagagagaagctgaccagctctttgctctcctggcccaggacgtagggaagagccccctaggtagtggaaatgccatactgaccttgtggcacagaaatgaagacctcacggtggggtggaagggcaccctctctggagtgagagtgaagagttctgagctacccttaaagggagaagggaattgagtgccccccagggcagccgttctgcaccaggctcctctcctatcccctatcctgttccagaaaggacccccccgcccagggtgatctcacacaggagacttccattcayatggaatcagatacacagcgtggcacaccaacaccagatcagatcacacaaggacacctaccgtgttacactgtgcctgccaaggagtgggtggggagagcactggaatctgaattgggaggctagtgtagtgtccagaagggactcagatgtgccatatcagcacaggacgtcaacctatgcctgctaggatcttggggtgaaggagaggggctggctggtgggagggtctcctagactggtccctccctcttctccattcctatcccaccccagtcacagaccttgtttgttgctctc

SEQ ID NO: 88366 - DNA, 601 bp, Human
agggatagaggaaactacttgaactgttttggggcggggagggcagaaagtgggaggggtgctgggaatgtgctaaggtgtagtgtttggccaagtaggggcctgaggattagggagacacagatggagagaaacaaagaccttagaagctgaaggggaagctgggagggatgcccaggagagagagtcctcaggaaaaggccccagaggtagacaaaaggcagagctgggcgggcagtggcggggcaggcaagggaggcggagggacacaggagggggcggggcactgaggctgcaagcmgatggagaggatttgctttgctgagctgaactcttcagccagtgaggtttgggagaacttgatgggggtggggatcattaccctggttgcccgctcctgcttcttcatccctttcccacctcaccttgggtcttggggaaggaggtgtttggtctcaaccccttcatggccctaatgtaaggaccctagggcccctattctgtctctaagctgtggccaccttattcagttcacacacctctaagctcactacagagggagaactggggctgcagggacttaggggctgcaagccatttg

SEQ ID NO: 88367 - DNA, 601 bp, Human
gcccttccccaatgacccatttctggctcctcagatgaggaagaagaagaagaggatgatgaagggcccgcgctgaagagagctgccgaagaggaggtttgggctgggttgctgggcctgaggggctgtcagggatgcagccgggctgggcgccctttggatttggacccagatccctgtgtggcaggggtgggggctggaacaggaccgggacagggggaggtctcccctcccattttacagctcccccattctctccctctccacaggatgaagcggatcccaaacggcagaagacagaaaatggggcatcggcgtgagcccctgccaacaggctggggttgggaggcctctctgggcctggaggtgggggtgggggcagccaagtccagccactcttcacctggctccctgctctgggccctgcaccagagctgccaccctcttctttctccccagccttctcatttccgcctctccagacactgcgccctccaccctcactctgccattgttccacctcctgacctgctccatctgagctctccagctggcccccaattgctcctctctctctttgctctctttctccctcccctac

SEQ ID NO: 88368 - DNA, 601 bp, Human
tccagcccttcctgcttctttacagaaagaggaggaccctgctacaggcactggagacccaccccggaagaagcccacgcggctggctattggtgagcaccgctgcagtcctattcttctccctgagctggtctttctggctctcagcagcaccaggaaagccccaaagagtgggcctgattgatggccctagaactctggatggggcaagtgaggtgctggctcggaggagggacattgacctgttgtcattgctctactctccctcttcttccctatccttccaggtgttgaaggcggrtttgaccttagcgaggagaagtttgaattagacgaggatgtgaagattgtcattttgccagattacctggagattgcccgggatggactggggggactgcctgacattgtcagagatcgggtatgactgccccctatgctacccaagattctagagcaagatgggccagggtagtggtgtcttaggcaagcactgacaaagctgaaggccaaggggaagaggggcatgtggggcagggggttgggtattgcctctgaccctctgcttcccccaggtgaccagtgcagtggaggccctact

SEQ ID NO: 88369 - DNA, 601 bp, Human
tattgcctctgaccctctgcttcccccaggtgaccagtgcagtggaggccctactgtcggccgactcagcctcccgcaagcaggaggtgcaggcatgggatggggaagtacggcaggtgtctaagcatgccttcagcctcaagcagttggacaaccctgctcgaatccctccctggtgaggcctggcccctctgcctcgggcaccacccccagagcaaggacaaggagcccacttttctgggggatctggtgggagagagggtagggagcaggacaggaagggaagcttggaaatgaacamgacatggggatggccagaggagaagagagagagaccttggattggcggggggcctgcagagccctctctctctgccactccctcaaatccccgacccacatttctgctgattctcttctctgtgggttagtggctggaagtgctccaagtgtgacatgagagagaacctgtggctcaacctgactgatggctccatcctctgtgggcgacgctacttcgatggcagtgggggcaacaaccacgctgtggagcactaccgagagacaggctacccgttagctgtcaagctgggcaccatca

SEQ ID NO: 88370 - DNA, 601 bp, Human
aactccccactcttgaggggagcccgttcacagagttagtaaatgtttgcttccttcccttttcctcggcgctcaggccagagcccctccaactgtccttcccttgacttttaggtatgtggataagctggagaagatcttccagaatgccccgacggaccctacccaggatttcagcacccaggtgtatgtaaccaggtcctatgtaggaaagctgttgacagtcatggccgtataccttcctcctccctgaccgcctggggggcacagcactttaacccctggcctttttttgttttgktttgttttgttttttgagacggagtcttgttctgttgccaggctggagtgcagtggcgcgatctcggctcactacaacctctgcctcctgggttcaagtgattctcctgcctcagtctcctgagtagctaggactacaggcacatgccaccacgcccagctaaattttttttgtatttttagtagagacggggtttcatcatgttggccaggatggtctcgatctcctgacctcgtggtctgcccacctcggcctcccaaagtgctgggattacaggcgtgagccaccgtgcacggccac

SEQ ID NO: 88371 - DNA, 601 bp, Human
cccactcttgaggggagcccgttcacagagttagtaaatgtttgcttccttcccttttcctcggcgctcaggccagagcccctccaactgtccttcccttgacttttaggtatgtggataagctggagaagatcttccagaatgccccgacggaccctacccaggatttcagcacccaggtgtatgtaaccaggtcctatgtaggaaagctgttgacagtcatggccgtataccttcctcctccctgaccgcctggggggcacagcactttaacccctggcctttttttgttttgttttgktttgttttttgagacggagtcttgttctgttgccaggctggagtgcagtggcgcgatctcggctcactacaacctctgcctcctgggttcaagtgattctcctgcctcagtctcctgagtagctaggactacaggcacatgccaccacgcccagctaaattttttttgtatttttagtagagacggggtttcatcatgttggccaggatggtctcgatctcctgacctcgtggtctgcccacctcggcctcccaaagtgctgggattacaggcgtgagccaccgtgcacggccaccactg

SEQ ID NO: 88372 - DNA, 601 bp, Human
tcttgagctgggttcctgtagaatctaaggtttttcacgttgttgagagttagctagggagagccacgagcagggggttgagctggggacacacagggtcgttagttgactgaagtgaaatgttttcttggatattaatgcagggccaagctgggccatggccttctctccggggagtattccaagccagtaccggagtcgggcgatggggagcgggtgccagaacagaaggtgcgtctaggaccctgtccctttcaggccctgggattgtggggaagctgaggtctgggagatgtctaargaaggcccctggatggccactgagccccagctgagtccctgccctgactcttcccaggaagttcaagatggcattgcccctcggatgttcaaggccctcatcggcaagggccaccctgaattctccaccaaccggcagcaggatgcccaggagttcttccttcaccttatcaacatggtggaggtaagggctggcaagatggcacacccccatcttcctgcaatttactcgctctccttcctgcccatttctccctctatcagccccaacccagtcccatccctgaaccccaacagtctg

SEQ ID NO: 88373 - DNA, 601 bp, Human
ggtgcgtctaggaccctgtccctttcaggccctgggattgtggggaagctgaggtctgggagatgtctaaagaaggcccctggatggccactgagccccagctgagtccctgccctgactcttcccaggaagttcaagatggcattgcccctcggatgttcaaggccctcatcggcaagggccaccctgaattctccaccaaccggcagcaggatgcccaggagttcttccttcaccttatcaacatggtggaggtaagggctggcaagatggcacacccccatcttcctgcaatttactmgctctccttcctgcccatttctccctctatcagccccaacccagtcccatccctgaaccccaacagtctgtgtccctgtgaacagtgcttgcacctgaggaggacagtgaaggtgatgatccctacccttgatgggcttgaagcccaattcagattatgcccaaagacaatgataagagaatacttgctgcttataaagaaaaatacaagcgtgttctaacacagtccctcagtgcagggatggggccagaaatggggaggggttggtgaattagggaaggtttctgctctgctcttgtg

SEQ ID NO: 88374 - DNA, 601 bp, Human
ccctgggattgtggggaagctgaggtctgggagatgtctaaagaaggcccctggatggccactgagccccagctgagtccctgccctgactcttcccaggaagttcaagatggcattgcccctcggatgttcaaggccctcatcggcaagggccaccctgaattctccaccaaccggcagcaggatgcccaggagttcttccttcaccttatcaacatggtggaggtaagggctggcaagatggcacacccccatcttcctgcaatttactcgctctccttcctgcccatttctccctctrtcagccccaacccagtcccatccctgaaccccaacagtctgtgtccctgtgaacagtgcttgcacctgaggaggacagtgaaggtgatgatccctacccttgatgggcttgaagcccaattcagattatgcccaaagacaatgataagagaatacttgctgcttataaagaaaaatacaagcgtgttctaacacagtccctcagtgcagggatggggccagaaatggggaggggttggtgaattagggaaggtttctgctctgctcttgtgtccctgagttccgagtggtagtctgcctt

SEQ ID NO: 88375 - DNA, 601 bp, Human
gctccagaaacagggcccattctgtgagaatgggcagggacccacattacaattgtgtggtcattttggttttgggataaggtgccaatccatgggagaaaaatgcatggaatgggtgattggaagagggctgggtcctgggggagggaggaggagcaaacagtggcccaatcagtcggtccgtgtacccacaattcccattacagcgcccatgctggatgaatcagtcatcatccagctggtggagatgggattccctatggacgcctgccgcaaagctgtctactacacgggcaacagyggggctgaggccgccatgaactgggtcatgtcacacatggatgatccaggtaggctggggtggggagcagggtggggcagggcctccatcctcccccaaacacatcaaccccttcacatccacagattttgcaaaccccctcatcctgcctggctctagtgggccgggctccacaagcgcagcagccgacccccctcctgaggactgtgtgaccaccattgtctccatgggcttctcccgggaccaggccttgaaagcgctgcgggccacggtatgggctgccccagctaaggacatggg

SEQ ID NO: 88376 - DNA, 601 bp, Human
cttggactatggggcaggtaaggacgttttgggtctcctggaggaaggtggccccggggcgcgcactggggctgtgcccgccaggcgacggggttaggagcggagcccgaggctctgcgggagaccgggggaggctgggccgcgtgggcttcccgctccctgcgccctggcctcccgcgccgtgcgccgccgcacgtagccccagactcctccccctcctcgccggcgtccgcgtccccgcgccgagctgctcgggctccctgagcccccagatctgaccccttcccttcggcaacctgarcgactcccgccttccacggaagggaccgagcccgtgccaaacaggctgagcgatttgggagtgaggagccatcctaccgctttccccaacctggaaacagcaaagcgcaaggcctctgagtcagttaggtctctgccacccacgggcaaaggatgctctcctccatcctccttcctccctccaccgaaatcggagagccgcgggcctgatccaaagaggcatccccttctcgttcattccccagaggcctcaatacaaaccccaggagttggcccctctccttttgctacaaatccttgc

SEQ ID NO: 88377 - DNA, 601 bp, Human
ccagccccaaggtagatgccacctggaaatcccccaatgtccactagggggcagtaggccaccgttcttcgtactccggagaacctggctggagagctctttcttgttcacccttccctccatctgtatctctgccctgcagataacgtgaaggactggagcaaggtcgtcctggcctatgagcctgtgtgggccattggtactggcaagactgcaacaccccaacaggtaaccgggcccaggagccctgccctcatcccagcctgcctcaataggtttggacagacacagcccacatggrgcaaccccttatttcaaagacacagagaccttgaacccagagacagtgacttgtccaagggcatccagtccagggcctggcttggatcagagccctggtactctgactcagtcagaaaccacactaagtgtccactggtgccagtgatttttcctcttagagaggcagaaaaggtcttacttaggccagcttcttgttctaggcccaggaagtacacgagaagctccgaggatggctgaagtccaacgtctctgatgcggtggctcagagcacccgtatcatttatggaggtgagtggct

SEQ ID NO: 88378 - DNA, 601 bp, Human; identical to SEQ ID NO: 23767

SEQ ID NO: 88379 - DNA, 601 bp, Human; identical to SEQ ID NO: 23768

SEQ ID NO: 88380 - DNA, 601 bp, Human; identical to SEQ ID NO: 23769

SEQ ID NO: 88381 - DNA, 601 bp, Human; identical to SEQ ID NO: 23770

SEQ ID NO: 88382 - DNA, 601 bp, Human; identical to SEQ ID NO: 23771

SEQ ID NO: 88383 - DNA, 601 bp, Human; identical to SEQ ID NO: 23772

SEQ ID NO: 88384 - DNA, 601 bp, Human; identical to SEQ ID NO: 23773

SEQ ID NO: 88385 - DNA, 601 bp, Human; identical to SEQ ID NO: 23774

SEQ ID NO: 88386 - DNA, 601 bp, Human; identical to SEQ ID NO: 23775

SEQ ID NO: 88387 - DNA, 601 bp, Human
taaagggcagcggaataacgctagggggttttcacatgcacccctgggccaagccgacttgcccttgccgtggatccctgcattcatggatcggttattgaaatgatcgggaaccttgctcctgccagcttgcagcctctctgagattcgggcctccaaactgcatcaatatttttggtcaaggcactgattgaaacttagagctggattcggtcacggtgcagccctgtggcccacctgggaggcctcctttcctggatcggcctccttcaaggccttccctctctctgtgagcctcacrtggctggctccgtgtctgccccctgcccttcctcttccccaccgcaacactcagggggcttttggcaccgagaccctctaaagctcatgtcctctctttctccttgcctccagccaggagaggaggacgggctgaccagtgcctggaggtggaagagaggagcagggccccaggaggcccctgcagaggaggctgaggcctgggttcaaggagaagagagaagagagagaaggaagggagggcagtgccggggcgggaggttaagaccagggaagccgcactggaggcccttttgggtga

SEQ ID NO: 88388 - DNA, 601 bp, Human
ctagcctgtccccaggcggtgggctgaagtagcccagtggggttaggaggctctgggggtctctcggctggagtcacctccgggcaggggtgagatgggttgggacagactggtcctcccctccttccccccatccctgcggttggaaaatttgcccgccctcccctcgtccctgggctgaggaaacctcacaacctcacttctcactctctccccagaaggagttttgtgttttttccatcacgtggtttcctgtggggctgggctttgtggggctacagtttcctcctgggaaaggggtgtgcttcggggaaagggcttagttctgctttctgccctgacagccccttcaaatccgtttgaaccctgggctccccttcagtgacatcatccagggcaccccagaaccccctacaccactctttccccagtggggttgtcttccccgcctccctggcggagcgcaccccatccgccttccttgtgacttgagtctgtgtgtccatctcccaccactccctgtggtgtggcctcggtctgcgtttctctttgcctctggtctctgctggggcacagtcccatccttcacggagattcatcc

SEQ ID NO: 88389 - DNA, 601 bp, Human
atggtagtagtgacagctgagaagtaaatactgctaagtgccatgagctgttataagcaatataaacgttagctcgcacattgagtgccctccgctcacccccggcttctcctgggtcccctcatggctccagaaccctgggtggatcgtggctggaaccagccccactttggccctctgcctgtgggtatcttcctcagagccctctccggatgtaccatctcgcccaaccctgccaaatacagaggaggagcccgggacccagttgctggccaggcccaagctagtcagggcaaggccrggcaggcacccacagtaggcctgtgtcccggctgctccgctttctctcgaggtcccattctgttggtttcttctcccaggaacatctatgaggcatgtgctccccattcctcctctttttccatcggtagccgcagggcttcggcttcttcctgactctgccctctctcccagcttccccaggcagtgccccatcctggcccccagggctgtgtggggatgggtgatgcttctttggggctgcacataactcctctgtctatctacccgcatgtttgtgatcaggagacctctggtaagg

SEQ ID NO: 88390 - DNA, 601 bp, Human
cgcggctctgtcctgtgctctctcagggacaggcccatccccgagagctaccctcctgctcacccgccacacacacattcacacacttcttgaaagccccatggcctttatttagacgttacaggaaggaagtgggtgtggggggttatttttgacaatctgggtttgaaattagacagcgcgactcagggcatcagcttgctgggctcagctgagggtgggcctggggtctccctgaggtctgtttgcccagggctgggaaaggagagaaacttcctactgcactgctcccctgagtccyctgaccctgtgcccccgcaccctgctgtctcagggctatcctttccctgacgtcagggtttgaaggaaaagggaagtgaagccatgctgagagacgctccataactccttcagggagaggcggggagggctcagggtacctgggagccggcaggacagtggtgggatttgggggtcccaggtcttccggggtgggggcagccactcactaggagtgaggagtcggcgcgaggagtggaggagggaaggatggtggcagctggggagccagcgtcagcaccgcagagcccgaggtggagcg

SEQ ID NO: 88391 - DNA, 601 bp, Human
catcgcccagttcattgaaaccactaagaagaagctggaggtcctgcaggtgcgtgcagagcagggcctggcgggggggggggctgcagtgcaggatgggtgccacctggccctgctgggaccaccaccttcccactgtccctctgcccacagtcgcagaagggccaggagtcggagtacgggaacatcacctatcccccagccatgaagaatgcccatgccaaggcctcccgcacctcgtccaagtgagtggccctgactgccaccgcccggcatccacccctttgtcctgcccagcccratcctcactttctggagaggacaagtgttgcagctggggggacctggcttcaagttcaggcttggttctcaccccttctgttcataagcatttcctgagtgcccacacgtgtgggcctctgctaggtaccagcagcgcactcgtgtatgagatgtagcctctgtcctctaggagcttggagtctagtgcagggaccgtggctgcgtcacctgtgagacggggtggccagaggggactgccagtgccgggtccccctgtgctgtctcctgacctgcaccaactgcctgtacttgcccccct

SEQ ID NO: 88392 - DNA, 601 bp, Human; identical to SEQ ID NO: 18521

SEQ ID NO: 88393 - DNA, 601 bp, Human; identical to SEQ ID NO: 18522

SEQ ID NO: 88394 - DNA, 601 bp, Human; identical to SEQ ID NO: 18523

SEQ ID NO: 88395 - DNA, 601 bp, Human; identical to SEQ ID NO: 18524

SEQ ID NO: 88396 - DNA, 601 bp, Human; identical to SEQ ID NO: 18525

SEQ ID NO: 88397 - DNA, 601 bp, Human; identical to SEQ ID NO: 18526

SEQ ID NO: 88398 - DNA, 601 bp, Human; identical to SEQ ID NO: 18527

SEQ ID NO: 88399 - DNA, 601 bp, Human; identical to SEQ ID NO: 18528

SEQ ID NO: 88400 - DNA, 601 bp, Human; identical to SEQ ID NO: 18529

SEQ ID NO: 88401 - DNA, 601 bp, Human; identical to SEQ ID NO: 18530

SEQ ID NO: 88402 - DNA, 601 bp, Human
cgcggggatgggtggtcgcgatgccgggagggcaggcagggccctggccgtgcttatgaagttggagctgtactctcagctactcgaagctggtccctgctttaggctgcgctcccgcgtgctccccattttctgggccccaggtcccgccttctaaatctccccaggtctccagcccactggaattttctcttccaagcgtggccccgccctctccgctcgtgattggccctaagttccgggccccagtttcattggatgagcggtcgggggaccgggccaggtgactaagtttccgcgrcgccttctccccggccactgcttgagccgctgagagggtggcgacgtcggggccatggggctgggcccggtcttcctgcttctggctggcatcttcccttttgcacctccgggagctgctgctggtgagtggcgttcctggcggtcctcggcggagcgggagcagtgggacgtttccgggggtcgggtgggtagcggcgagcgctgtgcggtcagggcggggctcctgtgccctgtcggtggcgcagggagctggacgcggcccgttaccgccacacttcagccctgcttccccgtcact

SEQ ID NO: 88403 - DNA, 601 bp, Human; identical to SEQ ID NO: 18361

SEQ ID NO: 88404 - DNA, 601 bp, Human; identical to SEQ ID NO: 18362

SEQ ID NO: 88405 - DNA, 601 bp, Human; identical to SEQ ID NO: 18363

SEQ ID NO: 88406 - DNA, 601 bp, Human; identical to SEQ ID NO: 18364

SEQ ID NO: 88407 - DNA, 601 bp, Human; identical to SEQ ID NO: 18365

SEQ ID NO: 88408 - DNA, 601 bp, Human; identical to SEQ ID NO: 18366

SEQ ID NO: 88409 - DNA, 601 bp, Human; identical to SEQ ID NO: 18367

SEQ ID NO: 88410 - DNA, 601 bp, Human
caactgctgcgcatagggggcggcaggggcggtgatctctacaccttccacccccccgccggggctggctgcacctatcgcttgggccacagggccgacctgtgtgatgtggccctgcggccccagcaggagcctggcctcatctctgggatccacgccgaactgcatgccgagccccggggtgatgactggagggtcagcctggaagaccacagcagccaaggtgagcattaagcagggcagctttgcccctgggtggttgaagcgccaggctggaatgagtaaggtctccacaagaccytgctgcctgcctcccatactcccatcagattggatggatagtcgtggtccagaccttcatcttcccaccagaagtgtgcacagtcagaagctctctgccagactgaccctttttggtcccgtttagctcatacaggacctgggatatcatcagaaagatatcacagtggggatgttctgaggccactagaggccaagtttagacttgattcagtttccagctttgctgaggcactctgttcctgggttagggcagttctatgttgaataatgtttttaataatctgggcatgtctttctc

SEQ ID NO: 88411 - DNA, 601 bp, Human
acaccttccacccccccgccggggctggctgcacctatcgcttgggccacagggccgacctgtgtgatgtggccctgcggccccagcaggagcctggcctcatctctgggatccacgccgaactgcatgccgagccccggggtgatgactggagggtcagcctggaagaccacagcagccaaggtgagcattaagcagggcagctttgcccctgggtggttgaagcgccaggctggaatgagtaaggtctccacaagaccttgctgcctgcctcccatactcccatcagattggatggatrgtcgtggtccagaccttcatcttcccaccagaagtgtgcacagtcagaagctctctgccagactgaccctttttggtcccgtttagctcatacaggacctgggatatcatcagaaagatatcacagtggggatgttctgaggccactagaggccaagtttagacttgattcagtttccagctttgctgaggcactctgttcctgggttagggcagttctatgttgaataatgtttttaataatctgggcatgtctttctccgtgacttgaggcagttagcctcagaaagcctagattcac

SEQ ID NO: 88412 - DNA, 601 bp, Human
gagtgttatggttattagactatagtagccaacattcatctagtgcttactgttatgagccaggccctattttaagtgtattgaatgtaggtggtactaatattatcctcatttacagtaaaggaaaatgaggcacaaagaggttaaggaacttgtccagggctgggcatggtggtttacacctataatccagcactttgggaggctaaggcagggtggatcacttgagctcaggagttcgagaccagcctgggcaacatggtgaaaacctgtctctaccaaaaaattaattaattttttwaaaaaagcctgggcgcggtggctcacgcctgtaatcccagcactttgggaggccgagatgggcagatcacgaggtcaggagttcgagaccatcctgaccaacatgttgaaaccccatctgtgctgaaaaaaaaatacaaaaattagccaggtgtggtggcgtgcacctgtaaccccagctactcaggaggctgaagcagcagaatcacttgaacccgggaggcggaggttgcagtgagctgagatcgcaccactgcactccagcttgggcgacagagcgagactccatctcaaacaaaca

SEQ ID NO: 88413 - DNA, 601 bp, Human
tagactatagtagccaacattcatctagtgcttactgttatgagccaggccctattttaagtgtattgaatgtaggtggtactaatattatcctcatttacagtaaaggaaaatgaggcacaaagaggttaaggaacttgtccagggctgggcatggtggtttacacctataatccagcactttgggaggctaaggcagggtggatcacttgagctcaggagttcgagaccagcctgggcaacatggtgaaaacctgtctctaccaaaaaattaattaattttttaaaaaaagcctgggcrcggtggctcacgcctgtaatcccagcactttgggaggccgagatgggcagatcacgaggtcaggagttcgagaccatcctgaccaacatgttgaaaccccatctgtgctgaaaaaaaaatacaaaaattagccaggtgtggtggcgtgcacctgtaaccccagctactcaggaggctgaagcagcagaatcacttgaacccgggaggcggaggttgcagtgagctgagatcgcaccactgcactccagcttgggcgacagagcgagactccatctcaaacaaacaaacaaaccaaaagct

SEQ ID NO: 88414 - DNA, 601 bp, Human
cctgggcgcggtggctcacgcctgtaatcccagcactttgggaggccgagatgggcagatcacgaggtcaggagttcgagaccatcctgaccaacatgttgaaaccccatctgtgctgaaaaaaaaatacaaaaattagccaggtgtggtggcgtgcacctgtaaccccagctactcaggaggctgaagcagcagaatcacttgaacccgggaggcggaggttgcagtgagctgagatcgcaccactgcactccagcttgggcgacagagcgagactccatctcaaacaaacaaacaaacmaaaagcttgcccagggtcacataactggtaagtggtagagctaggatctgaacgagctggagctgggggagagtgagcatgtttgaaaactggaccttagggcggggcacggtggctcacgcctgtaatcccagcactttgggaggctgaggcgggcagatcaggaggtcaggagtatgagaccagcctggccaacatggtaaaaccctgtctctgctaaaaataaaaaaattagccagacgtggtggcacatgcctgtaatcccagctactcaggaggctgaggcaggagaattgcttg

SEQ ID NO: 88415 - DNA, 601 bp, Human
actgggtaagtggagtcctcacttggccctctcagtgttttactgcttttcgattccttgtatccctaggctgtgaggaggtccccctgcctggggggatgggcacgggaggtggaatagatggaatggcaagacctgggttagctctgataggaaaagaaaaatatgtgcaggagaacatgagaggtggggtggggcagtgcttataaaacaaccggagtgagcatgtcctgctttttacattcatatggctttaaccccattcttctagtgcctaaggatggggaactttcaggctcayactagaggtttttaggcccaccctatgtgtttttaaggacagagtccaggctcaccttagttctcagaccactgtgcctctgtggcctcaccctatgaccagccatagggtggcaaggtctaggccttctcctacaggtttccggtgacccttgtgtctgtgtcacttccttcagaaatcgacgtggccgtcctcggaagtacccagtgagcgctcccatggctccccctgcagttgggggcggggagccctgtgcagctccttgttgctgcctgccccaggaagagacagtggcctggg

SEQ ID NO: 88416 - DNA, 601 bp, Human
gccttctcctacaggtttccggtgacccttgtgtctgtgtcacttccttcagaaatcgacgtggccgtcctcggaagtacccagtgagcgctcccatggctccccctgcagttgggggcggggagccctgtgcagctccttgttgctgcctgccccaggaagagacagtggcctgggttcagtgtgatggctgtgacgtctggttccatgtggcctgtgttggctgcagcatccaggctgccagggaggccgacttccgatgcccagggtgccgggctggcattcagacctaaggtccacygccaaggcaccatcggacacacctgcccatgagtagacacagcagcgagcaaataggtctgataaataccccccttcccttccctccccaagagggaatgactacagggaagaaggatggattgatgtggactcattcagggcctggagcagaccctggtggccaagacagaagagatggtttcctgccaaagatattgccacctccaggaaattgccagtgagctggaagttcccactattacaagccataaggccatgttgccatggacaccagaatatctgtagtcagagcacctat

SEQ ID NO: 88417 - DNA, 601 bp, Human
tcccatggctccccctgcagttgggggcggggagccctgtgcagctccttgttgctgcctgccccaggaagagacagtggcctgggttcagtgtgatggctgtgacgtctggttccatgtggcctgtgttggctgcagcatccaggctgccagggaggccgacttccgatgcccagggtgccgggctggcattcagacctaaggtccaccgccaaggcaccatcggacacacctgcccatgagtagacacagcagcgagcaaataggtctgataaataccccccttcccttccctccccargagggaatgactacagggaagaaggatggattgatgtggactcattcagggcctggagcagaccctggtggccaagacagaagagatggtttcctgccaaagatattgccacctccaggaaattgccagtgagctggaagttcccactattacaagccataaggccatgttgccatggacaccagaatatctgtagtcagagcacctatcagttgcaaaagccatgcctgcaaccgatggaaaatgtaagagggagttcttaaggttcttggtggcatcacccaaggcattctgggaaaa

SEQ ID NO: 88418 - DNA, 601 bp, Human
gatgcccagggtgccgggctggcattcagacctaaggtccaccgccaaggcaccatcggacacacctgcccatgagtagacacagcagcgagcaaataggtctgataaataccccccttcccttccctccccaagagggaatgactacagggaagaaggatggattgatgtggactcattcagggcctggagcagaccctggtggccaagacagaagagatggtttcctgccaaagatattgccacctccaggaaattgccagtgagctggaagttcccactattacaagccataaggccrtgttgccatggacaccagaatatctgtagtcagagcacctatcagttgcaaaagccatgcctgcaaccgatggaaaatgtaagagggagttcttaaggttcttggtggcatcacccaaggcattctgggaaaacctagggcctggccccaaaacttccctactctgtggctagtcctgctgccaacaaaatcgtagcgacctggcttttcacagctttgcttttatttccaagtcaaggacaagccgcttcattcactcctgggcatttactcttcttgtgggtctgtgatattccttgc

SEQ ID NO: 88419 - DNA, 601 bp, Human; identical to SEQ ID NO: 88101

SEQ ID NO: 88420 - DNA, 601 bp, Human; identical to SEQ ID NO: 38862

SEQ ID NO: 88421 - DNA, 601 bp, Human; identical to SEQ ID NO: 38863

SEQ ID NO: 88422 - DNA, 601 bp, Human; identical to SEQ ID NO: 38864

SEQ ID NO: 88423 - DNA, 601 bp, Human; identical to SEQ ID NO: 38865

SEQ ID NO: 88424 - DNA, 601 bp, Human; identical to SEQ ID NO: 38866

SEQ ID NO: 88425 - DNA, 601 bp, Human; identical to SEQ ID NO: 38867

SEQ ID NO: 88426 - DNA, 601 bp, Human; identical to SEQ ID NO: 38868

SEQ ID NO: 88427 - DNA, 601 bp, Human; identical to SEQ ID NO: 38869

SEQ ID NO: 88428 - DNA, 601 bp, Human; identical to SEQ ID NO: 38870

SEQ ID NO: 88429 - DNA, 601 bp, Human; identical to SEQ ID NO: 38871

SEQ ID NO: 88430 - DNA, 601 bp, Human; identical to SEQ ID NO: 38872

SEQ ID NO: 88431 - DNA, 601 bp, Human; identical to SEQ ID NO: 38873

SEQ ID NO: 88432 - DNA, 601 bp, Human; identical to SEQ ID NO: 38874

SEQ ID NO: 88433 - DNA, 601 bp, Human; identical to SEQ ID NO: 38875

SEQ ID NO: 88434 - DNA, 601 bp, Human; identical to SEQ ID NO: 38876

SEQ ID NO: 88435 - DNA, 601 bp, Human; identical to SEQ ID NO: 38877

SEQ ID NO: 88436 - DNA, 601 bp, Human; identical to SEQ ID NO: 38878

SEQ ID NO: 88437 - DNA, 601 bp, Human; identical to SEQ ID NO: 38879

SEQ ID NO: 88438 - DNA, 601 bp, Human; identical to SEQ ID NO: 38880

SEQ ID NO: 88439 - DNA, 601 bp, Human; identical to SEQ ID NO: 38881

SEQ ID NO: 88440 - DNA, 601 bp, Human; identical to SEQ ID NO: 38882

SEQ ID NO: 88441 - DNA, 601 bp, Human; identical to SEQ ID NO: 38883

SEQ ID NO: 88442 - DNA, 601 bp, Human; identical to SEQ ID NO: 38884

SEQ ID NO: 88443 - DNA, 601 bp, Human; identical to SEQ ID NO: 38885

SEQ ID NO: 88444 - DNA, 601 bp, Human; identical to SEQ ID NO: 38886

SEQ ID NO: 88445 - DNA, 601 bp, Human; identical to SEQ ID NO: 38887

SEQ ID NO: 88446 - DNA, 601 bp, Human; identical to SEQ ID NO: 38888

SEQ ID NO: 88447 - DNA, 601 bp, Human; identical to SEQ ID NO: 38889

SEQ ID NO: 88448 - DNA, 601 bp, Human; identical to SEQ ID NO: 38890

SEQ ID NO: 88449 - DNA, 601 bp, Human; identical to SEQ ID NO: 38891

SEQ ID NO: 88450 - DNA, 601 bp, Human; identical to SEQ ID NO: 38892

SEQ ID NO: 88451 - DNA, 601 bp, Human; identical to SEQ ID NO: 38893

SEQ ID NO: 88452 - DNA, 601 bp, Human
cttagtaaagagaccacttacaccatgtcaaagagggtatggggctcacagggagggctgctccccagctctgggtctgctcagcggagaggagcaaataccacgacccagaggagagagcctgtggagagggcaccttgacaggggcagtagactttggtcctgggatgcagctggcccgtatctacccctcagggagggcctgggagaatagatgccctgacctcactttctgccccaaactcctgctgggctcctctctggctaacccaaaccaggcctgttggtgcagtgtacactrgtcagccttggggcagaagcagggtagagacaggcagagagtggggttggaggggcaaagggaagacgtctggcacaccccaagccacgtcttccggctggagtccagtggcagtaatatacattaaggttgatgactggacacggtggctcatgcctgtaatcctagcactttgggaggccgaggcgggaggatcacctgaggtcaagagttcgagaccagcctgaccaacatggtgaaatcccatctctactaagaatacaaaattagccaggcatggtggctgatgcctgtaatccc

SEQ ID NO: 88453 - DNA, 601 bp, Human
cttgagcttcactttctctgcctgtaagatggtgctgatagtatccacagctgtagggctcttgtgagggctgagggagggaacgcagggatggacacagcagagggccaggccgtgtgtgctgagcaacacgggtgatgcctcccatccctatgacaaggctgaacggagggtgttggaagaggagctgacggttcacctctctgtccctggggacactatcctcatcaacaaccgcccaggtcctagagagccacccccgtaccaggagccccggcctcgtgggaatccgccccactcygctccctgtgtccccaatggctctggtaagacctgccttgttccagtcgcacctctgtcctctctgctgttttcttattgtatccctttcccattctctttttttcctgtcttccccagtttccacttgttttcttctttctgtgcccctggttactgtctatatcactctttgtccctaccatgtagtctctctcaagagttccccatgtattacccatagtcccccgtggtgctatcttgtctgtgtcccacagacatctctctatctttgttgtaccctctcattgtgtctccctgg

SEQ ID NO: 88454 - DNA, 601 bp, Human
ccgtccccctcgaggcccgggcccccccacacccgcctgggccaaacccaccaacacccagggtaagcccctctgcccctgggctccgccaggctccccatacctctactggggcagggaaaagccctcacaccttgcacttcctcctctccccactgtggcctattctgctctcctgagctcccaaggaggaagctcttgtgcccttagctcatctctgctgctgcttgctcttttttaaggtcccccccttgagctgaggagtagaaagcttactggtccccagctcttctccctcctsctcttccacgccatctcttcagctctccagagctagacaggaggttgctgtggtggccccagactatagtaactcctcctttattctccactctctctagagctgcgaggaggagggctctcaccccgggcgcttgccctttccctcacatgtgtcctctctctgcagtcccagaggtgaaggctcatgccccaaccctttccatctgcccctcttctcctcagtgttgccttctcattgtggccccttccccagggctaagaggggacagctctgcttcctctcctgtctgtagacaac

SEQ ID NO: 88455 - DNA, 601 bp, Human
caccaagaatgccaggtgaggaccagggatggcatctggaagaagggaggggaggccgtgaagagtggggagccatctagagagaacaatggcagagcccaacagaggggtggcatctctgggaggggatttacatgtacgctgggggtggggatgcctggtctgcctgaggtggggcaggggggtgggggcgcgggggaaggtgcaggccgcccactcggcattcctcttcagcttctccttgttctccaggaatgatttcctgaaagaggtgaagatcatgtcgaggctcaaggacccmaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcaggtacctgcttacccaggctgggccttgctcagaattcccccaggggatctcctcctctcccctcgcttcagcctggaggaaaagaggggagcgtgggggtgggaagggagagaggttccaggagggcctg

SEQ ID NO: 88456 - DNA, 601 bp, Human
cctcctctcccctcgcttcagcctggaggaaaagaggggagcgtgggggtgggaagggagagaggttccaggagggcctgggataaggaatgtgtgacaagttaacccaggaacatggacagaaaggctggaggtgactatgcaagagtggtgaagggacttgggccctgccatgacgtcccttctgctttctctcaccctcactcccctctgagtccagattggggagcacaataaaagaagagccccctagtgttggccaggcctgggagattgagagggaagtgacccttggcctcaygtgggcattccacctccacatggggagccagagtgaccgggcccggggagtgggctctctctcctctcctggatgggaatctgcgaagctgcccccagtgaccttctgtcggttcccttctcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattacc

SEQ ID NO: 88457 - DNA, 601 bp, Human
ctagttggggaaaatttcaccatcaaaatcgcagactttggcatgagccggaacctctatgctggggactattaccgtgtgcagggccgggcagtgctgcccatccgctggatggcctgggagtgcatcctcatggtgagcagcccgaggacagccaggttggagcagggcaggtgggagaacactggccgccactcacagccctggtctccatcagtcacacactttctctgggttgcattttacagaatctcatctataatatgaggttctcctagcccaagggactggggaaagcagragctgcagtgtgatgggcaagaatccaggagccaagagtgggtactggggatggagacagggtggcagagagctcaagagatgaggttgggcgaggaagctggagatagaaggggttgggtagggagaccgaaggtcaggaccagaaagtgggggtggatggagaggaaggaggagcagaaggaagaggtgggccagggccctggagagaggaccagagcatggagaggaaaggcagagcccaagggagaggagttggaaaaggtggccagcggaggagagtggagagcctggcgtcagg

SEQ ID NO: 88458 - DNA, 601 bp, Human
agtgctgcccatccgctggatggcctgggagtgcatcctcatggtgagcagcccgaggacagccaggttggagcagggcaggtgggagaacactggccgccactcacagccctggtctccatcagtcacacactttctctgggttgcattttacagaatctcatctataatatgaggttctcctagcccaagggactggggaaagcaggagctgcagtgtgatgggcaagaatccaggagccaagagtgggtactggggatggagacagggtggcagagagctcaagagatgaggttgggsgaggaagctggagatagaaggggttgggtagggagaccgaaggtcaggaccagaaagtgggggtggatggagaggaaggaggagcagaaggaagaggtgggccagggccctggagagaggaccagagcatggagaggaaaggcagagcccaagggagaggagttggaaaaggtggccagcggaggagagtggagagcctggcgtcaggagggatcaggcctgagtggagcccagagtggatctggggcttccaataggaagggaggagggtctacgttgcctgatgtccctgtctgtttt

SEQ ID NO: 88459 - DNA, 601 bp, Human; identical to SEQ ID NO: 88452

SEQ ID NO: 88460 - DNA, 601 bp, Human; identical to SEQ ID NO: 88453

SEQ ID NO: 88461 - DNA, 601 bp, Human; identical to SEQ ID NO: 88454

SEQ ID NO: 88462 - DNA, 601 bp, Human; identical to SEQ ID NO: 88455

SEQ ID NO: 88463 - DNA, 601 bp, Human; identical to SEQ ID NO: 88456

SEQ ID NO: 88464 - DNA, 601 bp, Human; identical to SEQ ID NO: 88457

SEQ ID NO: 88465 - DNA, 601 bp, Human; identical to SEQ ID NO: 88458

SEQ ID NO: 88466 - DNA, 601 bp, Human; identical to SEQ ID NO: 88452

SEQ ID NO: 88467 - DNA, 601 bp, Human; identical to SEQ ID NO: 88453

SEQ ID NO: 88468 - DNA, 601 bp, Human; identical to SEQ ID NO: 88454

SEQ ID NO: 88469 - DNA, 601 bp, Human; identical to SEQ ID NO: 88455

SEQ ID NO: 88470 - DNA, 601 bp, Human; identical to SEQ ID NO: 88456

SEQ ID NO: 88471 - DNA, 601 bp, Human; identical to SEQ ID NO: 88457

SEQ ID NO: 88472 - DNA, 601 bp, Human; identical to SEQ ID NO: 88458

SEQ ID NO: 88473 - DNA, 601 bp, Human
cgagccgaggactaaacgccagggttaggtatcatcctttttccaaaatgccatttcagtaaaataacttaagtgatggaattgacccctgtccaccctcagtcatgcataaccagctttttaaaaattatttaactaattaaggggccatgctaatctctgtatcgttgcaattttagcataacatatgtactccccaagcgagcgccacaaccagctgttaactatgcaagtggtgactaaatctgtgttgctctggaatgtccttggggaaattagggatcccaatttctaccaaccytgctatttctcaataaggtcaggatatattcttacgacctgaggacagtttctcagctctctttattaaatcagtttcttatcggagttatgagagcttaactccgtcctttgaattgaggtttccctccagtcttgtgtactcacctctctggaggttcttggtggggcacggtgagataggaaggcttgcccagctgccactccctaaagtgggactgaagagtggtgacagaggtcaacacagaaataataacagccttggtagctttaaaactagcgttaggactcaagtttgttc

SEQ ID NO: 88474 - DNA, 601 bp, Human
gaaagacattttgcacaacctcaagttggttataccttctcgaggttgtcgctccactgtcaggaatccacgagtggagaccttcccacgtgtgtcttagctgtctaggcagtacttcctgcaaccccccccccacaccccgcgcattttctaatcccgagccgaggactaaacgccagggttaggtatcatcctttttccaaaatgccatttcagtaaaataacttaagtgatggaattgacccctgtccaccctcagtcatgcataaccagctttttaaaaattatttaactaattaargggccatgctaatctctgtatcgttgcaattttagcataacatatgtactccccaagcgagcgccacaaccagctgttaactatgcaagtggtgactaaatctgtgttgctctggaatgtccttggggaaattagggatcccaatttctaccaaccttgctatttctcaataaggtcaggatatattcttacgacctgaggacagtttctcagctctctttattaaatcagtttcttatcggagttatgagagcttaactccgtcctttgaattgaggtttccctccagtcttgtgtact

SEQ ID NO: 88475 - DNA, 601 bp, Human
atcagtcagtttgagtttttcatccattagactaaaccaaaaaaggaagaatcagggtttaaagactaaaggtacctgcttgagatggtctacagtgagcggtagatgctgcagggtcagtagaatttgctggaggaggggaatgttgttggttgtctttgaatacgtcagccaattgttaagaagtttgtagccgccaacgtcaataaatctgcaggcaggcaggagagtctatcagtaatgccctttctaggttttgacagtaccacatcctacaatcccagtctcccatcaatgaccsaggaaccccatgcctcaccgccccatcttttcgctacaccttcccattccaaccatccagatccccacttacttgaccaatatttctggtgaacgggtctgcaggagaatgttcaagtaagtgcatcgactcaccatctttcgtgcttccttcatcaaactgcagaagatgagttagggttagaaatgaagcagccagtatctcttctcttagcaaaagcgcctctctgtgaactgcctagagattcctaatgacttgggactttgctccagagaaggggagtcacatatacctctagga

SEQ ID NO: 88476 - DNA, 601 bp, Human
agacacgctaggatgatactatttcccacagcaaattttaagtgtatgtgttttataacaagcaattttaggaatcagcttccagttaaagtatggcaccttatattcagcaacagagaaatgaacaactttggaattgagaacaggaaagagggtacaggttagaggaactttctctttaaaagaaggaaaaaaagcaaggtgaggtagaaagagaaaagtgaagggacaatccaaggatgggaaaagatattaaggtaattaagtggaagtaatagagaaaagcccatgagagagcagragtggcaccctaccttcatcctcacttgacttgctcagctgcttcaccagtttagctgtgttgttctatgagagatgggagcagcagaaaggtaaatgccaggaggcaaataattccacttagagctaaaaacgacaaaagttacagtcctccctgcttttttttttttttttattttttgagacggagtctcactctgttgcccaggctagagtgcagtggcgcagtcttggctcactgcagcctcgacctcccaggctcaaatgattctcccacctgagcctcctaaataactgagac

SEQ ID NO: 88477 - DNA, 601 bp, Human
caggagaatggcgtgaacccgggaggcggagcttgcagtgagccaagaccgtgccactgcactccagcctgggtgacagagtgagactctgtctccaaaaaaaaaaaaaaaaaagtttgctcctaattcaaagtacatcttccccactttagactcacgctgtggcgggatgatcttcactttgatctctttggtggcattaggtgttgtgttgagtggcttgtatttcttctctgcagggggagtggcatctcctggagcagctacgttgctgtcagaagaggaactgtcatcaacatcyccgactcaccccctcctgctcccttgtgtccacagatccaccccattcagagcctgagaatatggtccatacctctgacgtttgagggggatgggtttaaggttgtacttgtcagaaaccaccactgtgctggcattcttcttcacaggcaccaaggatggtgtctccagctctagtcctggggaaagaagcacggtgtgggcagctgaactcaaaccccagacccccgaattttcctcccgttctcacccgcaaatgttcttctagccttgtaaccaaagcttcctctgctagtcttcc

SEQ ID NO: 88478 - DNA, 601 bp, Human
ccataagagtttgctcctggccaggtgcggtggctcatgcctgtaatcccagcactttgggaagctgaggtgggtggatcacgaggtcaggaaatcaagaccatcctggctaacatggtgaaaccccatctctactaaaaatacaaaaaattagccgggcgtggtggcgggcacctgtagtcccagctactcgggaggctgaggcaggagaatggcgtgaacccgggaggcggagcttgcagtgagccaagaccgtgccactgcactccagcctgggtgacagagtgagactctgtctccaaaaaaaaaaaaaaaaaagtttgctcctaattcaaagtacatcttccccactttagactcacgctgtggcgggatgatcttcactttgatctctttggtggcattaggtgttgtgttgagtggcttgtatttcttctctgcagggggagtggcatctcctggagcagctacgttgctgtcagaagaggaactgtcatcaacatctccgactcaccccctcctgctcccttgtgtccacagatccaccccattcagagcctgagaatatggtccatacctctgacgtttgagggggatgggt

SEQ ID NO: 88479 - DNA, 601 bp, Human
aagtgacccctgaaacgggagttccagaggtacaaaaagtaagggataccaagaaatcaaaggaaaatggagggaaataataaaagagaagggaaaaaacttctcgttcccagggacattcattcccataagagtttgctcctggccaggtgcggtggctcatgcctgtaatcccagcactttgggaagctgaggtgggtggatcacgaggtcaggaaatcaagaccatcctggctaacatggtgaaaccccatctctactaaaaatacaaaaaattagccgggcgtggtggcgggcaccwgtagtcccagctactcgggaggctgaggcaggagaatggcgtgaacccgggaggcggagcttgcagtgagccaagaccgtgccactgcactccagcctgggtgacagagtgagactctgtctccaaaaaaaaaaaaaaaaaagtttgctcctaattcaaagtacatcttccccactttagactcacgctgtggcgggatgatcttcactttgatctctttggtggcattaggtgttgtgttgagtggcttgtatttcttctctgcagggggagtggcatctcctggagcagctacgttgc

SEQ ID NO: 88480 - DNA, 601 bp, Human
aggcgaatgggagacagtgaggagagcgagcttaaggaggctccacagaaggtggaaaaggggaaggagggtgcgtaccatgatggaggtgaggatctcttggacattaatgcctcctcctccagggccttgggggccctttccagcacccatgcttcccataagattggccagaactggaggcaacttggagcctcctgccccatcaggtgagccacctgaccccccaggttccagagtctcaacatacggagtctcatccatggaacactcctgaaagaagaacaaaaaaaatcaggaytgacagaacagagacattctcatatgaaagatgcaccgaattcaatgaccatcacaacttccatcatcacagaacattgacttacctcatctagggggatgagtttagggggtatgggctcgtagggctcaggatcaggctcatgaggactatcaggaacaacacaggtgagagaaaaaagaatgatagtcaagttattaattcagaccctgaaagtaatttctaacctccaccccgtaattaccccagctcatgttccctcaggagtgtccaagcactcaacatcccagggcacgaacc

SEQ ID NO: 88481 - DNA, 601 bp, Human
ccctctcaaaccaacctggcagagcaatgctctctctgtccagtcttcccctcccatttcttgcctagtggccacagccctgtattcttctgcatctttgaaaccctgcttcccccaactccactgcaggcttcctcccccagtcccctggggctggccctgaagattacccagcatctgcttgatcttgtccgaatagtctggttgtttcagtagttcctctgaaggatgactgtttgggctaccctgtgaggatgtaagaaggcaaagtcaacagacagaaagggtaacaaccatggcraaagatagcgccaaagattaggggtaagtgggtagatgtggagaactggggtaaggcgaatgggagacagtgaggagagcgagcttaaggaggctccacagaaggtggaaaaggggaaggagggtgcgtaccatgatggaggtgaggatctcttggacattaatgcctcctcctccagggccttgggggccctttccagcacccatgcttcccataagattggccagaactggaggcaacttggagcctcctgccccatcaggtgagccacctgaccccccaggttccagagtctcaaca

SEQ ID NO: 88482 - DNA, 601 bp, Human; identical to SEQ ID NO: 32393

SEQ ID NO: 88483 - DNA, 601 bp, Human; identical to SEQ ID NO: 32394

SEQ ID NO: 88484 - DNA, 601 bp, Human; identical to SEQ ID NO: 32395

SEQ ID NO: 88485 - DNA, 601 bp, Human
tgtggctaagaaaagatgtaccactgtgctcactctttacaacacatgcaagtatctaggaggaagggagggaaggagggagaaaaaagttctcctttgacgaccaccaccagacctagttctctgtccgctttgcaggaaaactccttaaaagacttacctacttttttcaccatttcttcctgctatcttctttgtaactgtaaactacaacatacaaaaaaatgcacagaacatacatgtgcagcctgatgaaccccataccacccaatgtgtgacaacatgttccatctgtccttgtttttttttgtttttgtttttgagacagagtctcactccctcacccgggctggagtgcagtggtgcgatgttggctcactacaacctcatcctcccaggttcaagcgattctcgtgcctcaacctcctgagtagctgagaccacaggcgtgcggctccacacctggctaactttttgtatttttagtagagatagggttttgccatgttggccaggctggtctcaaactcctgacctcaagtaatgcgcctgcctcagcctcccaaagtgctaggattacagggatgagccaccataccgg

SEQ ID NO: 88486 - DNA, 601 bp, Human
ccgctcgctctgagagagcatggccctgagaggcgtctccgtgcggctgctgagccgcggacccggcctgcacgtccttcgcacgtgggtctcgtcggcggcgcagaccggtcagtgtggggtcgggagtgtggagggaaggagggaggaactgggggtttagggactttccggggtgactttcccgttctgtgcttgcagagaaaggcgggagaacacagagccaactggctaagtgtaaggacctctggtcgcaccgtgtgtctgctgcccctgttcagctgtctgtctgccgcaggtsgactctgtcccagaatccgagagctgcccgagcggggtggcagggtcgtggccagggtcagaggcactaaggcagtgagtgcgctgtgcctgcggggccggagaaaagtcacctgatcagtctcgcttgcagctcgcactagccggggggcgacatgggtgttggggggtagggctgatgagggtccgagaagggagggcacagtgatcttgcggactggaccgaggcgaattccccttcccagcctcgcgtcccgagtttgactggcaggacccgctggtgctggaggagcagctgacc

SEQ ID NO: 88487 - DNA, 601 bp, Human
ggactttccggggtgactttcccgttctgtgcttgcagagaaaggcgggagaacacagagccaactggctaagtgtaaggacctctggtcgcaccgtgtgtctgctgcccctgttcagctgtctgtctgccgcaggtggactctgtcccagaatccgagagctgcccgagcggggtggcagggtcgtggccagggtcagaggcactaaggcagtgagtgcgctgtgcctgcggggccggagaaaagtcacctgatcagtctcgcttgcagctcgcactagccggggggcgacatgggtgtkggggggtagggctgatgagggtccgagaagggagggcacagtgatcttgcggactggaccgaggcgaattccccttcccagcctcgcgtcccgagtttgactggcaggacccgctggtgctggaggagcagctgaccacagatgagatcctcatcagggacaccttccgcacctactgccaggagagactcatgcctcgcatcctgttggccaatcgcaacgaaggtgggcgggctggtgggtgccctgagactgctcctccgcctggagccatagccaccccacctcaaggcccctctg

SEQ ID NO: 88488 - DNA, 601 bp, Human
ccttcccagccactggctgccagaaactcattgaagtggacgatgaacgcaaactttgtactttttatgagaagcgtatggccacagaagttgctgttgacgctctgggtgaagaatggaagggttacgtggtcggaatcagtggtgggaacaataaacaaggtttccccttgaaacagggtgtcttgacccatggccgtgtccacttgctactgagtaaggggcattcctattacagaccaaggagaactggagaaagaaagagaagatcagttcatggttgcatcgtggatgccaatctgagtgttctcaacttggttattgtaaaaaaaaggagagaagggtattcctggactgactgagactatgatgcctcgtcacctggggcccagtacagctagcagaatccgtaaacttttcagtctctctaaagaaaatgatgtctgccagtatgttgtaaaaaagcccttaaacaaagaaggtaagaaacctaggaccaaagcacccaagattcagcgccttgtcactccacatgtcctgcagcacaaacagcggcgtattgctctgaagcagccgcatattaagaaaaataaagaagagg

SEQ ID NO: 88489 - DNA, 601 bp, Human
cccttaaacaaagaaggtaagaaacctaggaccaaagcacccaagattcagcgccttgtcactccacatgtcctgcagcacaaacagcggcgtattgctctgaagcagccgcatattaagaaaaataaagaagaggctgcagaatatgctaaacttttggccaagagaatgaaggaggctaagaagcaccagggacaaatcgtgaagagacgcagactgtcctctctgcgagcttccacttctaagtctgaatccagtcagaaataagattttttgagtaacaaataagatcagattcgcaaaaaaaaaaaaaaacccacaaggccctgtgtgaccaggcctctgctgacctttccacctcatctctggccactcatgtgatcctcccagccagacttagctacttgaaattctccagaagtaccaccagttctttacacatctgttccctctcccagcactgctcttccccacagcctcctcctgcttaactcctcacacccttccagtttggccaactccttcctgattccctgggtccccctccccatcttggcattgtgatcatgactttggggtaacctgtctcttgaaagcaggg

SEQ ID NO: 88490 - DNA, 601 bp, Human
tatttttagtagagatggggtttcaccatattggtcaggctggattttttttcttttttgagatggagtcttgctctgttgcccaggctgtagtgcagtggcatgatcttggctcactgcaacctctcctgcccgggttcaagcgattctcctgcctcagtctcctgagtagctgggattacaggcacccaccaccacatctggctatttttttttttttttttttttaagtagagatggggtttcaccatgttggccaggctggtctggaactcctgacctcaattgatccacctgcctyggcctcctaaagtgctgggatgacaggcgtgagccactgcaccccgccacgaggataatttttgagtaaggggatgtatcagggaccaggcagccttgtgactttgtcttgtgcctgcagccaagggggagctcctgggctgcttcgggctcacagagcccaacagcggaagtgaccccagcagcatggagaccagagcccactacaactcatccaacaagagctacaccctcaatgggaccaagacctggtaagggttctgggtggtgggcaggtggtgaacaggggcaaaggggcact

SEQ ID NO: 88491 - DNA, 601 bp, Human
tttttagtagagatggggtttcaccatattggtcaggctggattttttttcttttttgagatggagtcttgctctgttgcccaggctgtagtgcagtggcatgatcttggctcactgcaacctctcctgcccgggttcaagcgattctcctgcctcagtctcctgagtagctgggattacaggcacccaccaccacatctggctatttttttttttttttttttttaagtagagatggggtttcaccatgttggccaggctggtctggaactcctgacctcaattgatccacctgccttgrcctcctaaagtgctgggatgacaggcgtgagccactgcaccccgccacgaggataatttttgagtaaggggatgtatcagggaccaggcagccttgtgactttgtcttgtgcctgcagccaagggggagctcctgggctgcttcgggctcacagagcccaacagcggaagtgaccccagcagcatggagaccagagcccactacaactcatccaacaagagctacaccctcaatgggaccaagacctggtaagggttctgggtggtgggcaggtggtgaacaggggcaaaggggcactgg

SEQ ID NO: 88492 - DNA, 601 bp, Human
tcagccacaggcatgatcatcatggacggtgtggaggtgccagaggagaatgtgctccctggtgcatccagcctgggggtaagtggcagccactttgggaatgggtgttgggtcacctgcggatgcggctttgtcaggcaggctccgtgctggggacgcggctccctgtgcctgtggagcccacacagtggtgattcttactcagccggactcgctgacgtgctgaaaactgcccccatttggtgaccgtctcgctcatcccggctctgcccgggacacatgggcctgaaccagctcagtyatttgactcacagtgcatcttctggcatccgtcagcctcctggctctgagcatcgaacccagatgccaggctgggtgggactgtgtgcaaaccgagtgagcaggcaccgagcttcagtgccagggccatctgtgatgtgaaccacaacctgagtccccctgcgtggggtggctggggaggaggctttccctgcttcagagttggttctgcataggccctcttggtgtctcttgggtgggcctgaggcgccatctcaaccctacagggtcccttcggctgcctgaacaacgcccggtacgg

SEQ ID NO: 88493 - DNA, 601 bp, Human; identical to SEQ ID NO: 88486

SEQ ID NO: 88494 - DNA, 601 bp, Human; identical to SEQ ID NO: 88487

SEQ ID NO: 88495 - DNA, 601 bp, Human; identical to SEQ ID NO: 88488

SEQ ID NO: 88496 - DNA, 601 bp, Human; identical to SEQ ID NO: 88489

SEQ ID NO: 88497 - DNA, 601 bp, Human; identical to SEQ ID NO: 88490

SEQ ID NO: 88498 - DNA, 601 bp, Human; identical to SEQ ID NO: 88491

SEQ ID NO: 88499 - DNA, 601 bp, Human; identical to SEQ ID NO: 88492

SEQ ID NO: 88500 - DNA, 601 bp, Human
tgggcctctgccactgcatagtcccacagtccacttttcaaccatgaggcagatgactaaaaagcactttcttttctttttttttttgagaggaaatctcgctctgtcgcccaggctggagtgcaatggcgcaatcccggctcactgcaacctccgcctcccgggttcaagcgattcttttgcccccgcccgagtagctgggactacaggcgcccgccaccacgcctgactaattttttgtatttttagtagagatgggatttcaccctgttagccaggatggtctcaatctcctgacctratgatctgcccgccttggcctcccaaagtgctgcaattacaggcatgagccatcacacctggctgactgaaaagcactttcttctttaatgtgaaaatgatcagatgcatacaatggtagagttatatcagagcttccagatacccaggtagggcacagtggctcatgcctgtaatcccagcactttgggaggctaaggcaggcagaccacttggtcaggagttttagaccagcctggccaacatggcaaaaactcgtctctactataaatacaaaaagtagctgagcatggcggcaggc

SEQ ID NO: 88501 - DNA, 601 bp, Human
tttgggggctggtaggtgggaatagagatagggtctatgttgcccaggctggttttgaactcttgggcccaagcagtccctcctgccttgcctcccaaattgttgaggttacaggcgtgagccaccacacccggccaagttcacctttctaaaagatccacagaccacgtcttttcccatgtaactgtcaccaccgtggcttccccctgctctagaaaatgggtctgacttgggccttcctctctggtgtcattgtctgcctcctcccccttcccttgttcgctgttttttgttttttttkttgttgttgtttgtttgtttttgagatggagtttcgctcttgttgcccaggctggagtgcagtggcgtgatctcagctcaccgtaacctccgcctcctgggttcaagagattctcctgcctcagcccccagagtagctgggattacaggcatgtgccaccacgccctgctaattttatatttttagtagagatgggatttctccatgttggtcaggctgctctcaaactcctgacctcaagtgatctgcctgcctcagcctcccaaagtactgggattgcaggcatgaggcaccgtgccc

SEQ ID NO: 88502 - DNA, 601 bp, Human
acgccaagagtaatgtaaggtagggaaacaggccaggtgtggcggctcatgccggtaatcgcagcacattaagaggccaaggtgggtggattgcttgaaccaggacttagagaccagcctaggcaacatggcaaaagcccactctacaaaaatacaaaaagtaggccaggtgtggtggctcacgcctgtaatcccagcactttgggaggccaaggcaggtggatcacctgaggtcaggagttcaatatcagcctgtccaacctggtaaaaccccatctctactaaaacatacaacatttakctgggcatggtggcgcacacctgtaatcccagctactccagaggctgaggcagaagaatcgcttgaactggggagatggagattgcagtgagctgagattgcaccaccgaactccagcctgggtgatggagagagagtgccgcaaaaaaaaaaaaaaaaaaaaaagccaggcgtggtggggggtaccggcaggcccagtacttgggaggctgaggtaggaggatcacctgagccctgggaggtcaaggctgcagtgagctgtgatactgcactccagcctaggtgactgggtgagacctt

SEQ ID NO: 88503 - DNA, 601 bp, Human
gcgcagtggctcacgcctgtaatcccagcactttgggagaccgagacacacagatcacctgaggtcaggagttagaaatcagcctggccaacatggcgaaaccccatctctactaaaaatacaaaaattagctgagcgtggtggtggacgcctgtaatcccagctactcaggaggctgaggcaggagaatcgcttgaacccaggaggtggaggttgcagtgagctgagatccaccactgcactccagcctgggccacagagcaaaatttcatctcaaacataagtaagtaagtaagtaaagaaataaataaataaataaataaataaaaatttaaaaaaagaaggcaggccccacgcagtgtaatcccagcactttgggaagccgaggagggcggatcacctgaggtcgggagttcaagaccagcctggccaacatggagaaacctcatcactactaaaaatacaacattagccgggcatggtggtgcatgcctgtaatcccagctactcgggaggctgatgcaggagaatcacttgaacccaggaggcggaggttgcagtgagccgagattgcaccattgcactccagcctgggtagcaa

SEQ ID NO: 88504 - DNA, 601 bp, Human
ggcgcagtggctcacgcctgtaatcccagcactttgggagaccgagacacacagatcacctgaggtcaggagttagaaatcagcctggccaacatggcgaaaccccatctctactaaaaatacaaaaattagctgagcgtggtggtggacgcctgtaatcccagctactcaggaggctgaggcaggagaatcgcttgaacccaggaggtggaggttgcagtgagctgagatccaccactgcactccagcctgggccacagagcaaaatttcatctcaaacataagtaagtaagtaagtaagtaaataaataaataaataaataaataaaaatttaaaaaaagaaggcaggccccacgcagtgtaatcccagcactttgggaagccgaggagggcggatcacctgaggtcgggagttcaagaccagcctggccaacatggagaaacctcatcactactaaaaatacaacattagccgggcatggtggtgcatgcctgtaatcccagctactcgggaggctgatgcaggagaatcacttgaacccaggaggcggaggttgcagtgagccgagattgcaccattgcactccagcctgggtagca

SEQ ID NO: 88505 - DNA, 601 bp, Human
gatgctgctgttccagggttcttggctaacgtggtggcccttgaccacattctccaagtcggggaattcctgggcaaagatcccttccagctggtagttatagacccaggggtaggtgtaggtcagctgcttgcctggaggacaaggggaggaggaaatgcaagatcgttccaggttctggtcagtaaacccaggactcatcctgtgtccctgactcgacttacccatcttcgagaactgagcgaagggaaaagacacacagagcagggtctgcccgtaggtacaggcgctatgaggccarctgtatgcagcagaggaggccggtggagggaagttaggtacactgtggaccagccagaagcccccatcgtggtcaaggagcaggacacctggaccaaaagaaggcattaggggaggtcgggcgcagtggctcacgcctgtaatcccagcactttgggagaccgagacacacagatcacctgaggtcaggagttagaaatcagcctggccaacatggcgaaaccccatctctactaaaaatacaaaaattagctgagcgtggtggtggacgcctgtaatcccagctactcaggaggctgag

SEQ ID NO: 88506 - DNA, 601 bp, Human
cttgcagcctcgacctcctgggctcaagctgttctcccacctcagcctcctgagtagtggggactacacgtgtgtgccactatgccccactaattaaaattttttttgtagagatggggtcccgctgtgttgcccaggctggtctcaaactcctgggctcaagcaatcctcctgcctcgactgggattacaggtgtgagccactgtgcctggcctatttatttgtatttatttatttatttatttattttgagacacagtctcactctgtcacccaggctggagtgcagtggcactatctygactcactgcaagctccaccttccgggttcacgccattctcctgcctcagcctcccgagtaactgggactacaggtgcccgccaccatgcctggctaatttttgcacttttagtagagacagggtttcaccgtgttagccaggatggtctcgatctcctgagctcgtgatctgcccacctcagcctcccaaagtgctgggattacaggcatgagccactgtgcccagcctatttatttatttttaaataaagacagggtcttgctctgtcacccaggctggagtgcagtggagtcattat

SEQ ID NO: 88507 - DNA, 601 bp, Human
ctgagctcagttgtcaattcccagtcctgggaatgatgacattaatattaattgcccttcccaaatttgtttttgagacagagtctcactctgtcgcccaggctggagtgcagtggtgtaatctcggcacactgcaacctctgcctcctggtttcaagcgattctcatgcctcagcctcctgagtagctgggattacaggtgcccgccaccacacccggctaatttttgtacttttagtagagatggggttccaccatgttggccaggctgttctcaaactcctgaccgtgtaatcagccrgcgccctccaccatgcccagataatttttgtacttttagtagagatggagtttcaccatgttggccagactggtcttgaactcctgggctcaagtgacccacccgccttggtctcccaaaatgtggggattacaggtgagccaccgcgtccggccctgagtgtttttaattaattaacttatttattttgagactgggtctcattttgacaccccagctggagtgcagtggcaggatcatgactcacttgcagcctcgacctcctgggctcaagctgttctcccacctcagcctcctgag

SEQ ID NO: 88508 - DNA, 601 bp, Human
gctctgtcgcccaggctagagtgcattggtgcaatctaggctcattgcaacctctgcctccgaggttcaagtgattctcctgcctcagccttctgagtagctgggactacaggcatgcacaaccatacccggctaattttttaataaagaggggtttcaccatattgaccaggctggtctcaaactcctgatctcaagcaatccgcccacctcggtcttccaaaatgctgggactacaggtgtgtgtcaccgcgccctgccacagtttccatatttctgagctcagttgtcaattcccagycctgggaatgatgacattaatattaattgcccttcccaaatttgtttttgagacagagtctcactctgtcgcccaggctggagtgcagtggtgtaatctcggcacactgcaacctctgcctcctggtttcaagcgattctcatgcctcagcctcctgagtagctgggattacaggtgcccgccaccacacccggctaatttttgtacttttagtagagatggggttccaccatgttggccaggctgttctcaaactcctgaccgtgtaatcagccagcgccctccaccatgcccagataa

SEQ ID NO: 88509 - DNA, 601 bp, Human
gtgaagctgtttcctaatagtttggaccagacagacatgcacggagactcagaatacaacatcatgtttggtgagggcctgcttcctggtgctgatctctgtcccattagttagagggagacccagaccccattgactttcttaataatgattttttttggaaggggagctaaaagaataagtcccagcaacaatttattgcattatgatcgcagatctaggctgttaatttaatttgcgtgtttgtatatagttatttcccaatcttactaatgaggattttgagttctagagcactgattttttttttttctcctttaaacttaaggctccacccacagcccattcaggacagaatcagggtctgagtttctcttctcagccttgacagacccgagttgaagaaccaggtcttccttttataaagaggggtgagagcctcgagatgatgggtagtctctgactcttaactggatctgcttcacacctaggtcccgacatctgtggccctggcaccaagaaggttcatgtcatcttcaactacaagggcaagaacgtgctgatcaacaaggacatccgttgcaaggtgtgcctgggggtg

SEQ ID NO: 88510 - DNA, 601 bp, Human
ggaaacgcaggttccagaggttgagcaatggccacgaagccacactgctaggacctgagggtgtgagcttagctgcaacctccctctttggcccctgctcataccaagccaggtgggtgaactgagagtccaccgagacgcccagcacttcacagcccagcttgcggaagtcctctgcacggttgctgaacgcgatgatctcggtggggcacacaaaagtgaagtccagagggtagaaaaagaggaccacgtacttccctggggaggagggacacagaggagttagggcccagcttctctyatgcacggccccgcttctacctgggccccctccgggcggcgctcacctttgtagtccgacagcttcacctctttgaaggcgccatcaaccaccgctgtggccttgaagtcaggggctggctttccgatgcgcgcgttaccggaggccatgactgaaagctgagacccccgcccggtcagtgcgcccgggaagacactttgtcctcccaacccaaggtcgcgctgcgtgctgggccctatgactgagtcagcacggcggaggcgacagcactaaccctcaccctcccgggtacccggtcta

SEQ ID NO: 88511 - DNA, 601 bp, Human
agcgtctggtcacgtcagcaagcagggggatgttcagggggcccaagcctccctctttccggggggtgttgatcctgggagtaggggagacagagttggggcctcaggatgcctggcacagcagggtcctcaccctgtgggcccaatgtgataagcactggaggccggagataaggggctttagagtaggccgctgggagcctcacccaccccaccctgggttgggtgcaaggactgtatccccatggctgggaagactgagtttgagaggcacagctccagctaagtggcttcacatgtrcttgtaacttgcagcatcacccagcagagagcctgtgttaagagtccccatcctcctctagctgtgtcatggggtacagcccttcacttcggtgaactggagtttccatcttcatgaaatagggcagcacagcctccctcctgggaactaagtacatagagtagatagagttgcatctgagttgcatctgcaactctatataccaggcaactagttgtcaaatgctaattactgtcatcatccttaaagacttgggcggcaatgtttccattattttcacgatggggaaacgcaggttcc

SEQ ID NO: 88512 - DNA, 601 bp, Human
cttaagcatgaggccgcacatgctgaagatcatgcccagcaggttcatgtagtccggcgtcgggtcgtccaaggccgggttacattcgctcggcgggggcttgtacctgcgacaggctcgagggtcaggggcgctcaggtcctgcccccgggatagacaggcgcttcccagggccccgatccacacccacaacccgaacccgtgcccacgacgctggggtcctcacctcagcactttgttcggcctccgtgggtccgacatattgttagtggacatagcgagtcgaaggccagatcacgcytcttccgctgcaggaatcgcagcttccggcgtgcaagctgagggcggattttagagtaacacccgaggccctcgcatttccgttcctcatgacagaggcttggactccccttacccagagaacggagatttaggagaagccagaagtcttcctttcaaagggaaaatggggaaaagaacctgaaagcgggcttcaatagttccaacccgatcaccgaaatgccaaaatgatgaacccggaagtgataaacaggaagtaggtcaggaagaacaataataaggttacacccaagcgtgggtt

SEQ ID NO: 88513 - DNA, 601 bp, Human
caagagttcgaggcaccattgcactccatgctgggtgaaagacagactgtctacaaaataataataatctggccgggcacggtggctcacacctgtaatcccagcactttgggaggccaaggtgggcagatcacttgaggtcaggaggttgagatcagcctggccaacatggtgaaaccccgtctctactaaaaatgcaaaaattagccaggtgtggtgacgggagcctgtaatcccagccactcgggaggcggaggcaggagaatcgcctgaacccgggagttggaggttgcagtgagcygagattgtgccactgcactccagcctgggcgacaaagtgagactccatctcaaaaaaaaaaagataaaatgatttctaaaaataaataaaaataggccgggcgctgtggctcatgcctgtaatcccagcactttgggaggcagaggcaggcggatcatgaggtcaggagatcgagatcattctggctaacacggtgaaaccccgtctctactaaaaatacaaaaaattagccgggcatagtggcaggcgcctgtagtcccagctactcaggaggctgaggcaggagaatggagtgaaccc

SEQ ID NO: 88514 - DNA, 601 bp, Human; identical to SEQ ID NO: 88512

SEQ ID NO: 88515 - DNA, 601 bp, Human; identical to SEQ ID NO: 88513

SEQ ID NO: 88516 - DNA, 601 bp, Human; identical to SEQ ID NO: 88512

SEQ ID NO: 88517 - DNA, 601 bp, Human; identical to SEQ ID NO: 88513

SEQ ID NO: 88518 - DNA, 601 bp, Human; identical to SEQ ID NO: 88512

SEQ ID NO: 88519 - DNA, 601 bp, Human; identical to SEQ ID NO: 88513

SEQ ID NO: 88520 - DNA, 601 bp, Human; identical to SEQ ID NO: 19397

SEQ ID NO: 88521 - DNA, 601 bp, Human; identical to SEQ ID NO: 19398

SEQ ID NO: 88522 - DNA, 601 bp, Human; identical to SEQ ID NO: 19399

SEQ ID NO: 88523 - DNA, 601 bp, Human; identical to SEQ ID NO: 19400

SEQ ID NO: 88524 - DNA, 601 bp, Human; identical to SEQ ID NO: 19401

SEQ ID NO: 88525 - DNA, 601 bp, Human; identical to SEQ ID NO: 19402

SEQ ID NO: 88526 - DNA, 601 bp, Human; identical to SEQ ID NO: 19403

SEQ ID NO: 88527 - DNA, 601 bp, Human; identical to SEQ ID NO: 19404

SEQ ID NO: 88528 - DNA, 601 bp, Human; identical to SEQ ID NO: 19405

SEQ ID NO: 88529 - DNA, 601 bp, Human; identical to SEQ ID NO: 19406

SEQ ID NO: 88530 - DNA, 601 bp, Human; identical to SEQ ID NO: 19407

SEQ ID NO: 88531 - DNA, 601 bp, Human; identical to SEQ ID NO: 19408

SEQ ID NO: 88532 - DNA, 601 bp, Human; identical to SEQ ID NO: 19409

SEQ ID NO: 88533 - DNA, 601 bp, Human; identical to SEQ ID NO: 19410

SEQ ID NO: 88534 - DNA, 601 bp, Human; identical to SEQ ID NO: 19411

SEQ ID NO: 88535 - DNA, 601 bp, Human
ataaaataggcaaaatggtacatgttccatatattctgtaatgacctctgcaagatctgtaccttattattaaagccattaatacctctgtaggaaaacacaaatattctcaccaagaggctaaataaggcataaatagcctcgcatcagtttgggtcaggtttgccaataaatgaattctgcattaaacttggaagcaatgttaggttttcagagcttgggcttggcacatgtggattgggggttgtgatctgcagtgcctccctcatggggctcccgtgacgactgaatgggtacatgygtgaatgtgcatatgtgtacagcgcttagacagtgccaagcactcgagagcactctgcagattgtggaaggcgcctcagtgccctgaggcctgcccttgggggcagagtccagctggacacaaaggacatctctgctcagcaccccaggaggccagaaacactggctcagggtcacccccttggctgacatcccctgtctatctttggccaaacctttctttcctctctctctccccctaccctctaacccattgtcactccactgctggtggaagaggagggccaggatggatcatcaa

SEQ ID NO: 88536 - DNA, 601 bp, Human
tcctatgctagaggtccggggggaagaggaggcggcccttgacaggctggggatgggggccacagcctacctctccgctctttgagatactcaggatccaccaggaccacaccatctggggaaaggacagagagtaagcggtctctcccaacctggtctcccaaacctctgtgccccaaacaccagcccaagcccagatccaaccatctgttcatctaaaatcatcctgagaaaaatggaaaggcgggcacctagagggtggcactgcccacctccaccacgctccacccttcccccatcscaggccagtataacagacccagctggtgactttaggcaggttagagaccatttctgtttcttcatctgctagtaagaataataacctaggtccgaaactcctagaaccaggtattctttggactttagaaattgcgaagtatagagaggcaaaatgggccgggcatggtgggtcatgcacataatcccaacactttgggaggctgaggtgggcggatcacttgaggccaagagttcaagaccagcctggccaacatggtgaaacatcaactctactataaatacaaaaatagctgggcat

SEQ ID NO: 88537 - DNA, 601 bp, Human
caggggcttcttgtcctcgggggccggtgggaacgactgtacgttggccacaaacaggtccttgcgaaaggtcaggcccaggacatccaggtcctcccggccatagcggaaggcgcaggtcagcgtcacatagactgtggggagcgaggagcactgaggaggggcctgggagagcagcaagcgagccccccagagtgccggcagcagccctgggacgggccccactggaggccccaagcctgtcccaagctctgtggggatggctgcactgtctccaccaggagggctggtagtgagtacmggaaggatgccatggcctggcccctgggaggaggagggggctgcctgctgagccagctctgtccttccccctcccacctctccccagggcatatgtggaggggtatggaaacggtctgacaggcttggcgggggctggagtagtctggcaggcctggggtgggggtaggggacctggggaaggagcagggagttgtgggggcagggcaagtgctgggtggtatctggacggcaagcgtcttgtcacagctcagtctgcactcttgtcttcctgcgcattgatactgccccggtatcaatg

SEQ ID NO: 88538 - DNA, 601 bp, Human
acatgtctacgtggaaaaggtgactccatgaccctctccactctctcagcctccaagaaagggagagaccacactgaatctcagaatcagagagcctaagaaacttgagattttgaaatccagcatcttaaagtctctgatttgaaaggtggtggggcagacagatcacctacttgccatccctctcttgcgagctgggttgctgccgggcaagtggggagctgatctgagcgggaaaccccttgcagtgatgcagggtccagaaagggctctttctttctctgaagccccttagcacccsctttctcccaccaatgacctggcctcagaagggtctgaggagtagcccaaaggtacaggtgacaaaccccagcaggggctggagaagagacacttaccaggtaacacaggtgacagtgccccaggtcccagcatacactgggaaactgggtggcagggagcagctgaccctcaccgccctcttatgcccaccccagagggcttcctagaggtggcatttctggaatggggccccagggatggcagttcctgacctcaaaggtgaaagggtaagcgtgctcgcccagcttcttgatgaggc

SEQ ID NO: 88539 - DNA, 601 bp, Human
gacacaaagactgttcaacagggagagtggtcctgtgtgtccagcacctcccagggagaaagccagggacctggggacatgagactcctggagccagagagatggtccccttggggtgacctaccttccccgtgtcttcgggccccggctgcagtgtcacagaacatggaaggtttggagggatctgtcaagaagaggacagaacgagccacctgtcacatccaccactgtcctgtctcatgtattgcagcccagacactcccatacacccatcagaccaagggccccaggggacaggccrtgtctatcccatcagaccatgccaagccatgccccatctaaaactctttagataaagagctttctttatctaaagggtttggcccagcccagtcctcgcagcaatggtttaaatagatctttctatgatgtctactgtggttggcagaataatgttccccaaagatgtccacaccctaatcgcccaaacctgggaccttaatgacaaaagtgactttgcagatccaattaaggccttgagatggggaccgtatcctggatgattttggtgggcctagtataatcacaagagtccttagaa

SEQ ID NO: 88540 - DNA, 601 bp, Human
gtcctcacagggtgctagaggccaagttcgtgtcttcgtgcttgagcttcccgtccaaggcgaggccccgcttctctcggttattggctaggaagggggtcagtgtgtagaccttgcagaacgtcgagctgggtgccacagtgtcactgggaagaaaggaagcagctgtggagatggccctccccagagccaaccccagccctgatctccagcccagcagaatatctagtctgagcctgctccaagtctccctctcccaacctctgtcccccagacacacggaccacttgggccagcccasctcgggcaaggagaccactgccactcaaaagaggcacatctacattctacgcacaaacaggactgaatctcggatattctaaaagattatcctagtcaagcagcacagtgctaaaaagcacatttatttaaagaattacagccagccgggtgcagtggctcacgcctgtaatcccagcattttgggaggccgaggcgggtagatcacgaggtcaggagttggagaccatcctggctaacaaggtgaaaccccgtctctactaaaaatacaaaaaaattagccgggcatggtggtgggcgc

SEQ ID NO: 88541 - DNA, 601 bp, Human
tttaatcctcgcaacaaccatattattatccccaatgtacagactgggacattgaggcatgaggagattaaaatatcttgcccaaggccacacagctattaatggttattattagattctggctccataaccacacccttgatcactgtgtgacagtagcagaattgagactaacaaaagcaaccctgaaggctcctctcggcttggggtgacatcaccctaggagaccacccaactgcgagtgcctacaggcacaagccacatcccactgatcttgttgtccagagcccagttgggaaaraggaagggacagggaatggagtggtcagaggcacaagccgtgcaattagaaaggtctgttccaccagcctcgccacccgctggtgcagcactttctagctttgagtctcactgagctcaacttggaacaaagcctgtcttctagaaccacgggaacttctgggagatgaggcagctaaagagctgagttaaactgtgaagcttgaccaggcgcagtggctcacgcctgtgatcctagcactttgggaggccaaggcgggcagatcccttgagctcaggagttcgagaccagcctgggcaa

SEQ ID NO: 88542 - DNA, 601 bp, Human
gggaggcggaggttgcagtgagctaagatcacgtcactgcactccagcctgggcaacagagtgagactgtgtctcaaaaccaaaaaaaaaaaaaaaaaaaaaaaaaagaagaagaaaaacatgacaatagcgtgtccaacggtcatcttatccaagcagccccttcccctacttccaaacgggatccagcccatgcctgggtgcaagatagaggctcaaagcatggccaatgagttcccttctccactcctggcctccctctcccatggggaacaggagccacgcctcactgtctcctggkggggtcagaagcaaatcgagttctggaccccacaaaagatctggggacccgagaaaagggtgactgggctgagggcgaacccggggcggggtgggttacagggtcacgtggcagctgctagagaacccctaccccagagacctacagattctgctcaccttcccgatgcgggggttcctctttgggcttggggtgcattagggtgaagggcagttccacggccacgtcgctgaaacagagacccagacccagtgagccttgagcggactcacaggctgtgagacttgatgtcgatgccct

SEQ ID NO: 88543 - DNA, 601 bp, Human
ctggacagcaaggagtagtttggcttaatgaaagagaagaccatgaagaacctttctcccagaagtgtcagctcagattctaccttgggggatcccagacagaagaaggctggggtaggaggatgtgaatctaaataggggggcagaggacctgttcgtgaggaaaggggaggcttgagtggggtttcaggactagactgcctttaagaacagcgagttcccttctaccatgaaacatgtccatttaggaccatgcaggtgtccacctgggtcccctgcccaacagggttcagccagtgcmtggggcatcctcatggggtgacctgagacccccacaccccagatttctcctgggggacaagggaagattggctttggagctggagcaagaaagccacttggacctggaggcggtccgcgcagtcggcccaggtcctccccctctggccactgtccggtgactcgatggcctttgactgcagggaaatccacatcggttggtcctcaggagtcagaagcaacaagatccccagtcccctgcccaccccacagcctgattccactggttggcgtgggcaggacaggagagccgagcccaggg

SEQ ID NO: 88544 - DNA, 601 bp, Human; identical to SEQ ID NO: 88535

SEQ ID NO: 88545 - DNA, 601 bp, Human; identical to SEQ ID NO: 88536

SEQ ID NO: 88546 - DNA, 601 bp, Human; identical to SEQ ID NO: 88537

SEQ ID NO: 88547 - DNA, 601 bp, Human; identical to SEQ ID NO: 88538

SEQ ID NO: 88548 - DNA, 601 bp, Human; identical to SEQ ID NO: 88539

SEQ ID NO: 88549 - DNA, 601 bp, Human; identical to SEQ ID NO: 88540

SEQ ID NO: 88550 - DNA, 601 bp, Human; identical to SEQ ID NO: 88541

SEQ ID NO: 88551 - DNA, 601 bp, Human; identical to SEQ ID NO: 88542

SEQ ID NO: 88552 - DNA, 601 bp, Human; identical to SEQ ID NO: 88543

SEQ ID NO: 88553 - DNA, 601 bp, Human
ctggaattcggcgctcggagcccgagtttctgaaggcgggaggcggcgcccggcctcaggggttgcgctgggctgccggagccaagagtgtctgcgtccccagccccgcgtcagaagggaccggagcccgagtccgccccggttcccggggcccccgagcaggtgcccgccgagggtctcagagtgtgactgagcgggttggcccggcggccgttgccccccgcccccgccccttcgcgcctggccgcgccactcactgtcgcgggtgtccgcgtgcgcgccgccgatgcggccgtcgggragcgcctggaggtggaagccgatgcccacgttgcagtagagccgccgcagccgcttgatgcccagcaggtagtcgccggcgccgctctggacggccgcctccttgggctgcgctgccaccggcaggcgcgccaacgagagcgccaccaggctctcccagcggcgctccagctcggcctccagcgtgccgttgggtgcagtgggtgcggcggcgccccctcggcccgcccagggcgccagcaaggccagcaggaccgccgggagcagcgctaccgcggccgtcccgggccccgacatcccg

SEQ ID NO: 88554 - DNA, 601 bp, Human
cagggttcccggcgcagccgcccccaagggcctccagagcccaagctgccctctagggcctccggagcccaagcctgcgctagctcagattagcttgcctgtgtaggggacccccggcggccgcacccagtcccggaccttcagacgcgagcccgaccccagcggttccccagcctgggccaggccggggcgcgtgtctcgggccccctgtggctgcaccgcgcgccctgtgcccacgggcgaaggcgctggaattcggcgctcggagcccgagtttctgaaggcgggaggcggcgcccgrcctcaggggttgcgctgggctgccggagccaagagtgtctgcgtccccagccccgcgtcagaagggaccggagcccgagtccgccccggttcccggggcccccgagcaggtgcccgccgagggtctcagagtgtgactgagcgggttggcccggcggccgttgccccccgcccccgccccttcgcgcctggccgcgccactcactgtcgcgggtgtccgcgtgcgcgccgccgatgcggccgtcggggagcgcctggaggtggaagccgatgcccacgttgcagtagagccgccgcagcc

SEQ ID NO: 88555 - DNA, 601 bp, Human
acaacagctggtgctctcaccacctgccctgcacctagcagccagagaattcattccctccgtgtccagcctcaagcccgcagttccaacactgagacctacccctctggactagagaagggaagggctctcaatagcgccctttcctcggtctgggaggggcccactcagggatggcaggaacctcattgttcctgccttggggctgcttcctttgtctggggaggcctgccggtcccgtgacctggtgaccctgccacccctccaagacccaggcacaggtggggctggagaagccacragcctgctagccatgtccgctgttcccaactaggtgcctagccagacccctgcggtactcaccgagccatagagcttgcccttgctgctcatggccacgaagaaccggctggccacgccgaagatgctcaccacgccccgctccacgggcgagagctccagcaggcctgggggcggggcgcaggtcattgcggggcaggtgatccctggcccactccgcccctcggcttgttcgcctccggggaccctatttctggggtggggttggggataaagggccagggttcccggcgcagccgcc

SEQ ID NO: 88556 - DNA, 601 bp, Human
cgtcattatccgctaagtcctcgccctgtttcttagcgccggatcctggggaccagacacggggagacacaacagcacagaacagagaacaaaacagagagagaattcaaaaacagcatgactgcagtgtggcccagcaagccagctccgggcctgggcccaggacaggcaggagggatggcaagaactgagggaatgggtgggctgaggcccagaccttcatcaggatgatggtgttgcaggcccctgctgtgctggcctctctgcaccgccttgccccgcctccttgtccccaacagcscatctcaaccaactacctttccagtgaggaaggaggtagcagcaagtgggccagggcacagagccagagaccctctcaggggaaggattcattctgggtggaaggggctgcttgtgtgtacacaggcaggtcgagctggagagcagggtcaggtaccaagggtgaggggtgacactgccagcaagtgtggaggttgtggatacgaggtacttagggcagagacgtgtagagggaccccaggcctgagctcctggggcccagtgggcaggctcaagctgggcctcagctgaccctgattcc

SEQ ID NO: 88557 - DNA, 601 bp, Human
ccaacggccttgtacaggaacagaaacacaccaacggacagacagacagacagacggggcttctccccatcgagaaggggaggggctctgtgccatgcaccagccgccgcgccctgcagcccccaaataccttcatcttcatccccgtcattatccgctaagtcctcgccctgtttcttagcgccggatcctggggaccagacacggggagacacaacagcacagaacagagaacaaaacagagagagaattcaaaaacagcatgactgcagtgtggcccagcaagccagctccgggcctrggcccaggacaggcaggagggatggcaagaactgagggaatgggtgggctgaggcccagaccttcatcaggatgatggtgttgcaggcccctgctgtgctggcctctctgcaccgccttgccccgcctccttgtccccaacagcccatctcaaccaactacctttccagtgaggaaggaggtagcagcaagtgggccagggcacagagccagagaccctctcaggggaaggattcattctgggtggaaggggctgcttgtgtgtacacaggcaggtcgagctggagagcagggtcaggta

SEQ ID NO: 88558 - DNA, 601 bp, Human
ctttctcaagtccttctgtacctagcttctgcaaaagagctcatctcatcctcttcaagtgtgttattaatttacctctggtacaattaagtatgtaaagtacttagttatttctcccgggccctagtcacaagtcctctttagccccaggttccagaggaggaaatgagaatgaattagagaaagcctgcatgaggatgaagaaggaacccttgctcttccagacaaggaaatcagcttttcctttgcgtggcccattcagaaattgaagctgctcctttgagtcttaaaaacttggccrggcatggtggctcacacctgtaatcccagcactttaggaggctgaggtgggaggatcacttgaggtcagaagtttgagaccaacctggccagtgtagcaagaccctgtccctttttgtttttaaaacaaaacaaattagccagttgtggtggtgcatgcctgtggtcccagccactcaggaggctggggctggaggatcacttgagcctaggtgtgaaggctgcagtgagctgttattaccccactgcactccagcctgggggacagaatgagactccatctctaaaaaagcaaccaaaa

SEQ ID NO: 88559 - DNA, 601 bp, Human
tcttggaagggtcactggcaaagggacccaccacaaggagagaggccaaaaatgagaatctccccggcagcttgcacagtcggggagaggtctggagtctgataatagaccatcgtcctatggaagaagcccacctcgtgggttagtgactctcatttcagacccacttccccctctaggatgtttcccctcttgtacagacttgttcttcagagagaaaggcagagaatggatgtttcttagacctagaaaccaatttccaccctatatctctactgtgaagtaacatgtccttcccatrctgaaagatcctccccaacccctgtcaaactattgtcctctgaggggacaattgttctattcccactccccaaaataagactcccacatcagaaggagaatcttgctttcccaggacataaatgggattctcttccttccctctccagctttgggagaagtacttctcccagagaaacatttctcttccacttcttgccaaagggataccaagctggtagaagagagctggccgattcccttggatgccctggggcatggatggggcatgctgggacagccggcacttggctagttcatg

SEQ ID NO: 88560 - DNA, 601 bp, Human
cccagggcttgaactcctatatcctccttcccggcgctcatcctttaagattaaggctatagatgctttttctttgcacatgctactgagcatttatcaatcttttcagctgcccaattttgccaggagccccctaataaagcctctttcttttattaagcaagcagaagttgctgaacccgaagtctctttttctttctttctttctttctctttcttttctttctctttctttctttctttctttctttctttctttctttctttcttttttttttctctttctttctttctctctctytctttctttcttccctttttctttctctctctctctttctttctctctttttttttctttttttttttttgagacagagtctcgctctgtcgcacaggctggagtgcggtggggcaacctcggctcactgcaacctctgcctcctgggttcaagcaattctcctgcctaggtagccgggactacaggcacccgccaccacgcctggcaaattttttgtattatagtagagacggtgtttcaccatgttggccaggctggtttcgaactcctgagctcaggcaatccacctgccttggcct

SEQ ID NO: 88561 - DNA, 601 bp, Human; identical to SEQ ID NO: 88556

SEQ ID NO: 88562 - DNA, 601 bp, Human; identical to SEQ ID NO: 88557

SEQ ID NO: 88563 - DNA, 601 bp, Human; identical to SEQ ID NO: 88558

SEQ ID NO: 88564 - DNA, 601 bp, Human; identical to SEQ ID NO: 88559

SEQ ID NO: 88565 - DNA, 601 bp, Human; identical to SEQ ID NO: 88560

SEQ ID NO: 88566 - DNA, 601 bp, Human
taaagcaaattgaactaggggtcaggagtctcaggcaaattcgctgtgtggcaaatactttaacctctctgttcttttccgttcttatctataaataggggcaaccaaccaccagtcctcagaggctctgaaaatctaatttcaattgtggttgaaagtgctctgaaaatttgaaatgttacacagatgtatgggattcctcctgagctgtatttgaaaccacagatatccatctgatttgtaaatcatttaccttttagtctccctagcagaagttaatagtgaatgcttttctttttttctttttattttcttgattgctaattttgttaagttcataagcgatacttacatatgtacatgtggaggctggaatctgctctggttgatgttgtagtgcgtgaatgcctgggtggggtttgagctgtactcatccaccgttatggtaactttgccttgagaaggaatcccatgtgccatccttcctccctataggcatgagcaattcacaactttacagagcaaaagatggaagcaggcatggtgcgtttcagccaacctctgaatccaaggatctactcatcaataccgctgtgcattt

SEQ ID NO: 88567 - DNA, 601 bp, Human
tgcaaaatccttgcctctgggtttctgccacactttgctccttaaacagtttaaacctcaacatgacttaaatagtattagggagtgagaggaaagtacaattcctggaaccaactgttccactgtcccttattcctttgttccccatattgtttgagtcctgtagcatgcagcacacgtttcactagcaacaggcaagacaatggatctagcagtagctggacaattagtcccaattaggcctatttcccagctgaatgtaaagggctagtggggtgaggtgtgggaaaaaaaaaaaaaactacagaaattttaaagaaatatttcagaatggaggcaagcaatacaatgtaaagcaaattgaactaggggtcaggagtctcaggcaaattcgctgtgtggcaaatactttaacctctctgttcttttccgttcttatctataaataggggcaaccaaccaccagtcctcagaggctctgaaaatctaatttcaattgtggttgaaagtgctctgaaaatttgaaatgttacacagatgtatgggattcctcctgagctgtatttgaaaccacagatatccatctgatttgtaaatcatt

SEQ ID NO: 88568 - DNA, 601 bp, Human
caactccagctgtgctttaattttctttcccaaggtcatacaggattgctttctaaaaaaaaaaaacttccctccataacaagcagagattcaagccagtcattcttagagagcttggtggtaatcttgtcagaactcagagatgaaaactaaaccaatgcttcttaaagctgtttgaaacatcagctctgaaatcagcaatgagcttcatgaagatggggactgggtcttatttatttttgtttccttaatagcatcgccttgcaaataaacattgtcttaactgcaatcttaatcttarcaagtcagagctaaaaagatccttaaccatcatttggtgcaaatatttacagatgagtaaactgagacttggaaaagaaaatttgttagtcacaaagctgagctgagactaattgaattaaatgggaagtgagctcttcctaattaaggtgaaaaaccccaactaccatcacaaggctgtagaaaagaaagtaagacatcattaaagggatagggtttttaactataatccaagtgatctgtcaggggtcttcagaaatctcaagtgtaagtgaaaaaaggaagcaaataatttaacaat

SEQ ID NO: 88569 - DNA, 601 bp, Human
ctgcttttcaaatgaattggcagtttaaaattaaaaacccagaatcaatgaaaaaattattaatgataacagctaacatttattgagcatagactatgtatgtataagcattaacatgtaatactgtttcatccttctatcctccacagccttttgagataggcattacttttatggtccagatcttacagatagaaaaataaaacataaggaagttagagtatgtattcacagttggttatacagctagtcagtggtgcaagcaaatgttaaacccggtaatctgattccacaggtgatrttgaccactatgctaacctgcctccacagaaccagggtaaaagaacaagtgcagtgtaagattcaaggggtgttaacaacagaaggcgcagataaggaaagtggctaaaactgaaaacaaggcttgatttgagttccctagtcgtcaatccttaaagaaaaacatgaagaattaacctgagtagggtatcctattgtcctatggcattccaataacacggggatttcaatgctaaaactgaaatggctggataccctactaataaagttttgtaacatttgattaggcctcagattatga

SEQ ID NO: 88570 - DNA, 601 bp, Human
ccctgacaaaccaaaatcccacctagaaaagtttccatgactctttgctgctcatagctccatgaggaagaaaggacaagatttagcaatgactttatttattcatttgtatacactccactgcttttcaaatgaattggcagtttaaaattaaaaacccagaatcaatgaaaaaattattaatgataacagctaacatttattgagcatagactatgtatgtataagcattaacatgtaatactgtttcatccttctatcctccacagccttttgagataggcattacttttatggtccrgatcttacagatagaaaaataaaacataaggaagttagagtatgtattcacagttggttatacagctagtcagtggtgcaagcaaatgttaaacccggtaatctgattccacaggtgatgttgaccactatgctaacctgcctccacagaaccagggtaaaagaacaagtgcagtgtaagattcaaggggtgttaacaacagaaggcgcagataaggaaagtggctaaaactgaaaacaaggcttgatttgagttccctagtcgtcaatccttaaagaaaaacatgaagaattaacctga

SEQ ID NO: 88571 - DNA, 601 bp, Human
ttgtcctcattccccagcccaagctgtgccttttgcactcaatcctggttaattacagatagcgcttgatgtttttgttttaaccacagatagagataggaagtctaagaaactgactggggtacagagaacctaggtccagctcatgtggaggaaggccactgtgattccacagacagcaaccagtcagcactcagctcacaagattccatccccgccttgggactgccactcccgtggagtaactggaggtggatgagacactcctaggctgtttataatcttgaaaggcactaaaccrggacacttgccaaccctgacaaaccaaaatcccacctagaaaagtttccatgactctttgctgctcatagctccatgaggaagaaaggacaagatttagcaatgactttatttattcatttgtatacactccactgcttttcaaatgaattggcagtttaaaattaaaaacccagaatcaatgaaaaaattattaatgataacagctaacatttattgagcatagactatgtatgtataagcattaacatgtaatactgtttcatccttctatcctccacagccttttgagataggcatt

SEQ ID NO: 88572 - DNA, 601 bp, Human
tatatattatcataaaatctatttatcaagtggtatcttttgggcactatatgtcattatatatcatttcatttaatgctcacaaccatattaaagggtcattaaacctattttacagatgagaagacaggttcaacaatttttccatcatcacccagccacgccagtaactggcaggatcagtatttgtatacagatcgctgatttcagaccatattctcagctaccatgtgtatattgtcctcattccccagcccaagctgtgccttttgcactcaatcctggttaattacagatagcrcttgatgtttttgttttaaccacagatagagataggaagtctaagaaactgactggggtacagagaacctaggtccagctcatgtggaggaaggccactgtgattccacagacagcaaccagtcagcactcagctcacaagattccatccccgccttgggactgccactcccgtggagtaactggaggtggatgagacactcctaggctgtttataatcttgaaaggcactaaaccaggacacttgccaaccctgacaaaccaaaatcccacctagaaaagtttccatgactctttgctg

SEQ ID NO: 88573 - DNA, 601 bp, Human
ttttaaagctcaatactatcaaatgtgaaaaagttatctgttccctatattccatggtgatgttagctttctttttctttttttttttttaaactagtttcaacagctctgaggcttaataaaaacttgcacaaaaatgtaaatcaactagagaagcttatattcttgatttgtggtaaagaagaaaaaaataaaaaaatctgcaaaaatgcattttcttatttgcatatattttgtcccttctacagggacagaaattgaataaaaccaatcttcaaagaaaaatagaataaaaatatgyagacccaaataatgcaggagccaataaattcaacagagtttcctctttgcagagttagtgtttccacacagacaaagcttctaagtgtaccttttacattaaataacaaaaaaagaaaaaaaaagaagaccaagatggtggtctgcaaaattgcagcagttttgtccatactgatattgaaataatagtctaaccatgctaggatagctacttaaacatctagtttccagtaagctatgaaagtctaaaagggaaaaagacatgggaaggaaagagctaaggcaatactgaaaaagaaga

SEQ ID NO: 88574 - DNA, 601 bp, Human
tttctgtgccatgtaaaattttcttaagcctggcagtttacagcaggatcttttcctgatcatttgcttttcaaggtgttgacagtttagtcacccacaattagaactccattgcatacttactttgaatttcctttgttttacctttaagtcaatgtttttaagaatggttttcaaccactgccataccaatactgttatgacggtgttatctgtatttaacccaaatcacagatttttgtcaaaaaagttgttctgtaaaaattttaagagtttactattaaaaaaaaaatgtagagtygttaaacatcagagtacagaataaaaactggttcgccttattcaaaacgcatgattcccatgatgacagatgacccgttttcatggtcttcatttcaagtaaactccacatattaggagcagttgtcacgttccaggtaagtgggctgaaatatatcttaattaatttaatgcttctgaccgataattgttgactccaaatatgatcaataagtgagcactttataaggagttaaaacaatatactttccgatgcctccattttaaaattaaagaacaatatagaaaacccaaatctcta

SEQ ID NO: 88575 - DNA, 601 bp, Human
gttataggttatctaagaactcatacctttgctttgacttccaccagcattcacgaattaagaaaacctcaggggagaggggaggtgttgtatgaaatacagcattctcatttgtcaccaaaattactgacttttgaagtcagtaattatttttattgtgtttatttgttttcaagaaaataagtgggagaatcttacaatgacttctgagtcctctgtcttaaggatacctcttaaagggtcaattaagatatgtatttcatagtagttgcttaaaagatgactaacaagtttttttttwaaaaaaaaaaaatatgttaaccattttctgtggccaactgcctgaaaagcttcagattgctttatatttccaaccaacactgactggcatttactcttagtaagcagaagttgtcacaaacgacagaaagtgattagcaatcacttgctacacggcatgagatagtcttaaaactcccatttaccccctactgaaccaatatcttagcttattctagaggacatgaacaagtatttctctagcaactaacataagtgaaaatacaagccctagctccgtagaatgccacaaatttggtca

SEQ ID NO: 88576 - DNA, 601 bp, Human
aaacaccacctcaacactgtgactctcttgctatagtgatatcaagataccccaaatcacagatttgtggcaccagaaagcagttttagaaacttactttatatcttacagataagaaaatgagacccagatattaatatcaaagtgtgagtcagtggcaaggctgaaactaggaattttcagacctagagtacttcaggctactgttcacatggttcttagatgagtgacatggtttggctgtctccccacccaaatctcatctttaatcgtagctcccataatccccatgtgtcatggratggacccagtgggaggtaactgaatcatgggggcaggtttttcccgtgcccttctcatgatagtgaataagtctcacaagatctgatggttttataaagggcagaccccctgcacatgctctctttcctgccaccatgtaagacatgactttgctccttcttcaccttctgtcatgattgtgaggccttcccagctgtgtggaactgtgagtccattaaacctctttttcttgataaattacgcagtctcaggtatttcttcatagcagtatgaaaatggactaatacaatgagtatgt

SEQ ID NO: 88577 - DNA, 601 bp, Human
actgtaacactgaaatcagaaatcacaattaccaaggctcttttaacaccctcatgcacatgtatgaccatcatctaaaaatccaagattcaaagctaagtctttgaatttaaaaatggttgtgtggtcttacagaacaacttctaagttgcatttgcatttcttatggttcaaacaaacaaacaacaaacacgaatttttgttttaagcagttaaaggttaagcaaatacaaaagagcatttttgcacttctaggcacagtagctggaattttgaaaatcttcaccgttcctgttaaaayaagattgagaaacaggaaagaaactgcttcaagttgaaagtcaggatggcttaatggaaaacaatgggctttgtcaggataagagctgggcctgaattctgattcaagccacatgcgggagggataagcagccacttcaaagggttctttgagtgttaaacatggtacctacaatgccaagcaccatctctggcacagagagtgtaaggattgcagaattattgtcaacaagaagaaaagcctatactgcaaggaggaggaagctgtcagggagtcatattgcactgacaatttatgagt

SEQ ID NO: 88578 - DNA, 601 bp, Human
cccagagatagctactagtaacattttggtatctttccatttcatctttctgctatgcattttaaaaatataattggaatcattctgcatgcaaaatgttatattctgggttctctttctttctgtttttgttttgttttgtttcgttttgttttttctctctctctccgtttagaccattataacgtcagcattttccatgttactgcagactctttataaacgttttcactggctgtgggatatttcacaggttagttttgtcacaattttcttaaccatttccctttgctataccccscaaaggcttttaagctgtcaggcccagacaagatttctagacacacagccctaaggatggggcctgcctgtggtcataaaccaagccattttgggaactaggtacatcacttttcacgataggtaagaatcaccatgagtcctactcttcaaatgccaacagaccctgagtccagtgatgtgtgaaccccaaatgccagtagttctggtcaacaattacagcaactcctctaggataaataaaataatgttctcgacaggcccggccacccacggtgagcacagggaagagcacaaacac

SEQ ID NO: 88579 - DNA, 601 bp, Human
caaacagcatggatttaaatcccaaatacacaaacggacaacctctggaatatgggcaagttactcaacctcatacttcagtattctcacatctgtgttaggggtaaaaatacttcataaggatgttatgaagaagaagtaatgagaatgcactgagcacggtataaatgacccataattactggaattgttttgttgtttttctgcctctgcaaaatttctcaggattgccctaatttcactaggttgaaaaaacctgaacacactccttgatgaagtgttccaaatacaggtctctcayaaacagataataaagcatcctacaccctaactgggaaaaaaatcatgtcattttacacttcataagtcaattccatctcttaaaattattattcatccggtactattaaaactgtcatcttctatagcacctcagtactcctatcagataggtaggtgttcttgaacacaatgtcctgcgttaatctggtcaaacaggagccatctgcgaagccagaatggcaagggacaagcaaatttccccgatccacaaacgggagtttccccaaaatataagaagttttatttttactgtgaaaat

SEQ ID NO: 88580 - DNA, 601 bp, Human
ccagtaataaaaataatcactaacatcaatgaacactattcccacgcttaggcaccatgccaagcactttatgaacattacctcatccattccttgagagaaccctataaggtaggtattattaatcccattttacagatgagaaatactggacttacaaggttacataatttccccatagtcagagatgctataaatcatgaggcctctgttataagaggaatagaattcctcagcttacctatagtccctccctgtccaatgcttttgtctacacaaactcaatgctaagttgaaaaaytgtaagttttctcctgatttcaaataaattccttttaaaatatctaataaatttatgaattctagtttggtccattttgatactgtcaaaaagaaaacacactacaaactgaaaagtgctgtcttttgtcaggtgtttttactgatccaagtattatttgcttctatctcttatttcgtttaaaagaaaaacagatggtttaatataaattcctgcatgaagttttctagactccccagcaaactttatgagcatagtaagttctagagacaaacagcatggatttaaatcccaaataca

SEQ ID NO: 88581 - DNA, 601 bp, Human
gaagagggagagagtcatgaaaggatcaacaaaggtgagtcatagtgccaaatttacaaagaggttaattcccagggggacactgcgtttgtcaggtgacctgaatttttctaaatttgttaaagcttgtgcctctctacttcacagttgtatgaagattactaaagccaaataggaatgcattatccaggtaccaatttacataaaaatctagacaccaaatcatcatgactacagttgtgactactcaccagttcaaatacccttcaggaataagtggttattttattctaaactttayaagcaacaaaaaaatatgagttcaaagtacaaaccacattttatacagatcgaactttatacaacatactttaacagttagctcccattcagtgtgtacgcatatgcatccctatacacacatgaaaataacacacaaagccaattacatccttgctcttatcctggacgtaactgctttctttctgtacctggttatatgtcatttctacattttattagtcttgttatggttcacatcaaaatttcccctgctctatttccaatcaattgctttcttggatactttggacaggagaat

SEQ ID NO: 88582 - DNA, 601 bp, Human
tatgttgcccaggctggtctccaattcttggcctcaagtgattctcccaccttggtctcccaaagcactgggattacaggtgttagccaccatgcccagcttaagtaactattgcttgtaaagggcccagtgcatatcgaatgctcagtaagtgttagccatcattattgagattcttctatgagaaatattgatgaaagaaattagttctatttaaaaatgggtagatcttcacaaaagaaggtgcattttacctgggacttgaaaggttaggtcaccaagcaaagaactggagtaatgycattagacataaaagaaacaatttaaattgaagagggagagagtcatgaaaggatcaacaaaggtgagtcatagtgccaaatttacaaagaggttaattcccagggggacactgcgtttgtcaggtgacctgaatttttctaaatttgttaaagcttgtgcctctctacttcacagttgtatgaagattactaaagccaaataggaatgcattatccaggtaccaatttacataaaaatctagacaccaaatcatcatgactacagttgtgactactcaccagttcaaatacccttcagg

SEQ ID NO: 88583 - DNA, 601 bp, Human
cagccttgaactcctgggttccagggattctcccacctcagtctcccaagtagctgggactacaggcatgtgccaccacacccagcttgtttttattttctgattttttgtacagacagggacttgctatgttgcccaggctggtctccaattcttggcctcaagtgattctcccaccttggtctcccaaagcactgggattacaggtgttagccaccatgcccagcttaagtaactattgcttgtaaagggcccagtgcatatcgaatgctcagtaagtgttagccatcattattgagaytcttctatgagaaatattgatgaaagaaattagttctatttaaaaatgggtagatcttcacaaaagaaggtgcattttacctgggacttgaaaggttaggtcaccaagcaaagaactggagtaatgtcattagacataaaagaaacaatttaaattgaagagggagagagtcatgaaaggatcaacaaaggtgagtcatagtgccaaatttacaaagaggttaattcccagggggacactgcgtttgtcaggtgacctgaatttttctaaatttgttaaagcttgtgcctctctacttca

SEQ ID NO: 88584 - DNA, 601 bp, Human
tcaattttaaaaaaattattcttttgcagaggttacgaagatgccatttttactatcttgaacctcacactttcatttgggagggcatacataccaaactgtaatcaatgtgaccacaaattatatatacctatgtacatactggggagggagaatggagaaagaataaagtgattaagaggtcacttcagcaaacagtgaggtcacttacagaatccacaagacctggctttggaccatggctttcccactacctgggtatgacactctggacaagtttactaaacctctcaaagcttcrtttacctcatctataaactagggataataatagtacttgcctcataagattgactatcaacacaaaaattaagtaactatctttttttttttcttaactgacggggtctctctctctcccagcctggagtgtaaaggtgcgatcatagctcactgcagccttgaactcctgggttccagggattctcccacctcagtctcccaagtagctgggactacaggcatgtgccaccacacccagcttgtttttattttctgattttttgtacagacagggacttgctatgttgcccaggctggt

SEQ ID NO: 88585 - DNA, 601 bp, Human
cctaagtaaattttctgacaggtgtttgcatatctgtatttgagtcaattttaaaaaaattattcttttgcagaggttacgaagatgccatttttactatcttgaacctcacactttcatttgggagggcatacataccaaactgtaatcaatgtgaccacaaattatatatacctatgtacatactggggagggagaatggagaaagaataaagtgattaagaggtcacttcagcaaacagtgaggtcacttacagaatccacaagacctggctttggaccatggctttcccactacctrggtatgacactctggacaagtttactaaacctctcaaagcttcatttacctcatctataaactagggataataatagtacttgcctcataagattgactatcaacacaaaaattaagtaactatctttttttttttcttaactgacggggtctctctctctcccagcctggagtgtaaaggtgcgatcatagctcactgcagccttgaactcctgggttccagggattctcccacctcagtctcccaagtagctgggactacaggcatgtgccaccacacccagcttgtttttattttct

SEQ ID NO: 88586 - DNA, 601 bp, Human
tctaaaccatgagcctatgttctttgtattgtataactttgtaacttatagataatgaaaagcaatgcaaataatttttgtctacagatgcaaataaattatgtccagtggaggttcaatcgacttcccctccacttttgatccatttgcaaattaatttcagcatttttttattccatataaattcatggttctacaaatctgttacaacaactttcttggttccctcattcattaacaacctaagtaaattttctgacaggtgtttgcatatctgtatttgagtcaattttaaaaaaawtattcttttgcagaggttacgaagatgccatttttactatcttgaacctcacactttcatttgggagggcatacataccaaactgtaatcaatgtgaccacaaattatatatacctatgtacatactggggagggagaatggagaaagaataaagtgattaagaggtcacttcagcaaacagtgaggtcacttacagaatccacaagacctggctttggaccatggctttcccactacctgggtatgacactctggacaagtttactaaacctctcaaagcttcatttacctcatctata

SEQ ID NO: 88587 - DNA, 601 bp, Human
gcttggaagttagaatctggattctggcctatctaaaccatgagcctatgttctttgtattgtataactttgtaacttatagataatgaaaagcaatgcaaataatttttgtctacagatgcaaataaattatgtccagtggaggttcaatcgacttcccctccacttttgatccatttgcaaattaatttcagcatttttttattccatataaattcatggttctacaaatctgttacaacaactttcttggttccctcattcattaacaacctaagtaaattttctgacaggtgtttgcatatctgtatttgagtcaattttaaaaaaattattcttttgcagaggttacgaagatgccatttttactatcttgaacctcacactttcatttgggagggcatacataccaaactgtaatcaatgtgaccacaaattatatatacctatgtacatactggggagggagaatggagaaagaataaagtgattaagaggtcacttcagcaaacagtgaggtcacttacagaatccacaagacctggctttggaccatggctttcccactacctgggtatgacactctggacaagtttactaa

SEQ ID NO: 88588 - DNA, 601 bp, Human
atcatttatgtgagtttgaagacaaatgcttatttgtaagacaacatgatgtcaacagttaaccacctttcaaaattaattcaatacaataattattagacttaatatttgtttctctggaggtggttttgtaacaataaagaactattttaccctacctctttatcccttgcagaaatggctggttcactttttagccacaaaactcacatagttcccactcaaccaaagaactcatgaaagactactttcttccctctctggaaatgcatacttactaccttggcagagtatatcatastttcctcatgattttcacagggtttgtatatccaagttgtagacatgatgggttgacttgcccaagattgcccagctagtacatggctgagaagagaatcaaatctaggtctaactgcaattccagtgttaagcaacttcaaacactaacaaagagaactaccatctactgtgttgtgctacaacaggagtggcatgtccagaactctttcaacagggaaaagtttgttcactcctgatttagtcactcaacaaacatttactaagcaataactaaatgttagagctctgatagaagctt

SEQ ID NO: 88589 - DNA, 601 bp, Human
tccccaaagcttaatgtcccacaagtagttgttaatgggcttcattgtttagttaattgtgcttattggaagtgcaggtgacttcatatttgcatggctaatgggccttctttaaagtgtgtggccattttagttggcttttaatggtctgtattgttttttcccaactttgagttgaattgataaacttactttctaagaaccatcaatgcctaagacaaaaagaccattttttactacataggggacatcatttatgtgagtttgaagacaaatgcttatttgtaagacaacatgatgycaacagttaaccacctttcaaaattaattcaatacaataattattagacttaatatttgtttctctggaggtggttttgtaacaataaagaactattttaccctacctctttatcccttgcagaaatggctggttcactttttagccacaaaactcacatagttcccactcaaccaaagaactcatgaaagactactttcttccctctctggaaatgcatacttactaccttggcagagtatatcatagtttcctcatgattttcacagggtttgtatatccaagttgtagacatgatgg

SEQ ID NO: 88590 - DNA, 601 bp, Human
ctcttgcctcagcctcctgagtagctgggactgcaggtgtctgccaccacgccatgttggccaggctggtctcgaactcctgacctctggtgatctgcctgccttggcctcccaaagtgctgggattacagacatgagtcaccgtgcccggccacaactgattcttaaaaagtaagtttatcaattcaacccaaagttcggaaaaaacaatagagacatgcctaaaactattattttaaaatcatagttttaaatcaatcattacaacatcatgaacaaaatgtggattatttccaaacaytgcccggcctcaaacatgtcttcacttagctcactccagtagaaagaacattaagagccatcaaacacacgagcttgtttttttaatgttgtaggggagagagttgggagtggggtttacaaagagcattaactgaccctaactgactctacaagatttcttttttattaaaattcagcccaaattgagaacaaattctgtcttttcttcctttccaactcatcaaagcccagttccccaaagcttaatgtcccacaagtagttgttaatgggcttcattgtttagttaattgtgcttat

SEQ ID NO: 88591 - DNA, 601 bp, Human
ttctaaaatgggacacatagttttaggcatgactgatatatatatatatattttttttagacagagtctcgctcttgtcgcccaggtagagtgcagtggcacggtctcggctcactgcaaccacctcccaggttcaagctattctcttgcctcagcctcctgagtagctgggactgcaggtgtctgccaccacgccatgttggccaggctggtctcgaactcctgacctctggtgatctgcctgccttggcctcccaaagtgctgggattacagacatgagtcaccgtgcccggccacaaytgattcttaaaaagtaagtttatcaattcaacccaaagttcggaaaaaacaatagagacatgcctaaaactattattttaaaatcatagttttaaatcaatcattacaacatcatgaacaaaatgtggattatttccaaacactgcccggcctcaaacatgtcttcacttagctcactccagtagaaagaacattaagagccatcaaacacacgagcttgtttttttaatgttgtaggggagagagttgggagtggggtttacaaagagcattaactgaccctaactgactctacaagat

SEQ ID NO: 88592 - DNA, 601 bp, Human
agggcaaaggtacagggataggcggtggctctgctccagtatgactgctcaatgtctgctttactccagcttctacaatctcctcttacacaaaacagcacacagagatctaagagcagattctgttctaaaatgggacacatagttttaggcatgactgatatatatatatatattttttttagacagagtctcgctcttgtcgcccaggtagagtgcagtggcacggtctcggctcactgcaaccacctcccaggttcaagctattctcttgcctcagcctcctgagtagctgggactrcaggtgtctgccaccacgccatgttggccaggctggtctcgaactcctgacctctggtgatctgcctgccttggcctcccaaagtgctgggattacagacatgagtcaccgtgcccggccacaactgattcttaaaaagtaagtttatcaattcaacccaaagttcggaaaaaacaatagagacatgcctaaaactattattttaaaatcatagttttaaatcaatcattacaacatcatgaacaaaatgtggattatttccaaacactgcccggcctcaaacatgtcttcacttagctc

SEQ ID NO: 88593 - DNA, 601 bp, Human
ttttcattgagaagccaggcactgtacagggcactttacatggatcactttcatttgacccttacagcgataggctctttttcccatttggcacacaaagacactgagactcagattaagcaatagggcaaaggtacagggataggcggtggctctgctccagtatgactgctcaatgtctgctttactccagcttctacaatctcctcttacacaaaacagcacacagagatctaagagcagattctgttctaaaatgggacacatagttttaggcatgactgatatatatatatatatwttttttagacagagtctcgctcttgtcgcccaggtagagtgcagtggcacggtctcggctcactgcaaccacctcccaggttcaagctattctcttgcctcagcctcctgagtagctgggactgcaggtgtctgccaccacgccatgttggccaggctggtctcgaactcctgacctctggtgatctgcctgccttggcctcccaaagtgctgggattacagacatgagtcaccgtgcccggccacaactgattcttaaaaagtaagtttatcaattcaacccaaagttcggaaaaaaca

SEQ ID NO: 88594 - DNA, 601 bp, Human
agttttcattgagaagccaggcactgtacagggcactttacatggatcactttcatttgacccttacagcgataggctctttttcccatttggcacacaaagacactgagactcagattaagcaatagggcaaaggtacagggataggcggtggctctgctccagtatgactgctcaatgtctgctttactccagcttctacaatctcctcttacacaaaacagcacacagagatctaagagcagattctgttctaaaatgggacacatagttttaggcatgactgatatatatatatatwttttttttagacagagtctcgctcttgtcgcccaggtagagtgcagtggcacggtctcggctcactgcaaccacctcccaggttcaagctattctcttgcctcagcctcctgagtagctgggactgcaggtgtctgccaccacgccatgttggccaggctggtctcgaactcctgacctctggtgatctgcctgccttggcctcccaaagtgctgggattacagacatgagtcaccgtgcccggccacaactgattcttaaaaagtaagtttatcaattcaacccaaagttcggaaaaaa

SEQ ID NO: 88595 - DNA, 601 bp, Human
aatggcagcagttttcattgagaagccaggcactgtacagggcactttacatggatcactttcatttgacccttacagcgataggctctttttcccatttggcacacaaagacactgagactcagattaagcaatagggcaaaggtacagggataggcggtggctctgctccagtatgactgctcaatgtctgctttactccagcttctacaatctcctcttacacaaaacagcacacagagatctaagagcagattctgttctaaaatgggacacatagttttaggcatgactgatatayatatatatattttttttagacagagtctcgctcttgtcgcccaggtagagtgcagtggcacggtctcggctcactgcaaccacctcccaggttcaagctattctcttgcctcagcctcctgagtagctgggactgcaggtgtctgccaccacgccatgttggccaggctggtctcgaactcctgacctctggtgatctgcctgccttggcctcccaaagtgctgggattacagacatgagtcaccgtgcccggccacaactgattcttaaaaagtaagtttatcaattcaacccaaagtt

SEQ ID NO: 88596 - DNA, 601 bp, Human
tagaaagagccctggctgtggaatccagtggcttttgtgttcttactacatatatcatcaatcagctgtgtgaccctgggcaagtcacttcccatcttctagcctctgtccctctagtgtgaaaagagaggcaagaccaaatgactccaaagttccatgattagccacacagtttacacaccactatttaccgatgaaagagcagaaacaattcaggttctgaagtcactccaaacctgtttttctctttgcaattttattttatgctttcccagacaatgcaaagataaatgccatccasatccatccacatataatcagaattagcaagactttaaataaagagaagtgaaattgcaatttacgactgtagactgagcttctagatatatctattccaacagagaacaaagaagccagaattccagttataacaaaaaaacaaaaatgacagaatatgtgattgaactaaggcgttccagaaatggcgttgttctttttttttttttttttttttttaaactaggagctggtaaaattcttagtttagccattatgccccagaacagtaatggtgctgaaacacagtaagcagaacaga

SEQ ID NO: 88597 - DNA, 601 bp, Human
cttctcctaaactaaataagtctcctaagtttaccaaaaaaataaaaataagtctcctaaatgaaaaaaatgcatattacagggagtgaacaatacagaagtttgttttttaaaatgctgataaagatataaaggttcctcattctcaaggatctcacgtcacatgcacatatggattttgcttccacatacaggtctcttcagagggactagttcagttgactgatgagtctcattagaaagagccctggctgtggaatccagtggcttttgtgttcttactacatatatcatcaatcarctgtgtgaccctgggcaagtcacttcccatcttctagcctctgtccctctagtgtgaaaagagaggcaagaccaaatgactccaaagttccatgattagccacacagtttacacaccactatttaccgatgaaagagcagaaacaattcaggttctgaagtcactccaaacctgtttttctctttgcaattttattttatgctttcccagacaatgcaaagataaatgccatccagatccatccacatataatcagaattagcaagactttaaataaagagaagtgaaattgcaatttac

SEQ ID NO: 88598 - DNA, 601 bp, Human
ctagagagacagtccaaaattattggaattagttgtcaaaaatatccaagttttagtgctctctatccagtcacggataatttacatgagaagtgaagtaatgacttctcctaaactaaataagtctcctaagtttaccaaaaaaataaaaataagtctcctaaatgaaaaaaatgcatattacagggagtgaacaatacagaagtttgttttttaaaatgctgataaagatataaaggttcctcattctcaaggatctcacgtcacatgcacatatggattttgcttccacatacaggtstcttcagagggactagttcagttgactgatgagtctcattagaaagagccctggctgtggaatccagtggcttttgtgttcttactacatatatcatcaatcagctgtgtgaccctgggcaagtcacttcccatcttctagcctctgtccctctagtgtgaaaagagaggcaagaccaaatgactccaaagttccatgattagccacacagtttacacaccactatttaccgatgaaagagcagaaacaattcaggttctgaagtcactccaaacctgtttttctctttgcaattttatt

SEQ ID NO: 88599 - DNA, 601 bp, Human
cagtcacctaactctggcaaccattaatatctagagagacagtccaaaattattggaattagttgtcaaaaatatccaagttttagtgctctctatccagtcacggataatttacatgagaagtgaagtaatgacttctcctaaactaaataagtctcctaagtttaccaaaaaaataaaaataagtctcctaaatgaaaaaaatgcatattacagggagtgaacaatacagaagtttgttttttaaaatgctgataaagatataaaggttcctcattctcaaggatctcacgtcacatgyacatatggattttgcttccacatacaggtctcttcagagggactagttcagttgactgatgagtctcattagaaagagccctggctgtggaatccagtggcttttgtgttcttactacatatatcatcaatcagctgtgtgaccctgggcaagtcacttcccatcttctagcctctgtccctctagtgtgaaaagagaggcaagaccaaatgactccaaagttccatgattagccacacagtttacacaccactatttaccgatgaaagagcagaaacaattcaggttctgaagtcactc

SEQ ID NO: 88600 - DNA, 601 bp, Human
taaaatatacctgcacttggagaataaaaataattttaaaaatgacaaaatactggcaaatcagtcacctaactctggcaaccattaatatctagagagacagtccaaaattattggaattagttgtcaaaaatatccaagttttagtgctctctatccagtcacggataatttacatgagaagtgaagtaatgacttctcctaaactaaataagtctcctaagtttaccaaaaaaataaaaataagtctcctaaatgaaaaaaatgcatattacagggagtgaacaatacagaagtttgwtttttaaaatgctgataaagatataaaggttcctcattctcaaggatctcacgtcacatgcacatatggattttgcttccacatacaggtctcttcagagggactagttcagttgactgatgagtctcattagaaagagccctggctgtggaatccagtggcttttgtgttcttactacatatatcatcaatcagctgtgtgaccctgggcaagtcacttcccatcttctagcctctgtccctctagtgtgaaaagagaggcaagaccaaatgactccaaagttccatgattagccacac

SEQ ID NO: 88601 - DNA, 601 bp, Human
acatagtccatgctctggaaaacactgatctggtttaaattgactcattttaccatgaagaatctgagccataagtagaactcagattttctaactttcaattcacttatctttccacccacttaattttgcaagctaaaatatacctgcacttggagaataaaaataattttaaaaatgacaaaatactggcaaatcagtcacctaactctggcaaccattaatatctagagagacagtccaaaattattggaattagttgtcaaaaatatccaagttttagtgctctctatccagtcayggataatttacatgagaagtgaagtaatgacttctcctaaactaaataagtctcctaagtttaccaaaaaaataaaaataagtctcctaaatgaaaaaaatgcatattacagggagtgaacaatacagaagtttgttttttaaaatgctgataaagatataaaggttcctcattctcaaggatctcacgtcacatgcacatatggattttgcttccacatacaggtctcttcagagggactagttcagttgactgatgagtctcattagaaagagccctggctgtggaatccagtggctt

SEQ ID NO: 88602 - DNA, 601 bp, Human
actcacttgtactagtccttaatttttgttagatgcttaatagtttttacagaaatattttttagttttgccctgaaaaacaacatctttgaagtcatcagtcagatatgatggttttacttttttaatgtgtagtaacacattaaaataaacacgagccaggttcggtggctcatgtctgtaatcccagcactttgggaggctaaggtgggtggattgcttgagctcaggagttcgaaatcagcctgggcaacatggcgagaccccatctcaaccaaaaatacaaaaaaaaaaaaaaaaagccaggcatggtggtacatgcttatagttccagctactcagaaggctgaggtaagaggatcacttgagcccaggaggtcaaggctgcagcgagctgagattgtgccactgcactccagcctgggtaacagagcaagaccatcttaaaaaaataaaaataaaaataaaataaaataaacatgtaagtgttcaatttttgtttaaggtatgtctcctctaaagtgtcttgcttattaatactaatgatacatagtccatgctctggaaaacactgatctggtttaaattgactcattttacc

SEQ ID NO: 88603 - DNA, 601 bp, Human
atcttcatggcctttgccttactcacttgtactagtccttaatttttgttagatgcttaatagtttttacagaaatattttttagttttgccctgaaaaacaacatctttgaagtcatcagtcagatatgatggttttacttttttaatgtgtagtaacacattaaaataaacacgagccaggttcggtggctcatgtctgtaatcccagcactttgggaggctaaggtgggtggattgcttgagctcaggagttcgaaatcagcctgggcaacatggcgagaccccatctcaaccaaaartacaaaaaaaaaaaaaaaaagccaggcatggtggtacatgcttatagttccagctactcagaaggctgaggtaagaggatcacttgagcccaggaggtcaaggctgcagcgagctgagattgtgccactgcactccagcctgggtaacagagcaagaccatcttaaaaaaataaaaataaaaataaaataaaataaacatgtaagtgttcaatttttgtttaaggtatgtctcctctaaagtgtcttgcttattaatactaatgatacatagtccatgctctggaaaacactgatctggt

SEQ ID NO: 88604 - DNA, 601 bp, Human
attctgattcctcttccggccatatttattattgtttttccaataacaaatgaatacagtattgcaaacctcattggtagatcttcagaaaagctgtcatgtggtttgttgtgacatggatttcttctttagaccatgtgtgcagtataacctttgtgtatacaatcaacctataattcagtgagagaatagaactgtatccttacaaagcattttaaagggatttcagtgcttttagcaacccccattccactttaaaatcctcaggctgtgcttatggattccactgaggttttcttayttttgtttttgctttttttagacagtgtctaaactcaagtacagtggcataatctcacctcactgcaacctctgcctcctgggttcaagcaattctcctgcctcagcctctcaagtaactacgactacaggcatgcgccaccacgcctggctaattttggtatttttatagagacaaggtttcaccatgttggccagggtggtctcaaactcctgacctcaagtgatccacctgccttggcctcccaaagtgttaggagtacaggagtgagccacggtgcctggcccactgactttatct

SEQ ID NO: 88605 - DNA, 601 bp, Human
caaatgcttacatatctcactgcatattcaaacaaataaaccattcttgtttattcagtcttgacatattagggtttttttactcacaaaaaatatgataatattatggcttccattctgattcctcttccggccatatttattattgtttttccaataacaaatgaatacagtattgcaaacctcattggtagatcttcagaaaagctgtcatgtggtttgttgtgacatggatttcttctttagaccatgtgtgcagtataacctttgtgtatacaatcaacctataattcagtgagaraatagaactgtatccttacaaagcattttaaagggatttcagtgcttttagcaacccccattccactttaaaatcctcaggctgtgcttatggattccactgaggttttcttacttttgtttttgctttttttagacagtgtctaaactcaagtacagtggcataatctcacctcactgcaacctctgcctcctgggttcaagcaattctcctgcctcagcctctcaagtaactacgactacaggcatgcgccaccacgcctggctaattttggtatttttatagagacaaggtttcacc

SEQ ID NO: 88606 - DNA, 601 bp, Human
taccacttactgtttatgctgctgagttctcaaatgacctaacatttcccctaaggcatcgtgtcaaatatcctagcaagtgagtatcttaccaaggcaatctaaaccccagagccagattcaaatattagagtgatatttgcacatatgtttgagtacacctgggggacaacaaggtgacatgggaagatgagaaaaaaacatagcagcataaaatcccaaagcaggactaaaccttatggggcatctcgttcaatgttttacatgacatctgaatctcctctatcccttccctctagaygacataatgttttgtgtttgtttggtttgttggttgttttttcttttgttgtttgtttgtttgagacaggatctcgctctatcacccaggctggagtgcagtggtacaatcatagcctactatagcctcgacctcccaggctcaagcaatcctcccaccgcagcttccagagtagctgggattatgggcacaggcaaccacacccagcttatttttcttgttattagcagtagtacaggtgaggtcttgttatgtttcctgggctagtcttgaactcctgggctcaagtaatcttcccac

SEQ ID NO: 88607 - DNA, 601 bp, Human
aagacatttccacccacaggcatagagttgaaaataagacctctagcagagtgggcaaattccagtggagataattaaaactgagaccaccctcaggaaactactcctcccaaattgggcatttgataaacacctggaaaagtcaagacagccaaacattttcactataaaagtacatctaagggagactccaactgctactggaagatcctatctgttcatattgtgtgaaggccctcacactatattttcatccttagtttacaactttaccacttactgtttatgctgctgagttctyaaatgacctaacatttcccctaaggcatcgtgtcaaatatcctagcaagtgagtatcttaccaaggcaatctaaaccccagagccagattcaaatattagagtgatatttgcacatatgtttgagtacacctgggggacaacaaggtgacatgggaagatgagaaaaaaacatagcagcataaaatcccaaagcaggactaaaccttatggggcatctcgttcaatgttttacatgacatctgaatctcctctatcccttccctctagacgacataatgttttgtgtttgtttggtttgt

SEQ ID NO: 88608 - DNA, 601 bp, Human
aaataaggaacaatatttcatatcccagccccaacccttgatagttaacatgcagcagagaacacactgaaagctccacacaagactccctaaacatattgcctctacaggctttgtttaatttgttttctcttttcctttatttatttattttcttaaagaaacaatctgttttaacaatgacaatttcagtgagggaaatagaagagatcagtgtgcaacctggatagtcccacatttcttcaatgactaacctttttatttcctcttatctgtgtcggagaaggaaagtaagaggagyaagaaggaagggaggaaaggaggagagtagggaggaaggaattgtgaactggttatcacagtgggtctaattggaagcccaaaaagaaagtttaacttccgcaaaaaattaatggattttttctgttagaaaggttagaaattaatatgctgttaccacgtagaaaattcactaatccactgtgatctcattagtaacctggaaaccctcctcattatagccgatgttgcttttttagatgtaaaaatgtttgatgtcttcctttccatcactgagacttggttacactcagtctcggtg

SEQ ID NO: 88609 - DNA, 601 bp, Human
aatatgcaatgcagagattagagtgtgaaacattaaataaggaacaatatttcatatcccagccccaacccttgatagttaacatgcagcagagaacacactgaaagctccacacaagactccctaaacatattgcctctacaggctttgtttaatttgttttctcttttcctttatttatttattttcttaaagaaacaatctgttttaacaatgacaatttcagtgagggaaatagaagagatcagtgtgcaacctggatagtcccacatttcttcaatgactaacctttttatttccwcttatctgtgtcggagaaggaaagtaagaggagcaagaaggaagggaggaaaggaggagagtagggaggaaggaattgtgaactggttatcacagtgggtctaattggaagcccaaaaagaaagtttaacttccgcaaaaaattaatggattttttctgttagaaaggttagaaattaatatgctgttaccacgtagaaaattcactaatccactgtgatctcattagtaacctggaaaccctcctcattatagccgatgttgcttttttagatgtaaaaatgtttgatgtcttcctttc

SEQ ID NO: 88610 - DNA, 601 bp, Human
tgttacgctcccagagtgacgtctgctctttactatataattctttcgtctttagggattctaaaatctcagaacatttgcacttctttccctccgctaagaggaaccaggatccaatattttgcagtaactgacctgtgggtgcctccacaatatccagaaaattgctattatcctttttacaggacacagggcaacttcacatcccaagtttttactttacagtaatatatctcatgttttcaggggtctagaacaccctccagctcacttaggaaatccgctcccaagcagcactgtrctataggaattttgtttcatataaggacttttataaccccttcatttcttagaaatgttctcttactagtaggtcatttgtatatctttgcttataatatctggggaaaaaaagattgcagagccaatgaattaaaaatatgattctaggtctcctgtgtgccaatgaatgccctcattaaagcagaatgagtgagatgagatgggtttcaaagctttccatccctttgccccagagccaccaaggccaggcactgaaaggatgcacagtaaaattaaatatctaaaaattcatctttaa

SEQ ID NO: 88611 - DNA, 601 bp, Human
aagccctaaaaccctagattgatctgacctctgactccactctgccaggccacctggcagctgctgctagaagcaccctttcagaaagggtcctcattgagccaagtggtagagtgttatcacacaccatctcttaccctctgagcaccatgaggttgcctgggtaacagtgagctattcttggccttctctatgggatcccaacttctctaaccatatcccagggctcccttcgatctcacattctgcaacccatgctgaaacctcttcctcctgtctcaccagatcataggggaaatargaagagaaggcactgaccatgcagctgtgccttggcattttatttccttatcattgtatttccttagttatgacacatttccatttatggagtactttcccttataaaatctcccagtgtttacttctgatctactaaataattcctctggcctcttctttttaccctttaaatatattttgatggttcatttggcacattccccattcagttattaatggcccacaaaaacttactagcagcaatcatttactgattaatctacacaacaatccagaaagacaagtagtattaatcctt

SEQ ID NO: 88612 - DNA, 601 bp, Human
gttgttttcaataatcagggtagtctacactagagtagaaagccagaaatcagagattcagtggactccaaatgcctaccaaatctgtgagacccatgccccactgacagtcggatgccctattatggaaaaagccctaaaaccctagattgatctgacctctgactccactctgccaggccacctggcagctgctgctagaagcaccctttcagaaagggtcctcattgagccaagtggtagagtgttatcacacaccatctcttaccctctgagcaccatgaggttgcctgggtaacartgagctattcttggccttctctatgggatcccaacttctctaaccatatcccagggctcccttcgatctcacattctgcaacccatgctgaaacctcttcctcctgtctcaccagatcataggggaaataagaagagaaggcactgaccatgcagctgtgccttggcattttatttccttatcattgtatttccttagttatgacacatttccatttatggagtactttcccttataaaatctcccagtgtttacttctgatctactaaataattcctctggcctcttctttttaccctt

SEQ ID NO: 88613 - DNA, 601 bp, Human
agcaaatcaaggcttgagagtttacacaacttaacaaaggtagtgaattcaaaactggctgggtcttcccagttgctcataatcattacatgttatactccccttccatcctgtagtgatatctggtttgagttcaatcttcttatgacctaagatgaagctgtgctcgattatctgataaattacgcatgttaatgactttgcctgttactcctactaggtgacatatgtacagattaaccagggatcatcatctctgaaccaacaaagaactcatgatgggattccctggccttgcagytgctaagtcaagggtgagatttaagatgggcagagcttaaacacatctttcaaatacgtgcaatattagcacatagccaaacagctactcaacttccacatgaagctgccagaagctacagcactttctagtacaagcttcaaatgtgcatgcttccagatgccacaagccctgtcataatatcacagaatgacaaaggaaaagggctcacactttggagtcagacagccccatgtctactagctgagtgtacttgggtggatactcagccactatgagcttcttacatactaaatgacc

SEQ ID NO: 88614 - DNA, 601 bp, Human
ctgcatctgtagaattctttacgggtatttgctttgttgtaactcaccaaagttgtctacaccaaatggggagaatacttccctacctcataatgctcttccatcggccagcttacgtagagaggctgtgccacaaaacagctttctcaggaaataaaccaccttaggccctgaacatatgtacgtgtaagtacttgtgttaaaaggaggcagttattcgaagaaccatggttttacccaggatgtagttcctccaacagatttcaagccccactctgggaagagaggtaaggaaatacayttggaaattggagtctgatggacgtaagtccaaatcctgaggtcactgctgaactgttaagttcaccaaggctcagtttcctcacacgttaaaaggaagctaataatacctacttcacaagttattgtgggggttgtatgaaatgacacatgtaatgcaggggtacagcatctggaccttacctcccatagacaatacatgttaatacatgttagttcacccaccccatcctgccccatccaaattctatcccaacttggctattaattatctgcgaaaccgtggacaattcattaaatc

SEQ ID NO: 88615 - DNA, 601 bp, Human
aatgcggtggtagctgcagtttttagaatatcctgatcatttcaagtgttcataagtgggaaatgcttgcccaaaaagacgatatttccaggctaccatcagtagctactcatttccaggactggtcaatgaaatgctaatgtcataacataatttagactgttctttggagcttacatgactggctgcatctgtagaattctttacgggtatttgctttgttgtaactcaccaaagttgtctacaccaaatggggagaatacttccctacctcataatgctcttccatcggccagcttaygtagagaggctgtgccacaaaacagctttctcaggaaataaaccaccttaggccctgaacatatgtacgtgtaagtacttgtgttaaaaggaggcagttattcgaagaaccatggttttacccaggatgtagttcctccaacagatttcaagccccactctgggaagagaggtaaggaaatacacttggaaattggagtctgatggacgtaagtccaaatcctgaggtcactgctgaactgttaagttcaccaaggctcagtttcctcacacgttaaaaggaagctaataatacctactt

SEQ ID NO: 88616 - DNA, 601 bp, Human
agtatcatggagaaattgcaatctttatgaagagaaatttgataatacataattttttaaaaatacacatcatctgaagaaacaattctacttctaggaatatatcctatgaatataattaaggatgtttgcaaagagagagcaagaaagatgttcatcacttcagtgcaagtagaataataaaagaatggaaataccttatgtatctagcaagagatctagctaaataaaaagtgcatcagtacaacagaatgctatgctgacacagagcatgatgtgttcattttttaagttacaagawtacactcatagttttatcaattttaaaaaatagtccttaataaagaccctaaatgggtgaagatttcctgctattgaggatattataaaaagaaacagaaagtagaaaaaattttgaaatgttatacatcaaatagtaagtaattactttggaaatataattatggaggaatgtatattttatactttacacacatcaaatatttggatttttataatgttatgtgtatcttacaatgaaagtattcttcttgggaaaaagtattttaaccacattcagtgatgtgaaaagtggttcata

SEQ ID NO: 88617 - DNA, 601 bp, Human
ggagaggtctatgtaagtttggtctggggtacttggaaggggacagcatcaggtttctggtggccaggtagggccactgtgtcaccgttttctctgttgcacaggcagagtgggccacaggccagcaggtcgctatgacacaagagacttcagggccaccttctccaagttctcccctccccctgtctctccaattcctgccctccccaggagtaacagaacctcaacaacagagcatgaaagagctgtcactgcacagcatgctcggaaaatgtcacagcagcaaataacatttcctgaycattcactacttgtacacattgggtctcctttatcttacttaacttcacagcaatctttagaggctggatacactaagcattaataagtctccttttacaaatgaatacattgaagatcacagaattaataatgttgaaaccaggatttaaatataggcaggctcaatccaatactcatgcttgtaacctaataccacactgcctttttatacacaatacacacacacacacatgcacatctaccacaccacaggatacacaccagccattaacagtagttacatgtgagctttatagga

SEQ ID NO: 88618 - DNA, 601 bp, Human
aattttgtccttattggaaagatgcacttttatatgaattagaccatgaagtaattcatataggaaaaaaattattcaatgtaaagaaagacacacagataataagcatgaatcaactgttacttgtattaagcaaatactcttatcctgtactattacagacaaaacaagctgtgttacagctacctgatagaacatacaggcaactcatagacacctactgaaatcctagaattacacaccacgacaaggacaacaatgatgatgagaaaggggaaagaaaaaaaaatagaaaaaaggrccctaagtggatttcttgaactagaaagagaagctttcaataaatcataactctaggatggttgctaggaaaaccaaattatgaatcaaaaacttaaaagtatagcattttagatactgtttttgtgaacaagctaaagattaagaaactacttgagtattaaactctcaacagtaagaatcagagatcttgactctagggaaacctctggcatattctcctttgtaaatcataggaagagttaatcttatctgcccttcctaaagccttctacctggtggaggttgcagtgagtcgaaa

SEQ ID NO: 88619 - DNA, 601 bp, Human
ttaagaattgaaggctggaacacagagtcaactcagtgacttcagctctaatggtggctccaatgtgacccagcctgtccttccacctttctggatctccacccatccatcagtaagacagagataatactatctgcccatatcaactcccctgaaacaatataagcattaatgatctaatatactcaaaaggtactttgagtcctttggaggaaagatgtcatataaattaaaggcataataatttatgtaatttaagaaaatggctgcccataacacagaggattgggttcacatggaycacaaaagacctagtcatcttgtcctcaggtcactaatgatcctttctaatggaacaaaatccaatcttacttatttgagcatattcaactatgctgtgtttgggttcattattttcccccaagtactttacttaattctgttatcaaaattgaactacactttaattttgtccttattggaaagatgcacttttatatgaattagaccatgaagtaattcatataggaaaaaaattattcaatgtaaagaaagacacacagataataagcatgaatcaactgttacttgtattaagcaa

SEQ ID NO: 88620 - DNA, 601 bp, Human
cccaccagtgtgagaagtgctgtctacacatttaacaggcctgatgcgaggctcttctgggacttaaccttgggctccactccactttcacctctctaggctagtggcctgccctgcgtgtgggaatggctgcattgaattacgtggacagtgctataattatgtcgtcttccctttcatcttccttgcaggactccaagtgagaatgtgtggagtgagctaatgatttgccacatatctctgatgagtactatattatttgcatcataatattttcatttcctccccctgcacataacgycacattgacagcaaggtcagttaagttactataagggatttttaatgaaaacaattataaatttaaaataactgtgtttaaagcatttaacaatcactagggtcaagtgattacagcagttacaagccccatgggacatgttcacaccaaaacaaagtgaataaattacctcagctggcacatgtaatcactaagtgaccacaggggtcaggcagagtagagccctgaagactttcacgcaaaaccaataatgaaaatttatcagtcaaaggtgggggcgggtggcaaacatcaagaatt

SEQ ID NO: 88621 - DNA, 601 bp, Human
ttttaaaactgactgcagtgcatgattctgtatagaagcctggaatagaaaaaaaaatgtcataaatggcatgattaagacaactggaaaaatatgaaaaaggtctatagattacataacagttgtattaatttatatttcttgattttgataactgtagtgagctcatgtaaatgaatatccatgttcttaggaaagatacattgaaatatttagggtaaaggggcatgatgtctatgacttaaactcaaatgcttcaggaaaacatacacacacacacacacacacacacacacacacctagaaagagaataataaagcaaatgtagcaaaacattaacagttggggaaatctgtgtgacgggtatatgagtgttcattgtattattcttgcaactttcctgaaacttgaagaaatattaattaaaaaataattaatcaatggaggccgcccaccagtgtgagaagtgctgtctacacatttaacaggcctgatgcgaggctcttctgggacttaaccttgggctccactccactttcacctctctaggctagtggcctgccctgcgtgtgggaatggctgcattgaattacgtggaca

SEQ ID NO: 88622 - DNA, 601 bp, Human
gttttaaaactgactgcagtgcatgattctgtatagaagcctggaatagaaaaaaaaatgtcataaatggcatgattaagacaactggaaaaatatgaaaaaggtctatagattacataacagttgtattaatttatatttcttgattttgataactgtagtgagctcatgtaaatgaatatccatgttcttaggaaagatacattgaaatatttagggtaaaggggcatgatgtctatgacttaaactcaaatgcttcaggaaaacatacacacacacacacacacacacacacacacaactagaaagagaataataaagcaaatgtagcaaaacattaacagttggggaaatctgtgtgacgggtatatgagtgttcattgtattattcttgcaactttcctgaaacttgaagaaatattaattaaaaaataattaatcaatggaggccgcccaccagtgtgagaagtgctgtctacacatttaacaggcctgatgcgaggctcttctgggacttaaccttgggctccactccactttcacctctctaggctagtggcctgccctgcgtgtgggaatggctgcattgaattacgtggac

SEQ ID NO: 88623 - DNA, 601 bp, Human
aatatcagttaggtttcctaaattcctaaattacagctaactattctggtattcctactagtaaccccagtactattattactattactaccactaccatcaccatcaccaccactaacattattatatgctcttggttgattaacaattctaaattgaggtaataaagggaagaactatacaggacttggtgggcactgagtctcaaacgactagggaataggattaatttagagtcagcaagtgaagaacttcctaacattgttctcaacattttacagacaaatcaaagctcagaggytgtatattttatagttagatgtctgccctcacaggcaagtacagtctcttcaaaaccaaaaggagctttacctcctaatttccaaacaaagaaggataagtgagattcataaaaacggcagcgagaagggagacaacacagtttaattgtacacgtttatcctgaaattagaaaaaaagaatgctgcttctttcctgctcttaaaatttgaacagctaaaaaaaatgtaaaaaatgtaaaaaaagtttaccccagtttcataatgtacacaaaacttgctgcaataacatctatgataga

SEQ ID NO: 88624 - DNA, 601 bp, Human
aaatcataaaaaatgatgttaaggagatatatatatgtgtctatatatacacaaacattttcaggctctgtggttacattgcttcctaaatccaggatttctatgaataatggattcacaaaatgaagaatacacaatgaaaatactaaaatatcagttaggtttcctaaattcctaaattacagctaactattctggtattcctactagtaaccccagtactattattactattactaccactaccatcaccatcaccaccactaacattattatatgctcttggttgattaacaattcyaaattgaggtaataaagggaagaactatacaggacttggtgggcactgagtctcaaacgactagggaataggattaatttagagtcagcaagtgaagaacttcctaacattgttctcaacattttacagacaaatcaaagctcagaggttgtatattttatagttagatgtctgccctcacaggcaagtacagtctcttcaaaaccaaaaggagctttacctcctaatttccaaacaaagaaggataagtgagattcataaaaacggcagcgagaagggagacaacacagtttaattgta

SEQ ID NO: 88625 - DNA, 601 bp, Human
ccatgtacactgacttgtgaacaacaaattcacactattactgaactatatccatgacatttttaaaaaaacaattcccaggcaggcaaagaaatcaaacattagatctgagaactactacaagagtttatggtagattatgagccacagaacagctaccaagaaccacacacagtctctgcttaggatctttctagatattctagacactcttttaaccgacagtctccagcctctctgagacacatactgtctgctgcccaacatgcacccactaacagcagccaggggctgtctctartagtcacctgtgctcttctgctccatgcacagttgtcctagagccacctctgtttatctccaaaccagtttatccagctgtattttttaatgtaatcatctcatgtaattataaatgactttaaaaatcatagcattctagaaagattctgcactcagattgtttcacaagcatctttatgttcaccaataaatatgccaaaatgaaaatgtgatacgtttttaataaagatgagaaattaaatgtgtgatttacccaagaaagacagtgctgacctataatcactgtgtccatacttaa

SEQ ID NO: 88626 - DNA, 601 bp, Human
ctttgttatattttacaaatgaatggacagaacactatatactatatatttgatgaaccaatcacacttcagaaattctggactatccacgtcgagaagacgtagtaacgctgctaaagtgtaggcctatgtgtctgggacgtgtccttcctcatcctgcatgtttctctctctttaggcaatggaacagggtactaatgagaagggaaagagcttgtcctgtaagcacggacaccctcatacttcaacccctctggccctgatgaaaagaactaccaaaggacgaagaaagaactgccaygccaagcttcttgatctttcctccttctgtcatgggagaaggagtctccataattaccttagtaaaatcatgtataaactatttctaagaaataaaacccttcttaaaatttaagttcctctctgataccttatactatgaattcttactctgcgatgcattttggtttacttatggtaaaaacgaggaactcaccatgtacactgacttgtgaacaacaaattcacactattactgaactatatccatgacatttttaaaaaaacaattcccaggcaggcaaagaaatcaaacattaga

SEQ ID NO: 88627 - DNA, 601 bp, Human
gcattaacataagctactgcatcttgattttcaatggcactgtaatgcccatgatactgtagataagtgctaatgctggaattttgagaaccaagtcctgtgtccagcaaatgcttttaaaagaatttcactctcaatggttgcttgcccagaagaaattcattttgtgttaaaaaaaagaaagaagaaagaaagaaaacaaggaggcattcaattgagcaagcattttcttaattcattttaagataaactcttacattccccaacaatttctccaatggatgcaaatgtggaaagagamcctgtatggatgggttggctgtatgctccattctgtattggtatatgacatcaaataatggaatggcgataaaacaacaacaaaaaaaggaaaggctttataatagtcaggacacgccaaccaattttaaattgaattacacagcctgctaatctttatgatgggatagaatttctttcaacattatgcattatactaaaatttgcagcacttctccctccccatttcttaagctgctatccccccatactccccatatatctccccagtggaaaagcttcccttcaactccaaaagcat

SEQ ID NO: 88628 - DNA, 601 bp, Human
aaggtggtagtgcactggctgtgagagaaccagggaagagctcattaaagctccaattatgaggactcatcagtagagaatttgatttaataagtctgaactagattccaggaatctgaatgtttaaccacctgcctgagagattctgatgggcagtcaggcttaggagatagaaactaggggctagagaaaactgagctgcccaagatttgggggacataacaggataaattgaattgaattgtctctcctgatctctgaattcctttccaagtaggtatgcaaaacagcttcacaagtyaaccacaccatcagagtggttgtacaaccttaattcttactatagatttagcatcacaaaccaaagttaatttgcttcctaaatcctacaggaccccaaaagttgtatgtgttttcttgtcttcttgacaaccttactaatgcactacccccaatttgccttacagacagctaagaacctcttgaaacagacatagaatagcctttaatgtgaagaaaactttaaaatcccatcaagcgaagatcacaatcatttcaggaacttagtattggagatattccaaagtctggattgactcta

SEQ ID NO: 88629 - DNA, 601 bp, Human
gagtgagactctatctcaaaacaaacaaacaaaaaacctttatacgttaacctacctcatctttacagtaaccttatgaggcaatatctattatcctcttttacagaggagctaaatgaagtctacaggggtcatcatgaaaagagagtggaaaagaatggctgggtttaggataataggagtatgcagaatatatccccaatcccggcaatccattttatccataagcaagaaggtggtagtgcactggctgtgagagaaccagggaagagctcattaaagctccaattatgaggactcrtcagtagagaatttgatttaataagtctgaactagattccaggaatctgaatgtttaaccacctgcctgagagattctgatgggcagtcaggcttaggagatagaaactaggggctagagaaaactgagctgcccaagatttgggggacataacaggataaattgaattgaattgtctctcctgatctctgaattcctttccaagtaggtatgcaaaacagcttcacaagttaaccacaccatcagagtggttgtacaaccttaattcttactatagatttagcatcacaaaccaaagtt

SEQ ID NO: 88630 - DNA, 601 bp, Human
tgagatttggaaccaacacatccaatatttacctctgtcaggcaccatcctaaaaaactttaggtctggcgcaatgactcactcctgtaatcccaacttcaggaggccatggtgggcagatcactggaggttaggagttcaagacaagcctggtgtggtgaaactcatctctactaaaactgcaaaaattagctaggcatggtggcacacacctgtaaccccagctactcagggggctgaggcaggagaatcctttgaatttgggaggcaggggttgcagtgagctgagattgcaccactrcactccagcctgggcaaaagagtgagactctatctcaaaacaaacaaacaaaaaacctttatacgttaacctacctcatctttacagtaaccttatgaggcaatatctattatcctcttttacagaggagctaaatgaagtctacaggggtcatcatgaaaagagagtggaaaagaatggctgggtttaggataataggagtatgcagaatatatccccaatcccggcaatccattttatccataagcaagaaggtggtagtgcactggctgtgagagaaccagggaagagctcattaaa

SEQ ID NO: 88631 - DNA, 601 bp, Human
tcaggccttgtcttctgtgcacatctttgtttcaagaggtctagccagggattcttgctacactctaccagtgggctcagatatcaaccaagtgtctttccatctcttcgtggccaattgatggtgacagataattagcttgaattgttaaaagtatagttcctatggtatcttcagaatctcaatatgccaaatacgtgatcttcaggaagtaaactattcaactgtagatggataagacagaaggttaaactgctccaaacagccatgaaacataacaggtgatgataggttaagtctytcagaactttggaatctgaccacataacaggaacctgtaatcttctcttctgagatcatttctatgggaaagggacacaggtggctagaagtctgtcctatacatggatcctggtataacatggacaaaagaggaaacaaaagaatgaaagaaaagagaacaaggaacataaaaaaaggaaacaagaaaagtaaagatttcaggatgaaaataggaaacaagatattgaaacaaggaaacaaggcatgatattttaaaatgctacccaagcctatctcagtcactggccaagcctcacta

SEQ ID NO: 88632 - DNA, 601 bp, Human
tgcagtggctcacgcctataatcccagcactttggaaggtggaggcgggctgatcacccaaggtcaggagttcaagaccagcctggtcaatatggtgaaaactcgtctctactaaaaatacaaaaattagccaaatgtggtggtgtacgcctgtgatcgcagctactcgggaggctgaggtggaagaatagcttgaatcggggggcagagttgcgctgacccaagatcacgccactgcactctactgtgctctagtttgggacaacagagggagactctgtctcaaaagaaaaaaaaaaaagtaaatcagtttccaggctttatcctgaaagattctgttctctaggtctgagtgggccatgaccttaaaaaaaaacatattcttccattttttctttgcatctctaatgagagacaagatctcagtgaccagcattaccctagcaaggagggataatgggggcctcctgccctacttttattctagtccagagacaggagtcctcagtccacccatggttaagcctagttcctctataaagggaaatgagctcaaaaccattaaaataatacagatgactgtttctctttctcttttttg

SEQ ID NO: 88633 - DNA, 601 bp, Human
tagttcccaaacccgtttgatcttccaaattatgtacaagttaaaaagtaaatcatggctgggtgcagtggctcacgcctataatcccagcactttggaaggtggaggcgggctgatcacccaaggtcaggagttcaagaccagcctggtcaatatggtgaaaactcgtctctactaaaaatacaaaaattagccaaatgtggtggtgtacgcctgtgatcgcagctactcgggaggctgaggtggaagaatagcttgaatcggggggcagagttgcgctgacccaagatcacgccactgmactctactgtgctctagtttgggacaacagagggagactctgtctcaaaagaaaaaaaaaaaagtaaatcagtttccaggctttatcctgaaagattctgttctctaggtctgagtgggccatgaccttaaaaaaaaacatattcttccattttttctttgcatctctaatgagagacaagatctcagtgaccagcattaccctagcaaggagggataatgggggcctcctgccctacttttattctagtccagagacaggagtcctcagtccacccatggttaagcctagttcctctat

SEQ ID NO: 88634 - DNA, 601 bp, Human
gatagtcactttaggccagtagttcccaaacccgtttgatcttccaaattatgtacaagttaaaaagtaaatcatggctgggtgcagtggctcacgcctataatcccagcactttggaaggtggaggcgggctgatcacccaaggtcaggagttcaagaccagcctggtcaatatggtgaaaactcgtctctactaaaaatacaaaaattagccaaatgtggtggtgtacgcctgtgatcgcagctactcgggaggctgaggtggaagaatagcttgaatcggggggcagagttgcgctgwcccaagatcacgccactgcactctactgtgctctagtttgggacaacagagggagactctgtctcaaaagaaaaaaaaaaaagtaaatcagtttccaggctttatcctgaaagattctgttctctaggtctgagtgggccatgaccttaaaaaaaaacatattcttccattttttctttgcatctctaatgagagacaagatctcagtgaccagcattaccctagcaaggagggataatgggggcctcctgccctacttttattctagtccagagacaggagtcctcagtccacccatgg

SEQ ID NO: 88635 - DNA, 601 bp, Human
tgcggagattaaaatgcaatccattagcaagattgggctaaatgtgtgtatactctgaacgtcaattactgttgttgtccttgtggttattgtctgggtgtggtttggaatagttcaacaaagctagcatatttctttattttcttaggctctatttttgtctccttaaaaattctcattattatagggaattggactctggggagttgagatgcgccacaacacaatgacttcactgaggagacaccaaataggcagtagtaacggtgtcctatgagaactctattgtcattgggcttcyagaagtcctgagagggaagatgtcctcatgactagggccatgcaccttggttccagggtccccttccagggtcattctacttggccaccattgactttccatatcttgttcatgtgacctcagacattcagtggccttgatgggatttttccctcggctctgccaagatggcccagataatgacattaggaagccatggcacctaatgtgtcttggcccagaaacagatcatttctcgttgcatgctggggcaagtggggtcaagggaaaactttgttcaaagaaaagtttatgaagaag

SEQ ID NO: 88636 - DNA, 601 bp, Human
ggtcagatgaaagaatccatgctaatttatgtgcaaggccagttctatccttttgcttccaacagaaaatcaagggacagcagggtgctcctgaccttttatcctttaattccaggcttaccgaaattccaacctagcagagtcctcagagatttgaatcattccttccatggaatgggaaactaagacctagcaaggctaaaatgactcctccaaggtcacccaatgacttagttgcaattcagaacttctgattttgcagaccaatcctctccttctccaccatatcacataatcaccrggtcagagatttaaatgattcactttgtagatcagaatgtttaggttcagagaagctaagaagtttttctaaagactgtgcctacaatcatgaatcctgggtcctaacattcatctgccactaccagcaagtatcatgcagtaacacccaagacatatagtcactcatttcttcttatttcatagacacagaggactaatcaaatttcattgttaagatactcttttgtttttaacctgtactatcacggtttaaggccatttttttttcagttgactcatggaaagcatctatttagcc

SEQ ID NO: 88637 - DNA, 601 bp, Human
tttcttcattgtatcccttcatctgaaagttttcacccctaggcctctcaggaaaatcactgctgttttgacagctggctttgcagaggccactctttataaatgagcctactgcctaggcccaaacaggacacgtgtgtgcatcttctcaggcccccaagtcactgggtcagatgaaagaatccatgctaatttatgtgcaaggccagttctatccttttgcttccaacagaaaatcaagggacagcagggtgctcctgaccttttatcctttaattccaggcttaccgaaattccaacstagcagagtcctcagagatttgaatcattccttccatggaatgggaaactaagacctagcaaggctaaaatgactcctccaaggtcacccaatgacttagttgcaattcagaacttctgattttgcagaccaatcctctccttctccaccatatcacataatcaccgggtcagagatttaaatgattcactttgtagatcagaatgtttaggttcagagaagctaagaagtttttctaaagactgtgcctacaatcatgaatcctgggtcctaacattcatctgccactaccagcaagta

SEQ ID NO: 88638 - DNA, 601 bp, Human
ggcaacatttactactataagagctaccctgaatcagagccactaagacttcctggggggtgtgaaatcatgaagtctcctttggataatgttttggttccactggaacacatttccaatagtctccgatatttctttggcaatgcttttatggctttatcccacaagcctcccgctggtatgaagcagtaaaaagtacgtagtataattcctcaggaagaaaggatttctggaaattccatcatggcccttggtacccaaggttccaagaagcagaattggaggtctattttactttctrcattttcattccttactcatgggttttccaatttctagagatctaggcctcagcatcttaaaatttatcaagagataaatttacactgtcttcctaaatctgtgttttctcctaattagtataattaaggcacaaagtattccataaagttcttccttaaataatttgaattaagtattttaaggaattcaggtaatcggaacacagttggagagcatactctgtctgctgaacgttgttccaaagcaagacacaaaaataaatacataaaaaggtgtttggcatgacagtaaaatgaaa

SEQ ID NO: 88639 - DNA, 601 bp, Human
ggaatatgtggcataaaggaaagagtgtggactttggagtcagacagatttcggatcaagttcctgcttctgtcacttattacctgttaaactcagactccaaacacataattttagcttcacaatactcatcaggaaaaaagaaaaagaataattgtacaatctaccttatgaagtgggtatggggaataagtgagagcaggaaaggaccaaatacaatacctgccacataaaggatgataattattattgttattattattattattaatttttgaaatggagtctcactctgtcaccygggtgagagtgcagtggcgcgatttcagttcactgcaacctccgcctccagggttcaagggattctcatatctcagcctcccaagtagctgggactacatgtgcccaccaccacccccggctaattttttatatttttagtagagacagggtttcgcaatgttggccaggctggtttcaaactcctgacctcagctgatcccctcagcccgcctcagcctcccaaagtgctgggattacaggcatgagccatcgtgcctggcctattactgttatttttatcctgtcttctgttttgcag

SEQ ID NO: 88640 - DNA, 601 bp, Human
cacagccttcaggctcactttcccttggtaatgtgctagaaaaaaaagctaacttgttgggatttaaaagaatcaaacaaatatatagtcagacctgttatcacaggactgtttctaaataagagatatacaacaatttgatcacatttctgaaacctgcctgcaatggggcagtgccagatgcctgttttaaaaccctgttccctaatgccagtgatataaagttactttgtttcacccaaggcacacagaaggaggaaatttttcctatttaaaattattattatatgtttaatattgkaactccagcaggaacagggaaaatgttaaaacttttgaagcctctctatttcactgaggaatgaataagaataacctgggcttgaaaactggccaagcagaaaattctgcaggaagatgaaaggaaaaaagtaataccaactgctaggagcatggaagaactatgaggctcaggatgggctaaggagacatttcatctaaattccttccttggcaattactgggggctgatagcagagaaggcctgagtccagcctggaggtggggagggggttctataagctatgaggaggcagagcca

SEQ ID NO: 88641 - DNA, 601 bp, Human
taatgttcctcaaaaataagtatcaaacaactgcaatcaggttttctgctataaatcattatagaatgaattcctctagaaaattcaagtttaggtcaaaccaaaatccaaggtcaattccagaacatttacttttcccaggaatctgcctgtgatatggtttggctgtgtccccatccaaatctcatcttgaattgtagctcctgttatccccacgtgttgtgggaaggatctggtgggaggtaattgaatcatgagggtggttatcctcatgctggtctcatgatagtaagttctcacragatttgatggttttataaggggctttacctccttttgctcagcacttctgcttgctgccgccatgtgaagaaagacgtgtaggcttccccttccgccatgattataagtttcctaaggcctacccagccttgctgaactatgagtcaattaaacctctctcctttataaattacccagtctcaggtatatctttagtaacagcatgagaacagactaatacagcctgccaactttcagaagacaactcttgcctcatactcttcattccccatgaacagggaatatggaaaacagggtc

SEQ ID NO: 88642 - DNA, 601 bp, Human
aaagaacattttgatttttctcatggcagaaactggcatgttccaacatgtctttcaaactaacaaaagtattattagggccaataagcatttggatctaaaagtgaaggtcagtgcggctatgaggtctccaacctgcacacaatgcaaacacagcacctctgttgagataatcctaacctcgcacaatgtattcccttaacacacaactttttgcctccttctctcatccagatatctctgtcttccagtatttatcaaataccaaaaaatgtgccgagtggcctctcattcatgaatrattagtataacctgtaatagatagcatccagactgtttctctcaagagtgactactcatgcagaatatccagaatttcttcttagaatcaggtggggttattcttctatgagcatgcagcaaggaatagatgaaaagtttaagatctccagctatgcacatgtctgatgaactctataacaatgttaaaacaaacacatagcaacttatgtcaaagtcagcataactcccttataaaactctggacatttaacatgccacttataatggctctgatgaatcacaacacatgaacccctaa

SEQ ID NO: 88643 - DNA, 601 bp, Human
atgcttagccctcaactgaggttattatttgtttgtttgttttttgttttgttttgtttttgtaatgaactaacatctagaactcaggaaatatcacccaaaagtttctgcacttccagcttcttgtgggaaatcaaaagatcaggcaaaactgacctccagtctgccaagagatctcccctctctgatttcttctcatacagcccacttaccacatttgttctgcctgatgggccactatattaatagatttaacaatgtacagccaaatggttactcaaaaattactcaatgcaatctrgcttctgcttctactctccttccaaaagcgtccctggaatgtgactaataacctcctaatggccaaagccatggctttatttgaattctgacctctgttgatcacactacagtggtgtgatccattcccttgattactgctgtggcactctccaagttctcctcctccctctctgatatttcctctcctctctcttcttcctcagcttcctttgcatcctatctcatctgcatgcttattccatgacactctccttattcatctttacttctatgggcagtatgtaatagtttcttactg

SEQ ID NO: 88644 - DNA, 601 bp, Human
ggctcacacccggaatcccagcactttgggaggtcaagacaggcagatcacctgaggtcaggagtttgagaccagcctggccaatgtgataaaaccctatctctactaaaaatacaaaaattagccgggtgtggtagcaggagaattgcttgaaccccggaggtgcaggttgctgtgagccgagattgaaccactgtactccagcctgggtgacaagagcaaaacttgtctcaaaaaaaaaaaaaaaaagaacgctaccaaccaaccagtttcatcgttcccaaggcatggtctatgttcyactaatggtacacaagattattttaggtgaaatggaaaggaacctttgacaaaatgtcaaatagttttgtattttaaaactacttttaagaatgcattgtttggacaaatacaatataaaagtataagtaatgatatatagcttccttttttctatctttatatgtaaaataagaggtaatttcaagaaaattactgagcaaatagtagaggtaacttacagggacaataaagtgacaatggtaggaagtgaattaatgagatgtggaaaacttgctcatcagttcaggttagagctaca

SEQ ID NO: 88645 - DNA, 601 bp, Human
ctgacctgcttgtataaaaaaaaccaaggccatatatatactctaacatggaaaaaaaatccttgctctgaatgacccaaagaactctaccagccgggcacggtggctcacacccggaatcccagcactttgggaggtcaagacaggcagatcacctgaggtcaggagtttgagaccagcctggccaatgtgataaaaccctatctctactaaaaatacaaaaattagccgggtgtggtagcaggagaattgcttgaaccccggaggtgcaggttgctgtgagccgagattgaaccactgyactccagcctgggtgacaagagcaaaacttgtctcaaaaaaaaaaaaaaaaagaacgctaccaaccaaccagtttcatcgttcccaaggcatggtctatgttctactaatggtacacaagattattttaggtgaaatggaaaggaacctttgacaaaatgtcaaatagttttgtattttaaaactacttttaagaatgcattgtttggacaaatacaatataaaagtataagtaatgatatatagcttccttttttctatctttatatgtaaaataagaggtaatttcaagaaaattact

SEQ ID NO: 88646 - DNA, 601 bp, Human
ttatatgaaaagtgtaaacagggcagctgacaaatctcctgttacttgatggcattttcgttgtttttttttttccagactagattaattgggaaggccctgcagtcaagcttcaaacttcttggtattcaaatagcaacactttaaaattgtcaggcaaagaggtgcctgcctttttccattttattcagatcatgccagctaagctgacctgcttgtataaaaaaaaccaaggccatatatatactctaacatggaaaaaaaatccttgctctgaatgacccaaagaactctaccagcygggcacggtggctcacacccggaatcccagcactttgggaggtcaagacaggcagatcacctgaggtcaggagtttgagaccagcctggccaatgtgataaaaccctatctctactaaaaatacaaaaattagccgggtgtggtagcaggagaattgcttgaaccccggaggtgcaggttgctgtgagccgagattgaaccactgtactccagcctgggtgacaagagcaaaacttgtctcaaaaaaaaaaaaaaaaagaacgctaccaaccaaccagtttcatcgttcccaaggcatgg

SEQ ID NO: 88647 - DNA, 601 bp, Human
tcttttaaatcaaattttggagactcagcataaaaaggtagccaccaaaatgaagagccacaaaaaaggtgatgatatttacacatcaccaacaaactcatctttttccgagaatccagtagtagcttccaacttctatcctctgttaccgatgttatgagattgtctgacatattttcttttttgctgaactgacctttcatctataatctgccaacctttatgttttatatgaaaagtgtaaacagggcagctgacaaatctcctgttacttgatggcattttcgttgtttttttttttccagactagattaattgggaaggccctgcagtcaagcttcaaacttcttggtattcaaatagcaacactttaaaattgtcaggcaaagaggtgcctgcctttttccattttattcagatcatgccagctaagctgacctgcttgtataaaaaaaaccaaggccatatatatactctaacatggaaaaaaaatccttgctctgaatgacccaaagaactctaccagccgggcacggtggctcacacccggaatcccagcactttgggaggtcaagacaggcagatcacctgaggtcaggag

SEQ ID NO: 88648 - DNA, 601 bp, Human
ccggtccttactgtgtgattcttagagcagaagattttacctgtacaagtcacactgtagttgcccagttcccctttaatcattcacgatgatgggactcactgtaaaccctttcattatgtgccaccgctcttgcaggaagcctgggtttctcaatttatcctcgttttagggctcgggttcagggacagcgtgggtgagactagccactatggcaaaggaagtatattttcccccttcagactgggtttttcctttctttctttctttctttctttttagtaaaactgctgcaaagtawatctttctcagaaagacaagcatctttggtgtcttttaaatcaaattttggagactcagcataaaaaggtagccaccaaaatgaagagccacaaaaaaggtgatgatatttacacatcaccaacaaactcatctttttccgagaatccagtagtagcttccaacttctatcctctgttaccgatgttatgagattgtctgacatattttcttttttgctgaactgacctttcatctataatctgccaacctttatgttttatatgaaaagtgtaaacagggcagctgacaaatctcctgt

SEQ ID NO: 88649 - DNA, 601 bp, Human
accagaaacgctgaggccaagcagcaatggatatctttgactactagcccacagtgctgtatgtcacgtctttggcctcagttatttgtaaggctatgctgaagagttcaaaaaagaataggaagcctccctcaaatgcatgtttatgcgaatttggtaattaagagtatgatgtacatagcaagttgtttggatagaatggtggtatcttgcacaattccagaacttcaagtgcagatgaaagatatatcaatagggccacaaattcccagtactgcacatgctggaaatttgtgagagrccctacaactctaatatcatggctctgtgaccctatgagtctaatagtgctccccgccccaattcacctgtgctcccaaagccggaacaggctaaaacgttttcccagacagcaatgtcttccaaggccggtccttactgtgtgattcttagagcagaagattttacctgtacaagtcacactgtagttgcccagttcccctttaatcattcacgatgatgggactcactgtaaaccctttcattatgtgccaccgctcttgcaggaagcctgggtttctcaatttatcctcgttttagg

SEQ ID NO: 88650 - DNA, 601 bp, Human
aaagtttaaccctcttttaatatttatggtatggaaatgtgagttctcagtgtgtgctttttatgcaaaagtttcctgatcaaaatgagataattctgggaagaagaatgaaagctataaaggaaaacccaaacaccagacttctgcatagatttataatgtttgaataaagtacgggtcatacatattaataactcaccgtgatgctataagaacgaaaatccaaagggagatagtgccgggcagctgtccccacctgaaattaatgttcttttccttactctgtcactacccatccctyaagcctcactgttcatctgctgctttttattttattttattttggaggaaaaaaagagtgggacaatggcacctataattccagctttctgagacctatgggtctgatgtgaaattaatgtttcctgctattccaggaagaattaaagttaccactagcaggaaattggatacacttgttgtaagaactggtccttaccagcaagccagagtctcaatgatttcattaaggaaacttagtggggaagagaattttgtgggcgggggggtggggggaggtgaggggagcaagttccatcgt

SEQ ID NO: 88651 - DNA, 601 bp, Human
ttgtgaataaaaagaacattagtaagggccccctgattagaaggctaactttcctcctattgggatgggagaagaaactgtaaagtttaaccctcttttaatatttatggtatggaaatgtgagttctcagtgtgtgctttttatgcaaaagtttcctgatcaaaatgagataattctgggaagaagaatgaaagctataaaggaaaacccaaacaccagacttctgcatagatttataatgtttgaataaagtacgggtcatacatattaataactcaccgtgatgctataagaacgaawatccaaagggagatagtgccgggcagctgtccccacctgaaattaatgttcttttccttactctgtcactacccatccctcaagcctcactgttcatctgctgctttttattttattttattttggaggaaaaaaagagtgggacaatggcacctataattccagctttctgagacctatgggtctgatgtgaaattaatgtttcctgctattccaggaagaattaaagttaccactagcaggaaattggatacacttgttgtaagaactggtccttaccagcaagccagagtctcaatg

SEQ ID NO: 88652 - DNA, 601 bp, Human
ctaaagacatggcatagtcaaacattccataattgacatacattaaaggaaccagatagtataatttcatatttcaactctaattttaagtttcctttttgggttgtgaataaaaagaacattagtaagggccccctgattagaaggctaactttcctcctattgggatgggagaagaaactgtaaagtttaaccctcttttaatatttatggtatggaaatgtgagttctcagtgtgtgctttttatgcaaaagtttcctgatcaaaatgagataattctgggaagaagaatgaaagctwtaaaggaaaacccaaacaccagacttctgcatagatttataatgtttgaataaagtacgggtcatacatattaataactcaccgtgatgctataagaacgaaaatccaaagggagatagtgccgggcagctgtccccacctgaaattaatgttcttttccttactctgtcactacccatccctcaagcctcactgttcatctgctgctttttattttattttattttggaggaaaaaaagagtgggacaatggcacctataattccagctttctgagacctatgggtctgatgtgaaatt

SEQ ID NO: 88653 - DNA, 601 bp, Human
caggagcggtggcttatacctgtaatcccagcactttgggaggccaaggcgggccaatcacctgaggtcaggagttcaagaccagcctggccaacatggtgaaaccccgtctctactaaaaatatgaaaattagccgggtacagtggcatgtgcctgtaatcccaggtactttggaggctgaggcaggagaattgctcgaacccgggaggcggaggttgcagtgagctgagatcacaccactgcattccagcctgggcaacagagagatactccacctcaaaaaaaaaaaaaaaaaaaaagagaaagaaagaaagaaagaaaagagaagaaaagaaaagaaaatattggaaaaaggattgcctctatgttggatattttttgtcattaatccttaaaccataaaacataacaatgatttatatcatatttacattgtattatgtattataagtaatctagagatgatttaaagtcttcacgaggatgtgcataggttatatgcaaatactacaccattttatataaaagacttgagcatgatggaattttatcagtgggaggtcctggaccaataccccatggacactgagggaggcatga

SEQ ID NO: 88654 - DNA, 601 bp, Human
ggaaggacaatcagagtctctggaggaagggcttcaaaatctatatttctacagagacggtaattctgatgtgtagggaggtttgagaaaccctaatctaagcaagatattttatgactgcttccagtacaaaatgagagggaaatgagttacctaaggctgatggaatgttcagagcagctgaatctatgtgaagggtagcatggtgacctcctctcaaatccttctgtgtcacacagacatacacccagccccagtaacataaacatatacagccagccctccataatcagaggttccrcatccagggatttaaccaaccaaggatagaaaatattagaaaaagggccaggagcggtggcttatacctgtaatcccagcactttgggaggccaaggcgggccaatcacctgaggtcaggagttcaagaccagcctggccaacatggtgaaaccccgtctctactaaaaatatgaaaattagccgggtacagtggcatgtgcctgtaatcccaggtactttggaggctgaggcaggagaattgctcgaacccgggaggcggaggttgcagtgagctgagatcacaccactgcattccagc

SEQ ID NO: 88655 - DNA, 601 bp, Human
tgaattatagctattttcctagtctgatggcgattacttttgagaaacctgtgaatccttaatatcagggttcttattttgatttctatttttaaaaccactagcggtatcagcaatgcagaacttaatacttcctccaaaaaagtcactgtgaaaacagggaaatcaaacaatcaatttacattattttgggttgaaatatctgttgggttactaagcagggactcacctatgtgtaaatctcagagatggaaaaaatctaatttccgaggggagaaaagtggtacctatggtataagtwctcccaaacgttgcttcttaataataaaagaggttaaaaattgtacaagacattaaaggaattcaagcatgctcacaaatatgtattgtttttgaaaattctaactttgatgaccatttaagtgggtggcatatgagagaaacaagggcagacctcattcctcatgttttacaactaaatgaagaagttaagggacttgcctagtgtcacccaatgggcagaaggtgaactagggctaaaacttatctaatctcactcctagtcccatagtctccttatgaaggttgacagaggtataaa

SEQ ID NO: 88656 - DNA, 601 bp, Human
aaacactactttaattctccctagtcttgaggtagctttcagctgtgttgcaagttatcaacatgtaacaaatacagactaatattctttttctgtagctagaccaagccacaatccatatcttctaaatacatgaattatagctattttcctagtctgatggcgattacttttgagaaacctgtgaatccttaatatcagggttcttattttgatttctatttttaaaaccactagcggtatcagcaatgcagaacttaatacttcctccaaaaaagtcactgtgaaaacagggaaatcmaacaatcaatttacattattttgggttgaaatatctgttgggttactaagcagggactcacctatgtgtaaatctcagagatggaaaaaatctaatttccgaggggagaaaagtggtacctatggtataagttctcccaaacgttgcttcttaataataaaagaggttaaaaattgtacaagacattaaaggaattcaagcatgctcacaaatatgtattgtttttgaaaattctaactttgatgaccatttaagtgggtggcatatgagagaaacaagggcagacctcattcctcatgt

SEQ ID NO: 88657 - DNA, 601 bp, Human
gcctcttccttggggatctagtaagtactacagaacattacggttgcaaacatatataaatgctctggtgtgttgtaagttattttctacataccaattcctgttaaactgtaaattagaaaacactactttaattctccctagtcttgaggtagctttcagctgtgttgcaagttatcaacatgtaacaaatacagactaatattctttttctgtagctagaccaagccacaatccatatcttctaaatacatgaattatagctattttcctagtctgatggcgattacttttgagaaamctgtgaatccttaatatcagggttcttattttgatttctatttttaaaaccactagcggtatcagcaatgcagaacttaatacttcctccaaaaaagtcactgtgaaaacagggaaatcaaacaatcaatttacattattttgggttgaaatatctgttgggttactaagcagggactcacctatgtgtaaatctcagagatggaaaaaatctaatttccgaggggagaaaagtggtacctatggtataagttctcccaaacgttgcttcttaataataaaagaggttaaaaattgtaca

SEQ ID NO: 88658 - DNA, 601 bp, Human
agtcccacgagtaagtttaccccaaattgcttgtgttaaaaagctggctacagattcagtaatcaaaaatacaaagatgatttcaaaactctaccttacctctacccagccagacatgccattagttaccacaggggctagtatttgacagattagaattttgttccctttctaaccatactcagcctttgagaaagatgttacagagctgagagtgagtcacaaagacaaaattgggcaccactggtggcagagaatcaattttaggtatgcaagcaatccacaagctctcccatggtaygaagtatgtatgaggctgacccacctgcctgacaacaaaaaaccttcttcttctgcactcccaaaaaagaatgagaaaaaaacaacaataggagaagtgaagcaaatctgtggctgaactgttaaaaagatgcctgatgcctttcttccagattcttggaagaatgagatggtgaaggaatacatacagatgccataaaacctgccttaaggcctcctgaggtaagggtgcccctaaagaattcatcaactattgccttcccatttgagggagcccctttccttccagacctggcatccc

SEQ ID NO: 88659 - DNA, 601 bp, Human
ctttcgctgaacaatacaactgctctgctccagtcggtgcaatatagacctttcactttctgcagcttggctgctgatcaattagtatgtggattttttttttttctgcacagtatcttagtatcaaaacagcaaaagaagagcctagtcccacgagtaagtttaccccaaattgcttgtgttaaaaagctggctacagattcagtaatcaaaaatacaaagatgatttcaaaactctaccttacctctacccagccagacatgccattagttaccacaggggctagtatttgacagattmgaattttgttccctttctaaccatactcagcctttgagaaagatgttacagagctgagagtgagtcacaaagacaaaattgggcaccactggtggcagagaatcaattttaggtatgcaagcaatccacaagctctcccatggtacgaagtatgtatgaggctgacccacctgcctgacaacaaaaaaccttcttcttctgcactcccaaaaaagaatgagaaaaaaacaacaataggagaagtgaagcaaatctgtggctgaactgttaaaaagatgcctgatgcctttcttccagatt

SEQ ID NO: 88660 - DNA, 601 bp, Human
taatgggagagtctatgggccctgtgccaagaaaaatgaaatgttaccctgggcctttaaacagaatcatgtaagagcagagtgcatatttgtttaacacacacacacacacacaagacctttttctgtgccaacacctttctgaaccctcctgaataaaagctgaaatccctgaaaacgtcgtacagaaccaatattgtttgcatagtctcattctttagtgccaaaggatttttctgctgaacaaggagctgtttctttcttttcttttttcttcttcttcttctccttttttttttttgcctaagttaattacaaagtatgactgagaaaataaaataaatgagcccattccacccatccctgtatctgaattctatcatatgagttgccagttggttttctaatcctctcactcaatatctgctgttaatttgttcactatttcaagaacttgaagactgtcagcaaaatacatgatgcattacaaaacttataattggaaataaaaacatctgacgctttcctgacagagtaaacataaagtactattgcactgatcagaacaagggaaatgtgagcaaccttgtagctatttgtg

SEQ ID NO: 88661 - DNA, 601 bp, Human
ccataggtttcataatgggagagtctatgggccctgtgccaagaaaaatgaaatgttaccctgggcctttaaacagaatcatgtaagagcagagtgcatatttgtttaacacacacacacacacacaagacctttttctgtgccaacacctttctgaaccctcctgaataaaagctgaaatccctgaaaacgtcgtacagaaccaatattgtttgcatagtctcattctttagtgccaaaggatttttctgctgaacaaggagctgtttctttcttttcttttttcttcttcttcttctcyttttttttttttgcctaagttaattacaaagtatgactgagaaaataaaataaatgagcccattccacccatccctgtatctgaattctatcatatgagttgccagttggttttctaatcctctcactcaatatctgctgttaatttgttcactatttcaagaacttgaagactgtcagcaaaatacatgatgcattacaaaacttataattggaaataaaaacatctgacgctttcctgacagagtaaacataaagtactattgcactgatcagaacaagggaaatgtgagcaaccttg

SEQ ID NO: 88662 - DNA, 601 bp, Human
gccataggtttcataatgggagagtctatgggccctgtgccaagaaaaatgaaatgttaccctgggcctttaaacagaatcatgtaagagcagagtgcatatttgtttaacacacacacacacacacaagacctttttctgtgccaacacctttctgaaccctcctgaataaaagctgaaatccctgaaaacgtcgtacagaaccaatattgtttgcatagtctcattctttagtgccaaaggatttttctgctgaacaaggagctgtttctttcttttcttttttcttcttcttcttctycttttttttttttgcctaagttaattacaaagtatgactgagaaaataaaataaatgagcccattccacccatccctgtatctgaattctatcatatgagttgccagttggttttctaatcctctcactcaatatctgctgttaatttgttcactatttcaagaacttgaagactgtcagcaaaatacatgatgcattacaaaacttataattggaaataaaaacatctgacgctttcctgacagagtaaacataaagtactattgcactgatcagaacaagggaaatgtgagcaacctt

SEQ ID NO: 88663 - DNA, 601 bp, Human
cagccataggtttcataatgggagagtctatgggccctgtgccaagaaaaatgaaatgttaccctgggcctttaaacagaatcatgtaagagcagagtgcatatttgtttaacacacacacacacacacaagacctttttctgtgccaacacctttctgaaccctcctgaataaaagctgaaatccctgaaaacgtcgtacagaaccaatattgtttgcatagtctcattctttagtgccaaaggatttttctgctgaacaaggagctgtttctttcttttcttttttcttcttcttcttctccttttttttttttgcctaagttaattacaaagtatgactgagaaaataaaataaatgagcccattccacccatccctgtatctgaattctatcatatgagttgccagttggttttctaatcctctcactcaatatctgctgttaatttgttcactatttcaagaacttgaagactgtcagcaaaatacatgatgcattacaaaacttataattggaaataaaaacatctgacgctttcctgacagagtaaacataaagtactattgcactgatcagaacaagggaaatgtgagcaacc

SEQ ID NO: 88664 - DNA, 601 bp, Human
atcaatggcgaggtaggaagcaaagtgatcggttttgctttctcctttttcaaataaacagggcagttgttaaaccagaagtgaatctgatccgggctttaagagcagtcagctgcattctgaaacaggcaaaaatgtaaacagagccctgtaactctagactagggcagaacagccataggtttcataatgggagagtctatgggccctgtgccaagaaaaatgaaatgttaccctgggcctttaaacagaatcatgtaagagcagagtgcatatttgtttaacacacacacacacacaaaagacctttttctgtgccaacacctttctgaaccctcctgaataaaagctgaaatccctgaaaacgtcgtacagaaccaatattgtttgcatagtctcattctttagtgccaaaggatttttctgctgaacaaggagctgtttctttcttttcttttttcttcttcttcttctccttttttttttttgcctaagttaattacaaagtatgactgagaaaataaaataaatgagcccattccacccatccctgtatctgaattctatcatatgagttgccagttggttttctaatcctctc

SEQ ID NO: 88665 - DNA, 601 bp, Human
cttataacacattaagacataaatctgtgtgtgtgagagacagggtttccctctgtcacccaggctgagtgcaggggtgtgctcacggctcattgcaacatcgacctcccagactcagcaatcctcctgcctcaacctcccaagtagctgggactacaagcacataccacgcctggctaattttttaattttgtagagatggggcctcactatgttgccctgtctggtctcaaactcctgagctcaagtgatcctccaacctcaacctcccaaagtgttgggattacatgcacaagtcacygcacctggccaatttttctttttaaaccctagtgtctgagtcacttgttttttctcttccctcaatgatcctattttcccctagaagcacacctcaccacttaatcctgagagcccctgaagggtgctggcctggatttctgtacaccctttttgcaactagatgaaaacgtccaggtcttctaagatgaaaagcagctacttcctgagttgctcaggccacggagtagacagacatctaggatatcctggtttagtctagcaaactccgcaaaggaagcctggattctagtcctatttt

SEQ ID NO: 88666 - DNA, 601 bp, Human
gggctgctgtctctctccactgcatggttcttcagagggaaaaagccacatgcaacctatacttgcctcctgatatgtgttgtggaggaagttgcctctgtggtgcaggaacagcaggagctgactcatgccttataacacattaagacataaatctgtgtgtgtgagagacagggtttccctctgtcacccaggctgagtgcaggggtgtgctcacggctcattgcaacatcgacctcccagactcagcaatcctcctgcctcaacctcccaagtagctgggactacaagcacataccaygcctggctaattttttaattttgtagagatggggcctcactatgttgccctgtctggtctcaaactcctgagctcaagtgatcctccaacctcaacctcccaaagtgttgggattacatgcacaagtcactgcacctggccaatttttctttttaaaccctagtgtctgagtcacttgttttttctcttccctcaatgatcctattttcccctagaagcacacctcaccacttaatcctgagagcccctgaagggtgctggcctggatttctgtacaccctttttgcaactagatgaaaa

SEQ ID NO: 88667 - DNA, 601 bp, Human
gtctctgtaactaagagtgatttctagagctgctcacagtacgggaataaggtgtctgagctgaagaaatgataccaaaaagcctaaaattgctggtggaggctttctttgaaaactctcactgccgtactgtgaggtttaatgtaagatttgtcctactcccatttctcacttttattgaacgatgctcacctgaagagatgctagatttctgagtgttcaggaagaatctaggtacatgtaccttgttaacacatgttattaaagcccatggacatcatttagggctttgcttggttccattttgctctatcatctctagtctttccgttttgtatgtccatgactgtgcctgatcttgtattggaaatactttctttccttttgtcactgggtgtctaatctgtgtaaattctcagttcaccagccagagacatatctctaccaccaccaccctgattcactcattcattcgttcagaagacagggaccaagcatctactatgtgccaggcactgagcttgcctagggtatgcatagaggacaaagtacaggtccttgctctgatggagcttgtaatcactttatactctctttctat

SEQ ID NO: 88668 - DNA, 601 bp, Human
tcactgtctggcaagacctggagaagttcactcttcacttacagttcagagtacaaaataagtaatcagtgtttgtcaagtagcctgaatataactggtacagaatctacacgacgctaagaactcaatcactgagaattcagccactgagaaaagggaatactgtatatttgacaattggttttaatgtccataggacgttctgagggcccacctggtctagcttccgaccaatctcaaacttgacaccaactactttgactgcagccttgaagcgacggtctctgtaactaagagtgayttctagagctgctcacagtacgggaataaggtgtctgagctgaagaaatgataccaaaaagcctaaaattgctggtggaggctttctttgaaaactctcactgccgtactgtgaggtttaatgtaagatttgtcctactcccatttctcacttttattgaacgatgctcacctgaagagatgctagatttctgagtgttcaggaagaatctaggtacatgtaccttgttaacacatgttattaaagcccatggacatcatttagggctttgcttggttccattttgctctatcatctcta

SEQ ID NO: 88669 - DNA, 601 bp, Human
agacagaagcagctaaggctggaaccaaataaatacaggttaagactgtcaatgggactctagtgggctcactgtctggcaagacctggagaagttcactcttcacttacagttcagagtacaaaataagtaatcagtgtttgtcaagtagcctgaatataactggtacagaatctacacgacgctaagaactcaatcactgagaattcagccactgagaaaagggaatactgtatatttgacaattggttttaatgtccataggacgttctgagggcccacctggtctagcttccgaccmatctcaaacttgacaccaactactttgactgcagccttgaagcgacggtctctgtaactaagagtgatttctagagctgctcacagtacgggaataaggtgtctgagctgaagaaatgataccaaaaagcctaaaattgctggtggaggctttctttgaaaactctcactgccgtactgtgaggtttaatgtaagatttgtcctactcccatttctcacttttattgaacgatgctcacctgaagagatgctagatttctgagtgttcaggaagaatctaggtacatgtaccttgttaac

SEQ ID NO: 88670 - DNA, 601 bp, Human
caaatgagggtaatatttatctcctttatagggttgctttgaggctttaaaacaattttacgtctggtacctgtatgtgaatgatgctcaataaatagtagttattattattacttatatacacatttgacagatgaaactggttcagagagattgcataacatgtgtaacaaggtaaataacatgtgtaacatttacacatgttacacataacatgtgtaacaaggtaaataagttctaaataatcaaagtgagagccaagcttattgggaacagcctgtttctaaggccaaaccccgcrgagctctataccactgcctccctccttctgtaagtaaaacagagttgtagatgtttgagctatgcccaatgtggggagcacatgccttcctgctggggaggccctgccagaagttttgtagcctaaggaactgcttgtttaagggaagagagaattagcaataatttttttggagaacagtttcaacaaagccttcgccatcagaggggatgtccctaggcacatggtggctctacaagcccgaccaagcctcccatgggcttatagatgaacccttgagagggtgggtgacatcatgcc

SEQ ID NO: 88671 - DNA, 601 bp, Human
caaaataagtgtccttgagtgaattatttaacttctctaacctttaattttctcatctcccaaatgagggtaatatttatctcctttatagggttgctttgaggctttaaaacaattttacgtctggtacctgtatgtgaatgatgctcaataaatagtagttattattattacttatatacacatttgacagatgaaactggttcagagagattgcataacatgtgtaacaaggtaaataacatgtgtaacatttacacatgttacacataacatgtgtaacaaggtaaataagttctacataatcaaagtgagagccaagcttattgggaacagcctgtttctaaggccaaaccccgcggagctctataccactgcctccctccttctgtaagtaaaacagagttgtagatgtttgagctatgcccaatgtggggagcacatgccttcctgctggggaggccctgccagaagttttgtagcctaaggaactgcttgtttaagggaagagagaattagcaataatttttttggagaacagtttcaacaaagccttcgccatcagaggggatgtccctaggcacatggtggctctacaagc

SEQ ID NO: 88672 - DNA, 601 bp, Human
ttgcaaaataagtgtccttgagtgaattatttaacttctctaacctttaattttctcatctcccaaatgagggtaatatttatctcctttatagggttgctttgaggctttaaaacaattttacgtctggtacctgtatgtgaatgatgctcaataaatagtagttattattattacttatatacacatttgacagatgaaactggttcagagagattgcataacatgtgtaacaaggtaaataacatgtgtaacatttacacatgttacacataacatgtgtaacaaggtaaataagttctaaataatcaaagtgagagccaagcttattgggaacagcctgtttctaaggccaaaccccgcggagctctataccactgcctccctccttctgtaagtaaaacagagttgtagatgtttgagctatgcccaatgtggggagcacatgccttcctgctggggaggccctgccagaagttttgtagcctaaggaactgcttgtttaagggaagagagaattagcaataatttttttggagaacagtttcaacaaagccttcgccatcagaggggatgtccctaggcacatggtggctctaca

SEQ ID NO: 88673 - DNA, 601 bp, Human
tttgcaaaataagtgtccttgagtgaattatttaacttctctaacctttaattttctcatctcccaaatgagggtaatatttatctcctttatagggttgctttgaggctttaaaacaattttacgtctggtacctgtatgtgaatgatgctcaataaatagtagttattattattacttatatacacatttgacagatgaaactggttcagagagattgcataacatgtgtaacaaggtaaataacatgtgtaacatttacacatgttacacataacatgtgtaacaaggtaaataagtactaaataatcaaagtgagagccaagcttattgggaacagcctgtttctaaggccaaaccccgcggagctctataccactgcctccctccttctgtaagtaaaacagagttgtagatgtttgagctatgcccaatgtggggagcacatgccttcctgctggggaggccctgccagaagttttgtagcctaaggaactgcttgtttaagggaagagagaattagcaataatttttttggagaacagtttcaacaaagccttcgccatcagaggggatgtccctaggcacatggtggctctac

SEQ ID NO: 88674 - DNA, 601 bp, Human
ttctttgcaaaataagtgtccttgagtgaattatttaacttctctaacctttaattttctcatctcccaaatgagggtaatatttatctcctttatagggttgctttgaggctttaaaacaattttacgtctggtacctgtatgtgaatgatgctcaataaatagtagttattattattacttatatacacatttgacagatgaaactggttcagagagattgcataacatgtgtaacaaggtaaataacatgtgtaacatttacacatgttacacataacatgtgtaacaaggtaaatacgttctaaataatcaaagtgagagccaagcttattgggaacagcctgtttctaaggccaaaccccgcggagctctataccactgcctccctccttctgtaagtaaaacagagttgtagatgtttgagctatgcccaatgtggggagcacatgccttcctgctggggaggccctgccagaagttttgtagcctaaggaactgcttgtttaagggaagagagaattagcaataatttttttggagaacagtttcaacaaagccttcgccatcagaggggatgtccctaggcacatggtggctc

SEQ ID NO: 88675 - DNA, 601 bp, Human
gttctttgcaaaataagtgtccttgagtgaattatttaacttctctaacctttaattttctcatctcccaaatgagggtaatatttatctcctttatagggttgctttgaggctttaaaacaattttacgtctggtacctgtatgtgaatgatgctcaataaatagtagttattattattacttatatacacatttgacagatgaaactggttcagagagattgcataacatgtgtaacaaggtaaataacatgtgtaacatttacacatgttacacataacatgtgtaacaaggtaaatcagttctaaataatcaaagtgagagccaagcttattgggaacagcctgtttctaaggccaaaccccgcggagctctataccactgcctccctccttctgtaagtaaaacagagttgtagatgtttgagctatgcccaatgtggggagcacatgccttcctgctggggaggccctgccagaagttttgtagcctaaggaactgcttgtttaagggaagagagaattagcaataatttttttggagaacagtttcaacaaagccttcgccatcagaggggatgtccctaggcacatggtggct

SEQ ID NO: 88676 - DNA, 601 bp, Human
agttctttgcaaaataagtgtccttgagtgaattatttaacttctctaacctttaattttctcatctcccaaatgagggtaatatttatctcctttatagggttgctttgaggctttaaaacaattttacgtctggtacctgtatgtgaatgatgctcaataaatagtagttattattattacttatatacacatttgacagatgaaactggttcagagagattgcataacatgtgtaacaaggtaaataacatgtgtaacatttacacatgttacacataacatgtgtaacaaggtaaataagttctaaataatcaaagtgagagccaagcttattgggaacagcctgtttctaaggccaaaccccgcggagctctataccactgcctccctccttctgtaagtaaaacagagttgtagatgtttgagctatgcccaatgtggggagcacatgccttcctgctggggaggccctgccagaagttttgtagcctaaggaactgcttgtttaagggaagagagaattagcaataatttttttggagaacagtttcaacaaagccttcgccatcagaggggatgtccctaggcacatggtggc

SEQ ID NO: 88677 - DNA, 601 bp, Human
acagttctttgcaaaataagtgtccttgagtgaattatttaacttctctaacctttaattttctcatctcccaaatgagggtaatatttatctcctttatagggttgctttgaggctttaaaacaattttacgtctggtacctgtatgtgaatgatgctcaataaatagtagttattattattacttatatacacatttgacagatgaaactggttcagagagattgcataacatgtgtaacaaggtaaataacatgtgtaacatttacacatgttacacataacatgtgtaacaaggtacataagttctaaataatcaaagtgagagccaagcttattgggaacagcctgtttctaaggccaaaccccgcggagctctataccactgcctccctccttctgtaagtaaaacagagttgtagatgtttgagctatgcccaatgtggggagcacatgccttcctgctggggaggccctgccagaagttttgtagcctaaggaactgcttgtttaagggaagagagaattagcaataatttttttggagaacagtttcaacaaagccttcgccatcagaggggatgtccctaggcacatggtg

SEQ ID NO: 88678 - DNA, 601 bp, Human
ttacagttctttgcaaaataagtgtccttgagtgaattatttaacttctctaacctttaattttctcatctcccaaatgagggtaatatttatctcctttatagggttgctttgaggctttaaaacaattttacgtctggtacctgtatgtgaatgatgctcaataaatagtagttattattattacttatatacacatttgacagatgaaactggttcagagagattgcataacatgtgtaacaaggtaaataacatgtgtaacatttacacatgttacacataacatgtgtaacaaggtaaataagttctaaataatcaaagtgagagccaagcttattgggaacagcctgtttctaaggccaaaccccgcggagctctataccactgcctccctccttctgtaagtaaaacagagttgtagatgtttgagctatgcccaatgtggggagcacatgccttcctgctggggaggccctgccagaagttttgtagcctaaggaactgcttgtttaagggaagagagaattagcaataatttttttggagaacagtttcaacaaagccttcgccatcagaggggatgtccctaggcacatgg

SEQ ID NO: 88679 - DNA, 601 bp, Human
gatttacagttctttgcaaaataagtgtccttgagtgaattatttaacttctctaacctttaattttctcatctcccaaatgagggtaatatttatctcctttatagggttgctttgaggctttaaaacaattttacgtctggtacctgtatgtgaatgatgctcaataaatagtagttattattattacttatatacacatttgacagatgaaactggttcagagagattgcataacatgtgtaacaaggtaaataacatgtgtaacatttacacatgttacacataacatgtgtaacacggtaaataagttctaaataatcaaagtgagagccaagcttattgggaacagcctgtttctaaggccaaaccccgcggagctctataccactgcctccctccttctgtaagtaaaacagagttgtagatgtttgagctatgcccaatgtggggagcacatgccttcctgctggggaggccctgccagaagttttgtagcctaaggaactgcttgtttaagggaagagagaattagcaataatttttttggagaacagtttcaacaaagccttcgccatcagaggggatgtccctaggcaca

SEQ ID NO: 88680 - DNA, 601 bp, Human
tgatttacagttctttgcaaaataagtgtccttgagtgaattatttaacttctctaacctttaattttctcatctcccaaatgagggtaatatttatctcctttatagggttgctttgaggctttaaaacaattttacgtctggtacctgtatgtgaatgatgctcaataaatagtagttattattattacttatatacacatttgacagatgaaactggttcagagagattgcataacatgtgtaacaaggtaaataacatgtgtaacatttacacatgttacacataacatgtgtaactaggtaaataagttctaaataatcaaagtgagagccaagcttattgggaacagcctgtttctaaggccaaaccccgcggagctctataccactgcctccctccttctgtaagtaaaacagagttgtagatgtttgagctatgcccaatgtggggagcacatgccttcctgctggggaggccctgccagaagttttgtagcctaaggaactgcttgtttaagggaagagagaattagcaataatttttttggagaacagtttcaacaaagccttcgccatcagaggggatgtccctaggcac

SEQ ID NO: 88681 - DNA, 601 bp, Human
agttatagtaactgtatttacactttaaccaagctgattttttatatttaagcaaaacagtcttcccatatcctctcctgaattaatgcagatttgtagctcacctttgcagctctttgcagaatgcatatgcattctgctaaacccagaaacttcaaagtttgacactcacttggtgttggagcagccctcatggaacagtccacatttaatttatagtcaccatccaagattacttttatttttcctgggtggaaacacactgccaacattactcatacactgaaaatgatactccatrtaagtgaccttcaaaatgcccatatgtcttcatttaacagacgtctatccactcttccatgccttttgaccaaatgcagcggaatatggggttcctttcttaaatggtttctacgtatccagatcataagcaacctgccatgcaaagaaactgtacaatattcactttaaacagtttctctcttcctttatcccccttcccccaccaatacacaaacaggggtaagcattttcctagactaagtttcctatttatctcatttctactcttttttgcttcttctcttctaccatggtaata

SEQ ID NO: 88682 - DNA, 601 bp, Human
tttataactatcactcagttagcccacactctatctccacaggtaggtcagtttttgtcccttgataatgaagataagaaaattgagatacagagttttccctacataacaggtagaataattttaatctgtggcaaggtcatttggcacaagggagggtggaaaggaaaaagtgaggaaatgcacaaaattgtattgggtcttcttacagtagctaatactgtagctaaaagaatgatattcccactttaagaatcaaaagaattacatttcaaatccacataaaattttattaataggygacctttccttgacaccatgcttctagactataatatgaataatgccttattttctgttccagtcaactgcaccgtgcagtttattatacaccacagccaggttacataagttatattttccataaacttttcctcctcctgaaacatcactctacaactccacactagcattttcctgttgtcttttcaaacagtattttccttcttgacagtgcaatcagcgtataaaaaccaaatttcaccatctggtcccgtttaaagcaaaccgagcagcctgaaccacagcctgacaaggagaa

SEQ ID NO: 88683 - DNA, 601 bp, Human
agtgtaagcagaaaagtctcttccacctgcttgctacaaggtttgattctgaggatagtgtactcccaaagacatacctctaaaggaaaaaaaaataccatttgattttctttccatttttaaaatctgatatcactaataataaattttatgtatttttcctaagtcaaagagagaaataccttattagtagctgtctgttgcttacactgaaacagccataagaacatattttaaaagctatgccttataaaagtgccttttttagaaaataaaaaaaagagagagagactgagaaatytgctaattgctctcaaattcaaatctccaatcaactgaacacaattgtaagtaaatagggcctctttgggggaaggtaatcctaattatgtggcaagctacagggacacccaagtttatgtcagtagcagattctgataagatatgcaccaaaggaatcatgtctggactgtttcaactgggagggtgttggtgtaatgttggtgtttagctgtgatctagagatcagcaaaggtcaggctggacaaaacagcgcctaatgaagcttctcgtgtttggggtgaaagagccacaaagcctt

SEQ ID NO: 88684 - DNA, 601 bp, Human
ataagtttataaagatgcatttttctggttgataattacatataatgtcaaaagatatctccacttagctactgcttcatatcaaatatacagtaaaattttaaactaaagcagaataatctctagcaattgagaagagtagggggagaatctacaaacaataacactgaaaagtaaggcttccctccccagcaaccaaaagcttgacaaataaatcatgcctgttgtttcattgctcaggatatttaaaatagtgtaagcagaaaagtctcttccacctgcttgctacaaggtttgattytgaggatagtgtactcccaaagacatacctctaaaggaaaaaaaaataccatttgattttctttccatttttaaaatctgatatcactaataataaattttatgtatttttcctaagtcaaagagagaaataccttattagtagctgtctgttgcttacactgaaacagccataagaacatattttaaaagctatgccttataaaagtgccttttttagaaaataaaaaaaagagagagagactgagaaatttgctaattgctctcaaattcaaatctccaatcaactgaacacaattgt

SEQ ID NO: 88685 - DNA, 601 bp, Human
agacattgaactcaagaatattgaagcagtctcaaagcaggagaaaacttcagcttgcatgcctaaaagcttatccacatgtcaagggccgtgggacattttcccagagggcctggacaagaagcctccctggtcttcttatcctaaactaggctgaatggaacaccagggaatatgctggagggagggagatcacactggccaaaagggtggaaaaagtgatgcaatcagagagctctttcccatctctaattttatgactctaaaaaggaaagagaattcaaaccacttcaaaataagrtcaccggagacctgacgtagaggactggatctgttgaaaaataagtttataaagatgcatttttctggttgataattacatataatgtcaaaagatatctccacttagctactgcttcatatcaaatatacagtaaaattttaaactaaagcagaataatctctagcaattgagaagagtagggggagaatctacaaacaataacactgaaaagtaaggcttccctccccagcaaccaaaagcttgacaaataaatcatgcctgttgtttcattgctcaggatatttaaaatagtgtaag

SEQ ID NO: 88686 - DNA, 601 bp, Human
gatgaattagatagatttttttttcactttacacccatcttgtattcctggtataaatccacattgatcataatctattaacctttctatatgttgttggatttgatttgctaaccttccggaaagtattttagtttctgctcatgaggcatgttattctgtaatttttttggtaacacatttttgttaggttttggtattaatgtcatgctggctataaaacatgttgggaagcatttcgtcttcaaatttcggaaagattttctgtaagatttcattacttcttctttgaatgtttaawtgttgatatctacggtggacggtagctcggatctcagtttagacactttcaatctgcccctacatgcatgactcagggtccagagactttgtagaatatacacaaagaatttggtgtttctcttatttagctctctctttttttcccctaggattccccctcactctgtggtggctctggttactctgagcgttttcaaatggtttctcctgcccaaaagagtatgggctgtctgtcagaattttagccatatcatgaaaccgttttactaaactgtggctaccctccagaaaccaacag

SEQ ID NO: 88687 - DNA, 601 bp, Human
ctattgtgtgtgcagtggtatcttgctatggttttaatttgcatttcagccatgactaatgttttttaacatcttttcatatacttgttggccatttggatatatccctttatgaagagtcaattcaaacttctgagcattttttattggggtgtttgtcttttttattagtgggttgtaagactcctttatgtattctggatagagatttacataatatccagatttataggttgaaaatatgttcccctagactatgttccccaagactatggaccacattttgatttttgtaatgatrtctttcaaagactgaaaattttaaaattttgtcattattttcttcagtggtttatgttgtttatgttttttgtgtccgaatctaagaaattttgcccattccaaggttgcaaagattaagttttcttctagaagttttatagatttcattttttaaaaaaatttaagtgtaagatctgttttgtaattatttttgtatgtggtatgaggtaaaggtcacggttttccatattgatatttatctgtccaggtaccatttatcgaagactactgtttcctcattaaattgccttgaaactgt

SEQ ID NO: 88688 - DNA, 601 bp, Human
cccacactgattggtccaaagaaaaacatgcaaatcaagctaaaacaatgagagtctcttgactgaatgtaaagctcaaactgccagcagccaccacaagaggagtctgtctacagatgaagccaacacttaaagacccagccaataataagaaataagaagtgaattccaataataacattggtatctggatcaagctattctcggtgttggtcatccctgaggacttctaagttatgtaagccagtaatttccaatgttttgagtcattttgagttgatgtcttattacttgcagccaraagtgttttaactaatatgcccctcttgctttgctgctccaagatttcaagcacaacaaaacaaaaaactgcataacttgacagattagagaatgttgctgatacaaactgaagttttcccttaatactgaaagcaataatagccttgaatgtaagttatggtgagcatggttctagaaaggttattctttgatatctaagatggatagatatgaaatctagaattgggttgttttgtttaagaagacttggatttattttcatcttttttctctcccactacagaagtgactgatataa

SEQ ID NO: 88689 - DNA, 601 bp, Human
tccatcttcctgcatctttctgctccttctgattcaagacagttaccatgttgtgagctgccctgtggagaggtccatatggcaaggcatagaggaagggcactggccaatagtaaacagaaaacccagaaaaccatgagaaactgaggccttcagtccaacaacctgtgagcaactgattcctatcaacaaccacctgagtaatgttggaagtggattccacccaagtcatgccttgaaatgagaccactattctggacgacatcttcattactgtcttgtgagaaagactgagctagargacccagctaagctgcaccttggttcctgacccacagaagctgtaagataataaatgtttgttatttaagaagctgcattttgtggtgaattttttacatagctatagctaaccaatacagccacactgtcagattgctgggcttaatggaagtttaagaaggcatttaccattccaggattttcaattcatcatcaccaccaccacggttgagagtgttctagcttcctgtgccatgaacagatggccatggtccttggaaaaagaggttggaagacaactaggaccaggaacttaaaa

SEQ ID NO: 88690 - DNA, 601 bp, Human
atttgggtatatctacagaatatgtctctcaaattaagcggtaaggctaggcgcagtggctcctgcctgcaatcccagcactttgcgggggcaaggctggaggacagtttcagtctaacaatttgagaccagcctgggcaacataagatcccatctctacaaaaaactaaaaaaccagccagaggttgtggtgcatgcttgtggtctcaactacttgggggtctgaggtgggaggattgcttgaacctggaagcttgaggctgcagtgagccgtggtggtgccatagcgctccagcctagrcaacagaacaagggcctgtctcgaataataataataataataataattaagcatgaaaatgaagggagaagaggaccttagttgcagtttaggatactgtgactcaacagagattttcaacctgatgctcacagagaggtttcacacttttgctccaagtaccttcacaacccaagtgtccatcaacaaataaatggataaacagcatgtgatgtatacatacaatgaaatattattcagccttacaaagaaaggaaattctaacacatgctacaacatggatgaactttgaaagcatca

SEQ ID NO: 88691 - DNA, 601 bp, Human
gtcctgatttgctatctttttctcttagaaccataacccatggatttttgaaggacaactaatcaatttaatgcccagactcagaataatctctataaaccacatgcaaccaaatgacaaaaaaaaaacatttttcagggttgctaaagtcaaagcgtgattcttgtcaatcccagctacagtgcacgccatttgtgcacaacatttgggtatatctacagaatatgtctctcaaattaagcggtaaggctaggcgcagtggctcctgcctgcaatcccagcactttgcgggggcaaggckggaggacagtttcagtctaacaatttgagaccagcctgggcaacataagatcccatctctacaaaaaactaaaaaaccagccagaggttgtggtgcatgcttgtggtctcaactacttgggggtctgaggtgggaggattgcttgaacctggaagcttgaggctgcagtgagccgtggtggtgccatagcgctccagcctaggcaacagaacaagggcctgtctcgaataataataataataataataattaagcatgaaaatgaagggagaagaggaccttagttgcagtttaggatac

SEQ ID NO: 88692 - DNA, 601 bp, Human
ggtgcacatgtgtcctgatttgctatctttttctcttagaaccataacccatggatttttgaaggacaactaatcaatttaatgcccagactcagaataatctctataaaccacatgcaaccaaatgacaaaaaaaaaacatttttcagggttgctaaagtcaaagcgtgattcttgtcaatcccagctacagtgcacgccatttgtgcacaacatttgggtatatctacagaatatgtctctcaaattaagcggtaaggctaggcgcagtggctcctgcctgcaatcccagcactttgcrggggcaaggctggaggacagtttcagtctaacaatttgagaccagcctgggcaacataagatcccatctctacaaaaaactaaaaaaccagccagaggttgtggtgcatgcttgtggtctcaactacttgggggtctgaggtgggaggattgcttgaacctggaagcttgaggctgcagtgagccgtggtggtgccatagcgctccagcctaggcaacagaacaagggcctgtctcgaataataataataataataataattaagcatgaaaatgaagggagaagaggaccttagttgca

SEQ ID NO: 88693 - DNA, 601 bp, Human
gttcaccaaaaccacaggataccatccaaactctctcacccggcacatgaggcccttatgaccttctcatcttaccacacatgtcctgcattctaacttgcttctactcattgggcatgctgccctttctgccttaaatatcctcttccagattcgtctcagtcttcctgaagcttgtccttacccaagctgaattgggtgctcatcatgtctgtctcccaagtcatcttacaaaattgctgtagcacttgtgacagtctgttaaatgatctacttctctctctcttttactaagaggctwataaggttttctggggacagtattttaatttgtccattcccatattcccagcacctaggactgtgcctgacattacagtgagcaggcgttcgataaatggtagttaagttaatgaacaaatgaaacttgagaagacacaggaataagtttctaccattgatgcaggggtgcacatgtgtcctgatttgctatctttttctcttagaaccataacccatggatttttgaaggacaactaatcaatttaatgcccagactcagaataatctctataaaccacatgcaaccaaatgacaaaaa

SEQ ID NO: 88694 - DNA, 601 bp, Human
gcctggtggcttatttctacttccagactcatgttgctacattctttatcctaacccttagtaccatgttctagtttcaatggccgcttctttccttgcttctttcccacctcctctgcctctagccatcctgcatagaccaatttttaacctctaagattctctccataaatatacctccacagataatggaagaaagaagcttgcaggatgtgccacctagaaagggtgcccagctatatcctgagaaaatcatcaaacgtttctcacaatagggctccttggaaaaagactcaattartggttcattatcagattactagagaatcatttaatattagccagcaagccagaaatttaatcttaacttctcccttgccctcagcccattagttctaaacctttcaattctgtcttctccgcttgtcttgggtctttctttcctgttcacctcacgtgatgatgcttcaaagtaagatcctcaacatcttgttcctggacaattataacattcctggtctcacttccttcccattcccttcatcttagtccacattgctgctagagttctttccaaaagataaatatagccaaataattg

SEQ ID NO: 88695 - DNA, 601 bp, Human
gaaaagaaagaaaagatgcccaggcaagatatacaaataaaaatattaatcatataggaacctccatattgtgtctgtgtgtgtgtgtaacacaatcacaccaggaactctgttcaccaaaaccatggctacctcatgaggggtcagtattatcttcaatgattacacaacactggtcccaatcataaacctgaaaataggaggcatttatgctctgatcccccagattcttccagggacccttgtaattcactccaccactggatctttgcctttcacaccatgcagacttaacagcaasctgcatagccagccctccctacaccttccccacttaccttccttatcagttcaggaagaaatttctgcaaaactcttcccctggtcactgatatctctgggaaccaaatccattaagatatttttgatccttactcatgctattttgaatgtctggtgcacaggaaggaaccgataaaaatagaattacaatgcccttaccgccaaagtagcaaaggagctgattaagattgatgtctgaataaatatacaatagcaggccctacatttaatagtctttgatggaagtggaaaagaagtg

SEQ ID NO: 88696 - DNA, 601 bp, Human
gaatggaccaacaaccacatcctacagctctccccagaggcccccgatgcaagtaaaagatgccatgtattacaacagtgtatcccaagcttcagtcctcatgtactagagtcatgattcattagctacatctgtgtaccacctgtactaatatttactaagtatttctctacatatggtatcacttttattacttaaataaatttatcctcatcctaaacaagaatatccatgaaatcacaaatatggcatactatacacacacacacacacacacacacacactctctctctctctctctctctctttcaatatgcatgcaataaatacataattactaaagaacaaatgtgcacctctgcaccacctaagattgtgtcacacttcaccatgtggcatagcctaccactgtatgcattgctgtaagaactatagttgttctggatattctaatctcattttctcttcccatcaatctcagtttacaaactttgataactttttgatgatgactagtctgaatataaaatggcattaagggagagtgaaagagaggccaaggggaaaaagagggtaaaaggaggagaagaggtaaaataa

SEQ ID NO: 88697 - DNA, 601 bp, Human
tggaatggaccaacaaccacatcctacagctctccccagaggcccccgatgcaagtaaaagatgccatgtattacaacagtgtatcccaagcttcagtcctcatgtactagagtcatgattcattagctacatctgtgtaccacctgtactaatatttactaagtatttctctacatatggtatcacttttattacttaaataaatttatcctcatcctaaacaagaatatccatgaaatcacaaatatggcatactatacacacacacacacacacacacacacactctctctctctctctctctctctttcaatatgcatgcaataaatacataattactaaagaacaaatgtgcacctctgcaccacctaagattgtgtcacacttcaccatgtggcatagcctaccactgtatgcattgctgtaagaactatagttgttctggatattctaatctcattttctcttcccatcaatctcagtttacaaactttgataactttttgatgatgactagtctgaatataaaatggcattaagggagagtgaaagagaggccaaggggaaaaagagggtaaaaggaggagaagaggtaaaat

SEQ ID NO: 88698 - DNA, 601 bp, Human
cttggagatcacttggaatggaccaacaaccacatcctacagctctccccagaggcccccgatgcaagtaaaagatgccatgtattacaacagtgtatcccaagcttcagtcctcatgtactagagtcatgattcattagctacatctgtgtaccacctgtactaatatttactaagtatttctctacatatggtatcacttttattacttaaataaatttatcctcatcctaaacaagaatatccatgaaatcacaaatatggcatactatacacacacacacacacacacacacacacwctctctctctctctctctctctttcaatatgcatgcaataaatacataattactaaagaacaaatgtgcacctctgcaccacctaagattgtgtcacacttcaccatgtggcatagcctaccactgtatgcattgctgtaagaactatagttgttctggatattctaatctcattttctcttcccatcaatctcagtttacaaactttgataactttttgatgatgactagtctgaatataaaatggcattaagggagagtgaaagagaggccaaggggaaaaagagggtaaaaggagga

SEQ ID NO: 88699 - DNA, 601 bp, Human
aaggctagatcaacacatatgggaggagagccaggtgagtgcctttggagacaggggtgagggtgaagggcttccagacacagtcaagattaagcaggagggggattcctctagaatgaaaagggagggattgtctggagtagtgaggactcagctggaattcctggcaagggggcaggcttagtgggggagtgacaagctctcagctggcacagctgtgtgatgtcccaaatcatgccatcactcccagcttgggaagggatccccaagcccaagtcagtgaaaacagagacattgcctrattttaagggcccagtacctgatggatactaacagaggacccatcagcagtggccagtgtggaccacagtccagagggctcccaccaaatggcctggatctcccccaggccctgggctgggagccaaggtcgagtgaacccccattacaagtgcgatctaattctttcccactccaagagacaagactcagatttagatttacttctactctaaaaacaaacaaacaaatatattgatgtgaaatttcttgcatctgcatatcatagaataacattcacacctgctacacatgtttaaat

SEQ ID NO: 88700 - DNA, 601 bp, Human
taactccatgagtgcacactctttgctcttaagcctgcaaaagaagaatagatctataactattgaatgacaaaaatgaaaggtattattatttgttcctgtggatttctatatagaatctaagcttctgacctacaaattttagtctctgaaacttaatagacttatcttccccctttgaatcaggattcagctaagagagcaaggtatgatagagtcaggtaattcaatctaggaattaatattaaattggagcattactttcaaaagtgttagaagaggaatgtggatttagcaaccraaagatgctgcaccctgccatggggctggagtgatgaaaggaagaggtgctgctcagctggaggccaggagcaccctgacatccggtccaatggtgggctgtccagctggatccattgaggaaagggcccttcagggatcgctggaccctagatggcagaggtcaatctgccctttgatgcagaggggagcagggcaatgaggaatggggctgaatgcaaagagcaaaggatcagggtagccattgagttttaaaacatcaatactgaaggggcagtgatgcaaatgaaccaaaggttag

SEQ ID NO: 88701 - DNA, 601 bp, Human
agtatacatgggggtcctgcaaccaatcctccacatatactgagggatgactgtatagggcttcagtgtctttgaaagctacatccaagcttatagtaattacaaggccttccccaaatattaaaataccatcctattttactcctgtgcacagcacttctcagtgcctgatattcttttacttttcttttcagttggcctgttccttgctagaatgtaactccatgagtgcacactctttgctcttaagcctgcaaaagaagaatagatctataactattgaatgacaaaaatgaaaggyattattatttgttcctgtggatttctatatagaatctaagcttctgacctacaaattttagtctctgaaacttaatagacttatcttccccctttgaatcaggattcagctaagagagcaaggtatgatagagtcaggtaattcaatctaggaattaatattaaattggagcattactttcaaaagtgttagaagaggaatgtggatttagcaaccgaaagatgctgcaccctgccatggggctggagtgatgaaaggaagaggtgctgctcagctggaggccaggagcaccctgacatc

SEQ ID NO: 88702 - DNA, 601 bp, Human
tagttctgcgaagtggctggccatcattttgaaagcctaaggagacagcatgcctgaggatggagccaacctgtgagaaatggagctcagaagtgtaaaggaagaaacagtatctgggttacatgttaaggccacatcaaaatctctaaagccatatctacctttgaagttttaaaatatggagacaatagattgcatttgtacaagattgtttgggttgacttttcttaacataaaattgcatggaacataaaaatcctaactgatatgggattatgtctaaactgttattttatatatrtatatatacacacacacacacacttaaatgaaataacacataatttgaaccctacaatggtgaattttagaaaatataggtcagggaagagctaggttgaaatttacccacgcaatacctaaaaaacaaaattcaaagagacatttaaactatttgactaaaaactggtatatagcaagtgttcaatataaatttgattagttatatcgacatatatctatgataccttaataacaatgtaaatattatcctaacaagtaagtgatatgataaatacatcagcttgtttaagttgatctt

SEQ ID NO: 88703 - DNA, 601 bp, Human
aaaggaaatggcttgaactatctggaggcaaacagcagcaaggaggctttatttgagagtcagcctggcgtctgcttcactttgtagaccacatggccactgtgggaatgagaaagcactgggagcttggccgttacaaaggcacacggggcattttgtacttggcacacacaagatcaggtacaccctaaaaggaagcagcaatggacagatgggagtttcacaccctgcttatagcattttctgtttaaatccagagggtcctgtatcctttgtgaatgctggcttttcttctgcattwtgccatagtttttgcttttttcttcttgtcttcttttgatacatttctgcttcccgtggcgacaatataagtgcagtgtccaactttccccctcaccccaaaaatggagaaaaacctttactgacaagaatcaggctgggcgtggtagctcatgcctgtaatcccagtactttggaaggctgaggtggaaggatcacttgaggccaggagtttcaaaaccagcctgggcaagagagtgagattcctgtctctacaaaatttttttaaaaagttagccaggaatggtggtgcacctgtagt

SEQ ID NO: 88704 - DNA, 601 bp, Human
gtaaaggagtttttgttcaatcctcagaaatttaaatttacccaaacaccccacctaccaaagatgcctgtttatctgtattgtgctactttctgtgcacaatgttagcacattcataaagaaatccatttcctaaagtgagactttgctgcgaccacagaatatctggtttgaaatacacaacatcactatgacaactctaattttataataagaaaacccacaaacatcccagcctagaaaataaaacctaaactatggcttttgaaatactgagtctcttgaggtttttctgcaactrcaaatgttcaagacttcacaagatgaaagccatggtagcgccttgaggtcacatgataaggggaggccttgacaagatcataaaatattcagtatagcagttttcaaatccacaaagcttcacatagaagctctctctctctggtatcatattattccaagaagtagaacgagttaacagttacctgaaatcagaactaatgtcctcctgctccctcctcttggcccaaacctgccatatgtgtggtcaggttgggtaacatacaccagtatcaaacatttctttctctttggaaatcct

SEQ ID NO: 88705 - DNA, 601 bp, Human
ctcgatctcctgacctcgtgatccgcccgcctcggcctcccaaagtgcttgcacagttcttaaggtaaaggagtttttgttcaatcctcagaaatttaaatttacccaaacaccccacctaccaaagatgcctgtttatctgtattgtgctactttctgtgcacaatgttagcacattcataaagaaatccatttcctaaagtgagactttgctgcgaccacagaatatctggtttgaaatacacaacatcactatgacaactctaattttataataagaaaacccacaaacatcccagcctagaaaataaaacctaaactatggcttttgaaatactgagtctcttgaggtttttctgcaactacaaatgttcaagacttcacaagatgaaagccatggtagcgccttgaggtcacatgataaggggaggccttgacaagatcataaaatattcagtatagcagttttcaaatccacaaagcttcacatagaagctctctctctctggtatcatattattccaagaagtagaacgagttaacagttacctgaaatcagaactaatgtcctcctgctccctcctcttggcccaaacctgcc

SEQ ID NO: 88706 - DNA, 601 bp, Human
ctcatacgtgagtctccccagaatctctgtccccagatacaatttgatgacacatatgaatcaatcctaacacattaaattcctaatgtccaaatgttgagagcaacctctgctgctgccgtaccaaatacttatcgggcagggctggaatgtaagaaatggagccccacatacgataagcaattcatgccacagtgcaaggagctctactgtgagagctgaagccccaggctctcatgtgggctctttcaaagcagcatctccaatttgttcctcagcttattttctctcgtgcctaatragagattaagatgaaatgatctcaaagggcctttctagttctatgcatggagaaaatgttttgagggtggaagagaaaaagttagaaaataaagaaggaaatcataagatgctagagatggaaagaaacactgagatcagagagtacaaccttgccatttaagtacgaagaaagtgaaagtcaatgggaaaagaggacaccctaaattatggaaccagtaattgaaccatgtatataattggagtctccctaagtttcacatcaaccctcattctataacacagagcagaatgcacttga

SEQ ID NO: 88707 - DNA, 601 bp, Human
tgacttctgttggtctggggaaaaagcttatcagcatttatggagtacagcaacatgctttgagaatgcacatccagcaatgttccctggacatgttctaaaggaactctgagaacaagaaaaagtggagacacaataagggagaggtttcctgccctggtctgtgacaggttccaataatgaaggggctggatccttactgatgtcataagcccgtactataaaagctcaaaaagagcttcgcatttatagatgagtctggcattttgacttcctaattttccaaaaaaaaaaaaaaaasagttccttctttttaaattgctgaaagctgatatcgcaagaagcttaaaattaccccctttgtattttcaaattgttggtatgtgtcccaagtttgcaaagtttcaaactctaataataccaacaagtaaagaaagatccatgagctggtatttacttggtgcccattaaattccaggaatcgttacatgtaagatcgtatttaatccacaaactagttatttcacaacctttatgttgataaggctcagagaggtaaggtaacctgcctagggttccacagttaataaattcccaaacc

SEQ ID NO: 88708 - DNA, 601 bp, Human
atgacttctgttggtctggggaaaaagcttatcagcatttatggagtacagcaacatgctttgagaatgcacatccagcaatgttccctggacatgttctaaaggaactctgagaacaagaaaaagtggagacacaataagggagaggtttcctgccctggtctgtgacaggttccaataatgaaggggctggatccttactgatgtcataagcccgtactataaaagctcaaaaagagcttcgcatttatagatgagtctggcattttgacttcctaattttccaaaaaaaaaaaaaaaacagttccttctttttaaattgctgaaagctgatatcgcaagaagcttaaaattaccccctttgtattttcaaattgttggtatgtgtcccaagtttgcaaagtttcaaactctaataataccaacaagtaaagaaagatccatgagctggtatttacttggtgcccattaaattccaggaatcgttacatgtaagatcgtatttaatccacaaactagttatttcacaacctttatgttgataaggctcagagaggtaaggtaacctgcctagggttccacagttaataaattcccaaac

SEQ ID NO: 88709 - DNA, 601 bp, Human
aaagaggactaaaaagaagtagcctagcactcactttctgttttttagcccagttttttctcatgggtacagaatattctggacctttccaatgccttaaacagtgccataatggtttcatatataagaccctttacactagcactgtctttccaggaaggttaggctcttaaagcactccatgggcactaattattcatgcaatcatacagctagcaataagaacaaaaatggtttggaatgacaaatacttcacaataggaactaattcacacctggaaaaaagtgatccgtattcctkttaaaaattaatacttcatcaagaggagtaagctatagagagaaaattccattcctggtgggggtcaatcttcttctcactctttctttgataaattttcttctctgtcctttcacttatatgacttctgttggtctggggaaaaagcttatcagcatttatggagtacagcaacatgctttgagaatgcacatccagcaatgttccctggacatgttctaaaggaactctgagaacaagaaaaagtggagacacaataagggagaggtttcctgccctggtctgtgacaggttccaata

SEQ ID NO: 88710 - DNA, 601 bp, Human
gcggtaaagcagagttgataaattcattcattctcattttctttctctctttctctgtgtttctccccaatcctgtgtgtgtgcgtgtgtgtgtgtgtctgtgtgtgtgtagtacaggactgttgtagaggaatccatgtacttgatggttagataaactttaagcaatattacaatcctgatattctgtaaccctaagaatcaaatagaaagaggactaaaaagaagtagcctagcactcactttctgttttttagcccagttttttctcatgggtacagaatattctggacctttccartgccttaaacagtgccataatggtttcatatataagaccctttacactagcactgtctttccaggaaggttaggctcttaaagcactccatgggcactaattattcatgcaatcatacagctagcaataagaacaaaaatggtttggaatgacaaatacttcacaataggaactaattcacacctggaaaaaagtgatccgtattcctgttaaaaattaatacttcatcaagaggagtaagctatagagagaaaattccattcctggtgggggtcaatcttcttctcactctttctttga

SEQ ID NO: 88711 - DNA, 601 bp, Human
gactacaagcaattatcatggaaaagagaagacacttgatctctcctctctttctctttgtgctttaagaaaaaaggctgccttctggagtgaattttggcaatagttctatttttattattaaaatatacatttgaagcataaaaggtgttttccattcatacattaaaaagaaaaagctaagtatatatccttatgttactccagcgccctttgttttttaatgccaaaaggtggcttctacaacttacgctttcctccccatatgggatggtaggcaaccagaattcatgcctgtgcrcttcatcaacggtgtaaatcaattaagcatcccgattctcccctggaatgtgtccctttccagatcagcttggcttaacatgatgaggtatgggagctccccactcacaaaggtaaagagccctcacctgggtagtcctaccatgctcagaactgcctctgggcacatgcagcactcgttaacctgacagccgttctgctctgcaagattgacatagtgacgctttgaccaagaggctccatgactctgtttctccactctaacacagacaggacgctgccctgggtaatgtttcatcac

SEQ ID NO: 88712 - DNA, 601 bp, Human
gaagaaacttaaatgtactcaacacatttagatcctgcctggattttcactagcctctgatttaattccacaccaaatgctactgcataactggacagagcaaagcctctagtatttacactggaggctaaggtctgacattctgtctaaatgaaatttcccagttgtcccaagaagtttttaccttgtttccatgctagcagtttgaaacgtcactacatattgctgcaatgacaggtgagcaaaaaccaaccctggcttggctggtgctcagagcaaacaggcctgggaaccagcctastgttttctgccccattcctgctgaggcactggcccatactctgtcccaccaaccaacatcgccaagggggcccacaagctctgccagtgaccctgtcaaaaggccagttagcagggactacaagcaattatcatggaaaagagaagacacttgatctctcctctctttctctttgtgctttaagaaaaaaggctgccttctggagtgaattttggcaatagttctatttttattattaaaatatacatttgaagcataaaaggtgttttccattcatacattaaaaagaaaaagctaagt

SEQ ID NO: 88713 - DNA, 601 bp, Human
gctgaggataataaagatggcctttgaaagtcatgacctagtttaaaaaaaaagttgcctgaaatttgataatttgatccctgaaacataaaaagcgtttgcaatagaatgaaaatgaccctgttctctctcctttttaaaaaatcctgtatctgaaaaatgaatagaatggtgtgtgaatatatgcagctcacccttctagagctgaaatcctgcttgcttattcaagaatatgggttaggttgctgggcaaatcaaaacaactagtgctgggccagattctgaagaccaaagcacttaraaaaaatcagagagcctataagctcttcattttttattctgtgatagagaatctagcgatcatattcctattcaagactgttagggcctcttccaggtagttgtcagtgccaaagggtggagaagcataaggtttcctaaattagagaagaaacttaaatgtactcaacacatttagatcctgcctggattttcactagcctctgatttaattccacaccaaatgctactgcataactggacagagcaaagcctctagtatttacactggaggctaaggtctgacattctgtctaaatga

SEQ ID NO: 88714 - DNA, 601 bp, Human
acaatgggtttactggcgtactgtgataaatggctgtctaacatccttcaacaatagccgggctacagccataaccacgatgtgtataaacactacatcagtttaacaatacacagtgctgaatagcaggaagtgaaggcaaacattttccccgagcattttttgtatgtgtgggggtggaaataaaagaaaaaaaatcaccagaggaaaaaaaattataaatttttttttacaagtttaatgtttctgctgaggataataaagatggcctttgaaagtcatgacctagtttaaaaaaaaagttgcctgaaatttgataatttgatccctgaaacataaaaagcgtttgcaatagaatgaaaatgaccctgttctctctcctttttaaaaaatcctgtatctgaaaaatgaatagaatggtgtgtgaatatatgcagctcacccttctagagctgaaatcctgcttgcttattcaagaatatgggttaggttgctgggcaaatcaaaacaactagtgctgggccagattctgaagaccaaagcacttaaaaaaaatcagagagcctataagctcttcattttttattctgtgatagagaat

SEQ ID NO: 88715 - DNA, 601 bp, Human
ttttaccttggcaaggagactattgttgcttgaaaacaaaaggaatctgcaccttaatcctgatgacatttctataggaaccttatttacagtatgtcaaaatcccgttctgctcttacagcctcattaaatctaagcctcatttaactagtaggacatttttacaatgggtttactggcgtactgtgataaatggctgtctaacatccttcaacaatagccgggctacagccataaccacgatgtgtataaacactacatcagtttaacaatacacagtgctgaatagcaggaagtgaargcaaacattttccccgagcattttttgtatgtgtgggggtggaaataaaagaaaaaaaatcaccagaggaaaaaaaattataaatttttttttacaagtttaatgtttctgctgaggataataaagatggcctttgaaagtcatgacctagtttaaaaaaaaagttgcctgaaatttgataatttgatccctgaaacataaaaagcgtttgcaatagaatgaaaatgaccctgttctctctcctttttaaaaaatcctgtatctgaaaaatgaatagaatggtgtgtgaatatatgcagc

SEQ ID NO: 88716 - DNA, 601 bp, Human
cccccaaaaccactttttttggttttcaattttctgtggagcccctgtgcatgtaaaattaaaaatatcaattaaatctgtatgttttttctcctactaacctttctagtgtcttttgaattcacaggcgccagccacaaaacataagagggtagaggaaagggtcttttttcccccttctttattcccctacaatatgaactcattacttttttccaaaatattaattgagcatctgctactgccaggccttgtcagacctgaagatgcagtggttaatcaaagagcctaaaacccgccytcatggggttccaagagtcctactccttgtctatatcagaataataaagacaacaactaaagcaaaatgagtaaaaatagacattgtgtataagttattcctttatttcaggtgtgacacagagtaatttgtatatattatctcattgattctcacaactctcctataaattagatgcagttattggtctcattttacagatgaagatctcaacttggagaagtgaagtaaaccactgataaccagaattgagcaaatgggggaactgggatttttgacaatagctgactctggttccaa

SEQ ID NO: 88717 - DNA, 601 bp, Human
tagtgtaaccttttttcttaattatggtaaaatatgcataacaaataatttatcattttaaccatttttagtgtagttcagtggcattaagtatactcacattattgtgcaactatcactaccaaccatcttcaaaatttgttcatcttcccaaaccgaaactacgcattaaatgataacccccttcacccctagcccctggcaactgccattctactttccatctttatgaatttgaccactctaagtacctcatacaagtggaataatacaatatacgttcttttgtgtctggcttacytcacttagcataatgtcttcaaggctcatccatgtagtagtatgtgttaggatttccttctgttttaaggctgattaatattccattttaggtatctatgttttgtttattcattcacctgtcagtggacacttgaggtgcttccaccttttggctattgggaataatgctgctatgaacctggctatacaaatatccgttcaagttcatgcagtctttaagcaactactctcttccctagtgtcactattaccatctctaaagtggtgacagtggcatgtgtacatgtgtacgttcttg

SEQ ID NO: 88718 - DNA, 601 bp, Human
tttatttctcagggatttctgggagtcaatgatcatccacattgggataaaagaacaggacatatggcaatttcttaacagcaaatacattaatttcttttcctctttgggaattgtgaaattaagtttgggagagatgaacagttcctttaaagcttccatcttctctttcactcctttcccctgacaacacctagtctaggtatgcagtcattgcctgaatgacctgtgacaaagaaaaaaaaataaagagagcaaaatccaggctggcttcaggacaatgtccactaggagactcccyggctgaggaagggctctgggtatgtaagactggcagagctggaatgttgttcaaccctctcttataaatggaaaacaaggctcaaagggctaacatgatttgttgaagaccttcgactaatacaaaggaactaaattccatgcctgctgactcccagaccaaacatctttccattctattgttagactggtattcaagggatttgcattccagtctagttgtcactaattagtgtaaccttttttcttaattatggtaaaatatgcataacaaataatttatcattttaaccatttttag

SEQ ID NO: 88719 - DNA, 601 bp, Human
atccttgtgttaagtgaaaagtttgctcttaaggcacagaaaggtagaataaatgatactgagagagagaactgacccggcatgatctgcattccacctgcgttataacgtaatgaaaatgaagccatgtgctcggggcagggttgtcactttcaattgctccaaattgttttgcttgtctcacaaaatgcttcaaacacatcaaaagcacttaccttcctgaagaaggagtccataacaggactggaaattaacagtggtttctaaattactctcaaacacacagaacatcattctattttttttttttttttttagaaaaaacacatttttccaagatgacctaattccatgatggctaaatccatttaaaacaaacattccaaataaactcacctcagggctgaaacaagaaataaaatgtacatttactgtgatttcaaataatgttacaagttaagacttaaaaagaggaaataaattaactcattaaaaatatttattataatcttgctcctttctacgttattttttggttctttatctgcacattttgggctgtgttggtttctgagaatcttccccacttgtttaatttctt

SEQ ID NO: 88720 - DNA, 601 bp, Human
tggctattcactggaaaagcaaaaaagaagccaaatggatagcatccttgtgttaagtgaaaagtttgctcttaaggcacagaaaggtagaataaatgatactgagagagagaactgacccggcatgatctgcattccacctgcgttataacgtaatgaaaatgaagccatgtgctcggggcagggttgtcactttcaattgctccaaattgttttgcttgtctcacaaaatgcttcaaacacatcaaaagcacttaccttcctgaagaaggagtccataacaggactggaaattaacagkggtttctaaattactctcaaacacacagaacatcattctattttttttttttttttttagaaaaaacacatttttccaagatgacctaattccatgatggctaaatccatttaaaacaaacattccaaataaactcacctcagggctgaaacaagaaataaaatgtacatttactgtgatttcaaataatgttacaagttaagacttaaaaagaggaaataaattaactcattaaaaatatttattataatcttgctcctttctacgttattttttggttctttatctgcacattttggg

SEQ ID NO: 88721 - DNA, 601 bp, Human
ttttgtgtttacttgaagatagtatgaattactgacagttctcaccatacgaatgactgcataacgaaacaacaaactcatcttaagcagagatgaacccaccttatgcttctccatagtaatccgaggcttggaacagtacattgccctcaatccacatttgatgaatggatgaatgcaaattgttaagggatacaagaccttctggaaaaagcactagtttcaaagcaaaataaatgtcttttttgtgttattgctatctcacaagagttaaagccaaaaaattattttaaaagaaaaytgactaaagcttattatagtaagttcaaaaacaagtcgataagcaaatggctattcactggaaaagcaaaaaagaagccaaatggatagcatccttgtgttaagtgaaaagtttgctcttaaggcacagaaaggtagaataaatgatactgagagagagaactgacccggcatgatctgcattccacctgcgttataacgtaatgaaaatgaagccatgtgctcggggcagggttgtcactttcaattgctccaaattgttttgcttgtctcacaaaatgcttcaaacacatcaaaagca

SEQ ID NO: 88722 - DNA, 601 bp, Human
cacattataggtaacatttcaactaggtatcagttggggctcttttcaaaaaaaagttatcaccattaagccaggcacggtgactcacacctataatcccaatactttgggaggctgaaggaggaggatagcttgagctcgggagttggaggccaagctggggaacataaacagatcccaattctacaaaaattgttttaaaaaattaactgggtatggtggcttgagcctgtagctccagctactcctgcttgggccaggagtttgaggcagtagcgagctatgatcacaccactgcacrccagcctggtcgacagcaaaatcctgtctcaaggaaaaaaaaatattgtcattaagctttcatccttatctttttttaatcaagtcacataagaaattcttcagacacaatataaatttatactttctctgctcatagacacacagactcctgaaaccaatcctccacacctgcttctccatccactctgctgggaacctagtgggaaatgctactttaaaaaaataataaataaataaagcatttatgatgggaagatcgtaaacataatagcagttaacactaactgaggcttactgc

SEQ ID NO: 88723 - DNA, 601 bp, Human
tggggctgggtatggtggctcacacctataattccagcactttgggaggctgaggcggggggattacctgaggtcaggagttcaagaccagcctggccaacatggtgaaaccccgtctctactaaaaatacaaaaactagccgggcgtggtggcagatgcctgtaatcccagctactcaggaggctcgggcaggagaattgcttgaatccgggaggcggaggttgcagtgagccgaggtcgcgccactgcactccagcctgggtgacagcgtgagactccgtctccaaaaaaaaaaaaaaagttttactgggacacagctatacctattcatttgcatatcatctacaactgcttccacaccgcaatggcagaggtgagtagccatgacagagaccatatgggccgtaaagtctaagatatttattacaccttctagtcctttacagaaaacatttgctgacccctgttctggactctggagcactgaatgaatgatggttattagggcagctgtagggcaggtaatagccattttacagagaaaagagaagctcaatgaggttaacctctttactcaaggcagcaaaactggtagtgcca

SEQ ID NO: 88724 - DNA, 601 bp, Human
cccacaactcagaatgaattttcttttaactcccttgtgtttgttttaatacatcccattccctgttcatttaggtttttctatgattctattaaacagcttacacatctttgcaaatacgtaaaagtatgttaactgaactagaagctgaaaaagggactgggagacagatttccttgtgttgtcattgactcttaagtgagacctgaaagcttctattttccccatcaaatttcaaccctagaatggcaaagaagacttggaaggggctactctctgtttctaagtaagtcctttcctkttaggagaataaaaacctggcttgtcacctaggcatgactctgagctggggctcttctggatccacacttatctgaatactagcctaaatctagtcgccagccttcctctacccagttgacttttgcacaaccttccctcttcatttaaaacacctctagactctgtgctttgaaatttagtcctatggttcagctatcatcttgaattattaaccctggaaaatcaagagcagtaaaagggaggcagatagaagaaatctgacctcaccaaagaatcccgacttgttaacaaaatgtgc

SEQ ID NO: 88725 - DNA, 601 bp, Human
cgaaggaaattagcagtgaaacaaattaaaacaacaatcagatttaagtggcctctatcaggaaattaactttaatgaatattgtcatcaccaggcctacctcagcatcgctgggctcaagcattaggatgcaataaaaaactgggacctaaacactaagttacctacccacaactcagaatgaattttcttttaactcccttgtgtttgttttaatacatcccattccctgttcatttaggtttttctatgattctattaaacagcttacacatctttgcaaatacgtaaaagtatgttwactgaactagaagctgaaaaagggactgggagacagatttccttgtgttgtcattgactcttaagtgagacctgaaagcttctattttccccatcaaatttcaaccctagaatggcaaagaagacttggaaggggctactctctgtttctaagtaagtcctttccttttaggagaataaaaacctggcttgtcacctaggcatgactctgagctggggctcttctggatccacacttatctgaatactagcctaaatctagtcgccagccttcctctacccagttgacttttgcacaacc

SEQ ID NO: 88726 - DNA, 601 bp, Human
agtttgcgagtgcattcctaacaggcccttgtttgtatgctttctgagttattagttctgcaaagaacacatttcttacttccttattttgccagtgttttagaaggcgagggaccagaattctgttctctggaaagtgggttataactgcatggtatcccattctccccagtcccctctactctttatctggtgacacaccatctcttatgtgaaatgtctgctagccagtcaaatatcttcttcttaaagccttttaacaagcacactatcaaaagtggtgctgtctgcctttttcaayaaacggaaatttccaaaagtcaggtttttactggctttccctgaaacagaaaactctgaaccagtggcagtgacactcgatcacagtggctatacatttggaagcatatctaatacacacacaaaatctatgctccttctgaggactctggctaagcatactgcagtgagaaggagagaaaactgtgtttcaaaatctcacaaagttgaagagcaggaagttttgtgagtccaagagcagtgacagacactggaccaacaaagcctgaccacccatcattcacatcccttccctagactg

SEQ ID NO: 88727 - DNA, 601 bp, Human
atgcttagatcaacctggcacataagaagctctcagtaagtgatacctttccgttttgttgctattcaccatcactgaaacaattgtacagttatctgctgggtactttcaatgcattagcttcacaagaactctggaagatataaagtgctaatttttttttttcagttttacagacgatcgaatgaggaaaggtccacagtgtttaatcactcgattagggtcatgcatctgactggtaaagttgagatccaaactcagatttggttgccttcagaatccccagtttcaatatttcttyttctccttcaaatttgctacccaagtttctctggggccaggacaatgtgtcagaatcatgagttaaaccagaattagcatagtttgcgagtgcattcctaacaggcccttgtttgtatgctttctgagttattagttctgcaaagaacacatttcttacttccttattttgccagtgttttagaaggcgagggaccagaattctgttctctggaaagtgggttataactgcatggtatcccattctccccagtcccctctactctttatctggtgacacaccatctcttatgtgaaatgt

SEQ ID NO: 88728 - DNA, 601 bp, Human
atttaaatcacaattttcatattaatacaagcttgtgcatttccagttctgcataaaaacatttaaaagctcttcctagttgccagagtacacggagataacacagtctaactccaataataatagtgatatttaaataaattgatacctatgaaatgcttagatcaacctggcacataagaagctctcagtaagtgatacctttccgttttgttgctattcaccatcactgaaacaattgtacagttatctgctgggtactttcaatgcattagcttcacaagaactctggaagatatamagtgctaatttttttttttcagttttacagacgatcgaatgaggaaaggtccacagtgtttaatcactcgattagggtcatgcatctgactggtaaagttgagatccaaactcagatttggttgccttcagaatccccagtttcaatatttcttcttctccttcaaatttgctacccaagtttctctggggccaggacaatgtgtcagaatcatgagttaaaccagaattagcatagtttgcgagtgcattcctaacaggcccttgtttgtatgctttctgagttattagttctgcaaag

SEQ ID NO: 88729 - DNA, 601 bp, Human
ggcttcccacattccttggctcctggccctaaattactctgacttctgcttctgtggccacaactctcactctgaccctccagcctcccggttgtggggacccatgtgattacactgagccctctccactaatccaagataatcttcccatctcatgacccttaatttaatcacacctgcaaaatcctctcttccatgtaaggtaacattcacatatttctgggattaggatgtggacatctttagggcagggtcattatgctgcctaccacattggcatgtcactactgatgagctgaakaggaggtgggcagggatccagaattcgcaggggaagggggaagagacaaggtcatggggcatatcccttcctcacttgcccctcttaccatcaccagctcatccacaatagcccctgaacagcagaggtgagataaaaagaggagtgcagggctgtaattctcaaaccatggtgtgtttacccccaggaagtaacaactggatccacagatcatcctggtttatcatcctggagcaataattttcatttaagatattgagaattttctaatttaaatcacaattttcatattaatacaag

SEQ ID NO: 88730 - DNA, 601 bp, Human
attccccagaagttagatttcctatatttacacaaggcatgcctgtgcaaagtaatgacactagtttttttttaaaaacatacgccctagaatgaatacaacttagtgatgctatacttccaccctataaaatacacaattcttttttgaaaattgcttatttgaagagtaaaataaacattttgatgtatatatttctaggttatctgctcacaaatcaacagcattactttgaagctaaagtacaggtccccaacttgtgaattacattctaaactatttctaggttgcctggttggarctaaagtgtcatggtatggaaacaatgctaggttcccaggcaagtccccaggagccaagctaactgatatgataacatacaatgttagaacaatgtgaacgtggaaaaaagcctctaatcttcagcttttgatactaggcacatgtttctccttgcactgttctgatgggggtccccaatctccagttcggtgatggctctagaagctgggtacagggactatgagttggagagaggtgaaccaaggtttcctggtgtaacttttaagggtagtgtttctcatactatgaccaataaatc

SEQ ID NO: 88731 - DNA, 601 bp, Human
actttttttcagccgggcacggtggctcacgcctgtaattccagcactttgggaggccaaggtgggtggatcacctgaggtcaggagtttaagaccagtccggccagtatggcaaaaccccatttctactaaaaatacaaaaactgtgtggtggcaggcacttgtaatcctggctacttgggaggctgaagcatgagaattgcttgaacccaggaggcagaggtttcaaggagccgagatcgcgccactgccctccagcatgggggatagagcaggattctgtctcaaaaaaaaaaaaaaatccaatttatcaatctccaggtaacctctcatagtcaaaactaaaaccaggtcaattgctttgttgtgtcttaaagagatgctgatgaattcaaggaatcttgaaaacagaaacatttcatttttccgatactcagtcttgctcttttctcttattactaagcaactttgcatgaaaacagactctgttttataaatagaacattgtgcaaggttttctagaggtgtctgctaaaaataaagcaggttatagtttacttctttatagctttcaaaacaaaacagcctaagcttgactaaa

SEQ ID NO: 88732 - DNA, 601 bp, Human
cagcatgatacaaaattgatcagaatgataaagcagatggtggaaactgcctgtttcctacactacattctagttgtattgggtcattactttcactttctagaatcttctatagccattgaatttactcaaccacgttttcttctgtgttgttttctgttttgttttgtttttttgttaatgccttaaaggatgatgaaattataaatgttctatataatgtgatattgaaatgacctgataattatttaggtcctctgtcgcttactcagtggcataactcataaaagacagactgcaytttcatttcaaattccactttttttcagccgggcacggtggctcacgcctgtaattccagcactttgggaggccaaggtgggtggatcacctgaggtcaggagtttaagaccagtccggccagtatggcaaaaccccatttctactaaaaatacaaaaactgtgtggtggcaggcacttgtaatcctggctacttgggaggctgaagcatgagaattgcttgaacccaggaggcagaggtttcaaggagccgagatcgcgccactgccctccagcatgggggatagagcaggattctgtc

SEQ ID NO: 88733 - DNA, 601 bp, Human
ctctgaagtcagacctgtgtctgaaccagctttaacacctccaaaggtgtgaacttgagtaagctgctgcacctctctgaatctgtttcccaatctgtaagatggagataattatattatctatggcaatgacacattgttgggaacattaaatgaaataatccacataaagctcctagcagagtgcatggcacataataacccctaaataaatgttggttttattgttattgtaaagattaggaaacagcatgatacaaaattgatcagaatgataaagcagatggtggaaactgcctgyttcctacactacattctagttgtattgggtcattactttcactttctagaatcttctatagccattgaatttactcaaccacgttttcttctgtgttgttttctgttttgttttgtttttttgttaatgccttaaaggatgatgaaattataaatgttctatataatgtgatattgaaatgacctgataattatttaggtcctctgtcgcttactcagtggcataactcataaaagacagactgcactttcatttcaaattccactttttttcagccgggcacggtggctcacgcctgta

SEQ ID NO: 88734 - DNA, 601 bp, Human
ctgtgactgcaaactggcagtacacacaatcagaggaatgagtaaaaagcttagactgcccttcaattcagaggttaaagcaagcacacagacccggtgtctccctcactgtgtgccagccaaccatatattattaattgggctcaacaaacattattgagcaccttctactgcaaaactctggcagggcgctctggggagatctaaatgcaatgtgaggcaatgccccactcttcaccaacctgccatctggttgggataacaagatcatcacaggcaaaactgttctcccatatctctrcccattaaaatttcactgagccctcaaggctcaattcataattagattttccccaagaagctttccccaatcccctcagccctttgtttaatcctcatttctggaatttgtcatgctctgcattataacttgcttgtgtgtgtctttttttctcaaaattatttcctatctcattccgacaagcatttgaatccacgttgtgttatgggtatgtctatcttctcccagtgggttgcaaaccatgtcctatttatcttggtgtcccccaagatctagcacagtgcctgacacaaaatagag

SEQ ID NO: 88735 - DNA, 601 bp, Human
aggaaagcaccttctgataagtgtcttctaattcccatgtcatttcttgtccctgtggcctgtttgtgctgtttgaaagctcgggggaattggaataagtgacaaggaggtcagatgtaagttaaagtgttagcccccatttatctaccattttggctctaaacgactagtttcagtccagaccgatttagtaaagtgagaaaactgtgactgcaaactggcagtacacacaatcagaggaatgagtaaaaagcttagactgcccttcaattcagaggttaaagcaagcacacagacccgstgtctccctcactgtgtgccagccaaccatatattattaattgggctcaacaaacattattgagcaccttctactgcaaaactctggcagggcgctctggggagatctaaatgcaatgtgaggcaatgccccactcttcaccaacctgccatctggttgggataacaagatcatcacaggcaaaactgttctcccatatctctgcccattaaaatttcactgagccctcaaggctcaattcataattagattttccccaagaagctttccccaatcccctcagccctttgtttaatcctc

SEQ ID NO: 88736 - DNA, 601 bp, Human
ttaaatgtgataatatatgtaatacatttagcagacagcctgcctatatagattaaaaattaaatggtgactcttatcatcatcattatgaatgttaatatcattatagatattaatatcaccaaccctttggtttttgttccctaacttatcttctccatacttcatatgacctccaagtttaccttttctctacttttcagatgtaggatgtggataccaaagaattgagtagatctgtcacaaagcaatggaagatgacatttgatatgggtgggccaactgcgaataaaaagaagaygttcacttgggagatagaaaagagaagttctagtcatgacttttccaatttacttgctatataaccttgaataagtaccctctctgaattcctgtctccttacctgtggaatgaagacaaaaattcctaaggctctagcaagattgtcaaacaaaggcctatatgtgtgagttgcaaataaaaggaaagcaccttctgataagtgtcttctaattcccatgtcatttcttgtccctgtggcctgtttgtgctgtttgaaagctcgggggaattggaataagtgacaaggaggtcagatgt

SEQ ID NO: 88737 - DNA, 601 bp, Human
actaagcttgaccacagggagacccggataataagtcccagtccctttctttgtgaagtgcacagttactggattgaaagcccagtgaggatgggctcagtaaggtacctcccagggtatacactcattcaacagacatcacctggatgcctataatgagccaggctctagcatggcaggtgctgagaaaatgaaattgaatacagtttccagaacaaatccatagccagccagttcataggtagcagtgccctggacagaagtctttaaactttggccttcttttttaaataacctaatwtcagaggagcttggggaacatcagaatgatgtgaaaattaatccagcagttccaaatgcagacaggccctgaggccaggaggtgacctggggcatctgtgacaggactggtgtgagcgggagggaggtccttccgtttcctcctatacattccataataaggccctgcagctgaaaccaggaccacaacacacaaaaacccacatcctaccagagactgagcctgcaagggtggcgtgtgtcacatgcctggctggctccagagcacaggacgaacaggacaggggaggaggtaggaaga

SEQ ID NO: 88738 - DNA, 601 bp, Human
cactaactcctccattccttctcccccagtccctagtaaccactattatactttgtctctatgaattcaacgattctaggtacttcatgtaagtggaatcagatagtaatagtccttttgtgtctggcttatttcaccctgcataatgttgtcaaggttcttccatactgtagcatgtgttagaaattcattcctttttacagctgaatgatatgccattgtgtgggtatgcagaattcattttttttatctaagaaggtttctgaatgctcagtaggtgccaggcactaagcttgaccayagggagacccggataataagtcccagtccctttctttgtgaagtgcacagttactggattgaaagcccagtgaggatgggctcagtaaggtacctcccagggtatacactcattcaacagacatcacctggatgcctataatgagccaggctctagcatggcaggtgctgagaaaatgaaattgaatacagtttccagaacaaatccatagccagccagttcataggtagcagtgccctggacagaagtctttaaactttggccttcttttttaaataacctaatttcagaggagcttgg

SEQ ID NO: 88739 - DNA, 601 bp, Human
tccatctccaaattcttttcatcatcctaaatagaaggtctatacacatttaacactaactcctccattccttctcccccagtccctagtaaccactattatactttgtctctatgaattcaacgattctaggtacttcatgtaagtggaatcagatagtaatagtccttttgtgtctggcttatttcaccctgcataatgttgtcaaggttcttccatactgtagcatgtgttagaaattcattcctttttacagctgaatgatatgccattgtgtgggtatgcagaattcattttttttatctaagaaggtttctgaatgctcagtaggtgccaggcactaagcttgaccacagggagacccggataataagtcccagtccctttctttgtgaagtgcacagttactggattgaaagcccagtgaggatgggctcagtaaggtacctcccagggtatacactcattcaacagacatcacctggatgcctataatgagccaggctctagcatggcaggtgctgagaaaatgaaattgaatacagtttccagaacaaatccatagccagccagttcataggtagcagtgccctggacagaa

SEQ ID NO: 88740 - DNA, 601 bp, Human
ccagttagcgtaacgagcacctgcaggctctttaaaagttagccattcttattttgaaggcaacggttaagagcatggattatggagtcaaacagacccaagttcaagttccagactggccaattattggcttctctggacttcagtttttacaaataaaaacagaatgtttgcctatgtggataaagtgaatgaacttttgtaaaatttttggcacagagggttaatgtacagcttttaatttacatatgatatatattaacacatacatgtatgtgtgtgtacatatatacatacacasagagaattgctcacattatttttttcttcctagaatttcccaagccatggtccatcaaatcatagaccctcctgctccagacttttgaaagtccccaatgcataggcaagcatttctagatggctagacagagcctgatttcctctggctgattacttattaaaaggtacttcctcagttcacttttgagtggaagtttttcagaaagccattcgctcactcgctcacttgctcgctccctcactggctcagtcttgcatggacaatcctgtggaatgcaagagcacagggcaaaacggt

SEQ ID NO: 88741 - DNA, 601 bp, Human
tgttacaaatcaacgtccacaaattttcaatgcacagacaggtcctgagctggctgcatcaaaaagacttgggttcttattactatagtcttctgggcaccttctgcagggattacagcttggaagccttggggcagctgtgctcggatttggcacagaagctgtgaaggggaaagtgcaaagatcacatagcacccagactttaggagctggcaggttggctgtgccagttagcgtaacgagcacctgcaggctctttaaaagttagccattcttattttgaaggcaacggttaagagcrtggattatggagtcaaacagacccaagttcaagttccagactggccaattattggcttctctggacttcagtttttacaaataaaaacagaatgtttgcctatgtggataaagtgaatgaacttttgtaaaatttttggcacagagggttaatgtacagcttttaatttacatatgatatatattaacacatacatgtatgtgtgtgtacatatatacatacacagagagaattgctcacattatttttttcttcctagaatttcccaagccatggtccatcaaatcatagaccctcctg

SEQ ID NO: 88742 - DNA, 601 bp, Human
ccaaagctggcacttgatgatctttccatatctaaaaatcctaatattttatagttctgtgcagattatccatgttctgagtaactgcagtgaattgctctcagtgaattacctaaactgcttgtgagggaccaagtctagtgtgagagaaatatctacacagagcagaacactgaatgtgtcagtgccaatgaataatgctttatccagttgagtttcaacctgaaacatgaaaccccagcagtgagcccatcaggggttcactggaaaatacgtgcacagccaacctccagagccccayaatgggttttgttgtgtagcaatgggggtgaggggggaaaggaggaggagggaatccaagggaacaatgtctattgcttcagccaaaggacttaataattagctgtgactaacaaataccacatgggaaccaacttgtaaaaaaatgtcccacaaagcaccctattgccagtgggccaatttgagcctgcaacctctccccttctagggagagattagaaaactagaaggaaggagagcaactccatctgcctgaagccactggaccaaagactcagatggatggaagctggggatgctt

SEQ ID NO: 88743 - DNA, 601 bp, Human
ttgtgcaaccgaggtggcctttagtaaaaacatagtatgatatggctgttctgggggctttccagtcctctaaatcctctaggtaaggtctttccacaagacagtggcaggcaatggaaaaagcagcccactgatggattccagaattatctcagcgtggcataacaaatggggcatacagaagtggggagatgtgtgtgctaattctcatgctgaaattaattcactggctcacctgaaccttaggttagcaaaaggtcctcactggttcagtttcctcacctgagcaatgaatgagagyggactcaattactggatttcaagattgcttttaggttgtagaaatcttacgcagaaatgcaatgcacaaagcaggcaaatgcaaaggtggggactgggaagaaggaacttggagcctgcttactcactcagctccctcctcctttccaacctgcacctctgaacacagctggccaaagctggcacttgatgatctttccatatctaaaaatcctaatattttatagttctgtgcagattatccatgttctgagtaactgcagtgaattgctctcagtgaattacctaaactgcttgtgag

SEQ ID NO: 88744 - DNA, 601 bp, Human
aggaacagggcttaaatttttcagtctttcctgttttcccttgcagaattttctcttaaaaccccacagccatattcccccaggaaatcctcagttttataagtgctctgtaaaagataagacaaacctatggtctatatttatagagacccaaaatttcatttggttaatgttaagctgtgacaaaatccagaagtttccaagttaaggatgaagtttaacaatgtctgtcttttatttcaactcagatccatatgtgtatgagaagaagagcagttatattccaggaaaaaaaaaaaaacatttatcatggccttgatgtgcttttacctagagcttttacgtaagttattggatttagttcttcacagcaatttttaaggtaggtattatcagctctatttttagttaaaaacctgaatatcagggatatcaagtaacttgtccatgttcccaggaccagtaagtagtagagccaagatctgaacccagatctgctggctccaaagcctgggttcttcccttgcacaatgctgaccaaaacctactagcacaatttcagtttttgctctcatatatgtaaagtaaaagtaaggctgct

SEQ ID NO: 88745 - DNA, 601 bp, Human
ggcaaggggaaattaaagtcactgatggaattcagatgacctgaaaatagtaagattatcctggattatctaggtcggcccagtgtaaccccaagggtccctaaaactggaagagggaggtagaaaagaagatcagagtgatgcaatgtgagaaggactcaacctgctattgatggctttgaacacagaagaaggagactaggaggcaacaaacgtgggcaacctgtagaagctggaaaagttacgaaaaacccagatcttcctatagagcctccaaaaaaatgcagccctgctgacaccyggattttagtccagtgagacccatgtcagacttctgaccaacgtacttgtaagataaatatgtgttgttagaagctactaaagttgctgtgacttgatagagcagaaatagaaaattggtacagtacctacaacgtctgagctgcctataaaatgcagggacctgggagtggccctgggcctcagctgacatatggcacatggtcagtcaacacagccacaccgccttgctcagctagatgcagtgcttttagagaggagaaggtagtgctctctttcctacctcaatttgcttgggagg

SEQ ID NO: 88746 - DNA, 601 bp, Human; identical to SEQ ID NO: 22627

SEQ ID NO: 88747 - DNA, 601 bp, Human; identical to SEQ ID NO: 22628

SEQ ID NO: 88748 - DNA, 601 bp, Human; identical to SEQ ID NO: 22629

SEQ ID NO: 88749 - DNA, 601 bp, Human; identical to SEQ ID NO: 22630

SEQ ID NO: 88750 - DNA, 601 bp, Human; identical to SEQ ID NO: 22631

SEQ ID NO: 88751 - DNA, 601 bp, Human; identical to SEQ ID NO: 22632

SEQ ID NO: 88752 - DNA, 601 bp, Human; identical to SEQ ID NO: 22633

SEQ ID NO: 88753 - DNA, 601 bp, Human; identical to SEQ ID NO: 22634

SEQ ID NO: 88754 - DNA, 601 bp, Human
agctccttttggccaactagaaaggccggagggttattgcttttggaaaacagacaaaaatctgtgcacatctggtatggggtgggggacactgaggagaacacaatgcccatctccccatggccactcatgcccatgccttcctaggggccccatctcggtcccttttctggcacattcgatctcgccaattaaacaaagttgcccgaatctgcctccgaagaaccccgccgatagcatgctctgctctcatttgcctctttgacattttcttaattttaaaacatggagattcacattyttatccatgttctgtctcacacaaacatacacacgggtttacacaggcagcacgcgatcgccgccaggccctgtgctgcctccagaactgacacttaagagagaaaagtcagcagggacagtagagctcaattttaaatctggaaaaaaaaaaaaaaaaaaaaaagatgggaagcggggattggaattccacagcaaaaagaaacctgtcgctgcaggatcccttctctaccccgcggggagagcggcacggagacagttcattactttagaagtggcaactgtttgcagccaggcggtg

SEQ ID NO: 88755 - DNA, 601 bp, Human
gggtttggtgaagaaggaagactggaaatagctccttttggccaactagaaaggccggagggttattgcttttggaaaacagacaaaaatctgtgcacatctggtatggggtgggggacactgaggagaacacaatgcccatctccccatggccactcatgcccatgccttcctaggggccccatctcggtcccttttctggcacattcgatctcgccaattaaacaaagttgcccgaatctgcctccgaagaaccccgccgatagcatgctctgctctcatttgcctctttgacattttyttaattttaaaacatggagattcacattcttatccatgttctgtctcacacaaacatacacacgggtttacacaggcagcacgcgatcgccgccaggccctgtgctgcctccagaactgacacttaagagagaaaagtcagcagggacagtagagctcaattttaaatctggaaaaaaaaaaaaaaaaaaaaaagatgggaagcggggattggaattccacagcaaaaagaaacctgtcgctgcaggatcccttctctaccccgcggggagagcggcacggagacagttcattactttag

SEQ ID NO: 88756 - DNA, 601 bp, Human
taagttgattttccatattgtgccagaactacacaaaatatgttgaccaaactgtgcatcaaactggttcccacctccccactcccattacctccaaccaattccctttaaaatgcttctagtgttgactgtacttggaagaactttcccaccagaaccaagttaaattttctttggaatggcattcagtgacctttctgtggcctgaaatagccaaatcatcatttttccttataagtcagacatttagtctttgaattactggtagatgaaaagaagaaacacacacacacacaccacacacacacacacacacacacacacacacacacacactgaaaagatgcccagagaaataaaaagacagaaaaaaggaaatcttttcattcttctatgcaaagggccctggctaaatttagctctttgtactgaagatgtggcatttactttgatttactgcttctctactttgaaaaactctatcacctttctccagggcctcaatttgctcttgggtaaaggatgttctatttctttgcagcttccgcttcagctgaagtcgcatttgagcctcatctgaatcttctccgttggaactgat

SEQ ID NO: 88757 - DNA, 601 bp, Human
ggtagatctattttggctgctagtctttctcgggcaaacacatctggataatgggttctctcaaactctgaaagagtaagttgattttccatattgtgccagaactacacaaaatatgttgaccaaactgtgcatcaaactggttcccacctccccactcccattacctccaaccaattccctttaaaatgcttctagtgttgactgtacttggaagaactttcccaccagaaccaagttaaattttctttggaatggcattcagtgacctttctgtggcctgaaatagccaaatcatcawttttccttataagtcagacatttagtctttgaattactggtagatgaaaagaagaaacacacacacacacaccacacacacacacacacacacacacacacacacacacactgaaaagatgcccagagaaataaaaagacagaaaaaaggaaatcttttcattcttctatgcaaagggccctggctaaatttagctctttgtactgaagatgtggcatttactttgatttactgcttctctactttgaaaaactctatcacctttctccagggcctcaatttgctcttgggtaaaggatg

SEQ ID NO: 88758 - DNA, 601 bp, Human
caaactggagaaatgtttaatttccaaaatccatatgctcagagagggaagcatatcagagaaggtccagaggaagacacccaccatttgtaaaatgatgattttggtcaagagaatgaataaatggatagacaatcgggctcacccactccaaaattcaaagagtagttttctctgaagagtaaagttattgatcattttgattttctttatgcttaatgaatgcatgtactttttgaattatacaaattatgtaatttttaaaagtcagtgtttgaaatagattgattccccataccgstctgtatgtggaaacagccctaatataattgcagcatctacttgttcgtcttattattttctcacatacacattttgctatcttcacagaaacctggatgttgttataatacatgaaactgaacgagacactctgtggccttattaaagtcagatgatgaatgctaacatcaagttcaaagaggcaaacaggccttgagggccctgccagaatttcagcttgcatttgtttctaattcctgcaatgagttcctctaggcaacctgacttctggaaaattccaacgcagttatagcaacac

SEQ ID NO: 88759 - DNA, 601 bp, Human
actatcatttctcttctctgcaaactggagaaatgtttaatttccaaaatccatatgctcagagagggaagcatatcagagaaggtccagaggaagacacccaccatttgtaaaatgatgattttggtcaagagaatgaataaatggatagacaatcgggctcacccactccaaaattcaaagagtagttttctctgaagagtaaagttattgatcattttgattttctttatgcttaatgaatgcatgtactttttgaattatacaaattatgtaatttttaaaagtcagtgtttgaaayagattgattccccataccgctctgtatgtggaaacagccctaatataattgcagcatctacttgttcgtcttattattttctcacatacacattttgctatcttcacagaaacctggatgttgttataatacatgaaactgaacgagacactctgtggccttattaaagtcagatgatgaatgctaacatcaagttcaaagaggcaaacaggccttgagggccctgccagaatttcagcttgcatttgtttctaattcctgcaatgagttcctctaggcaacctgacttctggaaaattc

SEQ ID NO: 88760 - DNA, 601 bp, Human
ctatgagggcaagaagcatttcaacaagcacgcacctacagctcagtgggccccctactgagcttcgtctaataatctgtcctcagaaaacttgcagtctcaggccttgtcttcatacacaacttttgtgaccaaattcaggaaaaacaattttagtttttgtctatatggtgtaaagttactaattagcttaactgaatttcccttttcaatccccatcccccagggacaaggaaagcaaggagttaaacacgccctcccataagaccaggagattctgtttgggtaaacttctagtgamgagagatcgcctctgtgcagcctgcagaaagcagtggctcacctgttgaagtggtgcccgaggtgcccattggctgactgttcatgtgtgtctgcatatgtgggggggtgtaggtatcataactccgcccattcaccgaagggctggtgggcagcatgcaggagtatgaggaggtctggctggggactgggggctgtgaggagagaggcaaacctgtggttactgaggaacacatcacacagccacagccccaggctccctcctcccgaggaactctgccaacaagtctgatcattaaag

SEQ ID NO: 88761 - DNA, 601 bp, Human
caggacacaattgtagaactgaagcggctctaacagccatttttctttctttcctgaaagctcaactgttgtgtccccatagtcactgactgaattaacacaatatttcctttcctttttttttttttttttttttttactgtaatcttggccagtattgagacatatcaggttcacttccgggaacttgaactggaactgacacaccaggggaaatgagtcctagaagtggatgaaagaaatagccatgtagatattccctttgagaaacagacatggaatacaaatttataggtttacaaaaaaaaaaaaaaaaaaaaaaactaatactttctaacattttttactgtattaaaatcacttcaattgttacaaataaaagtagcaccttcagaaactagacaatatatgtatatatacctattggatcccaagtaccccccaccccaatccaaaggaaaagaaaaaaaaatcctctgtttgtttgcatgtttggaacttttacaataaagctgtctctggaaaaccaatgtgtcactttttatttccagcaaaaggtctagaggagctatgagggcaagaagcatttcaacaagcacgc

SEQ ID NO: 88762 - DNA, 601 bp, Human; identical to SEQ ID NO: 88754

SEQ ID NO: 88763 - DNA, 601 bp, Human; identical to SEQ ID NO: 88755

SEQ ID NO: 88764 - DNA, 601 bp, Human; identical to SEQ ID NO: 88756

SEQ ID NO: 88765 - DNA, 601 bp, Human; identical to SEQ ID NO: 88757

SEQ ID NO: 88766 - DNA, 601 bp, Human; identical to SEQ ID NO: 88758

SEQ ID NO: 88767 - DNA, 601 bp, Human; identical to SEQ ID NO: 88759

SEQ ID NO: 88768 - DNA, 601 bp, Human; identical to SEQ ID NO: 88760

SEQ ID NO: 88769 - DNA, 601 bp, Human; identical to SEQ ID NO: 88761

SEQ ID NO: 88770 - DNA, 601 bp, Human; identical to SEQ ID NO: 23203

SEQ ID NO: 88771 - DNA, 601 bp, Human
aaggcagtcctcccgagggggcgggacgagggggtggtgctgattggctgagcctgaagtcgccacggactcggggcaacaggcagatttgcctgctgagggtggagacccacgagccgaggcctcctgcagtgttctgcacagcaaaccgcacgctatggctgacagccgggatcccgccagcgaccagatgcagcactggaaggagcagcgggccgcgcaggtacactctgtgctccccgagcgggcccgaaggtccgtttagaaagcgggggcgtcggcaagtaaaggcccggcttcycccggggcggcgcttggagggactgtaccgcggctcactgggcaggggggatccccttcggtgcagacggacttttacattcgccgaagcaggggaggggggtccgggtagtggggcgcgggactgcaggctttgttgtccgcgacaggctcgggtggttgcttcagaattttgcacttttgccaactgggacagaggtcgcagcttgaggacagattgagggctcatggggaaagaggcagagagctgcagctgcaaggaagtcagtgaggggagaagtggaaccaggctctaatggtg

SEQ ID NO: 88772 - DNA, 601 bp, Human
cggactcggggcaacaggcagatttgcctgctgagggtggagacccacgagccgaggcctcctgcagtgttctgcacagcaaaccgcacgctatggctgacagccgggatcccgccagcgaccagatgcagcactggaaggagcagcgggccgcgcaggtacactctgtgctccccgagcgggcccgaaggtccgtttagaaagcgggggcgtcggcaagtaaaggcccggcttcccccggggcggcgcttggagggactgtaccgcggctcactgggcaggggggatccccttcggtgcrgacggacttttacattcgccgaagcaggggaggggggtccgggtagtggggcgcgggactgcaggctttgttgtccgcgacaggctcgggtggttgcttcagaattttgcacttttgccaactgggacagaggtcgcagcttgaggacagattgagggctcatggggaaagaggcagagagctgcagctgcaaggaagtcagtgaggggagaagtggaaccaggctctaatggtgcccttcttgaaatactgtttacacgctttcatagttgtggggtcccagcagggcagggattgtgt

SEQ ID NO: 88773 - DNA, 601 bp, Human
ctaggcactgttcggggcaaggtgtacaaattccagtgcggcaagaacaacacccttgagaagctgagagtctagtctgggagacgagacacataaacagatgattacactccagcgtggtgagggctctaatagaggttatctgtagaatgtagagggagtgaccaggtgggccggacaaagcaggtgacatttgaacaggaatttttttaaatgagtaggattttaacttggtggtgggggaggcattcctggcctgtgcccacggctgcagagtctcagagggcatctatgaggaggktggattagatgagaccacatctggtctgagtctactgttggcagattggcccagggagtctaaaggtcttgccctgttccctggctgctggttaatggtagacagaggactgcagccctgttttccctattctgcctagtgctcttgctcaaaactcaggttcgtgaactggggtattaatgctaagtgctcatggattgctttaatggttccctgtttgggaaaaggctgccattctcctccaagggcctggaaaatctcccctcttggccctgttctttgttatataccattaggttg

SEQ ID NO: 88774 - DNA, 601 bp, Human
aggttatctgtagaatgtagagggagtgaccaggtgggccggacaaagcaggtgacatttgaacaggaatttttttaaatgagtaggattttaacttggtggtgggggaggcattcctggcctgtgcccacggctgcagagtctcagagggcatctatgaggaggttggattagatgagaccacatctggtctgagtctactgttggcagattggcccagggagtctaaaggtcttgccctgttccctggctgctggttaatggtagacagaggactgcagccctgttttccctattctgmctagtgctcttgctcaaaactcaggttcgtgaactggggtattaatgctaagtgctcatggattgctttaatggttccctgtttgggaaaaggctgccattctcctccaagggcctggaaaatctcccctcttggccctgttctttgttatataccattaggttggttcatgagctcttaaagtaaaccagagagaggtagagtcttagtaaaggatgtgccactacttagtggcagagacaaggttagaattcagcttcttggacccaagactctttccttacccagtgggtgcaaatc

SEQ ID NO: 88775 - DNA, 601 bp, Human
cctgctgttgatttaccttacatagttgcccatgtgagaaatggctgactccaaaacacatctatagttgggaggctcttaattgaaatacagccatcccctttgtccatgacatctcagggcactgtgtacatcgtcctgattggcagtcacattgatgtcttactgttcctcagttttagctgctcttagtaaaaaccgcttacttcttttaggcacttctccctccacccagggccctccaaaaggaattatgcatatgccttatagcctatataattttcaaacactttttttaaaygaaaaatttcaaatattcagaaaagttgaaaaaattttgcagtgtatatctatatatctgccatctagattctacaaggaacattttgccctgtgtcttttattacgttactccatctgtctgtccatcctttaattcattcaagttgtttcatgtattagcagtttgttcttttcattgctgagtaagattccattatttgaatataccaccatttggatatcctgttgctggacacctgggctatttaattttttttctattgtaagtaaagctgctgtggctgggcatgaaggctta
